United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 80

SEQ ID NO: 3655693 - RNA, 14 nt, Human
cucugccagugaca

SEQ ID NO: 3655694 - RNA, 15 nt, Human
cucugccagugacag

SEQ ID NO: 3655695 - RNA, 20 nt, Human
cucugccagugacagacagg

SEQ ID NO: 3655696 - RNA, 19 nt, Human
cucugccaugaacuggagg

SEQ ID NO: 3655697 - RNA, 16 nt, Human
cucugcccacucccug

SEQ ID NO: 3655698 - RNA, 17 nt, Human
cucugcccacucccugc

SEQ ID NO: 3655699 - RNA, 20 nt, Human
cucugcccacucccugcaac

SEQ ID NO: 3655700 - RNA, 13 nt, Human
cucugcccagagc

SEQ ID NO: 3655701 - RNA, 15 nt, Human
cucugcccagagcug

SEQ ID NO: 3655702 - RNA, 19 nt, Human
cucugcccagagcugggug

SEQ ID NO: 3655703 - RNA, 14 nt, Human
cucugcccaggcac

SEQ ID NO: 3655704 - RNA, 15 nt, Human
cucugcccauucccc

SEQ ID NO: 3655705 - RNA, 14 nt, Human
cucugccccagagg

SEQ ID NO: 3655706 - RNA, 18 nt, Human
cucugccccagcucuggc

SEQ ID NO: 3655707 - RNA, 21 nt, Human
cucugccccagcucuggcuuc

SEQ ID NO: 3655708 - RNA, 17 nt, Human
cucugccccagucguua

SEQ ID NO: 3655709 - RNA, 17 nt, Human
cucugccccauccucca

SEQ ID NO: 3655710 - RNA, 22 nt, Human
cucugccccauccuccagcagg

SEQ ID NO: 3655711 - RNA, 12 nt, Human
cucugcccccug

SEQ ID NO: 3655712 - RNA, 14 nt, Human
cucugcccgggagc

SEQ ID NO: 3655713 - RNA, 20 nt, Human
cucugcccuaaugcgcaggc

SEQ ID NO: 3655714 - RNA, 23 nt, Human
aaauccccaugccuguggcugcg

SEQ ID NO: 3655715 - RNA, 18 nt, Human
aaaucccuuaccucggug

SEQ ID NO: 3655716 - RNA, 22 nt, Human
aaauccuaagacacaaaugcau

SEQ ID NO: 3655717 - RNA, 15 nt, Human
aaauccuacugaaug

SEQ ID NO: 3655718 - RNA, 14 nt, Human
aaauccuaugugau

SEQ ID NO: 3655719 - RNA, 12 nt, Human
aaauccucuggc

SEQ ID NO: 3655720 - RNA, 17 nt, Human
aaauccucuuccucuga

SEQ ID NO: 3655721 - RNA, 18 nt, Human
aaauccucuuccucugag

SEQ ID NO: 3655722 - RNA, 22 nt, Human
aaauccugacuauuauguuguu

SEQ ID NO: 3655723 - RNA, 21 nt, Human
aaauccuggauuuuuuucugu

SEQ ID NO: 3655724 - RNA, 12 nt, Human
aaauccuguuga

SEQ ID NO: 3655725 - RNA, 21 nt, Human
aaauccuuagaucuggcaugu

SEQ ID NO: 3655726 - RNA, 15 nt, Human
aaauccuuugugaaa

SEQ ID NO: 3655727 - RNA, 14 nt, Human
aaaucuacaguaca

SEQ ID NO: 3655728 - RNA, 17 nt, Human
aaaucuaccacuguaug

SEQ ID NO: 3655729 - RNA, 20 nt, Human
aaaucuaggaaaauauuuug

SEQ ID NO: 3655730 - RNA, 15 nt, Human
aaaucuauagaaagu

SEQ ID NO: 3655731 - RNA, 17 nt, Human
aaaucuauagaaagugu

SEQ ID NO: 3655732 - RNA, 14 nt, Human
aaaucuauauuuug

SEQ ID NO: 3655733 - RNA, 14 nt, Human
aaaucuaugauucc

SEQ ID NO: 3655734 - RNA, 14 nt, Human
aaaucuaugccacu

SEQ ID NO: 3655735 - RNA, 22 nt, Human
aaaucuauuuaauuaggaaaaa

SEQ ID NO: 3655736 - RNA, 12 nt, Human
aaaucuauuuau

SEQ ID NO: 3655737 - RNA, 17 nt, Human
aaaucucaccccauccc

SEQ ID NO: 3655738 - RNA, 14 nt, Human
aaaucucaucccua

SEQ ID NO: 3655739 - RNA, 17 nt, Human
aaaucucuccacuuuca

SEQ ID NO: 3655740 - RNA, 17 nt, Human
aaaucucucucuguugu

SEQ ID NO: 3655741 - RNA, 12 nt, Human
aaaucucuucug

SEQ ID NO: 3655742 - RNA, 15 nt, Human
aaaucugaagauugu

SEQ ID NO: 3655743 - RNA, 14 nt, Human
aaaucugacccagu

SEQ ID NO: 3655744 - RNA, 21 nt, Human
aaaucugagggaaauguuuug

SEQ ID NO: 3655745 - RNA, 22 nt, Human
aaaucugagggaaauguuuugu

SEQ ID NO: 3655746 - RNA, 15 nt, Human
aaaucugcaaagcau

SEQ ID NO: 3655747 - RNA, 17 nt, Human
aaaucugcaaagcaugu

SEQ ID NO: 3655748 - RNA, 15 nt, Human
aaaucugccuggguu

SEQ ID NO: 3655749 - RNA, 13 nt, Human
aaaucugcuugua

SEQ ID NO: 3655750 - RNA, 14 nt, Human
aaaucuggcuucug

SEQ ID NO: 3655751 - RNA, 21 nt, Human
aaaucuggcuucuggccagga

SEQ ID NO: 3655752 - RNA, 22 nt, Human
aaaucuggucuuguuagaaaac

SEQ ID NO: 3655753 - RNA, 17 nt, Human
aaaucuguaacagguau

SEQ ID NO: 3655754 - RNA, 21 nt, Human
aaaucuguaagcucuuugaaa

SEQ ID NO: 3655755 - RNA, 21 nt, Human
aaaucuguccaaaggaggcug

SEQ ID NO: 3655756 - RNA, 22 nt, Human
aaaucuguccaaaggaggcugg

SEQ ID NO: 3655757 - RNA, 12 nt, Human
aaaucugucugc

SEQ ID NO: 3655758 - RNA, 19 nt, Human
aaaucugugaacuugaaau

SEQ ID NO: 3655759 - RNA, 23 nt, Human
aaaucugugaugauccucauaug

SEQ ID NO: 3655760 - RNA, 12 nt, Human
aaaucuguugcc

SEQ ID NO: 3655761 - RNA, 19 nt, Human
aaaucuguuugaucccugu

SEQ ID NO: 3655762 - RNA, 15 nt, Human
aaaucuuaauacugu

SEQ ID NO: 3655763 - RNA, 16 nt, Human
aaaucuuaauacuguu

SEQ ID NO: 3655764 - RNA, 17 nt, Human
aaaucuuaauacuguua

SEQ ID NO: 3655765 - RNA, 23 nt, Human
aaaucuuaauacuguuauucuuu

SEQ ID NO: 3655766 - RNA, 16 nt, Human
cugacaccuaacucuu

SEQ ID NO: 3655767 - RNA, 14 nt, Human
cugacaccuuucau

SEQ ID NO: 3655768 - RNA, 15 nt, Human
cugacacucccaccc

SEQ ID NO: 3655769 - RNA, 14 nt, Human
cugacacugcugga

SEQ ID NO: 3655770 - RNA, 15 nt, Human
cugacacugcuggag

SEQ ID NO: 3655771 - RNA, 14 nt, Human
cugaggucagggag

SEQ ID NO: 3655772 - RNA, 19 nt, Human
cugaggucagggagugcug

SEQ ID NO: 3655773 - RNA, 15 nt, Human
cugagguccugagca

SEQ ID NO: 3655774 - RNA, 17 nt, Human
cugaggucuagaaauag

SEQ ID NO: 3655775 - RNA, 21 nt, Human
cugaggucucuugagggagcu

SEQ ID NO: 3655776 - RNA, 14 nt, Human
cugaggucuggcug

SEQ ID NO: 3655777 - RNA, 17 nt, Human
cugaggugaaagggagc

SEQ ID NO: 3655778 - RNA, 16 nt, Human
cugaggugcacuggga

SEQ ID NO: 3655779 - RNA, 18 nt, Human
cugaggugcacugggagg

SEQ ID NO: 3655780 - RNA, 20 nt, Human
cugaggugcccaggagaaga

SEQ ID NO: 3655781 - RNA, 20 nt, Human
cugaggugggcagaucacga

SEQ ID NO: 3655782 - RNA, 15 nt, Human
cugaggugggcccag

SEQ ID NO: 3655783 - RNA, 16 nt, Human
cugaggugggcccagg

SEQ ID NO: 3655784 - RNA, 22 nt, Human
cugaggugggcccaggaccagc

SEQ ID NO: 3655785 - RNA, 13 nt, Human
cugaggugugggg

SEQ ID NO: 3655786 - RNA, 21 nt, Human
cugaggugugggggcugcagc

SEQ ID NO: 3655787 - RNA, 19 nt, Human
cugagguuacuggaaauua

SEQ ID NO: 3655788 - RNA, 18 nt, Human
cugagguuccucugccug

SEQ ID NO: 3655789 - RNA, 22 nt, Human
cugaguaaucgcuuaaagaugu

SEQ ID NO: 3655790 - RNA, 19 nt, Human
cugaguacguugugcauuu

SEQ ID NO: 3655791 - RNA, 20 nt, Human
cugaguacguugugcauuug

SEQ ID NO: 3655792 - RNA, 13 nt, Human
cugaguacuccac

SEQ ID NO: 3655793 - RNA, 18 nt, Human
cugaguacuccacacugc

SEQ ID NO: 3655794 - RNA, 20 nt, Human
cugaguagaaaggccuuuaa

SEQ ID NO: 3655795 - RNA, 19 nt, Human
cugaguagcuggauuacag

SEQ ID NO: 3655796 - RNA, 15 nt, Human
cugaguagcugggau

SEQ ID NO: 3655797 - RNA, 20 nt, Human
cugaguagcugggauuacag

SEQ ID NO: 3655798 - RNA, 22 nt, Human
cugaguaucuccucgcaagcug

SEQ ID NO: 3655799 - RNA, 16 nt, Human
cugaguauuaaaaugu

SEQ ID NO: 3655800 - RNA, 16 nt, Human
cugagucaaguuguuc

SEQ ID NO: 3655801 - RNA, 20 nt, Human
cugagucaaugcgcaaaaug

SEQ ID NO: 3655802 - RNA, 15 nt, Human
cugagucaccaggaa

SEQ ID NO: 3655803 - RNA, 17 nt, Human
cugagucaccaggaaug

SEQ ID NO: 3655804 - RNA, 22 nt, Human
cugagucacccuaccugugccu

SEQ ID NO: 3655805 - RNA, 17 nt, Human
cugagucagggcccaga

SEQ ID NO: 3655806 - RNA, 20 nt, Human
cugagucagggcccagaggc

SEQ ID NO: 3655807 - RNA, 23 nt, Human
cugagucagggcccagaggcuga

SEQ ID NO: 3655808 - RNA, 21 nt, Human
cugagucaucuguuagggccu

SEQ ID NO: 3655809 - RNA, 18 nt, Human
cugagucaugaucucccu

SEQ ID NO: 3655810 - RNA, 20 nt, Human
cugagucaugaucucccugc

SEQ ID NO: 3655811 - RNA, 18 nt, Human
cugagucauggccgggug

SEQ ID NO: 3655812 - RNA, 14 nt, Human
cugaguccuggccc

SEQ ID NO: 3655813 - RNA, 17 nt, Human
cugagucguacagaaag

SEQ ID NO: 3655814 - RNA, 20 nt, Human
cugagucguacagaaagcug

SEQ ID NO: 3655815 - RNA, 17 nt, Human
cugagucucccaaggcu

SEQ ID NO: 3655816 - RNA, 13 nt, Human
cugagucuccugu

SEQ ID NO: 3655817 - RNA, 14 nt, Human
cugagucugaaggc

SEQ ID NO: 3655818 - RNA, 15 nt, Human
cugagucugaaggcu

SEQ ID NO: 3655819 - RNA, 17 nt, Human
cugagucugaaggcugg

SEQ ID NO: 3655820 - RNA, 17 nt, Human
cugagucugcuauauuu

SEQ ID NO: 3655821 - RNA, 22 nt, Human
cugagucugcuauauuuucaug

SEQ ID NO: 3655822 - RNA, 13 nt, Human
cugagugaaccug

SEQ ID NO: 3655823 - RNA, 11 nt, Human
cugagugacuc

SEQ ID NO: 3655824 - RNA, 16 nt, Human
cugagugagaggggag

SEQ ID NO: 3655825 - RNA, 16 nt, Human
cugagugagcugaaga

SEQ ID NO: 3655826 - RNA, 13 nt, Human
cugagugcaggcc

SEQ ID NO: 3655827 - RNA, 17 nt, Human
cugagugccuucugugg

SEQ ID NO: 3655828 - RNA, 21 nt, Human
cugagugccuucuguggggac

SEQ ID NO: 3655829 - RNA, 15 nt, Human
cugagugccuuuugg

SEQ ID NO: 3655830 - RNA, 16 nt, Human
cugaguggacuggagu

SEQ ID NO: 3655831 - RNA, 21 nt, Human
cugaguggacuggaguggagc

SEQ ID NO: 3655832 - RNA, 22 nt, Human
cugaguggacuggaguggagca

SEQ ID NO: 3655833 - RNA, 19 nt, Human
cugaguggcuucacuccug

SEQ ID NO: 3655834 - RNA, 15 nt, Human
cugagugggaagccc

SEQ ID NO: 3655835 - RNA, 17 nt, Human
cugagugggaagcccau

SEQ ID NO: 3655836 - RNA, 22 nt, Human
cugagugggggaucacagccuc

SEQ ID NO: 3655837 - RNA, 17 nt, Human
cugaguuacagaaauga

SEQ ID NO: 3655838 - RNA, 19 nt, Human
cugaguuaggcuuucucuu

SEQ ID NO: 3655839 - RNA, 17 nt, Human
cugaguuccuagccacc

SEQ ID NO: 3655840 - RNA, 18 nt, Human
cugaguuccuagccaccg

SEQ ID NO: 3655841 - RNA, 21 nt, Human
cugaguucuguguauuuucag

SEQ ID NO: 3655842 - RNA, 17 nt, Human
cugaguuucauucuccu

SEQ ID NO: 3655843 - RNA, 19 nt, Human
cugaguuuccuaugggaac

SEQ ID NO: 3655844 - RNA, 14 nt, Human
cugaguuuuaccaa

SEQ ID NO: 3655845 - RNA, 16 nt, Human
cugaguuuuccauggc

SEQ ID NO: 3655846 - RNA, 19 nt, Human
cugaguuuuccauggcagg

SEQ ID NO: 3655847 - RNA, 22 nt, Human
cugaguuuuccauggcaggaag

SEQ ID NO: 3655848 - RNA, 13 nt, Human
cugaguuuugugu

SEQ ID NO: 3655849 - RNA, 15 nt, Human
cugaguuuuguuuug

SEQ ID NO: 3655850 - RNA, 17 nt, Human
cugaguuuuucagaugu

SEQ ID NO: 3655851 - RNA, 22 nt, Human
cugauaaauauucacacuugaa

SEQ ID NO: 3655852 - RNA, 18 nt, Human
cugauaacaaccuggaga

SEQ ID NO: 3655853 - RNA, 21 nt, Human
cugauaacuagauggugcuga

SEQ ID NO: 3655854 - RNA, 19 nt, Human
cugauaagagaaucaacau

SEQ ID NO: 3655855 - RNA, 14 nt, Human
cugauaagcuucaa

SEQ ID NO: 3655856 - RNA, 17 nt, Human
cugauaauuuuaaauuc

SEQ ID NO: 3655857 - RNA, 18 nt, Human
cugauaauuuuaaauucu

SEQ ID NO: 3655858 - RNA, 22 nt, Human
cugauacagaaaaguugaauuu

SEQ ID NO: 3655859 - RNA, 16 nt, Human
cugauacauaacuaaa

SEQ ID NO: 3655860 - RNA, 16 nt, Human
cugauacuuuuuugaa

SEQ ID NO: 3655861 - RNA, 18 nt, Human
cugauagaauuauuucac

SEQ ID NO: 3655862 - RNA, 19 nt, Human
cugauagcauaugacaaau

SEQ ID NO: 3655863 - RNA, 16 nt, Human
cugauagcguuggaau

SEQ ID NO: 3655864 - RNA, 19 nt, Human
cugauagggauacaugcuc

SEQ ID NO: 3655865 - RNA, 19 nt, Human
cugauaggguuugugacag

SEQ ID NO: 3655866 - RNA, 16 nt, Human
cugauaguuacuguug

SEQ ID NO: 3655867 - RNA, 17 nt, Human
cugauaguuacuguugu

SEQ ID NO: 3655868 - RNA, 19 nt, Human
cugauaguuacuguuguga

SEQ ID NO: 3655869 - RNA, 22 nt, Human
cugauaguuacuguugugaccu

SEQ ID NO: 3655870 - RNA, 17 nt, Human
cugauauaaauucugug

SEQ ID NO: 3655871 - RNA, 18 nt, Human
cugauauaaauucugugg

SEQ ID NO: 3655872 - RNA, 14 nt, Human
cugauauacugugu

SEQ ID NO: 3655873 - RNA, 15 nt, Human
cugauauagaauugc

SEQ ID NO: 3655874 - RNA, 15 nt, Human
cugauauauguguuu

SEQ ID NO: 3655875 - RNA, 16 nt, Human
cugauauauuuuacaa

SEQ ID NO: 3655876 - RNA, 18 nt, Human
cugauauauuuuacaauu

SEQ ID NO: 3655877 - RNA, 16 nt, Human
cugauauggaagcacc

SEQ ID NO: 3655878 - RNA, 13 nt, Human
cugauaugggacu

SEQ ID NO: 3655879 - RNA, 19 nt, Human
cugauauugccgcacuagg

SEQ ID NO: 3655880 - RNA, 12 nt, Human
cugaucaaggcc

SEQ ID NO: 3655881 - RNA, 15 nt, Human
cugaucaaggccuua

SEQ ID NO: 3655882 - RNA, 18 nt, Human
cugaucaagucaccggag

SEQ ID NO: 3655883 - RNA, 22 nt, Human
cugaucaagucaccggagcuuu

SEQ ID NO: 3655884 - RNA, 22 nt, Human
cugaucacuagccugucauccu

SEQ ID NO: 3655885 - RNA, 20 nt, Human
cugaucagagccgugguccu

SEQ ID NO: 3655886 - RNA, 19 nt, Human
cugaucagucuaagauggg

SEQ ID NO: 3655887 - RNA, 18 nt, Human
cugaucaucgccagaggu

SEQ ID NO: 3655888 - RNA, 16 nt, Human
cugaucaugcauuguu

SEQ ID NO: 3655889 - RNA, 23 nt, Human
cugaucauguuuaugagaaacug

SEQ ID NO: 3655890 - RNA, 15 nt, Human
cugauccagagcaca

SEQ ID NO: 3655891 - RNA, 15 nt, Human
cugaucccacuccua

SEQ ID NO: 3655892 - RNA, 16 nt, Human
cugaucccacuccuag

SEQ ID NO: 3655893 - RNA, 18 nt, Human
cugaucccacuccuagga

SEQ ID NO: 3655894 - RNA, 15 nt, Human
cugaucccagagagc

SEQ ID NO: 3655895 - RNA, 12 nt, Human
cugaucccucua

SEQ ID NO: 3655896 - RNA, 13 nt, Human
cugaucccucuac

SEQ ID NO: 3655897 - RNA, 14 nt, Human
cugaucccuuccac

SEQ ID NO: 3655898 - RNA, 21 nt, Human
cugaucccuuccaccugcucu

SEQ ID NO: 3655899 - RNA, 20 nt, Human
cugauccuaguuccaccauc

SEQ ID NO: 3655900 - RNA, 15 nt, Human
cugauccuggaggcc

SEQ ID NO: 3655901 - RNA, 18 nt, Human
cugauccuggaggcccag

SEQ ID NO: 3655902 - RNA, 13 nt, Human
cugaucgccuucc

SEQ ID NO: 3655903 - RNA, 16 nt, Human
cugaucgccuucccca

SEQ ID NO: 3655904 - RNA, 14 nt, Human
cugaucgugacgcu

SEQ ID NO: 3655905 - RNA, 21 nt, Human
cugaucgugcuaaauuuucag

SEQ ID NO: 3655906 - RNA, 23 nt, Human
cugaucucagggaagcccagcuc

SEQ ID NO: 3655907 - RNA, 17 nt, Human
cugaucucucgugauug

SEQ ID NO: 3655908 - RNA, 18 nt, Human
cugaucugacauccccac

SEQ ID NO: 3655909 - RNA, 19 nt, Human
cugaucugacauccccacu

SEQ ID NO: 3655910 - RNA, 16 nt, Human
cugagcccauguucug

SEQ ID NO: 3655911 - RNA, 20 nt, Human
cugagcccauguucugcccc

SEQ ID NO: 3655912 - RNA, 13 nt, Human
cugagccccaggg

SEQ ID NO: 3655913 - RNA, 20 nt, Human
cugagccccagggugcccag

SEQ ID NO: 3655914 - RNA, 21 nt, Human
cugagccccagggugcccaga

SEQ ID NO: 3655915 - RNA, 21 nt, Human
cugagcccccccaacacugug

SEQ ID NO: 3655916 - RNA, 22 nt, Human
cugagccccgcagaccucccca

SEQ ID NO: 3655917 - RNA, 23 nt, Human
cugagccccgcagaccuccccag

SEQ ID NO: 3655918 - RNA, 19 nt, Human
cugagccccgcccucuucc

SEQ ID NO: 3655919 - RNA, 20 nt, Human
cugagccccgcccucuuccu

SEQ ID NO: 3655920 - RNA, 23 nt, Human
cugagccccgcccucuuccugac

SEQ ID NO: 3655921 - RNA, 19 nt, Human
cugagccccuaccccacac

SEQ ID NO: 3655922 - RNA, 16 nt, Human
cugagccccugggacu

SEQ ID NO: 3655923 - RNA, 23 nt, Human
cugagccccugucuagagaggga

SEQ ID NO: 3655924 - RNA, 19 nt, Human
cugagccccuuccuugcuc

SEQ ID NO: 3655925 - RNA, 23 nt, Human
cugagcccgguaagagcaaaaga

SEQ ID NO: 3655926 - RNA, 22 nt, Human
cugagcccuacucccugcagau

SEQ ID NO: 3655927 - RNA, 11 nt, Human
cugagcccugg

SEQ ID NO: 3655928 - RNA, 12 nt, Human
cugagcccuggc

SEQ ID NO: 3655929 - RNA, 15 nt, Human
cugagcccuggcagg

SEQ ID NO: 3655930 - RNA, 14 nt, Human
cugagccgcagaga

SEQ ID NO: 3655931 - RNA, 16 nt, Human
cugagccggccccagg

SEQ ID NO: 3655932 - RNA, 19 nt, Human
cugagccggccccaggcuc

SEQ ID NO: 3655933 - RNA, 17 nt, Human
cugagccgggccuuguc

SEQ ID NO: 3655934 - RNA, 15 nt, Human
cugagccucacagca

SEQ ID NO: 3655935 - RNA, 16 nt, Human
cugagccucacagcag

SEQ ID NO: 3655936 - RNA, 19 nt, Human
cugagccucacagcaguga

SEQ ID NO: 3655937 - RNA, 16 nt, Human
cugagccucagucucc

SEQ ID NO: 3655938 - RNA, 21 nt, Human
cugagccucagucucccuccc

SEQ ID NO: 3655939 - RNA, 22 nt, Human
cugagccucagucucccucccu

SEQ ID NO: 3655940 - RNA, 16 nt, Human
cugagccucugcuccc

SEQ ID NO: 3655941 - RNA, 18 nt, Human
cugagccucugcucccca

SEQ ID NO: 3655942 - RNA, 13 nt, Human
cccugccuccauc

SEQ ID NO: 3655943 - RNA, 18 nt, Human
cccugccuccauccuagu

SEQ ID NO: 3655944 - RNA, 13 nt, Human
cccugccucuccg

SEQ ID NO: 3655945 - RNA, 22 nt, Human
cccugccucuccgccccugagc

SEQ ID NO: 3655946 - RNA, 23 nt, Human
cccugccucuccgccccugagcc

SEQ ID NO: 3655947 - RNA, 15 nt, Human
cccugccucucugca

SEQ ID NO: 3655948 - RNA, 18 nt, Human
cccugccucucugcaggu

SEQ ID NO: 3655949 - RNA, 21 nt, Human
cccugccucucugcagguccc

SEQ ID NO: 3655950 - RNA, 13 nt, Human
cccugccucuguu

SEQ ID NO: 3655951 - RNA, 9 nt, Human
cccugccug

SEQ ID NO: 3655952 - RNA, 19 nt, Human
cccugccugagggccccuc

SEQ ID NO: 3655953 - RNA, 23 nt, Human
cccugccugagggccccucugcc

SEQ ID NO: 3655954 - RNA, 20 nt, Human
cccugccugccauguaccuc

SEQ ID NO: 3655955 - RNA, 11 nt, Human
cccugccugga

SEQ ID NO: 3655956 - RNA, 23 nt, Human
cccugccuggggcgggccccuca

SEQ ID NO: 3655957 - RNA, 13 nt, Human
cccugccugguca

SEQ ID NO: 3655958 - RNA, 18 nt, Human
cccugccuuugggagcag

SEQ ID NO: 3655959 - RNA, 15 nt, Human
cccugcgccuuuccu

SEQ ID NO: 3655960 - RNA, 22 nt, Human
cccugcgcucucuuugcaacug

SEQ ID NO: 3655961 - RNA, 22 nt, Human
cccugcggccccgucuguggcu

SEQ ID NO: 3655962 - RNA, 16 nt, Human
cccugcuacccuagau

SEQ ID NO: 3655963 - RNA, 22 nt, Human
cccugcuagaugagaauucagc

SEQ ID NO: 3655964 - RNA, 13 nt, Human
cccugcucacugc

SEQ ID NO: 3655965 - RNA, 15 nt, Human
cccugcucauccacu

SEQ ID NO: 3655966 - RNA, 21 nt, Human
cccugcuccacgucugcgccg

SEQ ID NO: 3655967 - RNA, 11 nt, Human
cccugcucccu

SEQ ID NO: 3655968 - RNA, 17 nt, Human
cccugcuccucccuggc

SEQ ID NO: 3655969 - RNA, 22 nt, Human
cccugcuccucccuggcugccc

SEQ ID NO: 3655970 - RNA, 13 nt, Human
cccugcuccugca

SEQ ID NO: 3655971 - RNA, 15 nt, Human
cccugcuccugcagc

SEQ ID NO: 3655972 - RNA, 21 nt, Human
cccugcucuccgaccagacac

SEQ ID NO: 3655973 - RNA, 19 nt, Human
cccugcugcaggggcucug

SEQ ID NO: 3655974 - RNA, 21 nt, Human
cccugcugcaggggcucugga

SEQ ID NO: 3655975 - RNA, 22 nt, Human
cccugcugcaggggcucuggag

SEQ ID NO: 3655976 - RNA, 12 nt, Human
cccugcugccca

SEQ ID NO: 3655977 - RNA, 21 nt, Human
cccugcugcccaaucuccauc

SEQ ID NO: 3655978 - RNA, 20 nt, Human
cccugcugccgccucccagc

SEQ ID NO: 3655979 - RNA, 12 nt, Human
cccugcugccuc

SEQ ID NO: 3655980 - RNA, 14 nt, Human
cccugcugcuccua

SEQ ID NO: 3655981 - RNA, 16 nt, Human
cccugcugcugccugc

SEQ ID NO: 3655982 - RNA, 18 nt, Human
cccugcugcugccugccu

SEQ ID NO: 3655983 - RNA, 15 nt, Human
cccugcugcuggugc

SEQ ID NO: 3655984 - RNA, 17 nt, Human
cccugcugcugucaccu

SEQ ID NO: 3655985 - RNA, 12 nt, Human
cccugcuggccg

SEQ ID NO: 3655986 - RNA, 16 nt, Human
cccugcuggccggaca

SEQ ID NO: 3655987 - RNA, 14 nt, Human
cccugcuggcucuu

SEQ ID NO: 3655988 - RNA, 15 nt, Human
cccugcuggcucuuc

SEQ ID NO: 3655989 - RNA, 20 nt, Human
cccugcuggcucuucugccc

SEQ ID NO: 3655990 - RNA, 21 nt, Human
cccugcuggcucuucugccca

SEQ ID NO: 3655991 - RNA, 16 nt, Human
cccugcuggguguggc

SEQ ID NO: 3655992 - RNA, 21 nt, Human
cccugcuggguguggcgcagc

SEQ ID NO: 3655993 - RNA, 15 nt, Human
cccugcuuccaccuc

SEQ ID NO: 3655994 - RNA, 16 nt, Human
cccugcuuccaggaaa

SEQ ID NO: 3655995 - RNA, 15 nt, Human
cccugcuuccugcuu

SEQ ID NO: 3655996 - RNA, 16 nt, Human
cccugcuuccugcuug

SEQ ID NO: 3655997 - RNA, 19 nt, Human
cccugcuuccugcuugcca

SEQ ID NO: 3655998 - RNA, 15 nt, Human
cccugcuucuccagc

SEQ ID NO: 3655999 - RNA, 16 nt, Human
cccugcuucuccagcc

SEQ ID NO: 3656000 - RNA, 17 nt, Human
cccugcuucuccagccu

SEQ ID NO: 3656001 - RNA, 18 nt, Human
cccugcuucuccagccug

SEQ ID NO: 3656002 - RNA, 21 nt, Human
cccugcuucuccagccuggac

SEQ ID NO: 3656003 - RNA, 16 nt, Human
cccugcuuggcccagg

SEQ ID NO: 3656004 - RNA, 18 nt, Human
cccugcuuggcccagggg

SEQ ID NO: 3656005 - RNA, 18 nt, Human
cccugcuuuagagcuagg

SEQ ID NO: 3656006 - RNA, 23 nt, Human
cccugcuuugggcugcccuggug

SEQ ID NO: 3656007 - RNA, 17 nt, Human
cccugcuuugggcuugg

SEQ ID NO: 3656008 - RNA, 10 nt, Human
cccugcuuuu

SEQ ID NO: 3656009 - RNA, 15 nt, Human
cccuggaaaccuucc

SEQ ID NO: 3656010 - RNA, 19 nt, Human
cccuggaaaccuuccaccc

SEQ ID NO: 3656011 - RNA, 22 nt, Human
cccuggaacucuaucugggccu

SEQ ID NO: 3656012 - RNA, 23 nt, Human
cccuggaacucuaucugggccug

SEQ ID NO: 3656013 - RNA, 18 nt, Human
cccuggaagcagugccca

SEQ ID NO: 3656014 - RNA, 23 nt, Human
cccuggaaugaguugaggccacu

SEQ ID NO: 3656015 - RNA, 16 nt, Human
cccuggaccagugguc

SEQ ID NO: 3656016 - RNA, 21 nt, Human
cccuggaccaguggucucaca

SEQ ID NO: 3656017 - RNA, 15 nt, Human
cccuggaccccagcc

SEQ ID NO: 3656018 - RNA, 16 nt, Human
cccuggaccccagccu

SEQ ID NO: 3656019 - RNA, 21 nt, Human
cccuggacugugugcucagga

SEQ ID NO: 3656020 - RNA, 13 nt, Human
cccuggagaguuc

SEQ ID NO: 3656021 - RNA, 21 nt, Human
cccuggagaguucaauggcug

SEQ ID NO: 3656022 - RNA, 23 nt, Human
cccuggagaguucaauggcugcu

SEQ ID NO: 3656023 - RNA, 14 nt, Human
cccuggagcagcca

SEQ ID NO: 3656024 - RNA, 16 nt, Human
cccuggagcagccacc

SEQ ID NO: 3656025 - RNA, 22 nt, Human
cccuggagccaacugcugcuuu

SEQ ID NO: 3656026 - RNA, 23 nt, Human
cccuggagccagacucuggucuu

SEQ ID NO: 3656027 - RNA, 21 nt, Human
cccuggagggggaauggcagc

SEQ ID NO: 3656028 - RNA, 20 nt, Human
cccuggaggugccagcaaag

SEQ ID NO: 3656029 - RNA, 24 nt, Human
cccuggaucacgacgcugcagagc

SEQ ID NO: 3656030 - RNA, 17 nt, Human
cccuggaucagaacagg

SEQ ID NO: 3656031 - RNA, 22 nt, Human
cccuggaugaaguuaucuggcu

SEQ ID NO: 3656032 - RNA, 15 nt, Human
cccuggaugcccagg

SEQ ID NO: 3656033 - RNA, 16 nt, Human
cccuggauuuuuacca

SEQ ID NO: 3656034 - RNA, 24 nt, Human
cccuggauuuuuaccagucucaca

SEQ ID NO: 3656035 - RNA, 16 nt, Human
cccuggcacuggcaaa

SEQ ID NO: 3656036 - RNA, 20 nt, Human
cccuggcacuggcaaacagg

SEQ ID NO: 3656037 - RNA, 21 nt, Human
cccuggcagagaugccucccu

SEQ ID NO: 3656038 - RNA, 23 nt, Human
cccuggcauuauguccacugugu

SEQ ID NO: 3656039 - RNA, 9 nt, Human
cccuggccc

SEQ ID NO: 3656040 - RNA, 13 nt, Human
cccuggccccagg

SEQ ID NO: 3656041 - RNA, 14 nt, Human
cccuggccccagga

SEQ ID NO: 3656042 - RNA, 17 nt, Human
cccuggcccccacaugg

SEQ ID NO: 3656043 - RNA, 13 nt, Human
cccuggcccccuc

SEQ ID NO: 3656044 - RNA, 20 nt, Human
cccuggcccccucccuggau

SEQ ID NO: 3656045 - RNA, 13 nt, Human
cccuggcccucaa

SEQ ID NO: 3656046 - RNA, 22 nt, Human
cccuggcccucaaggccuccca

SEQ ID NO: 3656047 - RNA, 16 nt, Human
cccuggcccugaggug

SEQ ID NO: 3656048 - RNA, 15 nt, Human
cccuggccuccccca

SEQ ID NO: 3656049 - RNA, 19 nt, Human
cccuggccuccccugccac

SEQ ID NO: 3656050 - RNA, 20 nt, Human
cccuggccuccggcgucagc

SEQ ID NO: 3656051 - RNA, 21 nt, Human
cccuggccuccggcgucagcc

SEQ ID NO: 3656052 - RNA, 13 nt, Human
cccuggccucugu

SEQ ID NO: 3656053 - RNA, 14 nt, Human
cccuggccugcugg

SEQ ID NO: 3656054 - RNA, 18 nt, Human
cugcccaggccggccagc

SEQ ID NO: 3656055 - RNA, 16 nt, Human
cugcccaggggagccc

SEQ ID NO: 3656056 - RNA, 22 nt, Human
cugcccaggggagcccuccacg

SEQ ID NO: 3656057 - RNA, 14 nt, Human
cugcccaggggugc

SEQ ID NO: 3656058 - RNA, 21 nt, Human
cugcccaggggugcccccucc

SEQ ID NO: 3656059 - RNA, 14 nt, Human
cugcccaguccccc

SEQ ID NO: 3656060 - RNA, 16 nt, Human
cugcccagugcacuug

SEQ ID NO: 3656061 - RNA, 11 nt, Human
cugcccagugu

SEQ ID NO: 3656062 - RNA, 22 nt, Human
cugcccaucacaggguugggcc

SEQ ID NO: 3656063 - RNA, 18 nt, Human
cugcccaucauguggccc

SEQ ID NO: 3656064 - RNA, 18 nt, Human
cugcccauggacaggcug

SEQ ID NO: 3656065 - RNA, 19 nt, Human
cugcccauucugcccugug

SEQ ID NO: 3656066 - RNA, 18 nt, Human
cugcccauuucauauucu

SEQ ID NO: 3656067 - RNA, 15 nt, Human
cugccccaaacaaau

SEQ ID NO: 3656068 - RNA, 21 nt, Human
cugccccaaauaacuucaguc

SEQ ID NO: 3656069 - RNA, 14 nt, Human
cugccccaacuccu

SEQ ID NO: 3656070 - RNA, 17 nt, Human
cugccccaacuccugga

SEQ ID NO: 3656071 - RNA, 20 nt, Human
cugccccaacuccuggaagc

SEQ ID NO: 3656072 - RNA, 15 nt, Human
cugccccaacuccuu

SEQ ID NO: 3656073 - RNA, 15 nt, Human
cugccccaaguuuug

SEQ ID NO: 3656074 - RNA, 20 nt, Human
cugccccacuuguccuuagc

SEQ ID NO: 3656075 - RNA, 21 nt, Human
cugccccacuuguccuuagcc

SEQ ID NO: 3656076 - RNA, 16 nt, Human
cugccccagcccaagu

SEQ ID NO: 3656077 - RNA, 18 nt, Human
cugccccagcccaagucc

SEQ ID NO: 3656078 - RNA, 16 nt, Human
cugccccagcucuggc

SEQ ID NO: 3656079 - RNA, 18 nt, Human
cugccccagcucuggcuu

SEQ ID NO: 3656080 - RNA, 19 nt, Human
cugccccagcucuggcuuc

SEQ ID NO: 3656081 - RNA, 19 nt, Human
cugccccagcuugggcaga

SEQ ID NO: 3656082 - RNA, 23 nt, Human
cugccccagucguuagaauauag

SEQ ID NO: 3656083 - RNA, 13 nt, Human
cugccccauccuc

SEQ ID NO: 3656084 - RNA, 16 nt, Human
cugccccaucuccccu

SEQ ID NO: 3656085 - RNA, 22 nt, Human
cugcccccaaauaagaagggau

SEQ ID NO: 3656086 - RNA, 16 nt, Human
cugcccccacuuccug

SEQ ID NO: 3656087 - RNA, 18 nt, Human
cugcccccacuuccuguu

SEQ ID NO: 3656088 - RNA, 16 nt, Human
cugcccccagagccac

SEQ ID NO: 3656089 - RNA, 17 nt, Human
cugcccccagagccaca

SEQ ID NO: 3656090 - RNA, 14 nt, Human
cugcccccagccca

SEQ ID NO: 3656091 - RNA, 16 nt, Human
cugcccccagcccaaa

SEQ ID NO: 3656092 - RNA, 18 nt, Human
cugcccccagcccaaagg

SEQ ID NO: 3656093 - RNA, 17 nt, Human
cugcccccaggacuggg

SEQ ID NO: 3656094 - RNA, 12 nt, Human
cugccccccagc

SEQ ID NO: 3656095 - RNA, 19 nt, Human
cugccccccagccucuggc

SEQ ID NO: 3656096 - RNA, 22 nt, Human
cugcccccgcauccccugccuc

SEQ ID NO: 3656097 - RNA, 17 nt, Human
cugcccccggcccccug

SEQ ID NO: 3656098 - RNA, 15 nt, Human
cugcccccuccugag

SEQ ID NO: 3656099 - RNA, 17 nt, Human
cugcccccucugcccug

SEQ ID NO: 3656100 - RNA, 19 nt, Human
cugcccccucugcccugcg

SEQ ID NO: 3656101 - RNA, 17 nt, Human
cugcccccugaaacuua

SEQ ID NO: 3656102 - RNA, 12 nt, Human
cugcccccuggu

SEQ ID NO: 3656103 - RNA, 14 nt, Human
cugcccccuggugg

SEQ ID NO: 3656104 - RNA, 22 nt, Human
cugcccccugguggacaguccu

SEQ ID NO: 3656105 - RNA, 17 nt, Human
cugcccccuucucccac

SEQ ID NO: 3656106 - RNA, 18 nt, Human
cugcccccuucucccaca

SEQ ID NO: 3656107 - RNA, 20 nt, Human
cugcccccuucucccacacu

SEQ ID NO: 3656108 - RNA, 22 nt, Human
cugcccccuucucccacacugc

SEQ ID NO: 3656109 - RNA, 15 nt, Human
cugccccgcccagcu

SEQ ID NO: 3656110 - RNA, 18 nt, Human
cugccccgcccccagucc

SEQ ID NO: 3656111 - RNA, 18 nt, Human
cugccccgugcagacugg

SEQ ID NO: 3656112 - RNA, 16 nt, Human
cugccccucccagaac

SEQ ID NO: 3656113 - RNA, 14 nt, Human
cugccccuccccca

SEQ ID NO: 3656114 - RNA, 13 nt, Human
cugccccucccug

SEQ ID NO: 3656115 - RNA, 13 nt, Human
cugccccucccuu

SEQ ID NO: 3656116 - RNA, 21 nt, Human
cugccccuccucucugcccua

SEQ ID NO: 3656117 - RNA, 12 nt, Human
cugccccucucu

SEQ ID NO: 3656118 - RNA, 17 nt, Human
cugccccucucugggcc

SEQ ID NO: 3656119 - RNA, 14 nt, Human
cugccccucuuucu

SEQ ID NO: 3656120 - RNA, 16 nt, Human
cugccccucuuucucu

SEQ ID NO: 3656121 - RNA, 17 nt, Human
cugccccucuuucucuu

SEQ ID NO: 3656122 - RNA, 18 nt, Human
cugccccugagcccugug

SEQ ID NO: 3656123 - RNA, 11 nt, Human
cugccccugcc

SEQ ID NO: 3656124 - RNA, 16 nt, Human
cugccccugccccguc

SEQ ID NO: 3656125 - RNA, 18 nt, Human
cugccccugcuacugcca

SEQ ID NO: 3656126 - RNA, 22 nt, Human
cugccccugcuacugccaaccu

SEQ ID NO: 3656127 - RNA, 19 nt, Human
cugccccuggcagccccug

SEQ ID NO: 3656128 - RNA, 16 nt, Human
cugccccuggcucuga

SEQ ID NO: 3656129 - RNA, 13 nt, Human
cugccccuguucu

SEQ ID NO: 3656130 - RNA, 18 nt, Human
cugccccuucuacacucu

SEQ ID NO: 3656131 - RNA, 22 nt, Human
cugccccuuggacacgcucagu

SEQ ID NO: 3656132 - RNA, 15 nt, Human
cugcccgagcuggug

SEQ ID NO: 3656133 - RNA, 16 nt, Human
cugcccgcacacccuc

SEQ ID NO: 3656134 - RNA, 22 nt, Human
cugcccgcacacccucacucug

SEQ ID NO: 3656135 - RNA, 18 nt, Human
cugcccgcacagcagccu

SEQ ID NO: 3656136 - RNA, 21 nt, Human
cugcccgcacagcagccugcu

SEQ ID NO: 3656137 - RNA, 20 nt, Human
cugcccgcagaccucuggau

SEQ ID NO: 3656138 - RNA, 14 nt, Human
cugcccgcucccag

SEQ ID NO: 3656139 - RNA, 15 nt, Human
cugcccgcucccagu

SEQ ID NO: 3656140 - RNA, 15 nt, Human
cugcccggcgcccuc

SEQ ID NO: 3656141 - RNA, 20 nt, Human
cugcccggcgcccucugucc

SEQ ID NO: 3656142 - RNA, 23 nt, Human
cugcccggcgcccucuguccuga

SEQ ID NO: 3656143 - RNA, 11 nt, Human
cugcccggcug

SEQ ID NO: 3656144 - RNA, 15 nt, Human
cugcccggcugcgga

SEQ ID NO: 3656145 - RNA, 21 nt, Human
cugcccgggcgcggccagccc

SEQ ID NO: 3656146 - RNA, 13 nt, Human
cugcccggggcag

SEQ ID NO: 3656147 - RNA, 15 nt, Human
cugcccggggcagcu

SEQ ID NO: 3656148 - RNA, 16 nt, Human
cugcccggggcagcug

SEQ ID NO: 3656149 - RNA, 20 nt, Human
cugcccggugggggggcaga

SEQ ID NO: 3656150 - RNA, 13 nt, Human
ccgcaugcccccu

SEQ ID NO: 3656151 - RNA, 18 nt, Human
ccgcaugcccccucgugc

SEQ ID NO: 3656152 - RNA, 22 nt, Human
ccgcaugcccccucgugccagu

SEQ ID NO: 3656153 - RNA, 16 nt, Human
ccgcaugcggcccagg

SEQ ID NO: 3656154 - RNA, 14 nt, Human
ccgcauuccaggcu

SEQ ID NO: 3656155 - RNA, 15 nt, Human
ccgcauucccugagu

SEQ ID NO: 3656156 - RNA, 23 nt, Human
ccgcauucccugagucaccagga

SEQ ID NO: 3656157 - RNA, 20 nt, Human
ccgccaaugcacggccucgc

SEQ ID NO: 3656158 - RNA, 21 nt, Human
ccgccacauccccgcuggcug

SEQ ID NO: 3656159 - RNA, 23 nt, Human
ccgccaccuaucucgugggagag

SEQ ID NO: 3656160 - RNA, 16 nt, Human
ccgccacuccugaacc

SEQ ID NO: 3656161 - RNA, 13 nt, Human
ccgccacuggggc

SEQ ID NO: 3656162 - RNA, 14 nt, Human
ccgccacuggggcu

SEQ ID NO: 3656163 - RNA, 16 nt, Human
ccgccacuggggcuca

SEQ ID NO: 3656164 - RNA, 16 nt, Human
ccgccagacuguuaga

SEQ ID NO: 3656165 - RNA, 15 nt, Human
ccgccagagggcuug

SEQ ID NO: 3656166 - RNA, 16 nt, Human
ccgccagauggggccu

SEQ ID NO: 3656167 - RNA, 23 nt, Human
ccgccagccuccucuggacggca

SEQ ID NO: 3656168 - RNA, 15 nt, Human
ccgccauugccacca

SEQ ID NO: 3656169 - RNA, 16 nt, Human
ccgccauugccaccag

SEQ ID NO: 3656170 - RNA, 18 nt, Human
ccgcccaaaccuuucccc

SEQ ID NO: 3656171 - RNA, 17 nt, Human
ccgcccaaggccuuccc

SEQ ID NO: 3656172 - RNA, 15 nt, Human
ccgcccacuguccug

SEQ ID NO: 3656173 - RNA, 16 nt, Human
ccgcccacuguccugg

SEQ ID NO: 3656174 - RNA, 23 nt, Human
ccgcccagcggcuugccugccug

SEQ ID NO: 3656175 - RNA, 18 nt, Human
ccgcccaggcuggccagc

SEQ ID NO: 3656176 - RNA, 22 nt, Human
ccgcccaggcuggccagcccca

SEQ ID NO: 3656177 - RNA, 19 nt, Human
ccgcccccaguccccaccc

SEQ ID NO: 3656178 - RNA, 17 nt, Human
ccgcccccugcccuccc

SEQ ID NO: 3656179 - RNA, 14 nt, Human
ccgccccugagccc

SEQ ID NO: 3656180 - RNA, 13 nt, Human
ccgccccugcagc

SEQ ID NO: 3656181 - RNA, 14 nt, Human
ccgccccugcagca

SEQ ID NO: 3656182 - RNA, 17 nt, Human
ccgccccugcagcacgg

SEQ ID NO: 3656183 - RNA, 19 nt, Human
ccgccccuuccccgaggga

SEQ ID NO: 3656184 - RNA, 19 nt, Human
ccgcccgagguggcugccu

SEQ ID NO: 3656185 - RNA, 15 nt, Human
ccgcccgggcccaga

SEQ ID NO: 3656186 - RNA, 14 nt, Human
ccgcccucuuccug

SEQ ID NO: 3656187 - RNA, 14 nt, Human
ccgcccugcuccuc

SEQ ID NO: 3656188 - RNA, 18 nt, Human
ccgcccugcuccucccug

SEQ ID NO: 3656189 - RNA, 19 nt, Human
ccgcccugcuccucccugg

SEQ ID NO: 3656190 - RNA, 15 nt, Human
ccgccgccucgccca

SEQ ID NO: 3656191 - RNA, 13 nt, Human
ccgccgcuuuucu

SEQ ID NO: 3656192 - RNA, 20 nt, Human
ccgccggcaauaaaagccca

SEQ ID NO: 3656193 - RNA, 22 nt, Human
ccgccggcaauaaaagcccagg

SEQ ID NO: 3656194 - RNA, 14 nt, Human
ccgccucaaaaugu

SEQ ID NO: 3656195 - RNA, 18 nt, Human
ccgccucacccccucggg

SEQ ID NO: 3656196 - RNA, 18 nt, Human
ccgccucagccucccaaa

SEQ ID NO: 3656197 - RNA, 17 nt, Human
ccgccuccgggaccccc

SEQ ID NO: 3656198 - RNA, 18 nt, Human
ccgccuccgggaccccca

SEQ ID NO: 3656199 - RNA, 15 nt, Human
cugcaggcugagugc

SEQ ID NO: 3656200 - RNA, 12 nt, Human
cugcagggaaaa

SEQ ID NO: 3656201 - RNA, 22 nt, Human
cugcagggaaaauuauuugcau

SEQ ID NO: 3656202 - RNA, 14 nt, Human
cugcagggccagga

SEQ ID NO: 3656203 - RNA, 15 nt, Human
cugcagggccaggac

SEQ ID NO: 3656204 - RNA, 16 nt, Human
cugcagggccaggacu

SEQ ID NO: 3656205 - RNA, 17 nt, Human
cugcagggccaggacug

SEQ ID NO: 3656206 - RNA, 18 nt, Human
cugcagggccauggcuca

SEQ ID NO: 3656207 - RNA, 19 nt, Human
cugcagggccauggcucag

SEQ ID NO: 3656208 - RNA, 19 nt, Human
cugcagggccgccagggag

SEQ ID NO: 3656209 - RNA, 12 nt, Human
cugcagggcugc

SEQ ID NO: 3656210 - RNA, 16 nt, Human
cugcaggggcucugga

SEQ ID NO: 3656211 - RNA, 22 nt, Human
cugcaggggcucuggagagaaa

SEQ ID NO: 3656212 - RNA, 17 nt, Human
cugcagggggugugucu

SEQ ID NO: 3656213 - RNA, 23 nt, Human
cugcagggguuauguggaagugu

SEQ ID NO: 3656214 - RNA, 21 nt, Human
cugcaggguggugcugggacu

SEQ ID NO: 3656215 - RNA, 22 nt, Human
cugcaggucaaguugucagguu

SEQ ID NO: 3656216 - RNA, 18 nt, Human
cugcaggucccuaauaaa

SEQ ID NO: 3656217 - RNA, 20 nt, Human
cugcaggucccuaauaaagc

SEQ ID NO: 3656218 - RNA, 19 nt, Human
cugcaggugcugcugcgug

SEQ ID NO: 3656219 - RNA, 19 nt, Human
cugcagguuggaccccaga

SEQ ID NO: 3656220 - RNA, 17 nt, Human
cugcaguaaaucuuuua

SEQ ID NO: 3656221 - RNA, 16 nt, Human
cugcaguaugaaaaua

SEQ ID NO: 3656222 - RNA, 14 nt, Human
cugcagucacagcu

SEQ ID NO: 3656223 - RNA, 23 nt, Human
cugcagucccagcggugggaccu

SEQ ID NO: 3656224 - RNA, 18 nt, Human
cugcaguccuacucaagc

SEQ ID NO: 3656225 - RNA, 22 nt, Human
cugcaguccuacucaagcgggu

SEQ ID NO: 3656226 - RNA, 23 nt, Human
cugcaguccuacucaagcgggug

SEQ ID NO: 3656227 - RNA, 13 nt, Human
cugcaguccugga

SEQ ID NO: 3656228 - RNA, 17 nt, Human
cugcagucuggcugagc

SEQ ID NO: 3656229 - RNA, 20 nt, Human
cugcagucuggcugagcccu

SEQ ID NO: 3656230 - RNA, 21 nt, Human
cugcagucuggcugagcccug

SEQ ID NO: 3656231 - RNA, 15 nt, Human
cugcagugagcugug

SEQ ID NO: 3656232 - RNA, 19 nt, Human
cugcaguguucgcuuggcu

SEQ ID NO: 3656233 - RNA, 15 nt, Human
cugcaguuccccugg

SEQ ID NO: 3656234 - RNA, 17 nt, Human
cugcaguuccccuggaa

SEQ ID NO: 3656235 - RNA, 20 nt, Human
cugcaguuccccuggaagca

SEQ ID NO: 3656236 - RNA, 17 nt, Human
cugcaguucgacucugu

SEQ ID NO: 3656237 - RNA, 18 nt, Human
cugcaguucuacucaggc

SEQ ID NO: 3656238 - RNA, 20 nt, Human
cugcaguucuacucaggcug

SEQ ID NO: 3656239 - RNA, 16 nt, Human
cugcaguugccaguca

SEQ ID NO: 3656240 - RNA, 21 nt, Human
cugcaguugccagucaccccg

SEQ ID NO: 3656241 - RNA, 21 nt, Human
cugcaguuuugcuaucugggc

SEQ ID NO: 3656242 - RNA, 22 nt, Human
cugcaguuuugcuaucugggcu

SEQ ID NO: 3656243 - RNA, 14 nt, Human
cugcaguuuuucag

SEQ ID NO: 3656244 - RNA, 18 nt, Human
cugcaguuuuucaggagc

SEQ ID NO: 3656245 - RNA, 22 nt, Human
cugcauaauguuucuggauuuc

SEQ ID NO: 3656246 - RNA, 20 nt, Human
cugcauacuuuuuaaaugua

SEQ ID NO: 3656247 - RNA, 21 nt, Human
cugcauaguauuccauugugu

SEQ ID NO: 3656248 - RNA, 21 nt, Human
cugcauauguugaauacuuuu

SEQ ID NO: 3656249 - RNA, 13 nt, Human
cugcaucaucugu

SEQ ID NO: 3656250 - RNA, 14 nt, Human
cugcaucaucugua

SEQ ID NO: 3656251 - RNA, 17 nt, Human
cugcaucaucuguagau

SEQ ID NO: 3656252 - RNA, 16 nt, Human
cugcaucccagcaccu

SEQ ID NO: 3656253 - RNA, 12 nt, Human
cugcauccccuu

SEQ ID NO: 3656254 - RNA, 20 nt, Human
cugcauccguaguucccuga

SEQ ID NO: 3656255 - RNA, 21 nt, Human
cugcauccguaguucccugaa

SEQ ID NO: 3656256 - RNA, 20 nt, Human
cugcauccuccgccucccgg

SEQ ID NO: 3656257 - RNA, 20 nt, Human
cugcauccucuggagccagc

SEQ ID NO: 3656258 - RNA, 14 nt, Human
cugcaucuacucag

SEQ ID NO: 3656259 - RNA, 15 nt, Human
cugcaucuacuccca

SEQ ID NO: 3656260 - RNA, 18 nt, Human
cugcaucuacucccaagu

SEQ ID NO: 3656261 - RNA, 18 nt, Human
cugcaucugaccagcagc

SEQ ID NO: 3656262 - RNA, 18 nt, Human
cugcaucuggggcccaua

SEQ ID NO: 3656263 - RNA, 23 nt, Human
cugcaucuuauagcacuuugaaa

SEQ ID NO: 3656264 - RNA, 19 nt, Human
cugcaucuuggggacaucu

SEQ ID NO: 3656265 - RNA, 13 nt, Human
cugcaugcccaga

SEQ ID NO: 3656266 - RNA, 16 nt, Human
cugcaugcccagagac

SEQ ID NO: 3656267 - RNA, 17 nt, Human
cugcaugcccagagacc

SEQ ID NO: 3656268 - RNA, 21 nt, Human
cugcaugcccagagacccagc

SEQ ID NO: 3656269 - RNA, 19 nt, Human
cugcaugcccucucaggcc

SEQ ID NO: 3656270 - RNA, 15 nt, Human
cugcaugcggcccag

SEQ ID NO: 3656271 - RNA, 18 nt, Human
cugcaugcggcccagccc

SEQ ID NO: 3656272 - RNA, 22 nt, Human
cugcaugcgggcuuccuccugg

SEQ ID NO: 3656273 - RNA, 22 nt, Human
cugcaugcugcuggacaguauc

SEQ ID NO: 3656274 - RNA, 19 nt, Human
cugcaugcuggguucugca

SEQ ID NO: 3656275 - RNA, 13 nt, Human
cugcauggcaggg

SEQ ID NO: 3656276 - RNA, 21 nt, Human
cugcauggcagggggcugcug

SEQ ID NO: 3656277 - RNA, 22 nt, Human
cugcauggcagggggcugcugc

SEQ ID NO: 3656278 - RNA, 21 nt, Human
cugcauggcauccuccagccc

SEQ ID NO: 3656279 - RNA, 16 nt, Human
cugcaugguaauuuau

SEQ ID NO: 3656280 - RNA, 19 nt, Human
cugcaugguaauuuauagu

SEQ ID NO: 3656281 - RNA, 21 nt, Human
cugcauguacuguauauuaca

SEQ ID NO: 3656282 - RNA, 20 nt, Human
cugcauguagaggcuuguuu

SEQ ID NO: 3656283 - RNA, 15 nt, Human
cugcauuacauuccu

SEQ ID NO: 3656284 - RNA, 21 nt, Human
cugcauuaccgcguuguaaaa

SEQ ID NO: 3656285 - RNA, 15 nt, Human
cugcauuauucucuu

SEQ ID NO: 3656286 - RNA, 23 nt, Human
cugcauuauuggaauauaauugu

SEQ ID NO: 3656287 - RNA, 22 nt, Human
cugcauucacccagacagcucc

SEQ ID NO: 3656288 - RNA, 18 nt, Human
cugcauucuucugagcac

SEQ ID NO: 3656289 - RNA, 16 nt, Human
cugcauucuucugauc

SEQ ID NO: 3656290 - RNA, 14 nt, Human
cugcauucuuucug

SEQ ID NO: 3656291 - RNA, 15 nt, Human
cugcauucuuucugu

SEQ ID NO: 3656292 - RNA, 17 nt, Human
cugcauugagcuugcau

SEQ ID NO: 3656293 - RNA, 23 nt, Human
cugcauugagcuugcaugcuugc

SEQ ID NO: 3656294 - RNA, 18 nt, Human
cugcauugcuagauaaaa

SEQ ID NO: 3656295 - RNA, 15 nt, Human
cugcauuggaacugg

SEQ ID NO: 3656296 - RNA, 21 nt, Human
cugcauuggaacuggaggcag

SEQ ID NO: 3656297 - RNA, 14 nt, Human
cugcauuguaaaua

SEQ ID NO: 3656298 - RNA, 14 nt, Human
cugcauuuaaaaga

SEQ ID NO: 3656299 - RNA, 20 nt, Human
cugcauuuaaaagauacagu

SEQ ID NO: 3656300 - RNA, 17 nt, Human
cugcauuuagcacaaaa

SEQ ID NO: 3656301 - RNA, 18 nt, Human
cugcauuuagcacaaaaa

SEQ ID NO: 3656302 - RNA, 14 nt, Human
cugcauuucugagu

SEQ ID NO: 3656303 - RNA, 17 nt, Human
cugcauuugucuggccu

SEQ ID NO: 3656304 - RNA, 17 nt, Human
cugcauuugugaaauga

SEQ ID NO: 3656305 - RNA, 21 nt, Human
cugcauuuuaauuuuaaccaa

SEQ ID NO: 3656306 - RNA, 22 nt, Human
cugcauuuuaauuuuaaccaaa

SEQ ID NO: 3656307 - RNA, 19 nt, Human
cugcauuuuauucuggaug

SEQ ID NO: 3656308 - RNA, 21 nt, Human
cugcauuuucuggguucuggg

SEQ ID NO: 3656309 - RNA, 14 nt, Human
cugcauuuugcuau

SEQ ID NO: 3656310 - RNA, 18 nt, Human
cugcauuuuuagaccauu

SEQ ID NO: 3656311 - RNA, 22 nt, Human
cugccaaaaugcucuagugccu

SEQ ID NO: 3656312 - RNA, 14 nt, Human
cugccaaaggaugu

SEQ ID NO: 3656313 - RNA, 17 nt, Human
cugccaacacgcccggc

SEQ ID NO: 3656314 - RNA, 16 nt, Human
aaauguguuuaaaaca

SEQ ID NO: 3656315 - RNA, 22 nt, Human
aaauguguuuuguuuauuaaau

SEQ ID NO: 3656316 - RNA, 23 nt, Human
aaauguguuuuguuuauuaaaua

SEQ ID NO: 3656317 - RNA, 18 nt, Human
aaauguuaaaaguuuuau

SEQ ID NO: 3656318 - RNA, 12 nt, Human
aaauguuacaua

SEQ ID NO: 3656319 - RNA, 17 nt, Human
aaauguuacauagugua

SEQ ID NO: 3656320 - RNA, 18 nt, Human
aaauguuacauaguguag

SEQ ID NO: 3656321 - RNA, 17 nt, Human
aaauguuaccucugaau

SEQ ID NO: 3656322 - RNA, 19 nt, Human
aaauguuaccucugaauuu

SEQ ID NO: 3656323 - RNA, 16 nt, Human
aaauguuaguuucuug

SEQ ID NO: 3656324 - RNA, 14 nt, Human
aaauguuauuuccc

SEQ ID NO: 3656325 - RNA, 22 nt, Human
aaauguuauuucccuacauuaa

SEQ ID NO: 3656326 - RNA, 20 nt, Human
aaauguuauuuuuuaauuau

SEQ ID NO: 3656327 - RNA, 21 nt, Human
aaauguuauuuuuuaauuauu

SEQ ID NO: 3656328 - RNA, 13 nt, Human
aaauguucacuuu

SEQ ID NO: 3656329 - RNA, 21 nt, Human
aaauguucagaagguugcucu

SEQ ID NO: 3656330 - RNA, 18 nt, Human
aaauguucaucaauuccc

SEQ ID NO: 3656331 - RNA, 17 nt, Human
aaauguucuaaguuucu

SEQ ID NO: 3656332 - RNA, 18 nt, Human
aaauguucuaugguuaug

SEQ ID NO: 3656333 - RNA, 15 nt, Human
aaauguucuguuugc

SEQ ID NO: 3656334 - RNA, 13 nt, Human
aaauguucuucca

SEQ ID NO: 3656335 - RNA, 15 nt, Human
aaauguucuuccagu

SEQ ID NO: 3656336 - RNA, 11 nt, Human
aaauguucuuu

SEQ ID NO: 3656337 - RNA, 15 nt, Human
aaauguucuuugggg

SEQ ID NO: 3656338 - RNA, 12 nt, Human
aaauguugaaua

SEQ ID NO: 3656339 - RNA, 19 nt, Human
aaauguuggauuuauaaau

SEQ ID NO: 3656340 - RNA, 23 nt, Human
aaauguuggauuuauaaaugcua

SEQ ID NO: 3656341 - RNA, 19 nt, Human
aaauguuggucauuuuaug

SEQ ID NO: 3656342 - RNA, 18 nt, Human
cugccucucgguggccag

SEQ ID NO: 3656343 - RNA, 14 nt, Human
cugccucucuagga

SEQ ID NO: 3656344 - RNA, 13 nt, Human
cugccucucugca

SEQ ID NO: 3656345 - RNA, 15 nt, Human
cugccucucugcagg

SEQ ID NO: 3656346 - RNA, 18 nt, Human
cugccucucugcaggucc

SEQ ID NO: 3656347 - RNA, 21 nt, Human
cugccucucugcaggucccua

SEQ ID NO: 3656348 - RNA, 20 nt, Human
cugccucugccugcauucug

SEQ ID NO: 3656349 - RNA, 17 nt, Human
cugccucugccuuagag

SEQ ID NO: 3656350 - RNA, 23 nt, Human
cugccucugccuuagaggagccc

SEQ ID NO: 3656351 - RNA, 19 nt, Human
cugccucuuagacuucugc

SEQ ID NO: 3656352 - RNA, 22 nt, Human
cugccucuuagacuucugcuuu

SEQ ID NO: 3656353 - RNA, 21 nt, Human
cugccucuucccccugcuucc

SEQ ID NO: 3656354 - RNA, 18 nt, Human
cugccucuucccucuucc

SEQ ID NO: 3656355 - RNA, 19 nt, Human
cugccucuucccucuuccu

SEQ ID NO: 3656356 - RNA, 12 nt, Human
cugccucuuccu

SEQ ID NO: 3656357 - RNA, 17 nt, Human
cugccucuucugggagg

SEQ ID NO: 3656358 - RNA, 14 nt, Human
cugccucuuucccu

SEQ ID NO: 3656359 - RNA, 15 nt, Human
cugccugaagucaca

SEQ ID NO: 3656360 - RNA, 16 nt, Human
cugccugaagucacac

SEQ ID NO: 3656361 - RNA, 13 nt, Human
cugccugaauaaa

SEQ ID NO: 3656362 - RNA, 20 nt, Human
cugccugacagagggaugga

SEQ ID NO: 3656363 - RNA, 20 nt, Human
cugccugacauuuggagugu

SEQ ID NO: 3656364 - RNA, 12 nt, Human
cugccugagcuu

SEQ ID NO: 3656365 - RNA, 18 nt, Human
cugccugagggccccucu

SEQ ID NO: 3656366 - RNA, 17 nt, Human
cugccugcaauauuuga

SEQ ID NO: 3656367 - RNA, 19 nt, Human
cugccugcaauauuugaau

SEQ ID NO: 3656368 - RNA, 11 nt, Human
cugcugugcaa

SEQ ID NO: 3656369 - RNA, 21 nt, Human
cugcuguggccaggaggugcc

SEQ ID NO: 3656370 - RNA, 23 nt, Human
cugcugugugcuuuuuuugugug

SEQ ID NO: 3656371 - RNA, 22 nt, Human
cugcuuaaaagaaaauguucac

SEQ ID NO: 3656372 - RNA, 22 nt, Human
cugcuuaaaguugguauuaaua

SEQ ID NO: 3656373 - RNA, 13 nt, Human
cugcuuaacuuca

SEQ ID NO: 3656374 - RNA, 20 nt, Human
cugcuuaacuucacauauug

SEQ ID NO: 3656375 - RNA, 23 nt, Human
cugcuuaaucuucaaagccuucu

SEQ ID NO: 3656376 - RNA, 13 nt, Human
cugcuuaauucaa

SEQ ID NO: 3656377 - RNA, 23 nt, Human
cugcuuagaaauaacagaagaaa

SEQ ID NO: 3656378 - RNA, 18 nt, Human
cugcuuaggagagaccga

SEQ ID NO: 3656379 - RNA, 23 nt, Human
cugcuuaucaauaaaccuguuug

SEQ ID NO: 3656380 - RNA, 19 nt, Human
cugcuucaaauauuucccu

SEQ ID NO: 3656381 - RNA, 21 nt, Human
cugcuucaaggauccugagcc

SEQ ID NO: 3656382 - RNA, 21 nt, Human
cugcuucaauacccaaauccu

SEQ ID NO: 3656383 - RNA, 19 nt, Human
cugcuucaaucccagccua

SEQ ID NO: 3656384 - RNA, 16 nt, Human
cugcuucagccucccg

SEQ ID NO: 3656385 - RNA, 23 nt, Human
cugcuucagccucccgaguagcu

SEQ ID NO: 3656386 - RNA, 21 nt, Human
cugcuucagucccuuccccau

SEQ ID NO: 3656387 - RNA, 21 nt, Human
cugcuucaugcucagcccuga

SEQ ID NO: 3656388 - RNA, 22 nt, Human
cugcuuccaccucaccccacuu

SEQ ID NO: 3656389 - RNA, 23 nt, Human
cugcuuccagugaggcucugccc

SEQ ID NO: 3656390 - RNA, 13 nt, Human
cugcuucccaggu

SEQ ID NO: 3656391 - RNA, 23 nt, Human
cugcuucccagguucaagcgauu

SEQ ID NO: 3656392 - RNA, 14 nt, Human
cugcuucccauccu

SEQ ID NO: 3656393 - RNA, 15 nt, Human
cugcuucccauccua

SEQ ID NO: 3656394 - RNA, 14 nt, Human
cugcuucccucugc

SEQ ID NO: 3656395 - RNA, 23 nt, Human
cugcuucccucugccugucccuc

SEQ ID NO: 3656396 - RNA, 23 nt, Human
cugcuuccgguagggaggcagcc

SEQ ID NO: 3656397 - RNA, 14 nt, Human
cugcuuccuccugg

SEQ ID NO: 3656398 - RNA, 21 nt, Human
cugcuucuaccaacuggaagc

SEQ ID NO: 3656399 - RNA, 23 nt, Human
cugcuucuccaaaaaucugccug

SEQ ID NO: 3656400 - RNA, 16 nt, Human
cugcuucuccagccug

SEQ ID NO: 3656401 - RNA, 19 nt, Human
cugcuucuccauggccacc

SEQ ID NO: 3656402 - RNA, 14 nt, Human
cugcuucucccagg

SEQ ID NO: 3656403 - RNA, 15 nt, Human
cugcuucucccaggc

SEQ ID NO: 3656404 - RNA, 20 nt, Human
cugcuucucccaggcaaggc

SEQ ID NO: 3656405 - RNA, 21 nt, Human
cugcuucucccaggcaaggcu

SEQ ID NO: 3656406 - RNA, 16 nt, Human
cugcuucucugacuuc

SEQ ID NO: 3656407 - RNA, 19 nt, Human
cugcuucucugacuucugc

SEQ ID NO: 3656408 - RNA, 21 nt, Human
cugcuucucugacuucugccu

SEQ ID NO: 3656409 - RNA, 23 nt, Human
cugcuucucugacuucugccugg

SEQ ID NO: 3656410 - RNA, 19 nt, Human
cugcuucucugcccagcuu

SEQ ID NO: 3656411 - RNA, 19 nt, Human
cugcuucugacauaaucca

SEQ ID NO: 3656412 - RNA, 14 nt, Human
cugcuucugcaccu

SEQ ID NO: 3656413 - RNA, 20 nt, Human
cugcuugagcucaggaguuc

SEQ ID NO: 3656414 - RNA, 16 nt, Human
cugcuugaggaaaaca

SEQ ID NO: 3656415 - RNA, 22 nt, Human
cugcuugaggcaacucaucuua

SEQ ID NO: 3656416 - RNA, 21 nt, Human
cugcuugaugaagcaaggaag

SEQ ID NO: 3656417 - RNA, 18 nt, Human
cugcuugccaaggcagag

SEQ ID NO: 3656418 - RNA, 19 nt, Human
cugcuugccaucccucccu

SEQ ID NO: 3656419 - RNA, 22 nt, Human
cugcuugccaucccucccucca

SEQ ID NO: 3656420 - RNA, 20 nt, Human
cugcuugcccuaagcagaaa

SEQ ID NO: 3656421 - RNA, 22 nt, Human
cugcuugcccuaagcagaaagu

SEQ ID NO: 3656422 - RNA, 23 nt, Human
cugcuugccgaaacuggaaguua

SEQ ID NO: 3656423 - RNA, 20 nt, Human
cugcuuggaccucgugcuuu

SEQ ID NO: 3656424 - RNA, 15 nt, Human
cugcuugggcuucau

SEQ ID NO: 3656425 - RNA, 19 nt, Human
cugcuuggggggugaugag

SEQ ID NO: 3656426 - RNA, 14 nt, Human
cugcuuggguggag

SEQ ID NO: 3656427 - RNA, 21 nt, Human
cugcuugucccugcccagaau

SEQ ID NO: 3656428 - RNA, 19 nt, Human
cugcuugugaaaggaaaga

SEQ ID NO: 3656429 - RNA, 20 nt, Human
cugcuuuaaagggccugccu

SEQ ID NO: 3656430 - RNA, 16 nt, Human
cugcuuuagacuugaa

SEQ ID NO: 3656431 - RNA, 19 nt, Human
cugcuuuagacuugaaaag

SEQ ID NO: 3656432 - RNA, 16 nt, Human
cugcuuuagagcuagg

SEQ ID NO: 3656433 - RNA, 12 nt, Human
cugcuuucagau

SEQ ID NO: 3656434 - RNA, 16 nt, Human
cugcuuucagauacug

SEQ ID NO: 3656435 - RNA, 18 nt, Human
cugcuuucagauacugga

SEQ ID NO: 3656436 - RNA, 17 nt, Human
cugcuuuccaaagccaa

SEQ ID NO: 3656437 - RNA, 15 nt, Human
cugcuuuccccugug

SEQ ID NO: 3656438 - RNA, 19 nt, Human
cugcuuuccccugugggga

SEQ ID NO: 3656439 - RNA, 12 nt, Human
cugcuuucuccc

SEQ ID NO: 3656440 - RNA, 11 nt, Human
cugcuuucugu

SEQ ID NO: 3656441 - RNA, 13 nt, Human
cugcuuuggaaau

SEQ ID NO: 3656442 - RNA, 14 nt, Human
cugcuuuggcagug

SEQ ID NO: 3656443 - RNA, 15 nt, Human
cugcuuuggcagugc

SEQ ID NO: 3656444 - RNA, 20 nt, Human
cugcuuugggaagccgugcu

SEQ ID NO: 3656445 - RNA, 18 nt, Human
cugcuuugggcugcccug

SEQ ID NO: 3656446 - RNA, 20 nt, Human
cugcuuugggcugcccuggu

SEQ ID NO: 3656447 - RNA, 22 nt, Human
cugcuuugggcugcccuggugc

SEQ ID NO: 3656448 - RNA, 17 nt, Human
cugcuuuggucuugccc

SEQ ID NO: 3656449 - RNA, 14 nt, Human
cugcuuugucuccu

SEQ ID NO: 3656450 - RNA, 17 nt, Human
cugcuuuguugugugcc

SEQ ID NO: 3656451 - RNA, 23 nt, Human
cugcuuuguugugugccucuagc

SEQ ID NO: 3656452 - RNA, 17 nt, Human
cugcuuuuaacucuaga

SEQ ID NO: 3656453 - RNA, 23 nt, Human
cugcuuuuaacuuuauaaaucca

SEQ ID NO: 3656454 - RNA, 15 nt, Human
cugcuuuuaucucag

SEQ ID NO: 3656455 - RNA, 17 nt, Human
cugcuuuucacugcugc

SEQ ID NO: 3656456 - RNA, 21 nt, Human
cugcuuuucccuaagccaagg

SEQ ID NO: 3656457 - RNA, 18 nt, Human
cugcuuuucccuuuguga

SEQ ID NO: 3656458 - RNA, 22 nt, Human
cugcuuuucccuuugugaguca

SEQ ID NO: 3656459 - RNA, 21 nt, Human
cugcuuuuccuuggggcaggc

SEQ ID NO: 3656460 - RNA, 22 nt, Human
cugcuuuuccuuggggcaggca

SEQ ID NO: 3656461 - RNA, 15 nt, Human
cugcuuuucugcccu

SEQ ID NO: 3656462 - RNA, 16 nt, Human
cugcuuuucugcccug

SEQ ID NO: 3656463 - RNA, 15 nt, Human
cugcuuuuggccugg

SEQ ID NO: 3656464 - RNA, 19 nt, Human
cugcuuuugucuaugggac

SEQ ID NO: 3656465 - RNA, 22 nt, Human
cugcuuuuuaaagaaugcucuu

SEQ ID NO: 3656466 - RNA, 17 nt, Human
cugcuuuuuauggccug

SEQ ID NO: 3656467 - RNA, 14 nt, Human
cugcuuuuugaaau

SEQ ID NO: 3656468 - RNA, 15 nt, Human
cugcuuuuugaaaug

SEQ ID NO: 3656469 - RNA, 16 nt, Human
cugcuuuuugaaauga

SEQ ID NO: 3656470 - RNA, 18 nt, Human
cugcuuuuuggaaaguca

SEQ ID NO: 3656471 - RNA, 17 nt, Human
cugcuuuuuuuuuucca

SEQ ID NO: 3656472 - RNA, 21 nt, Human
cugcuuuuuuuuuuccagcaa

SEQ ID NO: 3656473 - RNA, 15 nt, Human
cuggaaaaaaugagc

SEQ ID NO: 3656474 - RNA, 14 nt, Human
cuggaaaacagaac

SEQ ID NO: 3656475 - RNA, 20 nt, Human
cuggaaaccuuccacccagu

SEQ ID NO: 3656476 - RNA, 23 nt, Human
cuggaaagcuuuucuauuuuaau

SEQ ID NO: 3656477 - RNA, 20 nt, Human
cuggaaaggggagagccugc

SEQ ID NO: 3656478 - RNA, 22 nt, Human
cuggaaaggggagagccugcug

SEQ ID NO: 3656479 - RNA, 23 nt, Human
cuggaaaggggggagcuggggaa

SEQ ID NO: 3656480 - RNA, 23 nt, Human
cuggaaauacuagauuugggaga

SEQ ID NO: 3656481 - RNA, 16 nt, Human
cuggaaauauuaagaa

SEQ ID NO: 3656482 - RNA, 13 nt, Human
cuggaacaauauu

SEQ ID NO: 3656483 - RNA, 17 nt, Human
cuggaacacuaaugagg

SEQ ID NO: 3656484 - RNA, 14 nt, Human
cugccuuguuugga

SEQ ID NO: 3656485 - RNA, 16 nt, Human
cugccuuuagaaaaua

SEQ ID NO: 3656486 - RNA, 22 nt, Human
cugccuuuauuguguuugucau

SEQ ID NO: 3656487 - RNA, 15 nt, Human
cugccuuuccaucca

SEQ ID NO: 3656488 - RNA, 21 nt, Human
cugccuuuccauccauggcca

SEQ ID NO: 3656489 - RNA, 17 nt, Human
cugccuuugacauuuaa

SEQ ID NO: 3656490 - RNA, 14 nt, Human
cugccuuugcacca

SEQ ID NO: 3656491 - RNA, 20 nt, Human
cugccuuugcaccacgggac

SEQ ID NO: 3656492 - RNA, 18 nt, Human
cugccuuugcagaaacag

SEQ ID NO: 3656493 - RNA, 19 nt, Human
cugccuuugcagaaacaga

SEQ ID NO: 3656494 - RNA, 21 nt, Human
cugccuuugcagaaacagauu

SEQ ID NO: 3656495 - RNA, 21 nt, Human
cugccuuugcuccucccaugu

SEQ ID NO: 3656496 - RNA, 20 nt, Human
cugccuuuuaguuccugugc

SEQ ID NO: 3656497 - RNA, 22 nt, Human
cugcgaaguccuauggaaaccc

SEQ ID NO: 3656498 - RNA, 15 nt, Human
cugcgacccuggggg

SEQ ID NO: 3656499 - RNA, 16 nt, Human
cugcgacuuucugccu

SEQ ID NO: 3656500 - RNA, 19 nt, Human
cugcgacuuucugccugga

SEQ ID NO: 3656501 - RNA, 15 nt, Human
cugcgagugguuucu

SEQ ID NO: 3656502 - RNA, 20 nt, Human
cugcgcccaccccgcucugc

SEQ ID NO: 3656503 - RNA, 19 nt, Human
cugcgcccaguccuuccac

SEQ ID NO: 3656504 - RNA, 14 nt, Human
cugcgcccugggcu

SEQ ID NO: 3656505 - RNA, 22 nt, Human
cugcgcccuuaacugcauccag

SEQ ID NO: 3656506 - RNA, 16 nt, Human
cugcgcccuuccccag

SEQ ID NO: 3656507 - RNA, 12 nt, Human
cugcgccugcug

SEQ ID NO: 3656508 - RNA, 13 nt, Human
cugcgcuugcuuu

SEQ ID NO: 3656509 - RNA, 17 nt, Human
cugcgcuugcuuuucug

SEQ ID NO: 3656510 - RNA, 14 nt, Human
cugcggaccccagc

SEQ ID NO: 3656511 - RNA, 15 nt, Human
cugcggaccccagcu

SEQ ID NO: 3656512 - RNA, 16 nt, Human
cugcggaccccagcug

SEQ ID NO: 3656513 - RNA, 20 nt, Human
cugcggaccccagcugugag

SEQ ID NO: 3656514 - RNA, 16 nt, Human
cugcggagcaagagga

SEQ ID NO: 3656515 - RNA, 19 nt, Human
cugcggagcacacuggcuc

SEQ ID NO: 3656516 - RNA, 20 nt, Human
cugcggagcacacuggcuca

SEQ ID NO: 3656517 - RNA, 18 nt, Human
cugcggagugaagagggg

SEQ ID NO: 3656518 - RNA, 23 nt, Human
cugcggagugaagaggggcagcc

SEQ ID NO: 3656519 - RNA, 14 nt, Human
cugcggcaucagau

SEQ ID NO: 3656520 - RNA, 16 nt, Human
cugcggcugcugugug

SEQ ID NO: 3656521 - RNA, 17 nt, Human
cugcgggaugguccugg

SEQ ID NO: 3656522 - RNA, 22 nt, Human
cugcggggcgggcacaccuccu

SEQ ID NO: 3656523 - RNA, 15 nt, Human
cugcgggucacagga

SEQ ID NO: 3656524 - RNA, 21 nt, Human
cugcgggucacaggagggagg

SEQ ID NO: 3656525 - RNA, 23 nt, Human
cugcgggugaacaaagcagccac

SEQ ID NO: 3656526 - RNA, 21 nt, Human
cugcggguggggcuuggggcu

SEQ ID NO: 3656527 - RNA, 15 nt, Human
cugcgguccacccag

SEQ ID NO: 3656528 - RNA, 17 nt, Human
cugcgguccacccagga

SEQ ID NO: 3656529 - RNA, 22 nt, Human
cugcggugcuaucucccccagc

SEQ ID NO: 3656530 - RNA, 11 nt, Human
ccucaggcagg

SEQ ID NO: 3656531 - RNA, 14 nt, Human
ccucaggccugggg

SEQ ID NO: 3656532 - RNA, 21 nt, Human
ccucaggccugggggcugggc

SEQ ID NO: 3656533 - RNA, 23 nt, Human
ccucaggccugggggcugggcag

SEQ ID NO: 3656534 - RNA, 18 nt, Human
ccucaggcugcuggagga

SEQ ID NO: 3656535 - RNA, 23 nt, Human
ccucagggacagagacaccugca

SEQ ID NO: 3656536 - RNA, 17 nt, Human
ccucagggagcagggaa

SEQ ID NO: 3656537 - RNA, 21 nt, Human
ccucagggagcagggaaggcc

SEQ ID NO: 3656538 - RNA, 23 nt, Human
ccucagggaucuugcauucccag

SEQ ID NO: 3656539 - RNA, 11 nt, Human
ccucagggcac

SEQ ID NO: 3656540 - RNA, 14 nt, Human
ccucagggcuccca

SEQ ID NO: 3656541 - RNA, 16 nt, Human
ccucagggcucccagg

SEQ ID NO: 3656542 - RNA, 17 nt, Human
ccucagggcucccaggg

SEQ ID NO: 3656543 - RNA, 18 nt, Human
ccucaggggucugagcuc

SEQ ID NO: 3656544 - RNA, 14 nt, Human
ccucagggucccug

SEQ ID NO: 3656545 - RNA, 22 nt, Human
ccucagggucccugguggcagc

SEQ ID NO: 3656546 - RNA, 20 nt, Human
ccucaggucagggugaggau

SEQ ID NO: 3656547 - RNA, 16 nt, Human
ccucaggugagaagca

SEQ ID NO: 3656548 - RNA, 20 nt, Human
ccucaggugagaagcagagg

SEQ ID NO: 3656549 - RNA, 22 nt, Human
ccucaggugagaagcagaggaa

SEQ ID NO: 3656550 - RNA, 19 nt, Human
ccucaggugauccacccac

SEQ ID NO: 3656551 - RNA, 22 nt, Human
ccucaggugauccacccaccuc

SEQ ID NO: 3656552 - RNA, 21 nt, Human
ccucagguggccagccuggau

SEQ ID NO: 3656553 - RNA, 21 nt, Human
ccucagguggccaugccucag

SEQ ID NO: 3656554 - RNA, 22 nt, Human
ccucagguugcugguugcugug

SEQ ID NO: 3656555 - RNA, 23 nt, Human
ccucagguugcugguugcugugu

SEQ ID NO: 3656556 - RNA, 18 nt, Human
ccucaguagucccugcac

SEQ ID NO: 3656557 - RNA, 16 nt, Human
ccucaguauauuuaaa

SEQ ID NO: 3656558 - RNA, 19 nt, Human
ccucaguauauuuaaacuc

SEQ ID NO: 3656559 - RNA, 18 nt, Human
ccucaguccuccccucac

SEQ ID NO: 3656560 - RNA, 20 nt, Human
ccucaguccuccccucacag

SEQ ID NO: 3656561 - RNA, 23 nt, Human
ccucaguccuccccucacagccu

SEQ ID NO: 3656562 - RNA, 24 nt, Human
ccucaguccuccccucacagccuc

SEQ ID NO: 3656563 - RNA, 14 nt, Human
ccucagucucccuc

SEQ ID NO: 3656564 - RNA, 21 nt, Human
ccucagugacccuggcuccuu

SEQ ID NO: 3656565 - RNA, 21 nt, Human
ccucaguggacuuuccacccc

SEQ ID NO: 3656566 - RNA, 15 nt, Human
ccucaguuucccuau

SEQ ID NO: 3656567 - RNA, 13 nt, Human
ccucauacccacc

SEQ ID NO: 3656568 - RNA, 17 nt, Human
ccucauagcccucaccc

SEQ ID NO: 3656569 - RNA, 18 nt, Human
ccucauagcccucacccu

SEQ ID NO: 3656570 - RNA, 22 nt, Human
ccucauagcccucacccugggg

SEQ ID NO: 3656571 - RNA, 13 nt, Human
ccucaucaggaug

SEQ ID NO: 3656572 - RNA, 15 nt, Human
ccucaucaucagagc

SEQ ID NO: 3656573 - RNA, 14 nt, Human
ccucaucccgagca

SEQ ID NO: 3656574 - RNA, 13 nt, Human
ccucauccucaua

SEQ ID NO: 3656575 - RNA, 21 nt, Human
ccucaucgcguccuccuaccg

SEQ ID NO: 3656576 - RNA, 21 nt, Human
ccucaucuaugaggaaagguu

SEQ ID NO: 3656577 - RNA, 20 nt, Human
ccucaucucucugcccaacc

SEQ ID NO: 3656578 - RNA, 20 nt, Human
ccucaucugggggaguggaa

SEQ ID NO: 3656579 - RNA, 15 nt, Human
ccucaucuucuucac

SEQ ID NO: 3656580 - RNA, 18 nt, Human
ccucaucuucuucaccau

SEQ ID NO: 3656581 - RNA, 15 nt, Human
ccucaugaauguaaa

SEQ ID NO: 3656582 - RNA, 20 nt, Human
ccucaugaauguaaauuugu

SEQ ID NO: 3656583 - RNA, 13 nt, Human
ccucaugcccacc

SEQ ID NO: 3656584 - RNA, 13 nt, Human
ccucaugcugcca

SEQ ID NO: 3656585 - RNA, 15 nt, Human
ccucaugcugccaau

SEQ ID NO: 3656586 - RNA, 18 nt, Human
ccucauggccccucugac

SEQ ID NO: 3656587 - RNA, 19 nt, Human
ccucaugguggguucaggg

SEQ ID NO: 3656588 - RNA, 21 nt, Human
ccucauguacauacccuggcc

SEQ ID NO: 3656589 - RNA, 15 nt, Human
ccucauguggcugga

SEQ ID NO: 3656590 - RNA, 17 nt, Human
ccucauguggcuggaag

SEQ ID NO: 3656591 - RNA, 18 nt, Human
ccucauguggcuggaaga

SEQ ID NO: 3656592 - RNA, 23 nt, Human
ccucauguggcuggaagauccug

SEQ ID NO: 3656593 - RNA, 19 nt, Human
ccucauguucuuaauucuu

SEQ ID NO: 3656594 - RNA, 17 nt, Human
ccucauguuuaugaaaa

SEQ ID NO: 3656595 - RNA, 18 nt, Human
ccucauguuuaugaaaau

SEQ ID NO: 3656596 - RNA, 16 nt, Human
ccucauuacugggccu

SEQ ID NO: 3656597 - RNA, 22 nt, Human
ccucauuacuuuaccaccccca

SEQ ID NO: 3656598 - RNA, 22 nt, Human
ccucauucaggaaaacugacag

SEQ ID NO: 3656599 - RNA, 21 nt, Human
ccucauucccucgucuuuccc

SEQ ID NO: 3656600 - RNA, 19 nt, Human
ccucauugacaagaacuga

SEQ ID NO: 3656601 - RNA, 19 nt, Human
ccucauuuaucccucaacc

SEQ ID NO: 3656602 - RNA, 20 nt, Human
ccucauuuaucccucaaccc

SEQ ID NO: 3656603 - RNA, 21 nt, Human
ccucauuuuuauaaugucccu

SEQ ID NO: 3656604 - RNA, 19 nt, Human
ccuccaaaacuccugcccc

SEQ ID NO: 3656605 - RNA, 16 nt, Human
ccuccaaaggcccccu

SEQ ID NO: 3656606 - RNA, 20 nt, Human
ccuccaaauggagaagcugc

SEQ ID NO: 3656607 - RNA, 21 nt, Human
ccuccaaauggagaagcugca

SEQ ID NO: 3656608 - RNA, 23 nt, Human
ccuccaacacaaggcuccaagac

SEQ ID NO: 3656609 - RNA, 19 nt, Human
ccuccaacaccaagcacag

SEQ ID NO: 3656610 - RNA, 16 nt, Human
ccuccaaccccucgcc

SEQ ID NO: 3656611 - RNA, 20 nt, Human
ccuccaaccccucgcccagu

SEQ ID NO: 3656612 - RNA, 19 nt, Human
ccuccaaccuggggggcag

SEQ ID NO: 3656613 - RNA, 17 nt, Human
ccuccaagaaucuaucu

SEQ ID NO: 3656614 - RNA, 17 nt, Human
ccuccaagaccuucucc

SEQ ID NO: 3656615 - RNA, 21 nt, Human
ccuccaagcuccaucuccacu

SEQ ID NO: 3656616 - RNA, 20 nt, Human
ccuccaaggaggggcuguaa

SEQ ID NO: 3656617 - RNA, 16 nt, Human
ccuccacacaagggaa

SEQ ID NO: 3656618 - RNA, 21 nt, Human
ccuccacacaagggaaggaca

SEQ ID NO: 3656619 - RNA, 13 nt, Human
ccuccacagcgag

SEQ ID NO: 3656620 - RNA, 23 nt, Human
ccuccacagcgagggcagcugcu

SEQ ID NO: 3656621 - RNA, 12 nt, Human
ccuccacagcuu

SEQ ID NO: 3656622 - RNA, 23 nt, Human
ccuccacaguucgaccugcggcu

SEQ ID NO: 3656623 - RNA, 20 nt, Human
ccuccacauccuccacguuc

SEQ ID NO: 3656624 - RNA, 15 nt, Human
ccuccacauuuguuu

SEQ ID NO: 3656625 - RNA, 19 nt, Human
ccuccaccaccacuggcca

SEQ ID NO: 3656626 - RNA, 19 nt, Human
cuggaggucacauucagga

SEQ ID NO: 3656627 - RNA, 16 nt, Human
cuggaggugccagcaa

SEQ ID NO: 3656628 - RNA, 19 nt, Human
cuggaggugccagcaaagc

SEQ ID NO: 3656629 - RNA, 22 nt, Human
cuggaggugccagcaaagcccc

SEQ ID NO: 3656630 - RNA, 20 nt, Human
cuggagguggcugagccccu

SEQ ID NO: 3656631 - RNA, 17 nt, Human
cuggaggugggagcagg

SEQ ID NO: 3656632 - RNA, 20 nt, Human
cuggaggugggagcaggaga

SEQ ID NO: 3656633 - RNA, 21 nt, Human
cuggaggugggagcaggagau

SEQ ID NO: 3656634 - RNA, 15 nt, Human
cuggaggugggguug

SEQ ID NO: 3656635 - RNA, 17 nt, Human
cuggagguugaagccaa

SEQ ID NO: 3656636 - RNA, 12 nt, Human
cuggagguuugu

SEQ ID NO: 3656637 - RNA, 15 nt, Human
cuggagucaaaacac

SEQ ID NO: 3656638 - RNA, 18 nt, Human
cuggagucaucauucccu

SEQ ID NO: 3656639 - RNA, 18 nt, Human
cuggagucccaaauguca

SEQ ID NO: 3656640 - RNA, 14 nt, Human
cuggagucccugug

SEQ ID NO: 3656641 - RNA, 13 nt, Human
cuggagucuggag

SEQ ID NO: 3656642 - RNA, 18 nt, Human
cuggagucuggagugggc

SEQ ID NO: 3656643 - RNA, 24 nt, Human
cuggaguggccacuaagcagagga

SEQ ID NO: 3656644 - RNA, 16 nt, Human
cuggagugggcagagc

SEQ ID NO: 3656645 - RNA, 23 nt, Human
cuggagugugaggguccugcagc

SEQ ID NO: 3656646 - RNA, 18 nt, Human
cuggaguguggcugagga

SEQ ID NO: 3656647 - RNA, 21 nt, Human
cuggaguguggcugaggaggc

SEQ ID NO: 3656648 - RNA, 15 nt, Human
cuggaguucugguuc

SEQ ID NO: 3656649 - RNA, 17 nt, Human
cuggaguugaucuggaa

SEQ ID NO: 3656650 - RNA, 22 nt, Human
cuggaguugaucuggaacccag

SEQ ID NO: 3656651 - RNA, 13 nt, Human
cuggaguugucac

SEQ ID NO: 3656652 - RNA, 23 nt, Human
cuggaguuuuuguuuggagagca

SEQ ID NO: 3656653 - RNA, 13 nt, Human
cuggauaaaauga

SEQ ID NO: 3656654 - RNA, 15 nt, Human
cuggauaacuuaggu

SEQ ID NO: 3656655 - RNA, 13 nt, Human
cuggauagugaag

SEQ ID NO: 3656656 - RNA, 24 nt, Human
cuggaucacgacgcugcagagcac

SEQ ID NO: 3656657 - RNA, 13 nt, Human
cuggaucagcgug

SEQ ID NO: 3656658 - RNA, 17 nt, Human
cuggaucagcguggccu

SEQ ID NO: 3656659 - RNA, 23 nt, Human
cuggaucaguaaaauuauacugu

SEQ ID NO: 3656660 - RNA, 17 nt, Human
cuggaucaguccuuuga

SEQ ID NO: 3656661 - RNA, 21 nt, Human
cuggaucaguccuuugaucag

SEQ ID NO: 3656662 - RNA, 15 nt, Human
cuggaucuaccugga

SEQ ID NO: 3656663 - RNA, 17 nt, Human
cuggaucucccagggcu

SEQ ID NO: 3656664 - RNA, 15 nt, Human
cuggaucuguuccuu

SEQ ID NO: 3656665 - RNA, 13 nt, Human
cuggaugaagauu

SEQ ID NO: 3656666 - RNA, 23 nt, Human
cuggaugaagauucuccugugcu

SEQ ID NO: 3656667 - RNA, 13 nt, Human
cuggaugagacuu

SEQ ID NO: 3656668 - RNA, 14 nt, Human
cuggaugauacuaa

SEQ ID NO: 3656669 - RNA, 16 nt, Human
cuggaugauggauucc

SEQ ID NO: 3656670 - RNA, 18 nt, Human
cuggaugcagccucacag

SEQ ID NO: 3656671 - RNA, 14 nt, Human
cuggaugcauuucu

SEQ ID NO: 3656672 - RNA, 14 nt, Human
cuggaugcccagga

SEQ ID NO: 3656673 - RNA, 18 nt, Human
cuggaugcccccugugga

SEQ ID NO: 3656674 - RNA, 18 nt, Human
cuggauggagcccaggcg

SEQ ID NO: 3656675 - RNA, 23 nt, Human
cuggauggagcccaggcgggagc

SEQ ID NO: 3656676 - RNA, 23 nt, Human
cuggauggcaccagaggcugcag

SEQ ID NO: 3656677 - RNA, 15 nt, Human
cuggauggggcugca

SEQ ID NO: 3656678 - RNA, 20 nt, Human
cuggaugguucccagagggu

SEQ ID NO: 3656679 - RNA, 18 nt, Human
cuggauucagccuucuuu

SEQ ID NO: 3656680 - RNA, 22 nt, Human
cuggauucagccuucuuuuucu

SEQ ID NO: 3656681 - RNA, 22 nt, Human
cuggauugaucggagccuccuc

SEQ ID NO: 3656682 - RNA, 20 nt, Human
cuggcaaaaggaucuuugug

SEQ ID NO: 3656683 - RNA, 19 nt, Human
cuggcaaacagggccucug

SEQ ID NO: 3656684 - RNA, 20 nt, Human
cuggcaaacagggccucugc

SEQ ID NO: 3656685 - RNA, 21 nt, Human
cuggcaaacagggccucugcg

SEQ ID NO: 3656686 - RNA, 23 nt, Human
cuggcaaacagggccucugcgga

SEQ ID NO: 3656687 - RNA, 16 nt, Human
cuggcaaacaugaaaa

SEQ ID NO: 3656688 - RNA, 18 nt, Human
cuggcaaagaugaucagu

SEQ ID NO: 3656689 - RNA, 19 nt, Human
cuggcaaagcuuuuagaaa

SEQ ID NO: 3656690 - RNA, 12 nt, Human
cuggcaaaggcc

SEQ ID NO: 3656691 - RNA, 22 nt, Human
cuggcaaagggagcagaacuga

SEQ ID NO: 3656692 - RNA, 18 nt, Human
cuggcaaagguggcucuc

SEQ ID NO: 3656693 - RNA, 22 nt, Human
cuggcaaagguggcucuccagu

SEQ ID NO: 3656694 - RNA, 13 nt, Human
cuggcaagaaugg

SEQ ID NO: 3656695 - RNA, 14 nt, Human
cuggcaagaaugug

SEQ ID NO: 3656696 - RNA, 22 nt, Human
cuggcaaugaaaaauucucagu

SEQ ID NO: 3656697 - RNA, 22 nt, Human
cuggcaauggaugaacugaaag

SEQ ID NO: 3656698 - RNA, 18 nt, Human
cuggcaauugucuauuua

SEQ ID NO: 3656699 - RNA, 21 nt, Human
cuggcacacaguaggugcuca

SEQ ID NO: 3656700 - RNA, 15 nt, Human
cuggcacagaaaccu

SEQ ID NO: 3656701 - RNA, 12 nt, Human
cuggcacagagg

SEQ ID NO: 3656702 - RNA, 15 nt, Human
cuggcacagccuggc

SEQ ID NO: 3656703 - RNA, 14 nt, Human
cuggcacagugucu

SEQ ID NO: 3656704 - RNA, 15 nt, Human
cuggcacagugucug

SEQ ID NO: 3656705 - RNA, 20 nt, Human
cuggcacagugucugggcug

SEQ ID NO: 3656706 - RNA, 18 nt, Human
cuggcacaguuuucugag

SEQ ID NO: 3656707 - RNA, 21 nt, Human
cuggcacaguuuucugagaaa

SEQ ID NO: 3656708 - RNA, 22 nt, Human
cuggcacauuuccccagaccug

SEQ ID NO: 3656709 - RNA, 17 nt, Human
cuggcacccggccccug

SEQ ID NO: 3656710 - RNA, 18 nt, Human
cuggcacccggccccugc

SEQ ID NO: 3656711 - RNA, 20 nt, Human
cuggcacccggccccugcug

SEQ ID NO: 3656712 - RNA, 17 nt, Human
cuggcaccgccuucucu

SEQ ID NO: 3656713 - RNA, 15 nt, Human
cuggcacuauaaugu

SEQ ID NO: 3656714 - RNA, 16 nt, Human
cuggcacuauaaugua

SEQ ID NO: 3656715 - RNA, 23 nt, Human
cuggcacuauaauguaagcucua

SEQ ID NO: 3656716 - RNA, 14 nt, Human
cuggcacugcuucc

SEQ ID NO: 3656717 - RNA, 15 nt, Human
cuggcacugcuucca

SEQ ID NO: 3656718 - RNA, 18 nt, Human
cuggcacugcuuccagug

SEQ ID NO: 3656719 - RNA, 19 nt, Human
cuggcacuggaccccagca

SEQ ID NO: 3656720 - RNA, 22 nt, Human
cuggcacuggcaaacagggccu

SEQ ID NO: 3656721 - RNA, 22 nt, Human
cuggcacugguuuguucccugu

SEQ ID NO: 3656722 - RNA, 15 nt, Human
cuggcagacugugua

SEQ ID NO: 3656723 - RNA, 20 nt, Human
cuggcagagaugccucccug

SEQ ID NO: 3656724 - RNA, 14 nt, Human
cuggcagaggaggg

SEQ ID NO: 3656725 - RNA, 19 nt, Human
cuggcagaguugaagacag

SEQ ID NO: 3656726 - RNA, 22 nt, Human
cuggcagaguugaagacagagc

SEQ ID NO: 3656727 - RNA, 15 nt, Human
cuggcagcagagugu

SEQ ID NO: 3656728 - RNA, 12 nt, Human
cuggcagccaca

SEQ ID NO: 3656729 - RNA, 23 nt, Human
cuggcagccacacuucucaggac

SEQ ID NO: 3656730 - RNA, 16 nt, Human
cuggcagcccagagac

SEQ ID NO: 3656731 - RNA, 18 nt, Human
cuggcagccccagcacca

SEQ ID NO: 3656732 - RNA, 12 nt, Human
cuggcucugagc

SEQ ID NO: 3656733 - RNA, 18 nt, Human
cuggcucugcaaugggca

SEQ ID NO: 3656734 - RNA, 12 nt, Human
cuggcucuguga

SEQ ID NO: 3656735 - RNA, 14 nt, Human
cuggcucuguggcu

SEQ ID NO: 3656736 - RNA, 15 nt, Human
cuggcucuguggcuu

SEQ ID NO: 3656737 - RNA, 18 nt, Human
cuggcucuguggcuugcu

SEQ ID NO: 3656738 - RNA, 20 nt, Human
cuggcucuuccaggcuggga

SEQ ID NO: 3656739 - RNA, 22 nt, Human
cuggcucuuccaggcugggaga

SEQ ID NO: 3656740 - RNA, 13 nt, Human
cuggcugaacccu

SEQ ID NO: 3656741 - RNA, 18 nt, Human
cuggcugaacccugugcu

SEQ ID NO: 3656742 - RNA, 13 nt, Human
cuggcugaaggac

SEQ ID NO: 3656743 - RNA, 19 nt, Human
cuggcugagguuccucugc

SEQ ID NO: 3656744 - RNA, 23 nt, Human
cuggcugcagagcagugggccug

SEQ ID NO: 3656745 - RNA, 13 nt, Human
cuggcugcccaga

SEQ ID NO: 3656746 - RNA, 19 nt, Human
cuggcugccccaaccugcu

SEQ ID NO: 3656747 - RNA, 20 nt, Human
cuggcugccccaaccugcug

SEQ ID NO: 3656748 - RNA, 18 nt, Human
cuggcugcccuggcccug

SEQ ID NO: 3656749 - RNA, 23 nt, Human
cuggcugcccuggcccugaggug

SEQ ID NO: 3656750 - RNA, 19 nt, Human
cuggcuggccuuguggucc

SEQ ID NO: 3656751 - RNA, 14 nt, Human
cuggcuggcugagg

SEQ ID NO: 3656752 - RNA, 17 nt, Human
cuggcuggcugagggca

SEQ ID NO: 3656753 - RNA, 12 nt, Human
cuggcugggacg

SEQ ID NO: 3656754 - RNA, 16 nt, Human
cuggcugggacguggc

SEQ ID NO: 3656755 - RNA, 17 nt, Human
cuggcugggcauggacg

SEQ ID NO: 3656756 - RNA, 13 nt, Human
cuggcuggggccu

SEQ ID NO: 3656757 - RNA, 19 nt, Human
cuggcugguaagggccaag

SEQ ID NO: 3656758 - RNA, 17 nt, Human
cuggcugguagagcagg

SEQ ID NO: 3656759 - RNA, 12 nt, Human
cuggcugguguu

SEQ ID NO: 3656760 - RNA, 18 nt, Human
cuggcugguguuaacaga

SEQ ID NO: 3656761 - RNA, 21 nt, Human
cuggcuguacugcucaggcug

SEQ ID NO: 3656762 - RNA, 19 nt, Human
cuggcugucaguaugacau

SEQ ID NO: 3656763 - RNA, 15 nt, Human
cuggcugugggcucc

SEQ ID NO: 3656764 - RNA, 18 nt, Human
cuggcugugggcucccuu

SEQ ID NO: 3656765 - RNA, 21 nt, Human
cuggcugugggcucccuuccu

SEQ ID NO: 3656766 - RNA, 22 nt, Human
cuggcugugggcucccuuccuc

SEQ ID NO: 3656767 - RNA, 14 nt, Human
cuggcuuacacugg

SEQ ID NO: 3656768 - RNA, 16 nt, Human
cuggcuucccaucccc

SEQ ID NO: 3656769 - RNA, 18 nt, Human
cuggcuuccuucucucaa

SEQ ID NO: 3656770 - RNA, 23 nt, Human
cuggcauuacaggugugagccac

SEQ ID NO: 3656771 - RNA, 22 nt, Human
cuggcauuagaauuauuuaaac

SEQ ID NO: 3656772 - RNA, 19 nt, Human
cuggcauuauguccacugu

SEQ ID NO: 3656773 - RNA, 17 nt, Human
cuggcauucuuguacag

SEQ ID NO: 3656774 - RNA, 17 nt, Human
cuggccaacaugguaaa

SEQ ID NO: 3656775 - RNA, 16 nt, Human
cuggccaacgggguga

SEQ ID NO: 3656776 - RNA, 22 nt, Human
cuggccaagcugaggugcccag

SEQ ID NO: 3656777 - RNA, 23 nt, Human
cuggccaagcugaggugcccagg

SEQ ID NO: 3656778 - RNA, 13 nt, Human
cuggccaccaccc

SEQ ID NO: 3656779 - RNA, 17 nt, Human
cuggccaccugaggugg

SEQ ID NO: 3656780 - RNA, 18 nt, Human
cuggccaccugagguggg

SEQ ID NO: 3656781 - RNA, 18 nt, Human
cuggccacgcagccagga

SEQ ID NO: 3656782 - RNA, 20 nt, Human
cuggccacgcagccaggaca

SEQ ID NO: 3656783 - RNA, 19 nt, Human
cuggccacugcacagagcu

SEQ ID NO: 3656784 - RNA, 21 nt, Human
cuggccacugcacagagcucu

SEQ ID NO: 3656785 - RNA, 13 nt, Human
cuggccagaaugc

SEQ ID NO: 3656786 - RNA, 13 nt, Human
cuggccagacaca

SEQ ID NO: 3656787 - RNA, 13 nt, Human
cuggccagacucg

SEQ ID NO: 3656788 - RNA, 18 nt, Human
cuggccagaugcaccagc

SEQ ID NO: 3656789 - RNA, 21 nt, Human
cuggccagaugcaccagcccu

SEQ ID NO: 3656790 - RNA, 21 nt, Human
cuggccagccccacagcccac

SEQ ID NO: 3656791 - RNA, 13 nt, Human
cuggccagccgcu

SEQ ID NO: 3656792 - RNA, 13 nt, Human
cuggccagccugg

SEQ ID NO: 3656793 - RNA, 21 nt, Human
cuggccagccuggggccuggc

SEQ ID NO: 3656794 - RNA, 12 nt, Human
cuggccaggagc

SEQ ID NO: 3656795 - RNA, 15 nt, Human
cuggccaggagcagg

SEQ ID NO: 3656796 - RNA, 23 nt, Human
cuggccaggagcaggcacgggug

SEQ ID NO: 3656797 - RNA, 13 nt, Human
cuggccagggcca

SEQ ID NO: 3656798 - RNA, 22 nt, Human
cuggccagggccacgcuccagc

SEQ ID NO: 3656799 - RNA, 23 nt, Human
cuggccagggccacgcuccagcu

SEQ ID NO: 3656800 - RNA, 14 nt, Human
cuggccagggccug

SEQ ID NO: 3656801 - RNA, 16 nt, Human
cuggccagggccugga

SEQ ID NO: 3656802 - RNA, 23 nt, Human
cuggccagggccuggaagacaga

SEQ ID NO: 3656803 - RNA, 20 nt, Human
cuggccaguccacccugccu

SEQ ID NO: 3656804 - RNA, 21 nt, Human
cuggccaguccaggcugccgu

SEQ ID NO: 3656805 - RNA, 22 nt, Human
cuggccaguccaggcugccgug

SEQ ID NO: 3656806 - RNA, 17 nt, Human
cuggccaguuggaacca

SEQ ID NO: 3656807 - RNA, 16 nt, Human
cuggccauacuguguc

SEQ ID NO: 3656808 - RNA, 17 nt, Human
cuggccaucccucgugg

SEQ ID NO: 3656809 - RNA, 22 nt, Human
cuggccaucucugaacuucagc

SEQ ID NO: 3656810 - RNA, 18 nt, Human
cuggccauggagaaagcu

SEQ ID NO: 3656811 - RNA, 15 nt, Human
cuggccauggccugc

SEQ ID NO: 3656812 - RNA, 18 nt, Human
cuggcccacagcaggugc

SEQ ID NO: 3656813 - RNA, 16 nt, Human
cuggcccaccccaccc

SEQ ID NO: 3656814 - RNA, 12 nt, Human
cuggcccacugc

SEQ ID NO: 3656815 - RNA, 13 nt, Human
cuggcccagcccu

SEQ ID NO: 3656816 - RNA, 15 nt, Human
cuggcccagcccugc

SEQ ID NO: 3656817 - RNA, 17 nt, Human
cuggcccagcccugcug

SEQ ID NO: 3656818 - RNA, 22 nt, Human
cuggcccagcccugcuggccgc

SEQ ID NO: 3656819 - RNA, 19 nt, Human
cuggcccagccggccucuc

SEQ ID NO: 3656820 - RNA, 21 nt, Human
cuggcccagccggccucucug

SEQ ID NO: 3656821 - RNA, 21 nt, Human
cuggcccagccuuuguucccc

SEQ ID NO: 3656822 - RNA, 12 nt, Human
cuggcccagcgg

SEQ ID NO: 3656823 - RNA, 18 nt, Human
cuggcccagcggccccuc

SEQ ID NO: 3656824 - RNA, 13 nt, Human
cuggcccagggca

SEQ ID NO: 3656825 - RNA, 14 nt, Human
cuggcccagggccc

SEQ ID NO: 3656826 - RNA, 20 nt, Human
cuggcccagggcccagagcc

SEQ ID NO: 3656827 - RNA, 21 nt, Human
cuggcccagggcccagagccc

SEQ ID NO: 3656828 - RNA, 22 nt, Human
cuggcccagggcccagagccca

SEQ ID NO: 3656829 - RNA, 17 nt, Human
cuggcccauagaaacau

SEQ ID NO: 3656830 - RNA, 21 nt, Human
cuggcccauagaaacaugaca

SEQ ID NO: 3656831 - RNA, 12 nt, Human
cuggccccacac

SEQ ID NO: 3656832 - RNA, 23 nt, Human
cuggccccacccucguggacacc

SEQ ID NO: 3656833 - RNA, 12 nt, Human
cuggccccagcc

SEQ ID NO: 3656834 - RNA, 16 nt, Human
cuggccccagcccugc

SEQ ID NO: 3656835 - RNA, 19 nt, Human
cuggccccagcccugcugg

SEQ ID NO: 3656836 - RNA, 21 nt, Human
cuggccccaggaccuggcugc

SEQ ID NO: 3656837 - RNA, 18 nt, Human
cuggccccagggcacccu

SEQ ID NO: 3656838 - RNA, 20 nt, Human
cuggccccagguagaaacuu

SEQ ID NO: 3656839 - RNA, 16 nt, Human
cuggccccaugucucu

SEQ ID NO: 3656840 - RNA, 14 nt, Human
cuggcccccacugg

SEQ ID NO: 3656841 - RNA, 15 nt, Human
cuggcccccucccug

SEQ ID NO: 3656842 - RNA, 16 nt, Human
cuggcccccucccugg

SEQ ID NO: 3656843 - RNA, 20 nt, Human
cuggcccccucccuggauga

SEQ ID NO: 3656844 - RNA, 21 nt, Human
cuggccccggaucagagcagg

SEQ ID NO: 3656845 - RNA, 18 nt, Human
cuggccccucaaccuccu

SEQ ID NO: 3656846 - RNA, 20 nt, Human
cuggccccucagggucccug

SEQ ID NO: 3656847 - RNA, 23 nt, Human
cuggccccuuugggcccugcaug

SEQ ID NO: 3656848 - RNA, 16 nt, Human
cuggcccgugacagac

SEQ ID NO: 3656849 - RNA, 24 nt, Human
cuggcccucaaggccucccacagu

SEQ ID NO: 3656850 - RNA, 17 nt, Human
cuggcccucaccccugc

SEQ ID NO: 3656851 - RNA, 21 nt, Human
cuggcccucaccccugcccug

SEQ ID NO: 3656852 - RNA, 22 nt, Human
cuggcccucaccccugcccugg

SEQ ID NO: 3656853 - RNA, 16 nt, Human
cuggcccucaguuucc

SEQ ID NO: 3656854 - RNA, 12 nt, Human
cuggcccucuuc

SEQ ID NO: 3656855 - RNA, 15 nt, Human
cuggcccucuucuua

SEQ ID NO: 3656856 - RNA, 23 nt, Human
cuggcccugcuuccugcuugcca

SEQ ID NO: 3656857 - RNA, 13 nt, Human
cuggcccuggggc

SEQ ID NO: 3656858 - RNA, 16 nt, Human
cuggcccuggggccug

SEQ ID NO: 3656859 - RNA, 13 nt, Human
cuggcccugugcc

SEQ ID NO: 3656860 - RNA, 21 nt, Human
cuggcccuugcuuaccucuca

SEQ ID NO: 3656861 - RNA, 17 nt, Human
cuggccgaguccaagcu

SEQ ID NO: 3656862 - RNA, 23 nt, Human
cuggccgaguccaagcugggaga

SEQ ID NO: 3656863 - RNA, 14 nt, Human
cuggccgcccccug

SEQ ID NO: 3656864 - RNA, 18 nt, Human
cuggccgcggagccugca

SEQ ID NO: 3656865 - RNA, 21 nt, Human
cuggccggagcaaacucugcu

SEQ ID NO: 3656866 - RNA, 22 nt, Human
cuggccggagcaaacucugcug

SEQ ID NO: 3656867 - RNA, 18 nt, Human
cuggccggagucagugcc

SEQ ID NO: 3656868 - RNA, 15 nt, Human
cuggccggccagcca

SEQ ID NO: 3656869 - RNA, 16 nt, Human
cuggccgggcacagcu

SEQ ID NO: 3656870 - RNA, 17 nt, Human
cuggccgggcacagcug

SEQ ID NO: 3656871 - RNA, 22 nt, Human
cuggccggucugcaagucagag

SEQ ID NO: 3656872 - RNA, 23 nt, Human
cuggccggucugcaagucagagg

SEQ ID NO: 3656873 - RNA, 15 nt, Human
cuggccguccuuguc

SEQ ID NO: 3656874 - RNA, 20 nt, Human
cuggccuaaaaucuuggaag

SEQ ID NO: 3656875 - RNA, 21 nt, Human
cuggccuaaaaucuuggaagu

SEQ ID NO: 3656876 - RNA, 19 nt, Human
cuggccuagaccagcagac

SEQ ID NO: 3656877 - RNA, 22 nt, Human
cuggccuagaccagcagacaga

SEQ ID NO: 3656878 - RNA, 21 nt, Human
cuggccuaggagauaucugag

SEQ ID NO: 3656879 - RNA, 21 nt, Human
cuggccucaaagcaagcauuc

SEQ ID NO: 3656880 - RNA, 21 nt, Human
cuggccucagacugcacccag

SEQ ID NO: 3656881 - RNA, 23 nt, Human
cuggccucagacugcacccagga

SEQ ID NO: 3656882 - RNA, 13 nt, Human
cuggccuccacag

SEQ ID NO: 3656883 - RNA, 23 nt, Human
cuggccuccaggcccgucugucc

SEQ ID NO: 3656884 - RNA, 14 nt, Human
cuggccucccaaau

SEQ ID NO: 3656885 - RNA, 12 nt, Human
cuggccucccac

SEQ ID NO: 3656886 - RNA, 19 nt, Human
cuggccucccacagacuca

SEQ ID NO: 3656887 - RNA, 17 nt, Human
cuggccucccacccgau

SEQ ID NO: 3656888 - RNA, 15 nt, Human
cuggccucccccacu

SEQ ID NO: 3656889 - RNA, 18 nt, Human
cuggccuccccugccacc

SEQ ID NO: 3656890 - RNA, 19 nt, Human
cugggauuacaggcuccug

SEQ ID NO: 3656891 - RNA, 22 nt, Human
cugggauuacaggcuccugcca

SEQ ID NO: 3656892 - RNA, 16 nt, Human
cugggauuacaggugu

SEQ ID NO: 3656893 - RNA, 19 nt, Human
cugggauuacaggugugca

SEQ ID NO: 3656894 - RNA, 15 nt, Human
cugggauucccacca

SEQ ID NO: 3656895 - RNA, 14 nt, Human
cugggauuccuccc

SEQ ID NO: 3656896 - RNA, 18 nt, Human
cugggauucuacuuuaag

SEQ ID NO: 3656897 - RNA, 23 nt, Human
cugggauucuacuuuaagcacua

SEQ ID NO: 3656898 - RNA, 14 nt, Human
cugggcaaggaaaa

SEQ ID NO: 3656899 - RNA, 15 nt, Human
cugggcaaggaaaaa

SEQ ID NO: 3656900 - RNA, 18 nt, Human
cugggcaaggaaaaagaa

SEQ ID NO: 3656901 - RNA, 21 nt, Human
cugggcaaggaggccacguga

SEQ ID NO: 3656902 - RNA, 18 nt, Human
cugggcacacgcugcucu

SEQ ID NO: 3656903 - RNA, 21 nt, Human
cugggcacacgcugcucugcc

SEQ ID NO: 3656904 - RNA, 18 nt, Human
cugggcaccacaaaauau

SEQ ID NO: 3656905 - RNA, 21 nt, Human
cugggcacccucccacccggc

SEQ ID NO: 3656906 - RNA, 20 nt, Human
cugggcaccuggggaguggg

SEQ ID NO: 3656907 - RNA, 17 nt, Human
cugggcacugcucucac

SEQ ID NO: 3656908 - RNA, 18 nt, Human
cugggcacugcucucacc

SEQ ID NO: 3656909 - RNA, 13 nt, Human
cugggcacuuccc

SEQ ID NO: 3656910 - RNA, 16 nt, Human
cugggcacuucccugc

SEQ ID NO: 3656911 - RNA, 22 nt, Human
cugggcacuucccugcugccug

SEQ ID NO: 3656912 - RNA, 16 nt, Human
cugggcagaaggaaga

SEQ ID NO: 3656913 - RNA, 14 nt, Human
cugguaagaaaaag

SEQ ID NO: 3656914 - RNA, 15 nt, Human
cugguaagauuguua

SEQ ID NO: 3656915 - RNA, 23 nt, Human
cugguaagauuguuauuaaaugu

SEQ ID NO: 3656916 - RNA, 15 nt, Human
cugguaaucuugcuc

SEQ ID NO: 3656917 - RNA, 17 nt, Human
cugguaauuuguaucug

SEQ ID NO: 3656918 - RNA, 21 nt, Human
cugguaauuuguaucugaagg

SEQ ID NO: 3656919 - RNA, 16 nt, Human
cugguacaacggaggc

SEQ ID NO: 3656920 - RNA, 18 nt, Human
cugguacaacggaggccu

SEQ ID NO: 3656921 - RNA, 19 nt, Human
cugguacaauuucuuuugg

SEQ ID NO: 3656922 - RNA, 21 nt, Human
cugguacaauuucuuuugguu

SEQ ID NO: 3656923 - RNA, 14 nt, Human
cugguacccagcca

SEQ ID NO: 3656924 - RNA, 14 nt, Human
cugguacucaagcc

SEQ ID NO: 3656925 - RNA, 19 nt, Human
cugguacucccucucagga

SEQ ID NO: 3656926 - RNA, 21 nt, Human
cugguacucccucucaggauc

SEQ ID NO: 3656927 - RNA, 22 nt, Human
cugguagaagggaaagcccaua

SEQ ID NO: 3656928 - RNA, 15 nt, Human
cugguagauagaaau

SEQ ID NO: 3656929 - RNA, 16 nt, Human
cugguagcucaggugg

SEQ ID NO: 3656930 - RNA, 18 nt, Human
cugguaggaaagggcaag

SEQ ID NO: 3656931 - RNA, 15 nt, Human
cugguaucucagaaa

SEQ ID NO: 3656932 - RNA, 22 nt, Human
cugguaucucagaaagugccug

SEQ ID NO: 3656933 - RNA, 23 nt, Human
cugguaugaacuugaggacacau

SEQ ID NO: 3656934 - RNA, 15 nt, Human
cugguauggcugcag

SEQ ID NO: 3656935 - RNA, 17 nt, Human
cugguauggcugcaguc

SEQ ID NO: 3656936 - RNA, 13 nt, Human
cugguauuaaaug

SEQ ID NO: 3656937 - RNA, 14 nt, Human
cugguauuccugcc

SEQ ID NO: 3656938 - RNA, 15 nt, Human
cugguauucuguucu

SEQ ID NO: 3656939 - RNA, 17 nt, Human
cugguauuguucucaca

SEQ ID NO: 3656940 - RNA, 14 nt, Human
cugguauuuuaucu

SEQ ID NO: 3656941 - RNA, 22 nt, Human
cuggugucaccccagagccaca

SEQ ID NO: 3656942 - RNA, 18 nt, Human
cuggugucacuuacuguu

SEQ ID NO: 3656943 - RNA, 12 nt, Human
cugguguccuga

SEQ ID NO: 3656944 - RNA, 19 nt, Human
cugguguccugaccacccu

SEQ ID NO: 3656945 - RNA, 21 nt, Human
cugguguccugaccacccucc

SEQ ID NO: 3656946 - RNA, 23 nt, Human
cuggugucugcuuucuccauugu

SEQ ID NO: 3656947 - RNA, 16 nt, Human
cuggugugaacuaaac

SEQ ID NO: 3656948 - RNA, 16 nt, Human
cuggugugaccugagg

SEQ ID NO: 3656949 - RNA, 17 nt, Human
cuggugugguacagaga

SEQ ID NO: 3656950 - RNA, 19 nt, Human
cuggugugguacagagaag

SEQ ID NO: 3656951 - RNA, 13 nt, Human
cugguguuaacag

SEQ ID NO: 3656952 - RNA, 23 nt, Human
cugguguuucuagcacuggccug

SEQ ID NO: 3656953 - RNA, 24 nt, Human
cugguguuucuagcacuggccugc

SEQ ID NO: 3656954 - RNA, 13 nt, Human
cugguguuucuug

SEQ ID NO: 3656955 - RNA, 23 nt, Human
cugguuagaaaugcagaauccua

SEQ ID NO: 3656956 - RNA, 16 nt, Human
cugguuagcucagccc

SEQ ID NO: 3656957 - RNA, 22 nt, Human
cugguuagcucagccccagccc

SEQ ID NO: 3656958 - RNA, 14 nt, Human
cugguuccaggguc

SEQ ID NO: 3656959 - RNA, 15 nt, Human
cugguuccagggucc

SEQ ID NO: 3656960 - RNA, 18 nt, Human
cugguuccagggucccuc

SEQ ID NO: 3656961 - RNA, 22 nt, Human
cugguuccagggucccucugug

SEQ ID NO: 3656962 - RNA, 23 nt, Human
cugguuccagggucccucugugu

SEQ ID NO: 3656963 - RNA, 13 nt, Human
cugguuccucccc

SEQ ID NO: 3656964 - RNA, 20 nt, Human
cugguuccugcuagaaaugg

SEQ ID NO: 3656965 - RNA, 18 nt, Human
cugguucuauuuaaugga

SEQ ID NO: 3656966 - RNA, 17 nt, Human
cugguucucaaugaaaa

SEQ ID NO: 3656967 - RNA, 16 nt, Human
cugguucucaauucca

SEQ ID NO: 3656968 - RNA, 17 nt, Human
cugguucucaauuccaa

SEQ ID NO: 3656969 - RNA, 12 nt, Human
cugguucucauc

SEQ ID NO: 3656970 - RNA, 13 nt, Human
cugguugaagaag

SEQ ID NO: 3656971 - RNA, 14 nt, Human
cugguugcugugug

SEQ ID NO: 3656972 - RNA, 15 nt, Human
cugguugcugugugg

SEQ ID NO: 3656973 - RNA, 18 nt, Human
cugguugcugugugguuu

SEQ ID NO: 3656974 - RNA, 17 nt, Human
cugguuggagagcuaga

SEQ ID NO: 3656975 - RNA, 21 nt, Human
cugguuggcucccgcggugcc

SEQ ID NO: 3656976 - RNA, 17 nt, Human
cugguugggcagccaga

SEQ ID NO: 3656977 - RNA, 21 nt, Human
cugguugguguugcagaaggu

SEQ ID NO: 3656978 - RNA, 14 nt, Human
cugguugucauuuu

SEQ ID NO: 3656979 - RNA, 15 nt, Human
cugguugucauuuuu

SEQ ID NO: 3656980 - RNA, 16 nt, Human
cugguuguuucuguuc

SEQ ID NO: 3656981 - RNA, 18 nt, Human
cugguuuacaggcccugc

SEQ ID NO: 3656982 - RNA, 18 nt, Human
cugguuucacuggcccaa

SEQ ID NO: 3656983 - RNA, 22 nt, Human
cugguuuccugcccugggaggc

SEQ ID NO: 3656984 - RNA, 16 nt, Human
cugguuucucauucuu

SEQ ID NO: 3656985 - RNA, 17 nt, Human
cugguuugaagaauguu

SEQ ID NO: 3656986 - RNA, 21 nt, Human
cugguuugacuccgcuggagg

SEQ ID NO: 3656987 - RNA, 13 nt, Human
cugguuuuaacaa

SEQ ID NO: 3656988 - RNA, 13 nt, Human
cugguuuugcuau

SEQ ID NO: 3656989 - RNA, 23 nt, Human
cugguuuuggcaucucuguccca

SEQ ID NO: 3656990 - RNA, 20 nt, Human
cugguuuuuaaccauugucu

SEQ ID NO: 3656991 - RNA, 19 nt, Human
cuguaaaaaaaaaaaaguu

SEQ ID NO: 3656992 - RNA, 19 nt, Human
cuguaaaaacacugaaaaa

SEQ ID NO: 3656993 - RNA, 16 nt, Human
cuguaaaacgcuguca

SEQ ID NO: 3656994 - RNA, 20 nt, Human
cuguaaaacuuuauuuuaua

SEQ ID NO: 3656995 - RNA, 17 nt, Human
cuguaaaauaaaagguc

SEQ ID NO: 3656996 - RNA, 10 nt, Human
cuguaaaauc

SEQ ID NO: 3656997 - RNA, 22 nt, Human
cuguaaaaugcaugauuuugua

SEQ ID NO: 3656998 - RNA, 15 nt, Human
cuguaaaauguggga

SEQ ID NO: 3656999 - RNA, 21 nt, Human
cuguaaaaugugggauuaugg

SEQ ID NO: 3657000 - RNA, 13 nt, Human
cuguaaacugugu

SEQ ID NO: 3657001 - RNA, 20 nt, Human
cuguaaacuguguauuccaa

SEQ ID NO: 3657002 - RNA, 18 nt, Human
cuguaaacuuuaucacuu

SEQ ID NO: 3657003 - RNA, 16 nt, Human
cuguaaagaaagagag

SEQ ID NO: 3657004 - RNA, 18 nt, Human
cuguaaagaaagagagaa

SEQ ID NO: 3657005 - RNA, 19 nt, Human
cuguaaagaaagagagaaa

SEQ ID NO: 3657006 - RNA, 20 nt, Human
cuguaaagaaagagagaaaa

SEQ ID NO: 3657007 - RNA, 22 nt, Human
cuguaaagaaagagagaaaaua

SEQ ID NO: 3657008 - RNA, 12 nt, Human
cuguaaagaugu

SEQ ID NO: 3657009 - RNA, 23 nt, Human
cuguaaagcuaaaauaaagaaau

SEQ ID NO: 3657010 - RNA, 12 nt, Human
cuguaaauacca

SEQ ID NO: 3657011 - RNA, 13 nt, Human
cuguaaauaccau

SEQ ID NO: 3657012 - RNA, 18 nt, Human
cuguaaaucuacacacgg

SEQ ID NO: 3657013 - RNA, 19 nt, Human
cuguaacacaagccacaga

SEQ ID NO: 3657014 - RNA, 18 nt, Human
cuguaacagguauuuugu

SEQ ID NO: 3657015 - RNA, 21 nt, Human
cuguaacaucacuauccaugc

SEQ ID NO: 3657016 - RNA, 22 nt, Human
cuguaaccucuucagaggcccu

SEQ ID NO: 3657017 - RNA, 16 nt, Human
cuguaacgugugcugu

SEQ ID NO: 3657018 - RNA, 16 nt, Human
cuguaacuacuuuaua

SEQ ID NO: 3657019 - RNA, 15 nt, Human
cuguaacugccaggc

SEQ ID NO: 3657020 - RNA, 16 nt, Human
cuguaacugccaggcu

SEQ ID NO: 3657021 - RNA, 20 nt, Human
cuguaacuuccaaauaaaua

SEQ ID NO: 3657022 - RNA, 17 nt, Human
cuguaagaagagacugg

SEQ ID NO: 3657023 - RNA, 20 nt, Human
cuguaagaagagacugggaa

SEQ ID NO: 3657024 - RNA, 18 nt, Human
cuguaagaauaauuuaua

SEQ ID NO: 3657025 - RNA, 12 nt, Human
cuguaagacauu

SEQ ID NO: 3657026 - RNA, 18 nt, Human
cuguaagaugucuguuug

SEQ ID NO: 3657027 - RNA, 21 nt, Human
cuguaagaugucuguuugcug

SEQ ID NO: 3657028 - RNA, 22 nt, Human
cuguaagaugucuguuugcuga

SEQ ID NO: 3657029 - RNA, 15 nt, Human
cuguaagccaaagaa

SEQ ID NO: 3657030 - RNA, 22 nt, Human
cuguaagccaaagaaaugaaca

SEQ ID NO: 3657031 - RNA, 23 nt, Human
cuguaagccaaagaaaugaacau

SEQ ID NO: 3657032 - RNA, 17 nt, Human
cuguaagccugcaagcc

SEQ ID NO: 3657033 - RNA, 13 nt, Human
cuguaagcucuuu

SEQ ID NO: 3657034 - RNA, 17 nt, Human
cuguaagcucuuugaaa

SEQ ID NO: 3657035 - RNA, 14 nt, Human
cuguaagcugaagu

SEQ ID NO: 3657036 - RNA, 18 nt, Human
cuguaaggcaaucauggu

SEQ ID NO: 3657037 - RNA, 20 nt, Human
cuguaaggcucuagaucaua

SEQ ID NO: 3657038 - RNA, 21 nt, Human
cuguaaguuacaugaaggcag

SEQ ID NO: 3657039 - RNA, 16 nt, Human
cuguaaguuuugaauu

SEQ ID NO: 3657040 - RNA, 13 nt, Human
cuguaauaaauau

SEQ ID NO: 3657041 - RNA, 22 nt, Human
cuguaauaauaccucaauguuu

SEQ ID NO: 3657042 - RNA, 14 nt, Human
cuguaauauuuaca

SEQ ID NO: 3657043 - RNA, 20 nt, Human
cuguaaucauuuguuuacau

SEQ ID NO: 3657044 - RNA, 14 nt, Human
cuguaaucccagca

SEQ ID NO: 3657045 - RNA, 19 nt, Human
cuguaaucccagcuacuca

SEQ ID NO: 3657046 - RNA, 19 nt, Human
cuguaauccuagcacuuug

SEQ ID NO: 3657047 - RNA, 19 nt, Human
cuguaaucucguuucaaaa

SEQ ID NO: 3657048 - RNA, 20 nt, Human
cuguaaucucguuucaaaaa

SEQ ID NO: 3657049 - RNA, 17 nt, Human
cuguaaucuuguugaua

SEQ ID NO: 3657050 - RNA, 20 nt, Human
cuguaaugaaccgcugaaua

SEQ ID NO: 3657051 - RNA, 21 nt, Human
cuguaaugaaucuaagcagca

SEQ ID NO: 3657052 - RNA, 17 nt, Human
cuguaauuauuugaaug

SEQ ID NO: 3657053 - RNA, 15 nt, Human
cuguaauucagguuu

SEQ ID NO: 3657054 - RNA, 18 nt, Human
cuguaauugaauauuauu

SEQ ID NO: 3657055 - RNA, 19 nt, Human
cuguaauugaauauuauuc

SEQ ID NO: 3657056 - RNA, 12 nt, Human
cuguaauugugu

SEQ ID NO: 3657057 - RNA, 15 nt, Human
cuguaugauucccag

SEQ ID NO: 3657058 - RNA, 21 nt, Human
cuguauggaauacaauguaau

SEQ ID NO: 3657059 - RNA, 16 nt, Human
cuguauguauuaguga

SEQ ID NO: 3657060 - RNA, 17 nt, Human
cuguauguauuagugau

SEQ ID NO: 3657061 - RNA, 12 nt, Human
cuguaugucaga

SEQ ID NO: 3657062 - RNA, 20 nt, Human
cuguaugucucgugguagga

SEQ ID NO: 3657063 - RNA, 12 nt, Human
cuguaugucugu

SEQ ID NO: 3657064 - RNA, 17 nt, Human
cuguaugucugucauug

SEQ ID NO: 3657065 - RNA, 18 nt, Human
cuguaugugcuguaauuu

SEQ ID NO: 3657066 - RNA, 18 nt, Human
cuguauguuauagaacuu

SEQ ID NO: 3657067 - RNA, 15 nt, Human
cuguauguuguccaa

SEQ ID NO: 3657068 - RNA, 18 nt, Human
cuguauguuguccaauug

SEQ ID NO: 3657069 - RNA, 17 nt, Human
cuguauuacauaaauaa

SEQ ID NO: 3657070 - RNA, 19 nt, Human
cuguauuagucacagagau

SEQ ID NO: 3657071 - RNA, 16 nt, Human
cuguauucagacagau

SEQ ID NO: 3657072 - RNA, 12 nt, Human
cuguauucagca

SEQ ID NO: 3657073 - RNA, 18 nt, Human
cuguauucccauaucaaa

SEQ ID NO: 3657074 - RNA, 13 nt, Human
cuguauucucaaa

SEQ ID NO: 3657075 - RNA, 17 nt, Human
cuguauugaaucaugua

SEQ ID NO: 3657076 - RNA, 15 nt, Human
cuguauugaugacag

SEQ ID NO: 3657077 - RNA, 17 nt, Human
cuguauuuaaaaauaga

SEQ ID NO: 3657078 - RNA, 18 nt, Human
cuguauuuaaaaauagaa

SEQ ID NO: 3657079 - RNA, 15 nt, Human
cuguauuuaagcaaa

SEQ ID NO: 3657080 - RNA, 17 nt, Human
cuguauuuaugugugag

SEQ ID NO: 3657081 - RNA, 23 nt, Human
cuguauuuaugugugaggagcug

SEQ ID NO: 3657082 - RNA, 14 nt, Human
cuguauuucaugug

SEQ ID NO: 3657083 - RNA, 15 nt, Human
cuguauuucaugugg

SEQ ID NO: 3657084 - RNA, 16 nt, Human
cuguauuugaaagugc

SEQ ID NO: 3657085 - RNA, 21 nt, Human
cuguauuugaaagugccuuug

SEQ ID NO: 3657086 - RNA, 18 nt, Human
cuguauuugaaauaagaa

SEQ ID NO: 3657087 - RNA, 16 nt, Human
cuguauuugugacuaa

SEQ ID NO: 3657088 - RNA, 17 nt, Human
cuguauuugugacuaau

SEQ ID NO: 3657089 - RNA, 20 nt, Human
cuguauuugugacuaauugu

SEQ ID NO: 3657090 - RNA, 23 nt, Human
cuguauuugugacuaauuguaua

SEQ ID NO: 3657091 - RNA, 15 nt, Human
cuguauuuguuccca

SEQ ID NO: 3657092 - RNA, 17 nt, Human
cuguauuuguucccaag

SEQ ID NO: 3657093 - RNA, 18 nt, Human
cuguauuuguucccaaga

SEQ ID NO: 3657094 - RNA, 20 nt, Human
cuguauuuuaaaagaaugau

SEQ ID NO: 3657095 - RNA, 21 nt, Human
cuguauuuuuaccuuuuuccu

SEQ ID NO: 3657096 - RNA, 21 nt, Human
cugucaaaacaaguuuuucug

SEQ ID NO: 3657097 - RNA, 21 nt, Human
cugucaaaaguuggacuaaau

SEQ ID NO: 3657098 - RNA, 17 nt, Human
cugucaaaauaauuuua

SEQ ID NO: 3657099 - RNA, 15 nt, Human
cugucaaacauuagu

SEQ ID NO: 3657100 - RNA, 21 nt, Human
cugucaaacauuaguacuuua

SEQ ID NO: 3657101 - RNA, 23 nt, Human
cugucaaacauuaguacuuuaua

SEQ ID NO: 3657102 - RNA, 15 nt, Human
cugucaaagaaucaa

SEQ ID NO: 3657103 - RNA, 12 nt, Human
cugucaagaaga

SEQ ID NO: 3657104 - RNA, 14 nt, Human
cugucaagaagaug

SEQ ID NO: 3657105 - RNA, 23 nt, Human
cuggucaaacaaacucucugaac

SEQ ID NO: 3657106 - RNA, 16 nt, Human
cuggucaaccuccugg

SEQ ID NO: 3657107 - RNA, 17 nt, Human
cuggucaaccuccugga

SEQ ID NO: 3657108 - RNA, 19 nt, Human
cuggucaaccuccuggaca

SEQ ID NO: 3657109 - RNA, 19 nt, Human
cuggucaaucaacacuacc

SEQ ID NO: 3657110 - RNA, 15 nt, Human
cuggucacagccucc

SEQ ID NO: 3657111 - RNA, 17 nt, Human
cuggucacagccuccuc

SEQ ID NO: 3657112 - RNA, 20 nt, Human
cuggucacaggacucugccu

SEQ ID NO: 3657113 - RNA, 22 nt, Human
cuggucacaggacucugccucc

SEQ ID NO: 3657114 - RNA, 23 nt, Human
cuggucaccuaggaagccucaga

SEQ ID NO: 3657115 - RNA, 14 nt, Human
cuggucacugccau

SEQ ID NO: 3657116 - RNA, 17 nt, Human
cuggucacuucuucugu

SEQ ID NO: 3657117 - RNA, 22 nt, Human
cugguccacagggcaccugcca

SEQ ID NO: 3657118 - RNA, 17 nt, Human
cugguccagggaagcug

SEQ ID NO: 3657119 - RNA, 21 nt, Human
cugguccagggaagcuggccg

SEQ ID NO: 3657120 - RNA, 22 nt, Human
cugguccagggaagcuggccga

SEQ ID NO: 3657121 - RNA, 15 nt, Human
cugguccauagagag

SEQ ID NO: 3657122 - RNA, 14 nt, Human
cuggucccacgagg

SEQ ID NO: 3657123 - RNA, 13 nt, Human
cuggucccacuca

SEQ ID NO: 3657124 - RNA, 15 nt, Human
cuggucccacucagu

SEQ ID NO: 3657125 - RNA, 23 nt, Human
cuggucccuguuuucccacgagg

SEQ ID NO: 3657126 - RNA, 16 nt, Human
cugguccggacacucc

SEQ ID NO: 3657127 - RNA, 20 nt, Human
cugguccggacacuccuaga

SEQ ID NO: 3657128 - RNA, 13 nt, Human
cugguccuaccca

SEQ ID NO: 3657129 - RNA, 17 nt, Human
cugguccuacccauccc

SEQ ID NO: 3657130 - RNA, 20 nt, Human
cugguccuaggcuggaagga

SEQ ID NO: 3657131 - RNA, 17 nt, Human
cugguccuauggccuca

SEQ ID NO: 3657132 - RNA, 14 nt, Human
cugguccucacacu

SEQ ID NO: 3657133 - RNA, 19 nt, Human
cugguccugagggucccca

SEQ ID NO: 3657134 - RNA, 21 nt, Human
cugguccugaggguccccacc

SEQ ID NO: 3657135 - RNA, 19 nt, Human
cugguccuuccaggccccc

SEQ ID NO: 3657136 - RNA, 15 nt, Human
cugguccuuuuuggu

SEQ ID NO: 3657137 - RNA, 21 nt, Human
cuggucguaaacaucucagag

SEQ ID NO: 3657138 - RNA, 18 nt, Human
cuggucucaaacuccuga

SEQ ID NO: 3657139 - RNA, 23 nt, Human
cuggucucaaacucuugaccuca

SEQ ID NO: 3657140 - RNA, 13 nt, Human
cuggucucacccu

SEQ ID NO: 3657141 - RNA, 13 nt, Human
cuggucucagcag

SEQ ID NO: 3657142 - RNA, 20 nt, Human
cuggucucagcagcgaccac

SEQ ID NO: 3657143 - RNA, 21 nt, Human
cuggucucagcagcgaccacc

SEQ ID NO: 3657144 - RNA, 22 nt, Human
cuggucucagcagcgaccaccc

SEQ ID NO: 3657145 - RNA, 17 nt, Human
cuggucuccugccccca

SEQ ID NO: 3657146 - RNA, 18 nt, Human
cuggucuccugcccccac

SEQ ID NO: 3657147 - RNA, 16 nt, Human
cuggucucuaggcugg

SEQ ID NO: 3657148 - RNA, 18 nt, Human
cuggucucuaggcugggg

SEQ ID NO: 3657149 - RNA, 23 nt, Human
cuggucucucuaugccucucuac

SEQ ID NO: 3657150 - RNA, 12 nt, Human
cuggucucuggu

SEQ ID NO: 3657151 - RNA, 20 nt, Human
cuggucugaugacuugcuua

SEQ ID NO: 3657152 - RNA, 16 nt, Human
cuggucugggugcccc

SEQ ID NO: 3657153 - RNA, 17 nt, Human
cuggucuuccuuuuugg

SEQ ID NO: 3657154 - RNA, 22 nt, Human
cuggucuugaaguccuggcuuc

SEQ ID NO: 3657155 - RNA, 14 nt, Human
cuggucuugagaug

SEQ ID NO: 3657156 - RNA, 14 nt, Human
cuggucuuguaaga

SEQ ID NO: 3657157 - RNA, 18 nt, Human
cuggucuuguggaauugg

SEQ ID NO: 3657158 - RNA, 15 nt, Human
cuggucuuguuagaa

SEQ ID NO: 3657159 - RNA, 18 nt, Human
cuggucuuugagcuccca

SEQ ID NO: 3657160 - RNA, 20 nt, Human
cuggugaagcucacuucugg

SEQ ID NO: 3657161 - RNA, 20 nt, Human
cuggugaauggccuuccuuc

SEQ ID NO: 3657162 - RNA, 22 nt, Human
cuggugacaugucuuuucuugc

SEQ ID NO: 3657163 - RNA, 15 nt, Human
cuggugacugauucu

SEQ ID NO: 3657164 - RNA, 22 nt, Human
cuggugacugcgaucuucagag

SEQ ID NO: 3657165 - RNA, 21 nt, Human
cuggugacuuuccucuuuggu

SEQ ID NO: 3657166 - RNA, 22 nt, Human
cuggugagagggccgggcagag

SEQ ID NO: 3657167 - RNA, 13 nt, Human
cuggugaggccuu

SEQ ID NO: 3657168 - RNA, 16 nt, Human
cuggugaggccuugcu

SEQ ID NO: 3657169 - RNA, 24 nt, Human
cuggugagucaccacuucagggcu

SEQ ID NO: 3657170 - RNA, 19 nt, Human
cuggugagucuuggcggca

SEQ ID NO: 3657171 - RNA, 15 nt, Human
cuggugauauaucuc

SEQ ID NO: 3657172 - RNA, 20 nt, Human
cuggugaugcgcaguugcug

SEQ ID NO: 3657173 - RNA, 19 nt, Human
cuggugcacagccacuccc

SEQ ID NO: 3657174 - RNA, 16 nt, Human
cuggugcacuggcccc

SEQ ID NO: 3657175 - RNA, 19 nt, Human
cuggugcacuggccccacc

SEQ ID NO: 3657176 - RNA, 17 nt, Human
cuggugcacuuuguaaa

SEQ ID NO: 3657177 - RNA, 19 nt, Human
cuggugcacuuuguaaauu

SEQ ID NO: 3657178 - RNA, 17 nt, Human
cuggugcagggccucca

SEQ ID NO: 3657179 - RNA, 15 nt, Human
cuggugcauuacaga

SEQ ID NO: 3657180 - RNA, 16 nt, Human
cuggugcauuacagag

SEQ ID NO: 3657181 - RNA, 18 nt, Human
cuggugcauuacagagag

SEQ ID NO: 3657182 - RNA, 15 nt, Human
cuggugccaauuuca

SEQ ID NO: 3657183 - RNA, 16 nt, Human
cuggugccaauuucaa

SEQ ID NO: 3657184 - RNA, 18 nt, Human
cuggugccaauuucaagu

SEQ ID NO: 3657185 - RNA, 13 nt, Human
cuggugccagccu

SEQ ID NO: 3657186 - RNA, 21 nt, Human
cuggugccccccaccccugga

SEQ ID NO: 3657187 - RNA, 14 nt, Human
cuggugcccggaga

SEQ ID NO: 3657188 - RNA, 14 nt, Human
cuggugccuccaga

SEQ ID NO: 3657189 - RNA, 15 nt, Human
cuggugccuggcucu

SEQ ID NO: 3657190 - RNA, 17 nt, Human
cuggugcgaauggacuu

SEQ ID NO: 3657191 - RNA, 14 nt, Human
cuggugcggcuggc

SEQ ID NO: 3657192 - RNA, 21 nt, Human
cuggugcggcuggccauggag

SEQ ID NO: 3657193 - RNA, 19 nt, Human
cuggugcuauaggcuggag

SEQ ID NO: 3657194 - RNA, 21 nt, Human
cuggugcuauaggcuggagaa

SEQ ID NO: 3657195 - RNA, 22 nt, Human
cuggugcuauaggcuggagaag

SEQ ID NO: 3657196 - RNA, 12 nt, Human
cuggugcugcca

SEQ ID NO: 3657197 - RNA, 20 nt, Human
cuggugcugccacacuucag

SEQ ID NO: 3657198 - RNA, 20 nt, Human
cuggugcuggauauuuucaa

SEQ ID NO: 3657199 - RNA, 20 nt, Human
cuggugcuguggccagggug

SEQ ID NO: 3657200 - RNA, 18 nt, Human
cugguggagaaagcacug

SEQ ID NO: 3657201 - RNA, 15 nt, Human
cuguccaucugcccg

SEQ ID NO: 3657202 - RNA, 21 nt, Human
cuguccauuuuuauucagggg

SEQ ID NO: 3657203 - RNA, 17 nt, Human
cugucccauggacacuc

SEQ ID NO: 3657204 - RNA, 14 nt, Human
cuguccccagccug

SEQ ID NO: 3657205 - RNA, 15 nt, Human
cuguccccccacucc

SEQ ID NO: 3657206 - RNA, 23 nt, Human
cugucccccugagaucagagucc

SEQ ID NO: 3657207 - RNA, 17 nt, Human
cuguccccgcacugggc

SEQ ID NO: 3657208 - RNA, 23 nt, Human
cuguccccgcagcccuggcaggg

SEQ ID NO: 3657209 - RNA, 15 nt, Human
cuguccccucuugcc

SEQ ID NO: 3657210 - RNA, 15 nt, Human
cuguccccugcuaca

SEQ ID NO: 3657211 - RNA, 21 nt, Human
cuguccccugcuacaccuauu

SEQ ID NO: 3657212 - RNA, 16 nt, Human
cuguccccuucucuca

SEQ ID NO: 3657213 - RNA, 19 nt, Human
cuguccccuucucucaucu

SEQ ID NO: 3657214 - RNA, 11 nt, Human
cugucccuagg

SEQ ID NO: 3657215 - RNA, 17 nt, Human
cugucccuaggucagcu

SEQ ID NO: 3657216 - RNA, 15 nt, Human
cugucccucccaccu

SEQ ID NO: 3657217 - RNA, 18 nt, Human
cugucccucccaccucug

SEQ ID NO: 3657218 - RNA, 23 nt, Human
cugucccucccaccucugugacc

SEQ ID NO: 3657219 - RNA, 12 nt, Human
cugucccuccgg

SEQ ID NO: 3657220 - RNA, 15 nt, Human
cugucccuccuggug

SEQ ID NO: 3657221 - RNA, 15 nt, Human
cugucccucucaggc

SEQ ID NO: 3657222 - RNA, 15 nt, Human
cugucccugaaaccu

SEQ ID NO: 3657223 - RNA, 15 nt, Human
cugucccugcccuuc

SEQ ID NO: 3657224 - RNA, 14 nt, Human
cugucccugccuca

SEQ ID NO: 3657225 - RNA, 14 nt, Human
cugucccuggccau

SEQ ID NO: 3657226 - RNA, 16 nt, Human
cugucccuggccaucu

SEQ ID NO: 3657227 - RNA, 22 nt, Human
cugucccuuacgugaguccugg

SEQ ID NO: 3657228 - RNA, 16 nt, Human
cugucccuucucuuaa

SEQ ID NO: 3657229 - RNA, 21 nt, Human
cugucccuucucuuaauuuaa

SEQ ID NO: 3657230 - RNA, 17 nt, Human
cugucccuucugucccu

SEQ ID NO: 3657231 - RNA, 22 nt, Human
cugucccuugccccccuggccu

SEQ ID NO: 3657232 - RNA, 23 nt, Human
cugucccuugccccccuggccuc

SEQ ID NO: 3657233 - RNA, 13 nt, Human
cugucccuugccu

SEQ ID NO: 3657234 - RNA, 20 nt, Human
cugucccuugccucaaugcc

SEQ ID NO: 3657235 - RNA, 21 nt, Human
cugucccuugccucaaugcca

SEQ ID NO: 3657236 - RNA, 21 nt, Human
cuguccguucacauguguggu

SEQ ID NO: 3657237 - RNA, 17 nt, Human
cuguccuacucuguguc

SEQ ID NO: 3657238 - RNA, 23 nt, Human
cuguccuaugaaugcuuugcauu

SEQ ID NO: 3657239 - RNA, 21 nt, Human
cuguccuauuauauucauucu

SEQ ID NO: 3657240 - RNA, 19 nt, Human
cuguccucacugcucccug

SEQ ID NO: 3657241 - RNA, 18 nt, Human
cuguccucagccuugcca

SEQ ID NO: 3657242 - RNA, 20 nt, Human
cuguccucagccuugccaga

SEQ ID NO: 3657243 - RNA, 15 nt, Human
cuguccucagcuucu

SEQ ID NO: 3657244 - RNA, 17 nt, Human
cuguccucagcuucuua

SEQ ID NO: 3657245 - RNA, 16 nt, Human
cuguccucagguggcc

SEQ ID NO: 3657246 - RNA, 18 nt, Human
cuguccucagguggccau

SEQ ID NO: 3657247 - RNA, 15 nt, Human
cuguccuccaacacc

SEQ ID NO: 3657248 - RNA, 18 nt, Human
cuguccucccauccccug

SEQ ID NO: 3657249 - RNA, 19 nt, Human
cuguccucccauccccugg

SEQ ID NO: 3657250 - RNA, 14 nt, Human
cuguccucccucca

SEQ ID NO: 3657251 - RNA, 15 nt, Human
cuguccucccuccac

SEQ ID NO: 3657252 - RNA, 13 nt, Human
cuguccucucccc

SEQ ID NO: 3657253 - RNA, 14 nt, Human
cuguccucuccccu

SEQ ID NO: 3657254 - RNA, 16 nt, Human
cuguccucuccccucc

SEQ ID NO: 3657255 - RNA, 19 nt, Human
cuguccucuccccuccagc

SEQ ID NO: 3657256 - RNA, 22 nt, Human
cuguccucuccccuccagccuu

SEQ ID NO: 3657257 - RNA, 15 nt, Human
cuguccucuucugca

SEQ ID NO: 3657258 - RNA, 20 nt, Human
cuguccucuuucagaaaaca

SEQ ID NO: 3657259 - RNA, 15 nt, Human
cuguccucuuucagc

SEQ ID NO: 3657260 - RNA, 20 nt, Human
cuguccucuuucagcuccug

SEQ ID NO: 3657261 - RNA, 16 nt, Human
cuguccugaaggccug

SEQ ID NO: 3657262 - RNA, 12 nt, Human
cuguccugaucu

SEQ ID NO: 3657263 - RNA, 17 nt, Human
cuguccugaucugugau

SEQ ID NO: 3657264 - RNA, 20 nt, Human
cuguccugauggucagcucc

SEQ ID NO: 3657265 - RNA, 22 nt, Human
cuguccugauggucagcucccu

SEQ ID NO: 3657266 - RNA, 15 nt, Human
cuguccugcagcaaa

SEQ ID NO: 3657267 - RNA, 16 nt, Human
cuguccugcagcaaac

SEQ ID NO: 3657268 - RNA, 22 nt, Human
cuguccugccacccagccccag

SEQ ID NO: 3657269 - RNA, 17 nt, Human
cuguccugccuguggcc

SEQ ID NO: 3657270 - RNA, 18 nt, Human
cuguccugccuguggcca

SEQ ID NO: 3657271 - RNA, 16 nt, Human
cuguccugcuccacag

SEQ ID NO: 3657272 - RNA, 18 nt, Human
cuguccugcuccacagug

SEQ ID NO: 3657273 - RNA, 14 nt, Human
cuguccugcuucug

SEQ ID NO: 3657274 - RNA, 15 nt, Human
cuguccugcuucuga

SEQ ID NO: 3657275 - RNA, 21 nt, Human
cuguccugggagugagcuggu

SEQ ID NO: 3657276 - RNA, 14 nt, Human
cuguccugggccug

SEQ ID NO: 3657277 - RNA, 18 nt, Human
cuguccugggccugcaga

SEQ ID NO: 3657278 - RNA, 13 nt, Human
cuguccugggcgc

SEQ ID NO: 3657279 - RNA, 19 nt, Human
cuguccugggcgcccugga

SEQ ID NO: 3657280 - RNA, 14 nt, Human
cuguccugggcugg

SEQ ID NO: 3657281 - RNA, 18 nt, Human
cuguccugggcugguggc

SEQ ID NO: 3657282 - RNA, 17 nt, Human
cuguccuggugguauuu

SEQ ID NO: 3657283 - RNA, 14 nt, Human
cuguccuguaacug

SEQ ID NO: 3657284 - RNA, 12 nt, Human
cuguccuguccu

SEQ ID NO: 3657285 - RNA, 12 nt, Human
cuguccugugac

SEQ ID NO: 3657286 - RNA, 22 nt, Human
cuguccugugagguuucccaau

SEQ ID NO: 3657287 - RNA, 17 nt, Human
cuguccuuacccaucug

SEQ ID NO: 3657288 - RNA, 17 nt, Human
cuguccuucagauggaa

SEQ ID NO: 3657289 - RNA, 22 nt, Human
cuguccuuuccaguggccuggc

SEQ ID NO: 3657290 - RNA, 12 nt, Human
cuguccuuuccu

SEQ ID NO: 3657291 - RNA, 13 nt, Human
cuguccuuuccuu

SEQ ID NO: 3657292 - RNA, 13 nt, Human
cuguccuuucuag

SEQ ID NO: 3657293 - RNA, 20 nt, Human
cuguccuuucuagagcacug

SEQ ID NO: 3657294 - RNA, 19 nt, Human
cuguccuuuuuccucucca

SEQ ID NO: 3657295 - RNA, 13 nt, Human
cugucgagacacu

SEQ ID NO: 3657296 - RNA, 14 nt, Human
cugucgagccuggg

SEQ ID NO: 3657297 - RNA, 22 nt, Human
cugucgaguucggcucugggug

SEQ ID NO: 3657298 - RNA, 15 nt, Human
cugucgauguaggca

SEQ ID NO: 3657299 - RNA, 15 nt, Human
cugucgauuagacug

SEQ ID NO: 3657300 - RNA, 13 nt, Human
cugucgcccaguc

SEQ ID NO: 3657301 - RNA, 22 nt, Human
cugucggcgcugccccaucucc

SEQ ID NO: 3657302 - RNA, 15 nt, Human
cugucgggcuuugug

SEQ ID NO: 3657303 - RNA, 21 nt, Human
cugucgugauggggcaagggc

SEQ ID NO: 3657304 - RNA, 18 nt, Human
cugucuaaaaaacaaaac

SEQ ID NO: 3657305 - RNA, 17 nt, Human
cuguggaugagcccuca

SEQ ID NO: 3657306 - RNA, 20 nt, Human
cuguggaugagcccucagaa

SEQ ID NO: 3657307 - RNA, 23 nt, Human
cuguggaugcugcugccccugca

SEQ ID NO: 3657308 - RNA, 15 nt, Human
cuguggcacuugccu

SEQ ID NO: 3657309 - RNA, 17 nt, Human
cuguggcagaguuacag

SEQ ID NO: 3657310 - RNA, 18 nt, Human
cuguggcaggcagcgcca

SEQ ID NO: 3657311 - RNA, 23 nt, Human
cuguggcaggccagcugugguuu

SEQ ID NO: 3657312 - RNA, 20 nt, Human
cuguggcaguaaagagaaac

SEQ ID NO: 3657313 - RNA, 17 nt, Human
cuguggcauaaauugca

SEQ ID NO: 3657314 - RNA, 13 nt, Human
cuguggccaaagg

SEQ ID NO: 3657315 - RNA, 15 nt, Human
cuguggccaggaggu

SEQ ID NO: 3657316 - RNA, 16 nt, Human
cuguggccccacccug

SEQ ID NO: 3657317 - RNA, 17 nt, Human
cuguggccccacccugg

SEQ ID NO: 3657318 - RNA, 19 nt, Human
cuguggcccuggcucugcu

SEQ ID NO: 3657319 - RNA, 20 nt, Human
cuguggccguuaucuggaag

SEQ ID NO: 3657320 - RNA, 16 nt, Human
cuguggccugccaguc

SEQ ID NO: 3657321 - RNA, 13 nt, Human
cuguggccugggc

SEQ ID NO: 3657322 - RNA, 17 nt, Human
cuguggccuguguccca

SEQ ID NO: 3657323 - RNA, 22 nt, Human
cuguggccugugucccaugacc

SEQ ID NO: 3657324 - RNA, 23 nt, Human
cuguggcgagccauuugucccaa

SEQ ID NO: 3657325 - RNA, 21 nt, Human
cuguggcgccgucuccagggg

SEQ ID NO: 3657326 - RNA, 18 nt, Human
cuguggcggugccugggu

SEQ ID NO: 3657327 - RNA, 14 nt, Human
cuguggcuggugag

SEQ ID NO: 3657328 - RNA, 13 nt, Human
cuguggcugugga

SEQ ID NO: 3657329 - RNA, 20 nt, Human
cuguggcuucccaugucuuu

SEQ ID NO: 3657330 - RNA, 18 nt, Human
cuguggcuuucagccucu

SEQ ID NO: 3657331 - RNA, 19 nt, Human
cuguggcuuucagccucug

SEQ ID NO: 3657332 - RNA, 16 nt, Human
cugugggaaggccagc

SEQ ID NO: 3657333 - RNA, 20 nt, Human
cugugggaaggccagcugcc

SEQ ID NO: 3657334 - RNA, 17 nt, Human
cugugggaccccaggcc

SEQ ID NO: 3657335 - RNA, 18 nt, Human
cugugggaccccaggccc

SEQ ID NO: 3657336 - RNA, 14 nt, Human
cugugggaugggau

SEQ ID NO: 3657337 - RNA, 14 nt, Human
cugugggcaauuua

SEQ ID NO: 3657338 - RNA, 22 nt, Human
cugugggcacgcugugggcagg

SEQ ID NO: 3657339 - RNA, 15 nt, Human
cugugggccagauug

SEQ ID NO: 3657340 - RNA, 17 nt, Human
cugugggcgggcccagc

SEQ ID NO: 3657341 - RNA, 22 nt, Human
cugugggcgugagaccugcccc

SEQ ID NO: 3657342 - RNA, 13 nt, Human
cugugggcucccu

SEQ ID NO: 3657343 - RNA, 14 nt, Human
cugugggcugcacu

SEQ ID NO: 3657344 - RNA, 15 nt, Human
cugugggcugcacuc

SEQ ID NO: 3657345 - RNA, 18 nt, Human
cugugggcugcacucugu

SEQ ID NO: 3657346 - RNA, 17 nt, Human
cuguuaccauuggaaau

SEQ ID NO: 3657347 - RNA, 22 nt, Human
cuguuaccauuggaaauuucac

SEQ ID NO: 3657348 - RNA, 17 nt, Human
cuguuacugucuucagu

SEQ ID NO: 3657349 - RNA, 21 nt, Human
cuguuacuugaaauaccagug

SEQ ID NO: 3657350 - RNA, 14 nt, Human
cuguuagaacacua

SEQ ID NO: 3657351 - RNA, 16 nt, Human
cuguuagaacacuauu

SEQ ID NO: 3657352 - RNA, 19 nt, Human
cuguuagaacacuauuuuc

SEQ ID NO: 3657353 - RNA, 20 nt, Human
cuguuagcacuguugaugua

SEQ ID NO: 3657354 - RNA, 15 nt, Human
cuguuagcuguuauu

SEQ ID NO: 3657355 - RNA, 21 nt, Human
cuguuagcuuuuuaaaacauu

SEQ ID NO: 3657356 - RNA, 14 nt, Human
cuguuagucauuug

SEQ ID NO: 3657357 - RNA, 18 nt, Human
cuguuauagguccuuuag

SEQ ID NO: 3657358 - RNA, 21 nt, Human
cuguuauagguccuuuagaaa

SEQ ID NO: 3657359 - RNA, 16 nt, Human
cuguuauauccccugc

SEQ ID NO: 3657360 - RNA, 18 nt, Human
cuguuauauccccugcua

SEQ ID NO: 3657361 - RNA, 19 nt, Human
cuguuaucaaaacuuucuu

SEQ ID NO: 3657362 - RNA, 19 nt, Human
cuguuaucauuuuuuccug

SEQ ID NO: 3657363 - RNA, 20 nt, Human
cuguuaucauuuuuuccugu

SEQ ID NO: 3657364 - RNA, 19 nt, Human
cuguuaugcugugacacau

SEQ ID NO: 3657365 - RNA, 12 nt, Human
cuguuauguacu

SEQ ID NO: 3657366 - RNA, 14 nt, Human
cuguuauguacugu

SEQ ID NO: 3657367 - RNA, 17 nt, Human
cuguuauguacuguacu

SEQ ID NO: 3657368 - RNA, 21 nt, Human
cuguuauguacuguacuaauu

SEQ ID NO: 3657369 - RNA, 20 nt, Human
cuguuaugucuguuuaagaa

SEQ ID NO: 3657370 - RNA, 14 nt, Human
cuguuauucuuugc

SEQ ID NO: 3657371 - RNA, 16 nt, Human
cuguuauuucuauuuu

SEQ ID NO: 3657372 - RNA, 17 nt, Human
cuguuauuucuauuuuu

SEQ ID NO: 3657373 - RNA, 20 nt, Human
cuguuauuuucaaguagcug

SEQ ID NO: 3657374 - RNA, 16 nt, Human
cuguucaaagcugccu

SEQ ID NO: 3657375 - RNA, 12 nt, Human
cuguucaagagc

SEQ ID NO: 3657376 - RNA, 12 nt, Human
cuguucaaggaa

SEQ ID NO: 3657377 - RNA, 22 nt, Human
cuguucaauguuuuuaaaaauc

SEQ ID NO: 3657378 - RNA, 12 nt, Human
cuguucacccac

SEQ ID NO: 3657379 - RNA, 14 nt, Human
cuguucacccacag

SEQ ID NO: 3657380 - RNA, 14 nt, Human
cuguucagcguuuu

SEQ ID NO: 3657381 - RNA, 22 nt, Human
cuguucagcuacucccacuccc

SEQ ID NO: 3657382 - RNA, 13 nt, Human
cuguucagcucca

SEQ ID NO: 3657383 - RNA, 14 nt, Human
cuguucagcuccag

SEQ ID NO: 3657384 - RNA, 22 nt, Human
cuguucagcuccagcucaccag

SEQ ID NO: 3657385 - RNA, 19 nt, Human
cuguucagcugguugaggu

SEQ ID NO: 3657386 - RNA, 21 nt, Human
cuguucagcugguugagguuu

SEQ ID NO: 3657387 - RNA, 20 nt, Human
cuguucagcuuuuauuccug

SEQ ID NO: 3657388 - RNA, 16 nt, Human
cuguucagugucccgg

SEQ ID NO: 3657389 - RNA, 17 nt, Human
cuguucaugaaagauuc

SEQ ID NO: 3657390 - RNA, 23 nt, Human
cuguucauggcagauguaggagg

SEQ ID NO: 3657391 - RNA, 16 nt, Human
cuguucauuccuccag

SEQ ID NO: 3657392 - RNA, 22 nt, Human
cuguucauuccuccagguauuc

SEQ ID NO: 3657393 - RNA, 11 nt, Human
cuguuccaaau

SEQ ID NO: 3657394 - RNA, 20 nt, Human
cuguuccaaauucaguuuca

SEQ ID NO: 3657395 - RNA, 22 nt, Human
cuguuccaaauucaguuucaua

SEQ ID NO: 3657396 - RNA, 23 nt, Human
cuguuccagccugcccucuucau

SEQ ID NO: 3657397 - RNA, 13 nt, Human
cuguuccccagag

SEQ ID NO: 3657398 - RNA, 15 nt, Human
cuguuccccagagaa

SEQ ID NO: 3657399 - RNA, 12 nt, Human
cuguucccccgc

SEQ ID NO: 3657400 - RNA, 15 nt, Human
cuguucccccuucac

SEQ ID NO: 3657401 - RNA, 23 nt, Human
cuguucccccuucacaaagccca

SEQ ID NO: 3657402 - RNA, 22 nt, Human
cuguuccccuaguaagugccuu

SEQ ID NO: 3657403 - RNA, 15 nt, Human
cuguuccccucacug

SEQ ID NO: 3657404 - RNA, 16 nt, Human
cuguuccccucucccu

SEQ ID NO: 3657405 - RNA, 17 nt, Human
cuguuccccucucccuu

SEQ ID NO: 3657406 - RNA, 20 nt, Human
cuguucccucugcuccugga

SEQ ID NO: 3657407 - RNA, 17 nt, Human
cuguuccugcugcuguc

SEQ ID NO: 3657408 - RNA, 18 nt, Human
cuguuccugcugcugucu

SEQ ID NO: 3657409 - RNA, 21 nt, Human
cuguuccuggcucagccucaa

SEQ ID NO: 3657410 - RNA, 18 nt, Human
cuguuccuucacauccug

SEQ ID NO: 3657411 - RNA, 20 nt, Human
cuguucuacccguuccaaaa

SEQ ID NO: 3657412 - RNA, 12 nt, Human
cuguucuaguuu

SEQ ID NO: 3657413 - RNA, 16 nt, Human
cuguucucccuucggu

SEQ ID NO: 3657414 - RNA, 17 nt, Human
cuguucucugcccucca

SEQ ID NO: 3657415 - RNA, 18 nt, Human
cuguucucugcccuccaa

SEQ ID NO: 3657416 - RNA, 19 nt, Human
cuguucucugcccuccaag

SEQ ID NO: 3657417 - RNA, 15 nt, Human
cuguucucuucuuca

SEQ ID NO: 3657418 - RNA, 16 nt, Human
cuguucucuucuucau

SEQ ID NO: 3657419 - RNA, 18 nt, Human
cuguucugauauuaauuu

SEQ ID NO: 3657420 - RNA, 17 nt, Human
cuguucugcacugaaaa

SEQ ID NO: 3657421 - RNA, 18 nt, Human
cuguucugcacugaaaag

SEQ ID NO: 3657422 - RNA, 13 nt, Human
cuguucugguaau

SEQ ID NO: 3657423 - RNA, 11 nt, Human
cuguucugugg

SEQ ID NO: 3657424 - RNA, 23 nt, Human
cuguucuguggaaaguguaaagc

SEQ ID NO: 3657425 - RNA, 19 nt, Human
cuguucugugguuccucug

SEQ ID NO: 3657426 - RNA, 14 nt, Human
cuguucugugucuu

SEQ ID NO: 3657427 - RNA, 15 nt, Human
cuguucuguuucaag

SEQ ID NO: 3657428 - RNA, 17 nt, Human
cuguucuguuuugccug

SEQ ID NO: 3657429 - RNA, 18 nt, Human
cuguucuuaagacgugau

SEQ ID NO: 3657430 - RNA, 13 nt, Human
cuguucuuagcuc

SEQ ID NO: 3657431 - RNA, 23 nt, Human
cuguucuuagcucaaugagcaug

SEQ ID NO: 3657432 - RNA, 19 nt, Human
cuguucuuccucagccagc

SEQ ID NO: 3657433 - RNA, 23 nt, Human
cuguucuuccucagccagccucg

SEQ ID NO: 3657434 - RNA, 13 nt, Human
cuguucuuccugg

SEQ ID NO: 3657435 - RNA, 12 nt, Human
cuguucuugcug

SEQ ID NO: 3657436 - RNA, 14 nt, Human
cuguucuugcugcu

SEQ ID NO: 3657437 - RNA, 16 nt, Human
cuguucuugcugcuag

SEQ ID NO: 3657438 - RNA, 17 nt, Human
cuguucuugcugcuaga

SEQ ID NO: 3657439 - RNA, 18 nt, Human
cuguucuugcugcuagaa

SEQ ID NO: 3657440 - RNA, 20 nt, Human
cuguucuugcugcuagaacu

SEQ ID NO: 3657441 - RNA, 13 nt, Human
cuguucuuuaauu

SEQ ID NO: 3657442 - RNA, 16 nt, Human
cuguucuuuccaaagu

SEQ ID NO: 3657443 - RNA, 21 nt, Human
cuguucuuuccaaaguacacu

SEQ ID NO: 3657444 - RNA, 13 nt, Human
cuguucuuucugg

SEQ ID NO: 3657445 - RNA, 14 nt, Human
cuguucuuucuggc

SEQ ID NO: 3657446 - RNA, 14 nt, Human
cuguugaaaauuau

SEQ ID NO: 3657447 - RNA, 17 nt, Human
cuguugaaagcaaaaau

SEQ ID NO: 3657448 - RNA, 20 nt, Human
cuguugaaagcaaaaaugcu

SEQ ID NO: 3657449 - RNA, 22 nt, Human
cuguugaaagcaaaaaugcuaa

SEQ ID NO: 3657450 - RNA, 23 nt, Human
cuguugaauuuuguucucuggga

SEQ ID NO: 3657451 - RNA, 22 nt, Human
cuguugacacaggucuuuccua

SEQ ID NO: 3657452 - RNA, 15 nt, Human
cuguugacauauuua

SEQ ID NO: 3657453 - RNA, 20 nt, Human
cuguugacauauuuaauguu

SEQ ID NO: 3657454 - RNA, 22 nt, Human
cuguugacauauuuaauguuuu

SEQ ID NO: 3657455 - RNA, 14 nt, Human
cuguugaccaggca

SEQ ID NO: 3657456 - RNA, 18 nt, Human
cuguugacgcaccugugg

SEQ ID NO: 3657457 - RNA, 15 nt, Human
cuguugacuggcugu

SEQ ID NO: 3657458 - RNA, 15 nt, Human
cuguugagcuguuuu

SEQ ID NO: 3657459 - RNA, 14 nt, Human
cuguugauaaaaac

SEQ ID NO: 3657460 - RNA, 18 nt, Human
cuguugauaauucuuauu

SEQ ID NO: 3657461 - RNA, 14 nt, Human
cuguugauguaucu

SEQ ID NO: 3657462 - RNA, 15 nt, Human
cuguugauguaucug

SEQ ID NO: 3657463 - RNA, 20 nt, Human
cuguugauuucuuuccagag

SEQ ID NO: 3657464 - RNA, 16 nt, Human
cuguugcaagccccuc

SEQ ID NO: 3657465 - RNA, 22 nt, Human
cuguugcaagccccucuuucug

SEQ ID NO: 3657466 - RNA, 20 nt, Human
ccuggguuagacugccagcu

SEQ ID NO: 3657467 - RNA, 17 nt, Human
ccuggguucccuuuccu

SEQ ID NO: 3657468 - RNA, 16 nt, Human
ccuggguugcagacag

SEQ ID NO: 3657469 - RNA, 17 nt, Human
ccuggguugcagacagg

SEQ ID NO: 3657470 - RNA, 16 nt, Human
ccuggguuuaagggga

SEQ ID NO: 3657471 - RNA, 12 nt, Human
ccuggguuuugu

SEQ ID NO: 3657472 - RNA, 23 nt, Human
ccuggguuuuguauucucugagc

SEQ ID NO: 3657473 - RNA, 18 nt, Human
ccugguaauagcuguaaa

SEQ ID NO: 3657474 - RNA, 14 nt, Human
ccugguacccagcc

SEQ ID NO: 3657475 - RNA, 15 nt, Human
ccugguacccagcca

SEQ ID NO: 3657476 - RNA, 13 nt, Human
ccugguacucccu

SEQ ID NO: 3657477 - RNA, 20 nt, Human
ccugguauauccaaaagcuu

SEQ ID NO: 3657478 - RNA, 21 nt, Human
ccuggucacaggacucugccu

SEQ ID NO: 3657479 - RNA, 15 nt, Human
ccuggucaccuagga

SEQ ID NO: 3657480 - RNA, 17 nt, Human
ccuggucaccuaggaag

SEQ ID NO: 3657481 - RNA, 12 nt, Human
ccuggucagccc

SEQ ID NO: 3657482 - RNA, 19 nt, Human
ccuggucaggcccuggugc

SEQ ID NO: 3657483 - RNA, 14 nt, Human
ccugguccagggaa

SEQ ID NO: 3657484 - RNA, 13 nt, Human
ccugguccccucc

SEQ ID NO: 3657485 - RNA, 14 nt, Human
ccugguccugaggg

SEQ ID NO: 3657486 - RNA, 15 nt, Human
ccugguccuuccagg

SEQ ID NO: 3657487 - RNA, 13 nt, Human
ccuggucuccugc

SEQ ID NO: 3657488 - RNA, 18 nt, Human
ccuggucuccugccccca

SEQ ID NO: 3657489 - RNA, 19 nt, Human
ccuggucuccugcccccac

SEQ ID NO: 3657490 - RNA, 16 nt, Human
ccuggucuugagaugu

SEQ ID NO: 3657491 - RNA, 15 nt, Human
cuguugcccaggcug

SEQ ID NO: 3657492 - RNA, 18 nt, Human
cuguugcccuuucuguac

SEQ ID NO: 3657493 - RNA, 21 nt, Human
cuguugcccuuucuguaccau

SEQ ID NO: 3657494 - RNA, 22 nt, Human
cuguugccuuuuucauuuucca

SEQ ID NO: 3657495 - RNA, 23 nt, Human
cuguugcgugacacucuccuugc

SEQ ID NO: 3657496 - RNA, 23 nt, Human
cuguugcuaagccccagcaagca

SEQ ID NO: 3657497 - RNA, 18 nt, Human
cuguugcuauagagccua

SEQ ID NO: 3657498 - RNA, 15 nt, Human
cuguugcugaauagg

SEQ ID NO: 3657499 - RNA, 14 nt, Human
cuguugcugccuca

SEQ ID NO: 3657500 - RNA, 16 nt, Human
cuguugcugccucaug

SEQ ID NO: 3657501 - RNA, 20 nt, Human
cuguuggacccgcucuggac

SEQ ID NO: 3657502 - RNA, 16 nt, Human
cuguuggauuccaugc

SEQ ID NO: 3657503 - RNA, 19 nt, Human
cuguuggauuccaugcuaa

SEQ ID NO: 3657504 - RNA, 21 nt, Human
cuguuggcacucacagaccug

SEQ ID NO: 3657505 - RNA, 15 nt, Human
cuguuggcaggcugg

SEQ ID NO: 3657506 - RNA, 21 nt, Human
cuguuggcagugagugagccu

SEQ ID NO: 3657507 - RNA, 12 nt, Human
cuguuggccagu

SEQ ID NO: 3657508 - RNA, 19 nt, Human
cuguuggcugggggccuca

SEQ ID NO: 3657509 - RNA, 20 nt, Human
cuguugggagagggcgcagg

SEQ ID NO: 3657510 - RNA, 22 nt, Human
cuguugggagagggcgcaggcc

SEQ ID NO: 3657511 - RNA, 16 nt, Human
cuguugggccaggagc

SEQ ID NO: 3657512 - RNA, 14 nt, Human
cuguugguuccaag

SEQ ID NO: 3657513 - RNA, 18 nt, Human
cuguuguaacuuauguag

SEQ ID NO: 3657514 - RNA, 21 nt, Human
cuguuguaacuuauguagaua

SEQ ID NO: 3657515 - RNA, 19 nt, Human
cuguuguaagaauucugau

SEQ ID NO: 3657516 - RNA, 14 nt, Human
cuguuguacauuua

SEQ ID NO: 3657517 - RNA, 22 nt, Human
cuguuguacauuuaugauuuaa

SEQ ID NO: 3657518 - RNA, 21 nt, Human
cuguugucaccuucaccuccu

SEQ ID NO: 3657519 - RNA, 15 nt, Human
cuguugucauugcug

SEQ ID NO: 3657520 - RNA, 17 nt, Human
cuguugucauugcuguu

SEQ ID NO: 3657521 - RNA, 20 nt, Human
cuguuguccuccccuugggc

SEQ ID NO: 3657522 - RNA, 14 nt, Human
cuguugucucuucu

SEQ ID NO: 3657523 - RNA, 17 nt, Human
cuguugucucuucuccu

SEQ ID NO: 3657524 - RNA, 19 nt, Human
cuguugugaccugaaguuc

SEQ ID NO: 3657525 - RNA, 20 nt, Human
cuguugugaccugaaguuca

SEQ ID NO: 3657526 - RNA, 21 nt, Human
cuguuguguauagaugcaaga

SEQ ID NO: 3657527 - RNA, 17 nt, Human
cuguuguuaugaugugc

SEQ ID NO: 3657528 - RNA, 21 nt, Human
cuguuguuaugaugugcuuaa

SEQ ID NO: 3657529 - RNA, 13 nt, Human
cuguuguuguuaa

SEQ ID NO: 3657530 - RNA, 17 nt, Human
cuguuguuucuaaacaa

SEQ ID NO: 3657531 - RNA, 20 nt, Human
cuguuguuuuguuuuaaaua

SEQ ID NO: 3657532 - RNA, 21 nt, Human
cuguuuaaauugcucacaguu

SEQ ID NO: 3657533 - RNA, 13 nt, Human
cuguuuaagaaaa

SEQ ID NO: 3657534 - RNA, 20 nt, Human
cuguuuaagaaaaguauuuu

SEQ ID NO: 3657535 - RNA, 23 nt, Human
cuguuuaaucauaguuacugugu

SEQ ID NO: 3657536 - RNA, 14 nt, Human
cuguuuacaagaaa

SEQ ID NO: 3657537 - RNA, 15 nt, Human
cuguuuacaagaaaa

SEQ ID NO: 3657538 - RNA, 15 nt, Human
cuguuuacugcaagg

SEQ ID NO: 3657539 - RNA, 13 nt, Human
cuguuuagaacac

SEQ ID NO: 3657540 - RNA, 14 nt, Human
cuguuuagauaaua

SEQ ID NO: 3657541 - RNA, 19 nt, Human
cuguuuagauuugccauag

SEQ ID NO: 3657542 - RNA, 20 nt, Human
cuguuuagguuccccuguca

SEQ ID NO: 3657543 - RNA, 17 nt, Human
cuguuuaguagcaguga

SEQ ID NO: 3657544 - RNA, 19 nt, Human
cuguuuagucuccuuuuua

SEQ ID NO: 3657545 - RNA, 20 nt, Human
cuguuuauauguguugaaaa

SEQ ID NO: 3657546 - RNA, 18 nt, Human
cuguuuaucccuuaagaa

SEQ ID NO: 3657547 - RNA, 15 nt, Human
cuguuuaugcuuuug

SEQ ID NO: 3657548 - RNA, 21 nt, Human
cuguuuauggccacauuuaau

SEQ ID NO: 3657549 - RNA, 14 nt, Human
cuguuuauggccuc

SEQ ID NO: 3657550 - RNA, 17 nt, Human
cuguuuauggccucagc

SEQ ID NO: 3657551 - RNA, 18 nt, Human
cuguuuauggccucagcu

SEQ ID NO: 3657552 - RNA, 16 nt, Human
cuguuuauuaaucuua

SEQ ID NO: 3657553 - RNA, 21 nt, Human
cuguuuauuacuuccaugaau

SEQ ID NO: 3657554 - RNA, 16 nt, Human
cuguuuauucauaugc

SEQ ID NO: 3657555 - RNA, 16 nt, Human
cuguuuauuuuauauu

SEQ ID NO: 3657556 - RNA, 17 nt, Human
cuguuucaaacuuuacu

SEQ ID NO: 3657557 - RNA, 15 nt, Human
cuguuucaaaguucu

SEQ ID NO: 3657558 - RNA, 17 nt, Human
cuguuucaaucacuguc

SEQ ID NO: 3657559 - RNA, 15 nt, Human
cuguuucccagcagu

SEQ ID NO: 3657560 - RNA, 21 nt, Human
cuguuucccuucccuuccacu

SEQ ID NO: 3657561 - RNA, 11 nt, Human
cuguuuccugu

SEQ ID NO: 3657562 - RNA, 13 nt, Human
cuguuuccuuuua

SEQ ID NO: 3657563 - RNA, 20 nt, Human
cuguuucuaauuugcugcug

SEQ ID NO: 3657564 - RNA, 13 nt, Human
cuguuucucugcu

SEQ ID NO: 3657565 - RNA, 16 nt, Human
cuguuucucuugagcu

SEQ ID NO: 3657566 - RNA, 20 nt, Human
cuguuucucuugagcuggcc

SEQ ID NO: 3657567 - RNA, 21 nt, Human
cuguuucucuugagcuggccu

SEQ ID NO: 3657568 - RNA, 22 nt, Human
cuguuucucuugagcuggccuc

SEQ ID NO: 3657569 - RNA, 16 nt, Human
cuguuucucuuuccuu

SEQ ID NO: 3657570 - RNA, 19 nt, Human
cuguuucucuuuccuuggc

SEQ ID NO: 3657571 - RNA, 18 nt, Human
cuguuucugaaaagaaau

SEQ ID NO: 3657572 - RNA, 21 nt, Human
cuguuucugaaaagaaauaau

SEQ ID NO: 3657573 - RNA, 12 nt, Human
cuguuucuuccu

SEQ ID NO: 3657574 - RNA, 15 nt, Human
cuguuucuugcuugu

SEQ ID NO: 3657575 - RNA, 19 nt, Human
cuguuugaaaacuucagaa

SEQ ID NO: 3657576 - RNA, 12 nt, Human
cuguuugagaaa

SEQ ID NO: 3657577 - RNA, 23 nt, Human
cuguuugaggauauauuuucacu

SEQ ID NO: 3657578 - RNA, 17 nt, Human
cuguuugcuaagugagg

SEQ ID NO: 3657579 - RNA, 18 nt, Human
cuguuugcuucaccgugg

SEQ ID NO: 3657580 - RNA, 22 nt, Human
cuguuuggaaauugauuuugaa

SEQ ID NO: 3657581 - RNA, 12 nt, Human
cuguuuggacug

SEQ ID NO: 3657582 - RNA, 16 nt, Human
cuguuuggacuuugua

SEQ ID NO: 3657583 - RNA, 22 nt, Human
cuguuuguccugagauggaaaa

SEQ ID NO: 3657584 - RNA, 17 nt, Human
cuguuugucuucucccc

SEQ ID NO: 3657585 - RNA, 14 nt, Human
cuguuuguuaaaac

SEQ ID NO: 3657586 - RNA, 20 nt, Human
cuguuuguuucaagaaccug

SEQ ID NO: 3657587 - RNA, 14 nt, Human
cuguuuguuucaua

SEQ ID NO: 3657588 - RNA, 18 nt, Human
cuguuuguuucugaaagg

SEQ ID NO: 3657589 - RNA, 22 nt, Human
cuguuuuaaauuuauuucaaaa

SEQ ID NO: 3657590 - RNA, 14 nt, Human
cuguuuuacaaguu

SEQ ID NO: 3657591 - RNA, 13 nt, Human
cuguuuuacugcu

SEQ ID NO: 3657592 - RNA, 15 nt, Human
cuguuuuacugcuuu

SEQ ID NO: 3657593 - RNA, 18 nt, Human
cuguuuuagguuaaaaaa

SEQ ID NO: 3657594 - RNA, 14 nt, Human
cuguuuuauaauuu

SEQ ID NO: 3657595 - RNA, 13 nt, Human
cuguuuucccccc

SEQ ID NO: 3657596 - RNA, 14 nt, Human
cuguuuuccucccu

SEQ ID NO: 3657597 - RNA, 16 nt, Human
cuguuuuccuuucuca

SEQ ID NO: 3657598 - RNA, 15 nt, Human
cuguuuucuagugua

SEQ ID NO: 3657599 - RNA, 17 nt, Human
cuguuuucuaguguauc

SEQ ID NO: 3657600 - RNA, 13 nt, Human
cuguuuucugagc

SEQ ID NO: 3657601 - RNA, 15 nt, Human
cuguuuucugagccc

SEQ ID NO: 3657602 - RNA, 19 nt, Human
cuguuuucugagcccgggc

SEQ ID NO: 3657603 - RNA, 21 nt, Human
cuguuuucuuuaugucuuuug

SEQ ID NO: 3657604 - RNA, 17 nt, Human
cuguuuugaaggcaaaa

SEQ ID NO: 3657605 - RNA, 22 nt, Human
cuguuuugccugaaguuggagu

SEQ ID NO: 3657606 - RNA, 17 nt, Human
cuguuuuguuauauaau

SEQ ID NO: 3657607 - RNA, 18 nt, Human
cuguuuuguuauauaauu

SEQ ID NO: 3657608 - RNA, 14 nt, Human
cuguuuuguugaca

SEQ ID NO: 3657609 - RNA, 19 nt, Human
cuguuuuguugacauucug

SEQ ID NO: 3657610 - RNA, 16 nt, Human
cuguuuuguuucgcuc

SEQ ID NO: 3657611 - RNA, 17 nt, Human
cuguuuuuaaaaaucau

SEQ ID NO: 3657612 - RNA, 17 nt, Human
cuguuuuuaagcuguuu

SEQ ID NO: 3657613 - RNA, 22 nt, Human
cuguuuuuacccauauccccuc

SEQ ID NO: 3657614 - RNA, 18 nt, Human
cuguuuuuagacaccuuc

SEQ ID NO: 3657615 - RNA, 12 nt, Human
cuguuuuucaca

SEQ ID NO: 3657616 - RNA, 15 nt, Human
cuguuuuucacauuu

SEQ ID NO: 3657617 - RNA, 21 nt, Human
cuguuuuucuggguggccucg

SEQ ID NO: 3657618 - RNA, 13 nt, Human
cuguuuuuguugu

SEQ ID NO: 3657619 - RNA, 14 nt, Human
cuguuuuuuuguua

SEQ ID NO: 3657620 - RNA, 14 nt, Human
cuuaaaaaaauaaa

SEQ ID NO: 3657621 - RNA, 18 nt, Human
cuuaaaaaacuuguaaau

SEQ ID NO: 3657622 - RNA, 12 nt, Human
cuuaaaaacuca

SEQ ID NO: 3657623 - RNA, 14 nt, Human
cuuaaaaaguaacu

SEQ ID NO: 3657624 - RNA, 22 nt, Human
cuuaaaaagucugcauuacauu

SEQ ID NO: 3657625 - RNA, 14 nt, Human
cuuaaaaaguuaua

SEQ ID NO: 3657626 - RNA, 13 nt, Human
cuuaaaaaucaca

SEQ ID NO: 3657627 - RNA, 20 nt, Human
cuuaaaaaucauugauuguc

SEQ ID NO: 3657628 - RNA, 12 nt, Human
cuuaaaaauggu

SEQ ID NO: 3657629 - RNA, 18 nt, Human
cuuaaaaauguaaauauu

SEQ ID NO: 3657630 - RNA, 20 nt, Human
cuuaaaacaucauuccuuuu

SEQ ID NO: 3657631 - RNA, 12 nt, Human
cuuaaaaccugc

SEQ ID NO: 3657632 - RNA, 15 nt, Human
cugugggcaauuuag

SEQ ID NO: 3657633 - RNA, 21 nt, Human
cugugggcacaggucaggcua

SEQ ID NO: 3657634 - RNA, 23 nt, Human
cugugggcuacaugcugggguca

SEQ ID NO: 3657635 - RNA, 14 nt, Human
cugugggcucccuu

SEQ ID NO: 3657636 - RNA, 17 nt, Human
cuucacucuaagauguu

SEQ ID NO: 3657637 - RNA, 14 nt, Human
cuucacugccuuug

SEQ ID NO: 3657638 - RNA, 17 nt, Human
cuucacuguauaaauag

SEQ ID NO: 3657639 - RNA, 14 nt, Human
cuucacugugcugu

SEQ ID NO: 3657640 - RNA, 18 nt, Human
cuucacuguugaaaauua

SEQ ID NO: 3657641 - RNA, 13 nt, Human
cuucacuucuccc

SEQ ID NO: 3657642 - RNA, 14 nt, Human
cuucacuucuccca

SEQ ID NO: 3657643 - RNA, 16 nt, Human
cuucacuucugaccac

SEQ ID NO: 3657644 - RNA, 12 nt, Human
cuucagaaagac

SEQ ID NO: 3657645 - RNA, 20 nt, Human
cuucagaaagugugcuuuau

SEQ ID NO: 3657646 - RNA, 17 nt, Human
cuucagaagacacugca

SEQ ID NO: 3657647 - RNA, 19 nt, Human
cuucagacacaaaagucca

SEQ ID NO: 3657648 - RNA, 16 nt, Human
cuucagacugcaagug

SEQ ID NO: 3657649 - RNA, 14 nt, Human
cuucagacuuugcu

SEQ ID NO: 3657650 - RNA, 20 nt, Human
cuucagagacuccugcaggc

SEQ ID NO: 3657651 - RNA, 11 nt, Human
cuucagagagc

SEQ ID NO: 3657652 - RNA, 20 nt, Human
cuucagagagcagugcuuuu

SEQ ID NO: 3657653 - RNA, 12 nt, Human
cuucagagcuga

SEQ ID NO: 3657654 - RNA, 14 nt, Human
cuucagagcugaca

SEQ ID NO: 3657655 - RNA, 20 nt, Human
cuucagagcugacacaggau

SEQ ID NO: 3657656 - RNA, 14 nt, Human
cuucagauccuacc

SEQ ID NO: 3657657 - RNA, 18 nt, Human
cuucagauguggagccag

SEQ ID NO: 3657658 - RNA, 21 nt, Human
cuucagauguggagccaggcg

SEQ ID NO: 3657659 - RNA, 18 nt, Human
cuucagauuuguguuaua

SEQ ID NO: 3657660 - RNA, 17 nt, Human
cuucagcaaaaauauuu

SEQ ID NO: 3657661 - RNA, 20 nt, Human
cuucagcaaaaauauuuuau

SEQ ID NO: 3657662 - RNA, 23 nt, Human
cuucagcaaaaauauuuuaugau

SEQ ID NO: 3657663 - RNA, 15 nt, Human
cuucagcaagagaga

SEQ ID NO: 3657664 - RNA, 10 nt, Human
cuucagcacc

SEQ ID NO: 3657665 - RNA, 21 nt, Human
cuucagcaguaccuauaaagu

SEQ ID NO: 3657666 - RNA, 15 nt, Human
cuucagcauccucag

SEQ ID NO: 3657667 - RNA, 17 nt, Human
cuucagccaggagcugg

SEQ ID NO: 3657668 - RNA, 14 nt, Human
cuucagcccccagc

SEQ ID NO: 3657669 - RNA, 18 nt, Human
cuucagcccccagccccu

SEQ ID NO: 3657670 - RNA, 15 nt, Human
cuucagcccucaccc

SEQ ID NO: 3657671 - RNA, 13 nt, Human
cuucagccuagcc

SEQ ID NO: 3657672 - RNA, 20 nt, Human
cuucagccuagccgaccuca

SEQ ID NO: 3657673 - RNA, 23 nt, Human
cuucagccuagccgaccucagcc

SEQ ID NO: 3657674 - RNA, 23 nt, Human
cuucagccuaguggcuuguccuc

SEQ ID NO: 3657675 - RNA, 20 nt, Human
cuucagccuccccaccuucu

SEQ ID NO: 3657676 - RNA, 14 nt, Human
cuucagccucccga

SEQ ID NO: 3657677 - RNA, 13 nt, Human
cuucagccucucc

SEQ ID NO: 3657678 - RNA, 20 nt, Human
cuucagccugaggcugagac

SEQ ID NO: 3657679 - RNA, 17 nt, Human
cuucagcucacgcuuca

SEQ ID NO: 3657680 - RNA, 19 nt, Human
cuucagcuccagccccuuu

SEQ ID NO: 3657681 - RNA, 23 nt, Human
cuucagcuccagccccuuuccaa

SEQ ID NO: 3657682 - RNA, 13 nt, Human
cuucagcuccagg

SEQ ID NO: 3657683 - RNA, 15 nt, Human
cuucagcugacuuuu

SEQ ID NO: 3657684 - RNA, 21 nt, Human
cuucaggaaagcagcaguuuu

SEQ ID NO: 3657685 - RNA, 21 nt, Human
cuucaggaaccucgaguacug

SEQ ID NO: 3657686 - RNA, 21 nt, Human
cuuacacaaaggggaucauaa

SEQ ID NO: 3657687 - RNA, 16 nt, Human
cuuacacauacaguuu

SEQ ID NO: 3657688 - RNA, 17 nt, Human
cuuacacauuaagcaaa

SEQ ID NO: 3657689 - RNA, 21 nt, Human
cuuacacuggcaaugguaguu

SEQ ID NO: 3657690 - RNA, 21 nt, Human
cuuacagauaggccuucuugu

SEQ ID NO: 3657691 - RNA, 22 nt, Human
cuuacagauaggccuucuugug

SEQ ID NO: 3657692 - RNA, 16 nt, Human
cuuacagcauaaggga

SEQ ID NO: 3657693 - RNA, 20 nt, Human
cuuacauaaaccauuuuugu

SEQ ID NO: 3657694 - RNA, 16 nt, Human
cuuacauaauuuuuua

SEQ ID NO: 3657695 - RNA, 22 nt, Human
cuuacauaauuuuuuauucaag

SEQ ID NO: 3657696 - RNA, 15 nt, Human
cuuacaugagaacag

SEQ ID NO: 3657697 - RNA, 16 nt, Human
cuuacaugagaacaga

SEQ ID NO: 3657698 - RNA, 12 nt, Human
cuuacaugauuc

SEQ ID NO: 3657699 - RNA, 19 nt, Human
cuuacaugcauuacugcau

SEQ ID NO: 3657700 - RNA, 14 nt, Human
cuuacaugcauuug

SEQ ID NO: 3657701 - RNA, 21 nt, Human
cuuacauuagcaguuugcuuu

SEQ ID NO: 3657702 - RNA, 20 nt, Human
cuuacauucucuaauaagaa

SEQ ID NO: 3657703 - RNA, 12 nt, Human
cuuacauuugug

SEQ ID NO: 3657704 - RNA, 20 nt, Human
cuuacauuugugagauuccu

SEQ ID NO: 3657705 - RNA, 14 nt, Human
cuuacauuuuuaca

SEQ ID NO: 3657706 - RNA, 19 nt, Human
cuuaccaacuuucuguaaa

SEQ ID NO: 3657707 - RNA, 16 nt, Human
cuuaccaauagcaggg

SEQ ID NO: 3657708 - RNA, 13 nt, Human
cuuaccagaagcu

SEQ ID NO: 3657709 - RNA, 15 nt, Human
cuuaccagcagagca

SEQ ID NO: 3657710 - RNA, 19 nt, Human
cuuaccaggcaccaaaaga

SEQ ID NO: 3657711 - RNA, 14 nt, Human
cuuaccaugugccu

SEQ ID NO: 3657712 - RNA, 19 nt, Human
cuuaccccuggcuguuugg

SEQ ID NO: 3657713 - RNA, 20 nt, Human
cuuaccccuuagccucccug

SEQ ID NO: 3657714 - RNA, 18 nt, Human
cuuacccucauguucuua

SEQ ID NO: 3657715 - RNA, 15 nt, Human
cuuacccuuagggag

SEQ ID NO: 3657716 - RNA, 18 nt, Human
cuuacccuucugugccca

SEQ ID NO: 3657717 - RNA, 23 nt, Human
cuuacccuucugugcccagcuca

SEQ ID NO: 3657718 - RNA, 20 nt, Human
cuuaccgugggcacugaagg

SEQ ID NO: 3657719 - RNA, 19 nt, Human
cuuaccuaaacagauauaa

SEQ ID NO: 3657720 - RNA, 21 nt, Human
cuuaccuaaacagauauaaau

SEQ ID NO: 3657721 - RNA, 22 nt, Human
cuuaccuaaacagauauaaaug

SEQ ID NO: 3657722 - RNA, 14 nt, Human
cuuaccuagugaaa

SEQ ID NO: 3657723 - RNA, 16 nt, Human
cuuaccuccugcccag

SEQ ID NO: 3657724 - RNA, 17 nt, Human
cuuaccuccugcccagg

SEQ ID NO: 3657725 - RNA, 17 nt, Human
cuuaccugaccucuugc

SEQ ID NO: 3657726 - RNA, 13 nt, Human
cuuaccugccagg

SEQ ID NO: 3657727 - RNA, 13 nt, Human
cuuaccuggccca

SEQ ID NO: 3657728 - RNA, 18 nt, Human
cuuaccuggcccaucagg

SEQ ID NO: 3657729 - RNA, 19 nt, Human
cuuaccuugaacugaaggc

SEQ ID NO: 3657730 - RNA, 19 nt, Human
cuuaccuuuuuauuugcau

SEQ ID NO: 3657731 - RNA, 17 nt, Human
cuuacggcccuggccuu

SEQ ID NO: 3657732 - RNA, 21 nt, Human
cuuacuaaacauuuuguuauu

SEQ ID NO: 3657733 - RNA, 23 nt, Human
cuuacuaagcuuugccagcugcu

SEQ ID NO: 3657734 - RNA, 24 nt, Human
cuuacuaagcuuugccagcugcug

SEQ ID NO: 3657735 - RNA, 15 nt, Human
cuuacuaauguaaaa

SEQ ID NO: 3657736 - RNA, 20 nt, Human
cuuacuacaugugggagcuu

SEQ ID NO: 3657737 - RNA, 19 nt, Human
cuuacuaguuucccuugca

SEQ ID NO: 3657738 - RNA, 12 nt, Human
cuuacuccugug

SEQ ID NO: 3657739 - RNA, 20 nt, Human
cuuacucuaagaucuuagau

SEQ ID NO: 3657740 - RNA, 16 nt, Human
cuuacucuguccauuu

SEQ ID NO: 3657741 - RNA, 17 nt, Human
cuuacucuguccauuua

SEQ ID NO: 3657742 - RNA, 14 nt, Human
cuuacucuuuccua

SEQ ID NO: 3657743 - RNA, 16 nt, Human
cuuacucuuuccuauu

SEQ ID NO: 3657744 - RNA, 12 nt, Human
cuuacugaaggu

SEQ ID NO: 3657745 - RNA, 19 nt, Human
cuuacugauauauuuuaca

SEQ ID NO: 3657746 - RNA, 21 nt, Human
cuuacugauauauuuuacaau

SEQ ID NO: 3657747 - RNA, 13 nt, Human
cuuacugcagaau

SEQ ID NO: 3657748 - RNA, 15 nt, Human
cuuacuguagccuca

SEQ ID NO: 3657749 - RNA, 13 nt, Human
cuuacuuacagca

SEQ ID NO: 3657750 - RNA, 14 nt, Human
cuuacuuacccuca

SEQ ID NO: 3657751 - RNA, 14 nt, Human
cuuacuuaguguua

SEQ ID NO: 3657752 - RNA, 18 nt, Human
cuuacuuauuaucuucag

SEQ ID NO: 3657753 - RNA, 16 nt, Human
cuuacuucuugcccug

SEQ ID NO: 3657754 - RNA, 19 nt, Human
cuuacuuggaacugaaggg

SEQ ID NO: 3657755 - RNA, 20 nt, Human
cuuacuuuaccucucuguca

SEQ ID NO: 3657756 - RNA, 18 nt, Human
cuuacuuuccugaaaaua

SEQ ID NO: 3657757 - RNA, 21 nt, Human
cuuacuuuccuuuccccagcc

SEQ ID NO: 3657758 - RNA, 12 nt, Human
cuuacuuuguaa

SEQ ID NO: 3657759 - RNA, 17 nt, Human
cuuacuuuguaaauucu

SEQ ID NO: 3657760 - RNA, 20 nt, Human
cuuacuuuguaaauucugau

SEQ ID NO: 3657761 - RNA, 15 nt, Human
cuuacuuuguaugau

SEQ ID NO: 3657762 - RNA, 18 nt, Human
cuuacuuuguaugauauu

SEQ ID NO: 3657763 - RNA, 21 nt, Human
cuuacuuuuaaggauaaauca

SEQ ID NO: 3657764 - RNA, 14 nt, Human
cuuacuuuuuauau

SEQ ID NO: 3657765 - RNA, 22 nt, Human
cuuagaaaacaauggaaugaga

SEQ ID NO: 3657766 - RNA, 19 nt, Human
cuuagaaaaccagcucagc

SEQ ID NO: 3657767 - RNA, 21 nt, Human
cuuagaaaaccagcucagcac

SEQ ID NO: 3657768 - RNA, 23 nt, Human
cuuagaaaaccagcucagcacug

SEQ ID NO: 3657769 - RNA, 21 nt, Human
cuuagaaaaggugauaaaauc

SEQ ID NO: 3657770 - RNA, 20 nt, Human
cuuagaaauguaaacugcca

SEQ ID NO: 3657771 - RNA, 16 nt, Human
cuuagaaauugcauuu

SEQ ID NO: 3657772 - RNA, 20 nt, Human
cuuagaacaguggaaacuau

SEQ ID NO: 3657773 - RNA, 14 nt, Human
cuuagaagguauua

SEQ ID NO: 3657774 - RNA, 17 nt, Human
cuuagaaguggaccagg

SEQ ID NO: 3657775 - RNA, 20 nt, Human
cuuagaaguggaccaggaca

SEQ ID NO: 3657776 - RNA, 21 nt, Human
cuuagaaguggaccaggacag

SEQ ID NO: 3657777 - RNA, 11 nt, Human
cuuagaauaaa

SEQ ID NO: 3657778 - RNA, 15 nt, Human
cuuagaauaaaauug

SEQ ID NO: 3657779 - RNA, 20 nt, Human
cuuagaauaaaauuguaaaa

SEQ ID NO: 3657780 - RNA, 15 nt, Human
cuuagaaucccugug

SEQ ID NO: 3657781 - RNA, 20 nt, Human
cuucauucaacccaccugcg

SEQ ID NO: 3657782 - RNA, 22 nt, Human
cuucauucuccuuguuguuggu

SEQ ID NO: 3657783 - RNA, 15 nt, Human
cuucauucuuugcag

SEQ ID NO: 3657784 - RNA, 19 nt, Human
cuucauugccuuaacugga

SEQ ID NO: 3657785 - RNA, 19 nt, Human
cuucauugucccucuucac

SEQ ID NO: 3657786 - RNA, 21 nt, Human
cuucauugucccucuucacuc

SEQ ID NO: 3657787 - RNA, 12 nt, Human
cuucauuuaaaa

SEQ ID NO: 3657788 - RNA, 14 nt, Human
cuucauuucauugu

SEQ ID NO: 3657789 - RNA, 13 nt, Human
cuucauuuggaga

SEQ ID NO: 3657790 - RNA, 18 nt, Human
cuucauuugggaugcuac

SEQ ID NO: 3657791 - RNA, 11 nt, Human
cuucauuugug

SEQ ID NO: 3657792 - RNA, 12 nt, Human
cuucauuuuccc

SEQ ID NO: 3657793 - RNA, 18 nt, Human
cuucauuuugaggggagg

SEQ ID NO: 3657794 - RNA, 13 nt, Human
cuucauuuuuccu

SEQ ID NO: 3657795 - RNA, 14 nt, Human
cuucauuuuuccua

SEQ ID NO: 3657796 - RNA, 19 nt, Human
cuucauuuuuuuuaauuga

SEQ ID NO: 3657797 - RNA, 19 nt, Human
cuuccaaacaggcucagag

SEQ ID NO: 3657798 - RNA, 22 nt, Human
cuuccaaagaauguuagagcac

SEQ ID NO: 3657799 - RNA, 21 nt, Human
cuuccaaaguaaaauugcugu

SEQ ID NO: 3657800 - RNA, 19 nt, Human
cuuccaaaugcaauuugau

SEQ ID NO: 3657801 - RNA, 18 nt, Human
cuuccaacaggagcuggg

SEQ ID NO: 3657802 - RNA, 19 nt, Human
cuuccaacccauuagccau

SEQ ID NO: 3657803 - RNA, 19 nt, Human
cuuccaacugcugccccaa

SEQ ID NO: 3657804 - RNA, 13 nt, Human
cuuccaagaccug

SEQ ID NO: 3657805 - RNA, 14 nt, Human
cuuccaagaccuga

SEQ ID NO: 3657806 - RNA, 15 nt, Human
cuuccaagagccuga

SEQ ID NO: 3657807 - RNA, 16 nt, Human
cuuccaaugucuggag

SEQ ID NO: 3657808 - RNA, 18 nt, Human
cuuccaaugucuggagac

SEQ ID NO: 3657809 - RNA, 22 nt, Human
cuuccacaagagcccaggccuc

SEQ ID NO: 3657810 - RNA, 14 nt, Human
cuuccacaccccca

SEQ ID NO: 3657811 - RNA, 13 nt, Human
cuuccacaggguc

SEQ ID NO: 3657812 - RNA, 15 nt, Human
cuuccacaggguccc

SEQ ID NO: 3657813 - RNA, 19 nt, Human
cuuccacagggucccacag

SEQ ID NO: 3657814 - RNA, 21 nt, Human
cuuccacaggucucagaaucu

SEQ ID NO: 3657815 - RNA, 16 nt, Human
cuuccaccagccugca

SEQ ID NO: 3657816 - RNA, 17 nt, Human
cuuccaccucaccccac

SEQ ID NO: 3657817 - RNA, 13 nt, Human
cuuccaccucccu

SEQ ID NO: 3657818 - RNA, 14 nt, Human
cuuccaccugcucu

SEQ ID NO: 3657819 - RNA, 18 nt, Human
cuuccaccugcucugcug

SEQ ID NO: 3657820 - RNA, 22 nt, Human
cuuccacgcugucuccagaccc

SEQ ID NO: 3657821 - RNA, 14 nt, Human
cuuccacugagggc

SEQ ID NO: 3657822 - RNA, 17 nt, Human
cuuccacugccucugcc

SEQ ID NO: 3657823 - RNA, 16 nt, Human
cuuccacuugaguguc

SEQ ID NO: 3657824 - RNA, 13 nt, Human
cuuccagaaauac

SEQ ID NO: 3657825 - RNA, 16 nt, Human
cuuccagaaucccaag

SEQ ID NO: 3657826 - RNA, 20 nt, Human
cuuccagaucacugccacac

SEQ ID NO: 3657827 - RNA, 19 nt, Human
cuuccagauccucucuggg

SEQ ID NO: 3657828 - RNA, 21 nt, Human
cuuccagauggucauccagac

SEQ ID NO: 3657829 - RNA, 16 nt, Human
cuuccagcacccugca

SEQ ID NO: 3657830 - RNA, 11 nt, Human
cuuccagcagg

SEQ ID NO: 3657831 - RNA, 13 nt, Human
cuuccagcaggag

SEQ ID NO: 3657832 - RNA, 12 nt, Human
cuuccagcuccu

SEQ ID NO: 3657833 - RNA, 14 nt, Human
cuuccagcuccugu

SEQ ID NO: 3657834 - RNA, 21 nt, Human
cuuccagcugcugucuucugg

SEQ ID NO: 3657835 - RNA, 19 nt, Human
cuuccaggaaaaaggacag

SEQ ID NO: 3657836 - RNA, 17 nt, Human
cuuccaggaugguguua

SEQ ID NO: 3657837 - RNA, 16 nt, Human
cuuccaggcccccacc

SEQ ID NO: 3657838 - RNA, 21 nt, Human
cuuccaggcugcauagaagga

SEQ ID NO: 3657839 - RNA, 15 nt, Human
cuuccaggcugggag

SEQ ID NO: 3657840 - RNA, 22 nt, Human
cuuccagggacgaagaagagcc

SEQ ID NO: 3657841 - RNA, 16 nt, Human
cuuccaggggaaccug

SEQ ID NO: 3657842 - RNA, 15 nt, Human
cuuccagggguggga

SEQ ID NO: 3657843 - RNA, 16 nt, Human
cuuccaggugcccagc

SEQ ID NO: 3657844 - RNA, 16 nt, Human
cuuccaguauaaccag

SEQ ID NO: 3657845 - RNA, 13 nt, Human
cuuccagucagga

SEQ ID NO: 3657846 - RNA, 17 nt, Human
cuuccaguccaaucuca

SEQ ID NO: 3657847 - RNA, 22 nt, Human
cuuccagucuuccugacacuuu

SEQ ID NO: 3657848 - RNA, 14 nt, Human
cuuccagugaggcu

SEQ ID NO: 3657849 - RNA, 15 nt, Human
cuuccagugaggcuc

SEQ ID NO: 3657850 - RNA, 18 nt, Human
cuuccagugaggcucugc

SEQ ID NO: 3657851 - RNA, 21 nt, Human
cuuccagugaggcucugcccu

SEQ ID NO: 3657852 - RNA, 17 nt, Human
ccuugcucucccucuuc

SEQ ID NO: 3657853 - RNA, 19 nt, Human
ccuugcucucccucuucuc

SEQ ID NO: 3657854 - RNA, 22 nt, Human
ccuugcugcaagcacagcccuu

SEQ ID NO: 3657855 - RNA, 15 nt, Human
ccuugcuggccccag

SEQ ID NO: 3657856 - RNA, 16 nt, Human
ccuugcuggccccagc

SEQ ID NO: 3657857 - RNA, 19 nt, Human
ccuugcuggccccagcccu

SEQ ID NO: 3657858 - RNA, 21 nt, Human
ccuugcuguaugcugaucauc

SEQ ID NO: 3657859 - RNA, 20 nt, Human
ccuugcuucuuacugauaau

SEQ ID NO: 3657860 - RNA, 21 nt, Human
ccuugcuuguugggauuccug

SEQ ID NO: 3657861 - RNA, 22 nt, Human
ccuugcuuuucccucuuuucuu

SEQ ID NO: 3657862 - RNA, 18 nt, Human
ccuugcuuuugcuucuag

SEQ ID NO: 3657863 - RNA, 21 nt, Human
ccuugcuuuugcuucuagagc

SEQ ID NO: 3657864 - RNA, 22 nt, Human
ccuuggaaaccugcccugccug

SEQ ID NO: 3657865 - RNA, 22 nt, Human
ccuuggaaguugcauggcauca

SEQ ID NO: 3657866 - RNA, 16 nt, Human
ccuuggacacgcucag

SEQ ID NO: 3657867 - RNA, 15 nt, Human
ccuuggauugucccc

SEQ ID NO: 3657868 - RNA, 14 nt, Human
ccuuggcaccaaag

SEQ ID NO: 3657869 - RNA, 19 nt, Human
ccuuggcagguccuggcca

SEQ ID NO: 3657870 - RNA, 15 nt, Human
ccuuggcaugccuuc

SEQ ID NO: 3657871 - RNA, 20 nt, Human
ccuuggcaugccuuccagca

SEQ ID NO: 3657872 - RNA, 21 nt, Human
ccuuggcaugccuuccagcac

SEQ ID NO: 3657873 - RNA, 15 nt, Human
ccuuggccgcaccua

SEQ ID NO: 3657874 - RNA, 23 nt, Human
ccuuggccggcugugcucagaga

SEQ ID NO: 3657875 - RNA, 15 nt, Human
ccuuggccuagccca

SEQ ID NO: 3657876 - RNA, 20 nt, Human
ccuuggccuagcccacccug

SEQ ID NO: 3657877 - RNA, 15 nt, Human
ccuuggccugucuca

SEQ ID NO: 3657878 - RNA, 19 nt, Human
ccuuggccugucucauccc

SEQ ID NO: 3657879 - RNA, 14 nt, Human
ccuuggccuguguu

SEQ ID NO: 3657880 - RNA, 20 nt, Human
ccuuggcugacaugaagcug

SEQ ID NO: 3657881 - RNA, 13 nt, Human
ccuuggcugcagg

SEQ ID NO: 3657882 - RNA, 14 nt, Human
ccuuggcugcaggg

SEQ ID NO: 3657883 - RNA, 17 nt, Human
ccuuggcuucugugaug

SEQ ID NO: 3657884 - RNA, 16 nt, Human
ccuuggcuuggcccug

SEQ ID NO: 3657885 - RNA, 21 nt, Human
ccuuggcuuggcccuggcagc

SEQ ID NO: 3657886 - RNA, 14 nt, Human
ccuugggaggaagc

SEQ ID NO: 3657887 - RNA, 18 nt, Human
ccuugggaggaagcagaa

SEQ ID NO: 3657888 - RNA, 20 nt, Human
ccuugggaggccccacuggg

SEQ ID NO: 3657889 - RNA, 14 nt, Human
ccuugggauccagg

SEQ ID NO: 3657890 - RNA, 17 nt, Human
ccuugggcccuuugagu

SEQ ID NO: 3657891 - RNA, 13 nt, Human
ccuugggcucccu

SEQ ID NO: 3657892 - RNA, 16 nt, Human
ccuugggcucugauga

SEQ ID NO: 3657893 - RNA, 20 nt, Human
ccuugggcucugaugaaaaa

SEQ ID NO: 3657894 - RNA, 22 nt, Human
ccuuggggaauuuccucuauug

SEQ ID NO: 3657895 - RNA, 19 nt, Human
ccuuggggaggacaaaacu

SEQ ID NO: 3657896 - RNA, 20 nt, Human
ccuuggggaggacaaaacuu

SEQ ID NO: 3657897 - RNA, 19 nt, Human
ccuuggggcugaugcaguu

SEQ ID NO: 3657898 - RNA, 21 nt, Human
ccuuggggguccuccuccagg

SEQ ID NO: 3657899 - RNA, 19 nt, Human
ccuuggguagugagcagug

SEQ ID NO: 3657900 - RNA, 16 nt, Human
ccuuggucuuuguauc

SEQ ID NO: 3657901 - RNA, 15 nt, Human
ccuugguggcaagag

SEQ ID NO: 3657902 - RNA, 22 nt, Human
ccuugguuaggcauugugggaa

SEQ ID NO: 3657903 - RNA, 17 nt, Human
ccuugguucaucagugu

SEQ ID NO: 3657904 - RNA, 16 nt, Human
ccuugguucccccacu

SEQ ID NO: 3657905 - RNA, 21 nt, Human
ccuugguugucuggcaaggac

SEQ ID NO: 3657906 - RNA, 22 nt, Human
ccuugguugucuggcaaggacu

SEQ ID NO: 3657907 - RNA, 15 nt, Human
ccuuguaauguaacu

SEQ ID NO: 3657908 - RNA, 18 nt, Human
ccuuguaauguaacugcu

SEQ ID NO: 3657909 - RNA, 18 nt, Human
ccuuguauaauauugaaa

SEQ ID NO: 3657910 - RNA, 14 nt, Human
ccuuguauuuaaau

SEQ ID NO: 3657911 - RNA, 17 nt, Human
ccuugucauuuuggucu

SEQ ID NO: 3657912 - RNA, 18 nt, Human
ccuuguccccacacuccu

SEQ ID NO: 3657913 - RNA, 21 nt, Human
ccuuguccccacacuccuaca

SEQ ID NO: 3657914 - RNA, 17 nt, Human
ccuuguccucagccagu

SEQ ID NO: 3657915 - RNA, 14 nt, Human
ccuuguccuuuccc

SEQ ID NO: 3657916 - RNA, 21 nt, Human
ccuugucuuauucccuuccug

SEQ ID NO: 3657917 - RNA, 20 nt, Human
ccuugugaaucaagggucag

SEQ ID NO: 3657918 - RNA, 21 nt, Human
ccuugugaugucauacagaga

SEQ ID NO: 3657919 - RNA, 20 nt, Human
ccuugugaugugcacguaaa

SEQ ID NO: 3657920 - RNA, 11 nt, Human
ccuugugccug

SEQ ID NO: 3657921 - RNA, 12 nt, Human
ccuugugccugg

SEQ ID NO: 3657922 - RNA, 18 nt, Human
ccuugugccuggcucaga

SEQ ID NO: 3657923 - RNA, 15 nt, Human
ccuugugccuggggu

SEQ ID NO: 3657924 - RNA, 12 nt, Human
ccuuguggcaga

SEQ ID NO: 3657925 - RNA, 16 nt, Human
ccuuguggccugggcc

SEQ ID NO: 3657926 - RNA, 13 nt, Human
cuuccuccaaccc

SEQ ID NO: 3657927 - RNA, 14 nt, Human
cuuccuccaaggac

SEQ ID NO: 3657928 - RNA, 21 nt, Human
cuuccuccacauccuuucuaa

SEQ ID NO: 3657929 - RNA, 17 nt, Human
cuuccuccagcugcacc

SEQ ID NO: 3657930 - RNA, 20 nt, Human
cuuccucccaaguggugccu

SEQ ID NO: 3657931 - RNA, 13 nt, Human
cuuccucccucau

SEQ ID NO: 3657932 - RNA, 13 nt, Human
cuuccucccuccc

SEQ ID NO: 3657933 - RNA, 19 nt, Human
cuuccuccugacaccccac

SEQ ID NO: 3657934 - RNA, 22 nt, Human
cuuccuccugggcccucucugc

SEQ ID NO: 3657935 - RNA, 22 nt, Human
cuuccuccuuuucuuucucucu

SEQ ID NO: 3657936 - RNA, 19 nt, Human
cuuccucuagaagccaagg

SEQ ID NO: 3657937 - RNA, 16 nt, Human
cuuccucuccacugcc

SEQ ID NO: 3657938 - RNA, 19 nt, Human
cuuccucuccacugccuuc

SEQ ID NO: 3657939 - RNA, 16 nt, Human
cuuccucuccuuccuu

SEQ ID NO: 3657940 - RNA, 14 nt, Human
cuuccucugagccu

SEQ ID NO: 3657941 - RNA, 12 nt, Human
cuuccucugagg

SEQ ID NO: 3657942 - RNA, 16 nt, Human
cuuccucugaggcuga

SEQ ID NO: 3657943 - RNA, 19 nt, Human
cuuccucugcagcugaccu

SEQ ID NO: 3657944 - RNA, 12 nt, Human
cuuccucugcug

SEQ ID NO: 3657945 - RNA, 15 nt, Human
cuuccucuggggcuc

SEQ ID NO: 3657946 - RNA, 19 nt, Human
cuuccucuucggcccucag

SEQ ID NO: 3657947 - RNA, 20 nt, Human
cuuccucuucggcccucaga

SEQ ID NO: 3657948 - RNA, 21 nt, Human
cuuccucuugacccugcaccc

SEQ ID NO: 3657949 - RNA, 17 nt, Human
cuuccugaaacuauauu

SEQ ID NO: 3657950 - RNA, 16 nt, Human
cuuccugacacuuuaa

SEQ ID NO: 3657951 - RNA, 18 nt, Human
cuuccugacacuuuaauu

SEQ ID NO: 3657952 - RNA, 18 nt, Human
cuuccugacgaaacuggc

SEQ ID NO: 3657953 - RNA, 21 nt, Human
cuuccugaggggagacagagc

SEQ ID NO: 3657954 - RNA, 22 nt, Human
cuuccugaggggagacagagca

SEQ ID NO: 3657955 - RNA, 20 nt, Human
cuuccugauugguuucucuu

SEQ ID NO: 3657956 - RNA, 20 nt, Human
cuuccugcaggcaggaacaa

SEQ ID NO: 3657957 - RNA, 20 nt, Human
cuuccugcauucacccagac

SEQ ID NO: 3657958 - RNA, 15 nt, Human
cuuccugccaccagu

SEQ ID NO: 3657959 - RNA, 17 nt, Human
cuuccugccagccccug

SEQ ID NO: 3657960 - RNA, 21 nt, Human
cuuccugccccaacuccuucc

SEQ ID NO: 3657961 - RNA, 17 nt, Human
cuuccugcccuacagag

SEQ ID NO: 3657962 - RNA, 15 nt, Human
cuuccugccuggucu

SEQ ID NO: 3657963 - RNA, 16 nt, Human
cuuccugcguccuccu

SEQ ID NO: 3657964 - RNA, 13 nt, Human
cuuccuggacagc

SEQ ID NO: 3657965 - RNA, 14 nt, Human
cuuccuggacagcu

SEQ ID NO: 3657966 - RNA, 15 nt, Human
cuuccuggacagcug

SEQ ID NO: 3657967 - RNA, 16 nt, Human
cuuccuggacagcugu

SEQ ID NO: 3657968 - RNA, 21 nt, Human
cuuccuggacagcugugccuc

SEQ ID NO: 3657969 - RNA, 24 nt, Human
cuuccuggacagcugugccucgcu

SEQ ID NO: 3657970 - RNA, 22 nt, Human
cuuccuggagacugcccagcua

SEQ ID NO: 3657971 - RNA, 22 nt, Human
cuuccuggagcagaagcagcaa

SEQ ID NO: 3657972 - RNA, 22 nt, Human
cuuccuggagcccagaggaggg

SEQ ID NO: 3657973 - RNA, 14 nt, Human
cuuccuggccugag

SEQ ID NO: 3657974 - RNA, 19 nt, Human
cuuccugggcacacgcugc

SEQ ID NO: 3657975 - RNA, 21 nt, Human
cuuccugggcacacgcugcuc

SEQ ID NO: 3657976 - RNA, 23 nt, Human
cuuccugggcacacgcugcucug

SEQ ID NO: 3657977 - RNA, 18 nt, Human
cuuccuggggcccaaaug

SEQ ID NO: 3657978 - RNA, 23 nt, Human
cuuccugguagaccacugccaua

SEQ ID NO: 3657979 - RNA, 15 nt, Human
cuuccuggugcugga

SEQ ID NO: 3657980 - RNA, 15 nt, Human
cuuccuguccagaga

SEQ ID NO: 3657981 - RNA, 17 nt, Human
cuuccuguccagagaga

SEQ ID NO: 3657982 - RNA, 18 nt, Human
cuuccuguccagcuccaa

SEQ ID NO: 3657983 - RNA, 14 nt, Human
cuuccuguccgccc

SEQ ID NO: 3657984 - RNA, 20 nt, Human
cuuccugucuagucucuccu

SEQ ID NO: 3657985 - RNA, 18 nt, Human
cuuccugugauccaccca

SEQ ID NO: 3657986 - RNA, 15 nt, Human
cuuccugugggagca

SEQ ID NO: 3657987 - RNA, 12 nt, Human
cuuccugugucc

SEQ ID NO: 3657988 - RNA, 19 nt, Human
cuuccuuaauucacuccca

SEQ ID NO: 3657989 - RNA, 21 nt, Human
cuuccuuaauucacucccaca

SEQ ID NO: 3657990 - RNA, 17 nt, Human
cuuccuuauuuuaagca

SEQ ID NO: 3657991 - RNA, 13 nt, Human
cuuccuucccacc

SEQ ID NO: 3657992 - RNA, 16 nt, Human
cuuccuucccugcugu

SEQ ID NO: 3657993 - RNA, 13 nt, Human
cuuccuucccugg

SEQ ID NO: 3657994 - RNA, 14 nt, Human
cuuccuucccuggc

SEQ ID NO: 3657995 - RNA, 21 nt, Human
cuuccuucccugggcugugcu

SEQ ID NO: 3657996 - RNA, 14 nt, Human
cuuccuuccugcuu

SEQ ID NO: 3657997 - RNA, 14 nt, Human
cuuccuugaccagc

SEQ ID NO: 3657998 - RNA, 16 nt, Human
cuuccuugaccagcag

SEQ ID NO: 3657999 - RNA, 20 nt, Human
cuuccuugagacacggagcc

SEQ ID NO: 3658000 - RNA, 23 nt, Human
cuuccuugagacacggagcccag

SEQ ID NO: 3658001 - RNA, 14 nt, Human
cuuccuugcucucc

SEQ ID NO: 3658002 - RNA, 15 nt, Human
cuuccuugcucugca

SEQ ID NO: 3658003 - RNA, 20 nt, Human
cuuccuugcuguccuaggcc

SEQ ID NO: 3658004 - RNA, 13 nt, Human
cuuccuuggcuuu

SEQ ID NO: 3658005 - RNA, 20 nt, Human
cuuccuuguagccuuuugac

SEQ ID NO: 3658006 - RNA, 21 nt, Human
cuuccuuguagccuuuugacu

SEQ ID NO: 3658007 - RNA, 15 nt, Human
cuuccuuuacuuucc

SEQ ID NO: 3658008 - RNA, 18 nt, Human
cuuccuuuacuuucccuu

SEQ ID NO: 3658009 - RNA, 15 nt, Human
cuuccuuuguaaaaa

SEQ ID NO: 3658010 - RNA, 21 nt, Human
cuuccuuuuaaguaaggucca

SEQ ID NO: 3658011 - RNA, 21 nt, Human
cuuccuuuuagccuaguucau

SEQ ID NO: 3658012 - RNA, 14 nt, Human
cuuccuuuucacug

SEQ ID NO: 3658013 - RNA, 14 nt, Human
cuuccuuuucccug

SEQ ID NO: 3658014 - RNA, 16 nt, Human
cuuccuuuucccugcu

SEQ ID NO: 3658015 - RNA, 22 nt, Human
cuuccuuuucccugcuuccagg

SEQ ID NO: 3658016 - RNA, 16 nt, Human
cuucgacacuguucuu

SEQ ID NO: 3658017 - RNA, 14 nt, Human
cuucgacagcauuu

SEQ ID NO: 3658018 - RNA, 14 nt, Human
cuucgacucaggau

SEQ ID NO: 3658019 - RNA, 13 nt, Human
cuucgacugugac

SEQ ID NO: 3658020 - RNA, 22 nt, Human
cuucgacuguuguuaucuguuu

SEQ ID NO: 3658021 - RNA, 16 nt, Human
cuucgauacaccgggc

SEQ ID NO: 3658022 - RNA, 19 nt, Human
cuucgcaucaaaagacaau

SEQ ID NO: 3658023 - RNA, 22 nt, Human
cuucgccaagguuguagcaugg

SEQ ID NO: 3658024 - RNA, 15 nt, Human
cuucgccaccugggu

SEQ ID NO: 3658025 - RNA, 22 nt, Human
cuucgcgguggaaggcccgagg

SEQ ID NO: 3658026 - RNA, 19 nt, Human
cuucgcgugcccucgcugc

SEQ ID NO: 3658027 - RNA, 13 nt, Human
cuucgcuccugug

SEQ ID NO: 3658028 - RNA, 14 nt, Human
cuucgcuccugugu

SEQ ID NO: 3658029 - RNA, 18 nt, Human
cuucgcuucuugccucug

SEQ ID NO: 3658030 - RNA, 17 nt, Human
cuucggaggaccagggc

SEQ ID NO: 3658031 - RNA, 22 nt, Human
cuucgggaagagaggaguucaa

SEQ ID NO: 3658032 - RNA, 19 nt, Human
cuucgggaggucgaggcag

SEQ ID NO: 3658033 - RNA, 21 nt, Human
cuucgggaggucgaggcagga

SEQ ID NO: 3658034 - RNA, 17 nt, Human
cuucgggcccuucccac

SEQ ID NO: 3658035 - RNA, 19 nt, Human
cuucgggcuggccaucugg

SEQ ID NO: 3658036 - RNA, 19 nt, Human
cuucggggaacuccuggaa

SEQ ID NO: 3658037 - RNA, 19 nt, Human
cuucgguacccaccacaca

SEQ ID NO: 3658038 - RNA, 17 nt, Human
cuucgguggaagagcuc

SEQ ID NO: 3658039 - RNA, 16 nt, Human
cuucguacaguucuuc

SEQ ID NO: 3658040 - RNA, 23 nt, Human
cuucguacaguucuucgggaaga

SEQ ID NO: 3658041 - RNA, 19 nt, Human
cuucguaucccgagucugg

SEQ ID NO: 3658042 - RNA, 14 nt, Human
cuucgucuuuccca

SEQ ID NO: 3658043 - RNA, 15 nt, Human
cuucgugcccccccu

SEQ ID NO: 3658044 - RNA, 17 nt, Human
cuucgugcccccccuuc

SEQ ID NO: 3658045 - RNA, 22 nt, Human
cuucgugggaucugccccuccc

SEQ ID NO: 3658046 - RNA, 21 nt, Human
cuucguuaguaaucuguauaa

SEQ ID NO: 3658047 - RNA, 19 nt, Human
cuucguucuuuuuaaguua

SEQ ID NO: 3658048 - RNA, 21 nt, Human
cuucguuuacuaugccugugu

SEQ ID NO: 3658049 - RNA, 13 nt, Human
cuucguuuugguu

SEQ ID NO: 3658050 - RNA, 13 nt, Human
cuucuaaaugcau

SEQ ID NO: 3658051 - RNA, 13 nt, Human
cuucuaaguaaaa

SEQ ID NO: 3658052 - RNA, 21 nt, Human
cgagcuguuuauguuuuuaua

SEQ ID NO: 3658053 - RNA, 11 nt, Human
cgaggaagccc

SEQ ID NO: 3658054 - RNA, 16 nt, Human
cgaggacagggaggug

SEQ ID NO: 3658055 - RNA, 17 nt, Human
cgaggagccaggcaacu

SEQ ID NO: 3658056 - RNA, 17 nt, Human
cgaggagguaaugaauu

SEQ ID NO: 3658057 - RNA, 16 nt, Human
cgaggaggugccugga

SEQ ID NO: 3658058 - RNA, 22 nt, Human
cgaggaggugucucaggcugcc

SEQ ID NO: 3658059 - RNA, 12 nt, Human
cgaggaguaaca

SEQ ID NO: 3658060 - RNA, 14 nt, Human
cgaggaguaacaau

SEQ ID NO: 3658061 - RNA, 21 nt, Human
cgaggaguaacaauacaaaug

SEQ ID NO: 3658062 - RNA, 14 nt, Human
cgaggauuuuaauu

SEQ ID NO: 3658063 - RNA, 12 nt, Human
cgaggcagagga

SEQ ID NO: 3658064 - RNA, 23 nt, Human
cgaggccuaccccgcagacaccu

SEQ ID NO: 3658065 - RNA, 10 nt, Human
cgaggccuga

SEQ ID NO: 3658066 - RNA, 11 nt, Human
cgaggccugaa

SEQ ID NO: 3658067 - RNA, 14 nt, Human
cgaggcugggccaa

SEQ ID NO: 3658068 - RNA, 15 nt, Human
cgaggcugggccaag

SEQ ID NO: 3658069 - RNA, 16 nt, Human
cgaggcugggccaagc

SEQ ID NO: 3658070 - RNA, 17 nt, Human
cgagggcagcgggagcc

SEQ ID NO: 3658071 - RNA, 11 nt, Human
cgccuccagga

SEQ ID NO: 3658072 - RNA, 20 nt, Human
aacacacgcgcgcacacaca

SEQ ID NO: 3658073 - RNA, 17 nt, Human
aacacacuaccgaaugu

SEQ ID NO: 3658074 - RNA, 18 nt, Human
aacacacugaggcaggga

SEQ ID NO: 3658075 - RNA, 21 nt, Human
aacacacugaggcagggaagu

SEQ ID NO: 3658076 - RNA, 13 nt, Human
aacacacuguguc

SEQ ID NO: 3658077 - RNA, 19 nt, Human
aacacacuguguccuggug

SEQ ID NO: 3658078 - RNA, 22 nt, Human
aacacagaaagccuaucaaaga

SEQ ID NO: 3658079 - RNA, 22 nt, Human
aacacagagaagcggauuucca

SEQ ID NO: 3658080 - RNA, 23 nt, Human
aacacagagaagcggauuuccag

SEQ ID NO: 3658081 - RNA, 18 nt, Human
aacacagcaagggugaug

SEQ ID NO: 3658082 - RNA, 13 nt, Human
aacacagccuggg

SEQ ID NO: 3658083 - RNA, 19 nt, Human
aacacagcgagacuccguc

SEQ ID NO: 3658084 - RNA, 20 nt, Human
aacacagcuuacaaucgcaa

SEQ ID NO: 3658085 - RNA, 14 nt, Human
aacacaggcagcuu

SEQ ID NO: 3658086 - RNA, 15 nt, Human
aacacaggcagcuuu

SEQ ID NO: 3658087 - RNA, 18 nt, Human
aacacaggcagcuuucua

SEQ ID NO: 3658088 - RNA, 19 nt, Human
aacacagugccuucaauaa

SEQ ID NO: 3658089 - RNA, 16 nt, Human
aacacaguguuuuugu

SEQ ID NO: 3658090 - RNA, 18 nt, Human
aacacaguguuuuuguaa

SEQ ID NO: 3658091 - RNA, 20 nt, Human
aacacauagauucaccugua

SEQ ID NO: 3658092 - RNA, 22 nt, Human
aacacauagauucaccuguaaa

SEQ ID NO: 3658093 - RNA, 17 nt, Human
aacacauguuuuuauac

SEQ ID NO: 3658094 - RNA, 15 nt, Human
aacacauuaaaggua

SEQ ID NO: 3658095 - RNA, 22 nt, Human
aacacauuguuauuuucaguga

SEQ ID NO: 3658096 - RNA, 21 nt, Human
aacacauuucaaaugaguuuu

SEQ ID NO: 3658097 - RNA, 14 nt, Human
aacacauuuuguau

SEQ ID NO: 3658098 - RNA, 16 nt, Human
aacacauuuuguauaa

SEQ ID NO: 3658099 - RNA, 23 nt, Human
aacacauuuuguauaauuguauc

SEQ ID NO: 3658100 - RNA, 19 nt, Human
aacacauuuuucuuaggga

SEQ ID NO: 3658101 - RNA, 16 nt, Human
aacaccaaaaaauauc

SEQ ID NO: 3658102 - RNA, 22 nt, Human
aacaccaagacuugaaggugcc

SEQ ID NO: 3658103 - RNA, 14 nt, Human
aacaccaagcacag

SEQ ID NO: 3658104 - RNA, 21 nt, Human
aacaccaagcacagcagccug

SEQ ID NO: 3658105 - RNA, 13 nt, Human
aacaccacagaca

SEQ ID NO: 3658106 - RNA, 15 nt, Human
aacaccacagacaca

SEQ ID NO: 3658107 - RNA, 17 nt, Human
aacaccacagacacaca

SEQ ID NO: 3658108 - RNA, 16 nt, Human
aacaccagccccugcc

SEQ ID NO: 3658109 - RNA, 20 nt, Human
aacaccauagguagaaugua

SEQ ID NO: 3658110 - RNA, 18 nt, Human
aacaccaucacagcuugu

SEQ ID NO: 3658111 - RNA, 18 nt, Human
aacaccaugauuccuuua

SEQ ID NO: 3658112 - RNA, 21 nt, Human
aacacccucacacugggacuu

SEQ ID NO: 3658113 - RNA, 20 nt, Human
aacacccuuagaaaaugugu

SEQ ID NO: 3658114 - RNA, 19 nt, Human
aacacccuuccuucuguaa

SEQ ID NO: 3658115 - RNA, 18 nt, Human
aacaccuagaucagaaca

SEQ ID NO: 3658116 - RNA, 19 nt, Human
aacaccuagcuuuauucuu

SEQ ID NO: 3658117 - RNA, 23 nt, Human
aacaccucccaggagacaguuca

SEQ ID NO: 3658118 - RNA, 16 nt, Human
aacaccuccucaugua

SEQ ID NO: 3658119 - RNA, 15 nt, Human
aacaccugacagccc

SEQ ID NO: 3658120 - RNA, 19 nt, Human
aacaccugggcuuaagaaa

SEQ ID NO: 3658121 - RNA, 14 nt, Human
aacaccuuaauaug

SEQ ID NO: 3658122 - RNA, 17 nt, Human
aacaccuuccagcuccu

SEQ ID NO: 3658123 - RNA, 16 nt, Human
aacacgaaacuuguua

SEQ ID NO: 3658124 - RNA, 15 nt, Human
aacacgaaagaaaug

SEQ ID NO: 3658125 - RNA, 15 nt, Human
aacacgcaccugccu

SEQ ID NO: 3658126 - RNA, 15 nt, Human
aacacgccugcaaac

SEQ ID NO: 3658127 - RNA, 20 nt, Human
aacacgccugcaaacgcugc

SEQ ID NO: 3658128 - RNA, 21 nt, Human
aacacguaucccaccugacau

SEQ ID NO: 3658129 - RNA, 21 nt, Human
aacacguccagaauuuuucau

SEQ ID NO: 3658130 - RNA, 15 nt, Human
aacacuaaaaauaaa

SEQ ID NO: 3658131 - RNA, 14 nt, Human
aacacuaaauguua

SEQ ID NO: 3658132 - RNA, 22 nt, Human
aacacuaaauguuaaagaugua

SEQ ID NO: 3658133 - RNA, 19 nt, Human
aacacuaacucaccagccc

SEQ ID NO: 3658134 - RNA, 22 nt, Human
aacacuaauauauuuaaaaaua

SEQ ID NO: 3658135 - RNA, 16 nt, Human
aacacuaauucauaau

SEQ ID NO: 3658136 - RNA, 17 nt, Human
aacacuaauucauaauc

SEQ ID NO: 3658137 - RNA, 15 nt, Human
aacacuauaaagguu

SEQ ID NO: 3658138 - RNA, 21 nt, Human
aacacuauauggcagugucuu

SEQ ID NO: 3658139 - RNA, 12 nt, Human
aacacuauuuuc

SEQ ID NO: 3658140 - RNA, 21 nt, Human
aacacucacauuuauucugcu

SEQ ID NO: 3658141 - RNA, 13 nt, Human
aacacucagcugu

SEQ ID NO: 3658142 - RNA, 17 nt, Human
aacacucaguggcccau

SEQ ID NO: 3658143 - RNA, 15 nt, Human
aacacucaugcugaa

SEQ ID NO: 3658144 - RNA, 17 nt, Human
aacacucauugaccuga

SEQ ID NO: 3658145 - RNA, 21 nt, Human
aacacuccccauuaacagaug

SEQ ID NO: 3658146 - RNA, 21 nt, Human
aacacucuauaacaaaggaua

SEQ ID NO: 3658147 - RNA, 13 nt, Human
aacacucugagac

SEQ ID NO: 3658148 - RNA, 12 nt, Human
aacacucuuuug

SEQ ID NO: 3658149 - RNA, 14 nt, Human
aacacugcaggcau

SEQ ID NO: 3658150 - RNA, 22 nt, Human
aacacugccaucuuaguuugga

SEQ ID NO: 3658151 - RNA, 14 nt, Human
aacacugccuuuuu

SEQ ID NO: 3658152 - RNA, 15 nt, Human
aacacugccuuuuua

SEQ ID NO: 3658153 - RNA, 19 nt, Human
aacacuggggacuuggccu

SEQ ID NO: 3658154 - RNA, 17 nt, Human
aacacugggggagggga

SEQ ID NO: 3658155 - RNA, 23 nt, Human
aacacugguggaggauggaaagg

SEQ ID NO: 3658156 - RNA, 22 nt, Human
aacacugguuuuaaauauuuug

SEQ ID NO: 3658157 - RNA, 22 nt, Human
aacacuguaguaaauaaugcuu

SEQ ID NO: 3658158 - RNA, 15 nt, Human
aacacugugcccugg

SEQ ID NO: 3658159 - RNA, 12 nt, Human
aacacuguggaa

SEQ ID NO: 3658160 - RNA, 16 nt, Human
aacacuguucucugcc

SEQ ID NO: 3658161 - RNA, 18 nt, Human
aacacuguucucugcccu

SEQ ID NO: 3658162 - RNA, 19 nt, Human
aacacuuauugcuuugaaa

SEQ ID NO: 3658163 - RNA, 13 nt, Human
aacacuuggugcu

SEQ ID NO: 3658164 - RNA, 14 nt, Human
aacacuuuaauggg

SEQ ID NO: 3658165 - RNA, 19 nt, Human
aacacuuucucuucuuguu

SEQ ID NO: 3658166 - RNA, 17 nt, Human
aacacuuugccuccugu

SEQ ID NO: 3658167 - RNA, 12 nt, Human
aacagaaaaaaa

SEQ ID NO: 3658168 - RNA, 15 nt, Human
aacagaaaaaaaaca

SEQ ID NO: 3658169 - RNA, 13 nt, Human
aacagaaaacaac

SEQ ID NO: 3658170 - RNA, 14 nt, Human
aacagaaaacaaca

SEQ ID NO: 3658171 - RNA, 18 nt, Human
aacagaaaacaacaaaaa

SEQ ID NO: 3658172 - RNA, 20 nt, Human
aacagaaaacaacaaaaaau

SEQ ID NO: 3658173 - RNA, 22 nt, Human
aacagaaagccugggugacauu

SEQ ID NO: 3658174 - RNA, 14 nt, Human
aacagaaauggaaa

SEQ ID NO: 3658175 - RNA, 11 nt, Human
aacagaaaugu

SEQ ID NO: 3658176 - RNA, 14 nt, Human
aacagaaauguaca

SEQ ID NO: 3658177 - RNA, 21 nt, Human
aacagaaauguacagcaagga

SEQ ID NO: 3658178 - RNA, 12 nt, Human
aacagaaauugg

SEQ ID NO: 3658179 - RNA, 15 nt, Human
aacagaaauugguac

SEQ ID NO: 3658180 - RNA, 22 nt, Human
aacagaaauugguaccuugcac

SEQ ID NO: 3658181 - RNA, 15 nt, Human
aacagaaauuguaua

SEQ ID NO: 3658182 - RNA, 17 nt, Human
aacagaaauuguauauu

SEQ ID NO: 3658183 - RNA, 13 nt, Human
aacagaacagcuu

SEQ ID NO: 3658184 - RNA, 16 nt, Human
aacagaacagcuucag

SEQ ID NO: 3658185 - RNA, 11 nt, Human
aacagaacagg

SEQ ID NO: 3658186 - RNA, 13 nt, Human
aacagaacagggu

SEQ ID NO: 3658187 - RNA, 14 nt, Human
aacagaacaggguc

SEQ ID NO: 3658188 - RNA, 17 nt, Human
aacagaacagggucaug

SEQ ID NO: 3658189 - RNA, 20 nt, Human
aacagaacaucauuagaaca

SEQ ID NO: 3658190 - RNA, 21 nt, Human
aacagaacuaaauguucuaug

SEQ ID NO: 3658191 - RNA, 16 nt, Human
aacagaagcauuugua

SEQ ID NO: 3658192 - RNA, 21 nt, Human
aacagaagcuuccauuccaag

SEQ ID NO: 3658193 - RNA, 13 nt, Human
aacagaagugguu

SEQ ID NO: 3658194 - RNA, 14 nt, Human
aacagaaugaaaaa

SEQ ID NO: 3658195 - RNA, 15 nt, Human
aacagaaugaaaaau

SEQ ID NO: 3658196 - RNA, 16 nt, Human
aacagaaugaaaaaug

SEQ ID NO: 3658197 - RNA, 18 nt, Human
aacagaaugaaaaaugaa

SEQ ID NO: 3658198 - RNA, 19 nt, Human
aacagaaugaaaaaugaaa

SEQ ID NO: 3658199 - RNA, 21 nt, Human
aacagaaugaaaaaugaaaga

SEQ ID NO: 3658200 - RNA, 21 nt, Human
aacagaaugucucuuccuggu

SEQ ID NO: 3658201 - RNA, 13 nt, Human
aacagaauuuuaa

SEQ ID NO: 3658202 - RNA, 16 nt, Human
aacagacaacagaagu

SEQ ID NO: 3658203 - RNA, 15 nt, Human
aacagacauuguuuu

SEQ ID NO: 3658204 - RNA, 18 nt, Human
aacagacauuguuuugcc

SEQ ID NO: 3658205 - RNA, 13 nt, Human
aacagagaaggca

SEQ ID NO: 3658206 - RNA, 13 nt, Human
aacagagauguga

SEQ ID NO: 3658207 - RNA, 21 nt, Human
aacagaggaccagcacacucc

SEQ ID NO: 3658208 - RNA, 19 nt, Human
aacagagugagacccuguc

SEQ ID NO: 3658209 - RNA, 16 nt, Human
aacagauaaauaguuu

SEQ ID NO: 3658210 - RNA, 22 nt, Human
aacagauaccauacucauuucu

SEQ ID NO: 3658211 - RNA, 14 nt, Human
aacagaucaguaaa

SEQ ID NO: 3658212 - RNA, 20 nt, Human
aacagaucuccaaagcuuuc

SEQ ID NO: 3658213 - RNA, 22 nt, Human
aacagaucuggaaccucagccu

SEQ ID NO: 3658214 - RNA, 21 nt, Human
aacagaugcaaugugcuacug

SEQ ID NO: 3658215 - RNA, 17 nt, Human
aacagauguuucuuuug

SEQ ID NO: 3658216 - RNA, 17 nt, Human
cggcucccagccucagc

SEQ ID NO: 3658217 - RNA, 15 nt, Human
cggcucccuggagcc

SEQ ID NO: 3658218 - RNA, 13 nt, Human
cggcuccucaggg

SEQ ID NO: 3658219 - RNA, 20 nt, Human
cggcuccucagggacucagg

SEQ ID NO: 3658220 - RNA, 23 nt, Human
cggcuccucgagaucccaacacu

SEQ ID NO: 3658221 - RNA, 19 nt, Human
cggcuccucggacucugcu

SEQ ID NO: 3658222 - RNA, 22 nt, Human
cggcuccucucuaaccuccuuu

SEQ ID NO: 3658223 - RNA, 12 nt, Human
cggcuccugcug

SEQ ID NO: 3658224 - RNA, 13 nt, Human
cggcuccugcugc

SEQ ID NO: 3658225 - RNA, 23 nt, Human
cggcuccugcugcaccaacccag

SEQ ID NO: 3658226 - RNA, 17 nt, Human
cggcuccuggacucauu

SEQ ID NO: 3658227 - RNA, 21 nt, Human
cggcuccuggacucauugcuu

SEQ ID NO: 3658228 - RNA, 19 nt, Human
cggcuccuggucaccuagg

SEQ ID NO: 3658229 - RNA, 20 nt, Human
cggcucgagcaguccugccu

SEQ ID NO: 3658230 - RNA, 18 nt, Human
cggcucuagguggggcgg

SEQ ID NO: 3658231 - RNA, 13 nt, Human
cggcucucaccug

SEQ ID NO: 3658232 - RNA, 21 nt, Human
cggcucugaagcaaggcggug

SEQ ID NO: 3658233 - RNA, 13 nt, Human
cggcucugcaguc

SEQ ID NO: 3658234 - RNA, 13 nt, Human
cggcucugggugg

SEQ ID NO: 3658235 - RNA, 16 nt, Human
cggcucuguccccagc

SEQ ID NO: 3658236 - RNA, 22 nt, Human
cggcucugugggugauggggag

SEQ ID NO: 3658237 - RNA, 11 nt, Human
cggcugaccau

SEQ ID NO: 3658238 - RNA, 14 nt, Human
cggcugaccaugcu

SEQ ID NO: 3658239 - RNA, 15 nt, Human
cggcugaccaugcuc

SEQ ID NO: 3658240 - RNA, 16 nt, Human
cggcugaccaugcuca

SEQ ID NO: 3658241 - RNA, 23 nt, Human
cggcugaccaugcucaucugcug

SEQ ID NO: 3658242 - RNA, 20 nt, Human
cggcugcagaggccagaggc

SEQ ID NO: 3658243 - RNA, 18 nt, Human
cggcugcauugaagaucc

SEQ ID NO: 3658244 - RNA, 11 nt, Human
cggcugcccuu

SEQ ID NO: 3658245 - RNA, 12 nt, Human
cggcugcccuuu

SEQ ID NO: 3658246 - RNA, 21 nt, Human
cggcuggagaccaugcagagc

SEQ ID NO: 3658247 - RNA, 22 nt, Human
cggcuggagaccaugcagagcg

SEQ ID NO: 3658248 - RNA, 23 nt, Human
cggcuggcagcccaccccucaac

SEQ ID NO: 3658249 - RNA, 19 nt, Human
cggcuggccuggccccuca

SEQ ID NO: 3658250 - RNA, 18 nt, Human
cggcuggcuccccugcag

SEQ ID NO: 3658251 - RNA, 22 nt, Human
cggcugggaggagggcaggcau

SEQ ID NO: 3658252 - RNA, 23 nt, Human
cggcugggaggagggcaggcauc

SEQ ID NO: 3658253 - RNA, 15 nt, Human
cggcuggugcagggc

SEQ ID NO: 3658254 - RNA, 23 nt, Human
cggcugguuuuguaagaugcugg

SEQ ID NO: 3658255 - RNA, 14 nt, Human
cggcugugcuggga

SEQ ID NO: 3658256 - RNA, 19 nt, Human
cggcuucaugccagcuacu

SEQ ID NO: 3658257 - RNA, 14 nt, Human
cgggaaagaagagc

SEQ ID NO: 3658258 - RNA, 20 nt, Human
cgggaacaguguuucccaua

SEQ ID NO: 3658259 - RNA, 22 nt, Human
cgggaacaguguuucccauaau

SEQ ID NO: 3658260 - RNA, 16 nt, Human
cgggaacaugcccccu

SEQ ID NO: 3658261 - RNA, 14 nt, Human
cgggaaccucacuc

SEQ ID NO: 3658262 - RNA, 19 nt, Human
cgggaaccuccccagccug

SEQ ID NO: 3658263 - RNA, 21 nt, Human
cgggaaccuccccagccugcg

SEQ ID NO: 3658264 - RNA, 22 nt, Human
cgggaagagaggaguucaauga

SEQ ID NO: 3658265 - RNA, 16 nt, Human
cgggaagccacccucc

SEQ ID NO: 3658266 - RNA, 23 nt, Human
cgggaagccacccucccagcucu

SEQ ID NO: 3658267 - RNA, 14 nt, Human
cgggaaggaggguu

SEQ ID NO: 3658268 - RNA, 22 nt, Human
cgggaagggggcugggacaugg

SEQ ID NO: 3658269 - RNA, 20 nt, Human
cgggaaggucaccagcacca

SEQ ID NO: 3658270 - RNA, 17 nt, Human
cgggaauaaccuuccau

SEQ ID NO: 3658271 - RNA, 16 nt, Human
cgggaauauuguuucu

SEQ ID NO: 3658272 - RNA, 18 nt, Human
cgggacaccuaggcuagg

SEQ ID NO: 3658273 - RNA, 15 nt, Human
cgggacaccugcccu

SEQ ID NO: 3658274 - RNA, 18 nt, Human
cgggacaccugcccugcc

SEQ ID NO: 3658275 - RNA, 14 nt, Human
cgggacccagggcc

SEQ ID NO: 3658276 - RNA, 13 nt, Human
cgggaccuggugc

SEQ ID NO: 3658277 - RNA, 14 nt, Human
cgggaccuguggcu

SEQ ID NO: 3658278 - RNA, 13 nt, Human
cgggacugcggag

SEQ ID NO: 3658279 - RNA, 23 nt, Human
cgggagcagugucuuccauaaug

SEQ ID NO: 3658280 - RNA, 15 nt, Human
cuuguuuaccuuucu

SEQ ID NO: 3658281 - RNA, 12 nt, Human
cuuguuucaauu

SEQ ID NO: 3658282 - RNA, 15 nt, Human
cuuguuuccaauguu

SEQ ID NO: 3658283 - RNA, 12 nt, Human
cuuguuucugaa

SEQ ID NO: 3658284 - RNA, 20 nt, Human
cuuguuugauuuuagcugca

SEQ ID NO: 3658285 - RNA, 18 nt, Human
cuuguuugcucaccuggg

SEQ ID NO: 3658286 - RNA, 14 nt, Human
cuuguuuggggcag

SEQ ID NO: 3658287 - RNA, 14 nt, Human
cuuguuuucuggga

SEQ ID NO: 3658288 - RNA, 17 nt, Human
cuuguuuucuugccaau

SEQ ID NO: 3658289 - RNA, 13 nt, Human
cuuguuuugcuuc

SEQ ID NO: 3658290 - RNA, 21 nt, Human
cuuguuuuggacuuuguuaca

SEQ ID NO: 3658291 - RNA, 14 nt, Human
cuuguuuuuaaguu

SEQ ID NO: 3658292 - RNA, 20 nt, Human
cuuguuuuuaaguuugcacu

SEQ ID NO: 3658293 - RNA, 23 nt, Human
cuuguuuuuauaauaaaaagcuu

SEQ ID NO: 3658294 - RNA, 16 nt, Human
cuuguuuuugcacaug

SEQ ID NO: 3658295 - RNA, 16 nt, Human
cuuguuuuuguaaaga

SEQ ID NO: 3658296 - RNA, 23 nt, Human
cuuguuuuuguuuuuguuuuguu

SEQ ID NO: 3658297 - RNA, 20 nt, Human
cuuguuuuuuuuuuccacuu

SEQ ID NO: 3658298 - RNA, 18 nt, Human
cuuuaaaaaaauuuaagu

SEQ ID NO: 3658299 - RNA, 19 nt, Human
cuuuaaaaaaauuuaagug

SEQ ID NO: 3658300 - RNA, 19 nt, Human
cuuuaaaaaagcuauaaau

SEQ ID NO: 3658301 - RNA, 17 nt, Human
cuuuaaaaaauauuuau

SEQ ID NO: 3658302 - RNA, 18 nt, Human
cuuuaaaaaauauuuauu

SEQ ID NO: 3658303 - RNA, 23 nt, Human
cuuuaaaaacuauuuaacuugag

SEQ ID NO: 3658304 - RNA, 21 nt, Human
cuuuaaaaagcuccaaaugca

SEQ ID NO: 3658305 - RNA, 20 nt, Human
cuuuaaaaagggaagaaacu

SEQ ID NO: 3658306 - RNA, 18 nt, Human
cuuuaaaaaugucuuauu

SEQ ID NO: 3658307 - RNA, 15 nt, Human
cuuuaaaaauuuacu

SEQ ID NO: 3658308 - RNA, 17 nt, Human
cuuuaaaacaaaacaaa

SEQ ID NO: 3658309 - RNA, 15 nt, Human
cuuuaaaagaaugac

SEQ ID NO: 3658310 - RNA, 20 nt, Human
cuuuaaaagacaaaucaaag

SEQ ID NO: 3658311 - RNA, 13 nt, Human
cuuuaaaagagag

SEQ ID NO: 3658312 - RNA, 16 nt, Human
cuuuaaaauguaaagc

SEQ ID NO: 3658313 - RNA, 21 nt, Human
cuuuaaaauuggguucacagc

SEQ ID NO: 3658314 - RNA, 21 nt, Human
cuuuaaaauuuuuuuagaaag

SEQ ID NO: 3658315 - RNA, 17 nt, Human
cuuuaaacaguauuuca

SEQ ID NO: 3658316 - RNA, 21 nt, Human
cuuuaaacauugguucuugua

SEQ ID NO: 3658317 - RNA, 15 nt, Human
cuuuaaacucaggga

SEQ ID NO: 3658318 - RNA, 22 nt, Human
cuuuaaacucagggacagagcc

SEQ ID NO: 3658319 - RNA, 14 nt, Human
cuuuaaacugucgu

SEQ ID NO: 3658320 - RNA, 13 nt, Human
cuuuaaaggaaaa

SEQ ID NO: 3658321 - RNA, 21 nt, Human
cuuuaaaggaaaaaauguugg

SEQ ID NO: 3658322 - RNA, 16 nt, Human
cuuuaaaggcccagcc

SEQ ID NO: 3658323 - RNA, 18 nt, Human
cuuuaaagggccugccug

SEQ ID NO: 3658324 - RNA, 16 nt, Human
cuuuaaaguaugaauc

SEQ ID NO: 3658325 - RNA, 13 nt, Human
cuuuaaaguucuu

SEQ ID NO: 3658326 - RNA, 15 nt, Human
cuuuaaaucauuuua

SEQ ID NO: 3658327 - RNA, 18 nt, Human
cuuuaaauguuuuauaag

SEQ ID NO: 3658328 - RNA, 12 nt, Human
cuuuaaauuaug

SEQ ID NO: 3658329 - RNA, 16 nt, Human
cuuuaacaacauguuu

SEQ ID NO: 3658330 - RNA, 15 nt, Human
cuuuaaccuuguaua

SEQ ID NO: 3658331 - RNA, 22 nt, Human
cuuuaacucccauuaccaugua

SEQ ID NO: 3658332 - RNA, 18 nt, Human
cuuuaacugacaagccau

SEQ ID NO: 3658333 - RNA, 21 nt, Human
cuuuaacugccguaauuuaac

SEQ ID NO: 3658334 - RNA, 15 nt, Human
cuuuaacuuaaauag

SEQ ID NO: 3658335 - RNA, 19 nt, Human
cuuuaacuuaauugcuaug

SEQ ID NO: 3658336 - RNA, 18 nt, Human
cuuuaacuucuguuuuac

SEQ ID NO: 3658337 - RNA, 11 nt, Human
cuuuaagaaaa

SEQ ID NO: 3658338 - RNA, 12 nt, Human
cuuuaagaaaaa

SEQ ID NO: 3658339 - RNA, 15 nt, Human
cuuuaagaacuaaaa

SEQ ID NO: 3658340 - RNA, 17 nt, Human
cuuuaagagagaaaucu

SEQ ID NO: 3658341 - RNA, 15 nt, Human
cuuuaagaguuuaaa

SEQ ID NO: 3658342 - RNA, 19 nt, Human
cuuuaagaguuuaaaauca

SEQ ID NO: 3658343 - RNA, 22 nt, Human
cuuuaagaguuuaaaaucauca

SEQ ID NO: 3658344 - RNA, 19 nt, Human
cuuuaagcacuacauaaac

SEQ ID NO: 3658345 - RNA, 16 nt, Human
cuuuaagcagcucuug

SEQ ID NO: 3658346 - RNA, 18 nt, Human
cuuuaagcagcucuugcu

SEQ ID NO: 3658347 - RNA, 21 nt, Human
cuuuaagggaguguacuccca

SEQ ID NO: 3658348 - RNA, 20 nt, Human
cuuuaagugccuacauuauc

SEQ ID NO: 3658349 - RNA, 15 nt, Human
cuuuaauauaaaugc

SEQ ID NO: 3658350 - RNA, 18 nt, Human
cuuuaauaucaucaguau

SEQ ID NO: 3658351 - RNA, 14 nt, Human
cuuuaauauguauu

SEQ ID NO: 3658352 - RNA, 22 nt, Human
cuuuaaucacuuaacauuccua

SEQ ID NO: 3658353 - RNA, 22 nt, Human
cuuuaauggacuuauuucuuca

SEQ ID NO: 3658354 - RNA, 18 nt, Human
cuuuaaugucacaggcag

SEQ ID NO: 3658355 - RNA, 19 nt, Human
cuuuaaugucacaggcagg

SEQ ID NO: 3658356 - RNA, 22 nt, Human
cuuuaaugucacaggcaggucc

SEQ ID NO: 3658357 - RNA, 17 nt, Human
cuuuaauguuuuuugcc

SEQ ID NO: 3658358 - RNA, 23 nt, Human
cuuuaauguuuuuugccacagcu

SEQ ID NO: 3658359 - RNA, 20 nt, Human
cuuuaauucucaugugaucc

SEQ ID NO: 3658360 - RNA, 16 nt, Human
cuuucucuuucguuac

SEQ ID NO: 3658361 - RNA, 13 nt, Human
cuuucucuuucuc

SEQ ID NO: 3658362 - RNA, 21 nt, Human
cuuucucuuuuccccuuuccu

SEQ ID NO: 3658363 - RNA, 22 nt, Human
cuuucucuuuuccccuuuccug

SEQ ID NO: 3658364 - RNA, 20 nt, Human
cuuucucuuuuccucuacca

SEQ ID NO: 3658365 - RNA, 17 nt, Human
cuuucucuuuucuaaaa

SEQ ID NO: 3658366 - RNA, 20 nt, Human
cuuucucuuuucuaaaagac

SEQ ID NO: 3658367 - RNA, 13 nt, Human
cuuucugaacagc

SEQ ID NO: 3658368 - RNA, 16 nt, Human
cuuucugaacagcugg

SEQ ID NO: 3658369 - RNA, 17 nt, Human
cuuucugaacagcuggu

SEQ ID NO: 3658370 - RNA, 21 nt, Human
cuuucugaacagcugguguag

SEQ ID NO: 3658371 - RNA, 14 nt, Human
cuuucugaccuuca

SEQ ID NO: 3658372 - RNA, 23 nt, Human
cuuucugauaacuagauggugcu

SEQ ID NO: 3658373 - RNA, 17 nt, Human
cuuucugaucaaggccu

SEQ ID NO: 3658374 - RNA, 21 nt, Human
cuuucugcaguuuuucaggag

SEQ ID NO: 3658375 - RNA, 15 nt, Human
cuuucugccaccccu

SEQ ID NO: 3658376 - RNA, 14 nt, Human
cuuucugcucagcu

SEQ ID NO: 3658377 - RNA, 16 nt, Human
cuuucugcuuguguua

SEQ ID NO: 3658378 - RNA, 15 nt, Human
cuuucuggccugccu

SEQ ID NO: 3658379 - RNA, 17 nt, Human
cuuucuggccugccuuc

SEQ ID NO: 3658380 - RNA, 17 nt, Human
cuuucuggcuaugcauu

SEQ ID NO: 3658381 - RNA, 20 nt, Human
cuuucugggcaccggggccu

SEQ ID NO: 3658382 - RNA, 22 nt, Human
cuuucuggggccuaauaaaacu

SEQ ID NO: 3658383 - RNA, 23 nt, Human
cuuucuggggccuaauaaaacug

SEQ ID NO: 3658384 - RNA, 16 nt, Human
cuuucuguaaccauaa

SEQ ID NO: 3658385 - RNA, 18 nt, Human
cuuucugucccuucuguc

SEQ ID NO: 3658386 - RNA, 23 nt, Human
cuuucugucccuucugucccuca

SEQ ID NO: 3658387 - RNA, 19 nt, Human
cuuucuguccuuuuggcac

SEQ ID NO: 3658388 - RNA, 18 nt, Human
cuuucugucuucuacaga

SEQ ID NO: 3658389 - RNA, 12 nt, Human
cuuucugugugc

SEQ ID NO: 3658390 - RNA, 15 nt, Human
cuuucugugugcacc

SEQ ID NO: 3658391 - RNA, 13 nt, Human
cuuucuguuaaaa

SEQ ID NO: 3658392 - RNA, 14 nt, Human
cuuucuguuaaaau

SEQ ID NO: 3658393 - RNA, 16 nt, Human
cuuucuguuaaaaugc

SEQ ID NO: 3658394 - RNA, 15 nt, Human
cuuucuguuccaaau

SEQ ID NO: 3658395 - RNA, 16 nt, Human
cuuucuguugccacaa

SEQ ID NO: 3658396 - RNA, 21 nt, Human
cuuucuguuggauuccaugcu

SEQ ID NO: 3658397 - RNA, 14 nt, Human
cuuucuguugucau

SEQ ID NO: 3658398 - RNA, 22 nt, Human
cuuucuguugucauugcuguug

SEQ ID NO: 3658399 - RNA, 23 nt, Human
cuuucuuaauauuuuuacaugca

SEQ ID NO: 3658400 - RNA, 22 nt, Human
cuuucuuacaaggaagguggug

SEQ ID NO: 3658401 - RNA, 11 nt, Human
cuuucuuagaa

SEQ ID NO: 3658402 - RNA, 17 nt, Human
cuuucuuagaaauuuau

SEQ ID NO: 3658403 - RNA, 22 nt, Human
cuuucuuauccuagcacaugcu

SEQ ID NO: 3658404 - RNA, 19 nt, Human
cuuucuuccaaacaggcuc

SEQ ID NO: 3658405 - RNA, 21 nt, Human
cuuucuuccucauucccucgu

SEQ ID NO: 3658406 - RNA, 15 nt, Human
cuuucuuccucugcu

SEQ ID NO: 3658407 - RNA, 11 nt, Human
cuuucuuccuu

SEQ ID NO: 3658408 - RNA, 16 nt, Human
cuuucuucuauuuuau

SEQ ID NO: 3658409 - RNA, 16 nt, Human
cuuucuucuuccacac

SEQ ID NO: 3658410 - RNA, 20 nt, Human
cuuucuugacaaaaccuaac

SEQ ID NO: 3658411 - RNA, 21 nt, Human
cuuucuugaucaacaucuuuu

SEQ ID NO: 3658412 - RNA, 21 nt, Human
cuuucuugcugguugucauuu

SEQ ID NO: 3658413 - RNA, 17 nt, Human
cuuucuuuaccugagac

SEQ ID NO: 3658414 - RNA, 21 nt, Human
cuuucuuucaauaaaacgcag

SEQ ID NO: 3658415 - RNA, 16 nt, Human
cuuucuuucacaaaaa

SEQ ID NO: 3658416 - RNA, 17 nt, Human
cuuucuuucuaacucca

SEQ ID NO: 3658417 - RNA, 15 nt, Human
cuuucuuucuuagaa

SEQ ID NO: 3658418 - RNA, 12 nt, Human
cuuucuuugauu

SEQ ID NO: 3658419 - RNA, 22 nt, Human
cuuucuuugggaauauuugaau

SEQ ID NO: 3658420 - RNA, 15 nt, Human
cuuucuuuggugccu

SEQ ID NO: 3658421 - RNA, 15 nt, Human
cuuucuuuucuuucu

SEQ ID NO: 3658422 - RNA, 14 nt, Human
cuuucuuuuucuuc

SEQ ID NO: 3658423 - RNA, 21 nt, Human
cuuucuuuuuguagcuggggc

SEQ ID NO: 3658424 - RNA, 16 nt, Human
cuuucuuuuuugauau

SEQ ID NO: 3658425 - RNA, 19 nt, Human
cuuucuuuuuuuccccccc

SEQ ID NO: 3658426 - RNA, 23 nt, Human
cuuugaaaaaguuaaugcuuaag

SEQ ID NO: 3658427 - RNA, 14 nt, Human
cuuugaaauaccuc

SEQ ID NO: 3658428 - RNA, 19 nt, Human
cuuugaaauaccucauguu

SEQ ID NO: 3658429 - RNA, 18 nt, Human
cuuugaaauguguuucug

SEQ ID NO: 3658430 - RNA, 21 nt, Human
cuuugaaauguguuucuguau

SEQ ID NO: 3658431 - RNA, 23 nt, Human
cuuugaaauguguuucuguauaa

SEQ ID NO: 3658432 - RNA, 20 nt, Human
cuuugaaauugaaccuuugu

SEQ ID NO: 3658433 - RNA, 14 nt, Human
cuuugaagaggaaa

SEQ ID NO: 3658434 - RNA, 18 nt, Human
cuuugaagagugaaauac

SEQ ID NO: 3658435 - RNA, 19 nt, Human
cuuugaagcaguuguguca

SEQ ID NO: 3658436 - RNA, 16 nt, Human
cuuugaagccucagcu

SEQ ID NO: 3658437 - RNA, 17 nt, Human
cuuugaagcugaaaaua

SEQ ID NO: 3658438 - RNA, 19 nt, Human
cuuugaagcugaaaauaua

SEQ ID NO: 3658439 - RNA, 16 nt, Human
cuuugaaggggccuca

SEQ ID NO: 3658440 - RNA, 18 nt, Human
cuuugaaggggccucacc

SEQ ID NO: 3658441 - RNA, 11 nt, Human
cuuugaauaaa

SEQ ID NO: 3658442 - RNA, 17 nt, Human
cuuugaauaaagaauac

SEQ ID NO: 3658443 - RNA, 18 nt, Human
cuuugaauaaagaauacu

SEQ ID NO: 3658444 - RNA, 12 nt, Human
cuuugaauaaau

SEQ ID NO: 3658445 - RNA, 14 nt, Human
cuuugaauaaaugu

SEQ ID NO: 3658446 - RNA, 16 nt, Human
cuuugaauaaauguca

SEQ ID NO: 3658447 - RNA, 19 nt, Human
cuuugaauccucucucugu

SEQ ID NO: 3658448 - RNA, 23 nt, Human
cuuugaauccucucucuguguua

SEQ ID NO: 3658449 - RNA, 14 nt, Human
cuuugaauguguuu

SEQ ID NO: 3658450 - RNA, 16 nt, Human
cuuugaauguguuuca

SEQ ID NO: 3658451 - RNA, 18 nt, Human
cuuugaauguguuucaca

SEQ ID NO: 3658452 - RNA, 23 nt, Human
cuuugaauguguuucacaguuug

SEQ ID NO: 3658453 - RNA, 17 nt, Human
cuuugaauguuaauuuu

SEQ ID NO: 3658454 - RNA, 12 nt, Human
cuuugaauuuuc

SEQ ID NO: 3658455 - RNA, 14 nt, Human
cuuugaauuuucau

SEQ ID NO: 3658456 - RNA, 17 nt, Human
cuuugaauuuucugugu

SEQ ID NO: 3658457 - RNA, 21 nt, Human
cuuugacaauuccuagauaaa

SEQ ID NO: 3658458 - RNA, 22 nt, Human
cuuugacaauugggagcugcca

SEQ ID NO: 3658459 - RNA, 19 nt, Human
cuuugacagcgcacagcug

SEQ ID NO: 3658460 - RNA, 18 nt, Human
cuuugacauuuaauuuag

SEQ ID NO: 3658461 - RNA, 18 nt, Human
cuuugaccucaaccugug

SEQ ID NO: 3658462 - RNA, 18 nt, Human
cuuugaccugccucccuu

SEQ ID NO: 3658463 - RNA, 16 nt, Human
cuuugacgccauccca

SEQ ID NO: 3658464 - RNA, 19 nt, Human
cuuugacgccaucccagcc

SEQ ID NO: 3658465 - RNA, 14 nt, Human
cuuugacucaccug

SEQ ID NO: 3658466 - RNA, 19 nt, Human
cuuugacucaccuguuacu

SEQ ID NO: 3658467 - RNA, 19 nt, Human
cuuugacucuauaagcaaa

SEQ ID NO: 3658468 - RNA, 21 nt, Human
cuuugacucuuuugccauuaa

SEQ ID NO: 3658469 - RNA, 14 nt, Human
cuuugacuuucuuc

SEQ ID NO: 3658470 - RNA, 22 nt, Human
cuuugagaagccuucagcucca

SEQ ID NO: 3658471 - RNA, 13 nt, Human
cuuugagacaguu

SEQ ID NO: 3658472 - RNA, 15 nt, Human
cuuugagacaguuuc

SEQ ID NO: 3658473 - RNA, 15 nt, Human
cuuugagagagaaag

SEQ ID NO: 3658474 - RNA, 19 nt, Human
cuuugagaucuaaaaauaa

SEQ ID NO: 3658475 - RNA, 19 nt, Human
cuuugagccugggaaauaa

SEQ ID NO: 3658476 - RNA, 19 nt, Human
cuuugagggacugccucug

SEQ ID NO: 3658477 - RNA, 22 nt, Human
cuuugagguggaagagggcugc

SEQ ID NO: 3658478 - RNA, 17 nt, Human
cuuugagguugcuuugu

SEQ ID NO: 3658479 - RNA, 20 nt, Human
cuuugagucccccagagaug

SEQ ID NO: 3658480 - RNA, 21 nt, Human
cuuugagugcaguccugauca

SEQ ID NO: 3658481 - RNA, 17 nt, Human
cuuugaguuuccucagg

SEQ ID NO: 3658482 - RNA, 17 nt, Human
cuuugauaaaauaaaug

SEQ ID NO: 3658483 - RNA, 13 nt, Human
cuuugauaauguu

SEQ ID NO: 3658484 - RNA, 21 nt, Human
cuuugauaauguuaaauuugu

SEQ ID NO: 3658485 - RNA, 22 nt, Human
cuuugauacagucaacaagccu

SEQ ID NO: 3658486 - RNA, 22 nt, Human
cuuugauauuuucaacgcagcc

SEQ ID NO: 3658487 - RNA, 19 nt, Human
cuuuuaagaugugucuuca

SEQ ID NO: 3658488 - RNA, 14 nt, Human
cuuuuaaggauaaa

SEQ ID NO: 3658489 - RNA, 22 nt, Human
cuuuuaauaaacuuuuuuuuga

SEQ ID NO: 3658490 - RNA, 16 nt, Human
cuuuuaaugaacaaau

SEQ ID NO: 3658491 - RNA, 18 nt, Human
cuuuuaaugcuccaaaug

SEQ ID NO: 3658492 - RNA, 13 nt, Human
cuuuuaauucauu

SEQ ID NO: 3658493 - RNA, 11 nt, Human
cuuuuaauuuu

SEQ ID NO: 3658494 - RNA, 18 nt, Human
cuuuuaccagcuuuuaac

SEQ ID NO: 3658495 - RNA, 16 nt, Human
cuuuuaccaugccccu

SEQ ID NO: 3658496 - RNA, 15 nt, Human
cuuuuacccuggccc

SEQ ID NO: 3658497 - RNA, 23 nt, Human
cuuuuacuacagcuaugaagaaa

SEQ ID NO: 3658498 - RNA, 23 nt, Human
cuuuuacucaugaucuugugaca

SEQ ID NO: 3658499 - RNA, 21 nt, Human
cuuuuacugguugcauggaaa

SEQ ID NO: 3658500 - RNA, 23 nt, Human
cuuuuagaaaagggaguuuaaaa

SEQ ID NO: 3658501 - RNA, 19 nt, Human
cuuuuagaaauacugcaag

SEQ ID NO: 3658502 - RNA, 22 nt, Human
cuuuuagcucaaacguggcuuu

SEQ ID NO: 3658503 - RNA, 14 nt, Human
cuuuuaggaaaauc

SEQ ID NO: 3658504 - RNA, 14 nt, Human
cuuugauguauuuu

SEQ ID NO: 3658505 - RNA, 17 nt, Human
cuuugauguauuuuccc

SEQ ID NO: 3658506 - RNA, 11 nt, Human
cuuugauguca

SEQ ID NO: 3658507 - RNA, 22 nt, Human
cuuugaugucagcaguugcugg

SEQ ID NO: 3658508 - RNA, 18 nt, Human
cuuugaugucauguguuc

SEQ ID NO: 3658509 - RNA, 18 nt, Human
cuuugauguguuguucuu

SEQ ID NO: 3658510 - RNA, 20 nt, Human
cuuugauguguuguucuugg

SEQ ID NO: 3658511 - RNA, 16 nt, Human
cuuugauguuccuucc

SEQ ID NO: 3658512 - RNA, 20 nt, Human
cuuugauuaaagacuccagu

SEQ ID NO: 3658513 - RNA, 18 nt, Human
cuuugauuauuugcaugu

SEQ ID NO: 3658514 - RNA, 19 nt, Human
cuuugauuauuugcauguu

SEQ ID NO: 3658515 - RNA, 15 nt, Human
cuuugauucacaugu

SEQ ID NO: 3658516 - RNA, 17 nt, Human
cuuugauucacauguuu

SEQ ID NO: 3658517 - RNA, 20 nt, Human
cuuugauucacauguuuuca

SEQ ID NO: 3658518 - RNA, 13 nt, Human
cuuugauucuccu

SEQ ID NO: 3658519 - RNA, 15 nt, Human
cuuugauucuccuuc

SEQ ID NO: 3658520 - RNA, 16 nt, Human
cuuugauucuccuuca

SEQ ID NO: 3658521 - RNA, 22 nt, Human
cuuugauucuccuuuuaugugu

SEQ ID NO: 3658522 - RNA, 14 nt, Human
cuuugauugcacau

SEQ ID NO: 3658523 - RNA, 18 nt, Human
cuuugauugcacauuguu

SEQ ID NO: 3658524 - RNA, 15 nt, Human
cuuugcaaaguauug

SEQ ID NO: 3658525 - RNA, 19 nt, Human
cuuugcaaaguauuguaaa

SEQ ID NO: 3658526 - RNA, 20 nt, Human
cuuugcaaaguauuguaaau

SEQ ID NO: 3658527 - RNA, 22 nt, Human
cuuugcaaaguauuguaaauua

SEQ ID NO: 3658528 - RNA, 20 nt, Human
cuuugcacacuuuggcccag

SEQ ID NO: 3658529 - RNA, 21 nt, Human
cuuugcacgacgcccucuccc

SEQ ID NO: 3658530 - RNA, 14 nt, Human
cuuugcacgugcug

SEQ ID NO: 3658531 - RNA, 18 nt, Human
cuuugcacugagggccac

SEQ ID NO: 3658532 - RNA, 19 nt, Human
cuuugcacugagggccaca

SEQ ID NO: 3658533 - RNA, 17 nt, Human
cuuugcacuuuuucuua

SEQ ID NO: 3658534 - RNA, 22 nt, Human
cuuugcacuuuuucuuaaucau

SEQ ID NO: 3658535 - RNA, 15 nt, Human
cuuugcagacaggca

SEQ ID NO: 3658536 - RNA, 16 nt, Human
cuuugcagacaggcaa

SEQ ID NO: 3658537 - RNA, 12 nt, Human
cuuugcaggcau

SEQ ID NO: 3658538 - RNA, 18 nt, Human
cuuugcagggcagcccca

SEQ ID NO: 3658539 - RNA, 15 nt, Human
cuuugcagguugcuu

SEQ ID NO: 3658540 - RNA, 21 nt, Human
cuuugcaguucccaucuccuu

SEQ ID NO: 3658541 - RNA, 22 nt, Human
cuuugcauaacguauaaaagcc

SEQ ID NO: 3658542 - RNA, 15 nt, Human
cuuugcauauuauaa

SEQ ID NO: 3658543 - RNA, 23 nt, Human
cuuugcauauuauaaaggauaaa

SEQ ID NO: 3658544 - RNA, 18 nt, Human
cuuugcaucguccccucc

SEQ ID NO: 3658545 - RNA, 21 nt, Human
cuuugcauggaauuuguaagu

SEQ ID NO: 3658546 - RNA, 22 nt, Human
cuuugcauguuccacuaacccc

SEQ ID NO: 3658547 - RNA, 12 nt, Human
cuuugcauuuua

SEQ ID NO: 3658548 - RNA, 17 nt, Human
cuuugccaaaaagcaua

SEQ ID NO: 3658549 - RNA, 16 nt, Human
cuuugccaagaccuuu

SEQ ID NO: 3658550 - RNA, 16 nt, Human
cuuugccacccucaug

SEQ ID NO: 3658551 - RNA, 21 nt, Human
cuuugccaggugacugucugg

SEQ ID NO: 3658552 - RNA, 22 nt, Human
cuuugccaggugacugucuggg

SEQ ID NO: 3658553 - RNA, 12 nt, Human
cuuugccaucuc

SEQ ID NO: 3658554 - RNA, 14 nt, Human
cuuugccaucucug

SEQ ID NO: 3658555 - RNA, 18 nt, Human
cuuugccaucucugcucc

SEQ ID NO: 3658556 - RNA, 18 nt, Human
cuuugcccaaccucagca

SEQ ID NO: 3658557 - RNA, 15 nt, Human
cuuugcccagaaaga

SEQ ID NO: 3658558 - RNA, 23 nt, Human
cuuugcccccaaacccccauucu

SEQ ID NO: 3658559 - RNA, 18 nt, Human
cuuugcccugcugcccuc

SEQ ID NO: 3658560 - RNA, 20 nt, Human
cuuugcccugguagggcagu

SEQ ID NO: 3658561 - RNA, 21 nt, Human
cuuugccuccagaagcacugg

SEQ ID NO: 3658562 - RNA, 11 nt, Human
cuuugccuggu

SEQ ID NO: 3658563 - RNA, 14 nt, Human
cuuugccuguucag

SEQ ID NO: 3658564 - RNA, 19 nt, Human
cuuugccuugggcugcucc

SEQ ID NO: 3658565 - RNA, 23 nt, Human
cuuugccuugggcugcuccucau

SEQ ID NO: 3658566 - RNA, 14 nt, Human
cuuugccuuuugca

SEQ ID NO: 3658567 - RNA, 15 nt, Human
cuuugcgccugugac

SEQ ID NO: 3658568 - RNA, 13 nt, Human
cuuugcgcuccug

SEQ ID NO: 3658569 - RNA, 19 nt, Human
cuuugcgugcccggggcag

SEQ ID NO: 3658570 - RNA, 18 nt, Human
cuuugcuccaccccacuc

SEQ ID NO: 3658571 - RNA, 13 nt, Human
cuuugcuccuccc

SEQ ID NO: 3658572 - RNA, 13 nt, Human
cuuugcucugggu

SEQ ID NO: 3658573 - RNA, 12 nt, Human
cuuugcucuggu

SEQ ID NO: 3658574 - RNA, 15 nt, Human
cuuugcugcauggca

SEQ ID NO: 3658575 - RNA, 10 nt, Human
cuuugcugcu

SEQ ID NO: 3658576 - RNA, 19 nt, Human
cuuugcugcugaaggcuca

SEQ ID NO: 3658577 - RNA, 17 nt, Human
cuuugcugugaggcugu

SEQ ID NO: 3658578 - RNA, 19 nt, Human
cuuugcuuaugaauauuua

SEQ ID NO: 3658579 - RNA, 20 nt, Human
cuuugcuucaaauccaucca

SEQ ID NO: 3658580 - RNA, 14 nt, Human
cuuugcuugaacac

SEQ ID NO: 3658581 - RNA, 19 nt, Human
cuuugcuugcaguagauuu

SEQ ID NO: 3658582 - RNA, 17 nt, Human
cuuugcuuuaauauaaa

SEQ ID NO: 3658583 - RNA, 18 nt, Human
cuuugcuuuaauauaaau

SEQ ID NO: 3658584 - RNA, 12 nt, Human
cuuugcuuucug

SEQ ID NO: 3658585 - RNA, 14 nt, Human
cuuugcuuucugcu

SEQ ID NO: 3658586 - RNA, 19 nt, Human
cuuugcuuucugcucagcu

SEQ ID NO: 3658587 - RNA, 18 nt, Human
cuuugcuuugucuggaag

SEQ ID NO: 3658588 - RNA, 17 nt, Human
cuuuggaaaaauguuug

SEQ ID NO: 3658589 - RNA, 24 nt, Human
cuuuggaaaguacacucugcuguu

SEQ ID NO: 3658590 - RNA, 15 nt, Human
cuuuggaaccagacu

SEQ ID NO: 3658591 - RNA, 16 nt, Human
cuuuggaaccagacuc

SEQ ID NO: 3658592 - RNA, 22 nt, Human
cuuuggaaccagacucuugccu

SEQ ID NO: 3658593 - RNA, 17 nt, Human
cuuuggaagaaaaaauc

SEQ ID NO: 3658594 - RNA, 15 nt, Human
cuuuggaaggaguga

SEQ ID NO: 3658595 - RNA, 18 nt, Human
cuuuggaaguuuagcucu

SEQ ID NO: 3658596 - RNA, 22 nt, Human
cuuuggaaguuuagcucugaga

SEQ ID NO: 3658597 - RNA, 17 nt, Human
cuuuggaaguuuguguu

SEQ ID NO: 3658598 - RNA, 17 nt, Human
cuuuggacacacacagc

SEQ ID NO: 3658599 - RNA, 18 nt, Human
cuuuggacagaagcagcu

SEQ ID NO: 3658600 - RNA, 18 nt, Human
cuuuggacccugaggccc

SEQ ID NO: 3658601 - RNA, 21 nt, Human
cuuuggaccuaaauggccuca

SEQ ID NO: 3658602 - RNA, 16 nt, Human
cuuuggaccuaaucca

SEQ ID NO: 3658603 - RNA, 17 nt, Human
cuuuggaccuaauccaa

SEQ ID NO: 3658604 - RNA, 16 nt, Human
cuuuggacgcacacag

SEQ ID NO: 3658605 - RNA, 15 nt, Human
cuuuggacucucccc

SEQ ID NO: 3658606 - RNA, 21 nt, Human
cuuuggacucuccccucuuau

SEQ ID NO: 3658607 - RNA, 19 nt, Human
cuuuggagaccauuaucag

SEQ ID NO: 3658608 - RNA, 20 nt, Human
cuuuggagacuuucuuuaaa

SEQ ID NO: 3658609 - RNA, 16 nt, Human
cuuuggauaauaagga

SEQ ID NO: 3658610 - RNA, 18 nt, Human
cuuuggauucuaaauaca

SEQ ID NO: 3658611 - RNA, 13 nt, Human
cuuuggauuugac

SEQ ID NO: 3658612 - RNA, 15 nt, Human
cuuuggauuugacau

SEQ ID NO: 3658613 - RNA, 16 nt, Human
cuuuggauuugacauu

SEQ ID NO: 3658614 - RNA, 16 nt, Human
cuuuggcacucugacu

SEQ ID NO: 3658615 - RNA, 14 nt, Human
cuuuggcccagggu

SEQ ID NO: 3658616 - RNA, 19 nt, Human
cuuuggcuaugagggccuu

SEQ ID NO: 3658617 - RNA, 15 nt, Human
cuuuggcuccccugu

SEQ ID NO: 3658618 - RNA, 22 nt, Human
cuuuggcugaaaggaagcugug

SEQ ID NO: 3658619 - RNA, 16 nt, Human
cuuuggcugcaugcga

SEQ ID NO: 3658620 - RNA, 12 nt, Human
cuuuggcuuuuu

SEQ ID NO: 3658621 - RNA, 14 nt, Human
cuuugggaaaacau

SEQ ID NO: 3658622 - RNA, 21 nt, Human
cuuugggaaaacauguuaaug

SEQ ID NO: 3658623 - RNA, 19 nt, Human
cuuugggaagccuuuacug

SEQ ID NO: 3658624 - RNA, 13 nt, Human
cuuugggaagggg

SEQ ID NO: 3658625 - RNA, 18 nt, Human
cuuugggaauauuugaau

SEQ ID NO: 3658626 - RNA, 19 nt, Human
cuuugggaauauuugaauc

SEQ ID NO: 3658627 - RNA, 13 nt, Human
cuuugggagacca

SEQ ID NO: 3658628 - RNA, 15 nt, Human
cuuugggauuuaauu

SEQ ID NO: 3658629 - RNA, 12 nt, Human
cuuugggccaga

SEQ ID NO: 3658630 - RNA, 18 nt, Human
cuuugggcuucagcugcc

SEQ ID NO: 3658631 - RNA, 21 nt, Human
cuuugggcuucagcugccagu

SEQ ID NO: 3658632 - RNA, 21 nt, Human
cuuuggggucagccagggcca

SEQ ID NO: 3658633 - RNA, 17 nt, Human
cuuugggguuuuuuaau

SEQ ID NO: 3658634 - RNA, 20 nt, Human
cuuuggguuaagcauuacca

SEQ ID NO: 3658635 - RNA, 22 nt, Human
cuuuggguuaagcauuaccacu

SEQ ID NO: 3658636 - RNA, 22 nt, Human
cuuugguacauggccaguguga

SEQ ID NO: 3658637 - RNA, 15 nt, Human
cuuugguaccagaua

SEQ ID NO: 3658638 - RNA, 17 nt, Human
cuuuggucucuugcuug

SEQ ID NO: 3658639 - RNA, 15 nt, Human
cuuuggucuugcccc

SEQ ID NO: 3658640 - RNA, 23 nt, Human
cuuuggugccaacugguguuuga

SEQ ID NO: 3658641 - RNA, 16 nt, Human
cuuuggugccuuuccu

SEQ ID NO: 3658642 - RNA, 20 nt, Human
cuuugguguacaaaauggaa

SEQ ID NO: 3658643 - RNA, 20 nt, Human
cuuugguuaaauagucuaga

SEQ ID NO: 3658644 - RNA, 19 nt, Human
cuuugguucuggccagaau

SEQ ID NO: 3658645 - RNA, 21 nt, Human
cuuugguucuggccagaaugc

SEQ ID NO: 3658646 - RNA, 20 nt, Human
cuuugguuuaauuuaaagcc

SEQ ID NO: 3658647 - RNA, 16 nt, Human
cuuugguuucugucug

SEQ ID NO: 3658648 - RNA, 19 nt, Human
cuuugguuuuuuucuucug

SEQ ID NO: 3658649 - RNA, 19 nt, Human
gaaaucuuacagcugggug

SEQ ID NO: 3658650 - RNA, 12 nt, Human
gaaaucuuuaaa

SEQ ID NO: 3658651 - RNA, 20 nt, Human
gaaaugaaaacaguguguaa

SEQ ID NO: 3658652 - RNA, 21 nt, Human
gaaaugaaauauuguuuccaa

SEQ ID NO: 3658653 - RNA, 16 nt, Human
gaaaugaaauuuuacc

SEQ ID NO: 3658654 - RNA, 17 nt, Human
gaaaugaaauuuuacca

SEQ ID NO: 3658655 - RNA, 15 nt, Human
gaaaugaacauucca

SEQ ID NO: 3658656 - RNA, 14 nt, Human
gaaaugaauaauuu

SEQ ID NO: 3658657 - RNA, 15 nt, Human
gaaaugaaugugugu

SEQ ID NO: 3658658 - RNA, 15 nt, Human
gaaaugaauuaaagu

SEQ ID NO: 3658659 - RNA, 15 nt, Human
gaaaugagaaggcag

SEQ ID NO: 3658660 - RNA, 18 nt, Human
gaaaugagaucaggcucu

SEQ ID NO: 3658661 - RNA, 22 nt, Human
gaaaugagcaccuccauuaaag

SEQ ID NO: 3658662 - RNA, 17 nt, Human
gaaaugaggucuguuua

SEQ ID NO: 3658663 - RNA, 23 nt, Human
gaaaugaggucuguuuaaagugg

SEQ ID NO: 3658664 - RNA, 14 nt, Human
gaaaugaucaguuu

SEQ ID NO: 3658665 - RNA, 12 nt, Human
gaaaugcacaau

SEQ ID NO: 3658666 - RNA, 16 nt, Human
gaaaugcacaaugucu

SEQ ID NO: 3658667 - RNA, 23 nt, Human
gaaaugcauccauuccucaggga

SEQ ID NO: 3658668 - RNA, 18 nt, Human
gaaaugccuaagaagaug

SEQ ID NO: 3658669 - RNA, 23 nt, Human
gaaaugccuaagaagaugacuuc

SEQ ID NO: 3658670 - RNA, 17 nt, Human
gaaaugccuuacuuugu

SEQ ID NO: 3658671 - RNA, 23 nt, Human
gaaaugccuuacuuuguaugaua

SEQ ID NO: 3658672 - RNA, 18 nt, Human
gaaaugcuaugucauuuc

SEQ ID NO: 3658673 - RNA, 19 nt, Human
gaaaugcuaugucauuuca

SEQ ID NO: 3658674 - RNA, 20 nt, Human
gaaaugcuaugucauuucau

SEQ ID NO: 3658675 - RNA, 22 nt, Human
gaaaugcugacccaugggcagg

SEQ ID NO: 3658676 - RNA, 14 nt, Human
gaaaugcugauuua

SEQ ID NO: 3658677 - RNA, 17 nt, Human
gaaaugcugccugccug

SEQ ID NO: 3658678 - RNA, 16 nt, Human
gaaauggaaagcagag

SEQ ID NO: 3658679 - RNA, 14 nt, Human
gaaauggaaauuuu

SEQ ID NO: 3658680 - RNA, 21 nt, Human
gaaauggauacuacaucuuua

SEQ ID NO: 3658681 - RNA, 14 nt, Human
gaaaugggcagagc

SEQ ID NO: 3658682 - RNA, 18 nt, Human
gaaaugguacuguacagc

SEQ ID NO: 3658683 - RNA, 21 nt, Human
gaaaugguacuguacagcugg

SEQ ID NO: 3658684 - RNA, 17 nt, Human
gaaaugguauccagaau

SEQ ID NO: 3658685 - RNA, 16 nt, Human
gaaaugguaugagcug

SEQ ID NO: 3658686 - RNA, 18 nt, Human
gaaaugguuguauuagau

SEQ ID NO: 3658687 - RNA, 16 nt, Human
gaaauguaaacugcca

SEQ ID NO: 3658688 - RNA, 21 nt, Human
gaaauguaaggcuguguaaga

SEQ ID NO: 3658689 - RNA, 16 nt, Human
gaaauguaccuucuuu

SEQ ID NO: 3658690 - RNA, 16 nt, Human
gaaaugucccuuucuu

SEQ ID NO: 3658691 - RNA, 18 nt, Human
gaaaugucccuuucuucu

SEQ ID NO: 3658692 - RNA, 19 nt, Human
gaaaugugaauuuuuauug

SEQ ID NO: 3658693 - RNA, 14 nt, Human
gaaauguguuucug

SEQ ID NO: 3658694 - RNA, 16 nt, Human
gaaauguguuucugua

SEQ ID NO: 3658695 - RNA, 19 nt, Human
gaaauguuuuguaaacauu

SEQ ID NO: 3658696 - RNA, 20 nt, Human
gaaauguuuuguaaacauuu

SEQ ID NO: 3658697 - RNA, 18 nt, Human
gaaauuaagaaggcaaaa

SEQ ID NO: 3658698 - RNA, 23 nt, Human
gaaauuaagacuuuauguaguuu

SEQ ID NO: 3658699 - RNA, 17 nt, Human
gaaauuacacccaaaga

SEQ ID NO: 3658700 - RNA, 15 nt, Human
gaaauuaccugugga

SEQ ID NO: 3658701 - RNA, 19 nt, Human
gaaauuacuaauuuuacuu

SEQ ID NO: 3658702 - RNA, 18 nt, Human
gaaauuacuacaaaauuu

SEQ ID NO: 3658703 - RNA, 19 nt, Human
gaaauuacuacaaaauuug

SEQ ID NO: 3658704 - RNA, 17 nt, Human
gaaauuagguugaaaca

SEQ ID NO: 3658705 - RNA, 19 nt, Human
gaaauuagguugaaacaua

SEQ ID NO: 3658706 - RNA, 17 nt, Human
gaaauuauauaaguauu

SEQ ID NO: 3658707 - RNA, 21 nt, Human
gaaauuauguauguuuacaua

SEQ ID NO: 3658708 - RNA, 23 nt, Human
gaaauuaugugacauuuuacauu

SEQ ID NO: 3658709 - RNA, 13 nt, Human
gaaauucccugga

SEQ ID NO: 3658710 - RNA, 23 nt, Human
gaaauucccuggaccagaugcug

SEQ ID NO: 3658711 - RNA, 17 nt, Human
gaaauucccuucaucug

SEQ ID NO: 3658712 - RNA, 20 nt, Human
cuacaguuguuuuuugaaaa

SEQ ID NO: 3658713 - RNA, 22 nt, Human
cuacaguuguuuuuugaaaaca

SEQ ID NO: 3658714 - RNA, 15 nt, Human
cuacaguuuuaacug

SEQ ID NO: 3658715 - RNA, 21 nt, Human
cuacauaaaauaaaucuacug

SEQ ID NO: 3658716 - RNA, 12 nt, Human
cuacauaaacug

SEQ ID NO: 3658717 - RNA, 18 nt, Human
cuacauaaacugacuuua

SEQ ID NO: 3658718 - RNA, 20 nt, Human
cuacauaaacugacuuuauc

SEQ ID NO: 3658719 - RNA, 19 nt, Human
cuacauaacuaauacagcu

SEQ ID NO: 3658720 - RNA, 23 nt, Human
cuacauaaguaauucaagaaaac

SEQ ID NO: 3658721 - RNA, 18 nt, Human
cuacauacaauuccaaac

SEQ ID NO: 3658722 - RNA, 19 nt, Human
cuacauaucccuuccagau

SEQ ID NO: 3658723 - RNA, 16 nt, Human
cuacauaugaucuguc

SEQ ID NO: 3658724 - RNA, 14 nt, Human
cuacauauugaaua

SEQ ID NO: 3658725 - RNA, 16 nt, Human
cuacaucuucugccuu

SEQ ID NO: 3658726 - RNA, 13 nt, Human
cuacaugaaacag

SEQ ID NO: 3658727 - RNA, 14 nt, Human
cuacaugaaacaga

SEQ ID NO: 3658728 - RNA, 18 nt, Human
cuacaugaaacagaaaca

SEQ ID NO: 3658729 - RNA, 19 nt, Human
cuacaugacgacaaagcug

SEQ ID NO: 3658730 - RNA, 21 nt, Human
cuacaugaggaacuguagaug

SEQ ID NO: 3658731 - RNA, 22 nt, Human
cuacaugaucuagagccaguua

SEQ ID NO: 3658732 - RNA, 23 nt, Human
cuacaugcagcccaugcccaccu

SEQ ID NO: 3658733 - RNA, 14 nt, Human
cuacaugcuggggu

SEQ ID NO: 3658734 - RNA, 23 nt, Human
cuacaugguugaaaccccaucuc

SEQ ID NO: 3658735 - RNA, 13 nt, Human
cuacauguauugc

SEQ ID NO: 3658736 - RNA, 22 nt, Human
cuacauguauugcacauuguaa

SEQ ID NO: 3658737 - RNA, 16 nt, Human
cuacaugugggagcuu

SEQ ID NO: 3658738 - RNA, 17 nt, Human
cuacaugugggagcuuu

SEQ ID NO: 3658739 - RNA, 17 nt, Human
cuacauuagguugugaa

SEQ ID NO: 3658740 - RNA, 17 nt, Human
cuacauuauaaacgcuu

SEQ ID NO: 3658741 - RNA, 13 nt, Human
cuacauucuguua

SEQ ID NO: 3658742 - RNA, 17 nt, Human
cuacauugacagauuga

SEQ ID NO: 3658743 - RNA, 23 nt, Human
cuacauuucaccuacuuuguaag

SEQ ID NO: 3658744 - RNA, 13 nt, Human
cuacauuuuaaca

SEQ ID NO: 3658745 - RNA, 15 nt, Human
cuacauuuuaacaug

SEQ ID NO: 3658746 - RNA, 15 nt, Human
cuaccaaaggacacu

SEQ ID NO: 3658747 - RNA, 18 nt, Human
cuaccaaggcauaucaug

SEQ ID NO: 3658748 - RNA, 15 nt, Human
cuaccacagugucug

SEQ ID NO: 3658749 - RNA, 16 nt, Human
cuaccaccacgcccgg

SEQ ID NO: 3658750 - RNA, 11 nt, Human
cuaccaccucc

SEQ ID NO: 3658751 - RNA, 18 nt, Human
cuaccacggccuccuuuc

SEQ ID NO: 3658752 - RNA, 19 nt, Human
cuaccacggccuccuuucc

SEQ ID NO: 3658753 - RNA, 20 nt, Human
cuaccagacuguguauucau

SEQ ID NO: 3658754 - RNA, 19 nt, Human
cuaccagcgcccgcugggc

SEQ ID NO: 3658755 - RNA, 19 nt, Human
cuaccagugcaggcuggcc

SEQ ID NO: 3658756 - RNA, 20 nt, Human
cuaccagugcaggcuggcca

SEQ ID NO: 3658757 - RNA, 22 nt, Human
cuaccagugcaggcuggccagc

SEQ ID NO: 3658758 - RNA, 23 nt, Human
cuaccagugcaggcuggccagcc

SEQ ID NO: 3658759 - RNA, 21 nt, Human
cuaccauugcuguucuacuuu

SEQ ID NO: 3658760 - RNA, 19 nt, Human
cuacccaaaacaagccugg

SEQ ID NO: 3658761 - RNA, 17 nt, Human
cuacccaaacccuaggu

SEQ ID NO: 3658762 - RNA, 14 nt, Human
cuacccaaccacuc

SEQ ID NO: 3658763 - RNA, 17 nt, Human
cuacccacccuccuuuc

SEQ ID NO: 3658764 - RNA, 20 nt, Human
cuacccacuauccuucguga

SEQ ID NO: 3658765 - RNA, 16 nt, Human
cuacccacuucuaaau

SEQ ID NO: 3658766 - RNA, 22 nt, Human
cuacccacuucuaaauagcaau

SEQ ID NO: 3658767 - RNA, 13 nt, Human
cuacccagcccau

SEQ ID NO: 3658768 - RNA, 15 nt, Human
cuacccagcgagccc

SEQ ID NO: 3658769 - RNA, 14 nt, Human
cuacccagggccug

SEQ ID NO: 3658770 - RNA, 15 nt, Human
cuacccagggccugc

SEQ ID NO: 3658771 - RNA, 13 nt, Human
cuacccaggugcu

SEQ ID NO: 3658772 - RNA, 15 nt, Human
cuacccauccccgca

SEQ ID NO: 3658773 - RNA, 16 nt, Human
cuaccccaauuccuug

SEQ ID NO: 3658774 - RNA, 17 nt, Human
cuaccccacaccaggcc

SEQ ID NO: 3658775 - RNA, 17 nt, Human
cuacccccagcugugcu

SEQ ID NO: 3658776 - RNA, 17 nt, Human
cuacccccuaagagcca

SEQ ID NO: 3658777 - RNA, 14 nt, Human
cuacccccugugcc

SEQ ID NO: 3658778 - RNA, 13 nt, Human
cuaccccucccag

SEQ ID NO: 3658779 - RNA, 16 nt, Human
cuaccccucccagcug

SEQ ID NO: 3658780 - RNA, 24 nt, Human
cuaccccucccggcccugccugcu

SEQ ID NO: 3658781 - RNA, 19 nt, Human
cuaccccuggcuguacugc

SEQ ID NO: 3658782 - RNA, 14 nt, Human
cuacccgggaaggg

SEQ ID NO: 3658783 - RNA, 15 nt, Human
cuacccgggaagggg

SEQ ID NO: 3658784 - RNA, 18 nt, Human
cuacccuagccauuccug

SEQ ID NO: 3658785 - RNA, 13 nt, Human
cuacccucacaau

SEQ ID NO: 3658786 - RNA, 15 nt, Human
cuacccucagugagc

SEQ ID NO: 3658787 - RNA, 14 nt, Human
cuacccucccccag

SEQ ID NO: 3658788 - RNA, 18 nt, Human
cuacccucccugcugucc

SEQ ID NO: 3658789 - RNA, 19 nt, Human
cuacccuccugcacuguuu

SEQ ID NO: 3658790 - RNA, 23 nt, Human
cuacccucgggcccaccuggcca

SEQ ID NO: 3658791 - RNA, 16 nt, Human
cuacccucuagagaaa

SEQ ID NO: 3658792 - RNA, 20 nt, Human
cuacccugcauggcugagcu

SEQ ID NO: 3658793 - RNA, 20 nt, Human
cuacuuccuccuccccacuu

SEQ ID NO: 3658794 - RNA, 15 nt, Human
cuacuuccugccugg

SEQ ID NO: 3658795 - RNA, 20 nt, Human
cuacuuccugccuggucucc

SEQ ID NO: 3658796 - RNA, 17 nt, Human
cuacuucuguaauugug

SEQ ID NO: 3658797 - RNA, 18 nt, Human
cuacuucuguaauugugu

SEQ ID NO: 3658798 - RNA, 15 nt, Human
cuacuugagaggcug

SEQ ID NO: 3658799 - RNA, 14 nt, Human
cuacuugcucaggu

SEQ ID NO: 3658800 - RNA, 13 nt, Human
cuacuugcucugg

SEQ ID NO: 3658801 - RNA, 16 nt, Human
cuacuugcucuggacc

SEQ ID NO: 3658802 - RNA, 16 nt, Human
cuacuugggaggcuga

SEQ ID NO: 3658803 - RNA, 20 nt, Human
cuacuugggaggcugaggca

SEQ ID NO: 3658804 - RNA, 13 nt, Human
cuacuugggccau

SEQ ID NO: 3658805 - RNA, 14 nt, Human
cuacuuuccaggcu

SEQ ID NO: 3658806 - RNA, 17 nt, Human
cuacuuugauaugacug

SEQ ID NO: 3658807 - RNA, 21 nt, Human
cuacuuugauaugacuguuuu

SEQ ID NO: 3658808 - RNA, 22 nt, Human
cuacuuuguccuuuuuguuauu

SEQ ID NO: 3658809 - RNA, 21 nt, Human
cuacuuuuccuucccucaaag

SEQ ID NO: 3658810 - RNA, 17 nt, Human
cuacuuuugcaugaaaa

SEQ ID NO: 3658811 - RNA, 11 nt, Human
cuagaaaaaca

SEQ ID NO: 3658812 - RNA, 22 nt, Human
cuagaaaacaaugcaaaaccuu

SEQ ID NO: 3658813 - RNA, 22 nt, Human
cuagaaaacuugacuccauuuc

SEQ ID NO: 3658814 - RNA, 18 nt, Human
cuagaaaagcugaucaua

SEQ ID NO: 3658815 - RNA, 17 nt, Human
cuagaaacaacacugua

SEQ ID NO: 3658816 - RNA, 19 nt, Human
cuagaaacaacacuguagu

SEQ ID NO: 3658817 - RNA, 20 nt, Human
cuagaaacaacacuguagua

SEQ ID NO: 3658818 - RNA, 18 nt, Human
cuagaaagcagagauuuu

SEQ ID NO: 3658819 - RNA, 13 nt, Human
cuagaaauuuuca

SEQ ID NO: 3658820 - RNA, 13 nt, Human
cuagaaauuuuuc

SEQ ID NO: 3658821 - RNA, 16 nt, Human
cuagaacacagaaagc

SEQ ID NO: 3658822 - RNA, 21 nt, Human
cuagaacacaggcaaaauccu

SEQ ID NO: 3658823 - RNA, 16 nt, Human
cuagaacacuaacuca

SEQ ID NO: 3658824 - RNA, 22 nt, Human
cuagaacacuaacucaccagcc

SEQ ID NO: 3658825 - RNA, 18 nt, Human
cuagaacaucccugccag

SEQ ID NO: 3658826 - RNA, 15 nt, Human
cuagaaccuggagag

SEQ ID NO: 3658827 - RNA, 12 nt, Human
cuagaacucccu

SEQ ID NO: 3658828 - RNA, 13 nt, Human
cuagaacucccuu

SEQ ID NO: 3658829 - RNA, 18 nt, Human
cuagaacucccuuucaac

SEQ ID NO: 3658830 - RNA, 23 nt, Human
cuagaacuuuuuuaaauaaacuu

SEQ ID NO: 3658831 - RNA, 15 nt, Human
cuagaagaaaugaaa

SEQ ID NO: 3658832 - RNA, 22 nt, Human
cuagaagaaaugaaauuuuacc

SEQ ID NO: 3658833 - RNA, 13 nt, Human
cuagaagaagcua

SEQ ID NO: 3658834 - RNA, 19 nt, Human
cuagaagagucuauugucu

SEQ ID NO: 3658835 - RNA, 20 nt, Human
cuagaagaugaauacaaaca

SEQ ID NO: 3658836 - RNA, 14 nt, Human
cuagaaggccacau

SEQ ID NO: 3658837 - RNA, 20 nt, Human
cuagaagugggccaggacag

SEQ ID NO: 3658838 - RNA, 18 nt, Human
cuagaaguuacugaaugc

SEQ ID NO: 3658839 - RNA, 17 nt, Human
cuagaauaaucuugcuc

SEQ ID NO: 3658840 - RNA, 18 nt, Human
cuagaauacuuuuuaaaa

SEQ ID NO: 3658841 - RNA, 22 nt, Human
cuagaaucagccuaggggucag

SEQ ID NO: 3658842 - RNA, 20 nt, Human
cuagaauucccucucucuga

SEQ ID NO: 3658843 - RNA, 15 nt, Human
cuagaauucuagugc

SEQ ID NO: 3658844 - RNA, 16 nt, Human
cuagaauugaguguuu

SEQ ID NO: 3658845 - RNA, 21 nt, Human
cuagaauuuaucacacuucug

SEQ ID NO: 3658846 - RNA, 15 nt, Human
cuagaauuuauucaa

SEQ ID NO: 3658847 - RNA, 23 nt, Human
cuagaauuuauucaauuccucug

SEQ ID NO: 3658848 - RNA, 15 nt, Human
cuagaauuuuaagcc

SEQ ID NO: 3658849 - RNA, 13 nt, Human
cuagacaacccug

SEQ ID NO: 3658850 - RNA, 15 nt, Human
cuagacaacccugca

SEQ ID NO: 3658851 - RNA, 15 nt, Human
cuagacaagauauug

SEQ ID NO: 3658852 - RNA, 18 nt, Human
cuagacaagauauuguac

SEQ ID NO: 3658853 - RNA, 16 nt, Human
cuagacaagccagaac

SEQ ID NO: 3658854 - RNA, 13 nt, Human
cuagacacacaaa

SEQ ID NO: 3658855 - RNA, 13 nt, Human
cuagacacagaua

SEQ ID NO: 3658856 - RNA, 14 nt, Human
cuagacacaugaag

SEQ ID NO: 3658857 - RNA, 15 nt, Human
cuagacaccaaaguu

SEQ ID NO: 3658858 - RNA, 21 nt, Human
cuagacaccaaaguucuaaua

SEQ ID NO: 3658859 - RNA, 17 nt, Human
cuagacauggagguucu

SEQ ID NO: 3658860 - RNA, 18 nt, Human
cuagacauggagguucua

SEQ ID NO: 3658861 - RNA, 20 nt, Human
cuagacauggagguucuaag

SEQ ID NO: 3658862 - RNA, 21 nt, Human
cuagacauggagguucuaagg

SEQ ID NO: 3658863 - RNA, 23 nt, Human
cuagacauggagguucuaaggcc

SEQ ID NO: 3658864 - RNA, 15 nt, Human
cuagacauucugucg

SEQ ID NO: 3658865 - RNA, 12 nt, Human
cuagaccaauaa

SEQ ID NO: 3658866 - RNA, 17 nt, Human
cuagaccagcagacaga

SEQ ID NO: 3658867 - RNA, 23 nt, Human
cuagaccagcagacagagccagg

SEQ ID NO: 3658868 - RNA, 21 nt, Human
cuagacuaaaagauugagaag

SEQ ID NO: 3658869 - RNA, 22 nt, Human
cuagacucaagguucccagaga

SEQ ID NO: 3658870 - RNA, 18 nt, Human
cuagacucccaagcugga

SEQ ID NO: 3658871 - RNA, 18 nt, Human
cuagacuggugacugauu

SEQ ID NO: 3658872 - RNA, 19 nt, Human
cuagacuggugacugauuc

SEQ ID NO: 3658873 - RNA, 18 nt, Human
cuagacuuuaggcuuuca

SEQ ID NO: 3658874 - RNA, 12 nt, Human
cuagacuuucug

SEQ ID NO: 3658875 - RNA, 15 nt, Human
cuagagaagaggcug

SEQ ID NO: 3658876 - RNA, 19 nt, Human
cuagagaagaggcuggugc

SEQ ID NO: 3658877 - RNA, 14 nt, Human
gaaaccagggccug

SEQ ID NO: 3658878 - RNA, 20 nt, Human
gaaaccagggccugagccaa

SEQ ID NO: 3658879 - RNA, 18 nt, Human
gaaaccagugcaacagca

SEQ ID NO: 3658880 - RNA, 13 nt, Human
gaaacccaagcuc

SEQ ID NO: 3658881 - RNA, 14 nt, Human
gaaacccagcucug

SEQ ID NO: 3658882 - RNA, 16 nt, Human
gaaacccagcucuggu

SEQ ID NO: 3658883 - RNA, 18 nt, Human
gaaacccagcucuggucc

SEQ ID NO: 3658884 - RNA, 18 nt, Human
gaaacccauaggcccaca

SEQ ID NO: 3658885 - RNA, 14 nt, Human
gaaacccugagcag

SEQ ID NO: 3658886 - RNA, 17 nt, Human
gaaacccuugaaaagac

SEQ ID NO: 3658887 - RNA, 17 nt, Human
gaaaccguccucuuuuu

SEQ ID NO: 3658888 - RNA, 13 nt, Human
gaaaccuacugcc

SEQ ID NO: 3658889 - RNA, 18 nt, Human
gaaaccuaguacugcccc

SEQ ID NO: 3658890 - RNA, 13 nt, Human
gaaaccugaaaaa

SEQ ID NO: 3658891 - RNA, 16 nt, Human
gaaaccugggauucag

SEQ ID NO: 3658892 - RNA, 12 nt, Human
gaaaccugggcu

SEQ ID NO: 3658893 - RNA, 18 nt, Human
gaaaccugggcucugguu

SEQ ID NO: 3658894 - RNA, 21 nt, Human
gaaaccuguauaacccuguua

SEQ ID NO: 3658895 - RNA, 13 nt, Human
gaaaccuguaucu

SEQ ID NO: 3658896 - RNA, 14 nt, Human
gaaaccuguaucuu

SEQ ID NO: 3658897 - RNA, 18 nt, Human
gaaaccuguaucuuucua

SEQ ID NO: 3658898 - RNA, 13 nt, Human
gaaaccugucuga

SEQ ID NO: 3658899 - RNA, 12 nt, Human
gaaaccugugaa

SEQ ID NO: 3658900 - RNA, 20 nt, Human
gaaaccuuauuguaccucuc

SEQ ID NO: 3658901 - RNA, 14 nt, Human
gaaaccuuccaccc

SEQ ID NO: 3658902 - RNA, 18 nt, Human
gaaaccuuuagggcagcu

SEQ ID NO: 3658903 - RNA, 20 nt, Human
gaaaccuuuagggcagcuug

SEQ ID NO: 3658904 - RNA, 23 nt, Human
gaaaccuuuuuuaagauuuuucu

SEQ ID NO: 3658905 - RNA, 23 nt, Human
gaaacgagacuuuccauuacaag

SEQ ID NO: 3658906 - RNA, 14 nt, Human
gaaacgcagacacu

SEQ ID NO: 3658907 - RNA, 18 nt, Human
gaaacgcuaccucucugu

SEQ ID NO: 3658908 - RNA, 17 nt, Human
gaaacggaugauuucua

SEQ ID NO: 3658909 - RNA, 15 nt, Human
gaaacgugcccucug

SEQ ID NO: 3658910 - RNA, 12 nt, Human
gaaacuaacaga

SEQ ID NO: 3658911 - RNA, 17 nt, Human
gaaacuaagauucuuuu

SEQ ID NO: 3658912 - RNA, 13 nt, Human
gaaacuaauaaaa

SEQ ID NO: 3658913 - RNA, 21 nt, Human
gaaacuaauaaaauauuuucu

SEQ ID NO: 3658914 - RNA, 21 nt, Human
gaaacuaauugacuuuagaaa

SEQ ID NO: 3658915 - RNA, 20 nt, Human
gaaacuagcuuacaugagaa

SEQ ID NO: 3658916 - RNA, 17 nt, Human
gaaacuauguguuuuuc

SEQ ID NO: 3658917 - RNA, 21 nt, Human
gaaacuauguguuuuucucau

SEQ ID NO: 3658918 - RNA, 18 nt, Human
gaaacucaccugcuggcc

SEQ ID NO: 3658919 - RNA, 21 nt, Human
gaaacucaccugcuggccccu

SEQ ID NO: 3658920 - RNA, 18 nt, Human
gaaacucauagacacuga

SEQ ID NO: 3658921 - RNA, 19 nt, Human
gaaacuccacaucugccuu

SEQ ID NO: 3658922 - RNA, 21 nt, Human
gaaacucuuaucucagucaug

SEQ ID NO: 3658923 - RNA, 20 nt, Human
gaaacucuugcuauugaauu

SEQ ID NO: 3658924 - RNA, 16 nt, Human
gaaacugacuugcugu

SEQ ID NO: 3658925 - RNA, 21 nt, Human
gaaacugcuuguuuccuagca

SEQ ID NO: 3658926 - RNA, 16 nt, Human
gaaacuggaaguuauu

SEQ ID NO: 3658927 - RNA, 17 nt, Human
gaaacuggcacugaauu

SEQ ID NO: 3658928 - RNA, 18 nt, Human
gaaacuggccauggccug

SEQ ID NO: 3658929 - RNA, 19 nt, Human
gaaacuggccauggccugc

SEQ ID NO: 3658930 - RNA, 20 nt, Human
gaaacuggccauggccugca

SEQ ID NO: 3658931 - RNA, 21 nt, Human
gaaacugucgguuugcuuuga

SEQ ID NO: 3658932 - RNA, 22 nt, Human
gaaacugucuagcacuuccuug

SEQ ID NO: 3658933 - RNA, 22 nt, Human
gaaacuguucccaccugcugga

SEQ ID NO: 3658934 - RNA, 15 nt, Human
gaaacuguugccaga

SEQ ID NO: 3658935 - RNA, 15 nt, Human
gaaacuuacacacaa

SEQ ID NO: 3658936 - RNA, 20 nt, Human
gaaacuuauuuuuuucugau

SEQ ID NO: 3658937 - RNA, 22 nt, Human
gaaacuucaagcaccagggaag

SEQ ID NO: 3658938 - RNA, 21 nt, Human
cuagugagcagucaggaaaga

SEQ ID NO: 3658939 - RNA, 15 nt, Human
cuagugauggucaga

SEQ ID NO: 3658940 - RNA, 16 nt, Human
cuagugcaaaucauag

SEQ ID NO: 3658941 - RNA, 17 nt, Human
cuagugcagcugaaauu

SEQ ID NO: 3658942 - RNA, 19 nt, Human
cuagugcagcugaaauuga

SEQ ID NO: 3658943 - RNA, 15 nt, Human
cuagugcagcugauu

SEQ ID NO: 3658944 - RNA, 18 nt, Human
cuagugcccuccacagcc

SEQ ID NO: 3658945 - RNA, 19 nt, Human
cuagugcccuccacagccg

SEQ ID NO: 3658946 - RNA, 22 nt, Human
cuagugcuccauaguuuggcau

SEQ ID NO: 3658947 - RNA, 13 nt, Human
cuagugcugaagc

SEQ ID NO: 3658948 - RNA, 14 nt, Human
cuagugcugaagcu

SEQ ID NO: 3658949 - RNA, 15 nt, Human
cuagugcugaagcuu

SEQ ID NO: 3658950 - RNA, 20 nt, Human
cuagugcugaagcuuauuaa

SEQ ID NO: 3658951 - RNA, 14 nt, Human
cuagugcugugaaa

SEQ ID NO: 3658952 - RNA, 13 nt, Human
cuagugcuuuccu

SEQ ID NO: 3658953 - RNA, 22 nt, Human
cuagugcuuuccuuuuuuaaaa

SEQ ID NO: 3658954 - RNA, 23 nt, Human
cuagugcuuuccuuuuuuaaaaa

SEQ ID NO: 3658955 - RNA, 18 nt, Human
cuaguggccgaaccagaa

SEQ ID NO: 3658956 - RNA, 20 nt, Human
cuaguggcuguccagugccc

SEQ ID NO: 3658957 - RNA, 15 nt, Human
cuaguggcuucaaaa

SEQ ID NO: 3658958 - RNA, 23 nt, Human
cuagugggacagcccagagccug

SEQ ID NO: 3658959 - RNA, 14 nt, Human
cuaguggucuuugu

SEQ ID NO: 3658960 - RNA, 19 nt, Human
cuaguggucuuuguaagag

SEQ ID NO: 3658961 - RNA, 20 nt, Human
cuaguggucuuuguaagagu

SEQ ID NO: 3658962 - RNA, 19 nt, Human
cuaguguaccuccucucag

SEQ ID NO: 3658963 - RNA, 14 nt, Human
cuagugugaauuaa

SEQ ID NO: 3658964 - RNA, 13 nt, Human
cuaguguucuguc

SEQ ID NO: 3658965 - RNA, 18 nt, Human
cuaguguucuguuuguua

SEQ ID NO: 3658966 - RNA, 18 nt, Human
cuaguguucuuucucuuu

SEQ ID NO: 3658967 - RNA, 18 nt, Human
cuaguguuuucaauuuua

SEQ ID NO: 3658968 - RNA, 12 nt, Human
cuaguuauuuau

SEQ ID NO: 3658969 - RNA, 20 nt, Human
cuaguuauuuauucugggaa

SEQ ID NO: 3658970 - RNA, 12 nt, Human
cuaguucaucca

SEQ ID NO: 3658971 - RNA, 20 nt, Human
cuaguucauccaauccucac

SEQ ID NO: 3658972 - RNA, 21 nt, Human
cuaguucauccaauccucacu

SEQ ID NO: 3658973 - RNA, 20 nt, Human
cuaguuccccuguuuauuca

SEQ ID NO: 3658974 - RNA, 14 nt, Human
cuaguucuagaaaa

SEQ ID NO: 3658975 - RNA, 22 nt, Human
cuaguucuuuguucauagccca

SEQ ID NO: 3658976 - RNA, 12 nt, Human
cuaguugaauac

SEQ ID NO: 3658977 - RNA, 18 nt, Human
cuaguugaauacuugaac

SEQ ID NO: 3658978 - RNA, 21 nt, Human
cuaguugaauacuugaaccau

SEQ ID NO: 3658979 - RNA, 14 nt, Human
cuaguuuacagaaa

SEQ ID NO: 3658980 - RNA, 21 nt, Human
cuaguuuacagaaaaaucuug

SEQ ID NO: 3658981 - RNA, 17 nt, Human
cuaguuuacuguuuuga

SEQ ID NO: 3658982 - RNA, 15 nt, Human
cuaguuuccucuccu

SEQ ID NO: 3658983 - RNA, 15 nt, Human
cuaguuugauuaaau

SEQ ID NO: 3658984 - RNA, 19 nt, Human
cuaguuugauuaaauucuu

SEQ ID NO: 3658985 - RNA, 13 nt, Human
cuaguuugcauuc

SEQ ID NO: 3658986 - RNA, 20 nt, Human
cuaguuugugagaaacaucu

SEQ ID NO: 3658987 - RNA, 17 nt, Human
cuaguuuucuccuccca

SEQ ID NO: 3658988 - RNA, 18 nt, Human
cuaguuuucuccucccag

SEQ ID NO: 3658989 - RNA, 16 nt, Human
cuaguuuucuuuccuc

SEQ ID NO: 3658990 - RNA, 19 nt, Human
cuaguuuuuaguaaucugu

SEQ ID NO: 3658991 - RNA, 22 nt, Human
cuaguuuuuaguaaucuguaca

SEQ ID NO: 3658992 - RNA, 23 nt, Human
cuaguuuuuaguaaucuguacau

SEQ ID NO: 3658993 - RNA, 11 nt, Human
cuaguuuuuua

SEQ ID NO: 3658994 - RNA, 23 nt, Human
cuaguuuuuucuuccuuuucacu

SEQ ID NO: 3658995 - RNA, 18 nt, Human
cuauaaaaaauaaaauaa

SEQ ID NO: 3658996 - RNA, 16 nt, Human
cuauaaaagcuuucug

SEQ ID NO: 3658997 - RNA, 21 nt, Human
cuauaaaauagauauaaauuu

SEQ ID NO: 3658998 - RNA, 17 nt, Human
cuauaaacaauuacaug

SEQ ID NO: 3658999 - RNA, 19 nt, Human
cuauaaagagaagacgaaa

SEQ ID NO: 3659000 - RNA, 14 nt, Human
cuauaaagcaguau

SEQ ID NO: 3659001 - RNA, 16 nt, Human
cuauaaagcaguauuu

SEQ ID NO: 3659002 - RNA, 11 nt, Human
cuauaaagcau

SEQ ID NO: 3659003 - RNA, 13 nt, Human
cuauaaagcauuu

SEQ ID NO: 3659004 - RNA, 20 nt, Human
cuauaaagcgauauacagau

SEQ ID NO: 3659005 - RNA, 18 nt, Human
cuauaaagcuagaugcuu

SEQ ID NO: 3659006 - RNA, 19 nt, Human
cuauaaagcuagaugcuuu

SEQ ID NO: 3659007 - RNA, 23 nt, Human
cuauaaaugguguuuuuuuaaua

SEQ ID NO: 3659008 - RNA, 19 nt, Human
cuauaaauuccucuuugcu

SEQ ID NO: 3659009 - RNA, 17 nt, Human
cuauaacacugugaaga

SEQ ID NO: 3659010 - RNA, 19 nt, Human
cuauaacacugugaagagc

SEQ ID NO: 3659011 - RNA, 19 nt, Human
cuauaacauagaauugcaa

SEQ ID NO: 3659012 - RNA, 16 nt, Human
cuauaaccagacacau

SEQ ID NO: 3659013 - RNA, 18 nt, Human
cuauaaccccagcucccu

SEQ ID NO: 3659014 - RNA, 20 nt, Human
cuauaacuacauauugaaua

SEQ ID NO: 3659015 - RNA, 15 nt, Human
cuauaacuugaugca

SEQ ID NO: 3659016 - RNA, 16 nt, Human
cuauaacuugaugcau

SEQ ID NO: 3659017 - RNA, 17 nt, Human
cuauaagaacuuugagc

SEQ ID NO: 3659018 - RNA, 12 nt, Human
cuauaaucuguc

SEQ ID NO: 3659019 - RNA, 12 nt, Human
cuauaaugaagc

SEQ ID NO: 3659020 - RNA, 13 nt, Human
cuauaaugugugu

SEQ ID NO: 3659021 - RNA, 22 nt, Human
cuauaauucccuaucuuuuagu

SEQ ID NO: 3659022 - RNA, 16 nt, Human
cuauaauugccacuga

SEQ ID NO: 3659023 - RNA, 20 nt, Human
cuauaauuuugauaguggga

SEQ ID NO: 3659024 - RNA, 13 nt, Human
cuauacaaauaua

SEQ ID NO: 3659025 - RNA, 15 nt, Human
cuauacaaauauaaa

SEQ ID NO: 3659026 - RNA, 15 nt, Human
cuauacauaucuuua

SEQ ID NO: 3659027 - RNA, 17 nt, Human
cuauacauaucuuuauu

SEQ ID NO: 3659028 - RNA, 16 nt, Human
cuauaccaauaaagug

SEQ ID NO: 3659029 - RNA, 21 nt, Human
cuauaccauuuccguaauucu

SEQ ID NO: 3659030 - RNA, 15 nt, Human
cuauacccacccaga

SEQ ID NO: 3659031 - RNA, 21 nt, Human
cuauaccugggcauacuaaua

SEQ ID NO: 3659032 - RNA, 15 nt, Human
cuauaccugugccuc

SEQ ID NO: 3659033 - RNA, 23 nt, Human
cuauaccuguguuucuugccuca

SEQ ID NO: 3659034 - RNA, 21 nt, Human
cuauacugcauacuuuuuaaa

SEQ ID NO: 3659035 - RNA, 12 nt, Human
cuauacugcuug

SEQ ID NO: 3659036 - RNA, 20 nt, Human
cuauagacuggaaaaaauga

SEQ ID NO: 3659037 - RNA, 16 nt, Human
cuauagaugucuuuuc

SEQ ID NO: 3659038 - RNA, 21 nt, Human
cuauagccuaggugacagagu

SEQ ID NO: 3659039 - RNA, 19 nt, Human
cuauagccuggacuuuccu

SEQ ID NO: 3659040 - RNA, 14 nt, Human
cuauagccuggggu

SEQ ID NO: 3659041 - RNA, 15 nt, Human
cuauagcuaaguaca

SEQ ID NO: 3659042 - RNA, 16 nt, Human
cuauagcucaggaccu

SEQ ID NO: 3659043 - RNA, 15 nt, Human
cuauagcuugcagaa

SEQ ID NO: 3659044 - RNA, 15 nt, Human
cuauaggcuggagaa

SEQ ID NO: 3659045 - RNA, 17 nt, Human
cuauaggcuggagaagc

SEQ ID NO: 3659046 - RNA, 15 nt, Human
cuauaggugcuacaa

SEQ ID NO: 3659047 - RNA, 20 nt, Human
cuauaggugcuacaaaaaca

SEQ ID NO: 3659048 - RNA, 18 nt, Human
cuauaguauuugauucaa

SEQ ID NO: 3659049 - RNA, 18 nt, Human
cuauauaauuccuguuuu

SEQ ID NO: 3659050 - RNA, 14 nt, Human
cuauauaauuuauu

SEQ ID NO: 3659051 - RNA, 22 nt, Human
cuauauacaucacguuaaagua

SEQ ID NO: 3659052 - RNA, 18 nt, Human
cuauauagaaugcugcac

SEQ ID NO: 3659053 - RNA, 18 nt, Human
cuauauauauaugccuuu

SEQ ID NO: 3659054 - RNA, 13 nt, Human
cuauauaugugua

SEQ ID NO: 3659055 - RNA, 13 nt, Human
cuauauauuucua

SEQ ID NO: 3659056 - RNA, 16 nt, Human
cuauauauuucuauua

SEQ ID NO: 3659057 - RNA, 21 nt, Human
cuauaucauuaaaagaacaua

SEQ ID NO: 3659058 - RNA, 12 nt, Human
cuauauccaugu

SEQ ID NO: 3659059 - RNA, 13 nt, Human
cuauauccaugua

SEQ ID NO: 3659060 - RNA, 16 nt, Human
cuauauccauguacug

SEQ ID NO: 3659061 - RNA, 20 nt, Human
cuauauccauguacuguagu

SEQ ID NO: 3659062 - RNA, 21 nt, Human
cuauauccauguacuguaguu

SEQ ID NO: 3659063 - RNA, 16 nt, Human
cuauaucuguauauaa

SEQ ID NO: 3659064 - RNA, 19 nt, Human
cuauaucuguauauaaaau

SEQ ID NO: 3659065 - RNA, 14 nt, Human
cuauaucuguuuua

SEQ ID NO: 3659066 - RNA, 15 nt, Human
cuauaucuguuuuac

SEQ ID NO: 3659067 - RNA, 23 nt, Human
cuauaucuguuuuacugcuuuua

SEQ ID NO: 3659068 - RNA, 15 nt, Human
cuauaugaauuuaaa

SEQ ID NO: 3659069 - RNA, 13 nt, Human
cuauaugauuuau

SEQ ID NO: 3659070 - RNA, 17 nt, Human
cuauaugauuuauaguu

SEQ ID NO: 3659071 - RNA, 18 nt, Human
cuauaugauuuauaguuu

SEQ ID NO: 3659072 - RNA, 13 nt, Human
cuauauggcaaga

SEQ ID NO: 3659073 - RNA, 19 nt, Human
cuauauguuuguauaauga

SEQ ID NO: 3659074 - RNA, 19 nt, Human
cuauauuacgguuugcccc

SEQ ID NO: 3659075 - RNA, 22 nt, Human
cuauauuccagguuuaaguaga

SEQ ID NO: 3659076 - RNA, 16 nt, Human
cuauauuguucagcau

SEQ ID NO: 3659077 - RNA, 18 nt, Human
cuauauuguuugcuaagc

SEQ ID NO: 3659078 - RNA, 18 nt, Human
cuauauuuaaguauucaa

SEQ ID NO: 3659079 - RNA, 15 nt, Human
cuauauuuacaguga

SEQ ID NO: 3659080 - RNA, 22 nt, Human
cuauauuuagauuguuaaaaua

SEQ ID NO: 3659081 - RNA, 23 nt, Human
cuauauuuagauuguuaaaauaa

SEQ ID NO: 3659082 - RNA, 12 nt, Human
cuauauuugcua

SEQ ID NO: 3659083 - RNA, 15 nt, Human
gaauauauauauaua

SEQ ID NO: 3659084 - RNA, 20 nt, Human
gaauauaucucuauuugaga

SEQ ID NO: 3659085 - RNA, 15 nt, Human
gaauauauggcagag

SEQ ID NO: 3659086 - RNA, 21 nt, Human
gaauauauggcagaguuguaa

SEQ ID NO: 3659087 - RNA, 22 nt, Human
gaauauauggcagaguuguaaa

SEQ ID NO: 3659088 - RNA, 14 nt, Human
gaauauauggcauu

SEQ ID NO: 3659089 - RNA, 19 nt, Human
gaauauauggcauuugcag

SEQ ID NO: 3659090 - RNA, 15 nt, Human
gaauauaugugugcc

SEQ ID NO: 3659091 - RNA, 16 nt, Human
gaauauauuuaagcaa

SEQ ID NO: 3659092 - RNA, 17 nt, Human
gaauauauuuauuuaaa

SEQ ID NO: 3659093 - RNA, 21 nt, Human
gaauauauuuauuuaaagcau

SEQ ID NO: 3659094 - RNA, 19 nt, Human
gaauauccuuuaaaauuua

SEQ ID NO: 3659095 - RNA, 15 nt, Human
gaauaucuguaaugg

SEQ ID NO: 3659096 - RNA, 14 nt, Human
gaauaugacagcug

SEQ ID NO: 3659097 - RNA, 19 nt, Human
gaauaugacggaagaacau

SEQ ID NO: 3659098 - RNA, 19 nt, Human
gaauaugauuaaaaauauc

SEQ ID NO: 3659099 - RNA, 21 nt, Human
gaauaugauuaaaaauaucaa

SEQ ID NO: 3659100 - RNA, 18 nt, Human
gaauaugccuguaauuca

SEQ ID NO: 3659101 - RNA, 20 nt, Human
gaauaugccuguaauucagu

SEQ ID NO: 3659102 - RNA, 20 nt, Human
cuauauuuuuuguuaaauga

SEQ ID NO: 3659103 - RNA, 22 nt, Human
cuauauuuuuuguuaaaugauu

SEQ ID NO: 3659104 - RNA, 13 nt, Human
cuaucaaacugaa

SEQ ID NO: 3659105 - RNA, 16 nt, Human
cuaucaaacugaagcc

SEQ ID NO: 3659106 - RNA, 21 nt, Human
cuaucaaacugaagccagaaa

SEQ ID NO: 3659107 - RNA, 15 nt, Human
cuaucaacaauaaaa

SEQ ID NO: 3659108 - RNA, 19 nt, Human
cuaucaagaggcugagaca

SEQ ID NO: 3659109 - RNA, 21 nt, Human
cuaucaagaggcugagacagg

SEQ ID NO: 3659110 - RNA, 21 nt, Human
cuaucaagucaaucauuucuc

SEQ ID NO: 3659111 - RNA, 23 nt, Human
cuaucaagugugcuuuagcuuga

SEQ ID NO: 3659112 - RNA, 14 nt, Human
cuaucaauagucaa

SEQ ID NO: 3659113 - RNA, 16 nt, Human
cuaucaauagucaaga

SEQ ID NO: 3659114 - RNA, 20 nt, Human
cuaucaauagucaagaaaaa

SEQ ID NO: 3659115 - RNA, 17 nt, Human
cuaucaccuauuuccau

SEQ ID NO: 3659116 - RNA, 17 nt, Human
cuaucaccuccccuccu

SEQ ID NO: 3659117 - RNA, 18 nt, Human
cuaucagugugcccccca

SEQ ID NO: 3659118 - RNA, 17 nt, Human
cuaucauaguuaacaua

SEQ ID NO: 3659119 - RNA, 14 nt, Human
cuaucauggaguga

SEQ ID NO: 3659120 - RNA, 17 nt, Human
cuaucauuuaauaauau

SEQ ID NO: 3659121 - RNA, 22 nt, Human
cuaucauuuuuguacaguuugc

SEQ ID NO: 3659122 - RNA, 14 nt, Human
cuauccaaacaugu

SEQ ID NO: 3659123 - RNA, 20 nt, Human
cuauccaaucaaucuugcau

SEQ ID NO: 3659124 - RNA, 15 nt, Human
cuauccacagagagu

SEQ ID NO: 3659125 - RNA, 23 nt, Human
cuauccacagagagucccacugc

SEQ ID NO: 3659126 - RNA, 15 nt, Human
cuauccacccagccc

SEQ ID NO: 3659127 - RNA, 16 nt, Human
cuauccacccagccca

SEQ ID NO: 3659128 - RNA, 12 nt, Human
cuaucccauccc

SEQ ID NO: 3659129 - RNA, 17 nt, Human
cuauccccaucucccug

SEQ ID NO: 3659130 - RNA, 18 nt, Human
cuauccccaucucccugc

SEQ ID NO: 3659131 - RNA, 21 nt, Human
cuauccccaucucccugccug

SEQ ID NO: 3659132 - RNA, 17 nt, Human
cuauccgcugccagccu

SEQ ID NO: 3659133 - RNA, 18 nt, Human
cuauccuacaaggccuau

SEQ ID NO: 3659134 - RNA, 15 nt, Human
cuauccucucuuccu

SEQ ID NO: 3659135 - RNA, 16 nt, Human
cuauccucucuuccuc

SEQ ID NO: 3659136 - RNA, 13 nt, Human
cuauccucuguaa

SEQ ID NO: 3659137 - RNA, 11 nt, Human
cuauccugauu

SEQ ID NO: 3659138 - RNA, 14 nt, Human
cuauccuggcuuug

SEQ ID NO: 3659139 - RNA, 21 nt, Human
cuauccuggcuuugcccaacc

SEQ ID NO: 3659140 - RNA, 18 nt, Human
cuauccuuggcaccaaag

SEQ ID NO: 3659141 - RNA, 22 nt, Human
cuaucggagaacaugaaucaaa

SEQ ID NO: 3659142 - RNA, 16 nt, Human
cuaucuaacccuccca

SEQ ID NO: 3659143 - RNA, 17 nt, Human
cuaucuaacccucccau

SEQ ID NO: 3659144 - RNA, 20 nt, Human
cuaucuagguggaguugaaa

SEQ ID NO: 3659145 - RNA, 22 nt, Human
cuaucuagguggaguugaaaga

SEQ ID NO: 3659146 - RNA, 18 nt, Human
cuaucuaguucuaacagu

SEQ ID NO: 3659147 - RNA, 18 nt, Human
cuaucucaauccuaauuu

SEQ ID NO: 3659148 - RNA, 21 nt, Human
cuaucuccagcggcccuguca

SEQ ID NO: 3659149 - RNA, 17 nt, Human
cuaucucccccagcccc

SEQ ID NO: 3659150 - RNA, 15 nt, Human
cuaucucccugccuc

SEQ ID NO: 3659151 - RNA, 12 nt, Human
cuaucuccugac

SEQ ID NO: 3659152 - RNA, 14 nt, Human
cuaucuccugacag

SEQ ID NO: 3659153 - RNA, 21 nt, Human
cuaucugaaccauuaaagucg

SEQ ID NO: 3659154 - RNA, 20 nt, Human
cuaucuggaggccuuccagc

SEQ ID NO: 3659155 - RNA, 13 nt, Human
cuaucugggccug

SEQ ID NO: 3659156 - RNA, 17 nt, Human
cuaucugggccugggcu

SEQ ID NO: 3659157 - RNA, 21 nt, Human
cuaucugggccugggcuaggg

SEQ ID NO: 3659158 - RNA, 18 nt, Human
cuaucugggcuuccugga

SEQ ID NO: 3659159 - RNA, 11 nt, Human
cuaucugucug

SEQ ID NO: 3659160 - RNA, 14 nt, Human
cuaucugucuggug

SEQ ID NO: 3659161 - RNA, 20 nt, Human
cuaucuguuuacaguguucc

SEQ ID NO: 3659162 - RNA, 22 nt, Human
cuaucuuaauuuugguuguauu

SEQ ID NO: 3659163 - RNA, 21 nt, Human
cuaucuuauauaguuuacuau

SEQ ID NO: 3659164 - RNA, 16 nt, Human
cuaucuucauguaaau

SEQ ID NO: 3659165 - RNA, 17 nt, Human
cuaucuucauguaaauu

SEQ ID NO: 3659166 - RNA, 12 nt, Human
cuaucuuugcca

SEQ ID NO: 3659167 - RNA, 15 nt, Human
cuaucuuugccaccc

SEQ ID NO: 3659168 - RNA, 18 nt, Human
cuaucuuugccacccuca

SEQ ID NO: 3659169 - RNA, 18 nt, Human
cuaucuuuuguuuccuuu

SEQ ID NO: 3659170 - RNA, 16 nt, Human
cuaugaaaagcuagaa

SEQ ID NO: 3659171 - RNA, 12 nt, Human
cuaugaacaacu

SEQ ID NO: 3659172 - RNA, 13 nt, Human
cuaugaacuacaa

SEQ ID NO: 3659173 - RNA, 22 nt, Human
cuaugaaguuuuuuuuauacag

SEQ ID NO: 3659174 - RNA, 22 nt, Human
cuaugaaugggcaaaacugaau

SEQ ID NO: 3659175 - RNA, 17 nt, Human
cuaugacagaaaaguaa

SEQ ID NO: 3659176 - RNA, 18 nt, Human
cuaugacauaaaaacaac

SEQ ID NO: 3659177 - RNA, 17 nt, Human
cuaugacugcuccccag

SEQ ID NO: 3659178 - RNA, 16 nt, Human
cuaugacuugggcacc

SEQ ID NO: 3659179 - RNA, 14 nt, Human
cuaugagcauccug

SEQ ID NO: 3659180 - RNA, 19 nt, Human
cuaugagcauccugagccc

SEQ ID NO: 3659181 - RNA, 21 nt, Human
cuaugagcauccugagccccg

SEQ ID NO: 3659182 - RNA, 22 nt, Human
cuaugagcauccugagccccgc

SEQ ID NO: 3659183 - RNA, 16 nt, Human
cuaugagcuaaauguc

SEQ ID NO: 3659184 - RNA, 22 nt, Human
cuaugaggaauaauuauuuauu

SEQ ID NO: 3659185 - RNA, 15 nt, Human
cuaugagucuagaug

SEQ ID NO: 3659186 - RNA, 19 nt, Human
cuaugagucuagauguuua

SEQ ID NO: 3659187 - RNA, 15 nt, Human
cuaugaguggaaaaa

SEQ ID NO: 3659188 - RNA, 21 nt, Human
cuaugaucccagcacuuuggg

SEQ ID NO: 3659189 - RNA, 14 nt, Human
cuaugaucucaggu

SEQ ID NO: 3659190 - RNA, 16 nt, Human
cuaugaugcuguugcc

SEQ ID NO: 3659191 - RNA, 23 nt, Human
cuaugaugugaaacacuuugccu

SEQ ID NO: 3659192 - RNA, 19 nt, Human
cuaugauuuaauuugaaau

SEQ ID NO: 3659193 - RNA, 18 nt, Human
cuaugcacauauggacuc

SEQ ID NO: 3659194 - RNA, 20 nt, Human
cuaugcacauauggacucug

SEQ ID NO: 3659195 - RNA, 22 nt, Human
cuaugcacauauggacucugca

SEQ ID NO: 3659196 - RNA, 21 nt, Human
cuaugcauggugccccaggac

SEQ ID NO: 3659197 - RNA, 23 nt, Human
cuaugcauggugccccaggacca

SEQ ID NO: 3659198 - RNA, 11 nt, Human
cuaugcauuug

SEQ ID NO: 3659199 - RNA, 19 nt, Human
cuaugcauuuuaaaguuaa

SEQ ID NO: 3659200 - RNA, 18 nt, Human
cuaugccaaagaucacuu

SEQ ID NO: 3659201 - RNA, 16 nt, Human
cuaugcuauugacaau

SEQ ID NO: 3659202 - RNA, 17 nt, Human
cuaugcucaggggcccu

SEQ ID NO: 3659203 - RNA, 20 nt, Human
cuaugcucauaacuguguca

SEQ ID NO: 3659204 - RNA, 15 nt, Human
cuaugcugaguuugu

SEQ ID NO: 3659205 - RNA, 19 nt, Human
cuaugcugccuaggcugac

SEQ ID NO: 3659206 - RNA, 16 nt, Human
cuaugcugcuuuuaua

SEQ ID NO: 3659207 - RNA, 19 nt, Human
cuaugcugcuuuuauaucu

SEQ ID NO: 3659208 - RNA, 22 nt, Human
cuaugcuguucacuggacacuu

SEQ ID NO: 3659209 - RNA, 11 nt, Human
cuaugcuuuga

SEQ ID NO: 3659210 - RNA, 17 nt, Human
cuaugcuuugaaacaga

SEQ ID NO: 3659211 - RNA, 16 nt, Human
cuauggaaaaucagcu

SEQ ID NO: 3659212 - RNA, 22 nt, Human
cuauggaauuuauaauucagua

SEQ ID NO: 3659213 - RNA, 15 nt, Human
cuauggacacagggu

SEQ ID NO: 3659214 - RNA, 21 nt, Human
cuauggacagcauugccagua

SEQ ID NO: 3659215 - RNA, 19 nt, Human
cuauggacggugcuccagg

SEQ ID NO: 3659216 - RNA, 22 nt, Human
cuauggacggugcuccaggcag

SEQ ID NO: 3659217 - RNA, 23 nt, Human
cuauggacggugcuccaggcagg

SEQ ID NO: 3659218 - RNA, 11 nt, Human
cuauggagagc

SEQ ID NO: 3659219 - RNA, 18 nt, Human
cuauggagagcccuggga

SEQ ID NO: 3659220 - RNA, 19 nt, Human
cuauggagccuggcacagg

SEQ ID NO: 3659221 - RNA, 14 nt, Human
cuauggauggcuuc

SEQ ID NO: 3659222 - RNA, 15 nt, Human
cuauggauggcuucu

SEQ ID NO: 3659223 - RNA, 18 nt, Human
cuauggaugugggguccc

SEQ ID NO: 3659224 - RNA, 16 nt, Human
cuauggcagaaaaaau

SEQ ID NO: 3659225 - RNA, 14 nt, Human
cuauggccucaugu

SEQ ID NO: 3659226 - RNA, 22 nt, Human
cuaugggacucaaugcacugac

SEQ ID NO: 3659227 - RNA, 18 nt, Human
gaaugccuccugugggga

SEQ ID NO: 3659228 - RNA, 19 nt, Human
gaaugccugagugccuggc

SEQ ID NO: 3659229 - RNA, 21 nt, Human
gaaugcggccgcauucccuga

SEQ ID NO: 3659230 - RNA, 11 nt, Human
gaaugcugcca

SEQ ID NO: 3659231 - RNA, 17 nt, Human
gaaugcugggacucagc

SEQ ID NO: 3659232 - RNA, 18 nt, Human
gaaugcugguuuuccuaa

SEQ ID NO: 3659233 - RNA, 14 nt, Human
gaaugcuguacauc

SEQ ID NO: 3659234 - RNA, 15 nt, Human
gaaugcuguacaucu

SEQ ID NO: 3659235 - RNA, 17 nt, Human
gaaugcuguacaucuau

SEQ ID NO: 3659236 - RNA, 20 nt, Human
gaaugcuguacaucuauuuu

SEQ ID NO: 3659237 - RNA, 15 nt, Human
gaaugcuguauaugu

SEQ ID NO: 3659238 - RNA, 13 nt, Human
gaaugcuguguua

SEQ ID NO: 3659239 - RNA, 14 nt, Human
gaaugcuguguuaa

SEQ ID NO: 3659240 - RNA, 23 nt, Human
gaaugcuuaaagaauucaaauuu

SEQ ID NO: 3659241 - RNA, 18 nt, Human
gaaugcuuauagguggcc

SEQ ID NO: 3659242 - RNA, 13 nt, Human
gaaugcuugaaaa

SEQ ID NO: 3659243 - RNA, 17 nt, Human
gaaugcuugaaaaaugu

SEQ ID NO: 3659244 - RNA, 20 nt, Human
gaaugcuugaaaaaugugca

SEQ ID NO: 3659245 - RNA, 18 nt, Human
gaaugcuuuuugaauguu

SEQ ID NO: 3659246 - RNA, 15 nt, Human
gaauggacauccugu

SEQ ID NO: 3659247 - RNA, 19 nt, Human
gaauggacauccuguauaa

SEQ ID NO: 3659248 - RNA, 19 nt, Human
gaauggacuuuggaagcag

SEQ ID NO: 3659249 - RNA, 21 nt, Human
gaauggacuuuggaagcaggg

SEQ ID NO: 3659250 - RNA, 11 nt, Human
gaauggagcag

SEQ ID NO: 3659251 - RNA, 20 nt, Human
gaauggaggggcagagccag

SEQ ID NO: 3659252 - RNA, 19 nt, Human
gaauggauuggauuauuua

SEQ ID NO: 3659253 - RNA, 13 nt, Human
gaauggcaauggu

SEQ ID NO: 3659254 - RNA, 11 nt, Human
gaauggcagca

SEQ ID NO: 3659255 - RNA, 18 nt, Human
gaauggcauuugcaauaa

SEQ ID NO: 3659256 - RNA, 19 nt, Human
gaauggcuauguuuuuaau

SEQ ID NO: 3659257 - RNA, 21 nt, Human
gaauggcuuuguauagaaccu

SEQ ID NO: 3659258 - RNA, 23 nt, Human
gaaugggagguugaucagaucug

SEQ ID NO: 3659259 - RNA, 15 nt, Human
gaaugggcaguuaca

SEQ ID NO: 3659260 - RNA, 16 nt, Human
gaaugggugcccacag

SEQ ID NO: 3659261 - RNA, 23 nt, Human
gaaugguagucuaaccaaaugca

SEQ ID NO: 3659262 - RNA, 23 nt, Human
gaauggucagcguugcaugucgu

SEQ ID NO: 3659263 - RNA, 14 nt, Human
gaaugguccagggu

SEQ ID NO: 3659264 - RNA, 15 nt, Human
gaaugguccaggguu

SEQ ID NO: 3659265 - RNA, 20 nt, Human
gaaugguccgugcuaaggac

SEQ ID NO: 3659266 - RNA, 19 nt, Human
gaauggugauuuuaaaugu

SEQ ID NO: 3659267 - RNA, 21 nt, Human
gaauggugauuuuaaaugugu

SEQ ID NO: 3659268 - RNA, 19 nt, Human
gaauggugugaacccggga

SEQ ID NO: 3659269 - RNA, 20 nt, Human
gaaugguuccaugccugagg

SEQ ID NO: 3659270 - RNA, 22 nt, Human
gaaugguuuucaaaauaaaaau

SEQ ID NO: 3659271 - RNA, 14 nt, Human
gaauguaaaugucu

SEQ ID NO: 3659272 - RNA, 16 nt, Human
gaauguaaaugucuca

SEQ ID NO: 3659273 - RNA, 19 nt, Human
gaauguaaucaauguuucu

SEQ ID NO: 3659274 - RNA, 20 nt, Human
gaauguaauuuguguaauaa

SEQ ID NO: 3659275 - RNA, 13 nt, Human
gaauguaggcugg

SEQ ID NO: 3659276 - RNA, 16 nt, Human
gaauguaguuugagga

SEQ ID NO: 3659277 - RNA, 17 nt, Human
gaauguaguuugaggaa

SEQ ID NO: 3659278 - RNA, 15 nt, Human
gaauguaucaggaaa

SEQ ID NO: 3659279 - RNA, 18 nt, Human
gaauguaugcuucauaca

SEQ ID NO: 3659280 - RNA, 12 nt, Human
gaauguauugua

SEQ ID NO: 3659281 - RNA, 14 nt, Human
gaauguauuguacc

SEQ ID NO: 3659282 - RNA, 22 nt, Human
gaauguauuguaccuuuuaaca

SEQ ID NO: 3659283 - RNA, 13 nt, Human
gaauguauuuauu

SEQ ID NO: 3659284 - RNA, 23 nt, Human
gaauguauuuauuugggagaccg

SEQ ID NO: 3659285 - RNA, 15 nt, Human
gaaugucagauuccu

SEQ ID NO: 3659286 - RNA, 13 nt, Human
gaaugucaguaug

SEQ ID NO: 3659287 - RNA, 16 nt, Human
gaaugucaguaugugg

SEQ ID NO: 3659288 - RNA, 13 nt, Human
gaaugucagugug

SEQ ID NO: 3659289 - RNA, 20 nt, Human
gaaugucagugugacugauc

SEQ ID NO: 3659290 - RNA, 21 nt, Human
gaaugucagugugacugaucu

SEQ ID NO: 3659291 - RNA, 17 nt, Human
gaaugucccuuuuccua

SEQ ID NO: 3659292 - RNA, 22 nt, Human
gaaugucuuuguuggaaaagaa

SEQ ID NO: 3659293 - RNA, 13 nt, Human
gaaugugaagccu

SEQ ID NO: 3659294 - RNA, 18 nt, Human
gaaugugauaaggaaauc

SEQ ID NO: 3659295 - RNA, 19 nt, Human
gaaugugauaaggaaauca

SEQ ID NO: 3659296 - RNA, 14 nt, Human
gaaugugauuuuaa

SEQ ID NO: 3659297 - RNA, 15 nt, Human
gaaugugcagguuug

SEQ ID NO: 3659298 - RNA, 15 nt, Human
gaaugugggcacugg

SEQ ID NO: 3659299 - RNA, 20 nt, Human
gaaugugggcacuggcccag

SEQ ID NO: 3659300 - RNA, 14 nt, Human
gaauguggucucag

SEQ ID NO: 3659301 - RNA, 15 nt, Human
gaauguggucucagg

SEQ ID NO: 3659302 - RNA, 18 nt, Human
gaauguguacaaagugua

SEQ ID NO: 3659303 - RNA, 14 nt, Human
gaaugugucuuuag

SEQ ID NO: 3659304 - RNA, 14 nt, Human
gaauguguuucaca

SEQ ID NO: 3659305 - RNA, 20 nt, Human
gaauguguuucacaguuuga

SEQ ID NO: 3659306 - RNA, 13 nt, Human
gaauguuaaaggg

SEQ ID NO: 3659307 - RNA, 17 nt, Human
gaauguuacauuguuug

SEQ ID NO: 3659308 - RNA, 20 nt, Human
gaauguuacauuguuugucu

SEQ ID NO: 3659309 - RNA, 18 nt, Human
aacagauuugugaacuca

SEQ ID NO: 3659310 - RNA, 16 nt, Human
aacagauuuugggguu

SEQ ID NO: 3659311 - RNA, 17 nt, Human
aacagcaaaccaagaga

SEQ ID NO: 3659312 - RNA, 19 nt, Human
aacagcaaaccaagagauu

SEQ ID NO: 3659313 - RNA, 14 nt, Human
aacagcacuggcuc

SEQ ID NO: 3659314 - RNA, 18 nt, Human
aacagcacuggcucucuc

SEQ ID NO: 3659315 - RNA, 20 nt, Human
aacagcacuggcucucucca

SEQ ID NO: 3659316 - RNA, 20 nt, Human
aacagcagacucagcucuga

SEQ ID NO: 3659317 - RNA, 16 nt, Human
aacagcagagguucuu

SEQ ID NO: 3659318 - RNA, 21 nt, Human
aacagcagagguucuuuuaaa

SEQ ID NO: 3659319 - RNA, 13 nt, Human
aacagcaguguuc

SEQ ID NO: 3659320 - RNA, 23 nt, Human
aacagcauucuugucacaauaaa

SEQ ID NO: 3659321 - RNA, 17 nt, Human
aacagcauugcuuucug

SEQ ID NO: 3659322 - RNA, 12 nt, Human
aacagccaacag

SEQ ID NO: 3659323 - RNA, 18 nt, Human
aacagccacuacauuacu

SEQ ID NO: 3659324 - RNA, 11 nt, Human
aacagccaugc

SEQ ID NO: 3659325 - RNA, 16 nt, Human
aacagccaugcccgca

SEQ ID NO: 3659326 - RNA, 22 nt, Human
aacagccgucagccaaauguaa

SEQ ID NO: 3659327 - RNA, 17 nt, Human
aacagccuauuccugaa

SEQ ID NO: 3659328 - RNA, 16 nt, Human
aacagccucuuuuuga

SEQ ID NO: 3659329 - RNA, 18 nt, Human
aacagccugacaacauuu

SEQ ID NO: 3659330 - RNA, 13 nt, Human
aacagcgcccaaa

SEQ ID NO: 3659331 - RNA, 13 nt, Human
aacagcgcugggu

SEQ ID NO: 3659332 - RNA, 14 nt, Human
aacagcguuuaaga

SEQ ID NO: 3659333 - RNA, 23 nt, Human
aacagcguuuaagacuguaauga

SEQ ID NO: 3659334 - RNA, 18 nt, Human
aacagcuaugggagcccc

SEQ ID NO: 3659335 - RNA, 18 nt, Human
aacagcucaagucuuccc

SEQ ID NO: 3659336 - RNA, 14 nt, Human
aacagcucaggauc

SEQ ID NO: 3659337 - RNA, 14 nt, Human
aacagcuccuuggg

SEQ ID NO: 3659338 - RNA, 21 nt, Human
aacagcugaggucucuugagg

SEQ ID NO: 3659339 - RNA, 11 nt, Human
aacagcugcaa

SEQ ID NO: 3659340 - RNA, 19 nt, Human
aacagcugcaauucccugg

SEQ ID NO: 3659341 - RNA, 11 nt, Human
aacagcugccu

SEQ ID NO: 3659342 - RNA, 13 nt, Human
aacagcugccucu

SEQ ID NO: 3659343 - RNA, 12 nt, Human
aacagcugccuu

SEQ ID NO: 3659344 - RNA, 20 nt, Human
aacagcugccuuagcuucag

SEQ ID NO: 3659345 - RNA, 11 nt, Human
aacagcuggug

SEQ ID NO: 3659346 - RNA, 20 nt, Human
aacagcuggugcccugcuuu

SEQ ID NO: 3659347 - RNA, 21 nt, Human
aacagcuggugcccugcuuuc

SEQ ID NO: 3659348 - RNA, 17 nt, Human
aacagcugguguagcua

SEQ ID NO: 3659349 - RNA, 13 nt, Human
aacagcuguggcu

SEQ ID NO: 3659350 - RNA, 20 nt, Human
aacagcuucaugccuuugua

SEQ ID NO: 3659351 - RNA, 15 nt, Human
aacagcuucauguuc

SEQ ID NO: 3659352 - RNA, 16 nt, Human
aacagcuuucaagugc

SEQ ID NO: 3659353 - RNA, 20 nt, Human
aacaggaaacuccugugacc

SEQ ID NO: 3659354 - RNA, 10 nt, Human
aacaggaagc

SEQ ID NO: 3659355 - RNA, 20 nt, Human
aacaggaccacaaaaaugaa

SEQ ID NO: 3659356 - RNA, 12 nt, Human
aacaggaccggg

SEQ ID NO: 3659357 - RNA, 17 nt, Human
aacaggaccggguggaa

SEQ ID NO: 3659358 - RNA, 12 nt, Human
aacaggagaauu

SEQ ID NO: 3659359 - RNA, 17 nt, Human
aacaggaggacaauuca

SEQ ID NO: 3659360 - RNA, 18 nt, Human
aacaggaggacaauucau

SEQ ID NO: 3659361 - RNA, 19 nt, Human
aacaggaggacaauucaug

SEQ ID NO: 3659362 - RNA, 14 nt, Human
aacaggauaacccu

SEQ ID NO: 3659363 - RNA, 18 nt, Human
aacaggcacugcccuggu

SEQ ID NO: 3659364 - RNA, 13 nt, Human
aacaggcacuugg

SEQ ID NO: 3659365 - RNA, 11 nt, Human
aacaggcagau

SEQ ID NO: 3659366 - RNA, 11 nt, Human
aacaggcccag

SEQ ID NO: 3659367 - RNA, 23 nt, Human
aacaggcccagcauugcugguuc

SEQ ID NO: 3659368 - RNA, 20 nt, Human
aacaggcucaauauuccuga

SEQ ID NO: 3659369 - RNA, 22 nt, Human
aacaggcuguucugcacugaaa

SEQ ID NO: 3659370 - RNA, 20 nt, Human
aacagggaaggcaggcaggg

SEQ ID NO: 3659371 - RNA, 23 nt, Human
aacagggaaggcaggcagggcuc

SEQ ID NO: 3659372 - RNA, 22 nt, Human
aacagggauugauuuuaaaaug

SEQ ID NO: 3659373 - RNA, 21 nt, Human
cucacuguucccucugcuccu

SEQ ID NO: 3659374 - RNA, 21 nt, Human
cucacuguuuguuuuuauuua

SEQ ID NO: 3659375 - RNA, 20 nt, Human
cucacuuccauacagcucua

SEQ ID NO: 3659376 - RNA, 13 nt, Human
cucacuuuaaacc

SEQ ID NO: 3659377 - RNA, 16 nt, Human
cucacuuuaaaccugu

SEQ ID NO: 3659378 - RNA, 14 nt, Human
cucacuuuucccac

SEQ ID NO: 3659379 - RNA, 16 nt, Human
cucacuuuucccacuc

SEQ ID NO: 3659380 - RNA, 17 nt, Human
cucacuuuucccacucc

SEQ ID NO: 3659381 - RNA, 22 nt, Human
cucagaaaagacgcaccagccc

SEQ ID NO: 3659382 - RNA, 18 nt, Human
cucagaaacacuggggcu

SEQ ID NO: 3659383 - RNA, 13 nt, Human
cucagaaaggcaa

SEQ ID NO: 3659384 - RNA, 15 nt, Human
cucagaacacauucu

SEQ ID NO: 3659385 - RNA, 14 nt, Human
cucagaacccaggg

SEQ ID NO: 3659386 - RNA, 17 nt, Human
cucagaacccagggcuc

SEQ ID NO: 3659387 - RNA, 21 nt, Human
cucagaacccuuggcuugccc

SEQ ID NO: 3659388 - RNA, 21 nt, Human
cucagaacugucggaggaaag

SEQ ID NO: 3659389 - RNA, 14 nt, Human
cucagaacuugcug

SEQ ID NO: 3659390 - RNA, 18 nt, Human
cucagaacuugcugcugu

SEQ ID NO: 3659391 - RNA, 19 nt, Human
cucagaacuugcugcuguc

SEQ ID NO: 3659392 - RNA, 11 nt, Human
cucagaagccu

SEQ ID NO: 3659393 - RNA, 15 nt, Human
cucagaagccucugg

SEQ ID NO: 3659394 - RNA, 17 nt, Human
cucagaagccucugggu

SEQ ID NO: 3659395 - RNA, 13 nt, Human
cucagaagccuga

SEQ ID NO: 3659396 - RNA, 14 nt, Human
cucagaagccuggg

SEQ ID NO: 3659397 - RNA, 17 nt, Human
cucagaagccugggggc

SEQ ID NO: 3659398 - RNA, 20 nt, Human
cucagaagccugggggccug

SEQ ID NO: 3659399 - RNA, 21 nt, Human
cucagaagccugggggccugg

SEQ ID NO: 3659400 - RNA, 19 nt, Human
cucagaaggcaaaugacuu

SEQ ID NO: 3659401 - RNA, 13 nt, Human
cucagaagggagg

SEQ ID NO: 3659402 - RNA, 20 nt, Human
cucagaagggaggcuggggu

SEQ ID NO: 3659403 - RNA, 17 nt, Human
cucagaaggucuguuuu

SEQ ID NO: 3659404 - RNA, 22 nt, Human
cucagaagugaaaaucuuggag

SEQ ID NO: 3659405 - RNA, 16 nt, Human
cucagaaguuucuucu

SEQ ID NO: 3659406 - RNA, 12 nt, Human
cucagaauauug

SEQ ID NO: 3659407 - RNA, 23 nt, Human
cucagaauccaagugaacacuag

SEQ ID NO: 3659408 - RNA, 20 nt, Human
cucagaaucuacccaaagga

SEQ ID NO: 3659409 - RNA, 17 nt, Human
cucagaaucucaaauaa

SEQ ID NO: 3659410 - RNA, 19 nt, Human
cucagaaucuuuccuuccu

SEQ ID NO: 3659411 - RNA, 17 nt, Human
cucagaauuauuuuuaa

SEQ ID NO: 3659412 - RNA, 19 nt, Human
cucagacauguuuuccgug

SEQ ID NO: 3659413 - RNA, 13 nt, Human
cucagacauuggc

SEQ ID NO: 3659414 - RNA, 18 nt, Human
cucagaccacaugcccca

SEQ ID NO: 3659415 - RNA, 13 nt, Human
cucagacccccac

SEQ ID NO: 3659416 - RNA, 15 nt, Human
cucagacccccacuc

SEQ ID NO: 3659417 - RNA, 22 nt, Human
cucagacccccacucucauucc

SEQ ID NO: 3659418 - RNA, 23 nt, Human
cucagacccccacucucauuccc

SEQ ID NO: 3659419 - RNA, 23 nt, Human
cucagaccgucuuccuccaaccc

SEQ ID NO: 3659420 - RNA, 14 nt, Human
cucagacucuaaga

SEQ ID NO: 3659421 - RNA, 19 nt, Human
cucagacugcacccaggag

SEQ ID NO: 3659422 - RNA, 14 nt, Human
cucagacugcucaa

SEQ ID NO: 3659423 - RNA, 14 nt, Human
cucagacuggggca

SEQ ID NO: 3659424 - RNA, 16 nt, Human
cucagacuuaccagga

SEQ ID NO: 3659425 - RNA, 17 nt, Human
cucagacuuuuguacau

SEQ ID NO: 3659426 - RNA, 21 nt, Human
cucagagaaaaaugcucccca

SEQ ID NO: 3659427 - RNA, 17 nt, Human
cucagagaaaagagauu

SEQ ID NO: 3659428 - RNA, 17 nt, Human
cucagagacaugcagag

SEQ ID NO: 3659429 - RNA, 16 nt, Human
cucagagaccagggcu

SEQ ID NO: 3659430 - RNA, 21 nt, Human
cucagagaccagggcuccagc

SEQ ID NO: 3659431 - RNA, 22 nt, Human
cucagagaccagggcuccagcc

SEQ ID NO: 3659432 - RNA, 13 nt, Human
cucagagagggca

SEQ ID NO: 3659433 - RNA, 20 nt, Human
cucagagaugugcacccaug

SEQ ID NO: 3659434 - RNA, 22 nt, Human
cucagagaugugcacccauggg

SEQ ID NO: 3659435 - RNA, 15 nt, Human
cucagagcucucucu

SEQ ID NO: 3659436 - RNA, 13 nt, Human
cucagaggcccca

SEQ ID NO: 3659437 - RNA, 18 nt, Human
cucagaggcgcacuguga

SEQ ID NO: 3659438 - RNA, 16 nt, Human
cucagaggguguccug

SEQ ID NO: 3659439 - RNA, 17 nt, Human
cucagaguauggagcuc

SEQ ID NO: 3659440 - RNA, 15 nt, Human
cucagaguccaggcc

SEQ ID NO: 3659441 - RNA, 23 nt, Human
cucagauaagguaaaaugccaug

SEQ ID NO: 3659442 - RNA, 18 nt, Human
cucagauagaaugacagu

SEQ ID NO: 3659443 - RNA, 14 nt, Human
cucagauauuuaua

SEQ ID NO: 3659444 - RNA, 13 nt, Human
cucagaucacugc

SEQ ID NO: 3659445 - RNA, 17 nt, Human
cucagaucacugcaacc

SEQ ID NO: 3659446 - RNA, 10 nt, Human
cucagaucca

SEQ ID NO: 3659447 - RNA, 22 nt, Human
cucagaucccacuuuugccaga

SEQ ID NO: 3659448 - RNA, 14 nt, Human
cucagauccuccuc

SEQ ID NO: 3659449 - RNA, 16 nt, Human
cucagauccuccucau

SEQ ID NO: 3659450 - RNA, 21 nt, Human
cucagaugcacaugagcuggc

SEQ ID NO: 3659451 - RNA, 18 nt, Human
cucagaugcaguuuggag

SEQ ID NO: 3659452 - RNA, 15 nt, Human
cucagaugcucaaag

SEQ ID NO: 3659453 - RNA, 12 nt, Human
cucagauggcag

SEQ ID NO: 3659454 - RNA, 23 nt, Human
cucagaugucccuugaugcacag

SEQ ID NO: 3659455 - RNA, 13 nt, Human
cucagauguuaaa

SEQ ID NO: 3659456 - RNA, 14 nt, Human
cucagauguuaaaa

SEQ ID NO: 3659457 - RNA, 17 nt, Human
cucagauguuaaaauaa

SEQ ID NO: 3659458 - RNA, 15 nt, Human
cucagauuauuuaaa

SEQ ID NO: 3659459 - RNA, 21 nt, Human
cucagauuccuucccauggag

SEQ ID NO: 3659460 - RNA, 22 nt, Human
cucagauuguaauauguaaaug

SEQ ID NO: 3659461 - RNA, 16 nt, Human
cucagauuucugagga

SEQ ID NO: 3659462 - RNA, 15 nt, Human
cucagauuuuauuau

SEQ ID NO: 3659463 - RNA, 23 nt, Human
cucagauuuuauuauguaaaucc

SEQ ID NO: 3659464 - RNA, 20 nt, Human
cucagcaaaagaugcuucuc

SEQ ID NO: 3659465 - RNA, 21 nt, Human
cucagcaaaagaugcuucuca

SEQ ID NO: 3659466 - RNA, 15 nt, Human
cucagcaaggccacc

SEQ ID NO: 3659467 - RNA, 18 nt, Human
cucagcaaggggcucugc

SEQ ID NO: 3659468 - RNA, 20 nt, Human
cucagcaaggggcucugccc

SEQ ID NO: 3659469 - RNA, 14 nt, Human
cucagcaccacuca

SEQ ID NO: 3659470 - RNA, 18 nt, Human
cucagcaccacucaagac

SEQ ID NO: 3659471 - RNA, 21 nt, Human
cucagcaccacucaagaccaa

SEQ ID NO: 3659472 - RNA, 22 nt, Human
cucagcaccacucaagaccaaa

SEQ ID NO: 3659473 - RNA, 15 nt, Human
gacaggcagaaagag

SEQ ID NO: 3659474 - RNA, 14 nt, Human
gacaggcagcagag

SEQ ID NO: 3659475 - RNA, 19 nt, Human
gacaggcauguucucugag

SEQ ID NO: 3659476 - RNA, 15 nt, Human
gacaggcccaagaga

SEQ ID NO: 3659477 - RNA, 18 nt, Human
gacaggcccaagagauga

SEQ ID NO: 3659478 - RNA, 11 nt, Human
gacaggccuca

SEQ ID NO: 3659479 - RNA, 21 nt, Human
gacaggccucaccucuaccca

SEQ ID NO: 3659480 - RNA, 24 nt, Human
gacaggcgagagaggagccagaca

SEQ ID NO: 3659481 - RNA, 13 nt, Human
gacaggcucuuag

SEQ ID NO: 3659482 - RNA, 18 nt, Human
gacaggcugcggccccuc

SEQ ID NO: 3659483 - RNA, 23 nt, Human
gacaggcugcggccccucccccg

SEQ ID NO: 3659484 - RNA, 14 nt, Human
gacaggcuggcucc

SEQ ID NO: 3659485 - RNA, 21 nt, Human
gacaggcuggcuccagaugca

SEQ ID NO: 3659486 - RNA, 22 nt, Human
gacaggcuggcuccagaugcag

SEQ ID NO: 3659487 - RNA, 15 nt, Human
gacagggaagagcag

SEQ ID NO: 3659488 - RNA, 23 nt, Human
gacagggaugagcauggagcugg

SEQ ID NO: 3659489 - RNA, 15 nt, Human
gacagggcauggcca

SEQ ID NO: 3659490 - RNA, 12 nt, Human
gacagggccagu

SEQ ID NO: 3659491 - RNA, 19 nt, Human
gacagggccaguggggccu

SEQ ID NO: 3659492 - RNA, 14 nt, Human
gacagggcuggccc

SEQ ID NO: 3659493 - RNA, 18 nt, Human
gacagggcuggcccagcc

SEQ ID NO: 3659494 - RNA, 20 nt, Human
gacaggggagggggcaaagg

SEQ ID NO: 3659495 - RNA, 14 nt, Human
gacagggguuccuu

SEQ ID NO: 3659496 - RNA, 20 nt, Human
gacagggguuccuucugggc

SEQ ID NO: 3659497 - RNA, 23 nt, Human
gacaggguuuggcugugucuaaa

SEQ ID NO: 3659498 - RNA, 20 nt, Human
gacaggguuuugccauguug

SEQ ID NO: 3659499 - RNA, 14 nt, Human
gacagguaaauuaa

SEQ ID NO: 3659500 - RNA, 17 nt, Human
gacaggucccucaccca

SEQ ID NO: 3659501 - RNA, 19 nt, Human
gacagguuuucacauaaau

SEQ ID NO: 3659502 - RNA, 15 nt, Human
gacaguaauuguguu

SEQ ID NO: 3659503 - RNA, 19 nt, Human
gacaguaauuguguuuaca

SEQ ID NO: 3659504 - RNA, 16 nt, Human
gacaguaucccacauc

SEQ ID NO: 3659505 - RNA, 19 nt, Human
gacagucaaggaguggcuu

SEQ ID NO: 3659506 - RNA, 22 nt, Human
gacagucaaggaguggcuuacu

SEQ ID NO: 3659507 - RNA, 16 nt, Human
gacagucaccccagga

SEQ ID NO: 3659508 - RNA, 22 nt, Human
gacagucacugccacuuugcac

SEQ ID NO: 3659509 - RNA, 19 nt, Human
gacagucaucaucagggcc

SEQ ID NO: 3659510 - RNA, 20 nt, Human
gacagucaucaucagggccu

SEQ ID NO: 3659511 - RNA, 13 nt, Human
gacagucccugcc

SEQ ID NO: 3659512 - RNA, 16 nt, Human
gacagucccugccaau

SEQ ID NO: 3659513 - RNA, 15 nt, Human
gacaguccucuccac

SEQ ID NO: 3659514 - RNA, 24 nt, Human
gacaguccucuccaccuaguggcu

SEQ ID NO: 3659515 - RNA, 18 nt, Human
gacaguccugggagaacc

SEQ ID NO: 3659516 - RNA, 14 nt, Human
gacagucucaccau

SEQ ID NO: 3659517 - RNA, 19 nt, Human
gacccugaggcccagaggg

SEQ ID NO: 3659518 - RNA, 20 nt, Human
gacccugcaaacagaacagg

SEQ ID NO: 3659519 - RNA, 14 nt, Human
gacccugcacccuc

SEQ ID NO: 3659520 - RNA, 13 nt, Human
gacccugccaggc

SEQ ID NO: 3659521 - RNA, 15 nt, Human
gacccugccaggcac

SEQ ID NO: 3659522 - RNA, 23 nt, Human
gacccugccaggcacaggcaggg

SEQ ID NO: 3659523 - RNA, 16 nt, Human
gacccugcccuguggg

SEQ ID NO: 3659524 - RNA, 23 nt, Human
gacccugcccuuguuuggggcag

SEQ ID NO: 3659525 - RNA, 21 nt, Human
gacccugccucucccaggcag

SEQ ID NO: 3659526 - RNA, 23 nt, Human
gacccugccucucccaggcaggg

SEQ ID NO: 3659527 - RNA, 15 nt, Human
gacccuggcuuucau

SEQ ID NO: 3659528 - RNA, 14 nt, Human
gacccuggggcugg

SEQ ID NO: 3659529 - RNA, 11 nt, Human
gacccuggggg

SEQ ID NO: 3659530 - RNA, 17 nt, Human
gacccugggugggcucu

SEQ ID NO: 3659531 - RNA, 18 nt, Human
gacccuggugccuggcuc

SEQ ID NO: 3659532 - RNA, 22 nt, Human
gacccugguuauugauguggcc

SEQ ID NO: 3659533 - RNA, 23 nt, Human
gacggagucccaccuuggcugca

SEQ ID NO: 3659534 - RNA, 19 nt, Human
gacggcacccacccagcac

SEQ ID NO: 3659535 - RNA, 11 nt, Human
gacggcaggcu

SEQ ID NO: 3659536 - RNA, 16 nt, Human
gacggccaagaaugua

SEQ ID NO: 3659537 - RNA, 23 nt, Human
gacggccugaugcucccuccccu

SEQ ID NO: 3659538 - RNA, 21 nt, Human
gacggcgagaaaugccucugg

SEQ ID NO: 3659539 - RNA, 12 nt, Human
gacggcuccacu

SEQ ID NO: 3659540 - RNA, 12 nt, Human
gacggcugggca

SEQ ID NO: 3659541 - RNA, 13 nt, Human
gacggcugggcac

SEQ ID NO: 3659542 - RNA, 16 nt, Human
gacggggacuggggau

SEQ ID NO: 3659543 - RNA, 17 nt, Human
gacggggggccccaguc

SEQ ID NO: 3659544 - RNA, 16 nt, Human
gacggguuucaccaug

SEQ ID NO: 3659545 - RNA, 19 nt, Human
gacgguauuaugcuucuug

SEQ ID NO: 3659546 - RNA, 21 nt, Human
gacggucaguuuggugucaac

SEQ ID NO: 3659547 - RNA, 14 nt, Human
gacggugacaaaga

SEQ ID NO: 3659548 - RNA, 21 nt, Human
gacggugacaaagauggcuca

SEQ ID NO: 3659549 - RNA, 17 nt, Human
gacggugcuccaggcag

SEQ ID NO: 3659550 - RNA, 18 nt, Human
gacgguucaccagccucu

SEQ ID NO: 3659551 - RNA, 18 nt, Human
gacgguuccuacacagga

SEQ ID NO: 3659552 - RNA, 22 nt, Human
gacgguuccuacacaggacagg

SEQ ID NO: 3659553 - RNA, 22 nt, Human
gacgguuuccagggaggggccg

SEQ ID NO: 3659554 - RNA, 16 nt, Human
gacguacaaguaguuc

SEQ ID NO: 3659555 - RNA, 21 nt, Human
gacguacguaucagcggcccc

SEQ ID NO: 3659556 - RNA, 15 nt, Human
gacguaggggagggg

SEQ ID NO: 3659557 - RNA, 14 nt, Human
gacgucaagucucc

SEQ ID NO: 3659558 - RNA, 18 nt, Human
gacgucccuuuuuucucu

SEQ ID NO: 3659559 - RNA, 23 nt, Human
gacgugcacugagagugaaguga

SEQ ID NO: 3659560 - RNA, 22 nt, Human
gacgugccuuuugcaccccucc

SEQ ID NO: 3659561 - RNA, 23 nt, Human
gacgugccuuuugcaccccuccc

SEQ ID NO: 3659562 - RNA, 14 nt, Human
gacguggcaccucc

SEQ ID NO: 3659563 - RNA, 20 nt, Human
gacguucauuugugugcuca

SEQ ID NO: 3659564 - RNA, 22 nt, Human
gacguuccagccggcauggcug

SEQ ID NO: 3659565 - RNA, 18 nt, Human
gacguuuacaagcccccc

SEQ ID NO: 3659566 - RNA, 23 nt, Human
gacguuuauaaacagaaauggaa

SEQ ID NO: 3659567 - RNA, 16 nt, Human
gacguuuuauaagcau

SEQ ID NO: 3659568 - RNA, 18 nt, Human
gacuaaaaauauuauaac

SEQ ID NO: 3659569 - RNA, 18 nt, Human
gacuaaaagauauaagug

SEQ ID NO: 3659570 - RNA, 18 nt, Human
gacuaaacuuuuuuucug

SEQ ID NO: 3659571 - RNA, 23 nt, Human
gacuaacacucagaagccugggg

SEQ ID NO: 3659572 - RNA, 22 nt, Human
gacuaaccccaacgcacaggaa

SEQ ID NO: 3659573 - RNA, 18 nt, Human
gacuaaccccaccacacc

SEQ ID NO: 3659574 - RNA, 23 nt, Human
gacuaagagaaguuguaaaguau

SEQ ID NO: 3659575 - RNA, 12 nt, Human
gacuaagccagc

SEQ ID NO: 3659576 - RNA, 18 nt, Human
gacuaagccuaccugcuc

SEQ ID NO: 3659577 - RNA, 22 nt, Human
gacuaauagaaaaguauguucu

SEQ ID NO: 3659578 - RNA, 15 nt, Human
gacuaauuaggcaag

SEQ ID NO: 3659579 - RNA, 22 nt, Human
gacuaauuaggguacauuuaua

SEQ ID NO: 3659580 - RNA, 12 nt, Human
gacuaauucuug

SEQ ID NO: 3659581 - RNA, 18 nt, Human
gacuaauucuugcauauu

SEQ ID NO: 3659582 - RNA, 20 nt, Human
gacuaauuguauaacagguu

SEQ ID NO: 3659583 - RNA, 21 nt, Human
gacuaauuguauaacagguua

SEQ ID NO: 3659584 - RNA, 13 nt, Human
gacuacaggcacc

SEQ ID NO: 3659585 - RNA, 13 nt, Human
gacuacagggccg

SEQ ID NO: 3659586 - RNA, 18 nt, Human
gacuacaggugugaguca

SEQ ID NO: 3659587 - RNA, 15 nt, Human
gacuagaaccuggag

SEQ ID NO: 3659588 - RNA, 22 nt, Human
gacuagagaaaccguccucuuu

SEQ ID NO: 3659589 - RNA, 15 nt, Human
gacuagagcuuucuu

SEQ ID NO: 3659590 - RNA, 17 nt, Human
gacuagaggcagggagg

SEQ ID NO: 3659591 - RNA, 19 nt, Human
gacuagagggaccucuccc

SEQ ID NO: 3659592 - RNA, 16 nt, Human
gacuagaugauggaug

SEQ ID NO: 3659593 - RNA, 17 nt, Human
gacuagauggaccugcc

SEQ ID NO: 3659594 - RNA, 17 nt, Human
gacuagcaaucucuuca

SEQ ID NO: 3659595 - RNA, 23 nt, Human
gacuaggccuugcggcuccucag

SEQ ID NO: 3659596 - RNA, 23 nt, Human
gacuagggaaaugaucaguuuuu

SEQ ID NO: 3659597 - RNA, 17 nt, Human
gacuagggauucaggcu

SEQ ID NO: 3659598 - RNA, 13 nt, Human
gacuagugcugaa

SEQ ID NO: 3659599 - RNA, 15 nt, Human
gacuagugcugaagc

SEQ ID NO: 3659600 - RNA, 16 nt, Human
gacuagugcugaagcu

SEQ ID NO: 3659601 - RNA, 17 nt, Human
gacuagugcugaagcuu

SEQ ID NO: 3659602 - RNA, 18 nt, Human
gacuagugcugaagcuua

SEQ ID NO: 3659603 - RNA, 23 nt, Human
gacuagugcugaagcuuauuaau

SEQ ID NO: 3659604 - RNA, 12 nt, Human
gacuauaaaugu

SEQ ID NO: 3659605 - RNA, 17 nt, Human
gacuauagcuguucuaa

SEQ ID NO: 3659606 - RNA, 12 nt, Human
gacuauauacau

SEQ ID NO: 3659607 - RNA, 23 nt, Human
gacuauauacauguguguauaua

SEQ ID NO: 3659608 - RNA, 16 nt, Human
gacuauauagagaugu

SEQ ID NO: 3659609 - RNA, 23 nt, Human
gacuauauagagauguuuuuaaa

SEQ ID NO: 3659610 - RNA, 19 nt, Human
gacuauauauauaaaugua

SEQ ID NO: 3659611 - RNA, 21 nt, Human
gacuaucccaacagucauguu

SEQ ID NO: 3659612 - RNA, 19 nt, Human
gacuaucuuacuauuucac

SEQ ID NO: 3659613 - RNA, 15 nt, Human
gacuaugaaaagcua

SEQ ID NO: 3659614 - RNA, 19 nt, Human
gacuaugaaaaugcuggcu

SEQ ID NO: 3659615 - RNA, 19 nt, Human
gacuaugaacuucucucag

SEQ ID NO: 3659616 - RNA, 20 nt, Human
gacuaugaacuucucucaga

SEQ ID NO: 3659617 - RNA, 13 nt, Human
gacuaugaauauu

SEQ ID NO: 3659618 - RNA, 21 nt, Human
gacuaugaaugggcaaaacug

SEQ ID NO: 3659619 - RNA, 19 nt, Human
gacuaugcguuuuuauaaa

SEQ ID NO: 3659620 - RNA, 12 nt, Human
gacuauggagcc

SEQ ID NO: 3659621 - RNA, 20 nt, Human
gacuauggagccuggcacag

SEQ ID NO: 3659622 - RNA, 15 nt, Human
gacuauggagcugag

SEQ ID NO: 3659623 - RNA, 22 nt, Human
gacuauuaggugcaauuucaag

SEQ ID NO: 3659624 - RNA, 16 nt, Human
gacuauuauguuguua

SEQ ID NO: 3659625 - RNA, 16 nt, Human
gacuauucaaacaguc

SEQ ID NO: 3659626 - RNA, 22 nt, Human
gacuauucaaacagucucagga

SEQ ID NO: 3659627 - RNA, 16 nt, Human
gacuauugacaucagc

SEQ ID NO: 3659628 - RNA, 13 nt, Human
gacuauuuaugaa

SEQ ID NO: 3659629 - RNA, 18 nt, Human
gacuauuuuuguuuuuau

SEQ ID NO: 3659630 - RNA, 21 nt, Human
gacuauuuuuguuuuuauuaa

SEQ ID NO: 3659631 - RNA, 14 nt, Human
gacucaaaccaaau

SEQ ID NO: 3659632 - RNA, 22 nt, Human
gacucaaaugcucagaccagcu

SEQ ID NO: 3659633 - RNA, 18 nt, Human
gacucaaauguucuaagu

SEQ ID NO: 3659634 - RNA, 19 nt, Human
gacucaaauguucuaaguu

SEQ ID NO: 3659635 - RNA, 19 nt, Human
gacucaagauucccaggag

SEQ ID NO: 3659636 - RNA, 20 nt, Human
gacucaagauucccaggagu

SEQ ID NO: 3659637 - RNA, 16 nt, Human
gacucaagugucucag

SEQ ID NO: 3659638 - RNA, 14 nt, Human
gacucaaugcacug

SEQ ID NO: 3659639 - RNA, 17 nt, Human
gacucaauuucucccca

SEQ ID NO: 3659640 - RNA, 22 nt, Human
gacucacaagaagaccagacug

SEQ ID NO: 3659641 - RNA, 14 nt, Human
gacucacaccugaa

SEQ ID NO: 3659642 - RNA, 14 nt, Human
gacucacaggaagg

SEQ ID NO: 3659643 - RNA, 12 nt, Human
gacucacccaag

SEQ ID NO: 3659644 - RNA, 15 nt, Human
gacucaccuccccca

SEQ ID NO: 3659645 - RNA, 22 nt, Human
gacucaccucccccaucucuuc

SEQ ID NO: 3659646 - RNA, 12 nt, Human
gacucaccucug

SEQ ID NO: 3659647 - RNA, 17 nt, Human
gacucaccuguuacuug

SEQ ID NO: 3659648 - RNA, 23 nt, Human
gacucacuuaucccaagagaaug

SEQ ID NO: 3659649 - RNA, 18 nt, Human
gacucagacauuggcacc

SEQ ID NO: 3659650 - RNA, 18 nt, Human
gacucagagcucucucua

SEQ ID NO: 3659651 - RNA, 11 nt, Human
gacucagcccu

SEQ ID NO: 3659652 - RNA, 12 nt, Human
gacucagccuuc

SEQ ID NO: 3659653 - RNA, 17 nt, Human
gacucagcuccccagag

SEQ ID NO: 3659654 - RNA, 22 nt, Human
gacucagcucugacauucugau

SEQ ID NO: 3659655 - RNA, 17 nt, Human
gacucaggauccagucc

SEQ ID NO: 3659656 - RNA, 15 nt, Human
gacucaggaugccca

SEQ ID NO: 3659657 - RNA, 16 nt, Human
gacucaggaugcccag

SEQ ID NO: 3659658 - RNA, 23 nt, Human
gacucaggcccccaccuggcuca

SEQ ID NO: 3659659 - RNA, 12 nt, Human
gacucagggcag

SEQ ID NO: 3659660 - RNA, 15 nt, Human
gacucagggccccag

SEQ ID NO: 3659661 - RNA, 21 nt, Human
gacugcagguuggaccccaga

SEQ ID NO: 3659662 - RNA, 23 nt, Human
gacugcagguuggaccccagaga

SEQ ID NO: 3659663 - RNA, 14 nt, Human
gacugcauuauauu

SEQ ID NO: 3659664 - RNA, 20 nt, Human
gacugcauuuuacuguacag

SEQ ID NO: 3659665 - RNA, 18 nt, Human
gacugccacaaggaagaa

SEQ ID NO: 3659666 - RNA, 19 nt, Human
gacugccacaaggaagaaa

SEQ ID NO: 3659667 - RNA, 14 nt, Human
gacugccagcucuu

SEQ ID NO: 3659668 - RNA, 18 nt, Human
gacugccagcucuuccua

SEQ ID NO: 3659669 - RNA, 13 nt, Human
gacugcccggcag

SEQ ID NO: 3659670 - RNA, 16 nt, Human
gacugccgaccgaggc

SEQ ID NO: 3659671 - RNA, 19 nt, Human
gacugccgaccgaggcugg

SEQ ID NO: 3659672 - RNA, 12 nt, Human
gacugccucugc

SEQ ID NO: 3659673 - RNA, 15 nt, Human
gacugccucugccac

SEQ ID NO: 3659674 - RNA, 21 nt, Human
gacugcgggaugguccugggg

SEQ ID NO: 3659675 - RNA, 12 nt, Human
gacugcuaaaua

SEQ ID NO: 3659676 - RNA, 21 nt, Human
gacugcuaccuuucaaagcuu

SEQ ID NO: 3659677 - RNA, 15 nt, Human
gacugcucagaacuu

SEQ ID NO: 3659678 - RNA, 20 nt, Human
gacugcucagaacuugcugc

SEQ ID NO: 3659679 - RNA, 23 nt, Human
gacugcucagaacuugcugcugu

SEQ ID NO: 3659680 - RNA, 15 nt, Human
gacugcuccccagcc

SEQ ID NO: 3659681 - RNA, 24 nt, Human
gacugcuccccagcccuggcucug

SEQ ID NO: 3659682 - RNA, 19 nt, Human
gacugcuccugagccccca

SEQ ID NO: 3659683 - RNA, 22 nt, Human
gacugcuccugagcccccagcu

SEQ ID NO: 3659684 - RNA, 16 nt, Human
gacugcugcugccugg

SEQ ID NO: 3659685 - RNA, 17 nt, Human
gacugcugcugccuggc

SEQ ID NO: 3659686 - RNA, 16 nt, Human
gacugcugguuuguag

SEQ ID NO: 3659687 - RNA, 15 nt, Human
gacugcuguggccag

SEQ ID NO: 3659688 - RNA, 17 nt, Human
gacugcuguggccagga

SEQ ID NO: 3659689 - RNA, 20 nt, Human
gacugcuguggccaggaggu

SEQ ID NO: 3659690 - RNA, 17 nt, Human
gacugcuucccauccua

SEQ ID NO: 3659691 - RNA, 20 nt, Human
gacugcuugcccuaagcaga

SEQ ID NO: 3659692 - RNA, 21 nt, Human
gacugcuugcccuaagcagaa

SEQ ID NO: 3659693 - RNA, 16 nt, Human
gacuggaagcacagcu

SEQ ID NO: 3659694 - RNA, 20 nt, Human
gacuggaagcuaauuugcau

SEQ ID NO: 3659695 - RNA, 19 nt, Human
gacuggaaguucauaccua

SEQ ID NO: 3659696 - RNA, 21 nt, Human
gacuggaaguucauaccuaag

SEQ ID NO: 3659697 - RNA, 23 nt, Human
gaccuuuauuggguaucaagaca

SEQ ID NO: 3659698 - RNA, 11 nt, Human
gaccuuucaau

SEQ ID NO: 3659699 - RNA, 20 nt, Human
gaccuuucaauaggaaaaac

SEQ ID NO: 3659700 - RNA, 18 nt, Human
gaccuuuccugaggaaga

SEQ ID NO: 3659701 - RNA, 18 nt, Human
gaccuuuguacagcccag

SEQ ID NO: 3659702 - RNA, 19 nt, Human
gaccuuuguacagcccaga

SEQ ID NO: 3659703 - RNA, 21 nt, Human
gaccuuugucaucuuucuucu

SEQ ID NO: 3659704 - RNA, 14 nt, Human
gaccuuuugcugcc

SEQ ID NO: 3659705 - RNA, 18 nt, Human
gaccuuuugggggagggc

SEQ ID NO: 3659706 - RNA, 22 nt, Human
gacgagacccaagggcagagca

SEQ ID NO: 3659707 - RNA, 17 nt, Human
gacgaggcccucgggcc

SEQ ID NO: 3659708 - RNA, 18 nt, Human
gacgaggggugucuuggg

SEQ ID NO: 3659709 - RNA, 23 nt, Human
gacgauacuccaaccauauggau

SEQ ID NO: 3659710 - RNA, 19 nt, Human
gacgcaagggccugauggg

SEQ ID NO: 3659711 - RNA, 13 nt, Human
gacgcacacagcu

SEQ ID NO: 3659712 - RNA, 14 nt, Human
gacgcacacagcuu

SEQ ID NO: 3659713 - RNA, 12 nt, Human
gacgcacugagc

SEQ ID NO: 3659714 - RNA, 23 nt, Human
gacgccacagcccagccacggac

SEQ ID NO: 3659715 - RNA, 14 nt, Human
gacgccacucauuu

SEQ ID NO: 3659716 - RNA, 16 nt, Human
gacgccacucauuuca

SEQ ID NO: 3659717 - RNA, 18 nt, Human
gacgccacucauuucauc

SEQ ID NO: 3659718 - RNA, 12 nt, Human
gacgccauccca

SEQ ID NO: 3659719 - RNA, 21 nt, Human
gacgccaucccagccccaaug

SEQ ID NO: 3659720 - RNA, 11 nt, Human
gacgcccaccc

SEQ ID NO: 3659721 - RNA, 22 nt, Human
gacgccggggacagaggccugc

SEQ ID NO: 3659722 - RNA, 13 nt, Human
gacgccugagcuc

SEQ ID NO: 3659723 - RNA, 17 nt, Human
gacgccugagcucacuc

SEQ ID NO: 3659724 - RNA, 13 nt, Human
gacgccugaggaa

SEQ ID NO: 3659725 - RNA, 22 nt, Human
gacgccugcccuccccagagca

SEQ ID NO: 3659726 - RNA, 19 nt, Human
gacgccugggggugccagg

SEQ ID NO: 3659727 - RNA, 15 nt, Human
gacgcgucuccuguu

SEQ ID NO: 3659728 - RNA, 16 nt, Human
gacgcuacccgggaag

SEQ ID NO: 3659729 - RNA, 19 nt, Human
gacgcuacccgggaagggg

SEQ ID NO: 3659730 - RNA, 13 nt, Human
gacgcucugcugu

SEQ ID NO: 3659731 - RNA, 13 nt, Human
gacgcugcagagc

SEQ ID NO: 3659732 - RNA, 18 nt, Human
gacgcugguagagaugga

SEQ ID NO: 3659733 - RNA, 12 nt, Human
gacgcugugcug

SEQ ID NO: 3659734 - RNA, 21 nt, Human
gacggaagccuuuuuccccaa

SEQ ID NO: 3659735 - RNA, 18 nt, Human
gacggaaggguaaacaau

SEQ ID NO: 3659736 - RNA, 22 nt, Human
gacggcacugagagagcgcagc

SEQ ID NO: 3659737 - RNA, 19 nt, Human
gacggcaggcucacugcca

SEQ ID NO: 3659738 - RNA, 17 nt, Human
gacggcgcccccagugu

SEQ ID NO: 3659739 - RNA, 18 nt, Human
gacggcuccacuaggacu

SEQ ID NO: 3659740 - RNA, 22 nt, Human
gacggggggccccagucagccu

SEQ ID NO: 3659741 - RNA, 19 nt, Human
gacggguuggggccgggca

SEQ ID NO: 3659742 - RNA, 22 nt, Human
gacggucaguuuggugucaaca

SEQ ID NO: 3659743 - RNA, 23 nt, Human
gacgguguuuugccauguuggcc

SEQ ID NO: 3659744 - RNA, 19 nt, Human
gacgguucaccagccucuc

SEQ ID NO: 3659745 - RNA, 11 nt, Human
gacgguuccua

SEQ ID NO: 3659746 - RNA, 18 nt, Human
gacgguuuccagggaggg

SEQ ID NO: 3659747 - RNA, 18 nt, Human
gacguacaaguaguucug

SEQ ID NO: 3659748 - RNA, 20 nt, Human
gacguacuccaacagaagaa

SEQ ID NO: 3659749 - RNA, 12 nt, Human
gacguagcugca

SEQ ID NO: 3659750 - RNA, 23 nt, Human
gacguaugcuuauuuuaaaauuu

SEQ ID NO: 3659751 - RNA, 13 nt, Human
gacguccugccac

SEQ ID NO: 3659752 - RNA, 14 nt, Human
gacguccugccacc

SEQ ID NO: 3659753 - RNA, 17 nt, Human
gacgucuggguggcccu

SEQ ID NO: 3659754 - RNA, 22 nt, Human
gacgucuuucuuuuuuuccccc

SEQ ID NO: 3659755 - RNA, 22 nt, Human
gacgugaccggacuuuucugca

SEQ ID NO: 3659756 - RNA, 22 nt, Human
gacgugauucaauucaacacuc

SEQ ID NO: 3659757 - RNA, 20 nt, Human
gacguggaaccucugucuca

SEQ ID NO: 3659758 - RNA, 12 nt, Human
gacguggcucag

SEQ ID NO: 3659759 - RNA, 11 nt, Human
gacguguuaug

SEQ ID NO: 3659760 - RNA, 15 nt, Human
gacguguuaugacuc

SEQ ID NO: 3659761 - RNA, 17 nt, Human
gacguguuaugacucca

SEQ ID NO: 3659762 - RNA, 22 nt, Human
gacguguuaugacuccagaauu

SEQ ID NO: 3659763 - RNA, 14 nt, Human
gacguguuuguguu

SEQ ID NO: 3659764 - RNA, 13 nt, Human
gacguuuccauca

SEQ ID NO: 3659765 - RNA, 12 nt, Human
gacguuucucau

SEQ ID NO: 3659766 - RNA, 23 nt, Human
gacguuucucauuuguuuuucuc

SEQ ID NO: 3659767 - RNA, 17 nt, Human
gacuaaaagauauaagu

SEQ ID NO: 3659768 - RNA, 21 nt, Human
gacuaaaagauauaagugcug

SEQ ID NO: 3659769 - RNA, 22 nt, Human
gacuaaaagauauaagugcugu

SEQ ID NO: 3659770 - RNA, 20 nt, Human
gacuaaacuuuuuuucugua

SEQ ID NO: 3659771 - RNA, 22 nt, Human
gacuaaacuuuuuuucuguacc

SEQ ID NO: 3659772 - RNA, 14 nt, Human
gacuaaagagagaa

SEQ ID NO: 3659773 - RNA, 17 nt, Human
gacuaaagagagaaugu

SEQ ID NO: 3659774 - RNA, 20 nt, Human
gacuaaauuuggggacagau

SEQ ID NO: 3659775 - RNA, 21 nt, Human
gacuaacacucagaagccugg

SEQ ID NO: 3659776 - RNA, 23 nt, Human
gacuaaccccaacgcacaggaaa

SEQ ID NO: 3659777 - RNA, 21 nt, Human
gacuaacuagacaccaaaguu

SEQ ID NO: 3659778 - RNA, 16 nt, Human
gacuaacuugucuuug

SEQ ID NO: 3659779 - RNA, 17 nt, Human
gacuaauauauuaauau

SEQ ID NO: 3659780 - RNA, 14 nt, Human
gacuaauggcauga

SEQ ID NO: 3659781 - RNA, 21 nt, Human
gacuaauuaggguacauuuau

SEQ ID NO: 3659782 - RNA, 15 nt, Human
gacuaauuguauaac

SEQ ID NO: 3659783 - RNA, 19 nt, Human
gacuaauuguauaacaggu

SEQ ID NO: 3659784 - RNA, 22 nt, Human
gacuaauuucaaaaugcuuuuu

SEQ ID NO: 3659785 - RNA, 15 nt, Human
gacuaauuuuacaug

SEQ ID NO: 3659786 - RNA, 15 nt, Human
gacuacaccuacgga

SEQ ID NO: 3659787 - RNA, 19 nt, Human
gacuacagcuggggugcag

SEQ ID NO: 3659788 - RNA, 18 nt, Human
gacuacagucaggaaagg

SEQ ID NO: 3659789 - RNA, 17 nt, Human
gacuacucccccaggug

SEQ ID NO: 3659790 - RNA, 14 nt, Human
gacuacuguucagc

SEQ ID NO: 3659791 - RNA, 13 nt, Human
gacuacuuagcau

SEQ ID NO: 3659792 - RNA, 18 nt, Human
gacuagaaagugaauaaa

SEQ ID NO: 3659793 - RNA, 23 nt, Human
gacuagaagggccaguccugccu

SEQ ID NO: 3659794 - RNA, 19 nt, Human
gacuagaauucuagugcug

SEQ ID NO: 3659795 - RNA, 16 nt, Human
gacuagacacacaaag

SEQ ID NO: 3659796 - RNA, 19 nt, Human
gacuagaccuccagcuguu

SEQ ID NO: 3659797 - RNA, 21 nt, Human
gacuagaugauggaugccaau

SEQ ID NO: 3659798 - RNA, 18 nt, Human
gacuaggguccuggggaa

SEQ ID NO: 3659799 - RNA, 12 nt, Human
gacuagugcuga

SEQ ID NO: 3659800 - RNA, 14 nt, Human
gacuagugcugaag

SEQ ID NO: 3659801 - RNA, 19 nt, Human
gacuagugcugaagcuuau

SEQ ID NO: 3659802 - RNA, 21 nt, Human
gacuauauacauguguguaua

SEQ ID NO: 3659803 - RNA, 20 nt, Human
gacuauauagagauguuuuu

SEQ ID NO: 3659804 - RNA, 18 nt, Human
gacuauauauauaaaugu

SEQ ID NO: 3659805 - RNA, 14 nt, Human
cucccuuguucucu

SEQ ID NO: 3659806 - RNA, 17 nt, Human
cucccuuguucucuaag

SEQ ID NO: 3659807 - RNA, 15 nt, Human
cucccuuucuccccu

SEQ ID NO: 3659808 - RNA, 19 nt, Human
cucccuuuuaauccuggcu

SEQ ID NO: 3659809 - RNA, 21 nt, Human
cucccuuuuuauaucccauuu

SEQ ID NO: 3659810 - RNA, 20 nt, Human
cucccuuuuuccuugucccc

SEQ ID NO: 3659811 - RNA, 22 nt, Human
cucccuuuuuccuuguccccac

SEQ ID NO: 3659812 - RNA, 18 nt, Human
cuccgaaaugcugucuuu

SEQ ID NO: 3659813 - RNA, 15 nt, Human
cuccgagaggugggc

SEQ ID NO: 3659814 - RNA, 18 nt, Human
cuccgagaggugggccag

SEQ ID NO: 3659815 - RNA, 17 nt, Human
cuccgaggacccaggaa

SEQ ID NO: 3659816 - RNA, 16 nt, Human
cuccgauccuuccucc

SEQ ID NO: 3659817 - RNA, 13 nt, Human
cuccgccagccuc

SEQ ID NO: 3659818 - RNA, 21 nt, Human
cuccgccagccuccucuggac

SEQ ID NO: 3659819 - RNA, 13 nt, Human
cuccgccaggcga

SEQ ID NO: 3659820 - RNA, 13 nt, Human
cuccgccauccac

SEQ ID NO: 3659821 - RNA, 15 nt, Human
cuccgcccccagccu

SEQ ID NO: 3659822 - RNA, 14 nt, Human
cuccgcccugccac

SEQ ID NO: 3659823 - RNA, 15 nt, Human
cuccgcccugccacu

SEQ ID NO: 3659824 - RNA, 14 nt, Human
cuccgccuucacau

SEQ ID NO: 3659825 - RNA, 21 nt, Human
cuccgccuucacuccggugug

SEQ ID NO: 3659826 - RNA, 16 nt, Human
cuccgcggcgggcccu

SEQ ID NO: 3659827 - RNA, 15 nt, Human
cuccgcucuguagug

SEQ ID NO: 3659828 - RNA, 21 nt, Human
cuccgcugccgugccgccugc

SEQ ID NO: 3659829 - RNA, 13 nt, Human
cuccgcugcuccu

SEQ ID NO: 3659830 - RNA, 18 nt, Human
cuccgcugcuccuuggcu

SEQ ID NO: 3659831 - RNA, 14 nt, Human
cuccgcuggaggug

SEQ ID NO: 3659832 - RNA, 20 nt, Human
cuccgcuuucuacccagcga

SEQ ID NO: 3659833 - RNA, 15 nt, Human
cuccggacuggugcc

SEQ ID NO: 3659834 - RNA, 16 nt, Human
cuccggacuggugccc

SEQ ID NO: 3659835 - RNA, 13 nt, Human
cuccggagacagg

SEQ ID NO: 3659836 - RNA, 22 nt, Human
cuccggagugagaagcuuugcc

SEQ ID NO: 3659837 - RNA, 19 nt, Human
cuccggccaggugccuccu

SEQ ID NO: 3659838 - RNA, 20 nt, Human
cuccggccaggugccuccug

SEQ ID NO: 3659839 - RNA, 14 nt, Human
cuccggcucccagc

SEQ ID NO: 3659840 - RNA, 20 nt, Human
cuccggcucccagccucagc

SEQ ID NO: 3659841 - RNA, 13 nt, Human
cuccggcugugcu

SEQ ID NO: 3659842 - RNA, 21 nt, Human
cuccggcugugcugggagaaa

SEQ ID NO: 3659843 - RNA, 15 nt, Human
cuccgggacccccag

SEQ ID NO: 3659844 - RNA, 14 nt, Human
cuccgggagagggg

SEQ ID NO: 3659845 - RNA, 21 nt, Human
cuccggggagcgcccgcgccc

SEQ ID NO: 3659846 - RNA, 19 nt, Human
cuccggggccauuugcaau

SEQ ID NO: 3659847 - RNA, 20 nt, Human
cuccgguaaaacaccggaga

SEQ ID NO: 3659848 - RNA, 13 nt, Human
cuccguauuucag

SEQ ID NO: 3659849 - RNA, 14 nt, Human
cuccguauuucaga

SEQ ID NO: 3659850 - RNA, 14 nt, Human
cuccgucaacucau

SEQ ID NO: 3659851 - RNA, 16 nt, Human
cuccgucacuaccugg

SEQ ID NO: 3659852 - RNA, 22 nt, Human
cuccguccagccgccauugcca

SEQ ID NO: 3659853 - RNA, 19 nt, Human
cuccguccaggagccuggc

SEQ ID NO: 3659854 - RNA, 22 nt, Human
cuccgucuuagaaguggaccag

SEQ ID NO: 3659855 - RNA, 14 nt, Human
cuccgugccuccac

SEQ ID NO: 3659856 - RNA, 13 nt, Human
cuccguggaggag

SEQ ID NO: 3659857 - RNA, 12 nt, Human
cuccguguggga

SEQ ID NO: 3659858 - RNA, 14 nt, Human
cuccgugugggaga

SEQ ID NO: 3659859 - RNA, 16 nt, Human
cuccguuagcuccugu

SEQ ID NO: 3659860 - RNA, 18 nt, Human
cuccguuagcuccugugg

SEQ ID NO: 3659861 - RNA, 12 nt, Human
cuccuaaaacaa

SEQ ID NO: 3659862 - RNA, 13 nt, Human
cuccuaaaacaac

SEQ ID NO: 3659863 - RNA, 16 nt, Human
cuccuaaaaggcccag

SEQ ID NO: 3659864 - RNA, 18 nt, Human
cuccuaaaaggcccagag

SEQ ID NO: 3659865 - RNA, 17 nt, Human
cuccuaaaguagacuuc

SEQ ID NO: 3659866 - RNA, 20 nt, Human
cuccuaacugccagcccccu

SEQ ID NO: 3659867 - RNA, 20 nt, Human
cuccuacaagauuuagaaaa

SEQ ID NO: 3659868 - RNA, 20 nt, Human
cuccuacauaucccuuccag

SEQ ID NO: 3659869 - RNA, 19 nt, Human
cuccuaccccucccagcug

SEQ ID NO: 3659870 - RNA, 15 nt, Human
cuccuacccugcgcc

SEQ ID NO: 3659871 - RNA, 14 nt, Human
cuccuaccucagcc

SEQ ID NO: 3659872 - RNA, 20 nt, Human
cuccuaccugcccuggaaca

SEQ ID NO: 3659873 - RNA, 12 nt, Human
cuccuagacuga

SEQ ID NO: 3659874 - RNA, 20 nt, Human
cuccuagagaacgcagcccu

SEQ ID NO: 3659875 - RNA, 15 nt, Human
cuccuagagggaggg

SEQ ID NO: 3659876 - RNA, 23 nt, Human
cuccuagagggaggggccuaggc

SEQ ID NO: 3659877 - RNA, 15 nt, Human
cuccuagcagagaga

SEQ ID NO: 3659878 - RNA, 22 nt, Human
cuccuaggacauguucccuucu

SEQ ID NO: 3659879 - RNA, 21 nt, Human
cuccuaggacccgucuccagc

SEQ ID NO: 3659880 - RNA, 15 nt, Human
cuccuagggcauugu

SEQ ID NO: 3659881 - RNA, 23 nt, Human
cuccuagguagcccccucuuccc

SEQ ID NO: 3659882 - RNA, 23 nt, Human
cuccuaguagggguaccacugaa

SEQ ID NO: 3659883 - RNA, 23 nt, Human
cuccuaguucuagaaaaacaggc

SEQ ID NO: 3659884 - RNA, 14 nt, Human
cuccuauaaucugu

SEQ ID NO: 3659885 - RNA, 18 nt, Human
cuccuaucuguguuuuga

SEQ ID NO: 3659886 - RNA, 16 nt, Human
cuccuaugaucugagu

SEQ ID NO: 3659887 - RNA, 23 nt, Human
cuccuaugaucugagucagagcc

SEQ ID NO: 3659888 - RNA, 19 nt, Human
cuccuauuuuuguaaacug

SEQ ID NO: 3659889 - RNA, 20 nt, Human
cuccucaaccccuccccucc

SEQ ID NO: 3659890 - RNA, 21 nt, Human
cuccucaaccccuccccucca

SEQ ID NO: 3659891 - RNA, 17 nt, Human
cuccucacacacccuga

SEQ ID NO: 3659892 - RNA, 19 nt, Human
cuccucacacacccugagg

SEQ ID NO: 3659893 - RNA, 16 nt, Human
cuccucacacuuacug

SEQ ID NO: 3659894 - RNA, 12 nt, Human
cuccucaccuca

SEQ ID NO: 3659895 - RNA, 16 nt, Human
cuccucaccucaugcc

SEQ ID NO: 3659896 - RNA, 15 nt, Human
cuccucaccucugga

SEQ ID NO: 3659897 - RNA, 16 nt, Human
cuccucaccucuggac

SEQ ID NO: 3659898 - RNA, 21 nt, Human
cuccucaccucuggacuggcu

SEQ ID NO: 3659899 - RNA, 14 nt, Human
cuccucacucccuu

SEQ ID NO: 3659900 - RNA, 23 nt, Human
gagacugguccugugugcaguga

SEQ ID NO: 3659901 - RNA, 21 nt, Human
gagacugucuggccccccugg

SEQ ID NO: 3659902 - RNA, 20 nt, Human
gagacuguggagacugcucc

SEQ ID NO: 3659903 - RNA, 13 nt, Human
gagacuugccaga

SEQ ID NO: 3659904 - RNA, 12 nt, Human
gagacuugccuu

SEQ ID NO: 3659905 - RNA, 14 nt, Human
gagacuuuaaaagc

SEQ ID NO: 3659906 - RNA, 17 nt, Human
gagacuuuaaaagcauu

SEQ ID NO: 3659907 - RNA, 10 nt, Human
gagacuuuga

SEQ ID NO: 3659908 - RNA, 15 nt, Human
gagacuuugauguca

SEQ ID NO: 3659909 - RNA, 14 nt, Human
gagacuuuuuucua

SEQ ID NO: 3659910 - RNA, 16 nt, Human
gagacuuuuuucuagu

SEQ ID NO: 3659911 - RNA, 14 nt, Human
gagagaaaaacaaa

SEQ ID NO: 3659912 - RNA, 18 nt, Human
gagagaaaacagaccuaa

SEQ ID NO: 3659913 - RNA, 22 nt, Human
gagagaaaacagaccuaaugcu

SEQ ID NO: 3659914 - RNA, 11 nt, Human
gagagaaaaua

SEQ ID NO: 3659915 - RNA, 13 nt, Human
gagagaaaauaaa

SEQ ID NO: 3659916 - RNA, 14 nt, Human
gagagaaaauaaaa

SEQ ID NO: 3659917 - RNA, 18 nt, Human
gagagaaaauaaaaaguu

SEQ ID NO: 3659918 - RNA, 21 nt, Human
gagagaaaauaaaaaguuaaa

SEQ ID NO: 3659919 - RNA, 21 nt, Human
gagagaaaauauauguauuuu

SEQ ID NO: 3659920 - RNA, 13 nt, Human
gagagaaacaaac

SEQ ID NO: 3659921 - RNA, 18 nt, Human
gagagaaagccaggcagg

SEQ ID NO: 3659922 - RNA, 16 nt, Human
gagagaaaggacuccu

SEQ ID NO: 3659923 - RNA, 15 nt, Human
gagagaaauauuuua

SEQ ID NO: 3659924 - RNA, 14 nt, Human
gagagaaauucugu

SEQ ID NO: 3659925 - RNA, 17 nt, Human
gagagaaccuaacugua

SEQ ID NO: 3659926 - RNA, 17 nt, Human
gagagaagagaaugcac

SEQ ID NO: 3659927 - RNA, 16 nt, Human
gagagaagagccccac

SEQ ID NO: 3659928 - RNA, 12 nt, Human
gagagaaggggc

SEQ ID NO: 3659929 - RNA, 13 nt, Human
gagagaagugccc

SEQ ID NO: 3659930 - RNA, 16 nt, Human
gagagaauuggcucaa

SEQ ID NO: 3659931 - RNA, 17 nt, Human
gagagaauuggcucaau

SEQ ID NO: 3659932 - RNA, 19 nt, Human
gagagacacacugaagaag

SEQ ID NO: 3659933 - RNA, 16 nt, Human
gagagaccaggcaaag

SEQ ID NO: 3659934 - RNA, 15 nt, Human
gagagaccucaucag

SEQ ID NO: 3659935 - RNA, 20 nt, Human
gagagacguguacauagugu

SEQ ID NO: 3659936 - RNA, 21 nt, Human
gagagacucccaugaagccuu

SEQ ID NO: 3659937 - RNA, 11 nt, Human
gagagagaaau

SEQ ID NO: 3659938 - RNA, 20 nt, Human
gagagagaaauucuguuaaa

SEQ ID NO: 3659939 - RNA, 11 nt, Human
gagagagagag

SEQ ID NO: 3659940 - RNA, 14 nt, Human
gagagagagagaaa

SEQ ID NO: 3659941 - RNA, 13 nt, Human
gagagagagagag

SEQ ID NO: 3659942 - RNA, 15 nt, Human
gagagagauguguaa

SEQ ID NO: 3659943 - RNA, 15 nt, Human
gagagagcagcuucu

SEQ ID NO: 3659944 - RNA, 16 nt, Human
gagagaggcagagagc

SEQ ID NO: 3659945 - RNA, 19 nt, Human
gagagagguugaaaaacaa

SEQ ID NO: 3659946 - RNA, 15 nt, Human
gagagauacucuggg

SEQ ID NO: 3659947 - RNA, 16 nt, Human
gagagauagccugugg

SEQ ID NO: 3659948 - RNA, 18 nt, Human
gagagauagccuguggcc

SEQ ID NO: 3659949 - RNA, 20 nt, Human
gagagauagccuguggcccu

SEQ ID NO: 3659950 - RNA, 17 nt, Human
gagagauauaucugaaa

SEQ ID NO: 3659951 - RNA, 13 nt, Human
gagagaucugcug

SEQ ID NO: 3659952 - RNA, 18 nt, Human
gagagauguguaauuuuu

SEQ ID NO: 3659953 - RNA, 14 nt, Human
gagagauguguguu

SEQ ID NO: 3659954 - RNA, 16 nt, Human
gagagcagaggucucc

SEQ ID NO: 3659955 - RNA, 19 nt, Human
gagagcagcuucugccacu

SEQ ID NO: 3659956 - RNA, 22 nt, Human
gagagcagcuucugccacuucc

SEQ ID NO: 3659957 - RNA, 14 nt, Human
gagagcaggcuggc

SEQ ID NO: 3659958 - RNA, 17 nt, Human
gagagcaggcuggcagc

SEQ ID NO: 3659959 - RNA, 22 nt, Human
gagagcauuauaaucaccaggg

SEQ ID NO: 3659960 - RNA, 16 nt, Human
gagagccaccaagagg

SEQ ID NO: 3659961 - RNA, 22 nt, Human
gagagccagagaagugacaggg

SEQ ID NO: 3659962 - RNA, 21 nt, Human
gagagcccagagguaacagaa

SEQ ID NO: 3659963 - RNA, 20 nt, Human
gagagcccagagucccccca

SEQ ID NO: 3659964 - RNA, 11 nt, Human
gagagcccagc

SEQ ID NO: 3659965 - RNA, 16 nt, Human
gagagcccaggagcuc

SEQ ID NO: 3659966 - RNA, 13 nt, Human
gagagccccagcu

SEQ ID NO: 3659967 - RNA, 18 nt, Human
gagagccccucacacagc

SEQ ID NO: 3659968 - RNA, 20 nt, Human
gagagccccuggggccuaga

SEQ ID NO: 3659969 - RNA, 23 nt, Human
gagagcccgaggaggugucucag

SEQ ID NO: 3659970 - RNA, 20 nt, Human
gagagccguggucccugagg

SEQ ID NO: 3659971 - RNA, 14 nt, Human
gagagccugcagga

SEQ ID NO: 3659972 - RNA, 14 nt, Human
gagagccugcuccc

SEQ ID NO: 3659973 - RNA, 21 nt, Human
gagagccugcucccccacccc

SEQ ID NO: 3659974 - RNA, 23 nt, Human
gagagccugcucccccacccccu

SEQ ID NO: 3659975 - RNA, 15 nt, Human
gagagccugcuggca

SEQ ID NO: 3659976 - RNA, 17 nt, Human
gagagccuggugcugcu

SEQ ID NO: 3659977 - RNA, 16 nt, Human
gagagcgccugccccu

SEQ ID NO: 3659978 - RNA, 14 nt, Human
gagagcggucucag

SEQ ID NO: 3659979 - RNA, 22 nt, Human
gagagcgugcuccagccuggcu

SEQ ID NO: 3659980 - RNA, 20 nt, Human
gagagcuagaaccuggagag

SEQ ID NO: 3659981 - RNA, 14 nt, Human
gagagcuaggagca

SEQ ID NO: 3659982 - RNA, 14 nt, Human
gagagcuggagccu

SEQ ID NO: 3659983 - RNA, 14 nt, Human
gagagcuggggaag

SEQ ID NO: 3659984 - RNA, 23 nt, Human
gagagcuggggaagcuucuuaaa

SEQ ID NO: 3659985 - RNA, 20 nt, Human
gagagcugggugucaagagg

SEQ ID NO: 3659986 - RNA, 18 nt, Human
gagagcuuagccuggagc

SEQ ID NO: 3659987 - RNA, 20 nt, Human
gagaggaaaaguaaggugca

SEQ ID NO: 3659988 - RNA, 12 nt, Human
gagaggaaauca

SEQ ID NO: 3659989 - RNA, 18 nt, Human
gagaggaaauucuccacu

SEQ ID NO: 3659990 - RNA, 23 nt, Human
gagaggaacuccuuggccuagcc

SEQ ID NO: 3659991 - RNA, 17 nt, Human
gagaggacaagaugggu

SEQ ID NO: 3659992 - RNA, 10 nt, Human
gagaggacag

SEQ ID NO: 3659993 - RNA, 17 nt, Human
gagaggacgugggcggc

SEQ ID NO: 3659994 - RNA, 11 nt, Human
gagaggagaga

SEQ ID NO: 3659995 - RNA, 18 nt, Human
gagaggagagaggcagag

SEQ ID NO: 3659996 - RNA, 13 nt, Human
gagaggagagcca

SEQ ID NO: 3659997 - RNA, 15 nt, Human
gagaggagagccaga

SEQ ID NO: 3659998 - RNA, 19 nt, Human
gagaggagcgggaccugug

SEQ ID NO: 3659999 - RNA, 21 nt, Human
gagaggagcgggaccuguggc

SEQ ID NO: 3660000 - RNA, 15 nt, Human
gagaggaguucaaug

SEQ ID NO: 3660001 - RNA, 17 nt, Human
gagaggaguucaaugau

SEQ ID NO: 3660002 - RNA, 19 nt, Human
gagaggaguucaaugaucu

SEQ ID NO: 3660003 - RNA, 16 nt, Human
gagaggaugagagccc

SEQ ID NO: 3660004 - RNA, 15 nt, Human
gagaggcaauggcca

SEQ ID NO: 3660005 - RNA, 14 nt, Human
gagaggcagagagc

SEQ ID NO: 3660006 - RNA, 13 nt, Human
gagaggcagagug

SEQ ID NO: 3660007 - RNA, 15 nt, Human
gagaggcagagugcc

SEQ ID NO: 3660008 - RNA, 16 nt, Human
gagaggcagagugccc

SEQ ID NO: 3660009 - RNA, 21 nt, Human
gagaggcagcccaggaagucu

SEQ ID NO: 3660010 - RNA, 21 nt, Human
gagaggcaggcauagaggcuu

SEQ ID NO: 3660011 - RNA, 12 nt, Human
gagaggcccugg

SEQ ID NO: 3660012 - RNA, 21 nt, Human
gagaggcccuggaucagcgug

SEQ ID NO: 3660013 - RNA, 12 nt, Human
gagaggcuggga

SEQ ID NO: 3660014 - RNA, 21 nt, Human
gagaggcugugguuuggggga

SEQ ID NO: 3660015 - RNA, 14 nt, Human
gagagggaauguga

SEQ ID NO: 3660016 - RNA, 14 nt, Human
gagagggagaagaa

SEQ ID NO: 3660017 - RNA, 15 nt, Human
gagagggagaagaag

SEQ ID NO: 3660018 - RNA, 19 nt, Human
gagagggaggcaagcccug

SEQ ID NO: 3660019 - RNA, 16 nt, Human
gagagggcaggcauga

SEQ ID NO: 3660020 - RNA, 23 nt, Human
gagagggccgggcagaggggcag

SEQ ID NO: 3660021 - RNA, 20 nt, Human
gagagggcucgagggguggg

SEQ ID NO: 3660022 - RNA, 21 nt, Human
gagagggcucgaggggugggc

SEQ ID NO: 3660023 - RNA, 18 nt, Human
gagaggggagagcugaac

SEQ ID NO: 3660024 - RNA, 16 nt, Human
gagaggggaggccaag

SEQ ID NO: 3660025 - RNA, 13 nt, Human
gagagggggcugg

SEQ ID NO: 3660026 - RNA, 13 nt, Human
gagagggucugga

SEQ ID NO: 3660027 - RNA, 14 nt, Human
gagagggugggagu

SEQ ID NO: 3660028 - RNA, 16 nt, Human
gagagggugggagugg

SEQ ID NO: 3660029 - RNA, 20 nt, Human
gagagggugggagugggccc

SEQ ID NO: 3660030 - RNA, 18 nt, Human
gagaggucaagcccagga

SEQ ID NO: 3660031 - RNA, 13 nt, Human
gagaggugccagc

SEQ ID NO: 3660032 - RNA, 14 nt, Human
gagaggugccagca

SEQ ID NO: 3660033 - RNA, 14 nt, Human
gagaggugggccag

SEQ ID NO: 3660034 - RNA, 17 nt, Human
gagaguauuuuuauaca

SEQ ID NO: 3660035 - RNA, 22 nt, Human
gagaguauuuuuauacaaaccu

SEQ ID NO: 3660036 - RNA, 20 nt, Human
gagagucagcucucugcccu

SEQ ID NO: 3660037 - RNA, 21 nt, Human
gagagucagcucucugcccug

SEQ ID NO: 3660038 - RNA, 15 nt, Human
gagagucccacugcc

SEQ ID NO: 3660039 - RNA, 20 nt, Human
gagagucccacugccucagg

SEQ ID NO: 3660040 - RNA, 14 nt, Human
gagagucuggcccu

SEQ ID NO: 3660041 - RNA, 15 nt, Human
gagagucuggcccua

SEQ ID NO: 3660042 - RNA, 18 nt, Human
gagagugcaacaguagca

SEQ ID NO: 3660043 - RNA, 14 nt, Human
gagaguggcugggg

SEQ ID NO: 3660044 - RNA, 20 nt, Human
gagaguggcuggggcaugga

SEQ ID NO: 3660045 - RNA, 12 nt, Human
gagagugggggu

SEQ ID NO: 3660046 - RNA, 14 nt, Human
gagagugucaacca

SEQ ID NO: 3660047 - RNA, 13 nt, Human
gagaguguugaaa

SEQ ID NO: 3660048 - RNA, 22 nt, Human
gagaguuaaucaacugaaagug

SEQ ID NO: 3660049 - RNA, 21 nt, Human
gagaguucaauggcugcugaa

SEQ ID NO: 3660050 - RNA, 13 nt, Human
gagauacauacag

SEQ ID NO: 3660051 - RNA, 21 nt, Human
gagauaccaagaugccaucug

SEQ ID NO: 3660052 - RNA, 22 nt, Human
gagacugucuggccccccuggu

SEQ ID NO: 3660053 - RNA, 21 nt, Human
gagacuguggagacugcuccu

SEQ ID NO: 3660054 - RNA, 19 nt, Human
gagacugugugugcccucu

SEQ ID NO: 3660055 - RNA, 21 nt, Human
gagacugugugugcccucugg

SEQ ID NO: 3660056 - RNA, 16 nt, Human
gagacuguuuggaaau

SEQ ID NO: 3660057 - RNA, 21 nt, Human
gagacuuagggcaccaggggu

SEQ ID NO: 3660058 - RNA, 13 nt, Human
gagacuugccuuc

SEQ ID NO: 3660059 - RNA, 14 nt, Human
gagacuugcucucu

SEQ ID NO: 3660060 - RNA, 11 nt, Human
gagacuuguuu

SEQ ID NO: 3660061 - RNA, 16 nt, Human
gagacuuuaaaagcau

SEQ ID NO: 3660062 - RNA, 11 nt, Human
gagacuuugau

SEQ ID NO: 3660063 - RNA, 19 nt, Human
gagacuuugaugucagcag

SEQ ID NO: 3660064 - RNA, 22 nt, Human
gagacuuuuaaucagacaaagu

SEQ ID NO: 3660065 - RNA, 19 nt, Human
gagacuuuuugguggaugu

SEQ ID NO: 3660066 - RNA, 20 nt, Human
gagagaaaacuuauuugagu

SEQ ID NO: 3660067 - RNA, 12 nt, Human
gagagaaaauaa

SEQ ID NO: 3660068 - RNA, 19 nt, Human
gagagaaaauaaaaaguua

SEQ ID NO: 3660069 - RNA, 17 nt, Human
gagagaaaauauaugua

SEQ ID NO: 3660070 - RNA, 16 nt, Human
gagagaaagccaggca

SEQ ID NO: 3660071 - RNA, 19 nt, Human
gagagaaagccaggcaggu

SEQ ID NO: 3660072 - RNA, 20 nt, Human
gagagaaagugggugagaug

SEQ ID NO: 3660073 - RNA, 13 nt, Human
gagagaaauauuu

SEQ ID NO: 3660074 - RNA, 13 nt, Human
gagagaaauucug

SEQ ID NO: 3660075 - RNA, 16 nt, Human
gagagaaccuaacugu

SEQ ID NO: 3660076 - RNA, 18 nt, Human
gagagaaccuaacuguau

SEQ ID NO: 3660077 - RNA, 15 nt, Human
gagagaaggggagga

SEQ ID NO: 3660078 - RNA, 16 nt, Human
gagagaaggggaggag

SEQ ID NO: 3660079 - RNA, 18 nt, Human
gagagacacagcgucccu

SEQ ID NO: 3660080 - RNA, 16 nt, Human
gagagacacugguggg

SEQ ID NO: 3660081 - RNA, 14 nt, Human
gagagaccaggcaa

SEQ ID NO: 3660082 - RNA, 19 nt, Human
gagagacguguacauagug

SEQ ID NO: 3660083 - RNA, 20 nt, Human
gagagacucccaugaagccu

SEQ ID NO: 3660084 - RNA, 12 nt, Human
gagagacuuguu

SEQ ID NO: 3660085 - RNA, 11 nt, Human
gagagagaaaa

SEQ ID NO: 3660086 - RNA, 13 nt, Human
gagagagaaaaaa

SEQ ID NO: 3660087 - RNA, 19 nt, Human
gagagagaaacaaacuuuu

SEQ ID NO: 3660088 - RNA, 18 nt, Human
gagagagaaagccaggca

SEQ ID NO: 3660089 - RNA, 9 nt, Human
gagagagag

SEQ ID NO: 3660090 - RNA, 14 nt, Human
gagagagagaaauu

SEQ ID NO: 3660091 - RNA, 12 nt, Human
gagagagagaga

SEQ ID NO: 3660092 - RNA, 14 nt, Human
gagagagagagaga

SEQ ID NO: 3660093 - RNA, 13 nt, Human
gagagagaggaca

SEQ ID NO: 3660094 - RNA, 22 nt, Human
gagagagauguguaauuuuucu

SEQ ID NO: 3660095 - RNA, 14 nt, Human
gagagagcagccag

SEQ ID NO: 3660096 - RNA, 19 nt, Human
gagagagcagcuucugcca

SEQ ID NO: 3660097 - RNA, 18 nt, Human
gagcuccacucugcuucu

SEQ ID NO: 3660098 - RNA, 21 nt, Human
gagcuccacucugcuucucug

SEQ ID NO: 3660099 - RNA, 16 nt, Human
gagcuccaguguccug

SEQ ID NO: 3660100 - RNA, 19 nt, Human
gagcuccaguguccugagc

SEQ ID NO: 3660101 - RNA, 23 nt, Human
gagcuccaguguccugagcucag

SEQ ID NO: 3660102 - RNA, 18 nt, Human
gagcuccauacacacgcu

SEQ ID NO: 3660103 - RNA, 20 nt, Human
gagcuccauacacacgcugc

SEQ ID NO: 3660104 - RNA, 19 nt, Human
gagcuccccaccaccccag

SEQ ID NO: 3660105 - RNA, 17 nt, Human
gagcuccccccaggucu

SEQ ID NO: 3660106 - RNA, 20 nt, Human
gagcuccccuacggaccagg

SEQ ID NO: 3660107 - RNA, 18 nt, Human
gagcuccccuccccaacu

SEQ ID NO: 3660108 - RNA, 17 nt, Human
gagcucccucugcccca

SEQ ID NO: 3660109 - RNA, 16 nt, Human
cucgggcccaccuggc

SEQ ID NO: 3660110 - RNA, 13 nt, Human
cucgggcccagcc

SEQ ID NO: 3660111 - RNA, 15 nt, Human
cucgggcccagcccc

SEQ ID NO: 3660112 - RNA, 18 nt, Human
cucgggcccagcccccac

SEQ ID NO: 3660113 - RNA, 12 nt, Human
cucgggcccagg

SEQ ID NO: 3660114 - RNA, 14 nt, Human
cucgggcccaggcc

SEQ ID NO: 3660115 - RNA, 14 nt, Human
cucgggcuccugug

SEQ ID NO: 3660116 - RNA, 21 nt, Human
cucgguacccggggcccaggg

SEQ ID NO: 3660117 - RNA, 18 nt, Human
cucgguauaguuuuguca

SEQ ID NO: 3660118 - RNA, 14 nt, Human
cucgguggacccag

SEQ ID NO: 3660119 - RNA, 18 nt, Human
cucgguggacccagggau

SEQ ID NO: 3660120 - RNA, 23 nt, Human
cucgguguccccaccaucugcug

SEQ ID NO: 3660121 - RNA, 16 nt, Human
cucgguguggagaagc

SEQ ID NO: 3660122 - RNA, 16 nt, Human
cucgguuugccaaaau

SEQ ID NO: 3660123 - RNA, 16 nt, Human
cucguaagauuuccuu

SEQ ID NO: 3660124 - RNA, 23 nt, Human
cucguauagaagucuucaugaaa

SEQ ID NO: 3660125 - RNA, 20 nt, Human
cucguauaugucucaggucc

SEQ ID NO: 3660126 - RNA, 18 nt, Human
cucguccccaagugaccu

SEQ ID NO: 3660127 - RNA, 24 nt, Human
cucguccucccccugccagugccu

SEQ ID NO: 3660128 - RNA, 17 nt, Human
cucgucugacugugugu

SEQ ID NO: 3660129 - RNA, 15 nt, Human
cucgucuuccgucuc

SEQ ID NO: 3660130 - RNA, 18 nt, Human
cucgucuuccgucucccc

SEQ ID NO: 3660131 - RNA, 19 nt, Human
cucgucuuccgucuccccc

SEQ ID NO: 3660132 - RNA, 15 nt, Human
cucgugagucauuua

SEQ ID NO: 3660133 - RNA, 12 nt, Human
cucgugcuuuaa

SEQ ID NO: 3660134 - RNA, 13 nt, Human
cucguggccagcc

SEQ ID NO: 3660135 - RNA, 14 nt, Human
cucguggccagccc

SEQ ID NO: 3660136 - RNA, 19 nt, Human
cucguggccagcccggcug

SEQ ID NO: 3660137 - RNA, 14 nt, Human
cucguggccuuccc

SEQ ID NO: 3660138 - RNA, 14 nt, Human
cucguguauccugg

SEQ ID NO: 3660139 - RNA, 19 nt, Human
cucguguauccuggggcuc

SEQ ID NO: 3660140 - RNA, 15 nt, Human
cucgugucuggcaca

SEQ ID NO: 3660141 - RNA, 18 nt, Human
cucguuagggaagagaaa

SEQ ID NO: 3660142 - RNA, 15 nt, Human
cucguuccuuucucc

SEQ ID NO: 3660143 - RNA, 12 nt, Human
cucguuugugau

SEQ ID NO: 3660144 - RNA, 20 nt, Human
cucuaaaagauccuuuuuaa

SEQ ID NO: 3660145 - RNA, 13 nt, Human
cucuaaaagcacc

SEQ ID NO: 3660146 - RNA, 16 nt, Human
cucuaaaagguucagg

SEQ ID NO: 3660147 - RNA, 11 nt, Human
cucuaaaauau

SEQ ID NO: 3660148 - RNA, 17 nt, Human
cucuaaaauuauaaaug

SEQ ID NO: 3660149 - RNA, 14 nt, Human
cucuaaagaccaaa

SEQ ID NO: 3660150 - RNA, 22 nt, Human
cucuaaagucuguugauuaaag

SEQ ID NO: 3660151 - RNA, 18 nt, Human
cucuaaaugggaaaguau

SEQ ID NO: 3660152 - RNA, 13 nt, Human
cucuaaauucuuu

SEQ ID NO: 3660153 - RNA, 17 nt, Human
cucuaaauucuuucauu

SEQ ID NO: 3660154 - RNA, 21 nt, Human
cucuaacaauguauuuucuuc

SEQ ID NO: 3660155 - RNA, 15 nt, Human
cucuaaccccaggcc

SEQ ID NO: 3660156 - RNA, 19 nt, Human
cucuaaccccaggccccga

SEQ ID NO: 3660157 - RNA, 21 nt, Human
cucuaaccccaggccccgagg

SEQ ID NO: 3660158 - RNA, 12 nt, Human
cucuaacgccug

SEQ ID NO: 3660159 - RNA, 18 nt, Human
cucuaacgccugagccca

SEQ ID NO: 3660160 - RNA, 16 nt, Human
cucuaacuguauauuu

SEQ ID NO: 3660161 - RNA, 17 nt, Human
cucuaacuguauauuug

SEQ ID NO: 3660162 - RNA, 20 nt, Human
cucuaacuguauauuuguau

SEQ ID NO: 3660163 - RNA, 14 nt, Human
cucuaagaucuuag

SEQ ID NO: 3660164 - RNA, 19 nt, Human
cucuaagaucuuagauucu

SEQ ID NO: 3660165 - RNA, 20 nt, Human
cucuaagucauguauguuuc

SEQ ID NO: 3660166 - RNA, 21 nt, Human
cucuaagucauguauguuucu

SEQ ID NO: 3660167 - RNA, 16 nt, Human
cucuaaguuccacuga

SEQ ID NO: 3660168 - RNA, 18 nt, Human
cucuaaguuccacugagc

SEQ ID NO: 3660169 - RNA, 19 nt, Human
cucuaaguuccacugagcu

SEQ ID NO: 3660170 - RNA, 14 nt, Human
cucuaauaagaaaa

SEQ ID NO: 3660171 - RNA, 15 nt, Human
cucuaauaagaaaac

SEQ ID NO: 3660172 - RNA, 18 nt, Human
cucuaauaagaaaaccac

SEQ ID NO: 3660173 - RNA, 23 nt, Human
cucuaauagcgaggcucuaacca

SEQ ID NO: 3660174 - RNA, 19 nt, Human
cucuaauauggcaaccauu

SEQ ID NO: 3660175 - RNA, 12 nt, Human
cucuaauucuaa

SEQ ID NO: 3660176 - RNA, 18 nt, Human
cucuaauucuaaccagag

SEQ ID NO: 3660177 - RNA, 18 nt, Human
cucuaauugaauuuucaa

SEQ ID NO: 3660178 - RNA, 17 nt, Human
cucuaauuggaagaaau

SEQ ID NO: 3660179 - RNA, 11 nt, Human
cucuaauuucc

SEQ ID NO: 3660180 - RNA, 13 nt, Human
cucuacaaaaagc

SEQ ID NO: 3660181 - RNA, 18 nt, Human
cucuacagagcuucccug

SEQ ID NO: 3660182 - RNA, 13 nt, Human
cucuacagugcca

SEQ ID NO: 3660183 - RNA, 15 nt, Human
cucuacaucuucugc

SEQ ID NO: 3660184 - RNA, 19 nt, Human
cucuacauggacucagaga

SEQ ID NO: 3660185 - RNA, 20 nt, Human
cucuaccauccccuguagag

SEQ ID NO: 3660186 - RNA, 15 nt, Human
cucuacccagcccau

SEQ ID NO: 3660187 - RNA, 17 nt, Human
cucuacccagggccugc

SEQ ID NO: 3660188 - RNA, 21 nt, Human
cucuacccaucuuaaaaacaa

SEQ ID NO: 3660189 - RNA, 13 nt, Human
cucuacccuggca

SEQ ID NO: 3660190 - RNA, 12 nt, Human
cucuaccugaca

SEQ ID NO: 3660191 - RNA, 16 nt, Human
cucuaccuucucccca

SEQ ID NO: 3660192 - RNA, 21 nt, Human
cucuaccuucuccccagcucc

SEQ ID NO: 3660193 - RNA, 22 nt, Human
cucuaccuucuccccagcuccc

SEQ ID NO: 3660194 - RNA, 19 nt, Human
cucuacuaaaaagaaggaa

SEQ ID NO: 3660195 - RNA, 19 nt, Human
cucuacuaaggcuuuccua

SEQ ID NO: 3660196 - RNA, 19 nt, Human
cucuacuccuaccucagcc

SEQ ID NO: 3660197 - RNA, 21 nt, Human
cucuacugggagccuacccac

SEQ ID NO: 3660198 - RNA, 15 nt, Human
cucuacuuaaugaga

SEQ ID NO: 3660199 - RNA, 16 nt, Human
cucuacuuagcauguc

SEQ ID NO: 3660200 - RNA, 13 nt, Human
cucuacuuuccag

SEQ ID NO: 3660201 - RNA, 18 nt, Human
cucuacuuuccaggcuag

SEQ ID NO: 3660202 - RNA, 19 nt, Human
cucuagaagccaagggaaa

SEQ ID NO: 3660203 - RNA, 20 nt, Human
cucuagaauuuuaagccuuu

SEQ ID NO: 3660204 - RNA, 18 nt, Human
cucuagacaacccugcaa

SEQ ID NO: 3660205 - RNA, 23 nt, Human
cucuagacaacccugcaaaggac

SEQ ID NO: 3660206 - RNA, 16 nt, Human
cucuagacaagauauu

SEQ ID NO: 3660207 - RNA, 21 nt, Human
cucuagacacugccacacagg

SEQ ID NO: 3660208 - RNA, 23 nt, Human
cucuagagaaguggacuggagga

SEQ ID NO: 3660209 - RNA, 19 nt, Human
cucuagagcagacuacagc

SEQ ID NO: 3660210 - RNA, 13 nt, Human
cucuagagcaggg

SEQ ID NO: 3660211 - RNA, 16 nt, Human
cucuagagcagggauu

SEQ ID NO: 3660212 - RNA, 14 nt, Human
cucuagaucauaag

SEQ ID NO: 3660213 - RNA, 15 nt, Human
cucuagaugagcugg

SEQ ID NO: 3660214 - RNA, 17 nt, Human
cucuagcagcaccuccu

SEQ ID NO: 3660215 - RNA, 14 nt, Human
cucuagcccugccc

SEQ ID NO: 3660216 - RNA, 16 nt, Human
cucuagcccugcccgg

SEQ ID NO: 3660217 - RNA, 13 nt, Human
cucuagccugggc

SEQ ID NO: 3660218 - RNA, 13 nt, Human
cucuagcugaauu

SEQ ID NO: 3660219 - RNA, 23 nt, Human
cucuagcugggggugggccaggc

SEQ ID NO: 3660220 - RNA, 17 nt, Human
cucuagcuggugguuuc

SEQ ID NO: 3660221 - RNA, 21 nt, Human
cucuaggaagacauuuuuccg

SEQ ID NO: 3660222 - RNA, 16 nt, Human
cucuaggauguauauu

SEQ ID NO: 3660223 - RNA, 22 nt, Human
cucuaggauguauauuuuauau

SEQ ID NO: 3660224 - RNA, 17 nt, Human
cucuaggcucugccuuc

SEQ ID NO: 3660225 - RNA, 13 nt, Human
cucuaggcugggg

SEQ ID NO: 3660226 - RNA, 15 nt, Human
cucuaggcuggggaa

SEQ ID NO: 3660227 - RNA, 23 nt, Human
cucuagggaaaaaccagcgugug

SEQ ID NO: 3660228 - RNA, 21 nt, Human
cucuagggaaggccaccugca

SEQ ID NO: 3660229 - RNA, 14 nt, Human
cucuagggcagugg

SEQ ID NO: 3660230 - RNA, 18 nt, Human
cucuaggguugcuggagc

SEQ ID NO: 3660231 - RNA, 14 nt, Human
cucuagguggggcg

SEQ ID NO: 3660232 - RNA, 14 nt, Human
cucuaguacuguga

SEQ ID NO: 3660233 - RNA, 16 nt, Human
cucuaguaguuaaaaa

SEQ ID NO: 3660234 - RNA, 13 nt, Human
cucuagugcccuc

SEQ ID NO: 3660235 - RNA, 12 nt, Human
cucuagugcugu

SEQ ID NO: 3660236 - RNA, 18 nt, Human
cucuagugggacagccca

SEQ ID NO: 3660237 - RNA, 15 nt, Human
cucuaguucuuuguu

SEQ ID NO: 3660238 - RNA, 21 nt, Human
cucuaguuugauuaaauucuu

SEQ ID NO: 3660239 - RNA, 16 nt, Human
cucuauaauugccacu

SEQ ID NO: 3660240 - RNA, 18 nt, Human
cucuauacaucucucccc

SEQ ID NO: 3660241 - RNA, 15 nt, Human
cucuauagcaccagg

SEQ ID NO: 3660242 - RNA, 16 nt, Human
gaggcagacagcagcu

SEQ ID NO: 3660243 - RNA, 21 nt, Human
gaggcagacagcagcucaggc

SEQ ID NO: 3660244 - RNA, 16 nt, Human
gaggcagagaaagaag

SEQ ID NO: 3660245 - RNA, 15 nt, Human
gaggcagagagcggu

SEQ ID NO: 3660246 - RNA, 11 nt, Human
gaggcagagga

SEQ ID NO: 3660247 - RNA, 19 nt, Human
gaggcagagguugcaguga

SEQ ID NO: 3660248 - RNA, 20 nt, Human
gaggcagagguugcagugag

SEQ ID NO: 3660249 - RNA, 22 nt, Human
gaggcagagugccccaccugcc

SEQ ID NO: 3660250 - RNA, 21 nt, Human
gaggcagcagugugaggccag

SEQ ID NO: 3660251 - RNA, 16 nt, Human
gaggcagcccaggaag

SEQ ID NO: 3660252 - RNA, 19 nt, Human
gaggcagccccauucugcc

SEQ ID NO: 3660253 - RNA, 20 nt, Human
gaggcagccccauucugccu

SEQ ID NO: 3660254 - RNA, 22 nt, Human
gaggcagccccauucugccugc

SEQ ID NO: 3660255 - RNA, 16 nt, Human
gaggcaggcauggccc

SEQ ID NO: 3660256 - RNA, 18 nt, Human
gaggcaggcauggcccug

SEQ ID NO: 3660257 - RNA, 22 nt, Human
gaggcaggccgacuguacuaaa

SEQ ID NO: 3660258 - RNA, 14 nt, Human
gaggcaggcuccag

SEQ ID NO: 3660259 - RNA, 15 nt, Human
gaggcagggagggga

SEQ ID NO: 3660260 - RNA, 16 nt, Human
gaggcagggaggggac

SEQ ID NO: 3660261 - RNA, 19 nt, Human
gaggcagggcaaaugacau

SEQ ID NO: 3660262 - RNA, 17 nt, Human
gaggcagggccuugccc

SEQ ID NO: 3660263 - RNA, 23 nt, Human
gaggcagggccuugcccagagau

SEQ ID NO: 3660264 - RNA, 17 nt, Human
gaggcaggggcuuccug

SEQ ID NO: 3660265 - RNA, 18 nt, Human
gaggcaggggcuuccugg

SEQ ID NO: 3660266 - RNA, 18 nt, Human
gaggcagggucucacucu

SEQ ID NO: 3660267 - RNA, 20 nt, Human
gaggcagggucucacucugu

SEQ ID NO: 3660268 - RNA, 12 nt, Human
gaggcagguccc

SEQ ID NO: 3660269 - RNA, 22 nt, Human
gaggcagugggucccacuuccc

SEQ ID NO: 3660270 - RNA, 21 nt, Human
gaggcaguugcccagccucuu

SEQ ID NO: 3660271 - RNA, 15 nt, Human
gaggcaguuugagga

SEQ ID NO: 3660272 - RNA, 13 nt, Human
gaggcauccagca

SEQ ID NO: 3660273 - RNA, 21 nt, Human
gaggcauccagcagucucugc

SEQ ID NO: 3660274 - RNA, 20 nt, Human
gaggcauccuacccuuuucu

SEQ ID NO: 3660275 - RNA, 14 nt, Human
cucuauuuaaauuc

SEQ ID NO: 3660276 - RNA, 18 nt, Human
cucuauuuaaauucuuuu

SEQ ID NO: 3660277 - RNA, 13 nt, Human
cucuauuuaauau

SEQ ID NO: 3660278 - RNA, 14 nt, Human
cucuauuuaauauu

SEQ ID NO: 3660279 - RNA, 17 nt, Human
cucuauuuauguuugca

SEQ ID NO: 3660280 - RNA, 14 nt, Human
cucuauuucccccu

SEQ ID NO: 3660281 - RNA, 17 nt, Human
cucuauuucccccuuuc

SEQ ID NO: 3660282 - RNA, 23 nt, Human
cucuauuucccccuuucuuccuc

SEQ ID NO: 3660283 - RNA, 17 nt, Human
cucuauuugaauuauuu

SEQ ID NO: 3660284 - RNA, 17 nt, Human
cucucaaagcaaauaau

SEQ ID NO: 3660285 - RNA, 20 nt, Human
cucucaaccaccuuucagau

SEQ ID NO: 3660286 - RNA, 17 nt, Human
cucucaacccaggagca

SEQ ID NO: 3660287 - RNA, 21 nt, Human
cucucacacacauagauuaau

SEQ ID NO: 3660288 - RNA, 19 nt, Human
cucucacacugguucucaa

SEQ ID NO: 3660289 - RNA, 22 nt, Human
cucucacacugguucucaauga

SEQ ID NO: 3660290 - RNA, 17 nt, Human
cucucacagcugaguug

SEQ ID NO: 3660291 - RNA, 15 nt, Human
cucucaccucagccu

SEQ ID NO: 3660292 - RNA, 14 nt, Human
cucucaccucuagg

SEQ ID NO: 3660293 - RNA, 14 nt, Human
cucucaccuggccc

SEQ ID NO: 3660294 - RNA, 15 nt, Human
cucucacuaaacuuu

SEQ ID NO: 3660295 - RNA, 21 nt, Human
cucucacuaaacuuuacccaa

SEQ ID NO: 3660296 - RNA, 12 nt, Human
cucucacucccc

SEQ ID NO: 3660297 - RNA, 13 nt, Human
cucucacucccca

SEQ ID NO: 3660298 - RNA, 21 nt, Human
cucucacuccccagccugggc

SEQ ID NO: 3660299 - RNA, 12 nt, Human
cucucacuccuu

SEQ ID NO: 3660300 - RNA, 21 nt, Human
cucucacuuguuuuauuuaac

SEQ ID NO: 3660301 - RNA, 19 nt, Human
cucucagaagggaggcugg

SEQ ID NO: 3660302 - RNA, 17 nt, Human
cucucagaauucuucag

SEQ ID NO: 3660303 - RNA, 18 nt, Human
cucucagaccgucuuccu

SEQ ID NO: 3660304 - RNA, 21 nt, Human
cucucagaccgucuuccucca

SEQ ID NO: 3660305 - RNA, 15 nt, Human
cucucagcccagaag

SEQ ID NO: 3660306 - RNA, 21 nt, Human
cucucagcccucacacacccu

SEQ ID NO: 3660307 - RNA, 17 nt, Human
cucucagccuuacauuu

SEQ ID NO: 3660308 - RNA, 16 nt, Human
cucucagcucagcgcc

SEQ ID NO: 3660309 - RNA, 17 nt, Human
cucucagcucagcgcca

SEQ ID NO: 3660310 - RNA, 12 nt, Human
cucucagcucca

SEQ ID NO: 3660311 - RNA, 13 nt, Human
cucucagcuccag

SEQ ID NO: 3660312 - RNA, 13 nt, Human
cucucaggagcca

SEQ ID NO: 3660313 - RNA, 14 nt, Human
cucucaggagccau

SEQ ID NO: 3660314 - RNA, 21 nt, Human
cucucaggagccaucaucggc

SEQ ID NO: 3660315 - RNA, 16 nt, Human
cucucaggauccaagc

SEQ ID NO: 3660316 - RNA, 16 nt, Human
cucucaggcaugccug

SEQ ID NO: 3660317 - RNA, 12 nt, Human
cucucaggccaa

SEQ ID NO: 3660318 - RNA, 13 nt, Human
cucucaggccagc

SEQ ID NO: 3660319 - RNA, 17 nt, Human
cucucaggccagcugcu

SEQ ID NO: 3660320 - RNA, 18 nt, Human
cucucaggccggcagccc

SEQ ID NO: 3660321 - RNA, 15 nt, Human
cucucagggccaggc

SEQ ID NO: 3660322 - RNA, 18 nt, Human
cucucaguacuuuggagg

SEQ ID NO: 3660323 - RNA, 22 nt, Human
cucucaguguuuuggacuccau

SEQ ID NO: 3660324 - RNA, 22 nt, Human
cucucaucaguguccucuugcu

SEQ ID NO: 3660325 - RNA, 15 nt, Human
cucucaucccccauu

SEQ ID NO: 3660326 - RNA, 19 nt, Human
cucucauccuccaguaccu

SEQ ID NO: 3660327 - RNA, 18 nt, Human
cucucauccuuuucuccu

SEQ ID NO: 3660328 - RNA, 11 nt, Human
cucucaucuga

SEQ ID NO: 3660329 - RNA, 14 nt, Human
cucucaugaaccuc

SEQ ID NO: 3660330 - RNA, 17 nt, Human
cucucauuuagccuguc

SEQ ID NO: 3660331 - RNA, 14 nt, Human
cucucauuugugug

SEQ ID NO: 3660332 - RNA, 13 nt, Human
cucuccaaccugg

SEQ ID NO: 3660333 - RNA, 14 nt, Human
cucuccaagggcuu

SEQ ID NO: 3660334 - RNA, 21 nt, Human
cucuccaagggcuucugcacc

SEQ ID NO: 3660335 - RNA, 23 nt, Human
cucuccaagggcuucugcacccu

SEQ ID NO: 3660336 - RNA, 17 nt, Human
cucuccaagucucagug

SEQ ID NO: 3660337 - RNA, 20 nt, Human
cucuccaagucucaguggcu

SEQ ID NO: 3660338 - RNA, 19 nt, Human
cucuccaagugccagaggu

SEQ ID NO: 3660339 - RNA, 17 nt, Human
cucuccacagcugccuc

SEQ ID NO: 3660340 - RNA, 22 nt, Human
cucuccaccuaguggcugucca

SEQ ID NO: 3660341 - RNA, 23 nt, Human
cucuccaccuaguggcuguccag

SEQ ID NO: 3660342 - RNA, 18 nt, Human
cucuccaccucagccuug

SEQ ID NO: 3660343 - RNA, 20 nt, Human
cucuccaccucagccuugga

SEQ ID NO: 3660344 - RNA, 11 nt, Human
cucuccacugc

SEQ ID NO: 3660345 - RNA, 16 nt, Human
cucuccacuuucagcu

SEQ ID NO: 3660346 - RNA, 17 nt, Human
cucuccacuuucagcug

SEQ ID NO: 3660347 - RNA, 19 nt, Human
cucuccacuuucagcuguc

SEQ ID NO: 3660348 - RNA, 15 nt, Human
cucuccagccccugg

SEQ ID NO: 3660349 - RNA, 16 nt, Human
cucuccagccccugga

SEQ ID NO: 3660350 - RNA, 17 nt, Human
cucuccagccccuggau

SEQ ID NO: 3660351 - RNA, 18 nt, Human
cucuccagccccuggaug

SEQ ID NO: 3660352 - RNA, 19 nt, Human
cucuccagccccuggaugc

SEQ ID NO: 3660353 - RNA, 23 nt, Human
cucuccagccucagcccccugcu

SEQ ID NO: 3660354 - RNA, 13 nt, Human
cucuccagcucca

SEQ ID NO: 3660355 - RNA, 13 nt, Human
cucuccaggcacc

SEQ ID NO: 3660356 - RNA, 19 nt, Human
cucuccaggcacccuucuu

SEQ ID NO: 3660357 - RNA, 22 nt, Human
cucuccaguuugcaccuguccc

SEQ ID NO: 3660358 - RNA, 16 nt, Human
cucuccauaaccccac

SEQ ID NO: 3660359 - RNA, 15 nt, Human
cucuccaucuucagc

SEQ ID NO: 3660360 - RNA, 15 nt, Human
cucuccauucugcuc

SEQ ID NO: 3660361 - RNA, 13 nt, Human
cucucccaaaaaa

SEQ ID NO: 3660362 - RNA, 13 nt, Human
cucucccaacucu

SEQ ID NO: 3660363 - RNA, 14 nt, Human
cucucccacccucu

SEQ ID NO: 3660364 - RNA, 20 nt, Human
cucucccacgggaccugggg

SEQ ID NO: 3660365 - RNA, 13 nt, Human
cucucccaggcag

SEQ ID NO: 3660366 - RNA, 14 nt, Human
cucucccaggcccc

SEQ ID NO: 3660367 - RNA, 24 nt, Human
cucucccaggccccaugaccucca

SEQ ID NO: 3660368 - RNA, 11 nt, Human
cucucccaggg

SEQ ID NO: 3660369 - RNA, 13 nt, Human
cucucccaucacu

SEQ ID NO: 3660370 - RNA, 16 nt, Human
cucucccaucccccug

SEQ ID NO: 3660371 - RNA, 14 nt, Human
cucucccauggagc

SEQ ID NO: 3660372 - RNA, 19 nt, Human
cucucccauggagccccag

SEQ ID NO: 3660373 - RNA, 22 nt, Human
cucucccauggagccccagccc

SEQ ID NO: 3660374 - RNA, 13 nt, Human
cucucccauggcu

SEQ ID NO: 3660375 - RNA, 14 nt, Human
cucucccauuuccu

SEQ ID NO: 3660376 - RNA, 17 nt, Human
cucuccccaccccuacc

SEQ ID NO: 3660377 - RNA, 11 nt, Human
cucuccccagc

SEQ ID NO: 3660378 - RNA, 15 nt, Human
cucuccccagcccag

SEQ ID NO: 3660379 - RNA, 20 nt, Human
cucuccccagcccagagaca

SEQ ID NO: 3660380 - RNA, 22 nt, Human
cucuccccagggaagcagcagc

SEQ ID NO: 3660381 - RNA, 16 nt, Human
cucuccccagguccag

SEQ ID NO: 3660382 - RNA, 23 nt, Human
cucuccccagguccagcucugga

SEQ ID NO: 3660383 - RNA, 16 nt, Human
cucucccccacccccu

SEQ ID NO: 3660384 - RNA, 21 nt, Human
cucuccccccccccuccaauc

SEQ ID NO: 3660385 - RNA, 19 nt, Human
cucuccccccgccugccac

SEQ ID NO: 3660386 - RNA, 14 nt, Human
cucuccccucaaag

SEQ ID NO: 3660387 - RNA, 19 nt, Human
gaguucuuuuugaaguauu

SEQ ID NO: 3660388 - RNA, 21 nt, Human
gaguugaaaaucuuauaauuu

SEQ ID NO: 3660389 - RNA, 17 nt, Human
gaguugaagacagagcu

SEQ ID NO: 3660390 - RNA, 15 nt, Human
gaguugaggaacugu

SEQ ID NO: 3660391 - RNA, 16 nt, Human
gaguugaggccacugu

SEQ ID NO: 3660392 - RNA, 20 nt, Human
gaguugaucuggaacccaga

SEQ ID NO: 3660393 - RNA, 21 nt, Human
gaguugaucuggaacccagac

SEQ ID NO: 3660394 - RNA, 17 nt, Human
gaguugccaagacaaau

SEQ ID NO: 3660395 - RNA, 17 nt, Human
gaguugccccgucucug

SEQ ID NO: 3660396 - RNA, 22 nt, Human
gaguugcuuuucagcugagguu

SEQ ID NO: 3660397 - RNA, 16 nt, Human
gaguuggcauugcauu

SEQ ID NO: 3660398 - RNA, 14 nt, Human
gaguugucacugcu

SEQ ID NO: 3660399 - RNA, 16 nt, Human
gaguuguggaaagccu

SEQ ID NO: 3660400 - RNA, 20 nt, Human
gaguuguggaaagccucugc

SEQ ID NO: 3660401 - RNA, 23 nt, Human
gaguugugugaauaccccaagac

SEQ ID NO: 3660402 - RNA, 16 nt, Human
gaguuguguuguucuu

SEQ ID NO: 3660403 - RNA, 13 nt, Human
gaguuguuuuugu

SEQ ID NO: 3660404 - RNA, 14 nt, Human
gaguuuaaaaauca

SEQ ID NO: 3660405 - RNA, 14 nt, Human
gaguuuaaaaucau

SEQ ID NO: 3660406 - RNA, 13 nt, Human
gaguuuaaagcaa

SEQ ID NO: 3660407 - RNA, 14 nt, Human
gaguuuaccauuug

SEQ ID NO: 3660408 - RNA, 17 nt, Human
gaguuuaccauuuguaa

SEQ ID NO: 3660409 - RNA, 20 nt, Human
gaguuuaccauuuguaauaa

SEQ ID NO: 3660410 - RNA, 22 nt, Human
gaguuuagggaacaauuuggca

SEQ ID NO: 3660411 - RNA, 21 nt, Human
gaguuuagugaucugaacaga

SEQ ID NO: 3660412 - RNA, 18 nt, Human
gaguuuauguuccauuaa

SEQ ID NO: 3660413 - RNA, 22 nt, Human
gaguuuauguuccauuaaacga

SEQ ID NO: 3660414 - RNA, 18 nt, Human
gaguuucauucuccugcc

SEQ ID NO: 3660415 - RNA, 20 nt, Human
gaguuucauucuccugccug

SEQ ID NO: 3660416 - RNA, 23 nt, Human
gaguuuccucaggcugcuggagg

SEQ ID NO: 3660417 - RNA, 12 nt, Human
gaguuucuaagg

SEQ ID NO: 3660418 - RNA, 16 nt, Human
gaguuucuaagguccg

SEQ ID NO: 3660419 - RNA, 17 nt, Human
gaguuugagcugccuuc

SEQ ID NO: 3660420 - RNA, 17 nt, Human
gaguuugaugaggcccu

SEQ ID NO: 3660421 - RNA, 15 nt, Human
gaguuuggucccugg

SEQ ID NO: 3660422 - RNA, 16 nt, Human
gaguuuggucuggacu

SEQ ID NO: 3660423 - RNA, 17 nt, Human
gaguuuggucuggacug

SEQ ID NO: 3660424 - RNA, 19 nt, Human
gaguuuggucuggacugac

SEQ ID NO: 3660425 - RNA, 17 nt, Human
gaguuugucgcucaugu

SEQ ID NO: 3660426 - RNA, 22 nt, Human
gaguuugucgcucaugugugca

SEQ ID NO: 3660427 - RNA, 18 nt, Human
gaguuuguguguugucuu

SEQ ID NO: 3660428 - RNA, 18 nt, Human
gaguuuuccauggcagga

SEQ ID NO: 3660429 - RNA, 21 nt, Human
gaguuuugggaaguuaaaggg

SEQ ID NO: 3660430 - RNA, 16 nt, Human
gaguuuugucauucag

SEQ ID NO: 3660431 - RNA, 13 nt, Human
gaguuuuguguuu

SEQ ID NO: 3660432 - RNA, 18 nt, Human
gaguuuuguguuuguugu

SEQ ID NO: 3660433 - RNA, 17 nt, Human
gaguuuuguuuccucug

SEQ ID NO: 3660434 - RNA, 19 nt, Human
gaguuuuuauggggcugaa

SEQ ID NO: 3660435 - RNA, 16 nt, Human
gauaaaaaaacagcuu

SEQ ID NO: 3660436 - RNA, 20 nt, Human
gauaaaaagccagggcugga

SEQ ID NO: 3660437 - RNA, 20 nt, Human
gauaaaaauaucaucauagu

SEQ ID NO: 3660438 - RNA, 16 nt, Human
gauaaaagauacauuu

SEQ ID NO: 3660439 - RNA, 14 nt, Human
gauaaaauaaauga

SEQ ID NO: 3660440 - RNA, 18 nt, Human
gauaaaaugagguucaac

SEQ ID NO: 3660441 - RNA, 18 nt, Human
gauaaacaacaagguggu

SEQ ID NO: 3660442 - RNA, 15 nt, Human
gauaaacacaagauu

SEQ ID NO: 3660443 - RNA, 16 nt, Human
gauaaagaccagaaau

SEQ ID NO: 3660444 - RNA, 14 nt, Human
gauaaagagacagu

SEQ ID NO: 3660445 - RNA, 11 nt, Human
gauaaagauga

SEQ ID NO: 3660446 - RNA, 12 nt, Human
gauaaagaugau

SEQ ID NO: 3660447 - RNA, 16 nt, Human
gauaaagauuucuuga

SEQ ID NO: 3660448 - RNA, 14 nt, Human
gauaaagcacagcu

SEQ ID NO: 3660449 - RNA, 17 nt, Human
gauaaagccucaagguu

SEQ ID NO: 3660450 - RNA, 14 nt, Human
gauaaaguuucuca

SEQ ID NO: 3660451 - RNA, 20 nt, Human
gauaaauauucacacuugaa

SEQ ID NO: 3660452 - RNA, 21 nt, Human
gauaaauauugagcagaucua

SEQ ID NO: 3660453 - RNA, 18 nt, Human
gauaaaucagugguuauu

SEQ ID NO: 3660454 - RNA, 13 nt, Human
gauaaaucauuuu

SEQ ID NO: 3660455 - RNA, 20 nt, Human
gauaaaucauuuuaugucaa

SEQ ID NO: 3660456 - RNA, 15 nt, Human
gauaaaugauagaca

SEQ ID NO: 3660457 - RNA, 20 nt, Human
gauaaaugccaucaauaaaa

SEQ ID NO: 3660458 - RNA, 22 nt, Human
gauaacaaagauaucuuuucuu

SEQ ID NO: 3660459 - RNA, 20 nt, Human
gauaacaaugcagcaaggcc

SEQ ID NO: 3660460 - RNA, 21 nt, Human
gauaacaccaccauucacaag

SEQ ID NO: 3660461 - RNA, 15 nt, Human
gauaacagcuaccau

SEQ ID NO: 3660462 - RNA, 20 nt, Human
gauaacagcuaccaugacaa

SEQ ID NO: 3660463 - RNA, 22 nt, Human
gauaacagggauugauuuuaaa

SEQ ID NO: 3660464 - RNA, 17 nt, Human
gauaacauuuguguguu

SEQ ID NO: 3660465 - RNA, 14 nt, Human
gauaaccauagcau

SEQ ID NO: 3660466 - RNA, 21 nt, Human
gauaaccuguacuucaaguua

SEQ ID NO: 3660467 - RNA, 22 nt, Human
gauaaccuguacuucaaguuaa

SEQ ID NO: 3660468 - RNA, 17 nt, Human
gauaacuagauggugcu

SEQ ID NO: 3660469 - RNA, 13 nt, Human
gauaacucuuugg

SEQ ID NO: 3660470 - RNA, 18 nt, Human
gauaacuguuauuuauaa

SEQ ID NO: 3660471 - RNA, 22 nt, Human
gauaagaaugcugguuuuccua

SEQ ID NO: 3660472 - RNA, 16 nt, Human
gauaagcuucaaagcu

SEQ ID NO: 3660473 - RNA, 16 nt, Human
gauaagggaaaagaua

SEQ ID NO: 3660474 - RNA, 19 nt, Human
gauaaguguucugucugac

SEQ ID NO: 3660475 - RNA, 13 nt, Human
gauaaguuggaaa

SEQ ID NO: 3660476 - RNA, 17 nt, Human
gauaaguuggaaacacu

SEQ ID NO: 3660477 - RNA, 20 nt, Human
gauaauaaggaaaaguuuaa

SEQ ID NO: 3660478 - RNA, 18 nt, Human
gauaauaauauuguuuuu

SEQ ID NO: 3660479 - RNA, 14 nt, Human
gauaauacaccacu

SEQ ID NO: 3660480 - RNA, 12 nt, Human
gauaauagauuc

SEQ ID NO: 3660481 - RNA, 14 nt, Human
gauaauagauucuc

SEQ ID NO: 3660482 - RNA, 16 nt, Human
gagucccagugggagg

SEQ ID NO: 3660483 - RNA, 16 nt, Human
gagucccccagagaug

SEQ ID NO: 3660484 - RNA, 20 nt, Human
gaguccccccucccaccucc

SEQ ID NO: 3660485 - RNA, 11 nt, Human
gaguccccuca

SEQ ID NO: 3660486 - RNA, 19 nt, Human
gaguccccucaccuccucu

SEQ ID NO: 3660487 - RNA, 12 nt, Human
gaguccccuguu

SEQ ID NO: 3660488 - RNA, 23 nt, Human
gaguccccuguuuguuucugaaa

SEQ ID NO: 3660489 - RNA, 16 nt, Human
gagucccugccuggac

SEQ ID NO: 3660490 - RNA, 21 nt, Human
gagucccugccuggaccagcc

SEQ ID NO: 3660491 - RNA, 23 nt, Human
gagucccugccuggaccagccuc

SEQ ID NO: 3660492 - RNA, 14 nt, Human
gagucccuuccagg

SEQ ID NO: 3660493 - RNA, 14 nt, Human
gaguccuccagaac

SEQ ID NO: 3660494 - RNA, 12 nt, Human
gaguccucugga

SEQ ID NO: 3660495 - RNA, 14 nt, Human
gaguccuuaaaaug

SEQ ID NO: 3660496 - RNA, 15 nt, Human
gagucgaggacaggg

SEQ ID NO: 3660497 - RNA, 17 nt, Human
gagucgaggacagggag

SEQ ID NO: 3660498 - RNA, 17 nt, Human
gagucguacagaaagcu

SEQ ID NO: 3660499 - RNA, 22 nt, Human
gagucguggggugugcugggag

SEQ ID NO: 3660500 - RNA, 21 nt, Human
gagucuaaagauggaguuucu

SEQ ID NO: 3660501 - RNA, 13 nt, Human
gagucuagauucu

SEQ ID NO: 3660502 - RNA, 14 nt, Human
gagucuagauucuc

SEQ ID NO: 3660503 - RNA, 19 nt, Human
gagucuagcguagugcagc

SEQ ID NO: 3660504 - RNA, 21 nt, Human
gagucuauuuacggaacucaa

SEQ ID NO: 3660505 - RNA, 20 nt, Human
gagucuccagugguugcugu

SEQ ID NO: 3660506 - RNA, 14 nt, Human
gagucucccaggga

SEQ ID NO: 3660507 - RNA, 15 nt, Human
gagucucuucuccac

SEQ ID NO: 3660508 - RNA, 17 nt, Human
gagucucuucuccacug

SEQ ID NO: 3660509 - RNA, 14 nt, Human
gagucugaagcaga

SEQ ID NO: 3660510 - RNA, 19 nt, Human
gagucugaggccguugcug

SEQ ID NO: 3660511 - RNA, 20 nt, Human
gagucugagggcuuguaguu

SEQ ID NO: 3660512 - RNA, 15 nt, Human
gagucugagguccug

SEQ ID NO: 3660513 - RNA, 19 nt, Human
gagucugagguccugagca

SEQ ID NO: 3660514 - RNA, 11 nt, Human
gagucugcaca

SEQ ID NO: 3660515 - RNA, 13 nt, Human
gagucugccaggg

SEQ ID NO: 3660516 - RNA, 21 nt, Human
gagucugccagggccccucuc

SEQ ID NO: 3660517 - RNA, 21 nt, Human
gagucugcuauauuuucauga

SEQ ID NO: 3660518 - RNA, 23 nt, Human
gagucuggugaagcucacuucug

SEQ ID NO: 3660519 - RNA, 20 nt, Human
gagucuugcuaccucaguca

SEQ ID NO: 3660520 - RNA, 15 nt, Human
gagucuugcuauauu

SEQ ID NO: 3660521 - RNA, 21 nt, Human
gagucuuggcggcagcagcca

SEQ ID NO: 3660522 - RNA, 22 nt, Human
gagucuuugaagcugaaaauau

SEQ ID NO: 3660523 - RNA, 17 nt, Human
gagugaagaggggcagc

SEQ ID NO: 3660524 - RNA, 18 nt, Human
gagugaagaggggcagcc

SEQ ID NO: 3660525 - RNA, 20 nt, Human
gagugaagaggggcagcccu

SEQ ID NO: 3660526 - RNA, 15 nt, Human
gagugacagaggcag

SEQ ID NO: 3660527 - RNA, 16 nt, Human
gagugacagaggcagc

SEQ ID NO: 3660528 - RNA, 18 nt, Human
gagugacagaggcagccc

SEQ ID NO: 3660529 - RNA, 19 nt, Human
gagugacaguggauugcau

SEQ ID NO: 3660530 - RNA, 15 nt, Human
gagugacggucccac

SEQ ID NO: 3660531 - RNA, 18 nt, Human
gagugacggucccacacu

SEQ ID NO: 3660532 - RNA, 22 nt, Human
gauaccagcgaggaggcuccag

SEQ ID NO: 3660533 - RNA, 18 nt, Human
gauacccaggaccaagcc

SEQ ID NO: 3660534 - RNA, 14 nt, Human
gauacccaucccau

SEQ ID NO: 3660535 - RNA, 14 nt, Human
gauaccuaaaacau

SEQ ID NO: 3660536 - RNA, 17 nt, Human
gauaccuccaacccugc

SEQ ID NO: 3660537 - RNA, 17 nt, Human
gauacgacaguacacug

SEQ ID NO: 3660538 - RNA, 22 nt, Human
gauacgcuacuauaaagagaag

SEQ ID NO: 3660539 - RNA, 23 nt, Human
gauacuccgcugucggcacauuc

SEQ ID NO: 3660540 - RNA, 11 nt, Human
gauacucuggg

SEQ ID NO: 3660541 - RNA, 14 nt, Human
gauacucugggaac

SEQ ID NO: 3660542 - RNA, 17 nt, Human
gauacucugucagaugg

SEQ ID NO: 3660543 - RNA, 15 nt, Human
gauacugcccggggc

SEQ ID NO: 3660544 - RNA, 18 nt, Human
gauacugcgacuuucugc

SEQ ID NO: 3660545 - RNA, 19 nt, Human
gauacugcgacuuucugcc

SEQ ID NO: 3660546 - RNA, 14 nt, Human
gauacuggaaguuu

SEQ ID NO: 3660547 - RNA, 16 nt, Human
gauacuggcacagagg

SEQ ID NO: 3660548 - RNA, 12 nt, Human
gauacuguugca

SEQ ID NO: 3660549 - RNA, 14 nt, Human
gauacuguugcacg

SEQ ID NO: 3660550 - RNA, 17 nt, Human
gauacuguugcacgugu

SEQ ID NO: 3660551 - RNA, 18 nt, Human
gauacuguugcacgugug

SEQ ID NO: 3660552 - RNA, 14 nt, Human
gauacuuauauuuu

SEQ ID NO: 3660553 - RNA, 13 nt, Human
gauacuuauuuaa

SEQ ID NO: 3660554 - RNA, 19 nt, Human
gauacuuauuuaaauagau

SEQ ID NO: 3660555 - RNA, 16 nt, Human
gauagaaagcauuaca

SEQ ID NO: 3660556 - RNA, 16 nt, Human
gauagaaauaaauagc

SEQ ID NO: 3660557 - RNA, 14 nt, Human
gauagaaaugccaa

SEQ ID NO: 3660558 - RNA, 17 nt, Human
gauagaagaaaaaagaa

SEQ ID NO: 3660559 - RNA, 17 nt, Human
gauagaagauguuugcu

SEQ ID NO: 3660560 - RNA, 20 nt, Human
gauagacacauaugaggggg

SEQ ID NO: 3660561 - RNA, 14 nt, Human
gauagaggaagccu

SEQ ID NO: 3660562 - RNA, 15 nt, Human
gauagaggaagccug

SEQ ID NO: 3660563 - RNA, 12 nt, Human
gauagagggggg

SEQ ID NO: 3660564 - RNA, 21 nt, Human
gauagaguaaaaagaaaacaa

SEQ ID NO: 3660565 - RNA, 13 nt, Human
gauagaguuccau

SEQ ID NO: 3660566 - RNA, 15 nt, Human
gauagauaacucuuu

SEQ ID NO: 3660567 - RNA, 23 nt, Human
gauagauaggucagugcaaauac

SEQ ID NO: 3660568 - RNA, 21 nt, Human
gauagaugcacuuaugcagua

SEQ ID NO: 3660569 - RNA, 14 nt, Human
gauagaugcccugc

SEQ ID NO: 3660570 - RNA, 12 nt, Human
gauagaugcugg

SEQ ID NO: 3660571 - RNA, 17 nt, Human
gauagaugcuggcccag

SEQ ID NO: 3660572 - RNA, 18 nt, Human
gauagaugcuggcccagg

SEQ ID NO: 3660573 - RNA, 15 nt, Human
gauagauuuggaaua

SEQ ID NO: 3660574 - RNA, 15 nt, Human
gauagcacagacccu

SEQ ID NO: 3660575 - RNA, 17 nt, Human
gauagcacagacccugc

SEQ ID NO: 3660576 - RNA, 19 nt, Human
gauagcacagacccugccc

SEQ ID NO: 3660577 - RNA, 22 nt, Human
gauagcacagacccugcccugu

SEQ ID NO: 3660578 - RNA, 12 nt, Human
gauagcacuuuc

SEQ ID NO: 3660579 - RNA, 20 nt, Human
gauagcacuuucuacaaugu

SEQ ID NO: 3660580 - RNA, 16 nt, Human
gauagcauaugacaaa

SEQ ID NO: 3660581 - RNA, 17 nt, Human
gauagcauuuuugauuu

SEQ ID NO: 3660582 - RNA, 23 nt, Human
gauagcauuuuugauuuaugcau

SEQ ID NO: 3660583 - RNA, 13 nt, Human
gauagccaaggcc

SEQ ID NO: 3660584 - RNA, 14 nt, Human
gauagccaaggcca

SEQ ID NO: 3660585 - RNA, 21 nt, Human
gauagcccuguccugguggua

SEQ ID NO: 3660586 - RNA, 20 nt, Human
gauagccuuccguaacccaa

SEQ ID NO: 3660587 - RNA, 14 nt, Human
gauagcguuggaau

SEQ ID NO: 3660588 - RNA, 15 nt, Human
gauagcguuggaauu

SEQ ID NO: 3660589 - RNA, 22 nt, Human
gauagcguuggaauuaaaacaa

SEQ ID NO: 3660590 - RNA, 23 nt, Human
gauagcguuggaauuaaaacaau

SEQ ID NO: 3660591 - RNA, 13 nt, Human
gauagcugugacu

SEQ ID NO: 3660592 - RNA, 20 nt, Human
gauagcuuuauuuuuuaagu

SEQ ID NO: 3660593 - RNA, 18 nt, Human
gauaggaaggucauuucc

SEQ ID NO: 3660594 - RNA, 15 nt, Human
gauaggaccuugggc

SEQ ID NO: 3660595 - RNA, 17 nt, Human
gauaggaccuugggcca

SEQ ID NO: 3660596 - RNA, 20 nt, Human
gauaggcacauagagaggga

SEQ ID NO: 3660597 - RNA, 12 nt, Human
gauaggcucugc

SEQ ID NO: 3660598 - RNA, 15 nt, Human
gauagggcugggcaa

SEQ ID NO: 3660599 - RNA, 22 nt, Human
gauagggcugggcaaggaaaaa

SEQ ID NO: 3660600 - RNA, 13 nt, Human
gauaggggcagag

SEQ ID NO: 3660601 - RNA, 17 nt, Human
gauaggucagugcaaau

SEQ ID NO: 3660602 - RNA, 18 nt, Human
gauaguagcauacauuua

SEQ ID NO: 3660603 - RNA, 14 nt, Human
gauaguagcuuccu

SEQ ID NO: 3660604 - RNA, 23 nt, Human
gauagucuuggaagcuguuugga

SEQ ID NO: 3660605 - RNA, 14 nt, Human
gauagucuuucagu

SEQ ID NO: 3660606 - RNA, 13 nt, Human
gauagugggacca

SEQ ID NO: 3660607 - RNA, 17 nt, Human
gauagugggauuuccag

SEQ ID NO: 3660608 - RNA, 21 nt, Human
gauaguuaucuguucuuuuga

SEQ ID NO: 3660609 - RNA, 22 nt, Human
gauaguugcuauuuuuguaaag

SEQ ID NO: 3660610 - RNA, 23 nt, Human
gauaguugcuauuuuuguaaagu

SEQ ID NO: 3660611 - RNA, 14 nt, Human
gauaguuuucaucc

SEQ ID NO: 3660612 - RNA, 23 nt, Human
gauaguuuucauccauaacugaa

SEQ ID NO: 3660613 - RNA, 14 nt, Human
gauauaaaaugugc

SEQ ID NO: 3660614 - RNA, 14 nt, Human
gauauaaacagcuu

SEQ ID NO: 3660615 - RNA, 15 nt, Human
gauauaaauauauau

SEQ ID NO: 3660616 - RNA, 16 nt, Human
gauauaaauauauaua

SEQ ID NO: 3660617 - RNA, 16 nt, Human
gauauaaauggcuggu

SEQ ID NO: 3660618 - RNA, 12 nt, Human
gauauaaauucu

SEQ ID NO: 3660619 - RNA, 13 nt, Human
gauauaaauucug

SEQ ID NO: 3660620 - RNA, 21 nt, Human
gauauaaauuuuuaagagaaa

SEQ ID NO: 3660621 - RNA, 18 nt, Human
gauauaagugcuguauaa

SEQ ID NO: 3660622 - RNA, 21 nt, Human
gauauaagugcuguauaaaau

SEQ ID NO: 3660623 - RNA, 23 nt, Human
gauauaagugcuguauaaaauca

SEQ ID NO: 3660624 - RNA, 17 nt, Human
gauauaaguguguguuu

SEQ ID NO: 3660625 - RNA, 21 nt, Human
gauauaaguguguguuuuuca

SEQ ID NO: 3660626 - RNA, 18 nt, Human
gauauacacggaugacuu

SEQ ID NO: 3660627 - RNA, 17 nt, Human
gauauacagaugaaaau

SEQ ID NO: 3660628 - RNA, 19 nt, Human
gauauacagaugaaaauuu

SEQ ID NO: 3660629 - RNA, 13 nt, Human
gauauaccaaauu

SEQ ID NO: 3660630 - RNA, 15 nt, Human
gauauacuuguuuuu

SEQ ID NO: 3660631 - RNA, 22 nt, Human
gauauacuuguuuuuguaaaga

SEQ ID NO: 3660632 - RNA, 16 nt, Human
gauauacuuuguggac

SEQ ID NO: 3660633 - RNA, 22 nt, Human
gauauacuuuguggaccaauua

SEQ ID NO: 3660634 - RNA, 12 nt, Human
gauauagaacag

SEQ ID NO: 3660635 - RNA, 19 nt, Human
gauauagaaguauaaagaa

SEQ ID NO: 3660636 - RNA, 14 nt, Human
gauauagagucauu

SEQ ID NO: 3660637 - RNA, 20 nt, Human
gauauagaucacauaacaga

SEQ ID NO: 3660638 - RNA, 21 nt, Human
gauauagcuaggugacauaua

SEQ ID NO: 3660639 - RNA, 19 nt, Human
gauauaguuuuacuuuuaa

SEQ ID NO: 3660640 - RNA, 21 nt, Human
gauauaguuuuacuuuuaaac

SEQ ID NO: 3660641 - RNA, 17 nt, Human
gauauauaaguguacau

SEQ ID NO: 3660642 - RNA, 20 nt, Human
gauauaucaugagugaauaa

SEQ ID NO: 3660643 - RNA, 23 nt, Human
gauauaugcucugcauguuacau

SEQ ID NO: 3660644 - RNA, 22 nt, Human
gauauauguguuuuucacauuu

SEQ ID NO: 3660645 - RNA, 19 nt, Human
gauauauguuuuugaaggc

SEQ ID NO: 3660646 - RNA, 13 nt, Human
gauauauuaaaaa

SEQ ID NO: 3660647 - RNA, 18 nt, Human
gauauauuaaaaauauaa

SEQ ID NO: 3660648 - RNA, 21 nt, Human
cucuucugagcuauuucaucu

SEQ ID NO: 3660649 - RNA, 22 nt, Human
cucuucugagcuauuucaucua

SEQ ID NO: 3660650 - RNA, 13 nt, Human
cucuucugcucca

SEQ ID NO: 3660651 - RNA, 15 nt, Human
cucuucugcuccacc

SEQ ID NO: 3660652 - RNA, 20 nt, Human
cucuucugcuccacccuugg

SEQ ID NO: 3660653 - RNA, 20 nt, Human
cucuucugcuuaggagagac

SEQ ID NO: 3660654 - RNA, 11 nt, Human
cucuucuggcu

SEQ ID NO: 3660655 - RNA, 15 nt, Human
cucuucugggccuga

SEQ ID NO: 3660656 - RNA, 19 nt, Human
cucuucuuauacagauaaa

SEQ ID NO: 3660657 - RNA, 20 nt, Human
cucuucuuccagguagcuga

SEQ ID NO: 3660658 - RNA, 16 nt, Human
cucuucuucccagcac

SEQ ID NO: 3660659 - RNA, 15 nt, Human
cucuucuucuucaga

SEQ ID NO: 3660660 - RNA, 14 nt, Human
cucuucuucuuucu

SEQ ID NO: 3660661 - RNA, 16 nt, Human
cucuucuuggggccca

SEQ ID NO: 3660662 - RNA, 20 nt, Human
cucuucuuggggcccagugc

SEQ ID NO: 3660663 - RNA, 22 nt, Human
cucuucuuuaaagggauggcaa

SEQ ID NO: 3660664 - RNA, 17 nt, Human
cucuucuuuagaacagg

SEQ ID NO: 3660665 - RNA, 22 nt, Human
cucuugaaauauaggaacuuaa

SEQ ID NO: 3660666 - RNA, 20 nt, Human
cucuugaagacacugaaaua

SEQ ID NO: 3660667 - RNA, 21 nt, Human
cucuugaagacacugaaauau

SEQ ID NO: 3660668 - RNA, 17 nt, Human
cucuugacccugcaccc

SEQ ID NO: 3660669 - RNA, 16 nt, Human
cucuugaccuuguaga

SEQ ID NO: 3660670 - RNA, 20 nt, Human
cucuugagaucuugguccug

SEQ ID NO: 3660671 - RNA, 18 nt, Human
cucuugagcaguggcugg

SEQ ID NO: 3660672 - RNA, 15 nt, Human
cucuugagccuggga

SEQ ID NO: 3660673 - RNA, 13 nt, Human
cucuugagcuggc

SEQ ID NO: 3660674 - RNA, 22 nt, Human
cucuugagcuggccucucuagc

SEQ ID NO: 3660675 - RNA, 16 nt, Human
cucuugaggccaggag

SEQ ID NO: 3660676 - RNA, 17 nt, Human
cucuugaggccaggagu

SEQ ID NO: 3660677 - RNA, 19 nt, Human
cugacuaaacuuuuuuucu

SEQ ID NO: 3660678 - RNA, 14 nt, Human
cugacuaagaaauu

SEQ ID NO: 3660679 - RNA, 15 nt, Human
cugacuacugggcaa

SEQ ID NO: 3660680 - RNA, 23 nt, Human
cugacuagaagggccaguccugc

SEQ ID NO: 3660681 - RNA, 18 nt, Human
cugacuagggagccaugu

SEQ ID NO: 3660682 - RNA, 21 nt, Human
cugacuagggagccauguuuc

SEQ ID NO: 3660683 - RNA, 18 nt, Human
cugacuauucuugaugua

SEQ ID NO: 3660684 - RNA, 19 nt, Human
cugacuauucuugauguaa

SEQ ID NO: 3660685 - RNA, 20 nt, Human
cugacuauucuugauguaaa

SEQ ID NO: 3660686 - RNA, 18 nt, Human
cugacucaacauguuacu

SEQ ID NO: 3660687 - RNA, 15 nt, Human
cugacucacaagaag

SEQ ID NO: 3660688 - RNA, 16 nt, Human
cugacucacaagaaga

SEQ ID NO: 3660689 - RNA, 21 nt, Human
cugacucacaagaagaccaga

SEQ ID NO: 3660690 - RNA, 22 nt, Human
cugacucacaccugaacugaac

SEQ ID NO: 3660691 - RNA, 15 nt, Human
cugacucagggcucc

SEQ ID NO: 3660692 - RNA, 16 nt, Human
cugacucagggcuccu

SEQ ID NO: 3660693 - RNA, 19 nt, Human
cugacucagggcuccuggg

SEQ ID NO: 3660694 - RNA, 16 nt, Human
cugacucaucauuugu

SEQ ID NO: 3660695 - RNA, 13 nt, Human
cugacuccagugg

SEQ ID NO: 3660696 - RNA, 20 nt, Human
cugacucccaaagagcugcc

SEQ ID NO: 3660697 - RNA, 17 nt, Human
cugacucccccaguccc

SEQ ID NO: 3660698 - RNA, 17 nt, Human
cugacuccucuaagcca

SEQ ID NO: 3660699 - RNA, 13 nt, Human
cugacuccuuaga

SEQ ID NO: 3660700 - RNA, 14 nt, Human
cugacucucuguga

SEQ ID NO: 3660701 - RNA, 12 nt, Human
cugacucugccc

SEQ ID NO: 3660702 - RNA, 17 nt, Human
cugacucuuaagaagac

SEQ ID NO: 3660703 - RNA, 13 nt, Human
cugacugacauga

SEQ ID NO: 3660704 - RNA, 14 nt, Human
cugacugccaagcc

SEQ ID NO: 3660705 - RNA, 15 nt, Human
cugacugcccagcau

SEQ ID NO: 3660706 - RNA, 18 nt, Human
cugacugcccagcauuug

SEQ ID NO: 3660707 - RNA, 13 nt, Human
cugacugcucaga

SEQ ID NO: 3660708 - RNA, 14 nt, Human
cugacugcucagaa

SEQ ID NO: 3660709 - RNA, 20 nt, Human
cugacuggauucauucucau

SEQ ID NO: 3660710 - RNA, 19 nt, Human
gaugcuucaugugaacgug

SEQ ID NO: 3660711 - RNA, 20 nt, Human
gaugcuucuucagagacucc

SEQ ID NO: 3660712 - RNA, 20 nt, Human
gaugcuugcggcaaaaggaa

SEQ ID NO: 3660713 - RNA, 16 nt, Human
gaugcuugggaagacu

SEQ ID NO: 3660714 - RNA, 16 nt, Human
gaugcuuguacauaau

SEQ ID NO: 3660715 - RNA, 23 nt, Human
gaugcuuuguuucuuucauauga

SEQ ID NO: 3660716 - RNA, 14 nt, Human
gaugcuuuuaacag

SEQ ID NO: 3660717 - RNA, 15 nt, Human
gaugcuuuuaacaga

SEQ ID NO: 3660718 - RNA, 16 nt, Human
gaugcuuuucugucuc

SEQ ID NO: 3660719 - RNA, 14 nt, Human
gauggaaacaaagu

SEQ ID NO: 3660720 - RNA, 17 nt, Human
gauggaacacggccaca

SEQ ID NO: 3660721 - RNA, 21 nt, Human
gauggaacaggcucagaucuc

SEQ ID NO: 3660722 - RNA, 20 nt, Human
gauggaacccuuuuggcccc

SEQ ID NO: 3660723 - RNA, 20 nt, Human
gauggaaccgcaggaagcug

SEQ ID NO: 3660724 - RNA, 13 nt, Human
gauggaaugaugg

SEQ ID NO: 3660725 - RNA, 20 nt, Human
gauggacaguucacacccug

SEQ ID NO: 3660726 - RNA, 16 nt, Human
gauggagaaggaaggc

SEQ ID NO: 3660727 - RNA, 22 nt, Human
gauggagacuccaugagaagcc

SEQ ID NO: 3660728 - RNA, 15 nt, Human
gauggagagagggga

SEQ ID NO: 3660729 - RNA, 22 nt, Human
gauggagcagagcaagucugca

SEQ ID NO: 3660730 - RNA, 22 nt, Human
gauggagcccaggcgggagcgg

SEQ ID NO: 3660731 - RNA, 19 nt, Human
gauggaggacuccaggcag

SEQ ID NO: 3660732 - RNA, 13 nt, Human
gauggaggagaag

SEQ ID NO: 3660733 - RNA, 16 nt, Human
gauggaggggaguguu

SEQ ID NO: 3660734 - RNA, 16 nt, Human
gauggagguuucauac

SEQ ID NO: 3660735 - RNA, 19 nt, Human
gauggaguucuugugccau

SEQ ID NO: 3660736 - RNA, 13 nt, Human
gauggaguuucua

SEQ ID NO: 3660737 - RNA, 18 nt, Human
gauggauaaccuauauga

SEQ ID NO: 3660738 - RNA, 22 nt, Human
gauggauuccaaccccaacucc

SEQ ID NO: 3660739 - RNA, 22 nt, Human
gauggauucucagauauuuaua

SEQ ID NO: 3660740 - RNA, 17 nt, Human
gauggauucuccacuca

SEQ ID NO: 3660741 - RNA, 22 nt, Human
gauggcacagggcaugaaauga

SEQ ID NO: 3660742 - RNA, 21 nt, Human
gauggcacuuagcuaucagaa

SEQ ID NO: 3660743 - RNA, 15 nt, Human
gauggcagcuguuua

SEQ ID NO: 3660744 - RNA, 20 nt, Human
gauggcaggacgugggcugg

SEQ ID NO: 3660745 - RNA, 15 nt, Human
gauggcaggauggcc

SEQ ID NO: 3660746 - RNA, 22 nt, Human
gauggcaggauggccuggccag

SEQ ID NO: 3660747 - RNA, 21 nt, Human
gauggcauccugugaaguccu

SEQ ID NO: 3660748 - RNA, 14 nt, Human
gauggccagccccu

SEQ ID NO: 3660749 - RNA, 14 nt, Human
gauggcccauccug

SEQ ID NO: 3660750 - RNA, 18 nt, Human
gauggcccauucuacuug

SEQ ID NO: 3660751 - RNA, 14 nt, Human
gauggccuuaauuu

SEQ ID NO: 3660752 - RNA, 21 nt, Human
gauggcuaaaaccaucauagu

SEQ ID NO: 3660753 - RNA, 21 nt, Human
gauggcuaguaucaaaagaaa

SEQ ID NO: 3660754 - RNA, 14 nt, Human
gauggcuccucuca

SEQ ID NO: 3660755 - RNA, 17 nt, Human
gauggcugugccucugc

SEQ ID NO: 3660756 - RNA, 19 nt, Human
gauggcugugccucugccu

SEQ ID NO: 3660757 - RNA, 13 nt, Human
gauggcuugucua

SEQ ID NO: 3660758 - RNA, 14 nt, Human
gaugggaaugaagc

SEQ ID NO: 3660759 - RNA, 22 nt, Human
gaugggacauuccaaagaacag

SEQ ID NO: 3660760 - RNA, 23 nt, Human
gaugggacuagagcuuucuuuca

SEQ ID NO: 3660761 - RNA, 14 nt, Human
gaugggacugggag

SEQ ID NO: 3660762 - RNA, 23 nt, Human
gaugggagcuccucuccuggagg

SEQ ID NO: 3660763 - RNA, 15 nt, Human
gaugggagugagaca

SEQ ID NO: 3660764 - RNA, 19 nt, Human
gaugggaugauugaagaaa

SEQ ID NO: 3660765 - RNA, 19 nt, Human
gaugggaugguggagggcc

SEQ ID NO: 3660766 - RNA, 13 nt, Human
gaugggauucugg

SEQ ID NO: 3660767 - RNA, 22 nt, Human
gaugggcaacccccagccugcu

SEQ ID NO: 3660768 - RNA, 23 nt, Human
gaugggcauaugugucagugggg

SEQ ID NO: 3660769 - RNA, 17 nt, Human
gaugggcaugggguggg

SEQ ID NO: 3660770 - RNA, 20 nt, Human
gaugggcauggggugggccu

SEQ ID NO: 3660771 - RNA, 22 nt, Human
gaugggcaugguguucuccugc

SEQ ID NO: 3660772 - RNA, 13 nt, Human
gaugggccaccgc

SEQ ID NO: 3660773 - RNA, 14 nt, Human
gaugggccaccgcc

SEQ ID NO: 3660774 - RNA, 18 nt, Human
gaugggccaccgccuugc

SEQ ID NO: 3660775 - RNA, 13 nt, Human
gaugggccugagu

SEQ ID NO: 3660776 - RNA, 20 nt, Human
gaugggccugcuuccugucu

SEQ ID NO: 3660777 - RNA, 18 nt, Human
gaugggcuuguuuucuug

SEQ ID NO: 3660778 - RNA, 14 nt, Human
gauggggaaggagg

SEQ ID NO: 3660779 - RNA, 12 nt, Human
gauggggagcgu

SEQ ID NO: 3660780 - RNA, 14 nt, Human
gauggggccacagc

SEQ ID NO: 3660781 - RNA, 15 nt, Human
gauggggccacagcc

SEQ ID NO: 3660782 - RNA, 14 nt, Human
gauggggcccugcc

SEQ ID NO: 3660783 - RNA, 15 nt, Human
gauggggcugcaccg

SEQ ID NO: 3660784 - RNA, 23 nt, Human
gauggggcugcaccggcuggccu

SEQ ID NO: 3660785 - RNA, 12 nt, Human
gauggggcuggg

SEQ ID NO: 3660786 - RNA, 21 nt, Human
gaugggggaaagcacaggugg

SEQ ID NO: 3660787 - RNA, 20 nt, Human
gaugggggaacucagaucca

SEQ ID NO: 3660788 - RNA, 22 nt, Human
gaugggggaacucagauccagg

SEQ ID NO: 3660789 - RNA, 17 nt, Human
gaugggggcagggcugu

SEQ ID NO: 3660790 - RNA, 20 nt, Human
gaugggggcagggcugugcu

SEQ ID NO: 3660791 - RNA, 22 nt, Human
gauggggugggguggagaacuc

SEQ ID NO: 3660792 - RNA, 20 nt, Human
gaugggucagguagggggga

SEQ ID NO: 3660793 - RNA, 15 nt, Human
gaugggucaguugua

SEQ ID NO: 3660794 - RNA, 19 nt, Human
gaugggugcuuggaggaag

SEQ ID NO: 3660795 - RNA, 22 nt, Human
gauggguucuaauuuuggaugg

SEQ ID NO: 3660796 - RNA, 18 nt, Human
gauggguuugacaagguu

SEQ ID NO: 3660797 - RNA, 15 nt, Human
gaugguaagaaacaa

SEQ ID NO: 3660798 - RNA, 13 nt, Human
gaugguaauucuu

SEQ ID NO: 3660799 - RNA, 20 nt, Human
gaugguacgugacccucugc

SEQ ID NO: 3660800 - RNA, 17 nt, Human
gaugguaguuuuuucau

SEQ ID NO: 3660801 - RNA, 17 nt, Human
gauggucuuacagcagg

SEQ ID NO: 3660802 - RNA, 21 nt, Human
gauggucuuacagcaggcagu

SEQ ID NO: 3660803 - RNA, 14 nt, Human
gauggugcaaugac

SEQ ID NO: 3660804 - RNA, 15 nt, Human
gauggugcaaugacc

SEQ ID NO: 3660805 - RNA, 16 nt, Human
gauggugcaaugaccu

SEQ ID NO: 3660806 - RNA, 17 nt, Human
gauggugcaaugaccuu

SEQ ID NO: 3660807 - RNA, 23 nt, Human
gauggugcaaugaccuuucaaua

SEQ ID NO: 3660808 - RNA, 14 nt, Human
gauggugcugagaa

SEQ ID NO: 3660809 - RNA, 16 nt, Human
gauggugcugagaagc

SEQ ID NO: 3660810 - RNA, 14 nt, Human
gaugguggagggcc

SEQ ID NO: 3660811 - RNA, 13 nt, Human
gauggugggcuuc

SEQ ID NO: 3660812 - RNA, 15 nt, Human
gauggugggcuucag

SEQ ID NO: 3660813 - RNA, 19 nt, Human
gauggugggcuucagggca

SEQ ID NO: 3660814 - RNA, 20 nt, Human
gaugguguagcccucccacu

SEQ ID NO: 3660815 - RNA, 20 nt, Human
gaugguguuacugcaguuga

SEQ ID NO: 3660816 - RNA, 18 nt, Human
gaugguuacacuguuaga

SEQ ID NO: 3660817 - RNA, 23 nt, Human
gaugguuacacuguuagaacacu

SEQ ID NO: 3660818 - RNA, 17 nt, Human
gaugguuauuuucuuuu

SEQ ID NO: 3660819 - RNA, 23 nt, Human
gaugguuauuuucuuuucuuuca

SEQ ID NO: 3660820 - RNA, 18 nt, Human
gaugguuccccuguucac

SEQ ID NO: 3660821 - RNA, 14 nt, Human
gauuaccagggacu

SEQ ID NO: 3660822 - RNA, 14 nt, Human
gauuacccaagcaa

SEQ ID NO: 3660823 - RNA, 17 nt, Human
gauuaccuccugagaaa

SEQ ID NO: 3660824 - RNA, 23 nt, Human
gauuacucuuugagauagaagaa

SEQ ID NO: 3660825 - RNA, 18 nt, Human
gauuacugccuauuuuaa

SEQ ID NO: 3660826 - RNA, 22 nt, Human
gauuacuggccuuuuucauuua

SEQ ID NO: 3660827 - RNA, 18 nt, Human
gauuacugucaauaaaca

SEQ ID NO: 3660828 - RNA, 20 nt, Human
gauuacuucucuauaaaaaa

SEQ ID NO: 3660829 - RNA, 15 nt, Human
gauuagaaauuaccu

SEQ ID NO: 3660830 - RNA, 20 nt, Human
gauuagaaauuaccugugga

SEQ ID NO: 3660831 - RNA, 22 nt, Human
gauuagaaugaaaauuguaugu

SEQ ID NO: 3660832 - RNA, 23 nt, Human
gauuagaauucuguauagauuag

SEQ ID NO: 3660833 - RNA, 18 nt, Human
gauuagacuggacagcuu

SEQ ID NO: 3660834 - RNA, 17 nt, Human
gauuagagccuguaaac

SEQ ID NO: 3660835 - RNA, 20 nt, Human
gauuagcaaggucauuucuu

SEQ ID NO: 3660836 - RNA, 12 nt, Human
gauuagcucugg

SEQ ID NO: 3660837 - RNA, 10 nt, Human
gauuagcuuu

SEQ ID NO: 3660838 - RNA, 13 nt, Human
gauuagcuuugug

SEQ ID NO: 3660839 - RNA, 14 nt, Human
gauuagcuuugugu

SEQ ID NO: 3660840 - RNA, 23 nt, Human
gauuagggcauuugagaaaugca

SEQ ID NO: 3660841 - RNA, 15 nt, Human
gauuaguaagaucuc

SEQ ID NO: 3660842 - RNA, 23 nt, Human
gauuaguuuucuuguugcuuugu

SEQ ID NO: 3660843 - RNA, 20 nt, Human
gauuauaaaauuaaucacaa

SEQ ID NO: 3660844 - RNA, 14 nt, Human
gauuauaaucagaa

SEQ ID NO: 3660845 - RNA, 13 nt, Human
gauuauaauuguu

SEQ ID NO: 3660846 - RNA, 13 nt, Human
gauuauagauucu

SEQ ID NO: 3660847 - RNA, 15 nt, Human
gauuauagauucuaa

SEQ ID NO: 3660848 - RNA, 17 nt, Human
gauuauagauucuaaag

SEQ ID NO: 3660849 - RNA, 18 nt, Human
gauuauagauucuaaaga

SEQ ID NO: 3660850 - RNA, 20 nt, Human
gauuauagauuggagccacc

SEQ ID NO: 3660851 - RNA, 20 nt, Human
gauuauaucaaaguauuugu

SEQ ID NO: 3660852 - RNA, 20 nt, Human
gauuaucuauuugugugugu

SEQ ID NO: 3660853 - RNA, 17 nt, Human
gauuauggaaaaauaaa

SEQ ID NO: 3660854 - RNA, 14 nt, Human
gauuauggagcuuu

SEQ ID NO: 3660855 - RNA, 13 nt, Human
gauuaugggucac

SEQ ID NO: 3660856 - RNA, 17 nt, Human
gauuaugguuuugugau

SEQ ID NO: 3660857 - RNA, 19 nt, Human
gauuauguagcaaaauaca

SEQ ID NO: 3660858 - RNA, 21 nt, Human
gauuaugucuuuuauauuugu

SEQ ID NO: 3660859 - RNA, 19 nt, Human
gauuauuaacgauguccaa

SEQ ID NO: 3660860 - RNA, 23 nt, Human
gauuauuaacuaauaugggcauu

SEQ ID NO: 3660861 - RNA, 13 nt, Human
gauuauucacuga

SEQ ID NO: 3660862 - RNA, 13 nt, Human
gauuauucagugu

SEQ ID NO: 3660863 - RNA, 13 nt, Human
gauuauucauuua

SEQ ID NO: 3660864 - RNA, 12 nt, Human
cugacugggagu

SEQ ID NO: 3660865 - RNA, 15 nt, Human
cugacugggggcaga

SEQ ID NO: 3660866 - RNA, 16 nt, Human
cugacuggugcugcag

SEQ ID NO: 3660867 - RNA, 17 nt, Human
cugacuguacuccuccc

SEQ ID NO: 3660868 - RNA, 18 nt, Human
cugacuguagcuuuggaa

SEQ ID NO: 3660869 - RNA, 14 nt, Human
cugacuguccucuc

SEQ ID NO: 3660870 - RNA, 16 nt, Human
cugacuguccucuccc

SEQ ID NO: 3660871 - RNA, 21 nt, Human
cugacugucgggcuuuaaaaa

SEQ ID NO: 3660872 - RNA, 20 nt, Human
cugacugucucccgggacua

SEQ ID NO: 3660873 - RNA, 19 nt, Human
cugacuuaagcaaaagaaa

SEQ ID NO: 3660874 - RNA, 17 nt, Human
cugacuucaucucccac

SEQ ID NO: 3660875 - RNA, 21 nt, Human
cugacuuccccgcauuccagg

SEQ ID NO: 3660876 - RNA, 23 nt, Human
cugacuuccccgcauuccaggcu

SEQ ID NO: 3660877 - RNA, 13 nt, Human
cugacuucuaagu

SEQ ID NO: 3660878 - RNA, 16 nt, Human
cugacuucugccugga

SEQ ID NO: 3660879 - RNA, 19 nt, Human
cugacuuggggaccuuuug

SEQ ID NO: 3660880 - RNA, 19 nt, Human
cugacuuucuuuuuugaua

SEQ ID NO: 3660881 - RNA, 14 nt, Human
cugacuuugcucuu

SEQ ID NO: 3660882 - RNA, 15 nt, Human
cugacuuugcucuuu

SEQ ID NO: 3660883 - RNA, 19 nt, Human
cugacuuugcuugcuuuga

SEQ ID NO: 3660884 - RNA, 14 nt, Human
cugagaaaacaagc

SEQ ID NO: 3660885 - RNA, 19 nt, Human
cugagaaaacgaaacugcu

SEQ ID NO: 3660886 - RNA, 21 nt, Human
cugagaaaacgaaacugcucu

SEQ ID NO: 3660887 - RNA, 23 nt, Human
cugagaaaaugagugacuagacg

SEQ ID NO: 3660888 - RNA, 12 nt, Human
cugagaaagacu

SEQ ID NO: 3660889 - RNA, 13 nt, Human
cugagaaagacua

SEQ ID NO: 3660890 - RNA, 18 nt, Human
cugagaaagacuauucaa

SEQ ID NO: 3660891 - RNA, 19 nt, Human
cugagaaagacuauucaaa

SEQ ID NO: 3660892 - RNA, 16 nt, Human
cugagaaagcccuguc

SEQ ID NO: 3660893 - RNA, 12 nt, Human
cugagaaccugg

SEQ ID NO: 3660894 - RNA, 16 nt, Human
cugagaaccuggccuu

SEQ ID NO: 3660895 - RNA, 17 nt, Human
cugagaagauugugaau

SEQ ID NO: 3660896 - RNA, 17 nt, Human
cugagaagguccuuaau

SEQ ID NO: 3660897 - RNA, 18 nt, Human
cugagaaugaacaaagac

SEQ ID NO: 3660898 - RNA, 16 nt, Human
cugagaauuccaagga

SEQ ID NO: 3660899 - RNA, 21 nt, Human
cugagaauuguugagauacuu

SEQ ID NO: 3660900 - RNA, 22 nt, Human
cugagacagcccgggcucugcc

SEQ ID NO: 3660901 - RNA, 14 nt, Human
cugagaccaguugg

SEQ ID NO: 3660902 - RNA, 23 nt, Human
cugagaccaguugggagcacugg

SEQ ID NO: 3660903 - RNA, 13 nt, Human
cugagacccagga

SEQ ID NO: 3660904 - RNA, 16 nt, Human
cugagaccccuggccu

SEQ ID NO: 3660905 - RNA, 19 nt, Human
cugagaccccuggccuccg

SEQ ID NO: 3660906 - RNA, 20 nt, Human
cugagaccccuggccuccgg

SEQ ID NO: 3660907 - RNA, 18 nt, Human
cugagacgucaugaggag

SEQ ID NO: 3660908 - RNA, 19 nt, Human
cugagacucacaggaagga

SEQ ID NO: 3660909 - RNA, 21 nt, Human
cugagacucagacaggaaagg

SEQ ID NO: 3660910 - RNA, 17 nt, Human
cugagacucucuuagga

SEQ ID NO: 3660911 - RNA, 14 nt, Human
cugagacugcggga

SEQ ID NO: 3660912 - RNA, 12 nt, Human
cugagacugugc

SEQ ID NO: 3660913 - RNA, 14 nt, Human
cugagagaaaauaa

SEQ ID NO: 3660914 - RNA, 20 nt, Human
cugagagaauuggcucaaua

SEQ ID NO: 3660915 - RNA, 16 nt, Human
cugagagacauggcuu

SEQ ID NO: 3660916 - RNA, 15 nt, Human
cugagagacccaagg

SEQ ID NO: 3660917 - RNA, 19 nt, Human
cugagagacccaaggagga

SEQ ID NO: 3660918 - RNA, 16 nt, Human
cugagagacuuuuaau

SEQ ID NO: 3660919 - RNA, 16 nt, Human
cugagagagcgcagcc

SEQ ID NO: 3660920 - RNA, 13 nt, Human
cugagagaggcca

SEQ ID NO: 3660921 - RNA, 21 nt, Human
cugagagaggcuaaaauguuu

SEQ ID NO: 3660922 - RNA, 14 nt, Human
cugagagaguggca

SEQ ID NO: 3660923 - RNA, 15 nt, Human
cugagagaucugcug

SEQ ID NO: 3660924 - RNA, 17 nt, Human
cugagagcccagaaaag

SEQ ID NO: 3660925 - RNA, 16 nt, Human
cugagagccccagcug

SEQ ID NO: 3660926 - RNA, 20 nt, Human
cugagaggacagagagaaau

SEQ ID NO: 3660927 - RNA, 12 nt, Human
cugagaggccac

SEQ ID NO: 3660928 - RNA, 13 nt, Human
cugagaggcccug

SEQ ID NO: 3660929 - RNA, 14 nt, Human
cugagaggcccugg

SEQ ID NO: 3660930 - RNA, 15 nt, Human
cugagaggcccugga

SEQ ID NO: 3660931 - RNA, 16 nt, Human
cugagaggcccuggau

SEQ ID NO: 3660932 - RNA, 14 nt, Human
cugagaggggaagc

SEQ ID NO: 3660933 - RNA, 17 nt, Human
cugagagucagcucucu

SEQ ID NO: 3660934 - RNA, 18 nt, Human
cugagagucagcucucug

SEQ ID NO: 3660935 - RNA, 15 nt, Human
cugagagucuagagg

SEQ ID NO: 3660936 - RNA, 13 nt, Human
cugagagucugca

SEQ ID NO: 3660937 - RNA, 19 nt, Human
cugagauacauacagaauu

SEQ ID NO: 3660938 - RNA, 18 nt, Human
cugagauaccagcgagga

SEQ ID NO: 3660939 - RNA, 12 nt, Human
cugagauaugaa

SEQ ID NO: 3660940 - RNA, 21 nt, Human
cugagaucaaaacgguuuuac

SEQ ID NO: 3660941 - RNA, 18 nt, Human
cugagauccccugagccc

SEQ ID NO: 3660942 - RNA, 20 nt, Human
cugagaugggcuucccaagg

SEQ ID NO: 3660943 - RNA, 20 nt, Human
cugagaugugaacacaucag

SEQ ID NO: 3660944 - RNA, 23 nt, Human
cugagauuauaggcaccuaccac

SEQ ID NO: 3660945 - RNA, 15 nt, Human
cugagauuuauuaaa

SEQ ID NO: 3660946 - RNA, 17 nt, Human
cugagauuuauuaaaga

SEQ ID NO: 3660947 - RNA, 14 nt, Human
cugagauuucaucu

SEQ ID NO: 3660948 - RNA, 16 nt, Human
cugagauuucaucugc

SEQ ID NO: 3660949 - RNA, 20 nt, Human
cugagauuucaucugcucuc

SEQ ID NO: 3660950 - RNA, 21 nt, Human
cugagauuucaucugcucucc

SEQ ID NO: 3660951 - RNA, 21 nt, Human
cugagcaaauguggcuccugg

SEQ ID NO: 3660952 - RNA, 19 nt, Human
cugagcaacgcuauuccag

SEQ ID NO: 3660953 - RNA, 20 nt, Human
cugagcaacgcuauuccagc

SEQ ID NO: 3660954 - RNA, 17 nt, Human
cugagcaagagcuggca

SEQ ID NO: 3660955 - RNA, 20 nt, Human
cugagcaagagcuggcaaag

SEQ ID NO: 3660956 - RNA, 15 nt, Human
cugagcaaugucugu

SEQ ID NO: 3660957 - RNA, 15 nt, Human
cugagcacccucugg

SEQ ID NO: 3660958 - RNA, 16 nt, Human
cugagcacccucugga

SEQ ID NO: 3660959 - RNA, 20 nt, Human
cugagcacccucuggauucu

SEQ ID NO: 3660960 - RNA, 20 nt, Human
cugagcaccgugucaagcug

SEQ ID NO: 3660961 - RNA, 15 nt, Human
cugagcaccucccag

SEQ ID NO: 3660962 - RNA, 17 nt, Human
cugagcaccugcuucau

SEQ ID NO: 3660963 - RNA, 15 nt, Human
cugagcacugccagg

SEQ ID NO: 3660964 - RNA, 16 nt, Human
cugagcacugccagga

SEQ ID NO: 3660965 - RNA, 17 nt, Human
cugagcacugccaggag

SEQ ID NO: 3660966 - RNA, 14 nt, Human
gauuuccaagccuc

SEQ ID NO: 3660967 - RNA, 16 nt, Human
gauuucccguggcccc

SEQ ID NO: 3660968 - RNA, 18 nt, Human
gauuucccguggccccag

SEQ ID NO: 3660969 - RNA, 22 nt, Human
gauuucccguggccccagccug

SEQ ID NO: 3660970 - RNA, 14 nt, Human
gauuuccucuugaa

SEQ ID NO: 3660971 - RNA, 20 nt, Human
gauuucgugggucuguuuuc

SEQ ID NO: 3660972 - RNA, 22 nt, Human
gauuucucuuugaaacaugcuu

SEQ ID NO: 3660973 - RNA, 12 nt, Human
gauuucugauuu

SEQ ID NO: 3660974 - RNA, 17 nt, Human
gauuucuguaaacucug

SEQ ID NO: 3660975 - RNA, 11 nt, Human
gauuucuguuu

SEQ ID NO: 3660976 - RNA, 19 nt, Human
gauuucuguuuagauaaua

SEQ ID NO: 3660977 - RNA, 12 nt, Human
gauuucuuaggg

SEQ ID NO: 3660978 - RNA, 14 nt, Human
gauuucuuugaaaa

SEQ ID NO: 3660979 - RNA, 17 nt, Human
gauuucuuugaaaaaaa

SEQ ID NO: 3660980 - RNA, 18 nt, Human
gauuucuuuucuuccugg

SEQ ID NO: 3660981 - RNA, 13 nt, Human
gauuugaacacuu

SEQ ID NO: 3660982 - RNA, 13 nt, Human
gauuugaacucag

SEQ ID NO: 3660983 - RNA, 22 nt, Human
gauuugaacucagaucugucug

SEQ ID NO: 3660984 - RNA, 17 nt, Human
gauuugaaggucuugau

SEQ ID NO: 3660985 - RNA, 12 nt, Human
gauuugaccucc

SEQ ID NO: 3660986 - RNA, 14 nt, Human
gauuugacuguuuu

SEQ ID NO: 3660987 - RNA, 21 nt, Human
gauuugacuguuuuuacccau

SEQ ID NO: 3660988 - RNA, 16 nt, Human
gauuugagauuuuuau

SEQ ID NO: 3660989 - RNA, 22 nt, Human
gauuugaggagcagcuucaguu

SEQ ID NO: 3660990 - RNA, 15 nt, Human
gauuugcauugaaca

SEQ ID NO: 3660991 - RNA, 21 nt, Human
gauuugcauugaacacaaacu

SEQ ID NO: 3660992 - RNA, 18 nt, Human
gauuugccacaucuuaaa

SEQ ID NO: 3660993 - RNA, 13 nt, Human
gauuugccauaga

SEQ ID NO: 3660994 - RNA, 17 nt, Human
gauuugcccauuuacac

SEQ ID NO: 3660995 - RNA, 19 nt, Human
gauuugcccauuuacacuu

SEQ ID NO: 3660996 - RNA, 21 nt, Human
gauuugcuaucaaaauaaauu

SEQ ID NO: 3660997 - RNA, 23 nt, Human
gauuugcucagugucuggcugca

SEQ ID NO: 3660998 - RNA, 15 nt, Human
gauuuggaagggaaa

SEQ ID NO: 3660999 - RNA, 22 nt, Human
gauuuggagcacucugaguuua

SEQ ID NO: 3661000 - RNA, 17 nt, Human
gauuugggcugaaugua

SEQ ID NO: 3661001 - RNA, 19 nt, Human
gauuugggcugaauguaug

SEQ ID NO: 3661002 - RNA, 22 nt, Human
gauuuggucaacacuaacauga

SEQ ID NO: 3661003 - RNA, 17 nt, Human
gauuuggugaauuugaa

SEQ ID NO: 3661004 - RNA, 19 nt, Human
gauuuguacuacaguucuu

SEQ ID NO: 3661005 - RNA, 17 nt, Human
gauuuguugauucucuc

SEQ ID NO: 3661006 - RNA, 14 nt, Human
gauuuguuuuagaa

SEQ ID NO: 3661007 - RNA, 19 nt, Human
gauuuguuuuuguauuuuu

SEQ ID NO: 3661008 - RNA, 22 nt, Human
gauuuuaaaauguacauguauu

SEQ ID NO: 3661009 - RNA, 22 nt, Human
gauuuuaaacuagaugaccuca

SEQ ID NO: 3661010 - RNA, 14 nt, Human
gauuuuaacucugu

SEQ ID NO: 3661011 - RNA, 16 nt, Human
gauuuuaacucugucu

SEQ ID NO: 3661012 - RNA, 21 nt, Human
gauuuuaaguuucucugcaga

SEQ ID NO: 3661013 - RNA, 23 nt, Human
gauuuuaauagggaauauaucuc

SEQ ID NO: 3661014 - RNA, 20 nt, Human
gauuuuaauggauuguuaau

SEQ ID NO: 3661015 - RNA, 18 nt, Human
gauuuuacaauugaaaug

SEQ ID NO: 3661016 - RNA, 20 nt, Human
gauuuuacaugaaguauuuu

SEQ ID NO: 3661017 - RNA, 19 nt, Human
gauuuuaggagcuaaggcu

SEQ ID NO: 3661018 - RNA, 19 nt, Human
gauuuuaguuuuauuuucu

SEQ ID NO: 3661019 - RNA, 20 nt, Human
gauuuuaucugugaauucag

SEQ ID NO: 3661020 - RNA, 13 nt, Human
gauuuuaugcuuu

SEQ ID NO: 3661021 - RNA, 14 nt, Human
gauuuuaugcuuua

SEQ ID NO: 3661022 - RNA, 19 nt, Human
gauuuuaugcuuuaaacau

SEQ ID NO: 3661023 - RNA, 13 nt, Human
gauuuuauguuga

SEQ ID NO: 3661024 - RNA, 14 nt, Human
gauuuuauguugac

SEQ ID NO: 3661025 - RNA, 16 nt, Human
gauuuuauguugacau

SEQ ID NO: 3661026 - RNA, 19 nt, Human
gauuuuauuauguaaaucc

SEQ ID NO: 3661027 - RNA, 19 nt, Human
gauuuucacauucuuggcu

SEQ ID NO: 3661028 - RNA, 15 nt, Human
cugagccucugcucc

SEQ ID NO: 3661029 - RNA, 18 nt, Human
cugagccugcagggaagc

SEQ ID NO: 3661030 - RNA, 19 nt, Human
cugagccugcagggaagcc

SEQ ID NO: 3661031 - RNA, 13 nt, Human
cugagccuggcca

SEQ ID NO: 3661032 - RNA, 12 nt, Human
cugagccugguc

SEQ ID NO: 3661033 - RNA, 12 nt, Human
cugagccuucag

SEQ ID NO: 3661034 - RNA, 16 nt, Human
cugagccuugggaccc

SEQ ID NO: 3661035 - RNA, 16 nt, Human
cugagccuuguaauuc

SEQ ID NO: 3661036 - RNA, 20 nt, Human
cugagcgaggagaugcuccu

SEQ ID NO: 3661037 - RNA, 14 nt, Human
cugagcgggaggca

SEQ ID NO: 3661038 - RNA, 16 nt, Human
cugagcuauguaguau

SEQ ID NO: 3661039 - RNA, 16 nt, Human
cugagcuauuucaucu

SEQ ID NO: 3661040 - RNA, 17 nt, Human
cugagcucacaaggcag

SEQ ID NO: 3661041 - RNA, 18 nt, Human
cugagcucacaaggcagc

SEQ ID NO: 3661042 - RNA, 19 nt, Human
cugagcucacaaggcagca

SEQ ID NO: 3661043 - RNA, 20 nt, Human
cugagcucacaaggcagcaa

SEQ ID NO: 3661044 - RNA, 23 nt, Human
cugagcucacaaggcagcaaggc

SEQ ID NO: 3661045 - RNA, 16 nt, Human
cugagcucagcgugga

SEQ ID NO: 3661046 - RNA, 16 nt, Human
cugagcuccaguggaa

SEQ ID NO: 3661047 - RNA, 18 nt, Human
cugagcuccccaccaccc

SEQ ID NO: 3661048 - RNA, 18 nt, Human
cugagcuccucugggcag

SEQ ID NO: 3661049 - RNA, 12 nt, Human
cugagcucugag

SEQ ID NO: 3661050 - RNA, 13 nt, Human
cugagcucugaga

SEQ ID NO: 3661051 - RNA, 17 nt, Human
cugagcucugagaggcc

SEQ ID NO: 3661052 - RNA, 15 nt, Human
cugagcugaccagcc

SEQ ID NO: 3661053 - RNA, 15 nt, Human
cugagcugagccagg

SEQ ID NO: 3661054 - RNA, 15 nt, Human
cugagcugccaucca

SEQ ID NO: 3661055 - RNA, 13 nt, Human
cugagcugcucug

SEQ ID NO: 3661056 - RNA, 16 nt, Human
cugagcugcucugaau

SEQ ID NO: 3661057 - RNA, 16 nt, Human
cugagcuggccucuca

SEQ ID NO: 3661058 - RNA, 12 nt, Human
cugagcugggau

SEQ ID NO: 3661059 - RNA, 11 nt, Human
cugagcuguca

SEQ ID NO: 3661060 - RNA, 14 nt, Human
cugagcuuggaagc

SEQ ID NO: 3661061 - RNA, 12 nt, Human
cugagcuuggcc

SEQ ID NO: 3661062 - RNA, 16 nt, Human
cugagcuuggccagaa

SEQ ID NO: 3661063 - RNA, 14 nt, Human
cugagcuuucugcu

SEQ ID NO: 3661064 - RNA, 15 nt, Human
cugagcuuugcaugu

SEQ ID NO: 3661065 - RNA, 22 nt, Human
cugagcuuuggacacacacagc

SEQ ID NO: 3661066 - RNA, 23 nt, Human
cugagcuuuggacgcacacagcu

SEQ ID NO: 3661067 - RNA, 18 nt, Human
cugaggaaaggccagcug

SEQ ID NO: 3661068 - RNA, 15 nt, Human
cugaggaagaacggg

SEQ ID NO: 3661069 - RNA, 23 nt, Human
cugaggaagagggacuguucuuu

SEQ ID NO: 3661070 - RNA, 20 nt, Human
cugaggaagcacagcagcau

SEQ ID NO: 3661071 - RNA, 21 nt, Human
cugaggaaucaacagggcagc

SEQ ID NO: 3661072 - RNA, 14 nt, Human
cugaggaauccaga

SEQ ID NO: 3661073 - RNA, 21 nt, Human
cugaggaauccagacccggcu

SEQ ID NO: 3661074 - RNA, 19 nt, Human
cugaggaauucuguauaga

SEQ ID NO: 3661075 - RNA, 16 nt, Human
cugaggaauuucaccu

SEQ ID NO: 3661076 - RNA, 20 nt, Human
cugaggacaaaguggaggag

SEQ ID NO: 3661077 - RNA, 23 nt, Human
cugaggacaaaguggaggagggc

SEQ ID NO: 3661078 - RNA, 15 nt, Human
cugaggacagaugcc

SEQ ID NO: 3661079 - RNA, 18 nt, Human
cugaggacagaugccucc

SEQ ID NO: 3661080 - RNA, 13 nt, Human
cugaggacagcug

SEQ ID NO: 3661081 - RNA, 16 nt, Human
cugaggacagcugucc

SEQ ID NO: 3661082 - RNA, 15 nt, Human
cugaggacugcacca

SEQ ID NO: 3661083 - RNA, 23 nt, Human
cugaggacugcaccauugcugcu

SEQ ID NO: 3661084 - RNA, 22 nt, Human
cugaggacuuaaaauauuccug

SEQ ID NO: 3661085 - RNA, 14 nt, Human
cugaggagcagcag

SEQ ID NO: 3661086 - RNA, 21 nt, Human
cugaggagcagcaggaggggg

SEQ ID NO: 3661087 - RNA, 13 nt, Human
cugaggaggccuc

SEQ ID NO: 3661088 - RNA, 16 nt, Human
cugaggaggccuccau

SEQ ID NO: 3661089 - RNA, 16 nt, Human
cugaggagucugaggu

SEQ ID NO: 3661090 - RNA, 21 nt, Human
cugaggauauggacacuggug

SEQ ID NO: 3661091 - RNA, 15 nt, Human
cugaggaucagaaag

SEQ ID NO: 3661092 - RNA, 17 nt, Human
cugaggaucagaaagua

SEQ ID NO: 3661093 - RNA, 18 nt, Human
cugaggaucagaaaguaa

SEQ ID NO: 3661094 - RNA, 19 nt, Human
cugaggaucagaguaaucc

SEQ ID NO: 3661095 - RNA, 16 nt, Human
cugaggaugaccagaa

SEQ ID NO: 3661096 - RNA, 15 nt, Human
cugaggaugagcugg

SEQ ID NO: 3661097 - RNA, 16 nt, Human
cugaggaugagcugga

SEQ ID NO: 3661098 - RNA, 17 nt, Human
cugaggaugagcuggaa

SEQ ID NO: 3661099 - RNA, 22 nt, Human
cugaggauuuaagggauggaaa

SEQ ID NO: 3661100 - RNA, 17 nt, Human
cugaggauuucaagccu

SEQ ID NO: 3661101 - RNA, 12 nt, Human
cugaggcaagag

SEQ ID NO: 3661102 - RNA, 15 nt, Human
cugaggcagaagaau

SEQ ID NO: 3661103 - RNA, 16 nt, Human
cugaggcagacagcag

SEQ ID NO: 3661104 - RNA, 18 nt, Human
cugaggcagacagcagcu

SEQ ID NO: 3661105 - RNA, 13 nt, Human
cugaggcaggaga

SEQ ID NO: 3661106 - RNA, 14 nt, Human
cugaggcagggaag

SEQ ID NO: 3661107 - RNA, 21 nt, Human
cugaggcagggaaguccccag

SEQ ID NO: 3661108 - RNA, 17 nt, Human
cugaggcaguuugagga

SEQ ID NO: 3661109 - RNA, 22 nt, Human
cugaggcauccagcagucucug

SEQ ID NO: 3661110 - RNA, 12 nt, Human
cugaggccacac

SEQ ID NO: 3661111 - RNA, 19 nt, Human
gcaaauuugcauuaaauua

SEQ ID NO: 3661112 - RNA, 21 nt, Human
gcaaauuuuuauuuuuuagug

SEQ ID NO: 3661113 - RNA, 14 nt, Human
gcaacaaacugcac

SEQ ID NO: 3661114 - RNA, 15 nt, Human
gcaacaaacugcaca

SEQ ID NO: 3661115 - RNA, 15 nt, Human
gcaacaacaauuggu

SEQ ID NO: 3661116 - RNA, 14 nt, Human
gcaacaauuuauga

SEQ ID NO: 3661117 - RNA, 14 nt, Human
gcaacaauuuucag

SEQ ID NO: 3661118 - RNA, 16 nt, Human
gcaacacaagcuggaa

SEQ ID NO: 3661119 - RNA, 23 nt, Human
gcaacacaagcuggaagcacaug

SEQ ID NO: 3661120 - RNA, 14 nt, Human
gcaacacagccugg

SEQ ID NO: 3661121 - RNA, 19 nt, Human
gcaacacuggucugcuguu

SEQ ID NO: 3661122 - RNA, 19 nt, Human
gcaacagacaagugacugu

SEQ ID NO: 3661123 - RNA, 12 nt, Human
gcaacagaucug

SEQ ID NO: 3661124 - RNA, 18 nt, Human
gcaacagaucuggaaccu

SEQ ID NO: 3661125 - RNA, 15 nt, Human
gcaacaggcugggcu

SEQ ID NO: 3661126 - RNA, 19 nt, Human
gcaacaggcugggcuucag

SEQ ID NO: 3661127 - RNA, 13 nt, Human
gcaacauccaaaa

SEQ ID NO: 3661128 - RNA, 18 nt, Human
gcaacaucuagcaaaugu

SEQ ID NO: 3661129 - RNA, 22 nt, Human
gcaacaugaugagguaguaccu

SEQ ID NO: 3661130 - RNA, 13 nt, Human
gcaacauggcuuu

SEQ ID NO: 3661131 - RNA, 14 nt, Human
gcaacauucauugc

SEQ ID NO: 3661132 - RNA, 20 nt, Human
gcaaccacaggcagcauuua

SEQ ID NO: 3661133 - RNA, 13 nt, Human
gcaaccaccacca

SEQ ID NO: 3661134 - RNA, 18 nt, Human
gcaaccagagcacuguau

SEQ ID NO: 3661135 - RNA, 20 nt, Human
gcaaccaggaacagcaaaug

SEQ ID NO: 3661136 - RNA, 18 nt, Human
gcaaccaguuggcuaggg

SEQ ID NO: 3661137 - RNA, 18 nt, Human
gcaaccauauagaaagcu

SEQ ID NO: 3661138 - RNA, 16 nt, Human
gcaaccccaguucugc

SEQ ID NO: 3661139 - RNA, 18 nt, Human
gcaaccccaguucugcuc

SEQ ID NO: 3661140 - RNA, 20 nt, Human
gcaaccccaguucugcuccu

SEQ ID NO: 3661141 - RNA, 24 nt, Human
gcaaccccaguucugcuccucucc

SEQ ID NO: 3661142 - RNA, 16 nt, Human
gcaacccccagccugc

SEQ ID NO: 3661143 - RNA, 19 nt, Human
gcaaccccuggaccccagc

SEQ ID NO: 3661144 - RNA, 15 nt, Human
gcaacccgugccaag

SEQ ID NO: 3661145 - RNA, 19 nt, Human
gcaacccgugccaagucca

SEQ ID NO: 3661146 - RNA, 14 nt, Human
gcaaccgcuucccu

SEQ ID NO: 3661147 - RNA, 19 nt, Human
gcaaccguggcccuuccug

SEQ ID NO: 3661148 - RNA, 23 nt, Human
gcaaccguggcccuuccuggaca

SEQ ID NO: 3661149 - RNA, 24 nt, Human
gcaaccguggcccuuccuggacag

SEQ ID NO: 3661150 - RNA, 20 nt, Human
gcaaccuccgccucuugggu

SEQ ID NO: 3661151 - RNA, 20 nt, Human
gcaaccucugcuucccaggu

SEQ ID NO: 3661152 - RNA, 18 nt, Human
gcaaccuggguccaaaua

SEQ ID NO: 3661153 - RNA, 19 nt, Human
gcaaccuggguccaaauaa

SEQ ID NO: 3661154 - RNA, 17 nt, Human
gcaaccuguaagacuga

SEQ ID NO: 3661155 - RNA, 23 nt, Human
gcaacgaagaaaaaaaauaacac

SEQ ID NO: 3661156 - RNA, 20 nt, Human
gcaacgaucacaaaugacuu

SEQ ID NO: 3661157 - RNA, 22 nt, Human
gcaacgaucacaaaugacuuua

SEQ ID NO: 3661158 - RNA, 17 nt, Human
gcaacgcuauuccagcu

SEQ ID NO: 3661159 - RNA, 18 nt, Human
gcaacgcuauuccagcug

SEQ ID NO: 3661160 - RNA, 22 nt, Human
gcaacggucuccugacuggugc

SEQ ID NO: 3661161 - RNA, 13 nt, Human
gcaacuauucaca

SEQ ID NO: 3661162 - RNA, 22 nt, Human
gcaacucaaggacuuugcagcc

SEQ ID NO: 3661163 - RNA, 14 nt, Human
gcaacucaucuuag

SEQ ID NO: 3661164 - RNA, 15 nt, Human
gcaacucuugauuau

SEQ ID NO: 3661165 - RNA, 15 nt, Human
gcaacugaacaaaaa

SEQ ID NO: 3661166 - RNA, 13 nt, Human
gcaacugaauaaa

SEQ ID NO: 3661167 - RNA, 18 nt, Human
gcaacugaauaaauaccu

SEQ ID NO: 3661168 - RNA, 21 nt, Human
gcaacugaauaaauaccucuu

SEQ ID NO: 3661169 - RNA, 15 nt, Human
gcaacugacacuccc

SEQ ID NO: 3661170 - RNA, 21 nt, Human
gcaacugaggcagacagcagc

SEQ ID NO: 3661171 - RNA, 18 nt, Human
gcaacugcauuggcuuug

SEQ ID NO: 3661172 - RNA, 20 nt, Human
gcaacugcugaugcucaugg

SEQ ID NO: 3661173 - RNA, 17 nt, Human
gcaacuucaguccuggg

SEQ ID NO: 3661174 - RNA, 20 nt, Human
gcaacuuguccuagcacaga

SEQ ID NO: 3661175 - RNA, 21 nt, Human
gcaacuuguccuagcacagau

SEQ ID NO: 3661176 - RNA, 22 nt, Human
gcaacuugucuuuuucuggacu

SEQ ID NO: 3661177 - RNA, 17 nt, Human
gcaacuuuaagcagcuc

SEQ ID NO: 3661178 - RNA, 13 nt, Human
gcaagaaaagagu

SEQ ID NO: 3661179 - RNA, 20 nt, Human
gcaagaacucaucacugugg

SEQ ID NO: 3661180 - RNA, 22 nt, Human
gcaagaacucaucacuguggcu

SEQ ID NO: 3661181 - RNA, 19 nt, Human
gcaagaagaucacgcuccc

SEQ ID NO: 3661182 - RNA, 21 nt, Human
gcaagaaggcaaaaauaguuu

SEQ ID NO: 3661183 - RNA, 23 nt, Human
gcaagaaggcaaaaauaguuugg

SEQ ID NO: 3661184 - RNA, 16 nt, Human
gcaagaauaaaaaaga

SEQ ID NO: 3661185 - RNA, 20 nt, Human
gcaagaaugguggcuucuuu

SEQ ID NO: 3661186 - RNA, 16 nt, Human
gcaagacccugucucu

SEQ ID NO: 3661187 - RNA, 23 nt, Human
gcaagacgcugugcugcccugcc

SEQ ID NO: 3661188 - RNA, 22 nt, Human
gcaagagagaaccuaacuguau

SEQ ID NO: 3661189 - RNA, 22 nt, Human
gcaagagccuugguguccaccu

SEQ ID NO: 3661190 - RNA, 18 nt, Human
gcaagaggcaagcugaaa

SEQ ID NO: 3661191 - RNA, 18 nt, Human
gcaagaggccguggcugc

SEQ ID NO: 3661192 - RNA, 22 nt, Human
gcaagaggccguggcugcugug

SEQ ID NO: 3661193 - RNA, 22 nt, Human
gcaagaggggguggaggggugu

SEQ ID NO: 3661194 - RNA, 18 nt, Human
gcaagagugauugcagcu

SEQ ID NO: 3661195 - RNA, 19 nt, Human
gcaagagugauugcagcuu

SEQ ID NO: 3661196 - RNA, 19 nt, Human
gcaagaguguggaggcuga

SEQ ID NO: 3661197 - RNA, 19 nt, Human
gcaagauagauuuggaaua

SEQ ID NO: 3661198 - RNA, 15 nt, Human
gcaagauauuuauau

SEQ ID NO: 3661199 - RNA, 15 nt, Human
gcaagaugugaauua

SEQ ID NO: 3661200 - RNA, 12 nt, Human
gcaagauguggg

SEQ ID NO: 3661201 - RNA, 18 nt, Human
gcaagauucugaaacauu

SEQ ID NO: 3661202 - RNA, 16 nt, Human
gcaagauugauguuuc

SEQ ID NO: 3661203 - RNA, 14 nt, Human
gcaagauugugucc

SEQ ID NO: 3661204 - RNA, 14 nt, Human
gcaagcacaucugc

SEQ ID NO: 3661205 - RNA, 15 nt, Human
gcaagcaccaucccc

SEQ ID NO: 3661206 - RNA, 21 nt, Human
gcaagcacugcaugggcaagc

SEQ ID NO: 3661207 - RNA, 12 nt, Human
gcaagcagagga

SEQ ID NO: 3661208 - RNA, 14 nt, Human
gcaagcaguuucaa

SEQ ID NO: 3661209 - RNA, 10 nt, Human
gcaagccaga

SEQ ID NO: 3661210 - RNA, 15 nt, Human
gcaagccccugcucc

SEQ ID NO: 3661211 - RNA, 20 nt, Human
gcaagccuguaaucccagcu

SEQ ID NO: 3661212 - RNA, 16 nt, Human
gcaagcgacgacagau

SEQ ID NO: 3661213 - RNA, 14 nt, Human
gcaagcuaaccuua

SEQ ID NO: 3661214 - RNA, 13 nt, Human
gcaagcucccaag

SEQ ID NO: 3661215 - RNA, 19 nt, Human
gcaagcucccaagggaugg

SEQ ID NO: 3661216 - RNA, 18 nt, Human
gcaagcuccgcaggacuu

SEQ ID NO: 3661217 - RNA, 14 nt, Human
gcaagcucucuugc

SEQ ID NO: 3661218 - RNA, 22 nt, Human
gcaagcugccgaaccaaaagaa

SEQ ID NO: 3661219 - RNA, 13 nt, Human
gcaagcuggguaa

SEQ ID NO: 3661220 - RNA, 22 nt, Human
gcaagcuuggcuguagaaggag

SEQ ID NO: 3661221 - RNA, 19 nt, Human
gcaagcuuuuuuauuuuuu

SEQ ID NO: 3661222 - RNA, 16 nt, Human
gcaaggaaaaagaaaa

SEQ ID NO: 3661223 - RNA, 13 nt, Human
gcaaggaaggaaa

SEQ ID NO: 3661224 - RNA, 17 nt, Human
gcaaggaccuaaaacau

SEQ ID NO: 3661225 - RNA, 18 nt, Human
gcaaggagauuuacaacu

SEQ ID NO: 3661226 - RNA, 16 nt, Human
gcaaggagcacaagcc

SEQ ID NO: 3661227 - RNA, 13 nt, Human
gcaaggaggcugg

SEQ ID NO: 3661228 - RNA, 13 nt, Human
gcaaggcagccgu

SEQ ID NO: 3661229 - RNA, 11 nt, Human
gcaaggcaggu

SEQ ID NO: 3661230 - RNA, 13 nt, Human
gcaaggcaggugc

SEQ ID NO: 3661231 - RNA, 13 nt, Human
gcaaggccaccuc

SEQ ID NO: 3661232 - RNA, 14 nt, Human
gcaaggccaccucu

SEQ ID NO: 3661233 - RNA, 20 nt, Human
gcaaggccaccucuuccugg

SEQ ID NO: 3661234 - RNA, 18 nt, Human
gcaaggcccgagcagcug

SEQ ID NO: 3661235 - RNA, 19 nt, Human
gcaaggcccgagcagcuga

SEQ ID NO: 3661236 - RNA, 18 nt, Human
gcacccuucuuuucucau

SEQ ID NO: 3661237 - RNA, 16 nt, Human
gcaccgaagcccagag

SEQ ID NO: 3661238 - RNA, 15 nt, Human
gcaccgaauauugag

SEQ ID NO: 3661239 - RNA, 13 nt, Human
gcaccgaccacgg

SEQ ID NO: 3661240 - RNA, 21 nt, Human
gcaccgaccacggggccgaca

SEQ ID NO: 3661241 - RNA, 20 nt, Human
gcaccgacuagacacacaaa

SEQ ID NO: 3661242 - RNA, 20 nt, Human
gcaccgccggccagcuggga

SEQ ID NO: 3661243 - RNA, 14 nt, Human
gcaccgccuucucu

SEQ ID NO: 3661244 - RNA, 22 nt, Human
gcaccgcggcgcuucccagcac

SEQ ID NO: 3661245 - RNA, 22 nt, Human
gcaccgcuuuuguucucgcaaa

SEQ ID NO: 3661246 - RNA, 19 nt, Human
gcaccggaccagccuggcc

SEQ ID NO: 3661247 - RNA, 16 nt, Human
gcaccggcuggccugg

SEQ ID NO: 3661248 - RNA, 17 nt, Human
gcaccggcuggccuggc

SEQ ID NO: 3661249 - RNA, 20 nt, Human
gcaccggggccugggcagga

SEQ ID NO: 3661250 - RNA, 19 nt, Human
gcaccgugucaagcugcuc

SEQ ID NO: 3661251 - RNA, 15 nt, Human
gcaccguucugugca

SEQ ID NO: 3661252 - RNA, 19 nt, Human
gcaccuaaaccaccagugc

SEQ ID NO: 3661253 - RNA, 14 nt, Human
gcaccuaaagaaaa

SEQ ID NO: 3661254 - RNA, 17 nt, Human
gcaccuaaagaaaaaca

SEQ ID NO: 3661255 - RNA, 22 nt, Human
aacauccuuucuauugaaaaau

SEQ ID NO: 3661256 - RNA, 19 nt, Human
aacauccuuugcagggcag

SEQ ID NO: 3661257 - RNA, 21 nt, Human
aacauccuuugcagggcagcc

SEQ ID NO: 3661258 - RNA, 12 nt, Human
aacaucuagaaa

SEQ ID NO: 3661259 - RNA, 17 nt, Human
aacaucuagcaaauguu

SEQ ID NO: 3661260 - RNA, 16 nt, Human
aacaucuucaacaugu

SEQ ID NO: 3661261 - RNA, 21 nt, Human
aacaucuuugaaauuauguaa

SEQ ID NO: 3661262 - RNA, 20 nt, Human
aacaugaaagucuagaaaua

SEQ ID NO: 3661263 - RNA, 18 nt, Human
aacaugaaaugauagauu

SEQ ID NO: 3661264 - RNA, 15 nt, Human
aacaugaacaaauuu

SEQ ID NO: 3661265 - RNA, 22 nt, Human
aacaugaacacccuuagaaaau

SEQ ID NO: 3661266 - RNA, 13 nt, Human
aacaugaaucaaa

SEQ ID NO: 3661267 - RNA, 20 nt, Human
aacaugagaaacgcuuaugu

SEQ ID NO: 3661268 - RNA, 17 nt, Human
aacaugaugagguagua

SEQ ID NO: 3661269 - RNA, 21 nt, Human
aacaugaugagguaguaccuu

SEQ ID NO: 3661270 - RNA, 19 nt, Human
aacaugcaauuuugcauuu

SEQ ID NO: 3661271 - RNA, 16 nt, Human
aacaugcacugauguu

SEQ ID NO: 3661272 - RNA, 12 nt, Human
aacaugcagaac

SEQ ID NO: 3661273 - RNA, 13 nt, Human
aacaugcaguuug

SEQ ID NO: 3661274 - RNA, 21 nt, Human
aacaugcaguuugaaauucug

SEQ ID NO: 3661275 - RNA, 14 nt, Human
aacaugcccuguuc

SEQ ID NO: 3661276 - RNA, 21 nt, Human
aacaugccugccccaaacaaa

SEQ ID NO: 3661277 - RNA, 18 nt, Human
aacaugcuggugaauauu

SEQ ID NO: 3661278 - RNA, 18 nt, Human
aacaugcuguacauacuu

SEQ ID NO: 3661279 - RNA, 21 nt, Human
aacaugcuguacauacuuuuu

SEQ ID NO: 3661280 - RNA, 16 nt, Human
aacaugcuucaugaaa

SEQ ID NO: 3661281 - RNA, 14 nt, Human
aacauggacuugua

SEQ ID NO: 3661282 - RNA, 20 nt, Human
aacauggacuuguauauuug

SEQ ID NO: 3661283 - RNA, 16 nt, Human
aacaugguuuaaaaga

SEQ ID NO: 3661284 - RNA, 20 nt, Human
aacauguaaccggcauguuu

SEQ ID NO: 3661285 - RNA, 22 nt, Human
aacauguaauauaaagauguua

SEQ ID NO: 3661286 - RNA, 21 nt, Human
aacauguaauuaaguacuaug

SEQ ID NO: 3661287 - RNA, 15 nt, Human
aacauguaggaagua

SEQ ID NO: 3661288 - RNA, 15 nt, Human
aacauguauuuaugu

SEQ ID NO: 3661289 - RNA, 21 nt, Human
aacauguauuuauguaaugaa

SEQ ID NO: 3661290 - RNA, 17 nt, Human
aacaugugaaaagaaua

SEQ ID NO: 3661291 - RNA, 14 nt, Human
aacauguuaaacca

SEQ ID NO: 3661292 - RNA, 20 nt, Human
aacauguuaaugacaauauu

SEQ ID NO: 3661293 - RNA, 16 nt, Human
aacauguuacugacca

SEQ ID NO: 3661294 - RNA, 17 nt, Human
aacauguuacugaccag

SEQ ID NO: 3661295 - RNA, 13 nt, Human
aacauguuccuga

SEQ ID NO: 3661296 - RNA, 18 nt, Human
aacauguugguauuuauc

SEQ ID NO: 3661297 - RNA, 20 nt, Human
aacauguuuacuuuucaggg

SEQ ID NO: 3661298 - RNA, 19 nt, Human
aacauguuuccagcauucc

SEQ ID NO: 3661299 - RNA, 19 nt, Human
aacauuaaaaauggaacug

SEQ ID NO: 3661300 - RNA, 21 nt, Human
aacauuaaaacaauauuguuu

SEQ ID NO: 3661301 - RNA, 23 nt, Human
aacauuaaaacaauauuguuucu

SEQ ID NO: 3661302 - RNA, 13 nt, Human
aacauuaaaauau

SEQ ID NO: 3661303 - RNA, 12 nt, Human
aacauuaaaugu

SEQ ID NO: 3661304 - RNA, 14 nt, Human
aacauuaaaugucu

SEQ ID NO: 3661305 - RNA, 20 nt, Human
aacauuaauagcagccuuuc

SEQ ID NO: 3661306 - RNA, 14 nt, Human
aacauuaauguuga

SEQ ID NO: 3661307 - RNA, 22 nt, Human
aacauuacagggaaugccugag

SEQ ID NO: 3661308 - RNA, 21 nt, Human
aacauuacucugaaauuguaa

SEQ ID NO: 3661309 - RNA, 16 nt, Human
aacauuaguacuuuau

SEQ ID NO: 3661310 - RNA, 17 nt, Human
aacauuaguacuuuaua

SEQ ID NO: 3661311 - RNA, 15 nt, Human
aacauuauauugcaa

SEQ ID NO: 3661312 - RNA, 23 nt, Human
aacauuauuaaguaacuuauuua

SEQ ID NO: 3661313 - RNA, 12 nt, Human
aacauuauuuau

SEQ ID NO: 3661314 - RNA, 13 nt, Human
aacauucaggagc

SEQ ID NO: 3661315 - RNA, 16 nt, Human
aacauucauagucuuu

SEQ ID NO: 3661316 - RNA, 13 nt, Human
aacauuccaagaa

SEQ ID NO: 3661317 - RNA, 20 nt, Human
aacauuccaaggaguuggaa

SEQ ID NO: 3661318 - RNA, 17 nt, Human
aacauuccuaaaaugcu

SEQ ID NO: 3661319 - RNA, 16 nt, Human
aacauuccucaaaaug

SEQ ID NO: 3661320 - RNA, 19 nt, Human
aacauucuaucuacugauu

SEQ ID NO: 3661321 - RNA, 15 nt, Human
aacauucuauuucaa

SEQ ID NO: 3661322 - RNA, 17 nt, Human
aacauucugauuuggaa

SEQ ID NO: 3661323 - RNA, 18 nt, Human
aacauugaaguaaugaau

SEQ ID NO: 3661324 - RNA, 19 nt, Human
aacauugaaguaaugaauu

SEQ ID NO: 3661325 - RNA, 17 nt, Human
aacauugaccaagaacu

SEQ ID NO: 3661326 - RNA, 18 nt, Human
aacauugaccaagaacug

SEQ ID NO: 3661327 - RNA, 21 nt, Human
aacauugaccaagaacugcau

SEQ ID NO: 3661328 - RNA, 18 nt, Human
aacauugauugcuguguc

SEQ ID NO: 3661329 - RNA, 14 nt, Human
aacauugcaauaga

SEQ ID NO: 3661330 - RNA, 21 nt, Human
aacauugcauauaacuuauau

SEQ ID NO: 3661331 - RNA, 22 nt, Human
aacauugcauauaacuuauauu

SEQ ID NO: 3661332 - RNA, 22 nt, Human
aacauuggaagcagguuaaaug

SEQ ID NO: 3661333 - RNA, 16 nt, Human
aacauuggaauguucu

SEQ ID NO: 3661334 - RNA, 16 nt, Human
aacauuggauuauccu

SEQ ID NO: 3661335 - RNA, 14 nt, Human
aacauuguagccuc

SEQ ID NO: 3661336 - RNA, 22 nt, Human
aacauuguccccaaugaauaua

SEQ ID NO: 3661337 - RNA, 17 nt, Human
aacauuuauuuuaugag

SEQ ID NO: 3661338 - RNA, 15 nt, Human
aacauuuauuuugac

SEQ ID NO: 3661339 - RNA, 19 nt, Human
aacauuuauuuugacauaa

SEQ ID NO: 3661340 - RNA, 22 nt, Human
aacauuuauuuuuuuuaaagaa

SEQ ID NO: 3661341 - RNA, 14 nt, Human
aacauuucauaauu

SEQ ID NO: 3661342 - RNA, 19 nt, Human
aacauuucuguaaauacca

SEQ ID NO: 3661343 - RNA, 14 nt, Human
aacauuugccuugc

SEQ ID NO: 3661344 - RNA, 22 nt, Human
aacauuugccuugcagaacugc

SEQ ID NO: 3661345 - RNA, 16 nt, Human
aacauuugcugccauu

SEQ ID NO: 3661346 - RNA, 15 nt, Human
aacauuugcuguuuu

SEQ ID NO: 3661347 - RNA, 16 nt, Human
aacauuugcuguuuua

SEQ ID NO: 3661348 - RNA, 13 nt, Human
aacauuugugaua

SEQ ID NO: 3661349 - RNA, 15 nt, Human
aacauuuguguguua

SEQ ID NO: 3661350 - RNA, 17 nt, Human
aacauuuucucuuagaa

SEQ ID NO: 3661351 - RNA, 20 nt, Human
aacauuuugagaacaaagau

SEQ ID NO: 3661352 - RNA, 15 nt, Human
aacauuuuguucuua

SEQ ID NO: 3661353 - RNA, 13 nt, Human
aacauuuuuaagu

SEQ ID NO: 3661354 - RNA, 13 nt, Human
aacauuuuuggua

SEQ ID NO: 3661355 - RNA, 16 nt, Human
aaccaaaaugacaucu

SEQ ID NO: 3661356 - RNA, 19 nt, Human
aaccaaagagacuggagca

SEQ ID NO: 3661357 - RNA, 19 nt, Human
aaccaaagagggcuuccuc

SEQ ID NO: 3661358 - RNA, 13 nt, Human
aaccaaaggacau

SEQ ID NO: 3661359 - RNA, 16 nt, Human
aaccaaauauuccaga

SEQ ID NO: 3661360 - RNA, 22 nt, Human
aaccaaaucacugaacuuugcu

SEQ ID NO: 3661361 - RNA, 15 nt, Human
aaccaaaucuggaag

SEQ ID NO: 3661362 - RNA, 13 nt, Human
aaccaacacccaa

SEQ ID NO: 3661363 - RNA, 20 nt, Human
aaccaacccuucccugaaaa

SEQ ID NO: 3661364 - RNA, 16 nt, Human
aaccaacuuuucuauu

SEQ ID NO: 3661365 - RNA, 14 nt, Human
aaccaagagauugc

SEQ ID NO: 3661366 - RNA, 10 nt, Human
aaccaagagg

SEQ ID NO: 3661367 - RNA, 13 nt, Human
aaccaagaggcug

SEQ ID NO: 3661368 - RNA, 14 nt, Human
aaccaagaggcugg

SEQ ID NO: 3661369 - RNA, 21 nt, Human
aaccaagaucuauaaagcgau

SEQ ID NO: 3661370 - RNA, 22 nt, Human
aaccaagcaucagggggaagaa

SEQ ID NO: 3661371 - RNA, 16 nt, Human
aaccaagccguggcuu

SEQ ID NO: 3661372 - RNA, 20 nt, Human
aaccaagcuauuccuuuccc

SEQ ID NO: 3661373 - RNA, 20 nt, Human
aaccaagcugaguuuccuau

SEQ ID NO: 3661374 - RNA, 20 nt, Human
aaccaagucaugugcauuuc

SEQ ID NO: 3661375 - RNA, 13 nt, Human
aaccaauccugga

SEQ ID NO: 3661376 - RNA, 22 nt, Human
aaccacaaaaaaauaccucagg

SEQ ID NO: 3661377 - RNA, 20 nt, Human
aaccacaaaggccaaacugc

SEQ ID NO: 3661378 - RNA, 17 nt, Human
aaccacaacugacacag

SEQ ID NO: 3661379 - RNA, 13 nt, Human
aaccacaccacau

SEQ ID NO: 3661380 - RNA, 21 nt, Human
aaccacaccacaucuaagccu

SEQ ID NO: 3661381 - RNA, 19 nt, Human
aaccacacuugaaaccuuu

SEQ ID NO: 3661382 - RNA, 13 nt, Human
aaccacagcugcu

SEQ ID NO: 3661383 - RNA, 14 nt, Human
aaccacagcugcug

SEQ ID NO: 3661384 - RNA, 17 nt, Human
aaccacaguguaccauu

SEQ ID NO: 3661385 - RNA, 21 nt, Human
aaccacaguguaccauuaaaa

SEQ ID NO: 3661386 - RNA, 22 nt, Human
aaccacauacaacacaaagaga

SEQ ID NO: 3661387 - RNA, 18 nt, Human
aaccaccagaagcccaga

SEQ ID NO: 3661388 - RNA, 23 nt, Human
aaccaccuggcccuuagaaauag

SEQ ID NO: 3661389 - RNA, 13 nt, Human
aaccacgcuggac

SEQ ID NO: 3661390 - RNA, 22 nt, Human
aaccacggaggaugaugccagu

SEQ ID NO: 3661391 - RNA, 21 nt, Human
aaccacgucugucuucacagc

SEQ ID NO: 3661392 - RNA, 12 nt, Human
aaccacuagaaa

SEQ ID NO: 3661393 - RNA, 19 nt, Human
aaccacucaaauuaaucuu

SEQ ID NO: 3661394 - RNA, 13 nt, Human
aaccacugaaaaa

SEQ ID NO: 3661395 - RNA, 16 nt, Human
aaccacugaaaaaaua

SEQ ID NO: 3661396 - RNA, 13 nt, Human
aaccacugaaucu

SEQ ID NO: 3661397 - RNA, 20 nt, Human
aaccacugcaaguccuuuug

SEQ ID NO: 3661398 - RNA, 16 nt, Human
aaccacuguaaaauga

SEQ ID NO: 3661399 - RNA, 12 nt, Human
aaccacuucccu

SEQ ID NO: 3661400 - RNA, 20 nt, Human
gcaggcaugcaugugcuugu

SEQ ID NO: 3661401 - RNA, 16 nt, Human
gcaggcauugaggaag

SEQ ID NO: 3661402 - RNA, 20 nt, Human
gcaggccaaggccuucuccu

SEQ ID NO: 3661403 - RNA, 23 nt, Human
gcaggccaaggccuucuccuccc

SEQ ID NO: 3661404 - RNA, 17 nt, Human
gcaggccaccuggcucu

SEQ ID NO: 3661405 - RNA, 21 nt, Human
gcaggccaccuggcucucacc

SEQ ID NO: 3661406 - RNA, 22 nt, Human
gcaggccaccuggcucucaccu

SEQ ID NO: 3661407 - RNA, 11 nt, Human
gcaggcccugc

SEQ ID NO: 3661408 - RNA, 12 nt, Human
gcaggcccugca

SEQ ID NO: 3661409 - RNA, 14 nt, Human
gcaggcccugcacu

SEQ ID NO: 3661410 - RNA, 23 nt, Human
gcaggcccugcacuguccugcuc

SEQ ID NO: 3661411 - RNA, 13 nt, Human
gcaggcccugcag

SEQ ID NO: 3661412 - RNA, 14 nt, Human
gcaggcccugcagu

SEQ ID NO: 3661413 - RNA, 19 nt, Human
gcaggccgugacgucuggg

SEQ ID NO: 3661414 - RNA, 13 nt, Human
gcaggccucccug

SEQ ID NO: 3661415 - RNA, 17 nt, Human
gcaggccucccugccag

SEQ ID NO: 3661416 - RNA, 16 nt, Human
gcaggcgguggggaga

SEQ ID NO: 3661417 - RNA, 21 nt, Human
gcaggcuaaggcguggagcug

SEQ ID NO: 3661418 - RNA, 15 nt, Human
gcaggcuacugucag

SEQ ID NO: 3661419 - RNA, 22 nt, Human
gcaggcucacugccaggccagc

SEQ ID NO: 3661420 - RNA, 14 nt, Human
gcaggcucccaggg

SEQ ID NO: 3661421 - RNA, 13 nt, Human
gcaggcucucagg

SEQ ID NO: 3661422 - RNA, 15 nt, Human
gcaggcucucaggcc

SEQ ID NO: 3661423 - RNA, 17 nt, Human
gcaggcugagccacucu

SEQ ID NO: 3661424 - RNA, 19 nt, Human
gcaggcugagugcauuugg

SEQ ID NO: 3661425 - RNA, 15 nt, Human
gcaggcuucaaacua

SEQ ID NO: 3661426 - RNA, 22 nt, Human
gcagggaaacagcuaaugggac

SEQ ID NO: 3661427 - RNA, 18 nt, Human
gcagggaacauggggagg

SEQ ID NO: 3661428 - RNA, 23 nt, Human
gcagggaagccccacauguccag

SEQ ID NO: 3661429 - RNA, 21 nt, Human
gcagggaaggggaggcagccg

SEQ ID NO: 3661430 - RNA, 21 nt, Human
gcagggacaaagaggccuuua

SEQ ID NO: 3661431 - RNA, 19 nt, Human
gcagggacacgggcagccu

SEQ ID NO: 3661432 - RNA, 22 nt, Human
gcagggacacgggcagccuggc

SEQ ID NO: 3661433 - RNA, 20 nt, Human
gcagggacuguaaacacaga

SEQ ID NO: 3661434 - RNA, 19 nt, Human
gcagggacuugaacccaua

SEQ ID NO: 3661435 - RNA, 22 nt, Human
gcagggagaggagugacugagc

SEQ ID NO: 3661436 - RNA, 19 nt, Human
gcagggagcggccggccag

SEQ ID NO: 3661437 - RNA, 22 nt, Human
gcagggagcugggcccgacaug

SEQ ID NO: 3661438 - RNA, 19 nt, Human
gcagggaggcaccauucag

SEQ ID NO: 3661439 - RNA, 14 nt, Human
gcagggaggcagcc

SEQ ID NO: 3661440 - RNA, 13 nt, Human
gcagggagggccu

SEQ ID NO: 3661441 - RNA, 17 nt, Human
gcagggagggccugggc

SEQ ID NO: 3661442 - RNA, 18 nt, Human
gcagggagggccugggcc

SEQ ID NO: 3661443 - RNA, 13 nt, Human
gcagggaggggac

SEQ ID NO: 3661444 - RNA, 15 nt, Human
gcagggaggggacua

SEQ ID NO: 3661445 - RNA, 16 nt, Human
gcagggaggucaggcc

SEQ ID NO: 3661446 - RNA, 20 nt, Human
gcagggaggucaggcccugg

SEQ ID NO: 3661447 - RNA, 22 nt, Human
gcagggauugcugccacuuuuu

SEQ ID NO: 3661448 - RNA, 15 nt, Human
gcagggauuugagga

SEQ ID NO: 3661449 - RNA, 14 nt, Human
gcagggcacagggc

SEQ ID NO: 3661450 - RNA, 16 nt, Human
gcagggcaggaccagc

SEQ ID NO: 3661451 - RNA, 21 nt, Human
gcagggcaggaccagcccacg

SEQ ID NO: 3661452 - RNA, 14 nt, Human
gcagggcaucuccu

SEQ ID NO: 3661453 - RNA, 15 nt, Human
gcagggcaucuccug

SEQ ID NO: 3661454 - RNA, 21 nt, Human
gcagggcaucuccugugcaug

SEQ ID NO: 3661455 - RNA, 14 nt, Human
gcagggccaggacu

SEQ ID NO: 3661456 - RNA, 15 nt, Human
gcagggccaggacug

SEQ ID NO: 3661457 - RNA, 18 nt, Human
cugccgccucccagccug

SEQ ID NO: 3661458 - RNA, 19 nt, Human
cugccgccucccagccugg

SEQ ID NO: 3661459 - RNA, 15 nt, Human
cugccgcgcagugug

SEQ ID NO: 3661460 - RNA, 14 nt, Human
cugccgcuaccucc

SEQ ID NO: 3661461 - RNA, 18 nt, Human
cugccgcuaccucccucc

SEQ ID NO: 3661462 - RNA, 16 nt, Human
cugccggcuccuuggu

SEQ ID NO: 3661463 - RNA, 20 nt, Human
cugccggcucuuuccuugcu

SEQ ID NO: 3661464 - RNA, 21 nt, Human
cugccgggcugagggccugcu

SEQ ID NO: 3661465 - RNA, 22 nt, Human
cugccgggcugagggccugcug

SEQ ID NO: 3661466 - RNA, 23 nt, Human
cugccgggcugagggccugcugg

SEQ ID NO: 3661467 - RNA, 19 nt, Human
cugccggggcagcccccuc

SEQ ID NO: 3661468 - RNA, 23 nt, Human
cugccggggcagcccccucacag

SEQ ID NO: 3661469 - RNA, 14 nt, Human
cugccggguucuag

SEQ ID NO: 3661470 - RNA, 18 nt, Human
cugccgguaaacacgccu

SEQ ID NO: 3661471 - RNA, 23 nt, Human
cugccgguucuuaaauccauccu

SEQ ID NO: 3661472 - RNA, 14 nt, Human
cugccgguuugaaa

SEQ ID NO: 3661473 - RNA, 18 nt, Human
cugccgucaccaccaccc

SEQ ID NO: 3661474 - RNA, 13 nt, Human
cugccgucagugc

SEQ ID NO: 3661475 - RNA, 19 nt, Human
cugccgucagugcugugcu

SEQ ID NO: 3661476 - RNA, 22 nt, Human
cugccguccccuagagucccag

SEQ ID NO: 3661477 - RNA, 15 nt, Human
cugccgucucuggag

SEQ ID NO: 3661478 - RNA, 17 nt, Human
cugccgugccgccugca

SEQ ID NO: 3661479 - RNA, 22 nt, Human
cugccgugccgccugcacuccu

SEQ ID NO: 3661480 - RNA, 14 nt, Human
cugccgugugcccu

SEQ ID NO: 3661481 - RNA, 20 nt, Human
cugccuaaauccacucugca

SEQ ID NO: 3661482 - RNA, 14 nt, Human
cugccuaacaaaau

SEQ ID NO: 3661483 - RNA, 15 nt, Human
cugccuaagacaugu

SEQ ID NO: 3661484 - RNA, 20 nt, Human
cugccuaaggacuucuuuaa

SEQ ID NO: 3661485 - RNA, 21 nt, Human
cugccuaaggacuucuuuaau

SEQ ID NO: 3661486 - RNA, 22 nt, Human
cugccuaaggacuucuuuaauu

SEQ ID NO: 3661487 - RNA, 16 nt, Human
cugccuaaggcugaac

SEQ ID NO: 3661488 - RNA, 20 nt, Human
cugccuaaguggcugcugac

SEQ ID NO: 3661489 - RNA, 14 nt, Human
cugccuacugcauc

SEQ ID NO: 3661490 - RNA, 18 nt, Human
cugccuagaaacaacacu

SEQ ID NO: 3661491 - RNA, 23 nt, Human
cugccuagaaacaacacuguagu

SEQ ID NO: 3661492 - RNA, 17 nt, Human
cugccuagcacucacau

SEQ ID NO: 3661493 - RNA, 17 nt, Human
cugccuauuaucuguca

SEQ ID NO: 3661494 - RNA, 15 nt, Human
cugccuauugauuua

SEQ ID NO: 3661495 - RNA, 21 nt, Human
cugccuauugcagcugggaga

SEQ ID NO: 3661496 - RNA, 24 nt, Human
cugccucaaugugaaucagacccu

SEQ ID NO: 3661497 - RNA, 14 nt, Human
cugccucagccucc

SEQ ID NO: 3661498 - RNA, 15 nt, Human
cugccucaggccucu

SEQ ID NO: 3661499 - RNA, 20 nt, Human
cugccuccacccucugagcu

SEQ ID NO: 3661500 - RNA, 13 nt, Human
cugccuccacucc

SEQ ID NO: 3661501 - RNA, 14 nt, Human
cugccuccacuccc

SEQ ID NO: 3661502 - RNA, 15 nt, Human
cugccuccacuccca

SEQ ID NO: 3661503 - RNA, 16 nt, Human
cugccuccacucccac

SEQ ID NO: 3661504 - RNA, 18 nt, Human
cugccuccacucccacuu

SEQ ID NO: 3661505 - RNA, 20 nt, Human
cugccuccagggcuggacug

SEQ ID NO: 3661506 - RNA, 22 nt, Human
cugccuccagggcuggacugag

SEQ ID NO: 3661507 - RNA, 23 nt, Human
cugccuccagggcuggacugagg

SEQ ID NO: 3661508 - RNA, 14 nt, Human
cugccucccacuuc

SEQ ID NO: 3661509 - RNA, 18 nt, Human
cugccucccacuucacug

SEQ ID NO: 3661510 - RNA, 14 nt, Human
cugccucccaucac

SEQ ID NO: 3661511 - RNA, 19 nt, Human
cugccucccaucacccgcu

SEQ ID NO: 3661512 - RNA, 18 nt, Human
cugccuccccaacccugc

SEQ ID NO: 3661513 - RNA, 20 nt, Human
cugccuccccuccucugcuu

SEQ ID NO: 3661514 - RNA, 21 nt, Human
cugccuccccuccucugcuug

SEQ ID NO: 3661515 - RNA, 20 nt, Human
cugccuccccucuccuuccu

SEQ ID NO: 3661516 - RNA, 13 nt, Human
cugccuccccugu

SEQ ID NO: 3661517 - RNA, 16 nt, Human
cugccuccccugugca

SEQ ID NO: 3661518 - RNA, 17 nt, Human
cugccuccccugugcag

SEQ ID NO: 3661519 - RNA, 22 nt, Human
cugccuccccugugcaguccug

SEQ ID NO: 3661520 - RNA, 14 nt, Human
cugccucccuucau

SEQ ID NO: 3661521 - RNA, 17 nt, Human
cugccucccuucaugca

SEQ ID NO: 3661522 - RNA, 18 nt, Human
cugccucccuucaugcau

SEQ ID NO: 3661523 - RNA, 19 nt, Human
cugccucccuucaugcaug

SEQ ID NO: 3661524 - RNA, 21 nt, Human
cugccucccuucaugcaugga

SEQ ID NO: 3661525 - RNA, 21 nt, Human
cugccucccuuguggcagcaa

SEQ ID NO: 3661526 - RNA, 23 nt, Human
cugccuccgcgugaucaaagcca

SEQ ID NO: 3661527 - RNA, 12 nt, Human
cugccuccugcc

SEQ ID NO: 3661528 - RNA, 23 nt, Human
cugccuccugccggcuccuuggu

SEQ ID NO: 3661529 - RNA, 16 nt, Human
cugccuccugccugcc

SEQ ID NO: 3661530 - RNA, 19 nt, Human
cugccuccugccugccccu

SEQ ID NO: 3661531 - RNA, 14 nt, Human
cugccuccuuugug

SEQ ID NO: 3661532 - RNA, 14 nt, Human
cugccucgaacugg

SEQ ID NO: 3661533 - RNA, 19 nt, Human
cugccucgaacuggcugca

SEQ ID NO: 3661534 - RNA, 15 nt, Human
cugccucuacuggga

SEQ ID NO: 3661535 - RNA, 17 nt, Human
cugccucuacugggaag

SEQ ID NO: 3661536 - RNA, 13 nt, Human
cugccucucacac

SEQ ID NO: 3661537 - RNA, 16 nt, Human
cugccucucacagcug

SEQ ID NO: 3661538 - RNA, 15 nt, Human
cugccucucccauca

SEQ ID NO: 3661539 - RNA, 12 nt, Human
cugccucucccu

SEQ ID NO: 3661540 - RNA, 14 nt, Human
cugccucucccucu

SEQ ID NO: 3661541 - RNA, 16 nt, Human
cugccucucccuggcc

SEQ ID NO: 3661542 - RNA, 19 nt, Human
cugccucuccgccccugag

SEQ ID NO: 3661543 - RNA, 16 nt, Human
cugccucucugcaggu

SEQ ID NO: 3661544 - RNA, 19 nt, Human
gcaggaauugguggcagau

SEQ ID NO: 3661545 - RNA, 17 nt, Human
gcaggacaacgaggaag

SEQ ID NO: 3661546 - RNA, 19 nt, Human
gcaggaccagcccacgcug

SEQ ID NO: 3661547 - RNA, 12 nt, Human
gcaggaccagga

SEQ ID NO: 3661548 - RNA, 13 nt, Human
gcaggaccaggac

SEQ ID NO: 3661549 - RNA, 14 nt, Human
gcaggaccucagag

SEQ ID NO: 3661550 - RNA, 15 nt, Human
gcaggaccucagagu

SEQ ID NO: 3661551 - RNA, 16 nt, Human
gcaggaccucagaguc

SEQ ID NO: 3661552 - RNA, 22 nt, Human
gcaggaccucagaguccaggcc

SEQ ID NO: 3661553 - RNA, 18 nt, Human
gcaggaccucccuuccga

SEQ ID NO: 3661554 - RNA, 12 nt, Human
gcaggaccucug

SEQ ID NO: 3661555 - RNA, 16 nt, Human
gcaggaccugccugua

SEQ ID NO: 3661556 - RNA, 21 nt, Human
gcaggaccuucgggcugugcc

SEQ ID NO: 3661557 - RNA, 13 nt, Human
gcaggacuccagg

SEQ ID NO: 3661558 - RNA, 23 nt, Human
gcaggacuccaggcccaaggcuc

SEQ ID NO: 3661559 - RNA, 18 nt, Human
gcaggacugaugucuccu

SEQ ID NO: 3661560 - RNA, 15 nt, Human
gcaggacuguccccu

SEQ ID NO: 3661561 - RNA, 22 nt, Human
gcaggagaaucacuugcacucc

SEQ ID NO: 3661562 - RNA, 17 nt, Human
gcaggagaggagagcca

SEQ ID NO: 3661563 - RNA, 19 nt, Human
gcaggagauugagaaggag

SEQ ID NO: 3661564 - RNA, 21 nt, Human
gcaggagauugagaaggagag

SEQ ID NO: 3661565 - RNA, 21 nt, Human
gcaggagcggcagauggggag

SEQ ID NO: 3661566 - RNA, 15 nt, Human
gcaggaggccaggcc

SEQ ID NO: 3661567 - RNA, 16 nt, Human
gcaggaggccaggccg

SEQ ID NO: 3661568 - RNA, 19 nt, Human
gcaggaggccccuggccca

SEQ ID NO: 3661569 - RNA, 22 nt, Human
gcaggaggccccuggcccagcg

SEQ ID NO: 3661570 - RNA, 22 nt, Human
gcaggagggcccuaccugauug

SEQ ID NO: 3661571 - RNA, 21 nt, Human
gcaggaguagcugagcucaca

SEQ ID NO: 3661572 - RNA, 19 nt, Human
gcaggagucccugccauca

SEQ ID NO: 3661573 - RNA, 21 nt, Human
gcaggauaguugcuccgccuc

SEQ ID NO: 3661574 - RNA, 22 nt, Human
gcaggauaguugcuccgccucu

SEQ ID NO: 3661575 - RNA, 17 nt, Human
gcaggaucucaccaggc

SEQ ID NO: 3661576 - RNA, 22 nt, Human
gcaggaucucaccaggcagccu

SEQ ID NO: 3661577 - RNA, 18 nt, Human
gcaggaugauuguacaga

SEQ ID NO: 3661578 - RNA, 24 nt, Human
gcaggauggccuggccagggccug

SEQ ID NO: 3661579 - RNA, 19 nt, Human
gcaggauugauuaugcaga

SEQ ID NO: 3661580 - RNA, 22 nt, Human
gcaggauuuguucucuguccag

SEQ ID NO: 3661581 - RNA, 20 nt, Human
gcaggcaccuagcaauucca

SEQ ID NO: 3661582 - RNA, 19 nt, Human
gcaggcacggguggucccc

SEQ ID NO: 3661583 - RNA, 20 nt, Human
gcaggcacucaaugcagcca

SEQ ID NO: 3661584 - RNA, 12 nt, Human
gcaggcagacac

SEQ ID NO: 3661585 - RNA, 16 nt, Human
gcaggcagaggcccag

SEQ ID NO: 3661586 - RNA, 15 nt, Human
gcaggcagccaggcc

SEQ ID NO: 3661587 - RNA, 18 nt, Human
gcaggcagcgccaagcaa

SEQ ID NO: 3661588 - RNA, 13 nt, Human
gcaggcagggcuc

SEQ ID NO: 3661589 - RNA, 22 nt, Human
gcaggcagggcucuccuggcuu

SEQ ID NO: 3661590 - RNA, 22 nt, Human
gcaggcaucggggagccgggag

SEQ ID NO: 3661591 - RNA, 23 nt, Human
gcaggcaucggggagccgggagc

SEQ ID NO: 3661592 - RNA, 15 nt, Human
gcaggcauugaggaa

SEQ ID NO: 3661593 - RNA, 18 nt, Human
gcaggcauugaggaagag

SEQ ID NO: 3661594 - RNA, 23 nt, Human
gcaggcauugccucggcuggcuc

SEQ ID NO: 3661595 - RNA, 22 nt, Human
gcaggccaagagcagaggcagc

SEQ ID NO: 3661596 - RNA, 24 nt, Human
gcaggccaagagcagaggcagcga

SEQ ID NO: 3661597 - RNA, 19 nt, Human
gcaggccaaggccuucucc

SEQ ID NO: 3661598 - RNA, 20 nt, Human
gcaggccaagucaggcccuu

SEQ ID NO: 3661599 - RNA, 16 nt, Human
gcaggccaggccagcu

SEQ ID NO: 3661600 - RNA, 19 nt, Human
gcaggccagguccagagag

SEQ ID NO: 3661601 - RNA, 22 nt, Human
gcaggcccaaauuaucaagcua

SEQ ID NO: 3661602 - RNA, 11 nt, Human
gcaggcccacc

SEQ ID NO: 3661603 - RNA, 20 nt, Human
gcaggcccacccugcuuggc

SEQ ID NO: 3661604 - RNA, 12 nt, Human
gcaggcccaccu

SEQ ID NO: 3661605 - RNA, 14 nt, Human
gcaggcccauggga

SEQ ID NO: 3661606 - RNA, 22 nt, Human
gcaggcccaugggaggcuggag

SEQ ID NO: 3661607 - RNA, 15 nt, Human
gcaggcccugcacug

SEQ ID NO: 3661608 - RNA, 20 nt, Human
gcaggcccugcacuguccug

SEQ ID NO: 3661609 - RNA, 15 nt, Human
gcaggcccuggccuc

SEQ ID NO: 3661610 - RNA, 16 nt, Human
gcaggcccuggccucc

SEQ ID NO: 3661611 - RNA, 20 nt, Human
gcaggccgugacgucugggu

SEQ ID NO: 3661612 - RNA, 15 nt, Human
gcaggccuauuucau

SEQ ID NO: 3661613 - RNA, 22 nt, Human
gcaggcggccuuuguugcucag

SEQ ID NO: 3661614 - RNA, 14 nt, Human
gcaggcggugggca

SEQ ID NO: 3661615 - RNA, 16 nt, Human
gcaggcggugggcacc

SEQ ID NO: 3661616 - RNA, 19 nt, Human
gcaggcguucagcucacug

SEQ ID NO: 3661617 - RNA, 20 nt, Human
gcaggcuacacugacacugg

SEQ ID NO: 3661618 - RNA, 16 nt, Human
gcaggcuagaaccugg

SEQ ID NO: 3661619 - RNA, 19 nt, Human
cugccuguagcccacucug

SEQ ID NO: 3661620 - RNA, 22 nt, Human
cugccuguagcccacucugcuc

SEQ ID NO: 3661621 - RNA, 16 nt, Human
cugccuguaguuagga

SEQ ID NO: 3661622 - RNA, 18 nt, Human
cugccuguaguuaggaaa

SEQ ID NO: 3661623 - RNA, 20 nt, Human
cugccuguaguuaggaaaua

SEQ ID NO: 3661624 - RNA, 22 nt, Human
cugccuguaguuaggaaauaaa

SEQ ID NO: 3661625 - RNA, 17 nt, Human
cugccuguauacuuuag

SEQ ID NO: 3661626 - RNA, 17 nt, Human
cugccuguccccaugcu

SEQ ID NO: 3661627 - RNA, 16 nt, Human
cugccugucccucuca

SEQ ID NO: 3661628 - RNA, 18 nt, Human
cugccugucccucucagg

SEQ ID NO: 3661629 - RNA, 15 nt, Human
cugccugucugaagc

SEQ ID NO: 3661630 - RNA, 13 nt, Human
cugccugucugcc

SEQ ID NO: 3661631 - RNA, 23 nt, Human
cugccugucugccccagcccaga

SEQ ID NO: 3661632 - RNA, 15 nt, Human
cugccugugagccag

SEQ ID NO: 3661633 - RNA, 18 nt, Human
cugccugugagccagucu

SEQ ID NO: 3661634 - RNA, 21 nt, Human
cugccugugcacggccagcug

SEQ ID NO: 3661635 - RNA, 20 nt, Human
cugccuguuauaacucugca

SEQ ID NO: 3661636 - RNA, 14 nt, Human
cugccuguucagcu

SEQ ID NO: 3661637 - RNA, 22 nt, Human
cugccuguugggccaggagccu

SEQ ID NO: 3661638 - RNA, 23 nt, Human
cugccuguugggccaggagccuc

SEQ ID NO: 3661639 - RNA, 16 nt, Human
cugccuuaaaaccaaa

SEQ ID NO: 3661640 - RNA, 19 nt, Human
cugccuuaaaaccaaagag

SEQ ID NO: 3661641 - RNA, 22 nt, Human
cugccuuaaaaccaaagagggc

SEQ ID NO: 3661642 - RNA, 20 nt, Human
cugccuuaaagucaguaacu

SEQ ID NO: 3661643 - RNA, 16 nt, Human
cugccuuagcuucagg

SEQ ID NO: 3661644 - RNA, 17 nt, Human
cugccuuagcuucagga

SEQ ID NO: 3661645 - RNA, 23 nt, Human
cugccuuagucucaguuugugug

SEQ ID NO: 3661646 - RNA, 15 nt, Human
cugccuuaucuugca

SEQ ID NO: 3661647 - RNA, 21 nt, Human
cugccuuauucagggaaggag

SEQ ID NO: 3661648 - RNA, 13 nt, Human
cugccuuccuccu

SEQ ID NO: 3661649 - RNA, 15 nt, Human
cugccuuccuugcua

SEQ ID NO: 3661650 - RNA, 20 nt, Human
cugccuucgcuucuugccuc

SEQ ID NO: 3661651 - RNA, 19 nt, Human
cugccuucgguacccacca

SEQ ID NO: 3661652 - RNA, 13 nt, Human
cugccuucguuaa

SEQ ID NO: 3661653 - RNA, 20 nt, Human
cugccuucguuaacugugua

SEQ ID NO: 3661654 - RNA, 20 nt, Human
cugccuucugacggcccugc

SEQ ID NO: 3661655 - RNA, 21 nt, Human
cugccuucugacggcccugca

SEQ ID NO: 3661656 - RNA, 23 nt, Human
cugccuucugacggcccugcaau

SEQ ID NO: 3661657 - RNA, 15 nt, Human
cugccuucuguccug

SEQ ID NO: 3661658 - RNA, 16 nt, Human
cugccuucuguccugg

SEQ ID NO: 3661659 - RNA, 20 nt, Human
cugccuugaagccacugaag

SEQ ID NO: 3661660 - RNA, 17 nt, Human
cugccuugcccacuccu

SEQ ID NO: 3661661 - RNA, 20 nt, Human
cugccuugcccacuccugcu

SEQ ID NO: 3661662 - RNA, 14 nt, Human
cugccuugccuuua

SEQ ID NO: 3661663 - RNA, 23 nt, Human
cugccuuggacuguguuuuuccu

SEQ ID NO: 3661664 - RNA, 14 nt, Human
cugccuuggccucc

SEQ ID NO: 3661665 - RNA, 17 nt, Human
cugccuuggccucccaa

SEQ ID NO: 3661666 - RNA, 17 nt, Human
cugccuuggcucagaca

SEQ ID NO: 3661667 - RNA, 19 nt, Human
cugccuuggggucagguug

SEQ ID NO: 3661668 - RNA, 15 nt, Human
cugccuuuagaaaau

SEQ ID NO: 3661669 - RNA, 18 nt, Human
cugccuuuauuguguuug

SEQ ID NO: 3661670 - RNA, 20 nt, Human
cugccuuuccauccauggcc

SEQ ID NO: 3661671 - RNA, 21 nt, Human
cugccuuugacauuuaauuua

SEQ ID NO: 3661672 - RNA, 15 nt, Human
cugccuuugccaggu

SEQ ID NO: 3661673 - RNA, 16 nt, Human
cugccuuugccaggug

SEQ ID NO: 3661674 - RNA, 18 nt, Human
cugccuuugccaggugac

SEQ ID NO: 3661675 - RNA, 20 nt, Human
cugccuuugccuccagaagc

SEQ ID NO: 3661676 - RNA, 21 nt, Human
cugccuuuuaguuccugugca

SEQ ID NO: 3661677 - RNA, 13 nt, Human
cugccuuuuguuc

SEQ ID NO: 3661678 - RNA, 22 nt, Human
cugcgaagacccucuugcccau

SEQ ID NO: 3661679 - RNA, 13 nt, Human
cugcgacccuggg

SEQ ID NO: 3661680 - RNA, 16 nt, Human
cugcgacgcuugcucu

SEQ ID NO: 3661681 - RNA, 23 nt, Human
cugcgacgcuugcucuguuugug

SEQ ID NO: 3661682 - RNA, 14 nt, Human
cugcgacuuucugc

SEQ ID NO: 3661683 - RNA, 17 nt, Human
cugcgacuuucugccug

SEQ ID NO: 3661684 - RNA, 20 nt, Human
cugcgacuuucugccuggag

SEQ ID NO: 3661685 - RNA, 16 nt, Human
cugcgaggcuaugagu

SEQ ID NO: 3661686 - RNA, 14 nt, Human
cugcgaucuucaga

SEQ ID NO: 3661687 - RNA, 18 nt, Human
gcauucuauugccuucuu

SEQ ID NO: 3661688 - RNA, 18 nt, Human
gcauucucauuggaaauu

SEQ ID NO: 3661689 - RNA, 15 nt, Human
gcauucuggcaguuu

SEQ ID NO: 3661690 - RNA, 19 nt, Human
gcauucuugucacaauaaa

SEQ ID NO: 3661691 - RNA, 12 nt, Human
gcauucuuuccc

SEQ ID NO: 3661692 - RNA, 18 nt, Human
gcauucuuucccagugag

SEQ ID NO: 3661693 - RNA, 17 nt, Human
gcauugaaaugagcacc

SEQ ID NO: 3661694 - RNA, 19 nt, Human
gcauugaacacaaacugua

SEQ ID NO: 3661695 - RNA, 16 nt, Human
gcauugaauauauuau

SEQ ID NO: 3661696 - RNA, 20 nt, Human
gcauugacaaaucuguguau

SEQ ID NO: 3661697 - RNA, 13 nt, Human
gcauugacauuau

SEQ ID NO: 3661698 - RNA, 22 nt, Human
gcauugacugguuuacaggccc

SEQ ID NO: 3661699 - RNA, 22 nt, Human
gcauugacuuucaguaaacaua

SEQ ID NO: 3661700 - RNA, 16 nt, Human
gcauugacuuucccca

SEQ ID NO: 3661701 - RNA, 16 nt, Human
gcauugauauugugaa

SEQ ID NO: 3661702 - RNA, 17 nt, Human
gcauugauggggaagga

SEQ ID NO: 3661703 - RNA, 18 nt, Human
gcauugauggggaaggag

SEQ ID NO: 3661704 - RNA, 16 nt, Human
gcauugauucaguauu

SEQ ID NO: 3661705 - RNA, 13 nt, Human
gcauugcauggac

SEQ ID NO: 3661706 - RNA, 14 nt, Human
gcauugccaagggc

SEQ ID NO: 3661707 - RNA, 15 nt, Human
gcauugcuuuccacu

SEQ ID NO: 3661708 - RNA, 13 nt, Human
gcauugcuuucug

SEQ ID NO: 3661709 - RNA, 16 nt, Human
gcauuggaacuggagg

SEQ ID NO: 3661710 - RNA, 20 nt, Human
gcauuggauacagcaguaga

SEQ ID NO: 3661711 - RNA, 16 nt, Human
gcauugggugaucauu

SEQ ID NO: 3661712 - RNA, 17 nt, Human
gcauugguucccuuugc

SEQ ID NO: 3661713 - RNA, 20 nt, Human
gcauuguaaaagcauuuugu

SEQ ID NO: 3661714 - RNA, 16 nt, Human
gcauuguaaaauaauu

SEQ ID NO: 3661715 - RNA, 12 nt, Human
gcauuguaaaua

SEQ ID NO: 3661716 - RNA, 16 nt, Human
gcauuguaaaugugcu

SEQ ID NO: 3661717 - RNA, 19 nt, Human
gcauuguaucgauguuaug

SEQ ID NO: 3661718 - RNA, 13 nt, Human
gcauugugggaag

SEQ ID NO: 3661719 - RNA, 22 nt, Human
gcauugugugugcagacuucag

SEQ ID NO: 3661720 - RNA, 20 nt, Human
gcauuguuugcuuauuguuc

SEQ ID NO: 3661721 - RNA, 20 nt, Human
gcauuuaaccccccuguaca

SEQ ID NO: 3661722 - RNA, 21 nt, Human
gcauuuaaccccccuguacac

SEQ ID NO: 3661723 - RNA, 22 nt, Human
gcauuuaaccccccuguacaca

SEQ ID NO: 3661724 - RNA, 14 nt, Human
gcauuuaagaauug

SEQ ID NO: 3661725 - RNA, 16 nt, Human
gcauuuaauguagcca

SEQ ID NO: 3661726 - RNA, 13 nt, Human
gcauuuagaugua

SEQ ID NO: 3661727 - RNA, 16 nt, Human
gcauuuagcacaaaaa

SEQ ID NO: 3661728 - RNA, 16 nt, Human
gcauuuagcuggccac

SEQ ID NO: 3661729 - RNA, 19 nt, Human
gcauuuaggccaugggaca

SEQ ID NO: 3661730 - RNA, 19 nt, Human
gcauuuagggaguauucua

SEQ ID NO: 3661731 - RNA, 22 nt, Human
gcauuuagggaguauucuaaua

SEQ ID NO: 3661732 - RNA, 20 nt, Human
gcauuuaugguaaucauauu

SEQ ID NO: 3661733 - RNA, 23 nt, Human
gcauuuaugguaaucauauuaga

SEQ ID NO: 3661734 - RNA, 17 nt, Human
gcauuuauuugugauga

SEQ ID NO: 3661735 - RNA, 20 nt, Human
gcauuucacaaaacagccuu

SEQ ID NO: 3661736 - RNA, 22 nt, Human
gcauuucacuuucccgguguuc

SEQ ID NO: 3661737 - RNA, 11 nt, Human
gcauuucauuc

SEQ ID NO: 3661738 - RNA, 13 nt, Human
gcauuucauucuu

SEQ ID NO: 3661739 - RNA, 23 nt, Human
gcauuuccaacaccacagacaca

SEQ ID NO: 3661740 - RNA, 18 nt, Human
gcauuucccuuccuuccu

SEQ ID NO: 3661741 - RNA, 21 nt, Human
gcauuuccuaucaccuauuuc

SEQ ID NO: 3661742 - RNA, 14 nt, Human
gcauuuccugggug

SEQ ID NO: 3661743 - RNA, 21 nt, Human
gcauuuccuggguggcuacuc

SEQ ID NO: 3661744 - RNA, 19 nt, Human
gcauuucugaauagaaaug

SEQ ID NO: 3661745 - RNA, 13 nt, Human
gcauuugaaugca

SEQ ID NO: 3661746 - RNA, 15 nt, Human
gcauuugaaugcauu

SEQ ID NO: 3661747 - RNA, 14 nt, Human
gcauuugagaaaug

SEQ ID NO: 3661748 - RNA, 15 nt, Human
gcauuugagaaaugc

SEQ ID NO: 3661749 - RNA, 17 nt, Human
gcauuugaucuguugca

SEQ ID NO: 3661750 - RNA, 17 nt, Human
gcauuugcagauuuuua

SEQ ID NO: 3661751 - RNA, 16 nt, Human
gcauuuggauuggggu

SEQ ID NO: 3661752 - RNA, 15 nt, Human
gcauuuggguccagg

SEQ ID NO: 3661753 - RNA, 22 nt, Human
gcauuuggugguuucagaaaug

SEQ ID NO: 3661754 - RNA, 23 nt, Human
gcauuuggugguuucagaaaugu

SEQ ID NO: 3661755 - RNA, 20 nt, Human
gcauuuguaaauauuaaacc

SEQ ID NO: 3661756 - RNA, 21 nt, Human
gcauuuguauuuugugugacc

SEQ ID NO: 3661757 - RNA, 12 nt, Human
gcauuugucuau

SEQ ID NO: 3661758 - RNA, 17 nt, Human
gcauuugugcuagaaau

SEQ ID NO: 3661759 - RNA, 22 nt, Human
gcauuuguuucuuucucugagg

SEQ ID NO: 3661760 - RNA, 18 nt, Human
gcauuuguuugaacugau

SEQ ID NO: 3661761 - RNA, 17 nt, Human
gcauuuguuuuguuuac

SEQ ID NO: 3661762 - RNA, 13 nt, Human
gcauuuuauaaau

SEQ ID NO: 3661763 - RNA, 13 nt, Human
gcauuuuauagac

SEQ ID NO: 3661764 - RNA, 12 nt, Human
gcauuuuauucu

SEQ ID NO: 3661765 - RNA, 18 nt, Human
gcauuuuccagcacuuug

SEQ ID NO: 3661766 - RNA, 13 nt, Human
gcauuuuccucug

SEQ ID NO: 3661767 - RNA, 16 nt, Human
gcauuuucuaaacaga

SEQ ID NO: 3661768 - RNA, 22 nt, Human
gcauuuugcuaaaugugaauga

SEQ ID NO: 3661769 - RNA, 13 nt, Human
gcauuuugcuauu

SEQ ID NO: 3661770 - RNA, 16 nt, Human
gcauuuuguuugguau

SEQ ID NO: 3661771 - RNA, 18 nt, Human
gcauuuuguuugguauug

SEQ ID NO: 3661772 - RNA, 11 nt, Human
gcauuuuuaga

SEQ ID NO: 3661773 - RNA, 23 nt, Human
gcauuuuuauuucagauuuugau

SEQ ID NO: 3661774 - RNA, 21 nt, Human
gcauuuuucaauauauugaac

SEQ ID NO: 3661775 - RNA, 15 nt, Human
gcauuuuuuaaaaca

SEQ ID NO: 3661776 - RNA, 13 nt, Human
gccaaaaauagcu

SEQ ID NO: 3661777 - RNA, 23 nt, Human
gccaaaacaauguuuaaaccuuu

SEQ ID NO: 3661778 - RNA, 16 nt, Human
gccaaaacccagcugc

SEQ ID NO: 3661779 - RNA, 19 nt, Human
gccaaaacccagcugcacc

SEQ ID NO: 3661780 - RNA, 16 nt, Human
gccaaaagcuagacag

SEQ ID NO: 3661781 - RNA, 15 nt, Human
gccaaaagcugcuca

SEQ ID NO: 3661782 - RNA, 14 nt, Human
gccaaaagcuuccc

SEQ ID NO: 3661783 - RNA, 15 nt, Human
gccaaaagcuucccu

SEQ ID NO: 3661784 - RNA, 18 nt, Human
gccaaaaggaaaaagcuc

SEQ ID NO: 3661785 - RNA, 19 nt, Human
gccaaaaggaaaaagcucc

SEQ ID NO: 3661786 - RNA, 11 nt, Human
gccaaaauaau

SEQ ID NO: 3661787 - RNA, 19 nt, Human
gccaaaauaaugucuuguu

SEQ ID NO: 3661788 - RNA, 17 nt, Human
gccaaaauucauuucua

SEQ ID NO: 3661789 - RNA, 23 nt, Human
gccaaacaaaaagguucucaggu

SEQ ID NO: 3661790 - RNA, 14 nt, Human
gccaaacaggcccu

SEQ ID NO: 3661791 - RNA, 12 nt, Human
gccaaacauuaa

SEQ ID NO: 3661792 - RNA, 19 nt, Human
gccaaacauuaauguugau

SEQ ID NO: 3661793 - RNA, 22 nt, Human
gccaaacauuaauguugauuuc

SEQ ID NO: 3661794 - RNA, 22 nt, Human
gccaaaccucuguucaguguaa

SEQ ID NO: 3661795 - RNA, 21 nt, Human
gccaaacucaccugccccuca

SEQ ID NO: 3661796 - RNA, 18 nt, Human
gccaaacucugccagcca

SEQ ID NO: 3661797 - RNA, 13 nt, Human
gccaaagaaauga

SEQ ID NO: 3661798 - RNA, 18 nt, Human
gccaaagaaaugaacauu

SEQ ID NO: 3661799 - RNA, 17 nt, Human
gccaaagaaugccuuga

SEQ ID NO: 3661800 - RNA, 19 nt, Human
gccaaagacuuaguauauu

SEQ ID NO: 3661801 - RNA, 20 nt, Human
gccaaagccaaagcuaggcc

SEQ ID NO: 3661802 - RNA, 16 nt, Human
gccaaagcuaggccug

SEQ ID NO: 3661803 - RNA, 16 nt, Human
gccaaagcuagggugg

SEQ ID NO: 3661804 - RNA, 20 nt, Human
gccaaagcuaggguggcccu

SEQ ID NO: 3661805 - RNA, 16 nt, Human
gccaaaggaagcacau

SEQ ID NO: 3661806 - RNA, 23 nt, Human
gccaaaggagggucaggaaggau

SEQ ID NO: 3661807 - RNA, 16 nt, Human
gccaaaggaugugaua

SEQ ID NO: 3661808 - RNA, 20 nt, Human
gccaaaggcugguggcaagu

SEQ ID NO: 3661809 - RNA, 19 nt, Human
gccaaagggaaauaucauu

SEQ ID NO: 3661810 - RNA, 18 nt, Human
gccaaaggggaccuggaa

SEQ ID NO: 3661811 - RNA, 19 nt, Human
gccaaaggggaccuggaag

SEQ ID NO: 3661812 - RNA, 19 nt, Human
gccaaauaaaguuaaaagu

SEQ ID NO: 3661813 - RNA, 13 nt, Human
gccaaauauaaau

SEQ ID NO: 3661814 - RNA, 15 nt, Human
gccaaauauauucuc

SEQ ID NO: 3661815 - RNA, 15 nt, Human
gccaaauauguccug

SEQ ID NO: 3661816 - RNA, 17 nt, Human
gccaaauauguccuggg

SEQ ID NO: 3661817 - RNA, 20 nt, Human
gccaaauccgcucucuuccu

SEQ ID NO: 3661818 - RNA, 18 nt, Human
gccaaauuaaaaaagaua

SEQ ID NO: 3661819 - RNA, 21 nt, Human
gccaaauuaaaaaagauaaac

SEQ ID NO: 3661820 - RNA, 23 nt, Human
gccaaauuaaaaaagauaaacac

SEQ ID NO: 3661821 - RNA, 11 nt, Human
gccaaauuauu

SEQ ID NO: 3661822 - RNA, 15 nt, Human
gccaaauuauuugug

SEQ ID NO: 3661823 - RNA, 23 nt, Human
gccaaauuauuuguguaauagaa

SEQ ID NO: 3661824 - RNA, 13 nt, Human
gccaacaaagcug

SEQ ID NO: 3661825 - RNA, 15 nt, Human
gccaacaaagcuguu

SEQ ID NO: 3661826 - RNA, 20 nt, Human
gccaacaagaaugcauugau

SEQ ID NO: 3661827 - RNA, 17 nt, Human
gccaacacgcaccugcc

SEQ ID NO: 3661828 - RNA, 20 nt, Human
gccaacacgcaccugccuca

SEQ ID NO: 3661829 - RNA, 19 nt, Human
gccaacagaagcuuccauu

SEQ ID NO: 3661830 - RNA, 11 nt, Human
gccaacagcua

SEQ ID NO: 3661831 - RNA, 21 nt, Human
gccaacagguagcauagcucu

SEQ ID NO: 3661832 - RNA, 23 nt, Human
gcccaggacggggccggccaggu

SEQ ID NO: 3661833 - RNA, 10 nt, Human
gcccaggaga

SEQ ID NO: 3661834 - RNA, 13 nt, Human
gcccaggagagag

SEQ ID NO: 3661835 - RNA, 15 nt, Human
gcccaggagagagaa

SEQ ID NO: 3661836 - RNA, 16 nt, Human
gcccaggagagagaaa

SEQ ID NO: 3661837 - RNA, 20 nt, Human
gcccaggagagagaaagcca

SEQ ID NO: 3661838 - RNA, 19 nt, Human
gcccaggagagccagcccu

SEQ ID NO: 3661839 - RNA, 11 nt, Human
gcccaggagcc

SEQ ID NO: 3661840 - RNA, 13 nt, Human
gcccaggagccca

SEQ ID NO: 3661841 - RNA, 14 nt, Human
gcccaggagcccau

SEQ ID NO: 3661842 - RNA, 20 nt, Human
gcccaggagggcauccauac

SEQ ID NO: 3661843 - RNA, 22 nt, Human
gcccaggagggcauccauacca

SEQ ID NO: 3661844 - RNA, 19 nt, Human
gcccaggccaggacucugc

SEQ ID NO: 3661845 - RNA, 22 nt, Human
gcccaggccaucuuccaggugg

SEQ ID NO: 3661846 - RNA, 13 nt, Human
gcccaggccccug

SEQ ID NO: 3661847 - RNA, 17 nt, Human
gcccaggccccugccac

SEQ ID NO: 3661848 - RNA, 13 nt, Human
gcccaggccccuu

SEQ ID NO: 3661849 - RNA, 17 nt, Human
gcccaggccggccagcc

SEQ ID NO: 3661850 - RNA, 18 nt, Human
gcccaggccggccagccu

SEQ ID NO: 3661851 - RNA, 20 nt, Human
gcccaggccggccagccuca

SEQ ID NO: 3661852 - RNA, 22 nt, Human
gcccaggccgggguggagcaug

SEQ ID NO: 3661853 - RNA, 23 nt, Human
gcccaggccgggguggagcaugg

SEQ ID NO: 3661854 - RNA, 10 nt, Human
gcccaggccu

SEQ ID NO: 3661855 - RNA, 16 nt, Human
gcccaggccuccagcu

SEQ ID NO: 3661856 - RNA, 18 nt, Human
gcccaggccuccagcuca

SEQ ID NO: 3661857 - RNA, 13 nt, Human
gcccaggccuccu

SEQ ID NO: 3661858 - RNA, 17 nt, Human
gcccaggccugccuguu

SEQ ID NO: 3661859 - RNA, 12 nt, Human
gcccaggcugcc

SEQ ID NO: 3661860 - RNA, 13 nt, Human
gcccaggcuggcc

SEQ ID NO: 3661861 - RNA, 16 nt, Human
gcccaggcuggcgugc

SEQ ID NO: 3661862 - RNA, 20 nt, Human
gcccaggcuggcgugcagug

SEQ ID NO: 3661863 - RNA, 15 nt, Human
gcccaggcugggaac

SEQ ID NO: 3661864 - RNA, 16 nt, Human
gcccaggcugguuucg

SEQ ID NO: 3661865 - RNA, 20 nt, Human
gcccagggacaccagccagg

SEQ ID NO: 3661866 - RNA, 16 nt, Human
gcccagggagaggcca

SEQ ID NO: 3661867 - RNA, 19 nt, Human
gcccagggagaggccauga

SEQ ID NO: 3661868 - RNA, 21 nt, Human
gcccagggaggccgaagcuaa

SEQ ID NO: 3661869 - RNA, 17 nt, Human
gcccagggauuuguccu

SEQ ID NO: 3661870 - RNA, 18 nt, Human
gcccagggcaucugggag

SEQ ID NO: 3661871 - RNA, 13 nt, Human
gcccagggccacu

SEQ ID NO: 3661872 - RNA, 14 nt, Human
gcccagggcccaga

SEQ ID NO: 3661873 - RNA, 13 nt, Human
gcccagggcucag

SEQ ID NO: 3661874 - RNA, 15 nt, Human
gcccagggcuccugc

SEQ ID NO: 3661875 - RNA, 19 nt, Human
gcccaggggugcccccucc

SEQ ID NO: 3661876 - RNA, 21 nt, Human
gcccagggugagguggcaugg

SEQ ID NO: 3661877 - RNA, 14 nt, Human
gcccaggguggacu

SEQ ID NO: 3661878 - RNA, 16 nt, Human
gcccaggguuccccca

SEQ ID NO: 3661879 - RNA, 19 nt, Human
gcccaggguucccccagcc

SEQ ID NO: 3661880 - RNA, 20 nt, Human
gcccaggguucccccagccc

SEQ ID NO: 3661881 - RNA, 21 nt, Human
gcccaggguucccccagcccu

SEQ ID NO: 3661882 - RNA, 22 nt, Human
gcccaggguucccccagcccug

SEQ ID NO: 3661883 - RNA, 16 nt, Human
gcccagguccucugau

SEQ ID NO: 3661884 - RNA, 21 nt, Human
gcccaggugaguccuagagcu

SEQ ID NO: 3661885 - RNA, 14 nt, Human
gcccagguuucugg

SEQ ID NO: 3661886 - RNA, 19 nt, Human
gcccaguacauuuaaauuu

SEQ ID NO: 3661887 - RNA, 14 nt, Human
gcccagucccagca

SEQ ID NO: 3661888 - RNA, 16 nt, Human
gcccagucccagcagc

SEQ ID NO: 3661889 - RNA, 20 nt, Human
gcccagucccagcagccagc

SEQ ID NO: 3661890 - RNA, 15 nt, Human
gcccagucccccaac

SEQ ID NO: 3661891 - RNA, 18 nt, Human
gcccaguccucucccaag

SEQ ID NO: 3661892 - RNA, 22 nt, Human
gccaggacuccccaggccaggc

SEQ ID NO: 3661893 - RNA, 15 nt, Human
gccaggacucugcag

SEQ ID NO: 3661894 - RNA, 17 nt, Human
gccaggacucugcagcc

SEQ ID NO: 3661895 - RNA, 12 nt, Human
gccaggagaagc

SEQ ID NO: 3661896 - RNA, 17 nt, Human
gccaggagaagcucagc

SEQ ID NO: 3661897 - RNA, 19 nt, Human
gccaggagaagcucagcug

SEQ ID NO: 3661898 - RNA, 15 nt, Human
gccaggagcaaaugu

SEQ ID NO: 3661899 - RNA, 22 nt, Human
gccaggagcaaauguuucugca

SEQ ID NO: 3661900 - RNA, 18 nt, Human
gccaggagcacggcucug

SEQ ID NO: 3661901 - RNA, 14 nt, Human
gccaggagccuccu

SEQ ID NO: 3661902 - RNA, 19 nt, Human
gccaggagccuccugcccu

SEQ ID NO: 3661903 - RNA, 22 nt, Human
gccaggagcucuucaggccucc

SEQ ID NO: 3661904 - RNA, 13 nt, Human
gccaggagcuggg

SEQ ID NO: 3661905 - RNA, 15 nt, Human
gccaggaggacccag

SEQ ID NO: 3661906 - RNA, 16 nt, Human
gccaggaggccaggcu

SEQ ID NO: 3661907 - RNA, 22 nt, Human
gccaggagggcguucuuaggcu

SEQ ID NO: 3661908 - RNA, 22 nt, Human
gccaggaucaugguguaauaag

SEQ ID NO: 3661909 - RNA, 24 nt, Human
gccaggaucaugguguaauaagac

SEQ ID NO: 3661910 - RNA, 14 nt, Human
gccaggauggaaug

SEQ ID NO: 3661911 - RNA, 22 nt, Human
gccaggcaacuucaguccuggg

SEQ ID NO: 3661912 - RNA, 15 nt, Human
gccaggcacacacug

SEQ ID NO: 3661913 - RNA, 22 nt, Human
gccaggcacacacugugcuuuc

SEQ ID NO: 3661914 - RNA, 21 nt, Human
gccaggcacccccuggagaga

SEQ ID NO: 3661915 - RNA, 15 nt, Human
gccaggcagaucugu

SEQ ID NO: 3661916 - RNA, 15 nt, Human
gccaggcaggggugg

SEQ ID NO: 3661917 - RNA, 17 nt, Human
gccaggcaggggugggg

SEQ ID NO: 3661918 - RNA, 17 nt, Human
gccaggcagguccacag

SEQ ID NO: 3661919 - RNA, 20 nt, Human
gccaggccaccuccagaaac

SEQ ID NO: 3661920 - RNA, 13 nt, Human
gccaggccagccu

SEQ ID NO: 3661921 - RNA, 19 nt, Human
gccaggccagccuccgaga

SEQ ID NO: 3661922 - RNA, 14 nt, Human
gccaggcccagccg

SEQ ID NO: 3661923 - RNA, 14 nt, Human
gccaggccccaggc

SEQ ID NO: 3661924 - RNA, 18 nt, Human
gccaggcccccaagccug

SEQ ID NO: 3661925 - RNA, 21 nt, Human
gccaggcccccaccacacauc

SEQ ID NO: 3661926 - RNA, 18 nt, Human
gccaggcccggggcuggc

SEQ ID NO: 3661927 - RNA, 17 nt, Human
gccaggcccucugccca

SEQ ID NO: 3661928 - RNA, 19 nt, Human
gccaggcccucugcccacu

SEQ ID NO: 3661929 - RNA, 18 nt, Human
gccaggccgggccuguac

SEQ ID NO: 3661930 - RNA, 14 nt, Human
gccaggccucuccc

SEQ ID NO: 3661931 - RNA, 17 nt, Human
gccaggccucuuggcag

SEQ ID NO: 3661932 - RNA, 15 nt, Human
gccaggcuaauuuuu

SEQ ID NO: 3661933 - RNA, 22 nt, Human
gccaggcucacucacagaguca

SEQ ID NO: 3661934 - RNA, 17 nt, Human
gccaggcucaggccaug

SEQ ID NO: 3661935 - RNA, 15 nt, Human
gccaggcuccuuccu

SEQ ID NO: 3661936 - RNA, 21 nt, Human
gccaggcuccuuccugucuuc

SEQ ID NO: 3661937 - RNA, 13 nt, Human
gccaggcucucuu

SEQ ID NO: 3661938 - RNA, 20 nt, Human
gccaggcucugugcugaccc

SEQ ID NO: 3661939 - RNA, 21 nt, Human
gccaggcucugugcugacccu

SEQ ID NO: 3661940 - RNA, 17 nt, Human
gccaggcugaccacagc

SEQ ID NO: 3661941 - RNA, 22 nt, Human
gccaggcugaccacagcacagc

SEQ ID NO: 3661942 - RNA, 15 nt, Human
gccaggcugaucucg

SEQ ID NO: 3661943 - RNA, 14 nt, Human
gccaggcugcucuu

SEQ ID NO: 3661944 - RNA, 19 nt, Human
gccaggcuggagugcagug

SEQ ID NO: 3661945 - RNA, 17 nt, Human
gccaggcugggucgccc

SEQ ID NO: 3661946 - RNA, 20 nt, Human
gccaggcugggucgcccugg

SEQ ID NO: 3661947 - RNA, 22 nt, Human
gccaggcuggucucgaacuccu

SEQ ID NO: 3661948 - RNA, 23 nt, Human
gccagggacagaggggguggccu

SEQ ID NO: 3661949 - RNA, 16 nt, Human
gccagggaccccagaa

SEQ ID NO: 3661950 - RNA, 15 nt, Human
gccagggagaagcuc

SEQ ID NO: 3661951 - RNA, 20 nt, Human
gccagggagaagcuccucuc

SEQ ID NO: 3661952 - RNA, 16 nt, Human
gccagggagacagagc

SEQ ID NO: 3661953 - RNA, 15 nt, Human
gccagggagaccugg

SEQ ID NO: 3661954 - RNA, 20 nt, Human
gccagggagagcccaggagc

SEQ ID NO: 3661955 - RNA, 19 nt, Human
gccagggauggggccacag

SEQ ID NO: 3661956 - RNA, 14 nt, Human
gccagggcagggcc

SEQ ID NO: 3661957 - RNA, 14 nt, Human
gccagggccccucu

SEQ ID NO: 3661958 - RNA, 22 nt, Human
gccagggccccucuccccaggg

SEQ ID NO: 3661959 - RNA, 15 nt, Human
gccagggcccugcag

SEQ ID NO: 3661960 - RNA, 17 nt, Human
gccagggcccugcagag

SEQ ID NO: 3661961 - RNA, 19 nt, Human
gccagggcccugcagaggg

SEQ ID NO: 3661962 - RNA, 13 nt, Human
gccagggccugcg

SEQ ID NO: 3661963 - RNA, 14 nt, Human
gccagggcugcccu

SEQ ID NO: 3661964 - RNA, 14 nt, Human
gccagggcuggaga

SEQ ID NO: 3661965 - RNA, 22 nt, Human
gccaggggaaaaucagccugcu

SEQ ID NO: 3661966 - RNA, 23 nt, Human
gccaggggaaaaucagccugcuc

SEQ ID NO: 3661967 - RNA, 14 nt, Human
gccaggggagcaga

SEQ ID NO: 3661968 - RNA, 21 nt, Human
gccaggggagcagaggggcag

SEQ ID NO: 3661969 - RNA, 22 nt, Human
gccaggggagguuacagguacc

SEQ ID NO: 3661970 - RNA, 16 nt, Human
gccaggggcuuuugcu

SEQ ID NO: 3661971 - RNA, 20 nt, Human
gccagggggacuagccccug

SEQ ID NO: 3661972 - RNA, 20 nt, Human
gccagggggagcugggccug

SEQ ID NO: 3661973 - RNA, 22 nt, Human
gccagggggagcugggccuggu

SEQ ID NO: 3661974 - RNA, 21 nt, Human
gccaggggggugaggagcugg

SEQ ID NO: 3661975 - RNA, 22 nt, Human
gccaggggggugaggagcuggg

SEQ ID NO: 3661976 - RNA, 23 nt, Human
gcccccagcuaagaaccuggaac

SEQ ID NO: 3661977 - RNA, 12 nt, Human
gcccccagcugg

SEQ ID NO: 3661978 - RNA, 13 nt, Human
gcccccagcuggc

SEQ ID NO: 3661979 - RNA, 15 nt, Human
gcccccagcuggccc

SEQ ID NO: 3661980 - RNA, 16 nt, Human
gcccccaggacugggc

SEQ ID NO: 3661981 - RNA, 16 nt, Human
gcccccaggcugcugg

SEQ ID NO: 3661982 - RNA, 14 nt, Human
gcccccagguaggg

SEQ ID NO: 3661983 - RNA, 18 nt, Human
gcccccaguccccacccc

SEQ ID NO: 3661984 - RNA, 19 nt, Human
gcccccaucauccucuggc

SEQ ID NO: 3661985 - RNA, 17 nt, Human
gccccccacacuucccu

SEQ ID NO: 3661986 - RNA, 19 nt, Human
gccccccacacuucccugg

SEQ ID NO: 3661987 - RNA, 14 nt, Human
gccccccaccccag

SEQ ID NO: 3661988 - RNA, 16 nt, Human
gccccccagcucaggg

SEQ ID NO: 3661989 - RNA, 15 nt, Human
gccccccauccuggc

SEQ ID NO: 3661990 - RNA, 16 nt, Human
gccccccauccuggcc

SEQ ID NO: 3661991 - RNA, 17 nt, Human
gccccccauccuggccc

SEQ ID NO: 3661992 - RNA, 19 nt, Human
gccccccauccuggcccau

SEQ ID NO: 3661993 - RNA, 17 nt, Human
gcccccccaacacugug

SEQ ID NO: 3661994 - RNA, 14 nt, Human
gcccccccuuccac

SEQ ID NO: 3661995 - RNA, 23 nt, Human
gcccccccuucccccuuuuuugu

SEQ ID NO: 3661996 - RNA, 14 nt, Human
gccccccucccaga

SEQ ID NO: 3661997 - RNA, 17 nt, Human
gccccccucccagaggc

SEQ ID NO: 3661998 - RNA, 16 nt, Human
gccccccuccuugcuc

SEQ ID NO: 3661999 - RNA, 20 nt, Human
gcccccgcauccccugccuc

SEQ ID NO: 3662000 - RNA, 13 nt, Human
gcccccgccccgc

SEQ ID NO: 3662001 - RNA, 22 nt, Human
gcccccuccccggcacccucug

SEQ ID NO: 3662002 - RNA, 16 nt, Human
gcccccuccgcccugc

SEQ ID NO: 3662003 - RNA, 18 nt, Human
gcccccuccgcccugcca

SEQ ID NO: 3662004 - RNA, 19 nt, Human
gcccccuccucuagcugug

SEQ ID NO: 3662005 - RNA, 20 nt, Human
gcccccuccucuagcugugg

SEQ ID NO: 3662006 - RNA, 17 nt, Human
gcccccuccucucccau

SEQ ID NO: 3662007 - RNA, 13 nt, Human
gcccccuccugaa

SEQ ID NO: 3662008 - RNA, 21 nt, Human
gcccccuccugaaccgcacag

SEQ ID NO: 3662009 - RNA, 22 nt, Human
gcccccuccugaaccgcacagc

SEQ ID NO: 3662010 - RNA, 17 nt, Human
gcccccucugcccugcg

SEQ ID NO: 3662011 - RNA, 18 nt, Human
gcccccugaaacuuauuu

SEQ ID NO: 3662012 - RNA, 18 nt, Human
gcccccugaccacucaga

SEQ ID NO: 3662013 - RNA, 12 nt, Human
gcccccugcaga

SEQ ID NO: 3662014 - RNA, 13 nt, Human
gcccccugcagga

SEQ ID NO: 3662015 - RNA, 16 nt, Human
gcccccugcaggaagg

SEQ ID NO: 3662016 - RNA, 18 nt, Human
gcccccugcaggaaggag

SEQ ID NO: 3662017 - RNA, 21 nt, Human
gcccccugcaggaaggagcug

SEQ ID NO: 3662018 - RNA, 23 nt, Human
gcccccugcaggaaggagcugcc

SEQ ID NO: 3662019 - RNA, 11 nt, Human
gcccccugccc

SEQ ID NO: 3662020 - RNA, 14 nt, Human
gcccccugcccccc

SEQ ID NO: 3662021 - RNA, 14 nt, Human
gcccccugcccucc

SEQ ID NO: 3662022 - RNA, 13 nt, Human
gcccccugccugc

SEQ ID NO: 3662023 - RNA, 13 nt, Human
gcccccugcuggc

SEQ ID NO: 3662024 - RNA, 13 nt, Human
gcccccuggccuc

SEQ ID NO: 3662025 - RNA, 14 nt, Human
gcccccuggccucu

SEQ ID NO: 3662026 - RNA, 22 nt, Human
gcccccugguggacaguccugg

SEQ ID NO: 3662027 - RNA, 19 nt, Human
gcccccuucucccacacug

SEQ ID NO: 3662028 - RNA, 16 nt, Human
gcccccuuucagaugu

SEQ ID NO: 3662029 - RNA, 15 nt, Human
gcccccuuucccggg

SEQ ID NO: 3662030 - RNA, 18 nt, Human
gcccccuuucccgggcug

SEQ ID NO: 3662031 - RNA, 19 nt, Human
gcccccuuugggcccaggg

SEQ ID NO: 3662032 - RNA, 21 nt, Human
gcccccuuugggcccagggac

SEQ ID NO: 3662033 - RNA, 16 nt, Human
gccccgacuccagcca

SEQ ID NO: 3662034 - RNA, 21 nt, Human
gccccgacuccagccagcgcc

SEQ ID NO: 3662035 - RNA, 17 nt, Human
gccccgaggacccagac

SEQ ID NO: 3662036 - RNA, 18 nt, Human
gccccgaggacccagacc

SEQ ID NO: 3662037 - RNA, 19 nt, Human
gccccgaggacccagaccc

SEQ ID NO: 3662038 - RNA, 21 nt, Human
gccccgaggacccagacccag

SEQ ID NO: 3662039 - RNA, 15 nt, Human
gccccgaggccuucu

SEQ ID NO: 3662040 - RNA, 14 nt, Human
gccccgcccaggcu

SEQ ID NO: 3662041 - RNA, 15 nt, Human
gccccgccccacauu

SEQ ID NO: 3662042 - RNA, 21 nt, Human
gccccgcccccaguccccacc

SEQ ID NO: 3662043 - RNA, 17 nt, Human
gccccgcccucuuccug

SEQ ID NO: 3662044 - RNA, 15 nt, Human
gccccgcccugcccc

SEQ ID NO: 3662045 - RNA, 14 nt, Human
gccccgcuugucca

SEQ ID NO: 3662046 - RNA, 19 nt, Human
gccccgcuuguccagcgcc

SEQ ID NO: 3662047 - RNA, 15 nt, Human
gccccggaucagagc

SEQ ID NO: 3662048 - RNA, 17 nt, Human
gccccggaucagagcag

SEQ ID NO: 3662049 - RNA, 22 nt, Human
gccccggaucagagcaggaccu

SEQ ID NO: 3662050 - RNA, 18 nt, Human
gccccggccaccucugcg

SEQ ID NO: 3662051 - RNA, 17 nt, Human
gccccggccccagccag

SEQ ID NO: 3662052 - RNA, 18 nt, Human
gccccggccccagccaga

SEQ ID NO: 3662053 - RNA, 17 nt, Human
gccccggcccugggcuc

SEQ ID NO: 3662054 - RNA, 21 nt, Human
gccccggcccugggcucggag

SEQ ID NO: 3662055 - RNA, 18 nt, Human
gccccgggacuuggaggg

SEQ ID NO: 3662056 - RNA, 19 nt, Human
gccccggggugaguccauu

SEQ ID NO: 3662057 - RNA, 21 nt, Human
gccccgucuacagcuccccca

SEQ ID NO: 3662058 - RNA, 17 nt, Human
gccccgucucaggucug

SEQ ID NO: 3662059 - RNA, 14 nt, Human
gccccgucucuguu

SEQ ID NO: 3662060 - RNA, 15 nt, Human
gccccgugcagacug

SEQ ID NO: 3662061 - RNA, 14 nt, Human
cuggcuggaaggga

SEQ ID NO: 3662062 - RNA, 12 nt, Human
cuggcuggagcc

SEQ ID NO: 3662063 - RNA, 15 nt, Human
cuggcuggagccuag

SEQ ID NO: 3662064 - RNA, 13 nt, Human
cuggcuggaguga

SEQ ID NO: 3662065 - RNA, 15 nt, Human
cuggcuggcacagaa

SEQ ID NO: 3662066 - RNA, 16 nt, Human
cuggcuggcugagggc

SEQ ID NO: 3662067 - RNA, 19 nt, Human
cuggcugggacguggcuca

SEQ ID NO: 3662068 - RNA, 21 nt, Human
cuggcugggacguggcucagc

SEQ ID NO: 3662069 - RNA, 15 nt, Human
cuggcugggacuggg

SEQ ID NO: 3662070 - RNA, 17 nt, Human
cuggcugggacugggaa

SEQ ID NO: 3662071 - RNA, 18 nt, Human
cuggcuggggccuaucag

SEQ ID NO: 3662072 - RNA, 21 nt, Human
cuggcuggggccuaucagugu

SEQ ID NO: 3662073 - RNA, 23 nt, Human
cuggcugggguggccuguguggc

SEQ ID NO: 3662074 - RNA, 21 nt, Human
cuggcuggguggcaccagcag

SEQ ID NO: 3662075 - RNA, 18 nt, Human
cuggcugguaagggccaa

SEQ ID NO: 3662076 - RNA, 22 nt, Human
cuggcugguguuaacagaaggg

SEQ ID NO: 3662077 - RNA, 15 nt, Human
cuggcuguaaggcuc

SEQ ID NO: 3662078 - RNA, 17 nt, Human
cuggcuguaaggcucua

SEQ ID NO: 3662079 - RNA, 20 nt, Human
cuggcuguaaggcucuagau

SEQ ID NO: 3662080 - RNA, 13 nt, Human
cuggcugucgaga

SEQ ID NO: 3662081 - RNA, 18 nt, Human
cuggcuguggccuaaccu

SEQ ID NO: 3662082 - RNA, 14 nt, Human
cuggcugugggcuc

SEQ ID NO: 3662083 - RNA, 16 nt, Human
cuggcugugggcuccc

SEQ ID NO: 3662084 - RNA, 17 nt, Human
cuggcuguuggcugggg

SEQ ID NO: 3662085 - RNA, 18 nt, Human
cuggcuuacacuggcaau

SEQ ID NO: 3662086 - RNA, 13 nt, Human
cuggcuucaggag

SEQ ID NO: 3662087 - RNA, 21 nt, Human
cuggcuucaggcaauucuccu

SEQ ID NO: 3662088 - RNA, 12 nt, Human
cuggcuuccagg

SEQ ID NO: 3662089 - RNA, 14 nt, Human
cuggcuuccaggua

SEQ ID NO: 3662090 - RNA, 18 nt, Human
cuggcuucccauccccag

SEQ ID NO: 3662091 - RNA, 22 nt, Human
cuggcuucccauccccagcgau

SEQ ID NO: 3662092 - RNA, 17 nt, Human
cuggcuucuggccagga

SEQ ID NO: 3662093 - RNA, 17 nt, Human
cuggcuucuguggggcc

SEQ ID NO: 3662094 - RNA, 21 nt, Human
cuggcuucuguggggccccuc

SEQ ID NO: 3662095 - RNA, 20 nt, Human
cuggcuuggccacagccagg

SEQ ID NO: 3662096 - RNA, 20 nt, Human
cuggcuuggggucaagaaac

SEQ ID NO: 3662097 - RNA, 17 nt, Human
cuggcuuguaacuccac

SEQ ID NO: 3662098 - RNA, 19 nt, Human
cuggcuuguaacuccacca

SEQ ID NO: 3662099 - RNA, 16 nt, Human
cuggcuuguuguaaag

SEQ ID NO: 3662100 - RNA, 14 nt, Human
cuggcuuguuuauu

SEQ ID NO: 3662101 - RNA, 18 nt, Human
cuggcuuguuuauuuugu

SEQ ID NO: 3662102 - RNA, 14 nt, Human
cuggcuuugagaag

SEQ ID NO: 3662103 - RNA, 19 nt, Human
cuggcuuugcccaaccuca

SEQ ID NO: 3662104 - RNA, 11 nt, Human
cuggcuuuggc

SEQ ID NO: 3662105 - RNA, 22 nt, Human
cuggcuuuucacugcuggcugc

SEQ ID NO: 3662106 - RNA, 22 nt, Human
cugggaaaaacuuuggaaccag

SEQ ID NO: 3662107 - RNA, 11 nt, Human
cugggaaacag

SEQ ID NO: 3662108 - RNA, 17 nt, Human
cugggaaagcauaaagc

SEQ ID NO: 3662109 - RNA, 16 nt, Human
cugggaaauaagagag

SEQ ID NO: 3662110 - RNA, 17 nt, Human
cugggaaauaagagaga

SEQ ID NO: 3662111 - RNA, 16 nt, Human
cugggaaaugagcagg

SEQ ID NO: 3662112 - RNA, 14 nt, Human
cugggaacagaacu

SEQ ID NO: 3662113 - RNA, 15 nt, Human
cugggaacagaacuc

SEQ ID NO: 3662114 - RNA, 21 nt, Human
cugggaacagugugcaaggca

SEQ ID NO: 3662115 - RNA, 23 nt, Human
cugggaacaucacauuccucugc

SEQ ID NO: 3662116 - RNA, 19 nt, Human
cugggaaccccuuucccac

SEQ ID NO: 3662117 - RNA, 15 nt, Human
cugggaaccucccag

SEQ ID NO: 3662118 - RNA, 17 nt, Human
cugggaaccucccagag

SEQ ID NO: 3662119 - RNA, 22 nt, Human
cugggaaccucccagaggucca

SEQ ID NO: 3662120 - RNA, 23 nt, Human
cugggaaccucccagagguccag

SEQ ID NO: 3662121 - RNA, 18 nt, Human
cugguuaggauggcagga

SEQ ID NO: 3662122 - RNA, 22 nt, Human
cugguuagguuaggacuugccc

SEQ ID NO: 3662123 - RNA, 20 nt, Human
cugguucacacugaccaaga

SEQ ID NO: 3662124 - RNA, 12 nt, Human
gccgaagcucug

SEQ ID NO: 3662125 - RNA, 15 nt, Human
gccgaaugcccucag

SEQ ID NO: 3662126 - RNA, 17 nt, Human
gccgaccagagccccac

SEQ ID NO: 3662127 - RNA, 12 nt, Human
gccgaccagagg

SEQ ID NO: 3662128 - RNA, 23 nt, Human
gccgacccccucucccugcaugg

SEQ ID NO: 3662129 - RNA, 22 nt, Human
gccgaccccuaguucccucugc

SEQ ID NO: 3662130 - RNA, 13 nt, Human
gccgaccucagcc

SEQ ID NO: 3662131 - RNA, 14 nt, Human
gccgaccucagccu

SEQ ID NO: 3662132 - RNA, 13 nt, Human
gccgaccucgucc

SEQ ID NO: 3662133 - RNA, 20 nt, Human
gccgaccucguccucccccu

SEQ ID NO: 3662134 - RNA, 12 nt, Human
gccgacucuggc

SEQ ID NO: 3662135 - RNA, 22 nt, Human
gccgacugcacagcggccccug

SEQ ID NO: 3662136 - RNA, 13 nt, Human
gccgagaagcaag

SEQ ID NO: 3662137 - RNA, 19 nt, Human
gccgagacucgacucugug

SEQ ID NO: 3662138 - RNA, 23 nt, Human
gccgagacucgacucugugccuc

SEQ ID NO: 3662139 - RNA, 16 nt, Human
gccgagagccugcucc

SEQ ID NO: 3662140 - RNA, 20 nt, Human
gccgagagccugcuccccca

SEQ ID NO: 3662141 - RNA, 16 nt, Human
gccgagauagccaagg

SEQ ID NO: 3662142 - RNA, 17 nt, Human
gccgagauagccaaggc

SEQ ID NO: 3662143 - RNA, 19 nt, Human
gccgagauagccaaggcca

SEQ ID NO: 3662144 - RNA, 18 nt, Human
gccgagaucacgccacug

SEQ ID NO: 3662145 - RNA, 19 nt, Human
gccgagaucacgccacugc

SEQ ID NO: 3662146 - RNA, 22 nt, Human
gccgagaucacgccacugcacu

SEQ ID NO: 3662147 - RNA, 15 nt, Human
gccgagcaggaggcc

SEQ ID NO: 3662148 - RNA, 23 nt, Human
gccgagcucguguauccuggggc

SEQ ID NO: 3662149 - RNA, 18 nt, Human
gccgaggccaugugcaua

SEQ ID NO: 3662150 - RNA, 21 nt, Human
gccgauagagggacggccaag

SEQ ID NO: 3662151 - RNA, 17 nt, Human
gccgauauacucuagau

SEQ ID NO: 3662152 - RNA, 22 nt, Human
gccgauauacucuagaugaagu

SEQ ID NO: 3662153 - RNA, 17 nt, Human
gccgauucaccugagca

SEQ ID NO: 3662154 - RNA, 17 nt, Human
gccgcaaaccacacugg

SEQ ID NO: 3662155 - RNA, 19 nt, Human
gccgcaaaccacacuggac

SEQ ID NO: 3662156 - RNA, 20 nt, Human
gccgcaccuaaagcagccag

SEQ ID NO: 3662157 - RNA, 13 nt, Human
gccgcagcccugc

SEQ ID NO: 3662158 - RNA, 16 nt, Human
gccgcagcccugcaga

SEQ ID NO: 3662159 - RNA, 14 nt, Human
gccgcagcucuugc

SEQ ID NO: 3662160 - RNA, 19 nt, Human
gccgcagcucuugcccuuc

SEQ ID NO: 3662161 - RNA, 18 nt, Human
gccgcaucucacagcuau

SEQ ID NO: 3662162 - RNA, 14 nt, Human
gccgcauucccuga

SEQ ID NO: 3662163 - RNA, 15 nt, Human
gccgcauucccugag

SEQ ID NO: 3662164 - RNA, 16 nt, Human
gccgcauucccugagu

SEQ ID NO: 3662165 - RNA, 17 nt, Human
gccgccaguacuuguca

SEQ ID NO: 3662166 - RNA, 15 nt, Human
gccgccaugcuccug

SEQ ID NO: 3662167 - RNA, 16 nt, Human
gccgccauugccacca

SEQ ID NO: 3662168 - RNA, 17 nt, Human
gccgccauugccaccag

SEQ ID NO: 3662169 - RNA, 18 nt, Human
gccgccauugccaccagg

SEQ ID NO: 3662170 - RNA, 21 nt, Human
gccgccauugccaccaggaga

SEQ ID NO: 3662171 - RNA, 14 nt, Human
gccgcccaaggccu

SEQ ID NO: 3662172 - RNA, 15 nt, Human
gccgcccgggcccag

SEQ ID NO: 3662173 - RNA, 17 nt, Human
gccgcccuguacccucu

SEQ ID NO: 3662174 - RNA, 14 nt, Human
gccgccgccucgcc

SEQ ID NO: 3662175 - RNA, 16 nt, Human
gccgccgccucgccca

SEQ ID NO: 3662176 - RNA, 17 nt, Human
gccgccuaggcucagcg

SEQ ID NO: 3662177 - RNA, 13 nt, Human
gccgccucaaugu

SEQ ID NO: 3662178 - RNA, 12 nt, Human
gccgccucccag

SEQ ID NO: 3662179 - RNA, 15 nt, Human
gccgccucccagccu

SEQ ID NO: 3662180 - RNA, 19 nt, Human
gccgccucccagccugggg

SEQ ID NO: 3662181 - RNA, 16 nt, Human
gccgccucgcccaccg

SEQ ID NO: 3662182 - RNA, 19 nt, Human
gccgccugcacuccucagg

SEQ ID NO: 3662183 - RNA, 16 nt, Human
gccgcgcguccagcug

SEQ ID NO: 3662184 - RNA, 15 nt, Human
gccgcggagccugca

SEQ ID NO: 3662185 - RNA, 20 nt, Human
gccgcguggugccaucccca

SEQ ID NO: 3662186 - RNA, 16 nt, Human
gccgcuaccucccucc

SEQ ID NO: 3662187 - RNA, 17 nt, Human
gccgcuaccucccuccc

SEQ ID NO: 3662188 - RNA, 15 nt, Human
gccgcuagaggccug

SEQ ID NO: 3662189 - RNA, 18 nt, Human
gccgcuagaggccugagg

SEQ ID NO: 3662190 - RNA, 19 nt, Human
gccgcuagaggccugagga

SEQ ID NO: 3662191 - RNA, 21 nt, Human
gccgcuccugucugccagcca

SEQ ID NO: 3662192 - RNA, 15 nt, Human
gccgcucuccugcca

SEQ ID NO: 3662193 - RNA, 17 nt, Human
gccgcugccacccaccu

SEQ ID NO: 3662194 - RNA, 15 nt, Human
gccgcuguucaccca

SEQ ID NO: 3662195 - RNA, 22 nt, Human
gccggacccggaggccgaggcc

SEQ ID NO: 3662196 - RNA, 19 nt, Human
gccggaguccacucccagu

SEQ ID NO: 3662197 - RNA, 15 nt, Human
gccggaugugcuuuu

SEQ ID NO: 3662198 - RNA, 11 nt, Human
gccggcaaccc

SEQ ID NO: 3662199 - RNA, 21 nt, Human
gccggcaauaaaagcccagga

SEQ ID NO: 3662200 - RNA, 22 nt, Human
gccggcaauaaaagcccaggag

SEQ ID NO: 3662201 - RNA, 17 nt, Human
gccggcagccccagccu

SEQ ID NO: 3662202 - RNA, 20 nt, Human
gccggcagccccagccugcu

SEQ ID NO: 3662203 - RNA, 16 nt, Human
gccggcaggccuggac

SEQ ID NO: 3662204 - RNA, 15 nt, Human
gccggcauggcuggg

SEQ ID NO: 3662205 - RNA, 19 nt, Human
gccggccaauggaaaccuc

SEQ ID NO: 3662206 - RNA, 12 nt, Human
gccggccagccc

SEQ ID NO: 3662207 - RNA, 14 nt, Human
gccggccagccccu

SEQ ID NO: 3662208 - RNA, 13 nt, Human
gccggccaggugg

SEQ ID NO: 3662209 - RNA, 16 nt, Human
gccggcccgccucucc

SEQ ID NO: 3662210 - RNA, 13 nt, Human
gccggcccugggg

SEQ ID NO: 3662211 - RNA, 15 nt, Human
gccggcccugugugc

SEQ ID NO: 3662212 - RNA, 16 nt, Human
gccggcccugugugca

SEQ ID NO: 3662213 - RNA, 18 nt, Human
gccggccucucuggccuc

SEQ ID NO: 3662214 - RNA, 17 nt, Human
gccggcgagcccugugg

SEQ ID NO: 3662215 - RNA, 22 nt, Human
gccggcuggaaaugcugggcug

SEQ ID NO: 3662216 - RNA, 22 nt, Human
gccgggaacagacaacagaagu

SEQ ID NO: 3662217 - RNA, 18 nt, Human
gccgggaccacccugagc

SEQ ID NO: 3662218 - RNA, 18 nt, Human
gccgggaccccgagccug

SEQ ID NO: 3662219 - RNA, 23 nt, Human
gccgggaccccgagccuggcucc

SEQ ID NO: 3662220 - RNA, 12 nt, Human
gccgggcacagc

SEQ ID NO: 3662221 - RNA, 20 nt, Human
gccgggcgugguggugagug

SEQ ID NO: 3662222 - RNA, 21 nt, Human
gccgggcuacccgugagcccu

SEQ ID NO: 3662223 - RNA, 13 nt, Human
gccgggcugaggg

SEQ ID NO: 3662224 - RNA, 16 nt, Human
gccggggaacuggcca

SEQ ID NO: 3662225 - RNA, 22 nt, Human
gccggggaacuggccaagcuga

SEQ ID NO: 3662226 - RNA, 23 nt, Human
gccggggaagacuugaaagaaag

SEQ ID NO: 3662227 - RNA, 12 nt, Human
gccggggaagag

SEQ ID NO: 3662228 - RNA, 16 nt, Human
gccggggacagaggcc

SEQ ID NO: 3662229 - RNA, 23 nt, Human
gccggggacagaggccugcccgg

SEQ ID NO: 3662230 - RNA, 17 nt, Human
gccggggccugccuagc

SEQ ID NO: 3662231 - RNA, 23 nt, Human
gccggggccuuaucgggcuccag

SEQ ID NO: 3662232 - RNA, 22 nt, Human
gccgggguggagcaugggccug

SEQ ID NO: 3662233 - RNA, 22 nt, Human
gccggggugggguggcugcagc

SEQ ID NO: 3662234 - RNA, 16 nt, Human
gccgggugcgguggcu

SEQ ID NO: 3662235 - RNA, 19 nt, Human
gccgggugcgguggcucac

SEQ ID NO: 3662236 - RNA, 17 nt, Human
gccgggugcucagggcu

SEQ ID NO: 3662237 - RNA, 23 nt, Human
gccggguguccccaacagcgccc

SEQ ID NO: 3662238 - RNA, 18 nt, Human
gccggguucuagucuccu

SEQ ID NO: 3662239 - RNA, 17 nt, Human
gccgguaacuguccugu

SEQ ID NO: 3662240 - RNA, 24 nt, Human
gccggucgcccuuugcugcauggc

SEQ ID NO: 3662241 - RNA, 21 nt, Human
gccggugugccugacugccca

SEQ ID NO: 3662242 - RNA, 16 nt, Human
gccggugugggggccc

SEQ ID NO: 3662243 - RNA, 14 nt, Human
gccguaauuuaacu

SEQ ID NO: 3662244 - RNA, 12 nt, Human
gccguacaguuc

SEQ ID NO: 3662245 - RNA, 16 nt, Human
gccguaccccacccuc

SEQ ID NO: 3662246 - RNA, 18 nt, Human
gccguaccccacccucag

SEQ ID NO: 3662247 - RNA, 20 nt, Human
gccguaucuccggcucccag

SEQ ID NO: 3662248 - RNA, 16 nt, Human
gccgucaccaccaccc

SEQ ID NO: 3662249 - RNA, 17 nt, Human
gccgucaccaccacccc

SEQ ID NO: 3662250 - RNA, 17 nt, Human
gccgucagugcugugcu

SEQ ID NO: 3662251 - RNA, 23 nt, Human
gccguccuaaccucgggccugcu

SEQ ID NO: 3662252 - RNA, 17 nt, Human
gccgucuaccugagggg

SEQ ID NO: 3662253 - RNA, 20 nt, Human
gccgucuaccugaggggccu

SEQ ID NO: 3662254 - RNA, 11 nt, Human
gccgucucaac

SEQ ID NO: 3662255 - RNA, 23 nt, Human
gccgucuccaggggcugcuuccu

SEQ ID NO: 3662256 - RNA, 14 nt, Human
gccgugaccccugc

SEQ ID NO: 3662257 - RNA, 18 nt, Human
gccgugacgucugggugg

SEQ ID NO: 3662258 - RNA, 15 nt, Human
gccgugaugccuccc

SEQ ID NO: 3662259 - RNA, 16 nt, Human
gccgugcauuagcaca

SEQ ID NO: 3662260 - RNA, 14 nt, Human
gccgugccuucagc

SEQ ID NO: 3662261 - RNA, 17 nt, Human
gccgugccuucagcucu

SEQ ID NO: 3662262 - RNA, 18 nt, Human
gccgugcugggcagcccg

SEQ ID NO: 3662263 - RNA, 12 nt, Human
gccguggaugcg

SEQ ID NO: 3662264 - RNA, 23 nt, Human
gccguggauugcacguggccucu

SEQ ID NO: 3662265 - RNA, 18 nt, Human
gccguggcugcggcaccc

SEQ ID NO: 3662266 - RNA, 22 nt, Human
gccucaguaaguaucuggagga

SEQ ID NO: 3662267 - RNA, 15 nt, Human
gccucaguauauuua

SEQ ID NO: 3662268 - RNA, 18 nt, Human
gccucaguccuccccuca

SEQ ID NO: 3662269 - RNA, 24 nt, Human
gccucaguccuccccucacagccu

SEQ ID NO: 3662270 - RNA, 18 nt, Human
gccucagucucccucccu

SEQ ID NO: 3662271 - RNA, 15 nt, Human
gccucagugccacua

SEQ ID NO: 3662272 - RNA, 22 nt, Human
gccucaucuauaacaugcauuu

SEQ ID NO: 3662273 - RNA, 13 nt, Human
gccucauguggcu

SEQ ID NO: 3662274 - RNA, 19 nt, Human
gccucauguggcuggaaga

SEQ ID NO: 3662275 - RNA, 21 nt, Human
gccucauuacuuuaccacccc

SEQ ID NO: 3662276 - RNA, 22 nt, Human
gccuccaaaugccaacuugucc

SEQ ID NO: 3662277 - RNA, 20 nt, Human
gccuccaacccuagcaaaag

SEQ ID NO: 3662278 - RNA, 22 nt, Human
gccuccaaggaggggcuguaaa

SEQ ID NO: 3662279 - RNA, 21 nt, Human
gccuccacagcgagggcagcu

SEQ ID NO: 3662280 - RNA, 21 nt, Human
gccuccaccaccacuggccac

SEQ ID NO: 3662281 - RNA, 18 nt, Human
gccuccaccccccagaac

SEQ ID NO: 3662282 - RNA, 22 nt, Human
gccuccacccucugagcuuugc

SEQ ID NO: 3662283 - RNA, 16 nt, Human
gccuccacucccacuu

SEQ ID NO: 3662284 - RNA, 21 nt, Human
gccuccacucccacuucccug

SEQ ID NO: 3662285 - RNA, 12 nt, Human
gccuccagaacu

SEQ ID NO: 3662286 - RNA, 22 nt, Human
gccuccagaggggcucagguca

SEQ ID NO: 3662287 - RNA, 13 nt, Human
gccuccagggcug

SEQ ID NO: 3662288 - RNA, 19 nt, Human
gcccucaaacuugacucua

SEQ ID NO: 3662289 - RNA, 17 nt, Human
gcccucaaggccuccca

SEQ ID NO: 3662290 - RNA, 23 nt, Human
gcccucaaggccucccacaguga

SEQ ID NO: 3662291 - RNA, 14 nt, Human
gcccucaagucuuu

SEQ ID NO: 3662292 - RNA, 16 nt, Human
gcccucaauugugaaa

SEQ ID NO: 3662293 - RNA, 13 nt, Human
gcccucaccccug

SEQ ID NO: 3662294 - RNA, 19 nt, Human
gcccucaccccugcccugg

SEQ ID NO: 3662295 - RNA, 22 nt, Human
gcccucaccccugguucucauc

SEQ ID NO: 3662296 - RNA, 19 nt, Human
gcccucagaacccuuggcu

SEQ ID NO: 3662297 - RNA, 23 nt, Human
gcccucagaacccuuggcuugcc

SEQ ID NO: 3662298 - RNA, 17 nt, Human
gcccucagaugucccuu

SEQ ID NO: 3662299 - RNA, 22 nt, Human
gcccucaggucagggugaggau

SEQ ID NO: 3662300 - RNA, 19 nt, Human
gcccucauggccccucuga

SEQ ID NO: 3662301 - RNA, 18 nt, Human
gcccucauuacugggccu

SEQ ID NO: 3662302 - RNA, 19 nt, Human
gcccucauuacugggccuu

SEQ ID NO: 3662303 - RNA, 19 nt, Human
gcccuccaagaccuucucc

SEQ ID NO: 3662304 - RNA, 13 nt, Human
gcccuccacaccu

SEQ ID NO: 3662305 - RNA, 14 nt, Human
gcccuccacaccug

SEQ ID NO: 3662306 - RNA, 18 nt, Human
gcccuccacaccugcggc

SEQ ID NO: 3662307 - RNA, 14 nt, Human
gcccuccacagccg

SEQ ID NO: 3662308 - RNA, 23 nt, Human
gcccuccacagccgcagccuccc

SEQ ID NO: 3662309 - RNA, 13 nt, Human
gcccuccacugcc

SEQ ID NO: 3662310 - RNA, 16 nt, Human
gcccuccagagcccca

SEQ ID NO: 3662311 - RNA, 22 nt, Human
gcccuccaucccgacauggacc

SEQ ID NO: 3662312 - RNA, 20 nt, Human
gcccuccaucuaaacugccc

SEQ ID NO: 3662313 - RNA, 14 nt, Human
gcccucccacuuug

SEQ ID NO: 3662314 - RNA, 23 nt, Human
gcccucccacuuugcuguuccuu

SEQ ID NO: 3662315 - RNA, 12 nt, Human
gcccucccaggc

SEQ ID NO: 3662316 - RNA, 19 nt, Human
gcccuccccucucugcacc

SEQ ID NO: 3662317 - RNA, 18 nt, Human
gcccucccuguccuccuc

SEQ ID NO: 3662318 - RNA, 21 nt, Human
gcccucccuguuccccagaga

SEQ ID NO: 3662319 - RNA, 21 nt, Human
gcccucccuuggaaaccugcc

SEQ ID NO: 3662320 - RNA, 14 nt, Human
gcccuccgacagcc

SEQ ID NO: 3662321 - RNA, 17 nt, Human
gcccuccuacccugcgc

SEQ ID NO: 3662322 - RNA, 18 nt, Human
gcccuccuacccugcgcc

SEQ ID NO: 3662323 - RNA, 19 nt, Human
gcccuccuacccugcgccc

SEQ ID NO: 3662324 - RNA, 14 nt, Human
gcccuccucuccca

SEQ ID NO: 3662325 - RNA, 17 nt, Human
gcccuccucucccauug

SEQ ID NO: 3662326 - RNA, 12 nt, Human
gcccuccugugc

SEQ ID NO: 3662327 - RNA, 19 nt, Human
gcccuccugugcucagccc

SEQ ID NO: 3662328 - RNA, 22 nt, Human
gcccuccugugcucagcccuga

SEQ ID NO: 3662329 - RNA, 15 nt, Human
gcccuccuuguccac

SEQ ID NO: 3662330 - RNA, 17 nt, Human
gcccuccuuucugugcc

SEQ ID NO: 3662331 - RNA, 13 nt, Human
gcccucgacacuc

SEQ ID NO: 3662332 - RNA, 16 nt, Human
gcccucgcccccgccc

SEQ ID NO: 3662333 - RNA, 15 nt, Human
gcccucgggcccagc

SEQ ID NO: 3662334 - RNA, 16 nt, Human
gcccucgggcccagcc

SEQ ID NO: 3662335 - RNA, 16 nt, Human
gcccucguggccagcc

SEQ ID NO: 3662336 - RNA, 17 nt, Human
gcccucgugguggaaac

SEQ ID NO: 3662337 - RNA, 13 nt, Human
gcccucuaccccu

SEQ ID NO: 3662338 - RNA, 17 nt, Human
gcccucuagggagggac

SEQ ID NO: 3662339 - RNA, 20 nt, Human
gcccucucccacccucuucc

SEQ ID NO: 3662340 - RNA, 15 nt, Human
gcccucuccccaccc

SEQ ID NO: 3662341 - RNA, 22 nt, Human
gcccucuccccaccccuacccc

SEQ ID NO: 3662342 - RNA, 17 nt, Human
gcccucuccccucagcc

SEQ ID NO: 3662343 - RNA, 20 nt, Human
gcccucuccccucagccucu

SEQ ID NO: 3662344 - RNA, 17 nt, Human
gcccucuccccugcccc

SEQ ID NO: 3662345 - RNA, 22 nt, Human
gcccucucccucuaggcucugc

SEQ ID NO: 3662346 - RNA, 17 nt, Human
gcccucucccuuacccu

SEQ ID NO: 3662347 - RNA, 12 nt, Human
gcccucuccugg

SEQ ID NO: 3662348 - RNA, 15 nt, Human
gcccucuccugggca

SEQ ID NO: 3662349 - RNA, 18 nt, Human
gcccucuccugggcagcu

SEQ ID NO: 3662350 - RNA, 22 nt, Human
gcccucucugaaggaggccacc

SEQ ID NO: 3662351 - RNA, 11 nt, Human
gcccucucuuc

SEQ ID NO: 3662352 - RNA, 19 nt, Human
gcccucugcauccucugga

SEQ ID NO: 3662353 - RNA, 12 nt, Human
gcccucugccca

SEQ ID NO: 3662354 - RNA, 19 nt, Human
gcccucugcccacucccug

SEQ ID NO: 3662355 - RNA, 14 nt, Human
gcccucuggagugg

SEQ ID NO: 3662356 - RNA, 16 nt, Human
gcccucuggaguggcc

SEQ ID NO: 3662357 - RNA, 17 nt, Human
gcccucuggaguggcca

SEQ ID NO: 3662358 - RNA, 20 nt, Human
gcccucuggaguggccacua

SEQ ID NO: 3662359 - RNA, 22 nt, Human
gcccucuggaguggccacuaag

SEQ ID NO: 3662360 - RNA, 11 nt, Human
gcccucugggc

SEQ ID NO: 3662361 - RNA, 12 nt, Human
gcccucugggcu

SEQ ID NO: 3662362 - RNA, 16 nt, Human
gcccucugggcucuga

SEQ ID NO: 3662363 - RNA, 12 nt, Human
gcccucuguccu

SEQ ID NO: 3662364 - RNA, 14 nt, Human
gcccucuguccuga

SEQ ID NO: 3662365 - RNA, 15 nt, Human
gcccucuguccugac

SEQ ID NO: 3662366 - RNA, 14 nt, Human
gcccucuuccauca

SEQ ID NO: 3662367 - RNA, 21 nt, Human
gcccucuuccccucuaaugcu

SEQ ID NO: 3662368 - RNA, 14 nt, Human
gcccucuuccugac

SEQ ID NO: 3662369 - RNA, 18 nt, Human
gcccugaagaauggcgcc

SEQ ID NO: 3662370 - RNA, 12 nt, Human
gcccugaccucc

SEQ ID NO: 3662371 - RNA, 15 nt, Human
gcccugaccucccag

SEQ ID NO: 3662372 - RNA, 19 nt, Human
gcccugagaaagcccuguc

SEQ ID NO: 3662373 - RNA, 20 nt, Human
gcccugagaagcugcuccag

SEQ ID NO: 3662374 - RNA, 12 nt, Human
gcccugagccag

SEQ ID NO: 3662375 - RNA, 23 nt, Human
gcccugagccagggucuccagaa

SEQ ID NO: 3662376 - RNA, 16 nt, Human
gcccugagcucggugg

SEQ ID NO: 3662377 - RNA, 22 nt, Human
gcccugaggaaggaggggaagc

SEQ ID NO: 3662378 - RNA, 16 nt, Human
gcccugaggaggccuu

SEQ ID NO: 3662379 - RNA, 21 nt, Human
gcccugaggugaaagggagcu

SEQ ID NO: 3662380 - RNA, 22 nt, Human
gcccugaggugaaagggagcua

SEQ ID NO: 3662381 - RNA, 18 nt, Human
gcccugaguuccuagcca

SEQ ID NO: 3662382 - RNA, 18 nt, Human
gcccugcaaaaggacucu

SEQ ID NO: 3662383 - RNA, 21 nt, Human
gcccugcaccaugcugcuggg

SEQ ID NO: 3662384 - RNA, 16 nt, Human
gcccugcaccugugca

SEQ ID NO: 3662385 - RNA, 15 nt, Human
gcccugcacuguccu

SEQ ID NO: 3662386 - RNA, 21 nt, Human
gcccugcacuguccugcucca

SEQ ID NO: 3662387 - RNA, 22 nt, Human
gcccugcacuguccugcuccac

SEQ ID NO: 3662388 - RNA, 14 nt, Human
gcccugcagagggc

SEQ ID NO: 3662389 - RNA, 16 nt, Human
gcccugcagagggcac

SEQ ID NO: 3662390 - RNA, 18 nt, Human
gcccugcagagggcacag

SEQ ID NO: 3662391 - RNA, 21 nt, Human
gcccugcagaggggaaaccag

SEQ ID NO: 3662392 - RNA, 22 nt, Human
gcccugcaguguucgcuuggcu

SEQ ID NO: 3662393 - RNA, 19 nt, Human
gcccugcaugggccagccc

SEQ ID NO: 3662394 - RNA, 21 nt, Human
gcccugcaugggccagccccu

SEQ ID NO: 3662395 - RNA, 20 nt, Human
gcccugccaccugucugucu

SEQ ID NO: 3662396 - RNA, 13 nt, Human
gcccugccacuca

SEQ ID NO: 3662397 - RNA, 19 nt, Human
gcccugccaucuucccagc

SEQ ID NO: 3662398 - RNA, 13 nt, Human
gcccugcccacac

SEQ ID NO: 3662399 - RNA, 17 nt, Human
gcccugcccaccuggcc

SEQ ID NO: 3662400 - RNA, 20 nt, Human
gcccugcccucuccuuccuu

SEQ ID NO: 3662401 - RNA, 15 nt, Human
gcccugcccugagga

SEQ ID NO: 3662402 - RNA, 16 nt, Human
gcccugcccugguuuc

SEQ ID NO: 3662403 - RNA, 13 nt, Human
gcccugccuccuu

SEQ ID NO: 3662404 - RNA, 14 nt, Human
gcccugccuccuuu

SEQ ID NO: 3662405 - RNA, 16 nt, Human
gcccugccuccuuugu

SEQ ID NO: 3662406 - RNA, 17 nt, Human
gcccugccucuccgccc

SEQ ID NO: 3662407 - RNA, 15 nt, Human
gcccugccucuguuu

SEQ ID NO: 3662408 - RNA, 23 nt, Human
gcccugccugagggccccucugc

SEQ ID NO: 3662409 - RNA, 11 nt, Human
gcccugccugg

SEQ ID NO: 3662410 - RNA, 19 nt, Human
gccucgaggugccuucuuc

SEQ ID NO: 3662411 - RNA, 19 nt, Human
gccucgcaggccucccugc

SEQ ID NO: 3662412 - RNA, 21 nt, Human
gccucgcaggccucccugcca

SEQ ID NO: 3662413 - RNA, 14 nt, Human
gccucgccuggccu

SEQ ID NO: 3662414 - RNA, 15 nt, Human
gccucgccuggccug

SEQ ID NO: 3662415 - RNA, 19 nt, Human
gccucgcucuguuacccag

SEQ ID NO: 3662416 - RNA, 16 nt, Human
gccucggacuuagcug

SEQ ID NO: 3662417 - RNA, 21 nt, Human
gccucggacuuagcugggaga

SEQ ID NO: 3662418 - RNA, 17 nt, Human
gccucggagccucaucc

SEQ ID NO: 3662419 - RNA, 17 nt, Human
gccucggauccccuucc

SEQ ID NO: 3662420 - RNA, 16 nt, Human
gccucggcuggcuccc

SEQ ID NO: 3662421 - RNA, 22 nt, Human
gccucggcuggcuccccugcag

SEQ ID NO: 3662422 - RNA, 20 nt, Human
gccucggcuuuucucagcug

SEQ ID NO: 3662423 - RNA, 18 nt, Human
gccucgggaaccucacuc

SEQ ID NO: 3662424 - RNA, 13 nt, Human
gccucgggaccuc

SEQ ID NO: 3662425 - RNA, 15 nt, Human
gccucuaaccccagg

SEQ ID NO: 3662426 - RNA, 20 nt, Human
gccucuaaccccaggccccg

SEQ ID NO: 3662427 - RNA, 18 nt, Human
gccucuacugggaaggcu

SEQ ID NO: 3662428 - RNA, 11 nt, Human
gccucuagcug

SEQ ID NO: 3662429 - RNA, 15 nt, Human
gccucucagugcccu

SEQ ID NO: 3662430 - RNA, 19 nt, Human
gccucucagugcccuccag

SEQ ID NO: 3662431 - RNA, 15 nt, Human
gccucuccagccuca

SEQ ID NO: 3662432 - RNA, 16 nt, Human
gccucuccaggcacca

SEQ ID NO: 3662433 - RNA, 22 nt, Human
gccucuccauuugcucuucaga

SEQ ID NO: 3662434 - RNA, 17 nt, Human
gccucucccaggcaggg

SEQ ID NO: 3662435 - RNA, 18 nt, Human
gccucuccccagguccag

SEQ ID NO: 3662436 - RNA, 18 nt, Human
gccucucccgucagggcc

SEQ ID NO: 3662437 - RNA, 19 nt, Human
gccucucccgucagggccc

SEQ ID NO: 3662438 - RNA, 23 nt, Human
gccucucccuccuccaggaagcc

SEQ ID NO: 3662439 - RNA, 19 nt, Human
gccucucccucugguccca

SEQ ID NO: 3662440 - RNA, 20 nt, Human
gccucucccucuggucccac

SEQ ID NO: 3662441 - RNA, 24 nt, Human
gccucuccgccccugagcccacug

SEQ ID NO: 3662442 - RNA, 22 nt, Human
gccucuccuuguggccugggcc

SEQ ID NO: 3662443 - RNA, 12 nt, Human
gccucuccuuug

SEQ ID NO: 3662444 - RNA, 23 nt, Human
gccucuccuuuguauauuauuuc

SEQ ID NO: 3662445 - RNA, 13 nt, Human
gccucucucaggc

SEQ ID NO: 3662446 - RNA, 15 nt, Human
gccucucucccaguc

SEQ ID NO: 3662447 - RNA, 14 nt, Human
gccucucucccucu

SEQ ID NO: 3662448 - RNA, 10 nt, Human
gccucucugc

SEQ ID NO: 3662449 - RNA, 18 nt, Human
gccucucugcaggucccu

SEQ ID NO: 3662450 - RNA, 14 nt, Human
gccucucuggccuc

SEQ ID NO: 3662451 - RNA, 20 nt, Human
gccucucuggccucccaccc

SEQ ID NO: 3662452 - RNA, 18 nt, Human
gccucucuuccuauccca

SEQ ID NO: 3662453 - RNA, 19 nt, Human
gccucugaaguuggacagc

SEQ ID NO: 3662454 - RNA, 18 nt, Human
gccucugacacacagcuc

SEQ ID NO: 3662455 - RNA, 20 nt, Human
gccucugacacacagcucug

SEQ ID NO: 3662456 - RNA, 13 nt, Human
gccucugaccccu

SEQ ID NO: 3662457 - RNA, 17 nt, Human
gccucugaccccuccuc

SEQ ID NO: 3662458 - RNA, 16 nt, Human
gccucugagagcauca

SEQ ID NO: 3662459 - RNA, 12 nt, Human
gccucugaggcc

SEQ ID NO: 3662460 - RNA, 16 nt, Human
gccucugaggccagcc

SEQ ID NO: 3662461 - RNA, 22 nt, Human
gccucugaggccagccuggccu

SEQ ID NO: 3662462 - RNA, 15 nt, Human
gccucugauauggga

SEQ ID NO: 3662463 - RNA, 17 nt, Human
gccucugcaaaggaaau

SEQ ID NO: 3662464 - RNA, 14 nt, Human
gccucugcacuccc

SEQ ID NO: 3662465 - RNA, 12 nt, Human
gccucugcauuc

SEQ ID NO: 3662466 - RNA, 21 nt, Human
gccucugcccaggcacugcua

SEQ ID NO: 3662467 - RNA, 15 nt, Human
gccucugccccgucu

SEQ ID NO: 3662468 - RNA, 16 nt, Human
gccucugccccgucuc

SEQ ID NO: 3662469 - RNA, 13 nt, Human
gccucugccugug

SEQ ID NO: 3662470 - RNA, 16 nt, Human
gccucugccugugcac

SEQ ID NO: 3662471 - RNA, 21 nt, Human
gccucugcggagcacacuggc

SEQ ID NO: 3662472 - RNA, 24 nt, Human
gccucugcggagcacacuggcuca

SEQ ID NO: 3662473 - RNA, 20 nt, Human
gccucuggaggccucugggc

SEQ ID NO: 3662474 - RNA, 21 nt, Human
gccucuggaggccucugggcc

SEQ ID NO: 3662475 - RNA, 17 nt, Human
gccucuggauuguggga

SEQ ID NO: 3662476 - RNA, 19 nt, Human
gccucuggcuagaggccag

SEQ ID NO: 3662477 - RNA, 22 nt, Human
gccucuggcuagaggccagccc

SEQ ID NO: 3662478 - RNA, 19 nt, Human
gccucuggcucuacacaua

SEQ ID NO: 3662479 - RNA, 23 nt, Human
gccucugggggguggccaggccg

SEQ ID NO: 3662480 - RNA, 12 nt, Human
gccucuggguca

SEQ ID NO: 3662481 - RNA, 17 nt, Human
gccucuggucugggugc

SEQ ID NO: 3662482 - RNA, 16 nt, Human
gccucugucaggccuu

SEQ ID NO: 3662483 - RNA, 18 nt, Human
gccucugucaggccuuca

SEQ ID NO: 3662484 - RNA, 19 nt, Human
gccucugucauaucuucac

SEQ ID NO: 3662485 - RNA, 20 nt, Human
gccucuguccccuucucuca

SEQ ID NO: 3662486 - RNA, 21 nt, Human
gccucuguccccuucucucau

SEQ ID NO: 3662487 - RNA, 20 nt, Human
gccucugucuggcaaugcca

SEQ ID NO: 3662488 - RNA, 23 nt, Human
gccucugucuggcaaugccacag

SEQ ID NO: 3662489 - RNA, 18 nt, Human
gccucuuaaagcugccug

SEQ ID NO: 3662490 - RNA, 23 nt, Human
gccucuuaaagcugccuguaguu

SEQ ID NO: 3662491 - RNA, 20 nt, Human
gccucuuacgguaguuagga

SEQ ID NO: 3662492 - RNA, 19 nt, Human
gccucuuacuaauguaaaa

SEQ ID NO: 3662493 - RNA, 19 nt, Human
cugugcccagcucagucuu

SEQ ID NO: 3662494 - RNA, 12 nt, Human
cugugcccaugg

SEQ ID NO: 3662495 - RNA, 12 nt, Human
cugugcccccag

SEQ ID NO: 3662496 - RNA, 14 nt, Human
cugugcccccaggg

SEQ ID NO: 3662497 - RNA, 18 nt, Human
cugugccccuggccuugg

SEQ ID NO: 3662498 - RNA, 13 nt, Human
cugugccccuucc

SEQ ID NO: 3662499 - RNA, 18 nt, Human
cugugccccuuccgccac

SEQ ID NO: 3662500 - RNA, 19 nt, Human
cugugcccuaaaguguauu

SEQ ID NO: 3662501 - RNA, 13 nt, Human
cugugcccuggug

SEQ ID NO: 3662502 - RNA, 16 nt, Human
cugugccucagagacc

SEQ ID NO: 3662503 - RNA, 19 nt, Human
cugugccucagagaccagg

SEQ ID NO: 3662504 - RNA, 22 nt, Human
cugugccucagagaccagggcu

SEQ ID NO: 3662505 - RNA, 15 nt, Human
cugugccuccucacc

SEQ ID NO: 3662506 - RNA, 14 nt, Human
cugugccuccuccc

SEQ ID NO: 3662507 - RNA, 23 nt, Human
cugugccucgcuccccacucugc

SEQ ID NO: 3662508 - RNA, 17 nt, Human
cugugccucugccuguc

SEQ ID NO: 3662509 - RNA, 19 nt, Human
cugugccugaccuugagga

SEQ ID NO: 3662510 - RNA, 18 nt, Human
cugugccuggagcuccug

SEQ ID NO: 3662511 - RNA, 19 nt, Human
cugugccuucuuuugauua

SEQ ID NO: 3662512 - RNA, 23 nt, Human
cugugccuuguuuuuuguuuguu

SEQ ID NO: 3662513 - RNA, 19 nt, Human
cugugccuuugcaaaucag

SEQ ID NO: 3662514 - RNA, 20 nt, Human
cugugccuuuuuuauaucuu

SEQ ID NO: 3662515 - RNA, 19 nt, Human
cugugcgaucccacccgug

SEQ ID NO: 3662516 - RNA, 21 nt, Human
cugugcgcauaggccugcuuu

SEQ ID NO: 3662517 - RNA, 14 nt, Human
cugugcuacuuugc

SEQ ID NO: 3662518 - RNA, 18 nt, Human
cugugcuacuuugccuuu

SEQ ID NO: 3662519 - RNA, 22 nt, Human
cugugcuagggaaacuucccgu

SEQ ID NO: 3662520 - RNA, 19 nt, Human
cugugcucagcccugagga

SEQ ID NO: 3662521 - RNA, 23 nt, Human
cugugcucaggacucagaagccu

SEQ ID NO: 3662522 - RNA, 14 nt, Human
cugugcucccuggu

SEQ ID NO: 3662523 - RNA, 17 nt, Human
cugugcuccgugccucc

SEQ ID NO: 3662524 - RNA, 19 nt, Human
cugugcuccgugccuccac

SEQ ID NO: 3662525 - RNA, 22 nt, Human
cugugcuccgugccuccaccac

SEQ ID NO: 3662526 - RNA, 14 nt, Human
cugugcugacccuc

SEQ ID NO: 3662527 - RNA, 18 nt, Human
cugugcugcccugcccac

SEQ ID NO: 3662528 - RNA, 21 nt, Human
cugugcugcccugcccaccug

SEQ ID NO: 3662529 - RNA, 22 nt, Human
cugugcugcccugcccaccugg

SEQ ID NO: 3662530 - RNA, 20 nt, Human
cugugcugcuguuacuguua

SEQ ID NO: 3662531 - RNA, 14 nt, Human
cugugcuggccagc

SEQ ID NO: 3662532 - RNA, 19 nt, Human
cugugcugguguccugacc

SEQ ID NO: 3662533 - RNA, 23 nt, Human
cugugcugguguccugaccaccc

SEQ ID NO: 3662534 - RNA, 18 nt, Human
cugugcugugcccaaguu

SEQ ID NO: 3662535 - RNA, 19 nt, Human
cugugcuguuguuaugaug

SEQ ID NO: 3662536 - RNA, 19 nt, Human
cugugcuguuucaaaguuc

SEQ ID NO: 3662537 - RNA, 18 nt, Human
cugugcuucaauuaauaa

SEQ ID NO: 3662538 - RNA, 19 nt, Human
cugugcuucgggcccuucc

SEQ ID NO: 3662539 - RNA, 20 nt, Human
cugugcuucgggcccuuccc

SEQ ID NO: 3662540 - RNA, 18 nt, Human
cugugcuugaaggcccug

SEQ ID NO: 3662541 - RNA, 22 nt, Human
cugugcuugaaggcccugcuga

SEQ ID NO: 3662542 - RNA, 16 nt, Human
cugugcuuucuauugu

SEQ ID NO: 3662543 - RNA, 19 nt, Human
cugugcuuugacucaccug

SEQ ID NO: 3662544 - RNA, 19 nt, Human
cuguggaaaagaaacacgc

SEQ ID NO: 3662545 - RNA, 13 nt, Human
cuguggaaagugu

SEQ ID NO: 3662546 - RNA, 16 nt, Human
cuguggaaaguguaaa

SEQ ID NO: 3662547 - RNA, 18 nt, Human
cuguggaaaguguaaagc

SEQ ID NO: 3662548 - RNA, 23 nt, Human
cuguggaaaguguaaagcauucc

SEQ ID NO: 3662549 - RNA, 22 nt, Human
cuguggaacccagcaguucugu

SEQ ID NO: 3662550 - RNA, 18 nt, Human
cuguggaacuaauaaaua

SEQ ID NO: 3662551 - RNA, 18 nt, Human
cuguggaaggcagagaaa

SEQ ID NO: 3662552 - RNA, 21 nt, Human
cuguggaaugagugugcaugg

SEQ ID NO: 3662553 - RNA, 18 nt, Human
gccugagcccagggaggc

SEQ ID NO: 3662554 - RNA, 16 nt, Human
gccugagccuggccag

SEQ ID NO: 3662555 - RNA, 22 nt, Human
gccugagcgcuccugccgcaga

SEQ ID NO: 3662556 - RNA, 14 nt, Human
gccugagcucacuc

SEQ ID NO: 3662557 - RNA, 12 nt, Human
gccugagcuggg

SEQ ID NO: 3662558 - RNA, 13 nt, Human
gccugaggagcag

SEQ ID NO: 3662559 - RNA, 17 nt, Human
gccugaggaugagcugg

SEQ ID NO: 3662560 - RNA, 21 nt, Human
gccugaggaugagcuggaagg

SEQ ID NO: 3662561 - RNA, 13 nt, Human
gccugaggcugag

SEQ ID NO: 3662562 - RNA, 20 nt, Human
gccugagggaaaggccagca

SEQ ID NO: 3662563 - RNA, 22 nt, Human
gccugagggccccucugcccag

SEQ ID NO: 3662564 - RNA, 16 nt, Human
gccugaggggcagccu

SEQ ID NO: 3662565 - RNA, 14 nt, Human
gccugaggguggag

SEQ ID NO: 3662566 - RNA, 15 nt, Human
gccugaggguggaga

SEQ ID NO: 3662567 - RNA, 19 nt, Human
gccugaggucaucggcgug

SEQ ID NO: 3662568 - RNA, 16 nt, Human
gccugaggucuggcug

SEQ ID NO: 3662569 - RNA, 13 nt, Human
gccugaggucugu

SEQ ID NO: 3662570 - RNA, 21 nt, Human
gccugaguagaaaggccuuua

SEQ ID NO: 3662571 - RNA, 12 nt, Human
gccugagucagg

SEQ ID NO: 3662572 - RNA, 19 nt, Human
gccugagucagggcccaga

SEQ ID NO: 3662573 - RNA, 20 nt, Human
gccugagucagggcccagag

SEQ ID NO: 3662574 - RNA, 18 nt, Human
gccugagucgugaccugc

SEQ ID NO: 3662575 - RNA, 13 nt, Human
gccugagucuccu

SEQ ID NO: 3662576 - RNA, 20 nt, Human
gccugagugacagagcaaga

SEQ ID NO: 3662577 - RNA, 15 nt, Human
gccugauaagcuuca

SEQ ID NO: 3662578 - RNA, 16 nt, Human
gccugauccuccaaca

SEQ ID NO: 3662579 - RNA, 17 nt, Human
gccugaucucuuccugu

SEQ ID NO: 3662580 - RNA, 20 nt, Human
gccugaugagauuuuuaaaa

SEQ ID NO: 3662581 - RNA, 14 nt, Human
gccugaugcucccu

SEQ ID NO: 3662582 - RNA, 14 nt, Human
gccugauggaccug

SEQ ID NO: 3662583 - RNA, 20 nt, Human
gccugauugccaagcucagg

SEQ ID NO: 3662584 - RNA, 15 nt, Human
gccugauuuguuccu

SEQ ID NO: 3662585 - RNA, 16 nt, Human
gccugcaaacgcugcc

SEQ ID NO: 3662586 - RNA, 19 nt, Human
gccugcaaacgcugccugc

SEQ ID NO: 3662587 - RNA, 14 nt, Human
gccugcaaacuggg

SEQ ID NO: 3662588 - RNA, 16 nt, Human
gccugcaaacugggaa

SEQ ID NO: 3662589 - RNA, 13 nt, Human
gccugcaagggag

SEQ ID NO: 3662590 - RNA, 15 nt, Human
gccugcaagggagug

SEQ ID NO: 3662591 - RNA, 16 nt, Human
gccugcacaauaaaaa

SEQ ID NO: 3662592 - RNA, 14 nt, Human
gccugcaccaggag

SEQ ID NO: 3662593 - RNA, 15 nt, Human
gccugcaccaggaga

SEQ ID NO: 3662594 - RNA, 22 nt, Human
gccugcacuugggggcucagca

SEQ ID NO: 3662595 - RNA, 23 nt, Human
gccugcacuugggggcucagcaa

SEQ ID NO: 3662596 - RNA, 19 nt, Human
gccugcagaaguaagccuc

SEQ ID NO: 3662597 - RNA, 12 nt, Human
gccugcagagcu

SEQ ID NO: 3662598 - RNA, 15 nt, Human
gccugcagagcugcg

SEQ ID NO: 3662599 - RNA, 19 nt, Human
gccugcagaggucugugcu

SEQ ID NO: 3662600 - RNA, 11 nt, Human
gccugcagccc

SEQ ID NO: 3662601 - RNA, 14 nt, Human
gccugcaggaccug

SEQ ID NO: 3662602 - RNA, 16 nt, Human
gccugcaggaccugcc

SEQ ID NO: 3662603 - RNA, 18 nt, Human
gccugcaggaccugccug

SEQ ID NO: 3662604 - RNA, 19 nt, Human
gccugcaggaccugccugu

SEQ ID NO: 3662605 - RNA, 21 nt, Human
gccugcaggaccugccuguag

SEQ ID NO: 3662606 - RNA, 13 nt, Human
gccugcaggaucu

SEQ ID NO: 3662607 - RNA, 12 nt, Human
gccugcagggaa

SEQ ID NO: 3662608 - RNA, 16 nt, Human
gccugcagggccaugg

SEQ ID NO: 3662609 - RNA, 20 nt, Human
gccugcaggguggugcuggg

SEQ ID NO: 3662610 - RNA, 23 nt, Human
gccugcauaggaguuuggaggaa

SEQ ID NO: 3662611 - RNA, 21 nt, Human
gccugcauccauucuccugag

SEQ ID NO: 3662612 - RNA, 21 nt, Human
gccugccaccuccccccacaa

SEQ ID NO: 3662613 - RNA, 12 nt, Human
gccugccaccug

SEQ ID NO: 3662614 - RNA, 17 nt, Human
gccugccaccuggaccc

SEQ ID NO: 3662615 - RNA, 23 nt, Human
gccugccaccuggaccccugcau

SEQ ID NO: 3662616 - RNA, 15 nt, Human
gccugccacucaggc

SEQ ID NO: 3662617 - RNA, 13 nt, Human
gccugccaggagg

SEQ ID NO: 3662618 - RNA, 16 nt, Human
gccugccaguccuagc

SEQ ID NO: 3662619 - RNA, 23 nt, Human
gccugccaguccuagcugcacag

SEQ ID NO: 3662620 - RNA, 20 nt, Human
gccugcccaagcccaggcca

SEQ ID NO: 3662621 - RNA, 14 nt, Human
gccugcccacccgu

SEQ ID NO: 3662622 - RNA, 13 nt, Human
gccugcccaccug

SEQ ID NO: 3662623 - RNA, 15 nt, Human
gccugcccaccugcc

SEQ ID NO: 3662624 - RNA, 21 nt, Human
gccugcccaccugccuggccg

SEQ ID NO: 3662625 - RNA, 15 nt, Human
gccugcccaggcccc

SEQ ID NO: 3662626 - RNA, 19 nt, Human
gccugcccaguugcacuca

SEQ ID NO: 3662627 - RNA, 18 nt, Human
gccugcccccaccccauu

SEQ ID NO: 3662628 - RNA, 15 nt, Human
gccugcccgcacagc

SEQ ID NO: 3662629 - RNA, 18 nt, Human
gccugcccgucucucucc

SEQ ID NO: 3662630 - RNA, 20 nt, Human
gccugcccucauggccccuc

SEQ ID NO: 3662631 - RNA, 19 nt, Human
gccugcccuccccagagca

SEQ ID NO: 3662632 - RNA, 14 nt, Human
gccugcccugguga

SEQ ID NO: 3662633 - RNA, 13 nt, Human
gccugcccuguca

SEQ ID NO: 3662634 - RNA, 20 nt, Human
gccugcccuuuguccuccug

SEQ ID NO: 3662635 - RNA, 22 nt, Human
gccugcccuuuguccuccugcu

SEQ ID NO: 3662636 - RNA, 12 nt, Human
gccugccgagca

SEQ ID NO: 3662637 - RNA, 14 nt, Human
gccugccgagcaac

SEQ ID NO: 3662638 - RNA, 19 nt, Human
gccugccgagcaaccgugg

SEQ ID NO: 3662639 - RNA, 17 nt, Human
gccugccgggcugaggg

SEQ ID NO: 3662640 - RNA, 20 nt, Human
gccugccgggcugagggccu

SEQ ID NO: 3662641 - RNA, 21 nt, Human
gccugccuagcacucacaugc

SEQ ID NO: 3662642 - RNA, 22 nt, Human
gccugccuagcacucacaugcu

SEQ ID NO: 3662643 - RNA, 16 nt, Human
gccugccucuucucua

SEQ ID NO: 3662644 - RNA, 13 nt, Human
gccugccuggagc

SEQ ID NO: 3662645 - RNA, 14 nt, Human
gccugccuggagcg

SEQ ID NO: 3662646 - RNA, 14 nt, Human
gccugccuggcccc

SEQ ID NO: 3662647 - RNA, 20 nt, Human
gccugccuuaagugaggaaa

SEQ ID NO: 3662648 - RNA, 22 nt, Human
gccugccuugcccacuccugcu

SEQ ID NO: 3662649 - RNA, 23 nt, Human
gccugcgacccugggggcacagg

SEQ ID NO: 3662650 - RNA, 20 nt, Human
gccugcgcccaccccgcucu

SEQ ID NO: 3662651 - RNA, 16 nt, Human
gccugcggucaaggcc

SEQ ID NO: 3662652 - RNA, 19 nt, Human
gccugcggucaaggccagc

SEQ ID NO: 3662653 - RNA, 13 nt, Human
gccugcgucuucc

SEQ ID NO: 3662654 - RNA, 14 nt, Human
gccugcgucuuccg

SEQ ID NO: 3662655 - RNA, 15 nt, Human
gccugcgucuuccgc

SEQ ID NO: 3662656 - RNA, 18 nt, Human
gccugcgucuuccgcccc

SEQ ID NO: 3662657 - RNA, 23 nt, Human
gccugcgucuuccgccccugccu

SEQ ID NO: 3662658 - RNA, 20 nt, Human
gccugcguucuugugacaga

SEQ ID NO: 3662659 - RNA, 16 nt, Human
cuguguacaaagaaau

SEQ ID NO: 3662660 - RNA, 17 nt, Human
cuguguacaccucugga

SEQ ID NO: 3662661 - RNA, 19 nt, Human
cuguguacauaacugaaaa

SEQ ID NO: 3662662 - RNA, 12 nt, Human
cuguguacugug

SEQ ID NO: 3662663 - RNA, 14 nt, Human
cuguguacuguguc

SEQ ID NO: 3662664 - RNA, 19 nt, Human
cuguguagcugugaccugc

SEQ ID NO: 3662665 - RNA, 22 nt, Human
cuguguagcugugaccugcuga

SEQ ID NO: 3662666 - RNA, 17 nt, Human
cuguguauauuauuugg

SEQ ID NO: 3662667 - RNA, 15 nt, Human
cuguguauauuugau

SEQ ID NO: 3662668 - RNA, 18 nt, Human
cuguguauauuugauuua

SEQ ID NO: 3662669 - RNA, 15 nt, Human
cuguguauggaaaaa

SEQ ID NO: 3662670 - RNA, 18 nt, Human
cuguguauguacauauau

SEQ ID NO: 3662671 - RNA, 17 nt, Human
cuguguauuuaauugua

SEQ ID NO: 3662672 - RNA, 20 nt, Human
cuguguauuuaauuguaaac

SEQ ID NO: 3662673 - RNA, 23 nt, Human
cuguguauuuuuuaaagcuacaa

SEQ ID NO: 3662674 - RNA, 14 nt, Human
cugugucacccagg

SEQ ID NO: 3662675 - RNA, 21 nt, Human
cugugucacuggcugccucca

SEQ ID NO: 3662676 - RNA, 20 nt, Human
cugugucaguuuauguuuug

SEQ ID NO: 3662677 - RNA, 16 nt, Human
cuguguccaacuccag

SEQ ID NO: 3662678 - RNA, 18 nt, Human
cuguguccaugcgcucag

SEQ ID NO: 3662679 - RNA, 13 nt, Human
cugugucccauga

SEQ ID NO: 3662680 - RNA, 17 nt, Human
cugugucccaugaccca

SEQ ID NO: 3662681 - RNA, 19 nt, Human
cugugucccaugacccacc

SEQ ID NO: 3662682 - RNA, 21 nt, Human
cugugucccaugacccacccc

SEQ ID NO: 3662683 - RNA, 16 nt, Human
cugugucccucucucu

SEQ ID NO: 3662684 - RNA, 19 nt, Human
cuguguccuggugcucucu

SEQ ID NO: 3662685 - RNA, 20 nt, Human
cuguguccuggugcucucug

SEQ ID NO: 3662686 - RNA, 20 nt, Human
cuguguccugguuagcagag

SEQ ID NO: 3662687 - RNA, 15 nt, Human
cuguguccuucccug

SEQ ID NO: 3662688 - RNA, 14 nt, Human
cuguguccuugcac

SEQ ID NO: 3662689 - RNA, 13 nt, Human
cugugucuaaacu

SEQ ID NO: 3662690 - RNA, 15 nt, Human
cugugucuaaacugc

SEQ ID NO: 3662691 - RNA, 13 nt, Human
cugugucuaagau

SEQ ID NO: 3662692 - RNA, 16 nt, Human
cugugucuaagauucu

SEQ ID NO: 3662693 - RNA, 14 nt, Human
cugugucucccuuc

SEQ ID NO: 3662694 - RNA, 19 nt, Human
cugugucucccuucauccu

SEQ ID NO: 3662695 - RNA, 20 nt, Human
cugugucuugcaauggcagc

SEQ ID NO: 3662696 - RNA, 19 nt, Human
cugugucuuuaaaugcugc

SEQ ID NO: 3662697 - RNA, 21 nt, Human
cugugugaaauaccagugugg

SEQ ID NO: 3662698 - RNA, 21 nt, Human
cuuacuauucauuaaauguuu

SEQ ID NO: 3662699 - RNA, 23 nt, Human
cuuacuauucauuaaauguuuga

SEQ ID NO: 3662700 - RNA, 20 nt, Human
cuuacuccugugggagccuc

SEQ ID NO: 3662701 - RNA, 15 nt, Human
cuuacugauuaacuc

SEQ ID NO: 3662702 - RNA, 17 nt, Human
cuuacugauuauuuucu

SEQ ID NO: 3662703 - RNA, 21 nt, Human
cuuacugauuuuuaaguuauu

SEQ ID NO: 3662704 - RNA, 17 nt, Human
cuuacugcgacuaaacu

SEQ ID NO: 3662705 - RNA, 16 nt, Human
cuuacuguagccucag

SEQ ID NO: 3662706 - RNA, 17 nt, Human
cuuacuguagccucaga

SEQ ID NO: 3662707 - RNA, 16 nt, Human
cuuacuguggaggaag

SEQ ID NO: 3662708 - RNA, 18 nt, Human
cuuacuguggaggaagga

SEQ ID NO: 3662709 - RNA, 21 nt, Human
cuuacuguuucugucaggaga

SEQ ID NO: 3662710 - RNA, 23 nt, Human
cuuacuuaaacccagcucccuuc

SEQ ID NO: 3662711 - RNA, 16 nt, Human
cuuacuuacuaaaaua

SEQ ID NO: 3662712 - RNA, 19 nt, Human
cuuacuuacuaaaauauau

SEQ ID NO: 3662713 - RNA, 14 nt, Human
cuuacuucuugccc

SEQ ID NO: 3662714 - RNA, 15 nt, Human
cuuacuucuugcccu

SEQ ID NO: 3662715 - RNA, 20 nt, Human
cuuacuuuccuuuccccagc

SEQ ID NO: 3662716 - RNA, 23 nt, Human
cuuacuuuccuuuccccagccca

SEQ ID NO: 3662717 - RNA, 14 nt, Human
cuuacuuuguaaau

SEQ ID NO: 3662718 - RNA, 13 nt, Human
cuuacuuuguaug

SEQ ID NO: 3662719 - RNA, 19 nt, Human
cuuacuuuguaugauauuc

SEQ ID NO: 3662720 - RNA, 16 nt, Human
cuuacuuuuuauauau

SEQ ID NO: 3662721 - RNA, 11 nt, Human
cuuagaaaacc

SEQ ID NO: 3662722 - RNA, 24 nt, Human
cuuagaaaaccagcucagcacugc

SEQ ID NO: 3662723 - RNA, 12 nt, Human
gcgacagagcag

SEQ ID NO: 3662724 - RNA, 19 nt, Human
gcgacagagcgagagucug

SEQ ID NO: 3662725 - RNA, 23 nt, Human
gcgacagagcgagagucugucuc

SEQ ID NO: 3662726 - RNA, 12 nt, Human
gcgacagugaga

SEQ ID NO: 3662727 - RNA, 17 nt, Human
gcgacauagcccauccc

SEQ ID NO: 3662728 - RNA, 21 nt, Human
gcgacauagcccaucccugcc

SEQ ID NO: 3662729 - RNA, 17 nt, Human
gcgaccauguggccaca

SEQ ID NO: 3662730 - RNA, 17 nt, Human
gcgaccccaucugccca

SEQ ID NO: 3662731 - RNA, 19 nt, Human
gcgaccccaucugcccagg

SEQ ID NO: 3662732 - RNA, 15 nt, Human
gcgaccuuggccgca

SEQ ID NO: 3662733 - RNA, 17 nt, Human
gcgacggagagaaaaaa

SEQ ID NO: 3662734 - RNA, 19 nt, Human
gcgacuccguuggccacuc

SEQ ID NO: 3662735 - RNA, 20 nt, Human
gcgacuccguuggccacucc

SEQ ID NO: 3662736 - RNA, 12 nt, Human
gcgacuuucugc

SEQ ID NO: 3662737 - RNA, 16 nt, Human
gcgacuuucugccugg

SEQ ID NO: 3662738 - RNA, 20 nt, Human
gcgagaaccuaaguuucagu

SEQ ID NO: 3662739 - RNA, 12 nt, Human
gcgagagaugug

SEQ ID NO: 3662740 - RNA, 13 nt, Human
gcgagagaugugu

SEQ ID NO: 3662741 - RNA, 14 nt, Human
gcgagagaugugug

SEQ ID NO: 3662742 - RNA, 16 nt, Human
gcgagagauguguguu

SEQ ID NO: 3662743 - RNA, 15 nt, Human
gcgagaggcagagaa

SEQ ID NO: 3662744 - RNA, 15 nt, Human
gcgagagucccugca

SEQ ID NO: 3662745 - RNA, 23 nt, Human
gcgagauggggugggguggagaa

SEQ ID NO: 3662746 - RNA, 15 nt, Human
gcgagcaucccccaa

SEQ ID NO: 3662747 - RNA, 24 nt, Human
gcgagccauuugucccaagugcca

SEQ ID NO: 3662748 - RNA, 21 nt, Human
gcgagcuaugaucgcgccacu

SEQ ID NO: 3662749 - RNA, 20 nt, Human
gcgaggagaugcuccuuggg

SEQ ID NO: 3662750 - RNA, 15 nt, Human
gcgaggaggcuccag

SEQ ID NO: 3662751 - RNA, 18 nt, Human
gcgaggaggcuccagagg

SEQ ID NO: 3662752 - RNA, 13 nt, Human
gcgaggcagagga

SEQ ID NO: 3662753 - RNA, 12 nt, Human
gcgaggcaggcc

SEQ ID NO: 3662754 - RNA, 17 nt, Human
gcgagggcagcugcuau

SEQ ID NO: 3662755 - RNA, 19 nt, Human
gcgaggucaacagagaagg

SEQ ID NO: 3662756 - RNA, 22 nt, Human
gcgaggucaacagagaaggcag

SEQ ID NO: 3662757 - RNA, 17 nt, Human
gcgaguuguggaaagcc

SEQ ID NO: 3662758 - RNA, 14 nt, Human
gcgauauacagaug

SEQ ID NO: 3662759 - RNA, 15 nt, Human
gcgaucccacacagg

SEQ ID NO: 3662760 - RNA, 16 nt, Human
gcgaucucuccuggcc

SEQ ID NO: 3662761 - RNA, 18 nt, Human
gcgaucucuccuggccua

SEQ ID NO: 3662762 - RNA, 22 nt, Human
gcgaucuggguucacugcaacc

SEQ ID NO: 3662763 - RNA, 19 nt, Human
gcgaugaauuuggagacuc

SEQ ID NO: 3662764 - RNA, 21 nt, Human
gcgauguggaacugcugccac

SEQ ID NO: 3662765 - RNA, 21 nt, Human
gcgauguuucaggaggcugga

SEQ ID NO: 3662766 - RNA, 21 nt, Human
gcgauucucuugccucagcuu

SEQ ID NO: 3662767 - RNA, 19 nt, Human
gcgauucuggauaaagcca

SEQ ID NO: 3662768 - RNA, 22 nt, Human
gcgauucuucugcuucagccuc

SEQ ID NO: 3662769 - RNA, 13 nt, Human
gcgcaaaacugaa

SEQ ID NO: 3662770 - RNA, 20 nt, Human
gcgcaagauagauuuggaau

SEQ ID NO: 3662771 - RNA, 19 nt, Human
gcgcaagggaggcccagcg

SEQ ID NO: 3662772 - RNA, 11 nt, Human
gcgcacacaca

SEQ ID NO: 3662773 - RNA, 15 nt, Human
gcgcacacacacaca

SEQ ID NO: 3662774 - RNA, 13 nt, Human
gcgcacccucccc

SEQ ID NO: 3662775 - RNA, 18 nt, Human
gcgcacccuccccucccg

SEQ ID NO: 3662776 - RNA, 22 nt, Human
gcgcacugugacccccagcucc

SEQ ID NO: 3662777 - RNA, 21 nt, Human
gcgcagcauauucaggaagcu

SEQ ID NO: 3662778 - RNA, 16 nt, Human
gcgcagcccgcggcaa

SEQ ID NO: 3662779 - RNA, 17 nt, Human
gcgcaggcuggcccugc

SEQ ID NO: 3662780 - RNA, 19 nt, Human
gcgcaggugggcuggacuu

SEQ ID NO: 3662781 - RNA, 16 nt, Human
gcgcagugccucuggu

SEQ ID NO: 3662782 - RNA, 23 nt, Human
gcgcauaggccugcuuugucucc

SEQ ID NO: 3662783 - RNA, 11 nt, Human
gcgcaucuaac

SEQ ID NO: 3662784 - RNA, 13 nt, Human
gcgccacaggacc

SEQ ID NO: 3662785 - RNA, 22 nt, Human
gcgccacuacacuccagccuga

SEQ ID NO: 3662786 - RNA, 24 nt, Human
gcgccacuacacuccagccugagc

SEQ ID NO: 3662787 - RNA, 23 nt, Human
gcgccacucgcuucccccauagc

SEQ ID NO: 3662788 - RNA, 11 nt, Human
gcgccacugcu

SEQ ID NO: 3662789 - RNA, 23 nt, Human
gcgccacugugcuccagccuggg

SEQ ID NO: 3662790 - RNA, 21 nt, Human
gcgccagcacagaaacagagg

SEQ ID NO: 3662791 - RNA, 22 nt, Human
gcgccaggauggaacacggcca

SEQ ID NO: 3662792 - RNA, 14 nt, Human
gcgccaggauggcg

SEQ ID NO: 3662793 - RNA, 15 nt, Human
gcgccaggcugacca

SEQ ID NO: 3662794 - RNA, 20 nt, Human
gcgccaggcugaccacagca

SEQ ID NO: 3662795 - RNA, 19 nt, Human
gcgccaguguaauccccca

SEQ ID NO: 3662796 - RNA, 12 nt, Human
gcgcccaccucc

SEQ ID NO: 3662797 - RNA, 13 nt, Human
gcgcccaccuccc

SEQ ID NO: 3662798 - RNA, 15 nt, Human
gcgcccagcuccuga

SEQ ID NO: 3662799 - RNA, 22 nt, Human
gcgccccaacccguggaggcug

SEQ ID NO: 3662800 - RNA, 13 nt, Human
gcgcccccagugu

SEQ ID NO: 3662801 - RNA, 15 nt, Human
gcgccccccucccag

SEQ ID NO: 3662802 - RNA, 16 nt, Human
gcgccccccucccaga

SEQ ID NO: 3662803 - RNA, 22 nt, Human
gcgccccgaaaggucaccucac

SEQ ID NO: 3662804 - RNA, 13 nt, Human
gcgccccuucccc

SEQ ID NO: 3662805 - RNA, 17 nt, Human
gcgcccgccccugcagc

SEQ ID NO: 3662806 - RNA, 13 nt, Human
gcgcccgcugggc

SEQ ID NO: 3662807 - RNA, 16 nt, Human
gcgcccgcugggcuga

SEQ ID NO: 3662808 - RNA, 16 nt, Human
gcgcccucuguccuga

SEQ ID NO: 3662809 - RNA, 13 nt, Human
gcgcccuggaagc

SEQ ID NO: 3662810 - RNA, 14 nt, Human
gcgcccuggaagcc

SEQ ID NO: 3662811 - RNA, 14 nt, Human
gcgcccuggccccc

SEQ ID NO: 3662812 - RNA, 12 nt, Human
gcgcccuuccuc

SEQ ID NO: 3662813 - RNA, 16 nt, Human
gcgcccuuggcuucug

SEQ ID NO: 3662814 - RNA, 12 nt, Human
gcgcccuuuccc

SEQ ID NO: 3662815 - RNA, 18 nt, Human
gcgcccuuuccccgacgc

SEQ ID NO: 3662816 - RNA, 17 nt, Human
gcgccggcgggcgggcc

SEQ ID NO: 3662817 - RNA, 16 nt, Human
gcgccgugcugggcag

SEQ ID NO: 3662818 - RNA, 17 nt, Human
gcgccgugcugggcagc

SEQ ID NO: 3662819 - RNA, 18 nt, Human
gcgccuacaggagugagc

SEQ ID NO: 3662820 - RNA, 21 nt, Human
gcgccucccuccaccccagga

SEQ ID NO: 3662821 - RNA, 23 nt, Human
gcgccucccuccaccccaggacg

SEQ ID NO: 3662822 - RNA, 15 nt, Human
gcgccuccuuccuug

SEQ ID NO: 3662823 - RNA, 12 nt, Human
gcgccucugcaa

SEQ ID NO: 3662824 - RNA, 16 nt, Human
gcgccugccccuccca

SEQ ID NO: 3662825 - RNA, 17 nt, Human
gcgccuggccuccaggc

SEQ ID NO: 3662826 - RNA, 22 nt, Human
gcgccuggccuccaggcccguc

SEQ ID NO: 3662827 - RNA, 12 nt, Human
gcgccugugacc

SEQ ID NO: 3662828 - RNA, 16 nt, Human
gcgccugugcacacac

SEQ ID NO: 3662829 - RNA, 21 nt, Human
gcgccuuaaggauguucuagc

SEQ ID NO: 3662830 - RNA, 14 nt, Human
gcgcgccacucgcu

SEQ ID NO: 3662831 - RNA, 17 nt, Human
gcgcgcucuucgcgccc

SEQ ID NO: 3662832 - RNA, 23 nt, Human
gcgcgcucuucgcgcccgccccu

SEQ ID NO: 3662833 - RNA, 13 nt, Human
gcgcggccagccc

SEQ ID NO: 3662834 - RNA, 14 nt, Human
gcgcggccagcccc

SEQ ID NO: 3662835 - RNA, 12 nt, Human
gcgcggcugcuu

SEQ ID NO: 3662836 - RNA, 12 nt, Human
gcgcggcuggga

SEQ ID NO: 3662837 - RNA, 13 nt, Human
gcgcgguggcuca

SEQ ID NO: 3662838 - RNA, 15 nt, Human
gcgcgguggcucacg

SEQ ID NO: 3662839 - RNA, 22 nt, Human
gcgcuaauucaaggaauuucuu

SEQ ID NO: 3662840 - RNA, 13 nt, Human
gcgcuacccacuu

SEQ ID NO: 3662841 - RNA, 18 nt, Human
gcgcuagcacagcucccu

SEQ ID NO: 3662842 - RNA, 21 nt, Human
gcgcuagcacagcucccuucu

SEQ ID NO: 3662843 - RNA, 18 nt, Human
gcugccugagcaccuccc

SEQ ID NO: 3662844 - RNA, 22 nt, Human
gcugccugagcaccucccagcc

SEQ ID NO: 3662845 - RNA, 22 nt, Human
gcugccugcccgcacagcagcc

SEQ ID NO: 3662846 - RNA, 23 nt, Human
gcugccugcccgcacagcagccu

SEQ ID NO: 3662847 - RNA, 11 nt, Human
gcugccugccu

SEQ ID NO: 3662848 - RNA, 13 nt, Human
gcugccuggaccc

SEQ ID NO: 3662849 - RNA, 16 nt, Human
gcugccuggagcccca

SEQ ID NO: 3662850 - RNA, 17 nt, Human
gcugccuggagccccac

SEQ ID NO: 3662851 - RNA, 21 nt, Human
gcugccuggcccccagcugug

SEQ ID NO: 3662852 - RNA, 18 nt, Human
gcugccugggaucccuca

SEQ ID NO: 3662853 - RNA, 18 nt, Human
gcugccugggcuguuggc

SEQ ID NO: 3662854 - RNA, 13 nt, Human
gcugccuguaguu

SEQ ID NO: 3662855 - RNA, 15 nt, Human
gcugccuguaguuag

SEQ ID NO: 3662856 - RNA, 16 nt, Human
gcugccuguccccaug

SEQ ID NO: 3662857 - RNA, 13 nt, Human
gcugccugugugg

SEQ ID NO: 3662858 - RNA, 13 nt, Human
gcugccuguucag

SEQ ID NO: 3662859 - RNA, 20 nt, Human
gcugccuuagcuucaggaac

SEQ ID NO: 3662860 - RNA, 21 nt, Human
gcugccuucccaugaaucugu

SEQ ID NO: 3662861 - RNA, 12 nt, Human
gcugccuucccu

SEQ ID NO: 3662862 - RNA, 16 nt, Human
gcugccuucuggauuc

SEQ ID NO: 3662863 - RNA, 21 nt, Human
gcugccuuggcucagacaugu

SEQ ID NO: 3662864 - RNA, 20 nt, Human
gcugccuuuagucgcugagg

SEQ ID NO: 3662865 - RNA, 15 nt, Human
gcugccuuuggacuu

SEQ ID NO: 3662866 - RNA, 15 nt, Human
gcugcgcccugggcu

SEQ ID NO: 3662867 - RNA, 19 nt, Human
gcugcgcccuuaccuuccc

SEQ ID NO: 3662868 - RNA, 15 nt, Human
gcugcgcuugcuuuu

SEQ ID NO: 3662869 - RNA, 17 nt, Human
gcugcgcuugcuuuucu

SEQ ID NO: 3662870 - RNA, 17 nt, Human
gcugcggcguacaggcu

SEQ ID NO: 3662871 - RNA, 17 nt, Human
gcugcgguccacccagg

SEQ ID NO: 3662872 - RNA, 18 nt, Human
gcugcgguccacccagga

SEQ ID NO: 3662873 - RNA, 21 nt, Human
gcugcgguccacccaggagcc

SEQ ID NO: 3662874 - RNA, 17 nt, Human
gcugcgucauuacaggg

SEQ ID NO: 3662875 - RNA, 13 nt, Human
gcugcgucuccca

SEQ ID NO: 3662876 - RNA, 16 nt, Human
gcugcgucuggagggg

SEQ ID NO: 3662877 - RNA, 16 nt, Human
gcugcgugccccugcu

SEQ ID NO: 3662878 - RNA, 18 nt, Human
gcugcuaaucuucagggc

SEQ ID NO: 3662879 - RNA, 16 nt, Human
gcugcuaauucuuugc

SEQ ID NO: 3662880 - RNA, 17 nt, Human
gcugcuaauucuuugca

SEQ ID NO: 3662881 - RNA, 15 nt, Human
gcugcuacaaagaag

SEQ ID NO: 3662882 - RNA, 20 nt, Human
gcugcuacaaagaagacaug

SEQ ID NO: 3662883 - RNA, 21 nt, Human
gcugcuacaaagaagacaugu

SEQ ID NO: 3662884 - RNA, 14 nt, Human
gcugcuacccuccc

SEQ ID NO: 3662885 - RNA, 22 nt, Human
gcugcuaccguugacuuccagg

SEQ ID NO: 3662886 - RNA, 14 nt, Human
gcugcuacuuauau

SEQ ID NO: 3662887 - RNA, 10 nt, Human
gcugcuagaa

SEQ ID NO: 3662888 - RNA, 13 nt, Human
gcugcuagaacuu

SEQ ID NO: 3662889 - RNA, 18 nt, Human
gcugcuagaacuuuuuua

SEQ ID NO: 3662890 - RNA, 21 nt, Human
gcugcuagaacuuuuuuaaau

SEQ ID NO: 3662891 - RNA, 16 nt, Human
gcugcuagagccagca

SEQ ID NO: 3662892 - RNA, 17 nt, Human
gcugcuauagccugggg

SEQ ID NO: 3662893 - RNA, 23 nt, Human
gcugcuauccccaucucccugcc

SEQ ID NO: 3662894 - RNA, 21 nt, Human
gcugcucacuaccuccucagg

SEQ ID NO: 3662895 - RNA, 16 nt, Human
gcugcuccaggccugc

SEQ ID NO: 3662896 - RNA, 22 nt, Human
gcugcuccaggccugcagcagg

SEQ ID NO: 3662897 - RNA, 11 nt, Human
gcugcucccac

SEQ ID NO: 3662898 - RNA, 13 nt, Human
gcugcuccccacg

SEQ ID NO: 3662899 - RNA, 12 nt, Human
gcugcuccccuc

SEQ ID NO: 3662900 - RNA, 13 nt, Human
gcugcucccucag

SEQ ID NO: 3662901 - RNA, 16 nt, Human
gcugcucccucagacu

SEQ ID NO: 3662902 - RNA, 19 nt, Human
gcugcucccucagacuggg

SEQ ID NO: 3662903 - RNA, 20 nt, Human
gcugcuccgaggacccagga

SEQ ID NO: 3662904 - RNA, 11 nt, Human
gcugcuccucc

SEQ ID NO: 3662905 - RNA, 15 nt, Human
gcugcuccuccaggg

SEQ ID NO: 3662906 - RNA, 23 nt, Human
gcugcuccuccagggccacgugc

SEQ ID NO: 3662907 - RNA, 20 nt, Human
gcugcuccuuagcugccaag

SEQ ID NO: 3662908 - RNA, 22 nt, Human
gcugcucugaauuaguccuugc

SEQ ID NO: 3662909 - RNA, 13 nt, Human
gcugcucugccca

SEQ ID NO: 3662910 - RNA, 14 nt, Human
gcugcucugcccca

SEQ ID NO: 3662911 - RNA, 14 nt, Human
gcugcucuggaaaa

SEQ ID NO: 3662912 - RNA, 22 nt, Human
gcugcucuucaucccauuccag

SEQ ID NO: 3662913 - RNA, 23 nt, Human
gcugcucuugaacuccugaccuc

SEQ ID NO: 3662914 - RNA, 18 nt, Human
gcugcucuuggcuggacc

SEQ ID NO: 3662915 - RNA, 22 nt, Human
gcugcucuuggcuggacccagc

SEQ ID NO: 3662916 - RNA, 23 nt, Human
gcugcucuuggcuggacccagcc

SEQ ID NO: 3662917 - RNA, 16 nt, Human
gcugcugaagcugccu

SEQ ID NO: 3662918 - RNA, 23 nt, Human
gcugcugaagcugccugcuuuuc

SEQ ID NO: 3662919 - RNA, 12 nt, Human
gcugcugaaggc

SEQ ID NO: 3662920 - RNA, 13 nt, Human
gcugcugaaggcu

SEQ ID NO: 3662921 - RNA, 21 nt, Human
gcugcugaaggcucgagcaug

SEQ ID NO: 3662922 - RNA, 10 nt, Human
gcugcugacc

SEQ ID NO: 3662923 - RNA, 11 nt, Human
gcugcugacca

SEQ ID NO: 3662924 - RNA, 21 nt, Human
gcugcugaccaauugugcugc

SEQ ID NO: 3662925 - RNA, 18 nt, Human
gcugcugaccuccacagc

SEQ ID NO: 3662926 - RNA, 14 nt, Human
gcugcugagaaccu

SEQ ID NO: 3662927 - RNA, 17 nt, Human
gcugcugagaaccuggc

SEQ ID NO: 3662928 - RNA, 21 nt, Human
gcugcugagaaccuggccuuc

SEQ ID NO: 3662929 - RNA, 22 nt, Human
gcugcugagaaccuggccuuca

SEQ ID NO: 3662930 - RNA, 14 nt, Human
gcugcugagccgca

SEQ ID NO: 3662931 - RNA, 13 nt, Human
gcuauuuugugaa

SEQ ID NO: 3662932 - RNA, 15 nt, Human
gcuauuuuuauggaa

SEQ ID NO: 3662933 - RNA, 12 nt, Human
gcuauuuuuccc

SEQ ID NO: 3662934 - RNA, 16 nt, Human
gcuauuuuucccccug

SEQ ID NO: 3662935 - RNA, 21 nt, Human
gcuauuuuucuaacuacaaag

SEQ ID NO: 3662936 - RNA, 13 nt, Human
gcucaaaacuuuc

SEQ ID NO: 3662937 - RNA, 12 nt, Human
gcucaaaaucuu

SEQ ID NO: 3662938 - RNA, 14 nt, Human
gcucaaaggcacag

SEQ ID NO: 3662939 - RNA, 22 nt, Human
gcucaaagguuuggaaggagca

SEQ ID NO: 3662940 - RNA, 14 nt, Human
gcucaaauaaaaau

SEQ ID NO: 3662941 - RNA, 14 nt, Human
gcucaaaucuauuc

SEQ ID NO: 3662942 - RNA, 17 nt, Human
gcucaaaucuauucaga

SEQ ID NO: 3662943 - RNA, 18 nt, Human
gcucaaaucuauucagac

SEQ ID NO: 3662944 - RNA, 23 nt, Human
gcucaaaucuauucagacaagca

SEQ ID NO: 3662945 - RNA, 16 nt, Human
gcucaacaauaaaaca

SEQ ID NO: 3662946 - RNA, 14 nt, Human
gcucaacuuucugu

SEQ ID NO: 3662947 - RNA, 23 nt, Human
gcucaagcaauccuccugaguga

SEQ ID NO: 3662948 - RNA, 15 nt, Human
gcucaagcagcgacc

SEQ ID NO: 3662949 - RNA, 21 nt, Human
gcucaagcagcgaccgccccc

SEQ ID NO: 3662950 - RNA, 22 nt, Human
gcucaagcagcgaccgcccccu

SEQ ID NO: 3662951 - RNA, 23 nt, Human
gcucaagcagcgaccgcccccuc

SEQ ID NO: 3662952 - RNA, 18 nt, Human
gcucaagcgauucuccug

SEQ ID NO: 3662953 - RNA, 23 nt, Human
gcucaaggaaagggggucccagu

SEQ ID NO: 3662954 - RNA, 14 nt, Human
gcucaaggccagcu

SEQ ID NO: 3662955 - RNA, 19 nt, Human
gcucaaguccucuuuucug

SEQ ID NO: 3662956 - RNA, 22 nt, Human
gcucaaguccucuuuucugaga

SEQ ID NO: 3662957 - RNA, 17 nt, Human
gcucaagucuucccuga

SEQ ID NO: 3662958 - RNA, 20 nt, Human
gcucaaugagcauguuuaga

SEQ ID NO: 3662959 - RNA, 20 nt, Human
gcucacaaggcagcaaggcc

SEQ ID NO: 3662960 - RNA, 21 nt, Human
gcucacaaggcagcaaggccc

SEQ ID NO: 3662961 - RNA, 22 nt, Human
gcucacaaggcagcaaggcccg

SEQ ID NO: 3662962 - RNA, 13 nt, Human
gcucacacaccug

SEQ ID NO: 3662963 - RNA, 15 nt, Human
gcucacaccaaauuu

SEQ ID NO: 3662964 - RNA, 22 nt, Human
gcucacaccccauugguggacu

SEQ ID NO: 3662965 - RNA, 14 nt, Human
gcucacacugagaa

SEQ ID NO: 3662966 - RNA, 22 nt, Human
gcucacacugagaauguaagaa

SEQ ID NO: 3662967 - RNA, 18 nt, Human
gcucacagaacccuugga

SEQ ID NO: 3662968 - RNA, 22 nt, Human
gcucacagaacccuuggagcca

SEQ ID NO: 3662969 - RNA, 17 nt, Human
gcucacagacuggagac

SEQ ID NO: 3662970 - RNA, 15 nt, Human
gcucacaguuccucg

SEQ ID NO: 3662971 - RNA, 17 nt, Human
gcucacaguuccucgcc

SEQ ID NO: 3662972 - RNA, 13 nt, Human
gcucaccagcccc

SEQ ID NO: 3662973 - RNA, 23 nt, Human
gcucaccagccccagugcccaca

SEQ ID NO: 3662974 - RNA, 17 nt, Human
gcucaccccccacacuc

SEQ ID NO: 3662975 - RNA, 19 nt, Human
gcucaccccccacacucac

SEQ ID NO: 3662976 - RNA, 13 nt, Human
gcucaccuagagc

SEQ ID NO: 3662977 - RNA, 16 nt, Human
gcucaccuagagccag

SEQ ID NO: 3662978 - RNA, 17 nt, Human
gcucaccuagagccaga

SEQ ID NO: 3662979 - RNA, 19 nt, Human
gcucaccuagagccagacc

SEQ ID NO: 3662980 - RNA, 11 nt, Human
gcucaccuggg

SEQ ID NO: 3662981 - RNA, 22 nt, Human
gcucaccuggggugugggaggc

SEQ ID NO: 3662982 - RNA, 15 nt, Human
gcucaccuguugcuu

SEQ ID NO: 3662983 - RNA, 19 nt, Human
gcucaccuguugcuuacaa

SEQ ID NO: 3662984 - RNA, 22 nt, Human
gcucacgccuaugaucccagca

SEQ ID NO: 3662985 - RNA, 21 nt, Human
gcucacgccuguaaucccagc

SEQ ID NO: 3662986 - RNA, 20 nt, Human
gcucacguccugagaaagcu

SEQ ID NO: 3662987 - RNA, 13 nt, Human
gcucacgugugug

SEQ ID NO: 3662988 - RNA, 17 nt, Human
gcugggauuacaggugu

SEQ ID NO: 3662989 - RNA, 19 nt, Human
gcugggcaacaugccugcu

SEQ ID NO: 3662990 - RNA, 15 nt, Human
gcugggcacugcucu

SEQ ID NO: 3662991 - RNA, 14 nt, Human
gcugggcacuuccc

SEQ ID NO: 3662992 - RNA, 18 nt, Human
gcugggcacuucccugcu

SEQ ID NO: 3662993 - RNA, 13 nt, Human
gcugggcagagga

SEQ ID NO: 3662994 - RNA, 17 nt, Human
gcugggcagaggaaagc

SEQ ID NO: 3662995 - RNA, 19 nt, Human
gcugggcagaggaaagcaa

SEQ ID NO: 3662996 - RNA, 12 nt, Human
gcugggcagccc

SEQ ID NO: 3662997 - RNA, 13 nt, Human
gcugggcagcccg

SEQ ID NO: 3662998 - RNA, 13 nt, Human
gcugggcagcuac

SEQ ID NO: 3662999 - RNA, 12 nt, Human
gcugggcagcug

SEQ ID NO: 3663000 - RNA, 14 nt, Human
gcugggcaguuuuu

SEQ ID NO: 3663001 - RNA, 19 nt, Human
gcugggccauguccaaaga

SEQ ID NO: 3663002 - RNA, 20 nt, Human
gcugggccauguccaaagag

SEQ ID NO: 3663003 - RNA, 13 nt, Human
gcugggcccagag

SEQ ID NO: 3663004 - RNA, 19 nt, Human
gcugggcccagaggcacag

SEQ ID NO: 3663005 - RNA, 20 nt, Human
gcugggcccagaggcacagc

SEQ ID NO: 3663006 - RNA, 14 nt, Human
gcugggccccagcc

SEQ ID NO: 3663007 - RNA, 16 nt, Human
gcugggccccagccca

SEQ ID NO: 3663008 - RNA, 18 nt, Human
gcugggccccccagcuca

SEQ ID NO: 3663009 - RNA, 21 nt, Human
gcugggccccccagcucaggg

SEQ ID NO: 3663010 - RNA, 13 nt, Human
gcugggccccugc

SEQ ID NO: 3663011 - RNA, 18 nt, Human
gcugggccccugccucuc

SEQ ID NO: 3663012 - RNA, 22 nt, Human
gcugggccccugccucucugca

SEQ ID NO: 3663013 - RNA, 23 nt, Human
gcugggccccugccucucugcag

SEQ ID NO: 3663014 - RNA, 15 nt, Human
gcugggcccucucuu

SEQ ID NO: 3663015 - RNA, 17 nt, Human
gcugggccgggacccag

SEQ ID NO: 3663016 - RNA, 13 nt, Human
gcugggcucccgu

SEQ ID NO: 3663017 - RNA, 20 nt, Human
gcugggcucccuucccaccu

SEQ ID NO: 3663018 - RNA, 14 nt, Human
gcugggcucuccac

SEQ ID NO: 3663019 - RNA, 15 nt, Human
gcugggcucuccacc

SEQ ID NO: 3663020 - RNA, 21 nt, Human
gcugggcucugccacccuacc

SEQ ID NO: 3663021 - RNA, 22 nt, Human
gcugggcugagccccuacccca

SEQ ID NO: 3663022 - RNA, 17 nt, Human
gcugggcuggggccuga

SEQ ID NO: 3663023 - RNA, 14 nt, Human
gcugggcugggugc

SEQ ID NO: 3663024 - RNA, 19 nt, Human
gcugggcuucaguggcagc

SEQ ID NO: 3663025 - RNA, 21 nt, Human
gcugggcuucaguggcagcug

SEQ ID NO: 3663026 - RNA, 13 nt, Human
gcuggggaagaau

SEQ ID NO: 3663027 - RNA, 14 nt, Human
gcuggggaagacag

SEQ ID NO: 3663028 - RNA, 15 nt, Human
gcuggggaagacagu

SEQ ID NO: 3663029 - RNA, 12 nt, Human
gcuggggaagga

SEQ ID NO: 3663030 - RNA, 16 nt, Human
gcuggggaccugguac

SEQ ID NO: 3663031 - RNA, 23 nt, Human
gcuggggaccugguacccuccug

SEQ ID NO: 3663032 - RNA, 22 nt, Human
gcuggggacggggggccccagu

SEQ ID NO: 3663033 - RNA, 23 nt, Human
gcuggggacggggggccccaguc

SEQ ID NO: 3663034 - RNA, 15 nt, Human
gcuggggagaggaaa

SEQ ID NO: 3663035 - RNA, 13 nt, Human
gcuggggaggagc

SEQ ID NO: 3663036 - RNA, 21 nt, Human
gcuggggauccccgccuggcc

SEQ ID NO: 3663037 - RNA, 23 nt, Human
gcuggggauccccgccuggccag

SEQ ID NO: 3663038 - RNA, 14 nt, Human
gcuggggaugucuc

SEQ ID NO: 3663039 - RNA, 14 nt, Human
gcuggggccucaga

SEQ ID NO: 3663040 - RNA, 16 nt, Human
gcuggggccucagacg

SEQ ID NO: 3663041 - RNA, 17 nt, Human
gcuggggccucagacga

SEQ ID NO: 3663042 - RNA, 15 nt, Human
gcuggggccugaugg

SEQ ID NO: 3663043 - RNA, 19 nt, Human
gcuggggccugauggggag

SEQ ID NO: 3663044 - RNA, 15 nt, Human
gcuggggccugggac

SEQ ID NO: 3663045 - RNA, 22 nt, Human
gcugggggaaugagcccagaga

SEQ ID NO: 3663046 - RNA, 18 nt, Human
gcugggggaugggccuga

SEQ ID NO: 3663047 - RNA, 19 nt, Human
gcugggggaugggccugag

SEQ ID NO: 3663048 - RNA, 23 nt, Human
gcugggggcaggagggcccuacc

SEQ ID NO: 3663049 - RNA, 14 nt, Human
gcugggggccucac

SEQ ID NO: 3663050 - RNA, 15 nt, Human
gcugggggugggcca

SEQ ID NO: 3663051 - RNA, 19 nt, Human
gcugggggugggccaggcu

SEQ ID NO: 3663052 - RNA, 17 nt, Human
gcuggggucccagcagc

SEQ ID NO: 3663053 - RNA, 13 nt, Human
gcuggggugcagg

SEQ ID NO: 3663054 - RNA, 20 nt, Human
gcuggggugcagggaugugg

SEQ ID NO: 3663055 - RNA, 20 nt, Human
gcugggguggccuguguggc

SEQ ID NO: 3663056 - RNA, 21 nt, Human
gcuggguaaacuguggaugau

SEQ ID NO: 3663057 - RNA, 15 nt, Human
gcugggucaggcagg

SEQ ID NO: 3663058 - RNA, 14 nt, Human
gcugggucgcccug

SEQ ID NO: 3663059 - RNA, 15 nt, Human
gcugggugcccacag

SEQ ID NO: 3663060 - RNA, 17 nt, Human
gcugggugcccacagcc

SEQ ID NO: 3663061 - RNA, 21 nt, Human
gcugggugcgaccccaucugc

SEQ ID NO: 3663062 - RNA, 23 nt, Human
gcugggugcgaccccaucugccc

SEQ ID NO: 3663063 - RNA, 21 nt, Human
gcuggguggcaccagcagccu

SEQ ID NO: 3663064 - RNA, 13 nt, Human
gcuggguggccca

SEQ ID NO: 3663065 - RNA, 14 nt, Human
gcuggguggcccau

SEQ ID NO: 3663066 - RNA, 22 nt, Human
gcuggguggcccauccccccuc

SEQ ID NO: 3663067 - RNA, 15 nt, Human
gcuggguguggcgca

SEQ ID NO: 3663068 - RNA, 20 nt, Human
gcuggguucuacccaggugc

SEQ ID NO: 3663069 - RNA, 15 nt, Human
gcuggguucugaucc

SEQ ID NO: 3663070 - RNA, 14 nt, Human
gcuggguuggaggg

SEQ ID NO: 3663071 - RNA, 21 nt, Human
gcuggguuggaggguguccca

SEQ ID NO: 3663072 - RNA, 16 nt, Human
gcuggguuggugcaca

SEQ ID NO: 3663073 - RNA, 17 nt, Human
gcuggguuggugcacag

SEQ ID NO: 3663074 - RNA, 18 nt, Human
gcugguagagauggagga

SEQ ID NO: 3663075 - RNA, 21 nt, Human
gcugguagagauggaggagga

SEQ ID NO: 3663076 - RNA, 19 nt, Human
gcugguaggcauuccagcu

SEQ ID NO: 3663077 - RNA, 13 nt, Human
gcuggucacagcc

SEQ ID NO: 3663078 - RNA, 17 nt, Human
gcuggucacagccuccu

SEQ ID NO: 3663079 - RNA, 18 nt, Human
gcuggucacugccaugga

SEQ ID NO: 3663080 - RNA, 20 nt, Human
gcuggucccacucaguccau

SEQ ID NO: 3663081 - RNA, 15 nt, Human
gcugguccgugggac

SEQ ID NO: 3663082 - RNA, 19 nt, Human
gcugguccuauggccucau

SEQ ID NO: 3663083 - RNA, 20 nt, Human
gcugguccucauucaaaggg

SEQ ID NO: 3663084 - RNA, 23 nt, Human
gcuggucguaaacaucucagaga

SEQ ID NO: 3663085 - RNA, 19 nt, Human
gcuggucucgaacuccuga

SEQ ID NO: 3663086 - RNA, 22 nt, Human
gcuggucucgaacuccugaccu

SEQ ID NO: 3663087 - RNA, 23 nt, Human
gcuggucucgaacuccugaccuu

SEQ ID NO: 3663088 - RNA, 18 nt, Human
gcuggugagugaugcggc

SEQ ID NO: 3663089 - RNA, 19 nt, Human
gcuggugauggagguuuca

SEQ ID NO: 3663090 - RNA, 18 nt, Human
gcuggugcauuacagaga

SEQ ID NO: 3663091 - RNA, 22 nt, Human
gcuggugccagccuuccucugc

SEQ ID NO: 3663092 - RNA, 20 nt, Human
gcuggugcggcuggccaugg

SEQ ID NO: 3663093 - RNA, 19 nt, Human
gcuggugcuguggccaggg

SEQ ID NO: 3663094 - RNA, 21 nt, Human
gcugguggacccagggaacag

SEQ ID NO: 3663095 - RNA, 21 nt, Human
gcugguggagaacucuggcuu

SEQ ID NO: 3663096 - RNA, 12 nt, Human
gcuccaaacccu

SEQ ID NO: 3663097 - RNA, 13 nt, Human
gcuccaaacccuc

SEQ ID NO: 3663098 - RNA, 16 nt, Human
gcuccaaacccucgag

SEQ ID NO: 3663099 - RNA, 19 nt, Human
gcuccaaacccucgaggcg

SEQ ID NO: 3663100 - RNA, 15 nt, Human
gcuccaaaccuucac

SEQ ID NO: 3663101 - RNA, 19 nt, Human
gcuccaaagucauaauugc

SEQ ID NO: 3663102 - RNA, 16 nt, Human
gcuccaaaugcagcuu

SEQ ID NO: 3663103 - RNA, 21 nt, Human
gcuccaacuccaacauccacu

SEQ ID NO: 3663104 - RNA, 18 nt, Human
gcuccaagaccuaggcuc

SEQ ID NO: 3663105 - RNA, 22 nt, Human
gcuccaagaccuguugguucca

SEQ ID NO: 3663106 - RNA, 15 nt, Human
gcuccaagauucuag

SEQ ID NO: 3663107 - RNA, 17 nt, Human
gcuccaagauucuagau

SEQ ID NO: 3663108 - RNA, 16 nt, Human
gcuccaagccccaucu

SEQ ID NO: 3663109 - RNA, 13 nt, Human
gcuccaagcuccc

SEQ ID NO: 3663110 - RNA, 17 nt, Human
gcuccaagcucccaggc

SEQ ID NO: 3663111 - RNA, 21 nt, Human
gcuccaagcucccaggcauuc

SEQ ID NO: 3663112 - RNA, 23 nt, Human
gcuccaaggggaaucagaacuca

SEQ ID NO: 3663113 - RNA, 23 nt, Human
gcuccacacccucucccaggacc

SEQ ID NO: 3663114 - RNA, 18 nt, Human
gcuccaccagcaucaccu

SEQ ID NO: 3663115 - RNA, 15 nt, Human
gcuccaccccacuca

SEQ ID NO: 3663116 - RNA, 19 nt, Human
gcuccaccccacucacaga

SEQ ID NO: 3663117 - RNA, 23 nt, Human
gcuccaccccgcaagcaccaucc

SEQ ID NO: 3663118 - RNA, 11 nt, Human
gcuccacccuu

SEQ ID NO: 3663119 - RNA, 13 nt, Human
gcuccacccuugg

SEQ ID NO: 3663120 - RNA, 15 nt, Human
gcuccacccuuggcc

SEQ ID NO: 3663121 - RNA, 23 nt, Human
gcuccacccuuggccugucucau

SEQ ID NO: 3663122 - RNA, 19 nt, Human
gcuccacgucugcgccgcc

SEQ ID NO: 3663123 - RNA, 20 nt, Human
gcuccacucugcuucucuga

SEQ ID NO: 3663124 - RNA, 12 nt, Human
gcuccacuguca

SEQ ID NO: 3663125 - RNA, 15 nt, Human
gcuccacuuggucug

SEQ ID NO: 3663126 - RNA, 19 nt, Human
gcuccacuuggucugugag

SEQ ID NO: 3663127 - RNA, 20 nt, Human
gcuccacuuggucugugaga

SEQ ID NO: 3663128 - RNA, 19 nt, Human
gcuccagaauuuggaaauc

SEQ ID NO: 3663129 - RNA, 18 nt, Human
gcuccagacacaugucca

SEQ ID NO: 3663130 - RNA, 14 nt, Human
gcuccagacaggga

SEQ ID NO: 3663131 - RNA, 21 nt, Human
gcuccagaccugauccuggag

SEQ ID NO: 3663132 - RNA, 17 nt, Human
gcuuuuugaaaugaaau

SEQ ID NO: 3663133 - RNA, 18 nt, Human
gcuuuuugaaaugaaauu

SEQ ID NO: 3663134 - RNA, 12 nt, Human
gcuuuuuggaaa

SEQ ID NO: 3663135 - RNA, 15 nt, Human
gcuuuuuuaucaugu

SEQ ID NO: 3663136 - RNA, 20 nt, Human
gcuuuuuuauuuuuuauaca

SEQ ID NO: 3663137 - RNA, 20 nt, Human
gcuuuuuuccaaaacaaaaa

SEQ ID NO: 3663138 - RNA, 22 nt, Human
gcuuuuuucucugauacagaaa

SEQ ID NO: 3663139 - RNA, 20 nt, Human
gcuuuuuuugaaacuuugag

SEQ ID NO: 3663140 - RNA, 21 nt, Human
gcuuuuuuuguguguauuugc

SEQ ID NO: 3663141 - RNA, 17 nt, Human
ggaaaaaaaaaaaagag

SEQ ID NO: 3663142 - RNA, 17 nt, Human
ggaaaaaaaugaaugag

SEQ ID NO: 3663143 - RNA, 21 nt, Human
ggaaaaacaucugaaagccac

SEQ ID NO: 3663144 - RNA, 19 nt, Human
ggaaaaaccacccccaaau

SEQ ID NO: 3663145 - RNA, 20 nt, Human
ggaaaaagaaaauaaagaca

SEQ ID NO: 3663146 - RNA, 17 nt, Human
ggaaaaagcacaagaag

SEQ ID NO: 3663147 - RNA, 13 nt, Human
ggaaaaauaaaca

SEQ ID NO: 3663148 - RNA, 11 nt, Human
ggaaaaauauu

SEQ ID NO: 3663149 - RNA, 15 nt, Human
ggaaaaauccagaaa

SEQ ID NO: 3663150 - RNA, 15 nt, Human
ggaaaaauguaggag

SEQ ID NO: 3663151 - RNA, 11 nt, Human
gcugaaauuga

SEQ ID NO: 3663152 - RNA, 19 nt, Human
gcugaacacauuucuuuuu

SEQ ID NO: 3663153 - RNA, 23 nt, Human
gcugaacagaugaccccugccca

SEQ ID NO: 3663154 - RNA, 13 nt, Human
gcugaacagugga

SEQ ID NO: 3663155 - RNA, 15 nt, Human
gcugaacauugcaua

SEQ ID NO: 3663156 - RNA, 17 nt, Human
gcugaacccugugcugg

SEQ ID NO: 3663157 - RNA, 20 nt, Human
gcugaacccugugcuggugu

SEQ ID NO: 3663158 - RNA, 21 nt, Human
gcugaacccugugcugguguc

SEQ ID NO: 3663159 - RNA, 16 nt, Human
gcugaacggggagaaa

SEQ ID NO: 3663160 - RNA, 15 nt, Human
gcugaacucaugaga

SEQ ID NO: 3663161 - RNA, 18 nt, Human
gcugaagaauuauuuuuu

SEQ ID NO: 3663162 - RNA, 16 nt, Human
gcugaagaauugaaaa

SEQ ID NO: 3663163 - RNA, 18 nt, Human
gcugaagaugaaucaaug

SEQ ID NO: 3663164 - RNA, 13 nt, Human
gcugaagcugccu

SEQ ID NO: 3663165 - RNA, 17 nt, Human
gcugaagcugccugcuu

SEQ ID NO: 3663166 - RNA, 22 nt, Human
gcugaagcuuauuaaugcuaag

SEQ ID NO: 3663167 - RNA, 19 nt, Human
gcugaaggaaaccagugca

SEQ ID NO: 3663168 - RNA, 21 nt, Human
gcugaaggacugugacaggca

SEQ ID NO: 3663169 - RNA, 20 nt, Human
gcugaagugcauccaaaggu

SEQ ID NO: 3663170 - RNA, 17 nt, Human
gcugaauaaaugucuuu

SEQ ID NO: 3663171 - RNA, 22 nt, Human
gcugaauacagaggcaacugca

SEQ ID NO: 3663172 - RNA, 19 nt, Human
gcugaaugccuccuguggg

SEQ ID NO: 3663173 - RNA, 18 nt, Human
gcugaauguauguaaaua

SEQ ID NO: 3663174 - RNA, 20 nt, Human
gcugaauguugggacugcua

SEQ ID NO: 3663175 - RNA, 17 nt, Human
gcugaauguuuuucuaa

SEQ ID NO: 3663176 - RNA, 14 nt, Human
gcugaauuaucuau

SEQ ID NO: 3663177 - RNA, 13 nt, Human
gcugaauugagcc

SEQ ID NO: 3663178 - RNA, 21 nt, Human
gcugaauugagccuaaaaaua

SEQ ID NO: 3663179 - RNA, 22 nt, Human
gcugacaaccaccgcuccccag

SEQ ID NO: 3663180 - RNA, 22 nt, Human
gcugacaaccauuaaagucaga

SEQ ID NO: 3663181 - RNA, 17 nt, Human
gcugacacaaaccugcc

SEQ ID NO: 3663182 - RNA, 21 nt, Human
gcugacacaaaccugccuggg

SEQ ID NO: 3663183 - RNA, 16 nt, Human
gcugacaccuaacucu

SEQ ID NO: 3663184 - RNA, 22 nt, Human
gcugacacuucaaggugacaga

SEQ ID NO: 3663185 - RNA, 21 nt, Human
gcugacagacacaggcccggc

SEQ ID NO: 3663186 - RNA, 15 nt, Human
gcugacagcugcucc

SEQ ID NO: 3663187 - RNA, 14 nt, Human
gcugacaguccucu

SEQ ID NO: 3663188 - RNA, 16 nt, Human
gcugacaucuguguuu

SEQ ID NO: 3663189 - RNA, 16 nt, Human
gcugacaucuugaauc

SEQ ID NO: 3663190 - RNA, 16 nt, Human
gcugacauucaccugc

SEQ ID NO: 3663191 - RNA, 17 nt, Human
gcugacauucaccugcc

SEQ ID NO: 3663192 - RNA, 13 nt, Human
gcugaccaagaga

SEQ ID NO: 3663193 - RNA, 15 nt, Human
gcugaccaagagaga

SEQ ID NO: 3663194 - RNA, 16 nt, Human
gcugaccacagcacag

SEQ ID NO: 3663195 - RNA, 19 nt, Human
gcugaccacagcacagcca

SEQ ID NO: 3663196 - RNA, 15 nt, Human
gcugacccagucccu

SEQ ID NO: 3663197 - RNA, 19 nt, Human
gcugacccagucccugggg

SEQ ID NO: 3663198 - RNA, 16 nt, Human
gcugacccaugggcag

SEQ ID NO: 3663199 - RNA, 18 nt, Human
gcugacccaugggcagga

SEQ ID NO: 3663200 - RNA, 21 nt, Human
gcugacccaugggcaggagac

SEQ ID NO: 3663201 - RNA, 14 nt, Human
gcugaccuccacag

SEQ ID NO: 3663202 - RNA, 15 nt, Human
gcugaccuccacagc

SEQ ID NO: 3663203 - RNA, 19 nt, Human
gcugaccucuguuguccuc

SEQ ID NO: 3663204 - RNA, 22 nt, Human
gcugaccucuguuguccucccc

SEQ ID NO: 3663205 - RNA, 22 nt, Human
gcugaccugccucucacacaca

SEQ ID NO: 3663206 - RNA, 23 nt, Human
gcugaccugccucucacacacau

SEQ ID NO: 3663207 - RNA, 13 nt, Human
gcugaccugcuga

SEQ ID NO: 3663208 - RNA, 14 nt, Human
gcugaccuugcuga

SEQ ID NO: 3663209 - RNA, 17 nt, Human
gcugacgaacuuccaug

SEQ ID NO: 3663210 - RNA, 18 nt, Human
gcugacgaggcugggcca

SEQ ID NO: 3663211 - RNA, 13 nt, Human
gcugacggccagg

SEQ ID NO: 3663212 - RNA, 22 nt, Human
gcugacuauaaugccucuccuu

SEQ ID NO: 3663213 - RNA, 13 nt, Human
gcugacuccuggu

SEQ ID NO: 3663214 - RNA, 14 nt, Human
gcugacuccugguc

SEQ ID NO: 3663215 - RNA, 15 nt, Human
gcugacuccuggucc

SEQ ID NO: 3663216 - RNA, 23 nt, Human
gcugacucuaggugcccuuggag

SEQ ID NO: 3663217 - RNA, 18 nt, Human
gcugacugauguugaggg

SEQ ID NO: 3663218 - RNA, 18 nt, Human
gcugacuguacuccuccc

SEQ ID NO: 3663219 - RNA, 16 nt, Human
gcugacuuacaucaug

SEQ ID NO: 3663220 - RNA, 21 nt, Human
gcugacuucacuuauuagucu

SEQ ID NO: 3663221 - RNA, 24 nt, Human
gcugacuucaucucccaccuagca

SEQ ID NO: 3663222 - RNA, 13 nt, Human
gcugagaaccugg

SEQ ID NO: 3663223 - RNA, 14 nt, Human
gcugagaaccuggc

SEQ ID NO: 3663224 - RNA, 17 nt, Human
gcugagaaccuggccuu

SEQ ID NO: 3663225 - RNA, 15 nt, Human
gcugagaacuccuga

SEQ ID NO: 3663226 - RNA, 12 nt, Human
gcugagaagacu

SEQ ID NO: 3663227 - RNA, 15 nt, Human
gcugagaauagaagg

SEQ ID NO: 3663228 - RNA, 19 nt, Human
gcugagaauagaaggaaac

SEQ ID NO: 3663229 - RNA, 15 nt, Human
gcugagacaggagaa

SEQ ID NO: 3663230 - RNA, 19 nt, Human
gcugagacuggauacugcc

SEQ ID NO: 3663231 - RNA, 20 nt, Human
gcugagacuggauacugccc

SEQ ID NO: 3663232 - RNA, 14 nt, Human
gcugagagaaccuc

SEQ ID NO: 3663233 - RNA, 14 nt, Human
gcugagagacuuuu

SEQ ID NO: 3663234 - RNA, 13 nt, Human
gcugagagcccca

SEQ ID NO: 3663235 - RNA, 18 nt, Human
gcugagagccccagcuga

SEQ ID NO: 3663236 - RNA, 13 nt, Human
gcugagaggggcu

SEQ ID NO: 3663237 - RNA, 18 nt, Human
gcugagcaaaucaccaca

SEQ ID NO: 3663238 - RNA, 17 nt, Human
gcugagcaccaggggau

SEQ ID NO: 3663239 - RNA, 13 nt, Human
gcugagcagggcc

SEQ ID NO: 3663240 - RNA, 20 nt, Human
gcugagccaccugcccuuuu

SEQ ID NO: 3663241 - RNA, 11 nt, Human
gcugagccagg

SEQ ID NO: 3663242 - RNA, 17 nt, Human
gcugagccccuacccca

SEQ ID NO: 3663243 - RNA, 15 nt, Human
gcugagccccugucu

SEQ ID NO: 3663244 - RNA, 22 nt, Human
gcugagccccugucuagagagg

SEQ ID NO: 3663245 - RNA, 11 nt, Human
gcugagcccug

SEQ ID NO: 3663246 - RNA, 12 nt, Human
gcugagcccugg

SEQ ID NO: 3663247 - RNA, 14 nt, Human
gcugagcccuggca

SEQ ID NO: 3663248 - RNA, 15 nt, Human
gcugagcccuggcag

SEQ ID NO: 3663249 - RNA, 19 nt, Human
gcugagccucacagcagug

SEQ ID NO: 3663250 - RNA, 14 nt, Human
gcugagccucucac

SEQ ID NO: 3663251 - RNA, 13 nt, Human
gcugagccucugc

SEQ ID NO: 3663252 - RNA, 19 nt, Human
gcugagccucugcucccca

SEQ ID NO: 3663253 - RNA, 15 nt, Human
gcugagccugcaggg

SEQ ID NO: 3663254 - RNA, 20 nt, Human
gcugagccugcagggaagcc

SEQ ID NO: 3663255 - RNA, 15 nt, Human
gcugagccuggacaa

SEQ ID NO: 3663256 - RNA, 14 nt, Human
gcugagcgccagga

SEQ ID NO: 3663257 - RNA, 16 nt, Human
gcugagcucacaaggc

SEQ ID NO: 3663258 - RNA, 14 nt, Human
gcugagcucugaga

SEQ ID NO: 3663259 - RNA, 15 nt, Human
gcugagcucugagag

SEQ ID NO: 3663260 - RNA, 18 nt, Human
gcugagcucugagaggcc

SEQ ID NO: 3663261 - RNA, 19 nt, Human
gcugagcucugagaggccc

SEQ ID NO: 3663262 - RNA, 23 nt, Human
gcugagcucugagaggcccugga

SEQ ID NO: 3663263 - RNA, 17 nt, Human
gcugaggaaaggccagc

SEQ ID NO: 3663264 - RNA, 21 nt, Human
gcugaggaaaggccagcuggc

SEQ ID NO: 3663265 - RNA, 12 nt, Human
gcugaggagcag

SEQ ID NO: 3663266 - RNA, 14 nt, Human
gcugaggaggccuc

SEQ ID NO: 3663267 - RNA, 16 nt, Human
gcugaggaggccucca

SEQ ID NO: 3663268 - RNA, 19 nt, Human
gcugaggauuucaagccug

SEQ ID NO: 3663269 - RNA, 14 nt, Human
gcugaggcaggaga

SEQ ID NO: 3663270 - RNA, 21 nt, Human
gcugaggccacacucagcaca

SEQ ID NO: 3663271 - RNA, 22 nt, Human
gcugaggccggaugcgguggcu

SEQ ID NO: 3663272 - RNA, 13 nt, Human
gcugaggccugga

SEQ ID NO: 3663273 - RNA, 14 nt, Human
gcugaggccuggac

SEQ ID NO: 3663274 - RNA, 14 nt, Human
gcugaggccugggc

SEQ ID NO: 3663275 - RNA, 23 nt, Human
gcugaggccugggccgcugccac

SEQ ID NO: 3663276 - RNA, 21 nt, Human
gcugaggccuuaucauucauu

SEQ ID NO: 3663277 - RNA, 23 nt, Human
cuugaggucuuuugacaugugga

SEQ ID NO: 3663278 - RNA, 15 nt, Human
cuugagguggccucc

SEQ ID NO: 3663279 - RNA, 21 nt, Human
cuugaggugguaguaaaacac

SEQ ID NO: 3663280 - RNA, 13 nt, Human
cuugaguaaaaua

SEQ ID NO: 3663281 - RNA, 16 nt, Human
cuugagucacaaagaa

SEQ ID NO: 3663282 - RNA, 16 nt, Human
cuugagugcucaguag

SEQ ID NO: 3663283 - RNA, 20 nt, Human
cuugaguguaauguuuguua

SEQ ID NO: 3663284 - RNA, 19 nt, Human
cuugaguuguuuuuguaua

SEQ ID NO: 3663285 - RNA, 21 nt, Human
cuugaguuguuuuuguauauu

SEQ ID NO: 3663286 - RNA, 22 nt, Human
cuugaguuguuuuuguauauug

SEQ ID NO: 3663287 - RNA, 19 nt, Human
cuugaguuuaaauuguaau

SEQ ID NO: 3663288 - RNA, 16 nt, Human
cuugaguuuuguuuua

SEQ ID NO: 3663289 - RNA, 23 nt, Human
cuugauacuaaaaguucuucucc

SEQ ID NO: 3663290 - RNA, 22 nt, Human
cuugauagaaaugccaagcacu

SEQ ID NO: 3663291 - RNA, 22 nt, Human
cuugauauccucuuugagugaa

SEQ ID NO: 3663292 - RNA, 14 nt, Human
cuugauauuuguau

SEQ ID NO: 3663293 - RNA, 16 nt, Human
cuugauauuuguauuu

SEQ ID NO: 3663294 - RNA, 20 nt, Human
cuugaucaguaguuugcauu

SEQ ID NO: 3663295 - RNA, 17 nt, Human
cuugaucugcucagccc

SEQ ID NO: 3663296 - RNA, 22 nt, Human
cuugaucugcucagcccuggag

SEQ ID NO: 3663297 - RNA, 13 nt, Human
cuugaugaagcaa

SEQ ID NO: 3663298 - RNA, 14 nt, Human
cuugaugaagcaag

SEQ ID NO: 3663299 - RNA, 18 nt, Human
cuugaugaccaaaguccu

SEQ ID NO: 3663300 - RNA, 16 nt, Human
cuugaugacuggaauu

SEQ ID NO: 3663301 - RNA, 17 nt, Human
cuugaugacuggaauuu

SEQ ID NO: 3663302 - RNA, 15 nt, Human
cuugaugcacagaga

SEQ ID NO: 3663303 - RNA, 19 nt, Human
cuugaugcacagagaagcu

SEQ ID NO: 3663304 - RNA, 22 nt, Human
cuugaugccaguaggcucaacu

SEQ ID NO: 3663305 - RNA, 13 nt, Human
cuugaugccuggc

SEQ ID NO: 3663306 - RNA, 15 nt, Human
cuugauggauuuuca

SEQ ID NO: 3663307 - RNA, 16 nt, Human
cuugauggcuaacuua

SEQ ID NO: 3663308 - RNA, 21 nt, Human
cuugauggcuaacuuacaaag

SEQ ID NO: 3663309 - RNA, 21 nt, Human
cuugauggcuccgaacacccu

SEQ ID NO: 3663310 - RNA, 22 nt, Human
cuugauggucagacacaaacaa

SEQ ID NO: 3663311 - RNA, 14 nt, Human
cuugauguaaaauc

SEQ ID NO: 3663312 - RNA, 18 nt, Human
cuugauguaaaaucuugu

SEQ ID NO: 3663313 - RNA, 17 nt, Human
cuugauguuuggggucu

SEQ ID NO: 3663314 - RNA, 13 nt, Human
cuugauuaaaagu

SEQ ID NO: 3663315 - RNA, 14 nt, Human
cuugauuaaaucaa

SEQ ID NO: 3663316 - RNA, 22 nt, Human
cuugauuaagauuuuacaaaag

SEQ ID NO: 3663317 - RNA, 12 nt, Human
ggaaccucagcc

SEQ ID NO: 3663318 - RNA, 14 nt, Human
ggaaccucagccug

SEQ ID NO: 3663319 - RNA, 22 nt, Human
ggaaccucagccuggccagaca

SEQ ID NO: 3663320 - RNA, 15 nt, Human
ggaaccucccagagg

SEQ ID NO: 3663321 - RNA, 22 nt, Human
ggaaccucccagagguccagcc

SEQ ID NO: 3663322 - RNA, 23 nt, Human
ggaaccucccagagguccagccc

SEQ ID NO: 3663323 - RNA, 21 nt, Human
ggaaccuccccagccugcgcc

SEQ ID NO: 3663324 - RNA, 19 nt, Human
ggaaccucgaguacugugg

SEQ ID NO: 3663325 - RNA, 23 nt, Human
ggaaccucugucucauccuccug

SEQ ID NO: 3663326 - RNA, 13 nt, Human
ggaaccugacccc

SEQ ID NO: 3663327 - RNA, 18 nt, Human
ggaaccugacguagcugc

SEQ ID NO: 3663328 - RNA, 19 nt, Human
ggaaccugaggccugaagg

SEQ ID NO: 3663329 - RNA, 11 nt, Human
ggaaccugcca

SEQ ID NO: 3663330 - RNA, 13 nt, Human
ggaaccuggacca

SEQ ID NO: 3663331 - RNA, 19 nt, Human
ggaaccuggaccaaagcug

SEQ ID NO: 3663332 - RNA, 13 nt, Human
ggaaccuugcugu

SEQ ID NO: 3663333 - RNA, 16 nt, Human
ggaaccuugcuguccu

SEQ ID NO: 3663334 - RNA, 17 nt, Human
ggaacgcguugaaauug

SEQ ID NO: 3663335 - RNA, 21 nt, Human
ggaacgcguugaaauuguaau

SEQ ID NO: 3663336 - RNA, 20 nt, Human
ggaacgguaaauuucugugg

SEQ ID NO: 3663337 - RNA, 22 nt, Human
ggaacggugaaggugacagcag

SEQ ID NO: 3663338 - RNA, 17 nt, Human
ggaacgugacugcccca

SEQ ID NO: 3663339 - RNA, 14 nt, Human
ggaacgugauuagu

SEQ ID NO: 3663340 - RNA, 23 nt, Human
ggaacuagacucccaagcuggac

SEQ ID NO: 3663341 - RNA, 20 nt, Human
ggaacucagauccagggaca

SEQ ID NO: 3663342 - RNA, 13 nt, Human
ggaacucccagca

SEQ ID NO: 3663343 - RNA, 13 nt, Human
ggaacuccuuggc

SEQ ID NO: 3663344 - RNA, 17 nt, Human
ggaacucgugucuggca

SEQ ID NO: 3663345 - RNA, 18 nt, Human
ggaacucuaucugggccu

SEQ ID NO: 3663346 - RNA, 11 nt, Human
ggaacucugac

SEQ ID NO: 3663347 - RNA, 16 nt, Human
ggaacucugacaaggg

SEQ ID NO: 3663348 - RNA, 19 nt, Human
ggaacucuggcuuccaggu

SEQ ID NO: 3663349 - RNA, 12 nt, Human
ggaacugaaggg

SEQ ID NO: 3663350 - RNA, 21 nt, Human
ggaacugcagaccuguccucc

SEQ ID NO: 3663351 - RNA, 12 nt, Human
ggaacugcagca

SEQ ID NO: 3663352 - RNA, 12 nt, Human
ggaacugcugcc

SEQ ID NO: 3663353 - RNA, 14 nt, Human
ggaacugcugccac

SEQ ID NO: 3663354 - RNA, 15 nt, Human
ggaacugcugggcuu

SEQ ID NO: 3663355 - RNA, 20 nt, Human
ggaacugcugggcuuggcag

SEQ ID NO: 3663356 - RNA, 11 nt, Human
ggaacuggagg

SEQ ID NO: 3663357 - RNA, 12 nt, Human
ggaacuggaggc

SEQ ID NO: 3663358 - RNA, 22 nt, Human
ggaacuggccaagcugaggugc

SEQ ID NO: 3663359 - RNA, 15 nt, Human
ggaacuguccagaga

SEQ ID NO: 3663360 - RNA, 15 nt, Human
ggaacuguuuccuuc

SEQ ID NO: 3663361 - RNA, 20 nt, Human
ggaacuuauuaaauggaaac

SEQ ID NO: 3663362 - RNA, 14 nt, Human
ggaacuugaacuga

SEQ ID NO: 3663363 - RNA, 20 nt, Human
ggaacuugccugccuuucca

SEQ ID NO: 3663364 - RNA, 23 nt, Human
ggaacuuggggaguuaagaccug

SEQ ID NO: 3663365 - RNA, 17 nt, Human
ggaagaaaaaaaucuuc

SEQ ID NO: 3663366 - RNA, 20 nt, Human
ggaagaaaaugguuuauuuu

SEQ ID NO: 3663367 - RNA, 19 nt, Human
ggaagaaacacuuucucuu

SEQ ID NO: 3663368 - RNA, 15 nt, Human
ggaagaaacugcuga

SEQ ID NO: 3663369 - RNA, 16 nt, Human
ggaagaaauuccugua

SEQ ID NO: 3663370 - RNA, 18 nt, Human
ggaagaaauuccuguagc

SEQ ID NO: 3663371 - RNA, 23 nt, Human
ggaagaaauuccuguagcaucuu

SEQ ID NO: 3663372 - RNA, 11 nt, Human
ggaagaacacc

SEQ ID NO: 3663373 - RNA, 13 nt, Human
ggaagaacauaga

SEQ ID NO: 3663374 - RNA, 16 nt, Human
ggaagaacauagaacu

SEQ ID NO: 3663375 - RNA, 15 nt, Human
ggaagaagagggaga

SEQ ID NO: 3663376 - RNA, 14 nt, Human
ggaagaagcagaga

SEQ ID NO: 3663377 - RNA, 18 nt, Human
ggaagaagcuuaggcagg

SEQ ID NO: 3663378 - RNA, 19 nt, Human
ggaagaauuuacuuuggaa

SEQ ID NO: 3663379 - RNA, 19 nt, Human
ggaagaauuuuaaaaauga

SEQ ID NO: 3663380 - RNA, 15 nt, Human
ggaagacaguggccc

SEQ ID NO: 3663381 - RNA, 19 nt, Human
ggaagacauuucuuuucuu

SEQ ID NO: 3663382 - RNA, 20 nt, Human
ggaagacccauuccuuccca

SEQ ID NO: 3663383 - RNA, 18 nt, Human
ggaagacgcaagggccug

SEQ ID NO: 3663384 - RNA, 12 nt, Human
ggaagacuuugg

SEQ ID NO: 3663385 - RNA, 18 nt, Human
ggaagacuuuggaaagag

SEQ ID NO: 3663386 - RNA, 13 nt, Human
ggaagagaaaaaa

SEQ ID NO: 3663387 - RNA, 15 nt, Human
ggaagagaaaaaaua

SEQ ID NO: 3663388 - RNA, 14 nt, Human
ggaagagaaacagg

SEQ ID NO: 3663389 - RNA, 13 nt, Human
ggaagagaaucac

SEQ ID NO: 3663390 - RNA, 18 nt, Human
ggaagagagccugcagga

SEQ ID NO: 3663391 - RNA, 17 nt, Human
ggaagagauccaaagac

SEQ ID NO: 3663392 - RNA, 18 nt, Human
ggaagagauccaaagacu

SEQ ID NO: 3663393 - RNA, 19 nt, Human
ggaagagcacagcccuccc

SEQ ID NO: 3663394 - RNA, 16 nt, Human
ggaagagcaggacucc

SEQ ID NO: 3663395 - RNA, 15 nt, Human
ggaagagcccagucu

SEQ ID NO: 3663396 - RNA, 16 nt, Human
ggaagagcccagucug

SEQ ID NO: 3663397 - RNA, 13 nt, Human
ggaagagccuugc

SEQ ID NO: 3663398 - RNA, 20 nt, Human
ggaagagcucaagggacaag

SEQ ID NO: 3663399 - RNA, 23 nt, Human
ggaagagcucaagggacaaggac

SEQ ID NO: 3663400 - RNA, 22 nt, Human
ggaagagcuccuugauauccuc

SEQ ID NO: 3663401 - RNA, 19 nt, Human
ggaagaggcuacagggcca

SEQ ID NO: 3663402 - RNA, 15 nt, Human
ggaagaguguacugg

SEQ ID NO: 3663403 - RNA, 18 nt, Human
ggaagauaaguuggaaac

SEQ ID NO: 3663404 - RNA, 14 nt, Human
ggaagauagcugug

SEQ ID NO: 3663405 - RNA, 14 nt, Human
ggaagaucccccag

SEQ ID NO: 3663406 - RNA, 21 nt, Human
ggaagaucccuuuguccacaa

SEQ ID NO: 3663407 - RNA, 22 nt, Human
ggaagauggggaccagcagccc

SEQ ID NO: 3663408 - RNA, 20 nt, Human
ggaagaugggggcaagaaga

SEQ ID NO: 3663409 - RNA, 19 nt, Human
ggaagcacagaaaacuaga

SEQ ID NO: 3663410 - RNA, 13 nt, Human
ggaagcacaugcc

SEQ ID NO: 3663411 - RNA, 14 nt, Human
ggaagcacaugccu

SEQ ID NO: 3663412 - RNA, 23 nt, Human
ggaagcacaugccucucucaggc

SEQ ID NO: 3663413 - RNA, 18 nt, Human
ggaagcagaaauccaagc

SEQ ID NO: 3663414 - RNA, 14 nt, Human
ggaagcagaauaaa

SEQ ID NO: 3663415 - RNA, 18 nt, Human
ggaagcagaauaaagcaa

SEQ ID NO: 3663416 - RNA, 22 nt, Human
ggaagcagauacauaugagugu

SEQ ID NO: 3663417 - RNA, 13 nt, Human
ggaagcagcagcc

SEQ ID NO: 3663418 - RNA, 18 nt, Human
ggaagcagcagccucgcc

SEQ ID NO: 3663419 - RNA, 13 nt, Human
ggaagcagcuuuc

SEQ ID NO: 3663420 - RNA, 14 nt, Human
ggaagcagugccca

SEQ ID NO: 3663421 - RNA, 15 nt, Human
ggaagcagugcccag

SEQ ID NO: 3663422 - RNA, 17 nt, Human
ggacggggaagccgagc

SEQ ID NO: 3663423 - RNA, 17 nt, Human
ggacggugcccaagcca

SEQ ID NO: 3663424 - RNA, 14 nt, Human
ggacggugcuccag

SEQ ID NO: 3663425 - RNA, 17 nt, Human
ggacggugcuccaggca

SEQ ID NO: 3663426 - RNA, 18 nt, Human
ggacggugcuccaggcag

SEQ ID NO: 3663427 - RNA, 17 nt, Human
ggacgucagacuuggcu

SEQ ID NO: 3663428 - RNA, 22 nt, Human
ggacguccugccaccuggggca

SEQ ID NO: 3663429 - RNA, 20 nt, Human
ggacguguuaugacuccaga

SEQ ID NO: 3663430 - RNA, 19 nt, Human
ggacuaaaagauauaagug

SEQ ID NO: 3663431 - RNA, 21 nt, Human
ggacuaaaugccuaguuuuua

SEQ ID NO: 3663432 - RNA, 10 nt, Human
ggacuaaauu

SEQ ID NO: 3663433 - RNA, 19 nt, Human
ggacuaacacucagaagcc

SEQ ID NO: 3663434 - RNA, 21 nt, Human
ggacuaacacucagaagccug

SEQ ID NO: 3663435 - RNA, 22 nt, Human
ggacuaaccccaacgcacagga

SEQ ID NO: 3663436 - RNA, 21 nt, Human
ggacuacguuaagggaaggaa

SEQ ID NO: 3663437 - RNA, 14 nt, Human
ggacuagaaccugg

SEQ ID NO: 3663438 - RNA, 17 nt, Human
ggacuagaaccuggagg

SEQ ID NO: 3663439 - RNA, 21 nt, Human
ggacuagagggaccucuccca

SEQ ID NO: 3663440 - RNA, 19 nt, Human
ggacuaugaaaagcuagaa

SEQ ID NO: 3663441 - RNA, 22 nt, Human
ggacucaaugcacugacauugu

SEQ ID NO: 3663442 - RNA, 14 nt, Human
ggacucagcccuga

SEQ ID NO: 3663443 - RNA, 15 nt, Human
ggacucagccuucag

SEQ ID NO: 3663444 - RNA, 17 nt, Human
ggacucagccuucagac

SEQ ID NO: 3663445 - RNA, 13 nt, Human
ggacucagcuccc

SEQ ID NO: 3663446 - RNA, 19 nt, Human
ggacucaggaugcccaggg

SEQ ID NO: 3663447 - RNA, 20 nt, Human
ggacucagggccaugccugc

SEQ ID NO: 3663448 - RNA, 19 nt, Human
ggacucaguggguuaacau

SEQ ID NO: 3663449 - RNA, 20 nt, Human
ggacucaucuuucccuccuu

SEQ ID NO: 3663450 - RNA, 14 nt, Human
ggacucaugaggag

SEQ ID NO: 3663451 - RNA, 22 nt, Human
ggacucauuuuaaaaaauggaa

SEQ ID NO: 3663452 - RNA, 11 nt, Human
ggacuccaccc

SEQ ID NO: 3663453 - RNA, 14 nt, Human
ggacuccagacucu

SEQ ID NO: 3663454 - RNA, 22 nt, Human
ggacuccagaucugcaccgccg

SEQ ID NO: 3663455 - RNA, 21 nt, Human
ggacuccaggcagcagacaca

SEQ ID NO: 3663456 - RNA, 11 nt, Human
ggacuccaucu

SEQ ID NO: 3663457 - RNA, 22 nt, Human
ggacuccaucucucauccucca

SEQ ID NO: 3663458 - RNA, 18 nt, Human
ggacucccaacccuggcu

SEQ ID NO: 3663459 - RNA, 21 nt, Human
ggacucccaacccuggcuugg

SEQ ID NO: 3663460 - RNA, 17 nt, Human
ggacuccccaggccagg

SEQ ID NO: 3663461 - RNA, 18 nt, Human
ggacuccccaggccaggc

SEQ ID NO: 3663462 - RNA, 12 nt, Human
ggacuccucugu

SEQ ID NO: 3663463 - RNA, 13 nt, Human
ggacucuaaaguc

SEQ ID NO: 3663464 - RNA, 20 nt, Human
ggacucugaaauaucccggg

SEQ ID NO: 3663465 - RNA, 19 nt, Human
ggacucugaagccucuggg

SEQ ID NO: 3663466 - RNA, 15 nt, Human
ggacucugagcggga

SEQ ID NO: 3663467 - RNA, 13 nt, Human
ggacucugaggcu

SEQ ID NO: 3663468 - RNA, 21 nt, Human
ggacucugcacaugucuugua

SEQ ID NO: 3663469 - RNA, 13 nt, Human
ggacucugcagcc

SEQ ID NO: 3663470 - RNA, 14 nt, Human
ggacucugcagccu

SEQ ID NO: 3663471 - RNA, 15 nt, Human
ggacucugcagccuc

SEQ ID NO: 3663472 - RNA, 17 nt, Human
ggacucugcagccucag

SEQ ID NO: 3663473 - RNA, 21 nt, Human
ggacucugcaucccagcaccu

SEQ ID NO: 3663474 - RNA, 20 nt, Human
ggacucugggcuauggacac

SEQ ID NO: 3663475 - RNA, 17 nt, Human
ggacucuggugccucca

SEQ ID NO: 3663476 - RNA, 22 nt, Human
ggacucuguccugaaggccuga

SEQ ID NO: 3663477 - RNA, 21 nt, Human
ggacucuugcucuuucuacuc

SEQ ID NO: 3663478 - RNA, 19 nt, Human
ggacucuuugguggcuuug

SEQ ID NO: 3663479 - RNA, 17 nt, Human
ggacugaauuaugaaac

SEQ ID NO: 3663480 - RNA, 19 nt, Human
ggacugaauuaugaaacuu

SEQ ID NO: 3663481 - RNA, 21 nt, Human
ggacugacagcaugugcccuc

SEQ ID NO: 3663482 - RNA, 15 nt, Human
ggacugaccagcagc

SEQ ID NO: 3663483 - RNA, 21 nt, Human
ggacugaccuuguaaaagaca

SEQ ID NO: 3663484 - RNA, 15 nt, Human
ggacugacugaggca

SEQ ID NO: 3663485 - RNA, 14 nt, Human
ggacugagaaauuu

SEQ ID NO: 3663486 - RNA, 18 nt, Human
ggacugagaaauuuauaa

SEQ ID NO: 3663487 - RNA, 18 nt, Human
ggacugagccagucccag

SEQ ID NO: 3663488 - RNA, 17 nt, Human
ggacugagccuggccca

SEQ ID NO: 3663489 - RNA, 21 nt, Human
ggacugagggacucugaagcc

SEQ ID NO: 3663490 - RNA, 15 nt, Human
ggacugagugggaag

SEQ ID NO: 3663491 - RNA, 16 nt, Human
ggacugaugucuccua

SEQ ID NO: 3663492 - RNA, 23 nt, Human
ggacugcacagcguccuguccac

SEQ ID NO: 3663493 - RNA, 10 nt, Human
ggacugcaug

SEQ ID NO: 3663494 - RNA, 15 nt, Human
ggacugccaccuccc

SEQ ID NO: 3663495 - RNA, 21 nt, Human
ggacugccaccuccccuugcc

SEQ ID NO: 3663496 - RNA, 23 nt, Human
ggacugccaccuccccuugccag

SEQ ID NO: 3663497 - RNA, 19 nt, Human
ggacugccagucccccugc

SEQ ID NO: 3663498 - RNA, 21 nt, Human
ggacugccagucccccugccc

SEQ ID NO: 3663499 - RNA, 21 nt, Human
ggacugccccgugcagacugg

SEQ ID NO: 3663500 - RNA, 18 nt, Human
ggacugcuaaauaaaauu

SEQ ID NO: 3663501 - RNA, 18 nt, Human
ggacuggccucugcugau

SEQ ID NO: 3663502 - RNA, 23 nt, Human
ggacuggcuagaguccucacucc

SEQ ID NO: 3663503 - RNA, 15 nt, Human
ggacuggcuguccuu

SEQ ID NO: 3663504 - RNA, 21 nt, Human
ggacuggcuuugucccacagc

SEQ ID NO: 3663505 - RNA, 18 nt, Human
ggacugggagcccccagc

SEQ ID NO: 3663506 - RNA, 12 nt, Human
ggacugggaggu

SEQ ID NO: 3663507 - RNA, 23 nt, Human
ggacuggguuuggaccccagcug

SEQ ID NO: 3663508 - RNA, 15 nt, Human
ggacuggugcccucc

SEQ ID NO: 3663509 - RNA, 17 nt, Human
ggacuggugcccuccuc

SEQ ID NO: 3663510 - RNA, 15 nt, Human
ggacuguaagggauu

SEQ ID NO: 3663511 - RNA, 18 nt, Human
ggacuguaaguugggcuu

SEQ ID NO: 3663512 - RNA, 13 nt, Human
ggacuguacacac

SEQ ID NO: 3663513 - RNA, 19 nt, Human
ggacuguacacacuuuauu

SEQ ID NO: 3663514 - RNA, 20 nt, Human
ggacuguagggagggcggca

SEQ ID NO: 3663515 - RNA, 14 nt, Human
ggacugucgcugcu

SEQ ID NO: 3663516 - RNA, 20 nt, Human
ggacugucgcugcuucgugg

SEQ ID NO: 3663517 - RNA, 20 nt, Human
ggacugucuuucagauacau

SEQ ID NO: 3663518 - RNA, 20 nt, Human
ggacugugacaggcagcaga

SEQ ID NO: 3663519 - RNA, 14 nt, Human
ggacuguggugacu

SEQ ID NO: 3663520 - RNA, 15 nt, Human
ggacuguggugacuu

SEQ ID NO: 3663521 - RNA, 21 nt, Human
ggacuguggugacuuuggaua

SEQ ID NO: 3663522 - RNA, 18 nt, Human
gcuguuauuucuauuuuu

SEQ ID NO: 3663523 - RNA, 23 nt, Human
gcuguucacagccagacuggcac

SEQ ID NO: 3663524 - RNA, 22 nt, Human
gcuguucacccacagggcuaag

SEQ ID NO: 3663525 - RNA, 14 nt, Human
gcuguucuuccugg

SEQ ID NO: 3663526 - RNA, 23 nt, Human
gcuguucuuuaguagcaacuaaa

SEQ ID NO: 3663527 - RNA, 19 nt, Human
gcuguugaaagcaaaaaug

SEQ ID NO: 3663528 - RNA, 19 nt, Human
gcuguugacauauuuaaug

SEQ ID NO: 3663529 - RNA, 18 nt, Human
gcuguugaccaggcaccu

SEQ ID NO: 3663530 - RNA, 23 nt, Human
gcuguugaccaggcaccuccccu

SEQ ID NO: 3663531 - RNA, 18 nt, Human
gcuguugagcuguuuucc

SEQ ID NO: 3663532 - RNA, 15 nt, Human
gcuguugcugaauag

SEQ ID NO: 3663533 - RNA, 19 nt, Human
gcuguugcuuaaaccacuu

SEQ ID NO: 3663534 - RNA, 13 nt, Human
gcuguuggcacuc

SEQ ID NO: 3663535 - RNA, 16 nt, Human
gcuguuggcagugagu

SEQ ID NO: 3663536 - RNA, 23 nt, Human
gcuguuggccucugcaaaggaaa

SEQ ID NO: 3663537 - RNA, 13 nt, Human
gcuguuggcuggg

SEQ ID NO: 3663538 - RNA, 14 nt, Human
gcuguuggcugggg

SEQ ID NO: 3663539 - RNA, 16 nt, Human
gcuguuggcugggggc

SEQ ID NO: 3663540 - RNA, 20 nt, Human
gcuguuggcugggggccuca

SEQ ID NO: 3663541 - RNA, 15 nt, Human
gcuguuggugggacc

SEQ ID NO: 3663542 - RNA, 18 nt, Human
gcuguugucauugcuuua

SEQ ID NO: 3663543 - RNA, 22 nt, Human
gcuguugucauugcuuuacugg

SEQ ID NO: 3663544 - RNA, 14 nt, Human
gcuguugucucuuc

SEQ ID NO: 3663545 - RNA, 17 nt, Human
gcuguuguuaugaugug

SEQ ID NO: 3663546 - RNA, 21 nt, Human
gcuguuuaaauguuuuucuau

SEQ ID NO: 3663547 - RNA, 15 nt, Human
gcuguuuacuaggga

SEQ ID NO: 3663548 - RNA, 14 nt, Human
gcuguuuauggccu

SEQ ID NO: 3663549 - RNA, 16 nt, Human
gcuguuuauggccuca

SEQ ID NO: 3663550 - RNA, 17 nt, Human
gcuguuuauguuuuuau

SEQ ID NO: 3663551 - RNA, 16 nt, Human
gcuguuuauuaaucuu

SEQ ID NO: 3663552 - RNA, 13 nt, Human
gcuguuucaaagu

SEQ ID NO: 3663553 - RNA, 13 nt, Human
gcuguuuccauag

SEQ ID NO: 3663554 - RNA, 13 nt, Human
gcuguuugaggau

SEQ ID NO: 3663555 - RNA, 14 nt, Human
gcuguuuggaaaag

SEQ ID NO: 3663556 - RNA, 12 nt, Human
gcuguuugucau

SEQ ID NO: 3663557 - RNA, 17 nt, Human
gcuguuuguccugagau

SEQ ID NO: 3663558 - RNA, 21 nt, Human
gcuguuuguuugacaaagaaa

SEQ ID NO: 3663559 - RNA, 21 nt, Human
gcuguuuuaguuaaauuucug

SEQ ID NO: 3663560 - RNA, 20 nt, Human
gcuguuuuccucccuucugc

SEQ ID NO: 3663561 - RNA, 21 nt, Human
gcuguuuuccucccuucugcu

SEQ ID NO: 3663562 - RNA, 22 nt, Human
gcuguuuuccucccuucugcua

SEQ ID NO: 3663563 - RNA, 13 nt, Human
gcuguuuugugga

SEQ ID NO: 3663564 - RNA, 19 nt, Human
gcuguuuuguggauuuuug

SEQ ID NO: 3663565 - RNA, 14 nt, Human
gcuguuuuguugac

SEQ ID NO: 3663566 - RNA, 16 nt, Human
ggagaaagggcccugg

SEQ ID NO: 3663567 - RNA, 23 nt, Human
ggagaaaugcauccauuccucag

SEQ ID NO: 3663568 - RNA, 20 nt, Human
ggagaacaagaaagggccag

SEQ ID NO: 3663569 - RNA, 18 nt, Human
ggagaaccuugugccugg

SEQ ID NO: 3663570 - RNA, 18 nt, Human
ggagaacuagaaccugga

SEQ ID NO: 3663571 - RNA, 18 nt, Human
ggagaacuugcugccucg

SEQ ID NO: 3663572 - RNA, 15 nt, Human
ggagaagagaggaga

SEQ ID NO: 3663573 - RNA, 16 nt, Human
ggagaagagaggagag

SEQ ID NO: 3663574 - RNA, 14 nt, Human
ggagaagagcgcag

SEQ ID NO: 3663575 - RNA, 19 nt, Human
ggagaagaguugaggaacu

SEQ ID NO: 3663576 - RNA, 20 nt, Human
ggagaagaguugaggaacug

SEQ ID NO: 3663577 - RNA, 15 nt, Human
ggagaagcagugagc

SEQ ID NO: 3663578 - RNA, 16 nt, Human
ggagaagcagugagcc

SEQ ID NO: 3663579 - RNA, 13 nt, Human
ggagaagcaugaa

SEQ ID NO: 3663580 - RNA, 18 nt, Human
ggagaagccacaggccug

SEQ ID NO: 3663581 - RNA, 19 nt, Human
ggagaagccacaggccuga

SEQ ID NO: 3663582 - RNA, 15 nt, Human
ggagaagccaggaau

SEQ ID NO: 3663583 - RNA, 17 nt, Human
ggagaaggaaggagacu

SEQ ID NO: 3663584 - RNA, 14 nt, Human
ggagaaggaucuag

SEQ ID NO: 3663585 - RNA, 22 nt, Human
ggagaagucucagcuaagcuca

SEQ ID NO: 3663586 - RNA, 19 nt, Human
ggagaagucuucuauuuau

SEQ ID NO: 3663587 - RNA, 16 nt, Human
ggagaaucacaggcug

SEQ ID NO: 3663588 - RNA, 22 nt, Human
ggagaaucacaggcugggcugg

SEQ ID NO: 3663589 - RNA, 15 nt, Human
ggagaaucacuugaa

SEQ ID NO: 3663590 - RNA, 17 nt, Human
ggagaaucaugugaacc

SEQ ID NO: 3663591 - RNA, 19 nt, Human
ggagaaucauguuucuuug

SEQ ID NO: 3663592 - RNA, 16 nt, Human
ggagaauuuuacugug

SEQ ID NO: 3663593 - RNA, 22 nt, Human
ggagacaaugcagaugccagag

SEQ ID NO: 3663594 - RNA, 13 nt, Human
ggagacacagaug

SEQ ID NO: 3663595 - RNA, 20 nt, Human
ggagacacuggccccucaaa

SEQ ID NO: 3663596 - RNA, 14 nt, Human
ggagacagcaucag

SEQ ID NO: 3663597 - RNA, 17 nt, Human
ggagacagcaucagggu

SEQ ID NO: 3663598 - RNA, 21 nt, Human
ggagacagccccagagcaggg

SEQ ID NO: 3663599 - RNA, 22 nt, Human
ggagacagccccagagcagggu

SEQ ID NO: 3663600 - RNA, 17 nt, Human
ggagacaggcagagcug

SEQ ID NO: 3663601 - RNA, 12 nt, Human
ggagacaggguu

SEQ ID NO: 3663602 - RNA, 13 nt, Human
ggagacagugauc

SEQ ID NO: 3663603 - RNA, 19 nt, Human
ggagaccggccugccagga

SEQ ID NO: 3663604 - RNA, 21 nt, Human
ggagaccucuccuuccuaccc

SEQ ID NO: 3663605 - RNA, 19 nt, Human
ggagacgccaugugaugga

SEQ ID NO: 3663606 - RNA, 13 nt, Human
ggagacucaccuc

SEQ ID NO: 3663607 - RNA, 21 nt, Human
ggagacucaccucugccucaa

SEQ ID NO: 3663608 - RNA, 21 nt, Human
ggagacuccaugagaagccgu

SEQ ID NO: 3663609 - RNA, 21 nt, Human
ggagacuccuaggcaggacau

SEQ ID NO: 3663610 - RNA, 18 nt, Human
ggagacugcuccugagcc

SEQ ID NO: 3663611 - RNA, 20 nt, Human
ggagacugucuggccccccu

SEQ ID NO: 3663612 - RNA, 16 nt, Human
ggagacuugccagagc

SEQ ID NO: 3663613 - RNA, 22 nt, Human
ggagacuugccagagccgggca

SEQ ID NO: 3663614 - RNA, 19 nt, Human
ggagacuuugaugucagca

SEQ ID NO: 3663615 - RNA, 21 nt, Human
ggagacuuugaugucagcagu

SEQ ID NO: 3663616 - RNA, 15 nt, Human
ggagagaaaaaagaa

SEQ ID NO: 3663617 - RNA, 16 nt, Human
ggagagaaaauauaug

SEQ ID NO: 3663618 - RNA, 24 nt, Human
ggagagaaagugggugagaugcug

SEQ ID NO: 3663619 - RNA, 15 nt, Human
ggagagaaauauuuu

SEQ ID NO: 3663620 - RNA, 18 nt, Human
ggagagaaauauuuuaau

SEQ ID NO: 3663621 - RNA, 16 nt, Human
ggagagaagagaaugc

SEQ ID NO: 3663622 - RNA, 20 nt, Human
ggagagaaggggaggagggc

SEQ ID NO: 3663623 - RNA, 13 nt, Human
ggagagaccucau

SEQ ID NO: 3663624 - RNA, 17 nt, Human
ggagagacgggcccugg

SEQ ID NO: 3663625 - RNA, 20 nt, Human
ggagagacucccaugaagcc

SEQ ID NO: 3663626 - RNA, 10 nt, Human
ggagagagaa

SEQ ID NO: 3663627 - RNA, 11 nt, Human
ggagagagaaa

SEQ ID NO: 3663628 - RNA, 17 nt, Human
ggagagagaaagccagg

SEQ ID NO: 3663629 - RNA, 18 nt, Human
ggagagagaaagccaggc

SEQ ID NO: 3663630 - RNA, 21 nt, Human
ggagagagaaagccaggcagg

SEQ ID NO: 3663631 - RNA, 20 nt, Human
ggagagagaccacacgcagu

SEQ ID NO: 3663632 - RNA, 14 nt, Human
ggagagagacucca

SEQ ID NO: 3663633 - RNA, 13 nt, Human
ggagagaggcaga

SEQ ID NO: 3663634 - RNA, 18 nt, Human
ggagagaggcagagagcg

SEQ ID NO: 3663635 - RNA, 14 nt, Human
ggagagaggggaau

SEQ ID NO: 3663636 - RNA, 16 nt, Human
ggagagauagccugug

SEQ ID NO: 3663637 - RNA, 14 nt, Human
ggagagcaggcugg

SEQ ID NO: 3663638 - RNA, 23 nt, Human
ggagagcaggcuggcagcucucc

SEQ ID NO: 3663639 - RNA, 19 nt, Human
ggagagccagaaccuggag

SEQ ID NO: 3663640 - RNA, 20 nt, Human
ggagagccagaaccuggagg

SEQ ID NO: 3663641 - RNA, 21 nt, Human
ggagagccagaaccuggaggg

SEQ ID NO: 3663642 - RNA, 18 nt, Human
ggagagccagcccucccu

SEQ ID NO: 3663643 - RNA, 21 nt, Human
ggagagccauacauaaaagaa

SEQ ID NO: 3663644 - RNA, 15 nt, Human
ggagagcccaggagc

SEQ ID NO: 3663645 - RNA, 17 nt, Human
ggagagccccuggggcc

SEQ ID NO: 3663646 - RNA, 12 nt, Human
ggagagccugcu

SEQ ID NO: 3663647 - RNA, 14 nt, Human
ggagagccugcugg

SEQ ID NO: 3663648 - RNA, 12 nt, Human
ggagagccuggu

SEQ ID NO: 3663649 - RNA, 13 nt, Human
ggagagccuucca

SEQ ID NO: 3663650 - RNA, 22 nt, Human
ggagagccuuccagggguggga

SEQ ID NO: 3663651 - RNA, 18 nt, Human
ggagagcgccugccccuc

SEQ ID NO: 3663652 - RNA, 22 nt, Human
ggagagcgccugccccucccag

SEQ ID NO: 3663653 - RNA, 22 nt, Human
ggagagcuagaaccuggagagc

SEQ ID NO: 3663654 - RNA, 20 nt, Human
ggagagcuagaaccuggagg

SEQ ID NO: 3663655 - RNA, 21 nt, Human
ggagagcuagaaccuggaggg

SEQ ID NO: 3663656 - RNA, 22 nt, Human
ggagagcuagaaccuggagggc

SEQ ID NO: 3663657 - RNA, 15 nt, Human
ggagagcuagcagca

SEQ ID NO: 3663658 - RNA, 12 nt, Human
ggagagcuagga

SEQ ID NO: 3663659 - RNA, 22 nt, Human
ggagagcuaggagcaaagccug

SEQ ID NO: 3663660 - RNA, 17 nt, Human
ggagagcuggugcccgg

SEQ ID NO: 3663661 - RNA, 18 nt, Human
ggagagcuggugcccgga

SEQ ID NO: 3663662 - RNA, 16 nt, Human
ggagaggaacuccuug

SEQ ID NO: 3663663 - RNA, 13 nt, Human
ggagaggagagag

SEQ ID NO: 3663664 - RNA, 15 nt, Human
ggagaggagagccag

SEQ ID NO: 3663665 - RNA, 16 nt, Human
ggagaggagagccaga

SEQ ID NO: 3663666 - RNA, 20 nt, Human
ggagaggagagccagagaag

SEQ ID NO: 3663667 - RNA, 15 nt, Human
ggagaggagcccugc

SEQ ID NO: 3663668 - RNA, 21 nt, Human
ggagaggaugagagcccagag

SEQ ID NO: 3663669 - RNA, 19 nt, Human
ggagagggaaugugaaauu

SEQ ID NO: 3663670 - RNA, 19 nt, Human
ggagagggacagcccacug

SEQ ID NO: 3663671 - RNA, 14 nt, Human
ggagagggggcugg

SEQ ID NO: 3663672 - RNA, 21 nt, Human
ggagagggggcuggugggugc

SEQ ID NO: 3663673 - RNA, 18 nt, Human
ggagagggucuggagaag

SEQ ID NO: 3663674 - RNA, 20 nt, Human
ggagagggucuggagaagca

SEQ ID NO: 3663675 - RNA, 21 nt, Human
ggagagggucuggagaagcag

SEQ ID NO: 3663676 - RNA, 23 nt, Human
ggagaggucuuuuuuaaaaggaa

SEQ ID NO: 3663677 - RNA, 15 nt, Human
ggagaggugccagca

SEQ ID NO: 3663678 - RNA, 22 nt, Human
ggagaguacauugaaggccugg

SEQ ID NO: 3663679 - RNA, 17 nt, Human
ggagagucacagaacaa

SEQ ID NO: 3663680 - RNA, 20 nt, Human
ggagagucccagagcaggag

SEQ ID NO: 3663681 - RNA, 21 nt, Human
ggagaguccccugaaggucug

SEQ ID NO: 3663682 - RNA, 22 nt, Human
ggagagugucaaccagacagag

SEQ ID NO: 3663683 - RNA, 19 nt, Human
ggagauaauuacugccuug

SEQ ID NO: 3663684 - RNA, 21 nt, Human
ggagauagccccacaggaggu

SEQ ID NO: 3663685 - RNA, 20 nt, Human
ggagaucaaggagaggaggc

SEQ ID NO: 3663686 - RNA, 18 nt, Human
ggagaucggggccagagg

SEQ ID NO: 3663687 - RNA, 15 nt, Human
ggagaugaggccaga

SEQ ID NO: 3663688 - RNA, 18 nt, Human
ggagaugaggccagacca

SEQ ID NO: 3663689 - RNA, 15 nt, Human
ggagaugcugugccc

SEQ ID NO: 3663690 - RNA, 23 nt, Human
ggagaugcugugccccuggccuu

SEQ ID NO: 3663691 - RNA, 18 nt, Human
ggagaugggccuuuugga

SEQ ID NO: 3663692 - RNA, 16 nt, Human
ggagauguagcaaaac

SEQ ID NO: 3663693 - RNA, 12 nt, Human
ggagaugucuuc

SEQ ID NO: 3663694 - RNA, 13 nt, Human
ggagaugucuucg

SEQ ID NO: 3663695 - RNA, 20 nt, Human
ggagauugagaaggagagaa

SEQ ID NO: 3663696 - RNA, 16 nt, Human
ggagcaaacucugcug

SEQ ID NO: 3663697 - RNA, 20 nt, Human
ggagcaaacugcaugcccag

SEQ ID NO: 3663698 - RNA, 22 nt, Human
ggagcaaacugcaugcccagag

SEQ ID NO: 3663699 - RNA, 13 nt, Human
ggagcaaagccug

SEQ ID NO: 3663700 - RNA, 17 nt, Human
ggagcaaagugagggcc

SEQ ID NO: 3663701 - RNA, 15 nt, Human
ggagcaagaggaggc

SEQ ID NO: 3663702 - RNA, 21 nt, Human
ggagcacaaagacccuggcuu

SEQ ID NO: 3663703 - RNA, 21 nt, Human
ggagcacaauaaauggcugua

SEQ ID NO: 3663704 - RNA, 13 nt, Human
ggagcacaggcag

SEQ ID NO: 3663705 - RNA, 18 nt, Human
ggagcacaggucccaccu

SEQ ID NO: 3663706 - RNA, 13 nt, Human
ggagcacccugag

SEQ ID NO: 3663707 - RNA, 22 nt, Human
ggagcacggcucuguccccagc

SEQ ID NO: 3663708 - RNA, 23 nt, Human
ggagcacggcucuguccccagcc

SEQ ID NO: 3663709 - RNA, 13 nt, Human
ggagcacuggagu

SEQ ID NO: 3663710 - RNA, 17 nt, Human
ggaagcgcucagaacag

SEQ ID NO: 3663711 - RNA, 21 nt, Human
ggaagcgugaaggccgagaag

SEQ ID NO: 3663712 - RNA, 15 nt, Human
ggaagcuacagguua

SEQ ID NO: 3663713 - RNA, 21 nt, Human
ggaagcuacagguuacaacag

SEQ ID NO: 3663714 - RNA, 22 nt, Human
ggaagcuagacacaugaaggua

SEQ ID NO: 3663715 - RNA, 21 nt, Human
ggaagcuagcuccccuccucu

SEQ ID NO: 3663716 - RNA, 22 nt, Human
ggaagcuagcuccccuccucuc

SEQ ID NO: 3663717 - RNA, 16 nt, Human
ggaagcuagucuuuug

SEQ ID NO: 3663718 - RNA, 15 nt, Human
ggaagcucagggccu

SEQ ID NO: 3663719 - RNA, 13 nt, Human
ggaagcugaggcg

SEQ ID NO: 3663720 - RNA, 17 nt, Human
ggaagcugcccugccca

SEQ ID NO: 3663721 - RNA, 13 nt, Human
ggaagcugcuacu

SEQ ID NO: 3663722 - RNA, 13 nt, Human
ggaagcugcuccg

SEQ ID NO: 3663723 - RNA, 15 nt, Human
ggaagcuggccugag

SEQ ID NO: 3663724 - RNA, 21 nt, Human
ggaagcuguguccuugcaccu

SEQ ID NO: 3663725 - RNA, 23 nt, Human
ggaagcuguguccuugcaccugc

SEQ ID NO: 3663726 - RNA, 20 nt, Human
ggaagcuuccaguccaaucu

SEQ ID NO: 3663727 - RNA, 21 nt, Human
ggaagcuuuggugagaaccug

SEQ ID NO: 3663728 - RNA, 17 nt, Human
ggaaggaacucuggcuu

SEQ ID NO: 3663729 - RNA, 23 nt, Human
ggaaggaacucuggcuuccaggu

SEQ ID NO: 3663730 - RNA, 11 nt, Human
ggaaggaagcc

SEQ ID NO: 3663731 - RNA, 17 nt, Human
ggaaggaccuauguuug

SEQ ID NO: 3663732 - RNA, 14 nt, Human
ggaaggagacacag

SEQ ID NO: 3663733 - RNA, 17 nt, Human
ggaaggagacacagaug

SEQ ID NO: 3663734 - RNA, 22 nt, Human
ggaaggagacucaccucugccu

SEQ ID NO: 3663735 - RNA, 12 nt, Human
ggaaggagagaa

SEQ ID NO: 3663736 - RNA, 13 nt, Human
ggaaggagagccu

SEQ ID NO: 3663737 - RNA, 15 nt, Human
ggaaggagagccugc

SEQ ID NO: 3663738 - RNA, 12 nt, Human
ggaaggagcugc

SEQ ID NO: 3663739 - RNA, 16 nt, Human
ggaaggaggagccgac

SEQ ID NO: 3663740 - RNA, 15 nt, Human
ggcaaaaaaauuaaa

SEQ ID NO: 3663741 - RNA, 13 nt, Human
ggcaaaaacaaag

SEQ ID NO: 3663742 - RNA, 15 nt, Human
ggcaaaaaggcagga

SEQ ID NO: 3663743 - RNA, 15 nt, Human
ggcaaaaccuugcua

SEQ ID NO: 3663744 - RNA, 18 nt, Human
ggcaaaacuuuggcacug

SEQ ID NO: 3663745 - RNA, 13 nt, Human
ggcaaacaggcag

SEQ ID NO: 3663746 - RNA, 17 nt, Human
ggcaaacagggccucug

SEQ ID NO: 3663747 - RNA, 21 nt, Human
ggcaaacauuuucucuuagaa

SEQ ID NO: 3663748 - RNA, 22 nt, Human
ggcaaacauuuucucuuagaaa

SEQ ID NO: 3663749 - RNA, 20 nt, Human
ggcaaagcagcaacacacau

SEQ ID NO: 3663750 - RNA, 19 nt, Human
ggcaaaggaagguggaugg

SEQ ID NO: 3663751 - RNA, 20 nt, Human
ggcaaagguggcucuccagu

SEQ ID NO: 3663752 - RNA, 13 nt, Human
ggcaaauaaaauu

SEQ ID NO: 3663753 - RNA, 16 nt, Human
ggcaaauaucuugaaa

SEQ ID NO: 3663754 - RNA, 20 nt, Human
ggcaaauccgaaaucagcag

SEQ ID NO: 3663755 - RNA, 18 nt, Human
ggcaaaugacaugcacug

SEQ ID NO: 3663756 - RNA, 15 nt, Human
ggcaaaugccagggc

SEQ ID NO: 3663757 - RNA, 16 nt, Human
ggcaaauguuuauuua

SEQ ID NO: 3663758 - RNA, 19 nt, Human
ggcaacaaaagaagcccgg

SEQ ID NO: 3663759 - RNA, 14 nt, Human
ggcaacacagaggc

SEQ ID NO: 3663760 - RNA, 18 nt, Human
ggcaacagaucaguaaag

SEQ ID NO: 3663761 - RNA, 16 nt, Human
ggcaaccacuaagaau

SEQ ID NO: 3663762 - RNA, 19 nt, Human
ggcaaccacuaagaauuca

SEQ ID NO: 3663763 - RNA, 20 nt, Human
ggcaaccccaguucugcucc

SEQ ID NO: 3663764 - RNA, 19 nt, Human
ggcaacccccagccugcua

SEQ ID NO: 3663765 - RNA, 17 nt, Human
ggcaaccugauuguaaa

SEQ ID NO: 3663766 - RNA, 15 nt, Human
ggcaacgaagaaaaa

SEQ ID NO: 3663767 - RNA, 16 nt, Human
ggcaacgaagaaaaaa

SEQ ID NO: 3663768 - RNA, 16 nt, Human
ggcaacgcacaaaaca

SEQ ID NO: 3663769 - RNA, 19 nt, Human
ggcaacugaacaaaaaaau

SEQ ID NO: 3663770 - RNA, 19 nt, Human
ggcaacugaggcagacagc

SEQ ID NO: 3663771 - RNA, 22 nt, Human
ggcaacugcugaugcucauggu

SEQ ID NO: 3663772 - RNA, 12 nt, Human
ggcaacuggcca

SEQ ID NO: 3663773 - RNA, 19 nt, Human
ggcaacuggccauuugcca

SEQ ID NO: 3663774 - RNA, 22 nt, Human
ggcaacuuuccuuguuccccau

SEQ ID NO: 3663775 - RNA, 19 nt, Human
ggcaagagcccccuugaca

SEQ ID NO: 3663776 - RNA, 17 nt, Human
ggcaagagggugacagc

SEQ ID NO: 3663777 - RNA, 17 nt, Human
ggcaagcaccuccugcc

SEQ ID NO: 3663778 - RNA, 19 nt, Human
ggcaagcaccuccugccuc

SEQ ID NO: 3663779 - RNA, 16 nt, Human
ggcaagcauguaacuu

SEQ ID NO: 3663780 - RNA, 21 nt, Human
ggcaagcauguaacuuauauu

SEQ ID NO: 3663781 - RNA, 13 nt, Human
ggcaagccaggcu

SEQ ID NO: 3663782 - RNA, 19 nt, Human
ggcaagccccugcccaucu

SEQ ID NO: 3663783 - RNA, 14 nt, Human
ggcaagcuccgcag

SEQ ID NO: 3663784 - RNA, 18 nt, Human
ggcaagcuccgcaggacu

SEQ ID NO: 3663785 - RNA, 14 nt, Human
ggcaaggaaaaaga

SEQ ID NO: 3663786 - RNA, 11 nt, Human
ggcaaggaaag

SEQ ID NO: 3663787 - RNA, 24 nt, Human
ggcaaggacgcuucacaggacagg

SEQ ID NO: 3663788 - RNA, 13 nt, Human
ggcaaggcugugc

SEQ ID NO: 3663789 - RNA, 17 nt, Human
ggcaaggggugccuggg

SEQ ID NO: 3663790 - RNA, 19 nt, Human
ggcaaggguuaaggccuga

SEQ ID NO: 3663791 - RNA, 22 nt, Human
ggcaagucccugacucucugug

SEQ ID NO: 3663792 - RNA, 16 nt, Human
ggcaaguuuucccuga

SEQ ID NO: 3663793 - RNA, 20 nt, Human
ggcaauaaaagcccaggagc

SEQ ID NO: 3663794 - RNA, 22 nt, Human
ggcaauaaaagcccaggagccc

SEQ ID NO: 3663795 - RNA, 19 nt, Human
ggcaauaaauuuugaaaag

SEQ ID NO: 3663796 - RNA, 18 nt, Human
ggcaauaguguguucuga

SEQ ID NO: 3663797 - RNA, 21 nt, Human
ggcaauauaaccaauguuuaa

SEQ ID NO: 3663798 - RNA, 22 nt, Human
ggcaauauaaccaauguuuaaa

SEQ ID NO: 3663799 - RNA, 16 nt, Human
ggcaauauucucugua

SEQ ID NO: 3663800 - RNA, 17 nt, Human
ggcaaugccacagcccu

SEQ ID NO: 3663801 - RNA, 20 nt, Human
ggcaaugggagcugaggcca

SEQ ID NO: 3663802 - RNA, 21 nt, Human
ggcaaugggagcugaggccac

SEQ ID NO: 3663803 - RNA, 13 nt, Human
ggcaauuuagaaa

SEQ ID NO: 3663804 - RNA, 14 nt, Human
ggcaauuuuguaac

SEQ ID NO: 3663805 - RNA, 15 nt, Human
ggcaauuuugugguu

SEQ ID NO: 3663806 - RNA, 15 nt, Human
ggcacaacugcaaua

SEQ ID NO: 3663807 - RNA, 20 nt, Human
ggcacaauggcuaauuccca

SEQ ID NO: 3663808 - RNA, 22 nt, Human
ggcacaauggcuaauucccaga

SEQ ID NO: 3663809 - RNA, 17 nt, Human
ggcacacaaggggcccu

SEQ ID NO: 3663810 - RNA, 13 nt, Human
ggcacacacugug

SEQ ID NO: 3663811 - RNA, 17 nt, Human
ggcacaccuccucccac

SEQ ID NO: 3663812 - RNA, 20 nt, Human
ggcacaccuccucccacugc

SEQ ID NO: 3663813 - RNA, 12 nt, Human
ggcacacgccuc

SEQ ID NO: 3663814 - RNA, 20 nt, Human
ggcacacgcugcucugcccc

SEQ ID NO: 3663815 - RNA, 15 nt, Human
ggcacacucugccag

SEQ ID NO: 3663816 - RNA, 21 nt, Human
ggcacagaaacacaauauuuu

SEQ ID NO: 3663817 - RNA, 15 nt, Human
ggcacagaugcucca

SEQ ID NO: 3663818 - RNA, 17 nt, Human
ggcacagcaucuguagu

SEQ ID NO: 3663819 - RNA, 22 nt, Human
ggcacagcaucuguagucagcc

SEQ ID NO: 3663820 - RNA, 20 nt, Human
ggcacagccggggccugccu

SEQ ID NO: 3663821 - RNA, 13 nt, Human
ggcacagccugca

SEQ ID NO: 3663822 - RNA, 20 nt, Human
ggcacagcggagucuguccu

SEQ ID NO: 3663823 - RNA, 17 nt, Human
ggcacaggagcuaccug

SEQ ID NO: 3663824 - RNA, 20 nt, Human
ggcacaggagcuaccugugu

SEQ ID NO: 3663825 - RNA, 12 nt, Human
ggcacaggaggc

SEQ ID NO: 3663826 - RNA, 16 nt, Human
ggcacaggaggcaggc

SEQ ID NO: 3663827 - RNA, 21 nt, Human
ggcacaggcagggcaggacca

SEQ ID NO: 3663828 - RNA, 14 nt, Human
ggcacagggagaag

SEQ ID NO: 3663829 - RNA, 16 nt, Human
ggcacagggcaguggg

SEQ ID NO: 3663830 - RNA, 12 nt, Human
ggcacagggccu

SEQ ID NO: 3663831 - RNA, 17 nt, Human
ggcacagggccuggccc

SEQ ID NO: 3663832 - RNA, 14 nt, Human
ggcacaguccagga

SEQ ID NO: 3663833 - RNA, 14 nt, Human
ggcacaucauuuca

SEQ ID NO: 3663834 - RNA, 21 nt, Human
ggcacauccuaugcaauauau

SEQ ID NO: 3663835 - RNA, 18 nt, Human
ggcacauugagcugugca

SEQ ID NO: 3663836 - RNA, 18 nt, Human
ggcacauuuaagagacag

SEQ ID NO: 3663837 - RNA, 20 nt, Human
ggcacauuuccccagaccug

SEQ ID NO: 3663838 - RNA, 18 nt, Human
ggcacauuuuuuuuuuua

SEQ ID NO: 3663839 - RNA, 20 nt, Human
ggcaccaaagaugcagccgc

SEQ ID NO: 3663840 - RNA, 13 nt, Human
ggcaccagacacc

SEQ ID NO: 3663841 - RNA, 16 nt, Human
ggcaccagcagccugg

SEQ ID NO: 3663842 - RNA, 18 nt, Human
ggcaccagccggggaaga

SEQ ID NO: 3663843 - RNA, 15 nt, Human
ggcaccagucccugu

SEQ ID NO: 3663844 - RNA, 17 nt, Human
ggcaccagucccugucc

SEQ ID NO: 3663845 - RNA, 18 nt, Human
ggcaccagucccuguccg

SEQ ID NO: 3663846 - RNA, 21 nt, Human
ggcaccaguguccuccccuca

SEQ ID NO: 3663847 - RNA, 22 nt, Human
ggcacccaagaccucagggcac

SEQ ID NO: 3663848 - RNA, 16 nt, Human
ggcacccacccagcac

SEQ ID NO: 3663849 - RNA, 13 nt, Human
ggcacccacccug

SEQ ID NO: 3663850 - RNA, 20 nt, Human
ggcacccaccguggaggagg

SEQ ID NO: 3663851 - RNA, 13 nt, Human
ggcacccccagcc

SEQ ID NO: 3663852 - RNA, 16 nt, Human
ggcacccccagccugg

SEQ ID NO: 3663853 - RNA, 17 nt, Human
ggcacccccagccuggg

SEQ ID NO: 3663854 - RNA, 17 nt, Human
ggcacccccgucaagag

SEQ ID NO: 3663855 - RNA, 13 nt, Human
ggaccaaagcuga

SEQ ID NO: 3663856 - RNA, 22 nt, Human
ggaccaaagggagucugccagg

SEQ ID NO: 3663857 - RNA, 18 nt, Human
ggaccaacaagggcagug

SEQ ID NO: 3663858 - RNA, 22 nt, Human
ggaccaacaagggcaguggagg

SEQ ID NO: 3663859 - RNA, 20 nt, Human
ggaccaacccuggggaagga

SEQ ID NO: 3663860 - RNA, 18 nt, Human
ggaccaacccuguuuccu

SEQ ID NO: 3663861 - RNA, 22 nt, Human
ggaccaacccuguuuccugagu

SEQ ID NO: 3663862 - RNA, 16 nt, Human
ggaccaagcaucuugg

SEQ ID NO: 3663863 - RNA, 15 nt, Human
ggaccaaggaccccu

SEQ ID NO: 3663864 - RNA, 15 nt, Human
ggaccaaggcaaggc

SEQ ID NO: 3663865 - RNA, 20 nt, Human
ggaccaaggcaaggcaggug

SEQ ID NO: 3663866 - RNA, 22 nt, Human
ggaccaaggcaaggcaggugcc

SEQ ID NO: 3663867 - RNA, 21 nt, Human
ggaccaauaaaauuucuaaga

SEQ ID NO: 3663868 - RNA, 20 nt, Human
ggaccacaacuauuuucaga

SEQ ID NO: 3663869 - RNA, 13 nt, Human
ggaccacaccucc

SEQ ID NO: 3663870 - RNA, 13 nt, Human
ggaccagagcugc

SEQ ID NO: 3663871 - RNA, 17 nt, Human
ggaccagagcugccacc

SEQ ID NO: 3663872 - RNA, 16 nt, Human
ggaccagccuggccca

SEQ ID NO: 3663873 - RNA, 22 nt, Human
ggaccagccuggcccaccccac

SEQ ID NO: 3663874 - RNA, 18 nt, Human
ggaccagcucaggacaga

SEQ ID NO: 3663875 - RNA, 19 nt, Human
ggaccagcuggggcguggg

SEQ ID NO: 3663876 - RNA, 17 nt, Human
ggaccagcuuuucccaa

SEQ ID NO: 3663877 - RNA, 22 nt, Human
ggaccagcuuuucccaaaagcc

SEQ ID NO: 3663878 - RNA, 14 nt, Human
ggaccaggacagga

SEQ ID NO: 3663879 - RNA, 17 nt, Human
ggaccaggacucccucc

SEQ ID NO: 3663880 - RNA, 16 nt, Human
ggaccagucccagagc

SEQ ID NO: 3663881 - RNA, 17 nt, Human
ggaccagucccagagca

SEQ ID NO: 3663882 - RNA, 18 nt, Human
ggaccagucccagagcag

SEQ ID NO: 3663883 - RNA, 22 nt, Human
ggaccagugguuuccagucaug

SEQ ID NO: 3663884 - RNA, 21 nt, Human
ggaccaugcugucuggcacag

SEQ ID NO: 3663885 - RNA, 22 nt, Human
ggaccaugcugucuggcacagc

SEQ ID NO: 3663886 - RNA, 23 nt, Human
ggaccaugcugucuggcacagcc

SEQ ID NO: 3663887 - RNA, 21 nt, Human
ggaccaugugucacuugugcu

SEQ ID NO: 3663888 - RNA, 16 nt, Human
ggaccauuuuccugca

SEQ ID NO: 3663889 - RNA, 12 nt, Human
ggacccagaccc

SEQ ID NO: 3663890 - RNA, 18 nt, Human
ggacccagcgggcagguu

SEQ ID NO: 3663891 - RNA, 13 nt, Human
ggacccagcuaau

SEQ ID NO: 3663892 - RNA, 13 nt, Human
ggacccagugcag

SEQ ID NO: 3663893 - RNA, 17 nt, Human
ggacccaguggcagggc

SEQ ID NO: 3663894 - RNA, 21 nt, Human
ggacccaguggcagggcacag

SEQ ID NO: 3663895 - RNA, 19 nt, Human
ggacccauagaucuucuga

SEQ ID NO: 3663896 - RNA, 20 nt, Human
ggacccauagaucuucugaa

SEQ ID NO: 3663897 - RNA, 19 nt, Human
ggacccaucacgccugugc

SEQ ID NO: 3663898 - RNA, 23 nt, Human
ggaccccacuccggcccuccaga

SEQ ID NO: 3663899 - RNA, 12 nt, Human
ggaccccagaga

SEQ ID NO: 3663900 - RNA, 17 nt, Human
ggaccccagccauccag

SEQ ID NO: 3663901 - RNA, 12 nt, Human
ggaccccagccu

SEQ ID NO: 3663902 - RNA, 11 nt, Human
ggaccccagcu

SEQ ID NO: 3663903 - RNA, 12 nt, Human
ggaccccagcuc

SEQ ID NO: 3663904 - RNA, 14 nt, Human
ggaccccaucugug

SEQ ID NO: 3663905 - RNA, 23 nt, Human
ggaccccccuuucacaggcagcc

SEQ ID NO: 3663906 - RNA, 16 nt, Human
ggacccccguggggca

SEQ ID NO: 3663907 - RNA, 14 nt, Human
ggacccccuucccc

SEQ ID NO: 3663908 - RNA, 15 nt, Human
ggaccccgagccugg

SEQ ID NO: 3663909 - RNA, 14 nt, Human
ggaccccuaugaag

SEQ ID NO: 3663910 - RNA, 18 nt, Human
ggcaggcuagaaccuggc

SEQ ID NO: 3663911 - RNA, 13 nt, Human
ggcaggcucacug

SEQ ID NO: 3663912 - RNA, 15 nt, Human
ggcaggcucacugcc

SEQ ID NO: 3663913 - RNA, 19 nt, Human
ggcaggcucacugccaggc

SEQ ID NO: 3663914 - RNA, 16 nt, Human
ggcaggcugacaucug

SEQ ID NO: 3663915 - RNA, 12 nt, Human
ggcaggcuggcc

SEQ ID NO: 3663916 - RNA, 22 nt, Human
ggcagggagcggccggccagcc

SEQ ID NO: 3663917 - RNA, 17 nt, Human
ggcagggagcugggccc

SEQ ID NO: 3663918 - RNA, 10 nt, Human
ggcagggagg

SEQ ID NO: 3663919 - RNA, 15 nt, Human
ggcagggaggcacca

SEQ ID NO: 3663920 - RNA, 19 nt, Human
ggcagggagggccugggcc

SEQ ID NO: 3663921 - RNA, 20 nt, Human
ggcagggagggccugggccc

SEQ ID NO: 3663922 - RNA, 17 nt, Human
ggcagggaggucaggcc

SEQ ID NO: 3663923 - RNA, 19 nt, Human
ggcagggaggucaggcccu

SEQ ID NO: 3663924 - RNA, 22 nt, Human
ggcagggaggucaggcccugga

SEQ ID NO: 3663925 - RNA, 17 nt, Human
ggcagggcacagggccu

SEQ ID NO: 3663926 - RNA, 18 nt, Human
ggcagggccuugcccaga

SEQ ID NO: 3663927 - RNA, 20 nt, Human
ggcagggccuugcccagaga

SEQ ID NO: 3663928 - RNA, 21 nt, Human
ggcagggccuugcccagagau

SEQ ID NO: 3663929 - RNA, 13 nt, Human
ggcagggcucucc

SEQ ID NO: 3663930 - RNA, 13 nt, Human
ggcagggcucuga

SEQ ID NO: 3663931 - RNA, 14 nt, Human
ggcagggcucugau

SEQ ID NO: 3663932 - RNA, 16 nt, Human
ggcagggcugugcuug

SEQ ID NO: 3663933 - RNA, 14 nt, Human
ggcaggggacagga

SEQ ID NO: 3663934 - RNA, 19 nt, Human
ggcaggggaggccaucugg

SEQ ID NO: 3663935 - RNA, 22 nt, Human
ggcaggggagggucagccaggg

SEQ ID NO: 3663936 - RNA, 19 nt, Human
ggcaggggcccugcagcuc

SEQ ID NO: 3663937 - RNA, 14 nt, Human
ggcaggggccugga

SEQ ID NO: 3663938 - RNA, 16 nt, Human
ggcaggggccuggaga

SEQ ID NO: 3663939 - RNA, 17 nt, Human
ggcagggggcugcugcu

SEQ ID NO: 3663940 - RNA, 15 nt, Human
ggcagggucaggaga

SEQ ID NO: 3663941 - RNA, 17 nt, Human
ggcagggucaggagagg

SEQ ID NO: 3663942 - RNA, 14 nt, Human
ggcagggugacccu

SEQ ID NO: 3663943 - RNA, 21 nt, Human
ggcagggugggauggaggaga

SEQ ID NO: 3663944 - RNA, 17 nt, Human
ggcagguaaacuccugu

SEQ ID NO: 3663945 - RNA, 23 nt, Human
ggcagguaugaucggcaggacac

SEQ ID NO: 3663946 - RNA, 18 nt, Human
ggcagguccuccccucuc

SEQ ID NO: 3663947 - RNA, 16 nt, Human
ggcaggugacagugag

SEQ ID NO: 3663948 - RNA, 19 nt, Human
ggcaggugacagugagguc

SEQ ID NO: 3663949 - RNA, 21 nt, Human
ggcaggugccaugucugggaa

SEQ ID NO: 3663950 - RNA, 15 nt, Human
ggcaggugccuccag

SEQ ID NO: 3663951 - RNA, 21 nt, Human
ggcaggugcuggagcacuggg

SEQ ID NO: 3663952 - RNA, 16 nt, Human
ggcaggugggagcuug

SEQ ID NO: 3663953 - RNA, 17 nt, Human
ggcaggugguggcacug

SEQ ID NO: 3663954 - RNA, 21 nt, Human
ggcaggugguggcacugagcc

SEQ ID NO: 3663955 - RNA, 17 nt, Human
ggcagguuggugggggc

SEQ ID NO: 3663956 - RNA, 16 nt, Human
ggcaguaaagagaaac

SEQ ID NO: 3663957 - RNA, 13 nt, Human
ggcaguaccugag

SEQ ID NO: 3663958 - RNA, 21 nt, Human
ggcaguagaacuccaggcccu

SEQ ID NO: 3663959 - RNA, 14 nt, Human
ggcaguaggccggu

SEQ ID NO: 3663960 - RNA, 22 nt, Human
ggcagucauucagcaccagagc

SEQ ID NO: 3663961 - RNA, 19 nt, Human
ggcagucgauagagcugua

SEQ ID NO: 3663962 - RNA, 14 nt, Human
ggcagucgggggcu

SEQ ID NO: 3663963 - RNA, 19 nt, Human
ggcagucgggggcuggccu

SEQ ID NO: 3663964 - RNA, 14 nt, Human
ggcagucucucucu

SEQ ID NO: 3663965 - RNA, 16 nt, Human
ggcagugagggagggc

SEQ ID NO: 3663966 - RNA, 19 nt, Human
ggcagugagugagccuggc

SEQ ID NO: 3663967 - RNA, 22 nt, Human
ggcagugcagcaaccagagcac

SEQ ID NO: 3663968 - RNA, 19 nt, Human
ggcagugcucacccacacc

SEQ ID NO: 3663969 - RNA, 16 nt, Human
ggcagugcuuggccca

SEQ ID NO: 3663970 - RNA, 21 nt, Human
ggcagugcuuggcccaggagu

SEQ ID NO: 3663971 - RNA, 22 nt, Human
ggcagugcuuggcccaggaguu

SEQ ID NO: 3663972 - RNA, 23 nt, Human
ggcagugcuuggcccaggaguuu

SEQ ID NO: 3663973 - RNA, 11 nt, Human
ggcaguggagg

SEQ ID NO: 3663974 - RNA, 20 nt, Human
ggcaguggagucggaagggc

SEQ ID NO: 3663975 - RNA, 13 nt, Human
ggcagugggaaaa

SEQ ID NO: 3663976 - RNA, 21 nt, Human
ggcagugggacagggcauggc

SEQ ID NO: 3663977 - RNA, 18 nt, Human
ggcagugggagcugccug

SEQ ID NO: 3663978 - RNA, 13 nt, Human
ggcaguggggcug

SEQ ID NO: 3663979 - RNA, 15 nt, Human
ggcaguggggcuggg

SEQ ID NO: 3663980 - RNA, 18 nt, Human
ggcaguggggcugggggu

SEQ ID NO: 3663981 - RNA, 21 nt, Human
ggcaguggugguuuucuguuc

SEQ ID NO: 3663982 - RNA, 16 nt, Human
ggcaguuaccauuaaa

SEQ ID NO: 3663983 - RNA, 12 nt, Human
ggcaguuauauu

SEQ ID NO: 3663984 - RNA, 16 nt, Human
ggcaguuauauuuugc

SEQ ID NO: 3663985 - RNA, 21 nt, Human
ggcaguucgcagccacccuga

SEQ ID NO: 3663986 - RNA, 23 nt, Human
ggcaguucgcagccacccugagg

SEQ ID NO: 3663987 - RNA, 15 nt, Human
ggcaguucugggugc

SEQ ID NO: 3663988 - RNA, 20 nt, Human
ggcaguuuugacaucagcca

SEQ ID NO: 3663989 - RNA, 12 nt, Human
ggcaguuuuucu

SEQ ID NO: 3663990 - RNA, 13 nt, Human
ggcauaaaacagc

SEQ ID NO: 3663991 - RNA, 14 nt, Human
ggcauacuaauaaa

SEQ ID NO: 3663992 - RNA, 15 nt, Human
ggcauagcccagaca

SEQ ID NO: 3663993 - RNA, 13 nt, Human
ggcauagcucugg

SEQ ID NO: 3663994 - RNA, 17 nt, Human
ggcauaggccugggugc

SEQ ID NO: 3663995 - RNA, 22 nt, Human
ggcauauauuggguuccauucu

SEQ ID NO: 3663996 - RNA, 15 nt, Human
ggcauauuuuucaca

SEQ ID NO: 3663997 - RNA, 17 nt, Human
ggcaucacagggcagag

SEQ ID NO: 3663998 - RNA, 21 nt, Human
ggcaucacaugcucaaugacu

SEQ ID NO: 3663999 - RNA, 23 nt, Human
ggcaucaccuuaggcagggaagu

SEQ ID NO: 3664000 - RNA, 17 nt, Human
ggccucaacuccuccca

SEQ ID NO: 3664001 - RNA, 20 nt, Human
ggccucaacuccucccauag

SEQ ID NO: 3664002 - RNA, 14 nt, Human
ggccucaagugauu

SEQ ID NO: 3664003 - RNA, 22 nt, Human
ggccucaagugauucuccugcc

SEQ ID NO: 3664004 - RNA, 12 nt, Human
ggccucacccac

SEQ ID NO: 3664005 - RNA, 17 nt, Human
ggccucacccaccccug

SEQ ID NO: 3664006 - RNA, 19 nt, Human
ggccucaccgagugggggc

SEQ ID NO: 3664007 - RNA, 10 nt, Human
ggccucagaa

SEQ ID NO: 3664008 - RNA, 11 nt, Human
ggccucagacu

SEQ ID NO: 3664009 - RNA, 20 nt, Human
ggccucagacugcacccagg

SEQ ID NO: 3664010 - RNA, 17 nt, Human
ggccucagcugaaugcc

SEQ ID NO: 3664011 - RNA, 13 nt, Human
ggccucagcugcc

SEQ ID NO: 3664012 - RNA, 16 nt, Human
ggccucagcugccuca

SEQ ID NO: 3664013 - RNA, 17 nt, Human
ggccucagcugccucac

SEQ ID NO: 3664014 - RNA, 17 nt, Human
ggccucagggcuccuug

SEQ ID NO: 3664015 - RNA, 19 nt, Human
ggccucaggugcuguccau

SEQ ID NO: 3664016 - RNA, 20 nt, Human
ggccucaguggacuuuccac

SEQ ID NO: 3664017 - RNA, 22 nt, Human
ggccucaguggacuuuccaccc

SEQ ID NO: 3664018 - RNA, 20 nt, Human
ggccucauguggcuggaaga

SEQ ID NO: 3664019 - RNA, 23 nt, Human
ggccuccaaguccacaguggaac

SEQ ID NO: 3664020 - RNA, 20 nt, Human
ggccuccagaacucacuggg

SEQ ID NO: 3664021 - RNA, 15 nt, Human
ggccuccagcucagc

SEQ ID NO: 3664022 - RNA, 19 nt, Human
ggccuccaggcccgucugu

SEQ ID NO: 3664023 - RNA, 22 nt, Human
ggccuccaggcccgucugucca

SEQ ID NO: 3664024 - RNA, 17 nt, Human
ggccuccauccugaggc

SEQ ID NO: 3664025 - RNA, 16 nt, Human
ggccucccaaagugcu

SEQ ID NO: 3664026 - RNA, 18 nt, Human
ggccucccaacucacccc

SEQ ID NO: 3664027 - RNA, 20 nt, Human
ggccucccaacucaccccag

SEQ ID NO: 3664028 - RNA, 14 nt, Human
ggccucccacagac

SEQ ID NO: 3664029 - RNA, 14 nt, Human
ggccucccacagug

SEQ ID NO: 3664030 - RNA, 11 nt, Human
ggccucccacc

SEQ ID NO: 3664031 - RNA, 11 nt, Human
ggccuccccca

SEQ ID NO: 3664032 - RNA, 13 nt, Human
ggccucccccacu

SEQ ID NO: 3664033 - RNA, 15 nt, Human
ggccucccccacuuu

SEQ ID NO: 3664034 - RNA, 15 nt, Human
ggccuccccugccac

SEQ ID NO: 3664035 - RNA, 14 nt, Human
ggccuccccugcug

SEQ ID NO: 3664036 - RNA, 23 nt, Human
ggccucccucucucuucugcucc

SEQ ID NO: 3664037 - RNA, 16 nt, Human
ggccuccggccucccc

SEQ ID NO: 3664038 - RNA, 19 nt, Human
ggccuccggcgucagccuc

SEQ ID NO: 3664039 - RNA, 20 nt, Human
ggccuccggcgucagccucc

SEQ ID NO: 3664040 - RNA, 22 nt, Human
ggccuccggcgucagccuccag

SEQ ID NO: 3664041 - RNA, 19 nt, Human
ggccuccucuguccagggc

SEQ ID NO: 3664042 - RNA, 22 nt, Human
ggccuccucuucaccccggcag

SEQ ID NO: 3664043 - RNA, 13 nt, Human
ggccuccugccuc

SEQ ID NO: 3664044 - RNA, 15 nt, Human
ggccuccugccucua

SEQ ID NO: 3664045 - RNA, 14 nt, Human
ggccuccugugugu

SEQ ID NO: 3664046 - RNA, 22 nt, Human
ggccuccuucugagcuccuguc

SEQ ID NO: 3664047 - RNA, 17 nt, Human
ggccucgccuggccuga

SEQ ID NO: 3664048 - RNA, 18 nt, Human
ggccucgccuggccugag

SEQ ID NO: 3664049 - RNA, 22 nt, Human
ggccucggacuuagcugggaga

SEQ ID NO: 3664050 - RNA, 13 nt, Human
ggccucggagccu

SEQ ID NO: 3664051 - RNA, 19 nt, Human
ggccucggagccucauccg

SEQ ID NO: 3664052 - RNA, 14 nt, Human
ggccucggccccuc

SEQ ID NO: 3664053 - RNA, 17 nt, Human
ggccucuaaccccaggc

SEQ ID NO: 3664054 - RNA, 19 nt, Human
ggccucuaaccccaggccc

SEQ ID NO: 3664055 - RNA, 20 nt, Human
ggccucuaaccccaggcccc

SEQ ID NO: 3664056 - RNA, 12 nt, Human
ggccucuccagu

SEQ ID NO: 3664057 - RNA, 20 nt, Human
ggccucucccuccuccagga

SEQ ID NO: 3664058 - RNA, 23 nt, Human
ggccucucccuccuccaggaagc

SEQ ID NO: 3664059 - RNA, 13 nt, Human
ggccucucuagca

SEQ ID NO: 3664060 - RNA, 14 nt, Human
ggccucucucccuc

SEQ ID NO: 3664061 - RNA, 13 nt, Human
ggccucucuggcc

SEQ ID NO: 3664062 - RNA, 19 nt, Human
ggccucucuggccucccac

SEQ ID NO: 3664063 - RNA, 14 nt, Human
ggccucugcacucc

SEQ ID NO: 3664064 - RNA, 19 nt, Human
ggccucugcggagcacacu

SEQ ID NO: 3664065 - RNA, 17 nt, Human
ggccucuuaugggcugg

SEQ ID NO: 3664066 - RNA, 18 nt, Human
ggccucuucaaauuagaa

SEQ ID NO: 3664067 - RNA, 17 nt, Human
ggccucuucucucagac

SEQ ID NO: 3664068 - RNA, 18 nt, Human
ggccucuugagcaguggc

SEQ ID NO: 3664069 - RNA, 17 nt, Human
ggccugaaagaggcuga

SEQ ID NO: 3664070 - RNA, 22 nt, Human
ggccugaaaggagcccuuaucu

SEQ ID NO: 3664071 - RNA, 20 nt, Human
ggccugaaauccugguuccu

SEQ ID NO: 3664072 - RNA, 12 nt, Human
ggccugaaccac

SEQ ID NO: 3664073 - RNA, 22 nt, Human
ggccugaauccaaaagaaaaac

SEQ ID NO: 3664074 - RNA, 22 nt, Human
ggccugaaugcuuauagguggc

SEQ ID NO: 3664075 - RNA, 20 nt, Human
ggccugaccaaacagccaac

SEQ ID NO: 3664076 - RNA, 16 nt, Human
ggccugaccucccccu

SEQ ID NO: 3664077 - RNA, 18 nt, Human
ggccugacugccaagcca

SEQ ID NO: 3664078 - RNA, 15 nt, Human
ggccugacugcucag

SEQ ID NO: 3664079 - RNA, 16 nt, Human
ggccugagacccagga

SEQ ID NO: 3664080 - RNA, 13 nt, Human
ggccugagagaau

SEQ ID NO: 3664081 - RNA, 15 nt, Human
ggccugagagucagc

SEQ ID NO: 3664082 - RNA, 16 nt, Human
ggccugagccuggcca

SEQ ID NO: 3664083 - RNA, 18 nt, Human
ggccugagcgcuccugcc

SEQ ID NO: 3664084 - RNA, 21 nt, Human
ggccugagcguccagaaaugg

SEQ ID NO: 3664085 - RNA, 12 nt, Human
ggccugagcugg

SEQ ID NO: 3664086 - RNA, 22 nt, Human
ggccugaggaugagcuggaagg

SEQ ID NO: 3664087 - RNA, 18 nt, Human
ggccugaggucucgcuga

SEQ ID NO: 3664088 - RNA, 19 nt, Human
ggccugaggucuggcugcu

SEQ ID NO: 3664089 - RNA, 14 nt, Human
ggccugaugacaga

SEQ ID NO: 3664090 - RNA, 18 nt, Human
ggccugaugcucccuccc

SEQ ID NO: 3664091 - RNA, 22 nt, Human
ggccugaugcucccuccccugc

SEQ ID NO: 3664092 - RNA, 17 nt, Human
ggccugcacggugggcc

SEQ ID NO: 3664093 - RNA, 13 nt, Human
ggccugcacuaau

SEQ ID NO: 3664094 - RNA, 17 nt, Human
ggccugcaggaccugcc

SEQ ID NO: 3664095 - RNA, 20 nt, Human
ggccugcaggaccugccugu

SEQ ID NO: 3664096 - RNA, 17 nt, Human
ggccugccaccuggacc

SEQ ID NO: 3664097 - RNA, 13 nt, Human
ggccugcccccac

SEQ ID NO: 3664098 - RNA, 17 nt, Human
ggccugcccucagggau

SEQ ID NO: 3664099 - RNA, 20 nt, Human
ggccugccuccagggcugga

SEQ ID NO: 3664100 - RNA, 15 nt, Human
ggccugccucccacu

SEQ ID NO: 3664101 - RNA, 12 nt, Human
ggccugccuggc

SEQ ID NO: 3664102 - RNA, 18 nt, Human
ggccugcucccagcagcc

SEQ ID NO: 3664103 - RNA, 10 nt, Human
ggccugcugc

SEQ ID NO: 3664104 - RNA, 11 nt, Human
ggccugcugcu

SEQ ID NO: 3664105 - RNA, 15 nt, Human
ggccugcuggaggcc

SEQ ID NO: 3664106 - RNA, 21 nt, Human
ggccugcuggaggccucaggu

SEQ ID NO: 3664107 - RNA, 16 nt, Human
ggccuggaagacagag

SEQ ID NO: 3664108 - RNA, 23 nt, Human
ggccuggaauuagcuuggggcca

SEQ ID NO: 3664109 - RNA, 15 nt, Human
ggccuggaccugccu

SEQ ID NO: 3664110 - RNA, 21 nt, Human
ggccuggaccugccuccugcc

SEQ ID NO: 3664111 - RNA, 14 nt, Human
ggccuggagauccu

SEQ ID NO: 3664112 - RNA, 19 nt, Human
ggccuggaggugggguugg

SEQ ID NO: 3664113 - RNA, 16 nt, Human
ggccuggauucauuuc

SEQ ID NO: 3664114 - RNA, 17 nt, Human
ggccuggauucauuucc

SEQ ID NO: 3664115 - RNA, 22 nt, Human
ggccuggcacagugucugggcu

SEQ ID NO: 3664116 - RNA, 20 nt, Human
gaaaaaaaauguucuuuggg

SEQ ID NO: 3664117 - RNA, 16 nt, Human
gaaaaaaaccacacaa

SEQ ID NO: 3664118 - RNA, 18 nt, Human
gaaaaaaaguuugccaga

SEQ ID NO: 3664119 - RNA, 22 nt, Human
gaaaaaaauaauuuuaaaaaug

SEQ ID NO: 3664120 - RNA, 15 nt, Human
gaaaaaaauacuauu

SEQ ID NO: 3664121 - RNA, 14 nt, Human
gaaaaaaauguauu

SEQ ID NO: 3664122 - RNA, 20 nt, Human
gaaaaaaauguauuuuaugu

SEQ ID NO: 3664123 - RNA, 12 nt, Human
gaaaaaaauuga

SEQ ID NO: 3664124 - RNA, 23 nt, Human
gaaaaaagaaauucccuggacca

SEQ ID NO: 3664125 - RNA, 10 nt, Human
gaaaaaagcu

SEQ ID NO: 3664126 - RNA, 11 nt, Human
gaaaaaagcuc

SEQ ID NO: 3664127 - RNA, 13 nt, Human
gaaaaaagcucau

SEQ ID NO: 3664128 - RNA, 15 nt, Human
gaaaaaaggaagugg

SEQ ID NO: 3664129 - RNA, 23 nt, Human
gaaaaaaguuguaggcgaaucau

SEQ ID NO: 3664130 - RNA, 16 nt, Human
gaaaaaauaauuauuu

SEQ ID NO: 3664131 - RNA, 15 nt, Human
gaaaaaauacauuuu

SEQ ID NO: 3664132 - RNA, 11 nt, Human
gaaaaaauaua

SEQ ID NO: 3664133 - RNA, 22 nt, Human
gaaaaaaugguagcauuuuaaa

SEQ ID NO: 3664134 - RNA, 14 nt, Human
gaaaaaauguugga

SEQ ID NO: 3664135 - RNA, 20 nt, Human
gaaaaaauuuacuuuaaacu

SEQ ID NO: 3664136 - RNA, 20 nt, Human
gaaaaacaacaacacaauaa

SEQ ID NO: 3664137 - RNA, 18 nt, Human
gaaaaacaucugaaagcc

SEQ ID NO: 3664138 - RNA, 15 nt, Human
gaaaaaccauuugaa

SEQ ID NO: 3664139 - RNA, 15 nt, Human
gaaaaaccuuggguu

SEQ ID NO: 3664140 - RNA, 19 nt, Human
gaaaaacucuuuauuuucc

SEQ ID NO: 3664141 - RNA, 17 nt, Human
gaaaaacuggcaacauu

SEQ ID NO: 3664142 - RNA, 20 nt, Human
gaaaaacuuccaugaggcca

SEQ ID NO: 3664143 - RNA, 12 nt, Human
gaaaaacuugug

SEQ ID NO: 3664144 - RNA, 22 nt, Human
gaaaaacuuuggaaccagacuc

SEQ ID NO: 3664145 - RNA, 20 nt, Human
aacgugaugaucagcuguuu

SEQ ID NO: 3664146 - RNA, 12 nt, Human
aacgugcaacug

SEQ ID NO: 3664147 - RNA, 17 nt, Human
aacgugcucuuuguuuu

SEQ ID NO: 3664148 - RNA, 13 nt, Human
aacguggcccaga

SEQ ID NO: 3664149 - RNA, 13 nt, Human
aacguggcugcuu

SEQ ID NO: 3664150 - RNA, 17 nt, Human
aacguggggcagcacag

SEQ ID NO: 3664151 - RNA, 19 nt, Human
aacgugugcuguguuugcu

SEQ ID NO: 3664152 - RNA, 19 nt, Human
aacguguugccuugaacca

SEQ ID NO: 3664153 - RNA, 13 nt, Human
aacguuggacuuu

SEQ ID NO: 3664154 - RNA, 20 nt, Human
aacguuuaagccaaaacaau

SEQ ID NO: 3664155 - RNA, 18 nt, Human
aacguuuagcugacaaaa

SEQ ID NO: 3664156 - RNA, 18 nt, Human
aacguuucaguaauaaaa

SEQ ID NO: 3664157 - RNA, 17 nt, Human
aacguuuucuaauugcu

SEQ ID NO: 3664158 - RNA, 23 nt, Human
aacguuuucuguuuggaggagca

SEQ ID NO: 3664159 - RNA, 18 nt, Human
aacguuuuguuugaaaaa

SEQ ID NO: 3664160 - RNA, 11 nt, Human
aacguuuuucc

SEQ ID NO: 3664161 - RNA, 19 nt, Human
aacuaaaauaauuuuguaa

SEQ ID NO: 3664162 - RNA, 16 nt, Human
aacuaaacucauuuau

SEQ ID NO: 3664163 - RNA, 17 nt, Human
aacuaaacuuucacacc

SEQ ID NO: 3664164 - RNA, 20 nt, Human
aacuaaagugcugcacucaa

SEQ ID NO: 3664165 - RNA, 19 nt, Human
aacuaaaguuguacuuuaa

SEQ ID NO: 3664166 - RNA, 17 nt, Human
aacuaaauagcauguau

SEQ ID NO: 3664167 - RNA, 20 nt, Human
aacuaaauagcauguauugu

SEQ ID NO: 3664168 - RNA, 16 nt, Human
aacuaaauuugauacu

SEQ ID NO: 3664169 - RNA, 21 nt, Human
aacuaaauuugauacuuauau

SEQ ID NO: 3664170 - RNA, 12 nt, Human
aacuaacacuau

SEQ ID NO: 3664171 - RNA, 22 nt, Human
aacuaacaggcuuagugaugua

SEQ ID NO: 3664172 - RNA, 14 nt, Human
aacuaacauguccu

SEQ ID NO: 3664173 - RNA, 15 nt, Human
aacuaacauguccug

SEQ ID NO: 3664174 - RNA, 13 nt, Human
aacuaacuaaaac

SEQ ID NO: 3664175 - RNA, 19 nt, Human
aacuaagaaacuuuuguaa

SEQ ID NO: 3664176 - RNA, 23 nt, Human
aacuaagaaauaugcacaauagc

SEQ ID NO: 3664177 - RNA, 14 nt, Human
aacuaagauucuuu

SEQ ID NO: 3664178 - RNA, 15 nt, Human
aacuaagauucuuuu

SEQ ID NO: 3664179 - RNA, 18 nt, Human
aacuaaggugcuaaaucu

SEQ ID NO: 3664180 - RNA, 14 nt, Human
aacuaauaaaagca

SEQ ID NO: 3664181 - RNA, 15 nt, Human
aacuaauaaaagcau

SEQ ID NO: 3664182 - RNA, 12 nt, Human
aacuaauaaaau

SEQ ID NO: 3664183 - RNA, 13 nt, Human
aacuaauaaaaua

SEQ ID NO: 3664184 - RNA, 14 nt, Human
aacuaauaaaauau

SEQ ID NO: 3664185 - RNA, 19 nt, Human
aacuaauaaaauauuuucu

SEQ ID NO: 3664186 - RNA, 22 nt, Human
aacuaauaugggcauuguaguu

SEQ ID NO: 3664187 - RNA, 12 nt, Human
aacuaaugccuu

SEQ ID NO: 3664188 - RNA, 19 nt, Human
aacuacaaacaaaauuucu

SEQ ID NO: 3664189 - RNA, 21 nt, Human
aacuacaaagguuuaaaugaa

SEQ ID NO: 3664190 - RNA, 20 nt, Human
aacuacauuagguugugaau

SEQ ID NO: 3664191 - RNA, 16 nt, Human
aacuacauuuuaacau

SEQ ID NO: 3664192 - RNA, 17 nt, Human
aacuacccuuaauuacu

SEQ ID NO: 3664193 - RNA, 18 nt, Human
aacuacccuuaauuacuu

SEQ ID NO: 3664194 - RNA, 17 nt, Human
aacuacuaauagaauaa

SEQ ID NO: 3664195 - RNA, 14 nt, Human
aacuacucuuugau

SEQ ID NO: 3664196 - RNA, 15 nt, Human
aacuacucuuugauu

SEQ ID NO: 3664197 - RNA, 23 nt, Human
aacuacugaaugaagcaguauuu

SEQ ID NO: 3664198 - RNA, 17 nt, Human
aacuacugcaccauuua

SEQ ID NO: 3664199 - RNA, 19 nt, Human
aacuacugccuuuagaaaa

SEQ ID NO: 3664200 - RNA, 17 nt, Human
aacuacuguguuccugg

SEQ ID NO: 3664201 - RNA, 16 nt, Human
aacuacuuugcugcua

SEQ ID NO: 3664202 - RNA, 16 nt, Human
aacuagacauucuguc

SEQ ID NO: 3664203 - RNA, 20 nt, Human
aacuagacucccaagcugga

SEQ ID NO: 3664204 - RNA, 16 nt, Human
aacuagagaugugcaa

SEQ ID NO: 3664205 - RNA, 20 nt, Human
aacuagaggugagaaauuua

SEQ ID NO: 3664206 - RNA, 21 nt, Human
aacuagaggugagaaauuuaa

SEQ ID NO: 3664207 - RNA, 14 nt, Human
aacuagcaccaggg

SEQ ID NO: 3664208 - RNA, 18 nt, Human
aacuagccaccaacucuu

SEQ ID NO: 3664209 - RNA, 16 nt, Human
aacuagccccuggggu

SEQ ID NO: 3664210 - RNA, 22 nt, Human
aacuagcuuacaugagaacaga

SEQ ID NO: 3664211 - RNA, 23 nt, Human
aacuaggaaggcacuucugccug

SEQ ID NO: 3664212 - RNA, 15 nt, Human
aacuaggaaguggcu

SEQ ID NO: 3664213 - RNA, 17 nt, Human
aacuagggaagauaaua

SEQ ID NO: 3664214 - RNA, 18 nt, Human
aacuagggaagauaauau

SEQ ID NO: 3664215 - RNA, 20 nt, Human
aacuauacuugaacaaaagg

SEQ ID NO: 3664216 - RNA, 22 nt, Human
aacuauacuugaacaaaagggu

SEQ ID NO: 3664217 - RNA, 23 nt, Human
aacuauagcuugcagaacuguag

SEQ ID NO: 3664218 - RNA, 24 nt, Human
aacuauauauaaucaucaaguaau

SEQ ID NO: 3664219 - RNA, 18 nt, Human
aacuauccugacuucuaa

SEQ ID NO: 3664220 - RNA, 18 nt, Human
aacuaucuuggugaauuu

SEQ ID NO: 3664221 - RNA, 17 nt, Human
aacuaugaacuacaaag

SEQ ID NO: 3664222 - RNA, 22 nt, Human
aacuauguguuuuucucauauu

SEQ ID NO: 3664223 - RNA, 14 nt, Human
aacuauucaugcua

SEQ ID NO: 3664224 - RNA, 17 nt, Human
aacuauucgaaugaaaa

SEQ ID NO: 3664225 - RNA, 20 nt, Human
aacuauucgaaugaaaagac

SEQ ID NO: 3664226 - RNA, 16 nt, Human
aacuauugcauuuaua

SEQ ID NO: 3664227 - RNA, 22 nt, Human
aacuauugugcucagagacacu

SEQ ID NO: 3664228 - RNA, 24 nt, Human
aacuauugugcucagagacacugu

SEQ ID NO: 3664229 - RNA, 23 nt, Human
aacuauuuaacuugagcuuuaaa

SEQ ID NO: 3664230 - RNA, 16 nt, Human
aacuauuucuacacag

SEQ ID NO: 3664231 - RNA, 20 nt, Human
aacuauuucuuauauaugug

SEQ ID NO: 3664232 - RNA, 14 nt, Human
aacuauuuucagau

SEQ ID NO: 3664233 - RNA, 20 nt, Human
aacuauuuucagaugugaac

SEQ ID NO: 3664234 - RNA, 16 nt, Human
aacucaaaauauuugu

SEQ ID NO: 3664235 - RNA, 14 nt, Human
aacucaaacacaga

SEQ ID NO: 3664236 - RNA, 22 nt, Human
aacucaaacuucuggcucccuc

SEQ ID NO: 3664237 - RNA, 13 nt, Human
aacucaaauacac

SEQ ID NO: 3664238 - RNA, 23 nt, Human
aacucaaauggggccagauccag

SEQ ID NO: 3664239 - RNA, 21 nt, Human
aacucaaaugugaguguuuuu

SEQ ID NO: 3664240 - RNA, 13 nt, Human
aacucaagacaau

SEQ ID NO: 3664241 - RNA, 12 nt, Human
aacucaauauuu

SEQ ID NO: 3664242 - RNA, 13 nt, Human
aacucaauauuuu

SEQ ID NO: 3664243 - RNA, 16 nt, Human
aacucaaugcuuuauu

SEQ ID NO: 3664244 - RNA, 19 nt, Human
aacucaaugcuuuauuugu

SEQ ID NO: 3664245 - RNA, 20 nt, Human
aacucaaugcuuuauuugua

SEQ ID NO: 3664246 - RNA, 21 nt, Human
aacucaccauguaaaagaguc

SEQ ID NO: 3664247 - RNA, 16 nt, Human
aacucaccugcuggcc

SEQ ID NO: 3664248 - RNA, 21 nt, Human
aacucacugcucaagaagaca

SEQ ID NO: 3664249 - RNA, 14 nt, Human
aacucacuuuccuc

SEQ ID NO: 3664250 - RNA, 13 nt, Human
aacucagaaauuu

SEQ ID NO: 3664251 - RNA, 23 nt, Human
aacucagaacugucggaggaaag

SEQ ID NO: 3664252 - RNA, 14 nt, Human
aacucagaucacua

SEQ ID NO: 3664253 - RNA, 15 nt, Human
aacucagaucacuac

SEQ ID NO: 3664254 - RNA, 19 nt, Human
aacucagaucacuacugca

SEQ ID NO: 3664255 - RNA, 21 nt, Human
aacucagaucacuacugcagu

SEQ ID NO: 3664256 - RNA, 12 nt, Human
aacucagaucca

SEQ ID NO: 3664257 - RNA, 22 nt, Human
aacucagauccagggacagagg

SEQ ID NO: 3664258 - RNA, 14 nt, Human
aacucagccaagca

SEQ ID NO: 3664259 - RNA, 16 nt, Human
aacucagccaagcaca

SEQ ID NO: 3664260 - RNA, 20 nt, Human
aacucaggacuccagcccau

SEQ ID NO: 3664261 - RNA, 13 nt, Human
aacucagggacag

SEQ ID NO: 3664262 - RNA, 18 nt, Human
aacucagggacagagcca

SEQ ID NO: 3664263 - RNA, 22 nt, Human
aacucagucauuagacuccucc

SEQ ID NO: 3664264 - RNA, 23 nt, Human
aacucagucauuagacuccuccu

SEQ ID NO: 3664265 - RNA, 15 nt, Human
aacucauauuuucau

SEQ ID NO: 3664266 - RNA, 16 nt, Human
aacucaucauaaaaua

SEQ ID NO: 3664267 - RNA, 18 nt, Human
aacucaucauaaaauaaa

SEQ ID NO: 3664268 - RNA, 20 nt, Human
aacucaucuggaguucucaa

SEQ ID NO: 3664269 - RNA, 23 nt, Human
aacucauuccugccugucuccuu

SEQ ID NO: 3664270 - RNA, 20 nt, Human
aacucauugcaucauuuaca

SEQ ID NO: 3664271 - RNA, 22 nt, Human
aacucauuuccuauguaacugc

SEQ ID NO: 3664272 - RNA, 19 nt, Human
aacucauuuguuaaaauua

SEQ ID NO: 3664273 - RNA, 17 nt, Human
aacucauuuugcuugug

SEQ ID NO: 3664274 - RNA, 20 nt, Human
aacucauuuuugccauacau

SEQ ID NO: 3664275 - RNA, 19 nt, Human
aacuccaacauccacucuc

SEQ ID NO: 3664276 - RNA, 15 nt, Human
aacuccacaucugcc

SEQ ID NO: 3664277 - RNA, 16 nt, Human
aacuccacaucugccu

SEQ ID NO: 3664278 - RNA, 18 nt, Human
aacuccacaucugccuua

SEQ ID NO: 3664279 - RNA, 19 nt, Human
aacuccaccuugcggggau

SEQ ID NO: 3664280 - RNA, 13 nt, Human
aacuccagcaacu

SEQ ID NO: 3664281 - RNA, 15 nt, Human
ggaugacaugucccu

SEQ ID NO: 3664282 - RNA, 16 nt, Human
ggaugacaugugacuc

SEQ ID NO: 3664283 - RNA, 15 nt, Human
ggaugagagcccaga

SEQ ID NO: 3664284 - RNA, 20 nt, Human
ggaugagaguuuuggaugca

SEQ ID NO: 3664285 - RNA, 20 nt, Human
ggaugagcauggagcuggcc

SEQ ID NO: 3664286 - RNA, 13 nt, Human
ggaugagcauuua

SEQ ID NO: 3664287 - RNA, 20 nt, Human
ggaugaggccgcuagaggcc

SEQ ID NO: 3664288 - RNA, 16 nt, Human
ggaugaggugcuggga

SEQ ID NO: 3664289 - RNA, 13 nt, Human
gggagaggaaaga

SEQ ID NO: 3664290 - RNA, 21 nt, Human
gggagaggcagcccaggaagu

SEQ ID NO: 3664291 - RNA, 17 nt, Human
gggagagggaggucacu

SEQ ID NO: 3664292 - RNA, 14 nt, Human
gggagagggcgcag

SEQ ID NO: 3664293 - RNA, 17 nt, Human
gggagaggggccucaaa

SEQ ID NO: 3664294 - RNA, 17 nt, Human
gggagagugcaggccug

SEQ ID NO: 3664295 - RNA, 18 nt, Human
gggagagugucaaccaga

SEQ ID NO: 3664296 - RNA, 19 nt, Human
gggagauggaguucuugug

SEQ ID NO: 3664297 - RNA, 12 nt, Human
gggagcaggaga

SEQ ID NO: 3664298 - RNA, 13 nt, Human
gggagcaggagau

SEQ ID NO: 3664299 - RNA, 18 nt, Human
gggagcaggagauugaga

SEQ ID NO: 3664300 - RNA, 12 nt, Human
gggagcaggcag

SEQ ID NO: 3664301 - RNA, 14 nt, Human
gggagcaggcagcc

SEQ ID NO: 3664302 - RNA, 15 nt, Human
gggagcaggcggugg

SEQ ID NO: 3664303 - RNA, 21 nt, Human
gggagcaggcggugggcaccc

SEQ ID NO: 3664304 - RNA, 23 nt, Human
gggagcaggcucgggcuccccag

SEQ ID NO: 3664305 - RNA, 17 nt, Human
gggagcaguccaugcau

SEQ ID NO: 3664306 - RNA, 11 nt, Human
gggagcagugu

SEQ ID NO: 3664307 - RNA, 19 nt, Human
gggagcagugucuuccaua

SEQ ID NO: 3664308 - RNA, 18 nt, Human
gggagcauagaaggcagg

SEQ ID NO: 3664309 - RNA, 19 nt, Human
gggagcauagaaggcaggu

SEQ ID NO: 3664310 - RNA, 17 nt, Human
gggagcaugagaggagg

SEQ ID NO: 3664311 - RNA, 21 nt, Human
gggagcaugagaggaggcagc

SEQ ID NO: 3664312 - RNA, 16 nt, Human
gggagcauggcuguga

SEQ ID NO: 3664313 - RNA, 9 nt, Human
gggagccaa

SEQ ID NO: 3664314 - RNA, 12 nt, Human
gggagccaaggg

SEQ ID NO: 3664315 - RNA, 13 nt, Human
gggagccaaggga

SEQ ID NO: 3664316 - RNA, 11 nt, Human
gggagccagcc

SEQ ID NO: 3664317 - RNA, 21 nt, Human
gggagcccacuguccugggcc

SEQ ID NO: 3664318 - RNA, 16 nt, Human
gggagccccagggucu

SEQ ID NO: 3664319 - RNA, 17 nt, Human
gggagcccccagccugu

SEQ ID NO: 3664320 - RNA, 13 nt, Human
gggagccgggagc

SEQ ID NO: 3664321 - RNA, 20 nt, Human
gggagccgggcaaacuggcc

SEQ ID NO: 3664322 - RNA, 20 nt, Human
gggagccgguaacuguccug

SEQ ID NO: 3664323 - RNA, 16 nt, Human
gggagccuaggaccac

SEQ ID NO: 3664324 - RNA, 12 nt, Human
gggagccuccug

SEQ ID NO: 3664325 - RNA, 14 nt, Human
gggagccuccugcc

SEQ ID NO: 3664326 - RNA, 21 nt, Human
gggagccuccugcccaguccc

SEQ ID NO: 3664327 - RNA, 13 nt, Human
gggagcggagguu

SEQ ID NO: 3664328 - RNA, 16 nt, Human
gggagcguagaaucug

SEQ ID NO: 3664329 - RNA, 15 nt, Human
gggagcuagccagag

SEQ ID NO: 3664330 - RNA, 18 nt, Human
gggagcuccucuccugga

SEQ ID NO: 3664331 - RNA, 21 nt, Human
gggagcuccucuccuggagga

SEQ ID NO: 3664332 - RNA, 13 nt, Human
gggagcugggccc

SEQ ID NO: 3664333 - RNA, 16 nt, Human
gggagcugggccuggu

SEQ ID NO: 3664334 - RNA, 24 nt, Human
gggaggaaauuugaauggguccau

SEQ ID NO: 3664335 - RNA, 23 nt, Human
gggaggaagaagcuuaggcaggg

SEQ ID NO: 3664336 - RNA, 13 nt, Human
gggaggaagcaga

SEQ ID NO: 3664337 - RNA, 21 nt, Human
gggaggaagcagaauaaagca

SEQ ID NO: 3664338 - RNA, 14 nt, Human
ggcaggcagguguu

SEQ ID NO: 3664339 - RNA, 23 nt, Human
ggcaggcaucggggagccgggag

SEQ ID NO: 3664340 - RNA, 15 nt, Human
ggcaggcauggcccu

SEQ ID NO: 3664341 - RNA, 15 nt, Human
ggcaggccaccuggc

SEQ ID NO: 3664342 - RNA, 19 nt, Human
ggcaggcccugcacugucc

SEQ ID NO: 3664343 - RNA, 22 nt, Human
ggcaggcuaaggcguggagcug

SEQ ID NO: 3664344 - RNA, 19 nt, Human
ggcaggcuagaaccuggca

SEQ ID NO: 3664345 - RNA, 16 nt, Human
ggcaggcucacugcca

SEQ ID NO: 3664346 - RNA, 18 nt, Human
ggcaggcugacaucugug

SEQ ID NO: 3664347 - RNA, 11 nt, Human
ggcaggcuggc

SEQ ID NO: 3664348 - RNA, 13 nt, Human
ggcaggcuggcca

SEQ ID NO: 3664349 - RNA, 12 nt, Human
ggcaggcugggc

SEQ ID NO: 3664350 - RNA, 13 nt, Human
ggcaggcugggcc

SEQ ID NO: 3664351 - RNA, 16 nt, Human
ggcaggcugggccaug

SEQ ID NO: 3664352 - RNA, 22 nt, Human
ggcaggcugucuggccaggccu

SEQ ID NO: 3664353 - RNA, 18 nt, Human
ggcagggaaaggcucuga

SEQ ID NO: 3664354 - RNA, 18 nt, Human
ggcagggaacauggggag

SEQ ID NO: 3664355 - RNA, 16 nt, Human
ggcagggacagggccg

SEQ ID NO: 3664356 - RNA, 14 nt, Human
ggcagggaggcagc

SEQ ID NO: 3664357 - RNA, 17 nt, Human
ggcagggagggccuggg

SEQ ID NO: 3664358 - RNA, 18 nt, Human
ggcagggagggccugggc

SEQ ID NO: 3664359 - RNA, 15 nt, Human
ggcagggauuugagg

SEQ ID NO: 3664360 - RNA, 15 nt, Human
ggcagggcacagggc

SEQ ID NO: 3664361 - RNA, 16 nt, Human
ggcagggcacagggcc

SEQ ID NO: 3664362 - RNA, 16 nt, Human
ggcagggcaggaccag

SEQ ID NO: 3664363 - RNA, 19 nt, Human
ggcagggccuugcccagag

SEQ ID NO: 3664364 - RNA, 11 nt, Human
ggcagggcuca

SEQ ID NO: 3664365 - RNA, 13 nt, Human
ggcagggcucagg

SEQ ID NO: 3664366 - RNA, 15 nt, Human
ggcagggcucaggau

SEQ ID NO: 3664367 - RNA, 21 nt, Human
ggcagggcucccacagagaca

SEQ ID NO: 3664368 - RNA, 16 nt, Human
ggcagggcucuccugg

SEQ ID NO: 3664369 - RNA, 18 nt, Human
ggcagggcucuccuggcu

SEQ ID NO: 3664370 - RNA, 19 nt, Human
ggcagggcucuccuggcuu

SEQ ID NO: 3664371 - RNA, 21 nt, Human
ggcaggggccuccaugggccc

SEQ ID NO: 3664372 - RNA, 16 nt, Human
ggcaggggcuggaggg

SEQ ID NO: 3664373 - RNA, 15 nt, Human
ggcaggggcuuccug

SEQ ID NO: 3664374 - RNA, 13 nt, Human
ggcagggggcugc

SEQ ID NO: 3664375 - RNA, 18 nt, Human
ggcagggggcugcugcug

SEQ ID NO: 3664376 - RNA, 15 nt, Human
ggcagggguggagga

SEQ ID NO: 3664377 - RNA, 16 nt, Human
ggcaggggugggggug

SEQ ID NO: 3664378 - RNA, 17 nt, Human
ggcagggguuagagcag

SEQ ID NO: 3664379 - RNA, 12 nt, Human
ggcaggguccua

SEQ ID NO: 3664380 - RNA, 17 nt, Human
ggcagggucucacucug

SEQ ID NO: 3664381 - RNA, 20 nt, Human
ggcagggucucacucugucg

SEQ ID NO: 3664382 - RNA, 16 nt, Human
ggcagggugggaugga

SEQ ID NO: 3664383 - RNA, 23 nt, Human
ggcagggugggauggaggagaag

SEQ ID NO: 3664384 - RNA, 20 nt, Human
ggcaggguuuuaucucuguc

SEQ ID NO: 3664385 - RNA, 20 nt, Human
ggcagguagccagggggacu

SEQ ID NO: 3664386 - RNA, 14 nt, Human
ggcagguccccaga

SEQ ID NO: 3664387 - RNA, 15 nt, Human
ggcagguccuggcca

SEQ ID NO: 3664388 - RNA, 16 nt, Human
ggcaggugaccuucug

SEQ ID NO: 3664389 - RNA, 13 nt, Human
ggcaggugccucc

SEQ ID NO: 3664390 - RNA, 21 nt, Human
ggcaggugccuccaggugugc

SEQ ID NO: 3664391 - RNA, 17 nt, Human
ggcaggugggagcuuga

SEQ ID NO: 3664392 - RNA, 22 nt, Human
ggcaggugguggcacugagccc

SEQ ID NO: 3664393 - RNA, 16 nt, Human
ggcagguuagaaccua

SEQ ID NO: 3664394 - RNA, 19 nt, Human
ggcaguaaagagaaacuuu

SEQ ID NO: 3664395 - RNA, 16 nt, Human
ggcaguaccugagggu

SEQ ID NO: 3664396 - RNA, 23 nt, Human
ggcaguaccugggcaagcuggcg

SEQ ID NO: 3664397 - RNA, 15 nt, Human
ggcaguccgugggac

SEQ ID NO: 3664398 - RNA, 15 nt, Human
ggcagucgggggcug

SEQ ID NO: 3664399 - RNA, 18 nt, Human
ggcagucgggggcuggcc

SEQ ID NO: 3664400 - RNA, 21 nt, Human
ggcagucgggggcuggccuag

SEQ ID NO: 3664401 - RNA, 22 nt, Human
ggcagucgggggcuggccuagg

SEQ ID NO: 3664402 - RNA, 21 nt, Human
ggcagugagggagggcuguca

SEQ ID NO: 3664403 - RNA, 15 nt, Human
ggcagugagugagcc

SEQ ID NO: 3664404 - RNA, 16 nt, Human
ggcagugagugagccu

SEQ ID NO: 3664405 - RNA, 18 nt, Human
ggcagugaugcuggaugc

SEQ ID NO: 3664406 - RNA, 16 nt, Human
ggcagugccagggcag

SEQ ID NO: 3664407 - RNA, 17 nt, Human
ggcagugcuuggcccag

SEQ ID NO: 3664408 - RNA, 20 nt, Human
ggcagugcuuggcccaggag

SEQ ID NO: 3664409 - RNA, 12 nt, Human
ggcaguggaggu

SEQ ID NO: 3664410 - RNA, 16 nt, Human
ggcagugggagcugcc

SEQ ID NO: 3664411 - RNA, 20 nt, Human
ggcagugggucccacuuccc

SEQ ID NO: 3664412 - RNA, 21 nt, Human
ggcaguguagggaguuguggg

SEQ ID NO: 3664413 - RNA, 15 nt, Human
ggcaguguuuugaga

SEQ ID NO: 3664414 - RNA, 24 nt, Human
ggcaguuaccauuaaaccaucucc

SEQ ID NO: 3664415 - RNA, 17 nt, Human
ggcaguuagagaugccu

SEQ ID NO: 3664416 - RNA, 14 nt, Human
ggcaguuauauuuu

SEQ ID NO: 3664417 - RNA, 22 nt, Human
ggcaguucgcagccacccugag

SEQ ID NO: 3664418 - RNA, 14 nt, Human
ggcaguuggccaga

SEQ ID NO: 3664419 - RNA, 23 nt, Human
ggcaguuuugacaucagccagcu

SEQ ID NO: 3664420 - RNA, 10 nt, Human
ggcaguuuuu

SEQ ID NO: 3664421 - RNA, 17 nt, Human
ggcauacuauguggaug

SEQ ID NO: 3664422 - RNA, 16 nt, Human
ggcauagaggcuucuc

SEQ ID NO: 3664423 - RNA, 21 nt, Human
ggcauagcuccccgcuucugc

SEQ ID NO: 3664424 - RNA, 15 nt, Human
ggcauagcucugggg

SEQ ID NO: 3664425 - RNA, 14 nt, Human
ggcauaggccuggg

SEQ ID NO: 3664426 - RNA, 16 nt, Human
ggcauaggccugggug

SEQ ID NO: 3664427 - RNA, 20 nt, Human
ggcauauauuaaaagcaggc

SEQ ID NO: 3664428 - RNA, 17 nt, Human
ggcauauuuuucacaua

SEQ ID NO: 3664429 - RNA, 13 nt, Human
ggcaucacagggc

SEQ ID NO: 3664430 - RNA, 14 nt, Human
ggcaucacagggca

SEQ ID NO: 3664431 - RNA, 20 nt, Human
ggcaucaccuuaggcaggga

SEQ ID NO: 3664432 - RNA, 13 nt, Human
ggcaucagcuggc

SEQ ID NO: 3664433 - RNA, 23 nt, Human
ggcaucaucucagcucacugcaa

SEQ ID NO: 3664434 - RNA, 15 nt, Human
ggcauccacuucaca

SEQ ID NO: 3664435 - RNA, 12 nt, Human
ggcccagagccc

SEQ ID NO: 3664436 - RNA, 13 nt, Human
ggcccagagccca

SEQ ID NO: 3664437 - RNA, 14 nt, Human
ggcccagagcccag

SEQ ID NO: 3664438 - RNA, 17 nt, Human
ggcccagagcccagcuc

SEQ ID NO: 3664439 - RNA, 14 nt, Human
ggcccagaggcaca

SEQ ID NO: 3664440 - RNA, 13 nt, Human
ggcccagaggcug

SEQ ID NO: 3664441 - RNA, 14 nt, Human
ggcccagaggcuga

SEQ ID NO: 3664442 - RNA, 23 nt, Human
ggcccagaggcugaguuuucucu

SEQ ID NO: 3664443 - RNA, 14 nt, Human
ggcccagagggccu

SEQ ID NO: 3664444 - RNA, 20 nt, Human
ggcccagcauugcugguucu

SEQ ID NO: 3664445 - RNA, 13 nt, Human
ggcccagccccca

SEQ ID NO: 3664446 - RNA, 11 nt, Human
ggcccagcccg

SEQ ID NO: 3664447 - RNA, 16 nt, Human
ggcccagccgaccccc

SEQ ID NO: 3664448 - RNA, 16 nt, Human
ggcccagccggccucu

SEQ ID NO: 3664449 - RNA, 21 nt, Human
ggcccagccggccucucuggc

SEQ ID NO: 3664450 - RNA, 22 nt, Human
ggcccagccggccucucuggcc

SEQ ID NO: 3664451 - RNA, 19 nt, Human
ggcccagccuuuguucccc

SEQ ID NO: 3664452 - RNA, 16 nt, Human
ggcccagcggccccuc

SEQ ID NO: 3664453 - RNA, 17 nt, Human
ggcccagcggccccucc

SEQ ID NO: 3664454 - RNA, 14 nt, Human
ggcccagcuccccc

SEQ ID NO: 3664455 - RNA, 16 nt, Human
ggcccagcucccccgg

SEQ ID NO: 3664456 - RNA, 22 nt, Human
ggcccaggaccaucauccuacu

SEQ ID NO: 3664457 - RNA, 13 nt, Human
ggcccaggccauc

SEQ ID NO: 3664458 - RNA, 13 nt, Human
ggcccaggcugcc

SEQ ID NO: 3664459 - RNA, 20 nt, Human
ggcccagggacaccagccag

SEQ ID NO: 3664460 - RNA, 20 nt, Human
ggcccagggagaggccauga

SEQ ID NO: 3664461 - RNA, 17 nt, Human
ggcccagggcaagcucc

SEQ ID NO: 3664462 - RNA, 20 nt, Human
ggcccagggcaagcuccgca

SEQ ID NO: 3664463 - RNA, 15 nt, Human
ggcccagggcaucug

SEQ ID NO: 3664464 - RNA, 19 nt, Human
ggcccagggcccagagccc

SEQ ID NO: 3664465 - RNA, 15 nt, Human
ggcccaggugagucc

SEQ ID NO: 3664466 - RNA, 23 nt, Human
ggcccagugucaaguugugcuug

SEQ ID NO: 3664467 - RNA, 19 nt, Human
ggcccauagaaacaugaca

SEQ ID NO: 3664468 - RNA, 14 nt, Human
ggcccaucaugggg

SEQ ID NO: 3664469 - RNA, 15 nt, Human
ggcccaucucccugc

SEQ ID NO: 3664470 - RNA, 20 nt, Human
ggcccauguauggccaggaa

SEQ ID NO: 3664471 - RNA, 19 nt, Human
ggcccauucuacuugcucu

SEQ ID NO: 3664472 - RNA, 22 nt, Human
ggcccauucuacuugcucugga

SEQ ID NO: 3664473 - RNA, 20 nt, Human
ggccccaaaaccacagcccu

SEQ ID NO: 3664474 - RNA, 19 nt, Human
ggccccaacucgggcuccc

SEQ ID NO: 3664475 - RNA, 17 nt, Human
ggccccaccagugccuc

SEQ ID NO: 3664476 - RNA, 18 nt, Human
ggccccaccagugccucu

SEQ ID NO: 3664477 - RNA, 23 nt, Human
ggccccacccucguggacaccug

SEQ ID NO: 3664478 - RNA, 15 nt, Human
ggccccacccugggc

SEQ ID NO: 3664479 - RNA, 17 nt, Human
ggccccacccugggccc

SEQ ID NO: 3664480 - RNA, 21 nt, Human
ggccccacccugggcccuggg

SEQ ID NO: 3664481 - RNA, 13 nt, Human
ggccccaccugca

SEQ ID NO: 3664482 - RNA, 15 nt, Human
ggccccaccuggccc

SEQ ID NO: 3664483 - RNA, 13 nt, Human
ggccccacugaug

SEQ ID NO: 3664484 - RNA, 12 nt, Human
ggccccacuggg

SEQ ID NO: 3664485 - RNA, 11 nt, Human
ggccccagaga

SEQ ID NO: 3664486 - RNA, 23 nt, Human
ggccccagagacucagagggagg

SEQ ID NO: 3664487 - RNA, 15 nt, Human
ggccccagcacagcu

SEQ ID NO: 3664488 - RNA, 12 nt, Human
ggccccagccag

SEQ ID NO: 3664489 - RNA, 12 nt, Human
ggccccagccca

SEQ ID NO: 3664490 - RNA, 14 nt, Human
ggccccagcccacc

SEQ ID NO: 3664491 - RNA, 13 nt, Human
ggccccagcccug

SEQ ID NO: 3664492 - RNA, 18 nt, Human
ggccccagcccugcuggg

SEQ ID NO: 3664493 - RNA, 21 nt, Human
ggccccagcccugcuggggau

SEQ ID NO: 3664494 - RNA, 11 nt, Human
ggccccagccu

SEQ ID NO: 3664495 - RNA, 13 nt, Human
ggccccagccucc

SEQ ID NO: 3664496 - RNA, 15 nt, Human
ggccccagccuggcc

SEQ ID NO: 3664497 - RNA, 16 nt, Human
ggccccagccuggccc

SEQ ID NO: 3664498 - RNA, 18 nt, Human
ggccccagccuggcccag

SEQ ID NO: 3664499 - RNA, 23 nt, Human
ggccccagccuggcccagcuccc

SEQ ID NO: 3664500 - RNA, 18 nt, Human
ggccccaggaaaggccca

SEQ ID NO: 3664501 - RNA, 15 nt, Human
ggccccaggaagccg

SEQ ID NO: 3664502 - RNA, 22 nt, Human
ggccccaggcauugccaagggc

SEQ ID NO: 3664503 - RNA, 17 nt, Human
ggccccagggcuacccu

SEQ ID NO: 3664504 - RNA, 13 nt, Human
ggccccagucagc

SEQ ID NO: 3664505 - RNA, 21 nt, Human
ggccccagucagccucucucc

SEQ ID NO: 3664506 - RNA, 16 nt, Human
ggccccaugaccucca

SEQ ID NO: 3664507 - RNA, 16 nt, Human
ggcccccaccuggcuc

SEQ ID NO: 3664508 - RNA, 17 nt, Human
ggcccccaccuggcuca

SEQ ID NO: 3664509 - RNA, 13 nt, Human
gggcagagggcug

SEQ ID NO: 3664510 - RNA, 22 nt, Human
gggcagagggcuggaggcccag

SEQ ID NO: 3664511 - RNA, 17 nt, Human
gggcagagugagaccca

SEQ ID NO: 3664512 - RNA, 16 nt, Human
gggcagcacagagagg

SEQ ID NO: 3664513 - RNA, 12 nt, Human
gggcagcacagc

SEQ ID NO: 3664514 - RNA, 13 nt, Human
gggcagcacagca

SEQ ID NO: 3664515 - RNA, 14 nt, Human
gggcagcacagcaa

SEQ ID NO: 3664516 - RNA, 20 nt, Human
gggcagcagaaggggguggu

SEQ ID NO: 3664517 - RNA, 16 nt, Human
gggcagcagcagcccu

SEQ ID NO: 3664518 - RNA, 19 nt, Human
gggcagcagcagcccugcc

SEQ ID NO: 3664519 - RNA, 12 nt, Human
gggcagcagcca

SEQ ID NO: 3664520 - RNA, 13 nt, Human
gggcagcagccag

SEQ ID NO: 3664521 - RNA, 14 nt, Human
gggcagcagccagc

SEQ ID NO: 3664522 - RNA, 17 nt, Human
gggcagcagccagcccu

SEQ ID NO: 3664523 - RNA, 20 nt, Human
gggcagcagccagcccugcc

SEQ ID NO: 3664524 - RNA, 22 nt, Human
gggcagcagccagcccugccug

SEQ ID NO: 3664525 - RNA, 23 nt, Human
gggcagcagccagcccugccugg

SEQ ID NO: 3664526 - RNA, 20 nt, Human
gggcagcauagcaagacaca

SEQ ID NO: 3664527 - RNA, 19 nt, Human
gggcagccagggagagccc

SEQ ID NO: 3664528 - RNA, 22 nt, Human
gggcagccuggcucccaggaca

SEQ ID NO: 3664529 - RNA, 18 nt, Human
gggcagcgcccuuccucu

SEQ ID NO: 3664530 - RNA, 23 nt, Human
gggcagcgcccuuccucuccacc

SEQ ID NO: 3664531 - RNA, 14 nt, Human
gggcagcuccucug

SEQ ID NO: 3664532 - RNA, 19 nt, Human
gggcagcugccuccccucc

SEQ ID NO: 3664533 - RNA, 14 nt, Human
gggcagcugggccc

SEQ ID NO: 3664534 - RNA, 16 nt, Human
gggcagcugggcccaa

SEQ ID NO: 3664535 - RNA, 19 nt, Human
gggcagcugggcccaaccc

SEQ ID NO: 3664536 - RNA, 15 nt, Human
gggcagcugucccuu

SEQ ID NO: 3664537 - RNA, 20 nt, Human
gggcagcuuagggcccugga

SEQ ID NO: 3664538 - RNA, 19 nt, Human
gggcaggaaggagagccug

SEQ ID NO: 3664539 - RNA, 17 nt, Human
gggcaggaccagcccac

SEQ ID NO: 3664540 - RNA, 21 nt, Human
gggcaggaccagcccacgcug

SEQ ID NO: 3664541 - RNA, 22 nt, Human
gggcaggacucagcuccccaga

SEQ ID NO: 3664542 - RNA, 14 nt, Human
gggcaggaguagcu

SEQ ID NO: 3664543 - RNA, 12 nt, Human
gggcaggcacag

SEQ ID NO: 3664544 - RNA, 23 nt, Human
gggcaggccaccuggcucucacc

SEQ ID NO: 3664545 - RNA, 15 nt, Human
gggcaggccagagcu

SEQ ID NO: 3664546 - RNA, 23 nt, Human
gggcaggcccugcacuguccugc

SEQ ID NO: 3664547 - RNA, 12 nt, Human
gggcaggcuggg

SEQ ID NO: 3664548 - RNA, 16 nt, Human
gggcaggcugggccau

SEQ ID NO: 3664549 - RNA, 20 nt, Human
gggcagggaaggggaggcag

SEQ ID NO: 3664550 - RNA, 18 nt, Human
gggcagggagcugggccc

SEQ ID NO: 3664551 - RNA, 13 nt, Human
gggcagggcagcc

SEQ ID NO: 3664552 - RNA, 15 nt, Human
gggcagggcucccac

SEQ ID NO: 3664553 - RNA, 17 nt, Human
gggcaggugggagcuug

SEQ ID NO: 3664554 - RNA, 22 nt, Human
gggcaggugguggcacugagcc

SEQ ID NO: 3664555 - RNA, 15 nt, Human
gggcagucuggaggg

SEQ ID NO: 3664556 - RNA, 19 nt, Human
gggcagugcuagugagcug

SEQ ID NO: 3664557 - RNA, 18 nt, Human
gggcagugcuuggcccag

SEQ ID NO: 3664558 - RNA, 14 nt, Human
gggcaguggaggug

SEQ ID NO: 3664559 - RNA, 18 nt, Human
gggcagugggucccagau

SEQ ID NO: 3664560 - RNA, 21 nt, Human
gggcagugguaagcucuggcu

SEQ ID NO: 3664561 - RNA, 20 nt, Human
gggcagugguguggagaagc

SEQ ID NO: 3664562 - RNA, 22 nt, Human
gggcaguucgcagccacccuga

SEQ ID NO: 3664563 - RNA, 23 nt, Human
gggcauaucggcucacaaagaga

SEQ ID NO: 3664564 - RNA, 13 nt, Human
gggcauccucagg

SEQ ID NO: 3664565 - RNA, 16 nt, Human
gggcaucucugggcug

SEQ ID NO: 3664566 - RNA, 18 nt, Human
gggcaucuggccuuacac

SEQ ID NO: 3664567 - RNA, 17 nt, Human
gggcaucuugcuggcua

SEQ ID NO: 3664568 - RNA, 12 nt, Human
gggcaugacacg

SEQ ID NO: 3664569 - RNA, 14 nt, Human
gggcaugcuggggc

SEQ ID NO: 3664570 - RNA, 20 nt, Human
gggcauggacguucggggca

SEQ ID NO: 3664571 - RNA, 22 nt, Human
gggcauggacguucggggcaug

SEQ ID NO: 3664572 - RNA, 17 nt, Human
gggcauggccagguggc

SEQ ID NO: 3664573 - RNA, 18 nt, Human
gggcaugguaccagcccu

SEQ ID NO: 3664574 - RNA, 19 nt, Human
gggcaugguaccagcccug

SEQ ID NO: 3664575 - RNA, 18 nt, Human
gggcauguauuggccugg

SEQ ID NO: 3664576 - RNA, 21 nt, Human
gggcauguauuggccuggagg

SEQ ID NO: 3664577 - RNA, 14 nt, Human
gggcaugugggcuu

SEQ ID NO: 3664578 - RNA, 13 nt, Human
gggcauugacaaa

SEQ ID NO: 3664579 - RNA, 20 nt, Human
gggccaaaagcuucccuccc

SEQ ID NO: 3664580 - RNA, 16 nt, Human
gaacuugaggacacau

SEQ ID NO: 3664581 - RNA, 19 nt, Human
gaacuugaggacacauguc

SEQ ID NO: 3664582 - RNA, 21 nt, Human
gaacuugaggacacaugucca

SEQ ID NO: 3664583 - RNA, 12 nt, Human
gaacuugcaugg

SEQ ID NO: 3664584 - RNA, 16 nt, Human
gaacuugccugccuuu

SEQ ID NO: 3664585 - RNA, 19 nt, Human
gaacuugccugccuuucca

SEQ ID NO: 3664586 - RNA, 13 nt, Human
gaacuuggaagca

SEQ ID NO: 3664587 - RNA, 15 nt, Human
gaacuuggaggcacc

SEQ ID NO: 3664588 - RNA, 13 nt, Human
gaacuuggcgcug

SEQ ID NO: 3664589 - RNA, 15 nt, Human
gaacuuggcgcugcc

SEQ ID NO: 3664590 - RNA, 17 nt, Human
gaacuuggcgcugcccc

SEQ ID NO: 3664591 - RNA, 23 nt, Human
gaacuugguucccauuugcuccu

SEQ ID NO: 3664592 - RNA, 15 nt, Human
gaacuuguagcugua

SEQ ID NO: 3664593 - RNA, 17 nt, Human
gaacuuguagcuguaaa

SEQ ID NO: 3664594 - RNA, 15 nt, Human
gaacuugucucuuca

SEQ ID NO: 3664595 - RNA, 13 nt, Human
gaacuuucauuuu

SEQ ID NO: 3664596 - RNA, 14 nt, Human
gaacuuucauuuuu

SEQ ID NO: 3664597 - RNA, 16 nt, Human
gaacuuugaccucugc

SEQ ID NO: 3664598 - RNA, 22 nt, Human
gaacuuuuccucuguaucacug

SEQ ID NO: 3664599 - RNA, 15 nt, Human
gaacuuuuucuuuuc

SEQ ID NO: 3664600 - RNA, 19 nt, Human
gaacuuuuuuaaauaaacu

SEQ ID NO: 3664601 - RNA, 16 nt, Human
gaagaaaaaaaauaac

SEQ ID NO: 3664602 - RNA, 20 nt, Human
gaagaaaaaaacgaaaacag

SEQ ID NO: 3664603 - RNA, 16 nt, Human
gaagaaaaaaaucuuc

SEQ ID NO: 3664604 - RNA, 19 nt, Human
gaagaaaaaaggccuugaa

SEQ ID NO: 3664605 - RNA, 13 nt, Human
gaagaaaaacuca

SEQ ID NO: 3664606 - RNA, 17 nt, Human
gaagaaaagagaagaag

SEQ ID NO: 3664607 - RNA, 19 nt, Human
gaagaaaagagaagaagaa

SEQ ID NO: 3664608 - RNA, 20 nt, Human
gaagaaaagugggccagugu

SEQ ID NO: 3664609 - RNA, 20 nt, Human
gaagaaaauacuuaaauguu

SEQ ID NO: 3664610 - RNA, 15 nt, Human
gaagaaaauagaauu

SEQ ID NO: 3664611 - RNA, 21 nt, Human
gaagaaaauguucuuccaguu

SEQ ID NO: 3664612 - RNA, 17 nt, Human
gaagaaacacuuucucu

SEQ ID NO: 3664613 - RNA, 16 nt, Human
gaagaaacagcuauga

SEQ ID NO: 3664614 - RNA, 18 nt, Human
gaagaaaggccaucagag

SEQ ID NO: 3664615 - RNA, 17 nt, Human
gaagaaauacugcacuu

SEQ ID NO: 3664616 - RNA, 13 nt, Human
gaagaaaugaaau

SEQ ID NO: 3664617 - RNA, 14 nt, Human
gaagaaaugaaauu

SEQ ID NO: 3664618 - RNA, 15 nt, Human
gaagaaaugaaauuu

SEQ ID NO: 3664619 - RNA, 23 nt, Human
gaagaaaugaaauuuuaccaagu

SEQ ID NO: 3664620 - RNA, 13 nt, Human
gaagaacaggccu

SEQ ID NO: 3664621 - RNA, 14 nt, Human
gaagaacugcaggc

SEQ ID NO: 3664622 - RNA, 19 nt, Human
gaagaacugcaggcccugg

SEQ ID NO: 3664623 - RNA, 15 nt, Human
gaagaagaaaagaga

SEQ ID NO: 3664624 - RNA, 15 nt, Human
gaagaagaagaagaa

SEQ ID NO: 3664625 - RNA, 19 nt, Human
gaagaagagaagcugcuga

SEQ ID NO: 3664626 - RNA, 14 nt, Human
gaagaagagccaca

SEQ ID NO: 3664627 - RNA, 14 nt, Human
gaagaagagggaga

SEQ ID NO: 3664628 - RNA, 13 nt, Human
gaagaagcagaga

SEQ ID NO: 3664629 - RNA, 12 nt, Human
gaagaagccugu

SEQ ID NO: 3664630 - RNA, 18 nt, Human
gaagaagcuuaggcaggg

SEQ ID NO: 3664631 - RNA, 14 nt, Human
gaagaagggagaag

SEQ ID NO: 3664632 - RNA, 15 nt, Human
gaagaagggagaaga

SEQ ID NO: 3664633 - RNA, 16 nt, Human
gaagaagggagaagaa

SEQ ID NO: 3664634 - RNA, 17 nt, Human
gaagaagggagaagaaa

SEQ ID NO: 3664635 - RNA, 20 nt, Human
gaagaagguggaccuuuuaa

SEQ ID NO: 3664636 - RNA, 16 nt, Human
gaagaaggugggagga

SEQ ID NO: 3664637 - RNA, 12 nt, Human
gaagaauaauuu

SEQ ID NO: 3664638 - RNA, 14 nt, Human
gaagaauauucagg

SEQ ID NO: 3664639 - RNA, 15 nt, Human
gaagaauauuguauu

SEQ ID NO: 3664640 - RNA, 19 nt, Human
gaagaauauuguuccuaag

SEQ ID NO: 3664641 - RNA, 20 nt, Human
gaagaauauuguuccuaagu

SEQ ID NO: 3664642 - RNA, 22 nt, Human
gaagaauauuguuccuaaguuc

SEQ ID NO: 3664643 - RNA, 21 nt, Human
gaagaaucucaucucagugaa

SEQ ID NO: 3664644 - RNA, 20 nt, Human
gaagaaugcaugcuuuccau

SEQ ID NO: 3664645 - RNA, 24 nt, Human
gaagaaugcuuaaucagauagaua

SEQ ID NO: 3664646 - RNA, 15 nt, Human
gaagaauggagagga

SEQ ID NO: 3664647 - RNA, 16 nt, Human
gaagaauggagaggaa

SEQ ID NO: 3664648 - RNA, 17 nt, Human
gaagaauugaaaaguuu

SEQ ID NO: 3664649 - RNA, 21 nt, Human
gaagaauugaaaaguuuuugu

SEQ ID NO: 3664650 - RNA, 20 nt, Human
gaagaauugaacccaggagg

SEQ ID NO: 3664651 - RNA, 13 nt, Human
gaagaauuuaaag

SEQ ID NO: 3664652 - RNA, 17 nt, Human
gaagaauuuucagaccc

SEQ ID NO: 3664653 - RNA, 21 nt, Human
gaagaauuuucagaccccagc

SEQ ID NO: 3664654 - RNA, 20 nt, Human
gaagacaaaaagacaaacau

SEQ ID NO: 3664655 - RNA, 17 nt, Human
gaagacaaaaauacucu

SEQ ID NO: 3664656 - RNA, 23 nt, Human
gaagacaaaacauacauuuugua

SEQ ID NO: 3664657 - RNA, 20 nt, Human
gaagacaauuugauacauaa

SEQ ID NO: 3664658 - RNA, 21 nt, Human
gaagacacugaaauauacaca

SEQ ID NO: 3664659 - RNA, 21 nt, Human
gaagacacugaugggcaaccc

SEQ ID NO: 3664660 - RNA, 13 nt, Human
gaagacagcucuu

SEQ ID NO: 3664661 - RNA, 14 nt, Human
gaagacagcucuua

SEQ ID NO: 3664662 - RNA, 15 nt, Human
gaagacagcucuuau

SEQ ID NO: 3664663 - RNA, 13 nt, Human
gaagacaggaaag

SEQ ID NO: 3664664 - RNA, 10 nt, Human
gaagacagug

SEQ ID NO: 3664665 - RNA, 13 nt, Human
gaagacaguggcc

SEQ ID NO: 3664666 - RNA, 18 nt, Human
gaagacaugaaccaagug

SEQ ID NO: 3664667 - RNA, 14 nt, Human
gaagacauuucuuu

SEQ ID NO: 3664668 - RNA, 18 nt, Human
gaagaccagacuguggag

SEQ ID NO: 3664669 - RNA, 20 nt, Human
gaagaccagcuuugcaguga

SEQ ID NO: 3664670 - RNA, 20 nt, Human
gaagacccauuccuucccag

SEQ ID NO: 3664671 - RNA, 18 nt, Human
gaagaccccacccaagcu

SEQ ID NO: 3664672 - RNA, 14 nt, Human
gaagacgaggcccu

SEQ ID NO: 3664673 - RNA, 16 nt, Human
gaagacgccugagcuc

SEQ ID NO: 3664674 - RNA, 21 nt, Human
gaagacgugaugccaggacca

SEQ ID NO: 3664675 - RNA, 17 nt, Human
gaagacucauucuucug

SEQ ID NO: 3664676 - RNA, 19 nt, Human
gaagacucauucuucugua

SEQ ID NO: 3664677 - RNA, 21 nt, Human
gaagacucauucuucuguacg

SEQ ID NO: 3664678 - RNA, 14 nt, Human
gaagacuccagaaa

SEQ ID NO: 3664679 - RNA, 19 nt, Human
gaagacugcauuauauuua

SEQ ID NO: 3664680 - RNA, 12 nt, Human
gaagacuguggc

SEQ ID NO: 3664681 - RNA, 13 nt, Human
gaagacuguggcu

SEQ ID NO: 3664682 - RNA, 16 nt, Human
gaagacuucaucccuc

SEQ ID NO: 3664683 - RNA, 17 nt, Human
gaagacuucaucccucu

SEQ ID NO: 3664684 - RNA, 23 nt, Human
gaagacuucaucccucuggggcu

SEQ ID NO: 3664685 - RNA, 14 nt, Human
gaagacuuuggaaa

SEQ ID NO: 3664686 - RNA, 17 nt, Human
gaagagaagcugcugac

SEQ ID NO: 3664687 - RNA, 13 nt, Human
gaagagaaggagc

SEQ ID NO: 3664688 - RNA, 18 nt, Human
gaagagacaggagggcaa

SEQ ID NO: 3664689 - RNA, 13 nt, Human
gaagagaggagag

SEQ ID NO: 3664690 - RNA, 14 nt, Human
gaagagaggagagg

SEQ ID NO: 3664691 - RNA, 15 nt, Human
gaagagaggaguuca

SEQ ID NO: 3664692 - RNA, 14 nt, Human
gaagagaggggaag

SEQ ID NO: 3664693 - RNA, 18 nt, Human
gaagagaugggcuuguuu

SEQ ID NO: 3664694 - RNA, 18 nt, Human
gaagagauuuuucaugau

SEQ ID NO: 3664695 - RNA, 22 nt, Human
gaagagcaaaaauaucccuucc

SEQ ID NO: 3664696 - RNA, 16 nt, Human
gaagagcagcuccuuc

SEQ ID NO: 3664697 - RNA, 22 nt, Human
gaagagcaggacuccaggccca

SEQ ID NO: 3664698 - RNA, 13 nt, Human
gaagagccccacu

SEQ ID NO: 3664699 - RNA, 23 nt, Human
gaagagccccacucucagaggcc

SEQ ID NO: 3664700 - RNA, 16 nt, Human
gaagagccggagccuc

SEQ ID NO: 3664701 - RNA, 15 nt, Human
gaagagccuuccacc

SEQ ID NO: 3664702 - RNA, 22 nt, Human
gaagagccuuccacccaggggc

SEQ ID NO: 3664703 - RNA, 12 nt, Human
gaagagccuugc

SEQ ID NO: 3664704 - RNA, 16 nt, Human
gaagagcuagagaaau

SEQ ID NO: 3664705 - RNA, 20 nt, Human
gaagagcucaagggacaagg

SEQ ID NO: 3664706 - RNA, 21 nt, Human
gaagagcucaagggacaagga

SEQ ID NO: 3664707 - RNA, 20 nt, Human
gaagagcuguugaugggaug

SEQ ID NO: 3664708 - RNA, 14 nt, Human
gaagaggaaaauga

SEQ ID NO: 3664709 - RNA, 18 nt, Human
gaagaggaaaaugaauaa

SEQ ID NO: 3664710 - RNA, 20 nt, Human
gaagaggccuguuuggccuc

SEQ ID NO: 3664711 - RNA, 18 nt, Human
gaagaggcgggccagcca

SEQ ID NO: 3664712 - RNA, 15 nt, Human
gaagaggcugguucu

SEQ ID NO: 3664713 - RNA, 19 nt, Human
gaagaggggacaggucccu

SEQ ID NO: 3664714 - RNA, 11 nt, Human
gaagaggggca

SEQ ID NO: 3664715 - RNA, 14 nt, Human
gaagaggggcagcc

SEQ ID NO: 3664716 - RNA, 19 nt, Human
ggcuccuuucuccagccag

SEQ ID NO: 3664717 - RNA, 17 nt, Human
ggcucgaaucucugugc

SEQ ID NO: 3664718 - RNA, 19 nt, Human
ggcucgaaucucugugccu

SEQ ID NO: 3664719 - RNA, 20 nt, Human
ggcucgaaucucugugccuu

SEQ ID NO: 3664720 - RNA, 21 nt, Human
ggcucgagcaguccugccuca

SEQ ID NO: 3664721 - RNA, 16 nt, Human
ggcucgccaugccggg

SEQ ID NO: 3664722 - RNA, 22 nt, Human
ggcucgccucaggaaugggcug

SEQ ID NO: 3664723 - RNA, 22 nt, Human
ggcucgccuucccuccugcuuu

SEQ ID NO: 3664724 - RNA, 16 nt, Human
ggcucggaggcugccc

SEQ ID NO: 3664725 - RNA, 14 nt, Human
ggcucggccugccc

SEQ ID NO: 3664726 - RNA, 14 nt, Human
gguacagagaagcc

SEQ ID NO: 3664727 - RNA, 16 nt, Human
gguacagagaagccag

SEQ ID NO: 3664728 - RNA, 21 nt, Human
gguacagagaagccagcuugu

SEQ ID NO: 3664729 - RNA, 17 nt, Human
gguacaguauggggguu

SEQ ID NO: 3664730 - RNA, 15 nt, Human
gguacauuucccugu

SEQ ID NO: 3664731 - RNA, 17 nt, Human
gaagaggggcagcccuu

SEQ ID NO: 3664732 - RNA, 20 nt, Human
gaagagguuuuaaagcuucc

SEQ ID NO: 3664733 - RNA, 16 nt, Human
gaagaguagcauuuca

SEQ ID NO: 3664734 - RNA, 20 nt, Human
gaagaguagcauuucauucu

SEQ ID NO: 3664735 - RNA, 20 nt, Human
gaagaguauuuuugacagaa

SEQ ID NO: 3664736 - RNA, 17 nt, Human
gaagagucuauugucuc

SEQ ID NO: 3664737 - RNA, 16 nt, Human
gaagagucuggaggga

SEQ ID NO: 3664738 - RNA, 14 nt, Human
gaagagugaaauac

SEQ ID NO: 3664739 - RNA, 21 nt, Human
gaagaguguggagucauucuc

SEQ ID NO: 3664740 - RNA, 20 nt, Human
gaagaguucccuugaaacuu

SEQ ID NO: 3664741 - RNA, 21 nt, Human
gaagaguucccuugaaacuuu

SEQ ID NO: 3664742 - RNA, 14 nt, Human
gaagaguugaggaa

SEQ ID NO: 3664743 - RNA, 23 nt, Human
gaagaguugaggaacuguacaga

SEQ ID NO: 3664744 - RNA, 18 nt, Human
gaagauaaguuggaaaca

SEQ ID NO: 3664745 - RNA, 16 nt, Human
gaagauaauuguugaa

SEQ ID NO: 3664746 - RNA, 15 nt, Human
gaagauacugaaaua

SEQ ID NO: 3664747 - RNA, 14 nt, Human
gaagauacuuugua

SEQ ID NO: 3664748 - RNA, 15 nt, Human
gaagauacuuuguau

SEQ ID NO: 3664749 - RNA, 14 nt, Human
gaagauagaagaaa

SEQ ID NO: 3664750 - RNA, 16 nt, Human
gaagauaggcucugca

SEQ ID NO: 3664751 - RNA, 14 nt, Human
gaagauaucuugaa

SEQ ID NO: 3664752 - RNA, 14 nt, Human
gaagauauuuuucc

SEQ ID NO: 3664753 - RNA, 15 nt, Human
gaagaucccccagaa

SEQ ID NO: 3664754 - RNA, 16 nt, Human
gaagauccccucagga

SEQ ID NO: 3664755 - RNA, 13 nt, Human
gaagauccuaccc

SEQ ID NO: 3664756 - RNA, 13 nt, Human
gaagauccuguga

SEQ ID NO: 3664757 - RNA, 14 nt, Human
gaagauccugugag

SEQ ID NO: 3664758 - RNA, 19 nt, Human
gaagaucucugcagggccg

SEQ ID NO: 3664759 - RNA, 15 nt, Human
gaagaucuuaaauuu

SEQ ID NO: 3664760 - RNA, 17 nt, Human
gaagaucuuugggcaua

SEQ ID NO: 3664761 - RNA, 17 nt, Human
gaagaugaaagaggagg

SEQ ID NO: 3664762 - RNA, 13 nt, Human
gaagaugacugag

SEQ ID NO: 3664763 - RNA, 14 nt, Human
gaagaugacugagg

SEQ ID NO: 3664764 - RNA, 20 nt, Human
gaagauggcauccugugaag

SEQ ID NO: 3664765 - RNA, 12 nt, Human
gaagaugggggc

SEQ ID NO: 3664766 - RNA, 18 nt, Human
gaagaugggggcaagaag

SEQ ID NO: 3664767 - RNA, 17 nt, Human
gaagauguagaggagaa

SEQ ID NO: 3664768 - RNA, 18 nt, Human
gaagauguagaggagaaa

SEQ ID NO: 3664769 - RNA, 13 nt, Human
gaagauguuuaac

SEQ ID NO: 3664770 - RNA, 15 nt, Human
gaagauuauuuuuua

SEQ ID NO: 3664771 - RNA, 20 nt, Human
gaagauucuauguuaauauu

SEQ ID NO: 3664772 - RNA, 23 nt, Human
gaagauucuauguuaauauuuua

SEQ ID NO: 3664773 - RNA, 17 nt, Human
gaagauucuccugugcu

SEQ ID NO: 3664774 - RNA, 20 nt, Human
gaagauucuuguauuuauua

SEQ ID NO: 3664775 - RNA, 13 nt, Human
gaagauuguuuau

SEQ ID NO: 3664776 - RNA, 15 nt, Human
gaagcaaacacauua

SEQ ID NO: 3664777 - RNA, 17 nt, Human
gaagcaaacacauuaag

SEQ ID NO: 3664778 - RNA, 17 nt, Human
gaagcaaacuaagcccc

SEQ ID NO: 3664779 - RNA, 22 nt, Human
gaagcaaaugucaugcugccuu

SEQ ID NO: 3664780 - RNA, 22 nt, Human
gaagcaacauuuuagcucuauu

SEQ ID NO: 3664781 - RNA, 16 nt, Human
gaagcaacgaagggaa

SEQ ID NO: 3664782 - RNA, 22 nt, Human
gaagcacaccaaucuuacuuug

SEQ ID NO: 3664783 - RNA, 18 nt, Human
gaagcacagaaaacuaga

SEQ ID NO: 3664784 - RNA, 21 nt, Human
gaagcaccccaugccaaagcu

SEQ ID NO: 3664785 - RNA, 18 nt, Human
gaagcacugggaucacag

SEQ ID NO: 3664786 - RNA, 19 nt, Human
gaagcacuguuccagccug

SEQ ID NO: 3664787 - RNA, 12 nt, Human
gaagcagaauaa

SEQ ID NO: 3664788 - RNA, 16 nt, Human
gaagcagaauaaagca

SEQ ID NO: 3664789 - RNA, 23 nt, Human
gaagcagaauaaagcaauuuucc

SEQ ID NO: 3664790 - RNA, 19 nt, Human
gaagcagaugcaaagaggc

SEQ ID NO: 3664791 - RNA, 23 nt, Human
gaagcagcuaaaccaaggacuga

SEQ ID NO: 3664792 - RNA, 23 nt, Human
gaagcaggcuacacugacacugg

SEQ ID NO: 3664793 - RNA, 12 nt, Human
gaagcaggcugg

SEQ ID NO: 3664794 - RNA, 18 nt, Human
gaagcagguuaaauguuu

SEQ ID NO: 3664795 - RNA, 12 nt, Human
gaagcagguucc

SEQ ID NO: 3664796 - RNA, 13 nt, Human
gaagcaguauuuu

SEQ ID NO: 3664797 - RNA, 15 nt, Human
gaagcagugagccgc

SEQ ID NO: 3664798 - RNA, 12 nt, Human
gaagcagugccc

SEQ ID NO: 3664799 - RNA, 14 nt, Human
gaagcaguggccuu

SEQ ID NO: 3664800 - RNA, 22 nt, Human
gaagcaguuguaccaagugaaa

SEQ ID NO: 3664801 - RNA, 13 nt, Human
gaagcaguugugu

SEQ ID NO: 3664802 - RNA, 22 nt, Human
gaagcauggugcccuggcuucu

SEQ ID NO: 3664803 - RNA, 16 nt, Human
gaagcauguuucaugu

SEQ ID NO: 3664804 - RNA, 17 nt, Human
gaagcauuaacuucucu

SEQ ID NO: 3664805 - RNA, 16 nt, Human
gaagcauucagagagc

SEQ ID NO: 3664806 - RNA, 16 nt, Human
gaagcauuuguauuuu

SEQ ID NO: 3664807 - RNA, 19 nt, Human
gaagcauuuguuucuacuu

SEQ ID NO: 3664808 - RNA, 15 nt, Human
gaagcauuuuauaaa

SEQ ID NO: 3664809 - RNA, 13 nt, Human
gaagccaaagaaa

SEQ ID NO: 3664810 - RNA, 15 nt, Human
gaagccaacuuggcu

SEQ ID NO: 3664811 - RNA, 14 nt, Human
gaagccaagggaaa

SEQ ID NO: 3664812 - RNA, 16 nt, Human
gaagccaagggaaagg

SEQ ID NO: 3664813 - RNA, 19 nt, Human
gaagccaagggaaaggggu

SEQ ID NO: 3664814 - RNA, 19 nt, Human
gaagccaaguggggugcug

SEQ ID NO: 3664815 - RNA, 18 nt, Human
gaagccacagcccaggcc

SEQ ID NO: 3664816 - RNA, 19 nt, Human
gaagccacagcccaggccu

SEQ ID NO: 3664817 - RNA, 16 nt, Human
gaagccacaggccuga

SEQ ID NO: 3664818 - RNA, 18 nt, Human
gaagccacccucccagcu

SEQ ID NO: 3664819 - RNA, 20 nt, Human
gaagccacgggugccagaag

SEQ ID NO: 3664820 - RNA, 15 nt, Human
gaagccacugaagcu

SEQ ID NO: 3664821 - RNA, 20 nt, Human
gaagccagcaggcucucagg

SEQ ID NO: 3664822 - RNA, 10 nt, Human
gaagccagcu

SEQ ID NO: 3664823 - RNA, 13 nt, Human
gaagccagcugcc

SEQ ID NO: 3664824 - RNA, 18 nt, Human
gaagccagcuuguuuaca

SEQ ID NO: 3664825 - RNA, 14 nt, Human
gaagccagggcccg

SEQ ID NO: 3664826 - RNA, 18 nt, Human
gaagccagugcggcaggu

SEQ ID NO: 3664827 - RNA, 18 nt, Human
gaagccaucaccucagau

SEQ ID NO: 3664828 - RNA, 20 nt, Human
gaagccaucaccucagaugg

SEQ ID NO: 3664829 - RNA, 22 nt, Human
gaagccaucaccucagauggca

SEQ ID NO: 3664830 - RNA, 12 nt, Human
gaagccauuguc

SEQ ID NO: 3664831 - RNA, 13 nt, Human
gaagccauugucu

SEQ ID NO: 3664832 - RNA, 15 nt, Human
gaagcccaagugaaa

SEQ ID NO: 3664833 - RNA, 19 nt, Human
gaagcccaauaaaccucuu

SEQ ID NO: 3664834 - RNA, 13 nt, Human
gaagcccagaggg

SEQ ID NO: 3664835 - RNA, 17 nt, Human
gaagcccagagggucug

SEQ ID NO: 3664836 - RNA, 19 nt, Human
gaagcccaggaaaggcucc

SEQ ID NO: 3664837 - RNA, 22 nt, Human
gaagcccaggaaaggcuccagg

SEQ ID NO: 3664838 - RNA, 23 nt, Human
gaagcccaggaaaggcuccagga

SEQ ID NO: 3664839 - RNA, 16 nt, Human
gaagcccaggggccgg

SEQ ID NO: 3664840 - RNA, 17 nt, Human
gaagcccauccugacca

SEQ ID NO: 3664841 - RNA, 14 nt, Human
gaagcccggcuccu

SEQ ID NO: 3664842 - RNA, 15 nt, Human
gaagcccggcuccug

SEQ ID NO: 3664843 - RNA, 18 nt, Human
gaagcccuaacucagcca

SEQ ID NO: 3664844 - RNA, 14 nt, Human
gaagcccuccuucc

SEQ ID NO: 3664845 - RNA, 13 nt, Human
gaagcccuggaga

SEQ ID NO: 3664846 - RNA, 23 nt, Human
gaagcccuucuaccuuccugcaa

SEQ ID NO: 3664847 - RNA, 16 nt, Human
gaagccgacucuggcc

SEQ ID NO: 3664848 - RNA, 21 nt, Human
gaagccgacucuggcccuggc

SEQ ID NO: 3664849 - RNA, 22 nt, Human
gaagccgacucuggcccuggcc

SEQ ID NO: 3664850 - RNA, 21 nt, Human
gaagccggggaagagauccaa

SEQ ID NO: 3664851 - RNA, 16 nt, Human
gaagccuauuguaaau

SEQ ID NO: 3664852 - RNA, 22 nt, Human
gaagccucagauuccuucccau

SEQ ID NO: 3664853 - RNA, 17 nt, Human
gaagccucagcuaccca

SEQ ID NO: 3664854 - RNA, 12 nt, Human
gaagccucuggc

SEQ ID NO: 3664855 - RNA, 13 nt, Human
gaagccucuggcu

SEQ ID NO: 3664856 - RNA, 14 nt, Human
gaagccucuggcua

SEQ ID NO: 3664857 - RNA, 21 nt, Human
gaagccucugggucagugguc

SEQ ID NO: 3664858 - RNA, 12 nt, Human
gaagccugaggc

SEQ ID NO: 3664859 - RNA, 12 nt, Human
gaagccugcccu

SEQ ID NO: 3664860 - RNA, 16 nt, Human
gaagccugcccuuguc

SEQ ID NO: 3664861 - RNA, 12 nt, Human
gaagccuggggg

SEQ ID NO: 3664862 - RNA, 13 nt, Human
gaagccugggggc

SEQ ID NO: 3664863 - RNA, 20 nt, Human
gaagccugggggccuggcug

SEQ ID NO: 3664864 - RNA, 18 nt, Human
gaagccuuaccacgcagu

SEQ ID NO: 3664865 - RNA, 20 nt, Human
gaagccuucaagcucugagg

SEQ ID NO: 3664866 - RNA, 15 nt, Human
gaagccuucagcucc

SEQ ID NO: 3664867 - RNA, 17 nt, Human
gaagccuucagcuccag

SEQ ID NO: 3664868 - RNA, 23 nt, Human
gaagccuuccccuuauccucccu

SEQ ID NO: 3664869 - RNA, 15 nt, Human
gaagccuuuccugua

SEQ ID NO: 3664870 - RNA, 10 nt, Human
gaagccuuug

SEQ ID NO: 3664871 - RNA, 18 nt, Human
gaagccuuugggaagggg

SEQ ID NO: 3664872 - RNA, 13 nt, Human
gaauauaaaugug

SEQ ID NO: 3664873 - RNA, 12 nt, Human
gaauauaauuau

SEQ ID NO: 3664874 - RNA, 19 nt, Human
gaauauaauuguuuuaucu

SEQ ID NO: 3664875 - RNA, 14 nt, Human
gaauauaggucucu

SEQ ID NO: 3664876 - RNA, 15 nt, Human
gaauauauaaccagu

SEQ ID NO: 3664877 - RNA, 20 nt, Human
gaauauauggcagaguugua

SEQ ID NO: 3664878 - RNA, 23 nt, Human
gaauauauggcagaguuguaaau

SEQ ID NO: 3664879 - RNA, 16 nt, Human
gaauauccauguacuu

SEQ ID NO: 3664880 - RNA, 19 nt, Human
gaauauccauguacuuguu

SEQ ID NO: 3664881 - RNA, 14 nt, Human
gaauaucugggauu

SEQ ID NO: 3664882 - RNA, 22 nt, Human
gaauaugaacggugagcauugu

SEQ ID NO: 3664883 - RNA, 13 nt, Human
gaauaugccugua

SEQ ID NO: 3664884 - RNA, 16 nt, Human
gaauaugccuguaauu

SEQ ID NO: 3664885 - RNA, 11 nt, Human
gaauaugccuu

SEQ ID NO: 3664886 - RNA, 21 nt, Human
gaauaugggagaaauagugug

SEQ ID NO: 3664887 - RNA, 19 nt, Human
gaauauguaguaucuauau

SEQ ID NO: 3664888 - RNA, 21 nt, Human
gaauaugucagugcugaugua

SEQ ID NO: 3664889 - RNA, 20 nt, Human
gaauauguuucaaacuuugg

SEQ ID NO: 3664890 - RNA, 13 nt, Human
gaauauuaaaaaa

SEQ ID NO: 3664891 - RNA, 20 nt, Human
gaauauuagugaccucagcu

SEQ ID NO: 3664892 - RNA, 17 nt, Human
gaauauuaucuucauaa

SEQ ID NO: 3664893 - RNA, 19 nt, Human
gaauauuauuggaaaauuc

SEQ ID NO: 3664894 - RNA, 12 nt, Human
gaauauucagga

SEQ ID NO: 3664895 - RNA, 18 nt, Human
gaauauucccaagcccau

SEQ ID NO: 3664896 - RNA, 13 nt, Human
gaauauugcaaaa

SEQ ID NO: 3664897 - RNA, 14 nt, Human
gaauauugcaaaau

SEQ ID NO: 3664898 - RNA, 20 nt, Human
gaauauugcaaaauacauga

SEQ ID NO: 3664899 - RNA, 19 nt, Human
gaauauugccauuaugcuu

SEQ ID NO: 3664900 - RNA, 12 nt, Human
gaauauugcuga

SEQ ID NO: 3664901 - RNA, 14 nt, Human
gaauauugcugaug

SEQ ID NO: 3664902 - RNA, 19 nt, Human
gaauauugcugauggugca

SEQ ID NO: 3664903 - RNA, 24 nt, Human
gaauauugcugauggugcaaugac

SEQ ID NO: 3664904 - RNA, 22 nt, Human
gaauauugcuuuggucauauga

SEQ ID NO: 3664905 - RNA, 14 nt, Human
gaauauuguuucuu

SEQ ID NO: 3664906 - RNA, 13 nt, Human
gaauauuuauaac

SEQ ID NO: 3664907 - RNA, 15 nt, Human
gaauauuuauaacag

SEQ ID NO: 3664908 - RNA, 18 nt, Human
gaauauuuauaacagcau

SEQ ID NO: 3664909 - RNA, 20 nt, Human
gaauauuuauauuucacuau

SEQ ID NO: 3664910 - RNA, 12 nt, Human
gaauauuuauua

SEQ ID NO: 3664911 - RNA, 13 nt, Human
gaauauuuauuac

SEQ ID NO: 3664912 - RNA, 17 nt, Human
gaauauuuauuaccucu

SEQ ID NO: 3664913 - RNA, 19 nt, Human
gaauauuuauuaccucuga

SEQ ID NO: 3664914 - RNA, 19 nt, Human
gaauauuuccauauggauu

SEQ ID NO: 3664915 - RNA, 18 nt, Human
gaauauuugaaucuuguc

SEQ ID NO: 3664916 - RNA, 12 nt, Human
gaauauuuuauu

SEQ ID NO: 3664917 - RNA, 14 nt, Human
gaauauuuuauuca

SEQ ID NO: 3664918 - RNA, 20 nt, Human
gaauauuuucauuaaaagcu

SEQ ID NO: 3664919 - RNA, 21 nt, Human
gaauauuuucauuaaaagcua

SEQ ID NO: 3664920 - RNA, 23 nt, Human
gaauauuuuguuuugugcagaga

SEQ ID NO: 3664921 - RNA, 20 nt, Human
gaauauuuuuauauuuccuu

SEQ ID NO: 3664922 - RNA, 21 nt, Human
gaauauuuuuauauuuccuuu

SEQ ID NO: 3664923 - RNA, 13 nt, Human
gaaucaaaacucu

SEQ ID NO: 3664924 - RNA, 14 nt, Human
gaaucaaaacucuc

SEQ ID NO: 3664925 - RNA, 15 nt, Human
gaaucaaaacucucc

SEQ ID NO: 3664926 - RNA, 15 nt, Human
gaaucaaaagugccu

SEQ ID NO: 3664927 - RNA, 14 nt, Human
gaaucaacagggca

SEQ ID NO: 3664928 - RNA, 15 nt, Human
gaaucaacagggcag

SEQ ID NO: 3664929 - RNA, 17 nt, Human
gaaucaagagcugcccu

SEQ ID NO: 3664930 - RNA, 20 nt, Human
gaaucaagcuagaaggccac

SEQ ID NO: 3664931 - RNA, 17 nt, Human
gaaucaagggucaggcc

SEQ ID NO: 3664932 - RNA, 17 nt, Human
gaaucacaggcugggcu

SEQ ID NO: 3664933 - RNA, 23 nt, Human
gaaucacguaaagcuagaaauga

SEQ ID NO: 3664934 - RNA, 19 nt, Human
gaaucacucuuguggaugu

SEQ ID NO: 3664935 - RNA, 11 nt, Human
gaaucacuguu

SEQ ID NO: 3664936 - RNA, 14 nt, Human
gaaucacuguuuuu

SEQ ID NO: 3664937 - RNA, 16 nt, Human
gaaucacuguuuuuag

SEQ ID NO: 3664938 - RNA, 23 nt, Human
gaaucagagaccuuccagaaaua

SEQ ID NO: 3664939 - RNA, 13 nt, Human
gguuaaaacuguc

SEQ ID NO: 3664940 - RNA, 13 nt, Human
gguuaaauguuuu

SEQ ID NO: 3664941 - RNA, 21 nt, Human
gguuaacaaauaacaacuuuu

SEQ ID NO: 3664942 - RNA, 18 nt, Human
gguuaacagcugucuaug

SEQ ID NO: 3664943 - RNA, 21 nt, Human
gguuaagcauuaccacucagg

SEQ ID NO: 3664944 - RNA, 16 nt, Human
gguuaagcccugaggg

SEQ ID NO: 3664945 - RNA, 23 nt, Human
gguuaagucuguuuuaugacuuc

SEQ ID NO: 3664946 - RNA, 22 nt, Human
gguuaauuuuuacauggagaaa

SEQ ID NO: 3664947 - RNA, 15 nt, Human
gguuacaaacugcaa

SEQ ID NO: 3664948 - RNA, 21 nt, Human
gguuacaacagauuugugaac

SEQ ID NO: 3664949 - RNA, 13 nt, Human
gguuacacuguua

SEQ ID NO: 3664950 - RNA, 21 nt, Human
gguuacccaguuagcucucaa

SEQ ID NO: 3664951 - RNA, 23 nt, Human
gguuagaccuacagggggucugg

SEQ ID NO: 3664952 - RNA, 18 nt, Human
gguuagauguugccaugu

SEQ ID NO: 3664953 - RNA, 13 nt, Human
gguuagggagggg

SEQ ID NO: 3664954 - RNA, 15 nt, Human
gguuagggaggggua

SEQ ID NO: 3664955 - RNA, 21 nt, Human
gguuaguggauggaaggggcu

SEQ ID NO: 3664956 - RNA, 14 nt, Human
gguuauaaaaguga

SEQ ID NO: 3664957 - RNA, 23 nt, Human
gguuauaacuuaaugaaaacaau

SEQ ID NO: 3664958 - RNA, 15 nt, Human
gguuauaguaacauc

SEQ ID NO: 3664959 - RNA, 18 nt, Human
gguuaucaaaaauuucau

SEQ ID NO: 3664960 - RNA, 17 nt, Human
gguuaucgaaauaacaa

SEQ ID NO: 3664961 - RNA, 23 nt, Human
gguuaucgaaauaacaauguuaa

SEQ ID NO: 3664962 - RNA, 13 nt, Human
gguuauggagagg

SEQ ID NO: 3664963 - RNA, 22 nt, Human
gguuauguguaugugccauuua

SEQ ID NO: 3664964 - RNA, 20 nt, Human
gguuauugaaaauaugaugu

SEQ ID NO: 3664965 - RNA, 16 nt, Human
gguuauuuuacuuuuu

SEQ ID NO: 3664966 - RNA, 21 nt, Human
gguucaaagauauuuugcuuu

SEQ ID NO: 3664967 - RNA, 23 nt, Human
gguucaacaaagaaacaaagaug

SEQ ID NO: 3664968 - RNA, 22 nt, Human
gguucaagcgauucuucugcuu

SEQ ID NO: 3664969 - RNA, 23 nt, Human
gguucaagcgauucuucugcuuc

SEQ ID NO: 3664970 - RNA, 18 nt, Human
gguucaaggucacuguuu

SEQ ID NO: 3664971 - RNA, 18 nt, Human
gguucaauucccugaagg

SEQ ID NO: 3664972 - RNA, 21 nt, Human
gguucacgccuguaaucccag

SEQ ID NO: 3664973 - RNA, 20 nt, Human
gguucacgugcagcucaagg

SEQ ID NO: 3664974 - RNA, 20 nt, Human
gguucacugcaaccuccgcc

SEQ ID NO: 3664975 - RNA, 20 nt, Human
gguucagccccuccucugcc

SEQ ID NO: 3664976 - RNA, 12 nt, Human
gguucagcuugu

SEQ ID NO: 3664977 - RNA, 22 nt, Human
gguucaggguuggccccugccc

SEQ ID NO: 3664978 - RNA, 14 nt, Human
gguuccagccugcc

SEQ ID NO: 3664979 - RNA, 15 nt, Human
gguuccaugccugag

SEQ ID NO: 3664980 - RNA, 18 nt, Human
gguuccaugccugagggu

SEQ ID NO: 3664981 - RNA, 14 nt, Human
gguucccccagccc

SEQ ID NO: 3664982 - RNA, 21 nt, Human
gguucccccagcccuguggaa

SEQ ID NO: 3664983 - RNA, 16 nt, Human
gguucccggucccgag

SEQ ID NO: 3664984 - RNA, 13 nt, Human
gguucccucugag

SEQ ID NO: 3664985 - RNA, 15 nt, Human
gguuccgcuuggagc

SEQ ID NO: 3664986 - RNA, 21 nt, Human
gguuccgcuuggagcagaggg

SEQ ID NO: 3664987 - RNA, 15 nt, Human
gguuccuacacagga

SEQ ID NO: 3664988 - RNA, 17 nt, Human
gguuccuacacaggaca

SEQ ID NO: 3664989 - RNA, 18 nt, Human
gguuccuacacaggacag

SEQ ID NO: 3664990 - RNA, 17 nt, Human
gguuccuaggggaauga

SEQ ID NO: 3664991 - RNA, 19 nt, Human
gguuccuaggggaaugagg

SEQ ID NO: 3664992 - RNA, 18 nt, Human
gguuccuccccuccagcu

SEQ ID NO: 3664993 - RNA, 14 nt, Human
gguuccucucuggu

SEQ ID NO: 3664994 - RNA, 17 nt, Human
gguuccucugccugccc

SEQ ID NO: 3664995 - RNA, 19 nt, Human
gguuccuuccucugagccu

SEQ ID NO: 3664996 - RNA, 22 nt, Human
gguucuaaaguucuaagauucu

SEQ ID NO: 3664997 - RNA, 22 nt, Human
gguucuacgccaggggaaaauc

SEQ ID NO: 3664998 - RNA, 23 nt, Human
gguucuagucuccuuugcacuga

SEQ ID NO: 3664999 - RNA, 13 nt, Human
gguucuauuugga

SEQ ID NO: 3665000 - RNA, 12 nt, Human
gguucucaauga

SEQ ID NO: 3665001 - RNA, 21 nt, Human
gguucucaauuccaacaguuu

SEQ ID NO: 3665002 - RNA, 22 nt, Human
gguucucaauuccaacaguuua

SEQ ID NO: 3665003 - RNA, 18 nt, Human
gguucucagguguugcca

SEQ ID NO: 3665004 - RNA, 12 nt, Human
gguucucaucuu

SEQ ID NO: 3665005 - RNA, 19 nt, Human
gguucugccugccagcugc

SEQ ID NO: 3665006 - RNA, 16 nt, Human
gguucugccugcuuug

SEQ ID NO: 3665007 - RNA, 12 nt, Human
gguucuggcugc

SEQ ID NO: 3665008 - RNA, 17 nt, Human
gguucuggggccccuuu

SEQ ID NO: 3665009 - RNA, 12 nt, Human
gguucugggugg

SEQ ID NO: 3665010 - RNA, 18 nt, Human
gguucugguuagcucagc

SEQ ID NO: 3665011 - RNA, 20 nt, Human
gguucugguuagcucagccc

SEQ ID NO: 3665012 - RNA, 12 nt, Human
gguucuguaaaa

SEQ ID NO: 3665013 - RNA, 20 nt, Human
gguucuugaggggaccagga

SEQ ID NO: 3665014 - RNA, 21 nt, Human
gguucuugaggggaccaggag

SEQ ID NO: 3665015 - RNA, 10 nt, Human
gguucuuguu

SEQ ID NO: 3665016 - RNA, 16 nt, Human
gguucuuucuuccucu

SEQ ID NO: 3665017 - RNA, 15 nt, Human
gggccgaugcccaga

SEQ ID NO: 3665018 - RNA, 20 nt, Human
gggccgccagggagaccugg

SEQ ID NO: 3665019 - RNA, 14 nt, Human
gggccgccuguccu

SEQ ID NO: 3665020 - RNA, 12 nt, Human
gggccgcugcca

SEQ ID NO: 3665021 - RNA, 14 nt, Human
gggccggccaggug

SEQ ID NO: 3665022 - RNA, 17 nt, Human
gggccggccaguggccu

SEQ ID NO: 3665023 - RNA, 19 nt, Human
gggccggcccugugugcag

SEQ ID NO: 3665024 - RNA, 17 nt, Human
gggccgggcagaggggc

SEQ ID NO: 3665025 - RNA, 17 nt, Human
gggccggggaacuggcc

SEQ ID NO: 3665026 - RNA, 20 nt, Human
gggccguaccccacccucag

SEQ ID NO: 3665027 - RNA, 22 nt, Human
gggccguaccccacccucagca

SEQ ID NO: 3665028 - RNA, 20 nt, Human
gggccguaucuccggcuccc

SEQ ID NO: 3665029 - RNA, 16 nt, Human
gggccuaauaaaacug

SEQ ID NO: 3665030 - RNA, 17 nt, Human
gggccuacuagagucug

SEQ ID NO: 3665031 - RNA, 22 nt, Human
gggccuagauccacacacagag

SEQ ID NO: 3665032 - RNA, 14 nt, Human
gggccuauggagag

SEQ ID NO: 3665033 - RNA, 21 nt, Human
gggccuauggagagcccuggg

SEQ ID NO: 3665034 - RNA, 16 nt, Human
gggccucaaggacuug

SEQ ID NO: 3665035 - RNA, 15 nt, Human
gggccucagugccac

SEQ ID NO: 3665036 - RNA, 23 nt, Human
gggccuccucuaacaggggcugg

SEQ ID NO: 3665037 - RNA, 13 nt, Human
gggccuccugugu

SEQ ID NO: 3665038 - RNA, 15 nt, Human
gggccuccugugugu

SEQ ID NO: 3665039 - RNA, 17 nt, Human
gggccucggagccucau

SEQ ID NO: 3665040 - RNA, 21 nt, Human
gggccucugcggagcacacug

SEQ ID NO: 3665041 - RNA, 18 nt, Human
gggccucuuaugggcugg

SEQ ID NO: 3665042 - RNA, 12 nt, Human
gggccugagcag

SEQ ID NO: 3665043 - RNA, 23 nt, Human
gggccugaggucuggcugcuugc

SEQ ID NO: 3665044 - RNA, 19 nt, Human
gggccugccaccuggaccc

SEQ ID NO: 3665045 - RNA, 23 nt, Human
gggccugccuagcacucacaugc

SEQ ID NO: 3665046 - RNA, 13 nt, Human
gggccugccuggc

SEQ ID NO: 3665047 - RNA, 16 nt, Human
gggccugcgagggcag

SEQ ID NO: 3665048 - RNA, 19 nt, Human
gggccugcgccaguccugc

SEQ ID NO: 3665049 - RNA, 15 nt, Human
gggccugcuccagac

SEQ ID NO: 3665050 - RNA, 18 nt, Human
gggccugcuccagaccug

SEQ ID NO: 3665051 - RNA, 16 nt, Human
gggccuggaccugccu

SEQ ID NO: 3665052 - RNA, 12 nt, Human
gggccuggagau

SEQ ID NO: 3665053 - RNA, 21 nt, Human
gggccuggagauccuccugca

SEQ ID NO: 3665054 - RNA, 16 nt, Human
gggccuggcagcucag

SEQ ID NO: 3665055 - RNA, 12 nt, Human
gggccuggccug

SEQ ID NO: 3665056 - RNA, 13 nt, Human
gggccuggccuga

SEQ ID NO: 3665057 - RNA, 18 nt, Human
gggccuggccugagcugg

SEQ ID NO: 3665058 - RNA, 18 nt, Human
gggccuggcuggcugagg

SEQ ID NO: 3665059 - RNA, 20 nt, Human
gggccuggcuggcugagggc

SEQ ID NO: 3665060 - RNA, 15 nt, Human
gggccugggcuccug

SEQ ID NO: 3665061 - RNA, 17 nt, Human
gggccugggcuccugga

SEQ ID NO: 3665062 - RNA, 14 nt, Human
gggccuggggccug

SEQ ID NO: 3665063 - RNA, 16 nt, Human
gggccuggggccugag

SEQ ID NO: 3665064 - RNA, 19 nt, Human
gggccuggucucacccugg

SEQ ID NO: 3665065 - RNA, 23 nt, Human
gggccugguuaaauaaggcaggg

SEQ ID NO: 3665066 - RNA, 23 nt, Human
gggccuguacaaaagggacauga

SEQ ID NO: 3665067 - RNA, 19 nt, Human
gggccuguacagucugucu

SEQ ID NO: 3665068 - RNA, 15 nt, Human
gggccuguacugccu

SEQ ID NO: 3665069 - RNA, 16 nt, Human
gggccuguggaaugag

SEQ ID NO: 3665070 - RNA, 18 nt, Human
gggccuuaggaagagccu

SEQ ID NO: 3665071 - RNA, 17 nt, Human
gggccuuagggcacugg

SEQ ID NO: 3665072 - RNA, 12 nt, Human
gggccuugccca

SEQ ID NO: 3665073 - RNA, 14 nt, Human
gggccuugcccaga

SEQ ID NO: 3665074 - RNA, 14 nt, Human
gggccuuggccugg

SEQ ID NO: 3665075 - RNA, 15 nt, Human
gggccuuggccugga

SEQ ID NO: 3665076 - RNA, 14 nt, Human
gggccuugggcucc

SEQ ID NO: 3665077 - RNA, 18 nt, Human
gggccuuuucuggcaccg

SEQ ID NO: 3665078 - RNA, 20 nt, Human
gggcgaccccgucacagccu

SEQ ID NO: 3665079 - RNA, 20 nt, Human
gggcgagacuccgucucaaa

SEQ ID NO: 3665080 - RNA, 20 nt, Human
gggcgagacucugucucaaa

SEQ ID NO: 3665081 - RNA, 12 nt, Human
gggcgaggcagg

SEQ ID NO: 3665082 - RNA, 22 nt, Human
gggcgaucgcggcggagcuggc

SEQ ID NO: 3665083 - RNA, 14 nt, Human
gggcgcccuggaag

SEQ ID NO: 3665084 - RNA, 15 nt, Human
gggcgcccuggaagc

SEQ ID NO: 3665085 - RNA, 22 nt, Human
gggcgccgcaaaccacacugga

SEQ ID NO: 3665086 - RNA, 15 nt, Human
gggcgcggccagccc

SEQ ID NO: 3665087 - RNA, 13 nt, Human
gggcgcuggccca

SEQ ID NO: 3665088 - RNA, 23 nt, Human
gggcgcuggcccagccggccucu

SEQ ID NO: 3665089 - RNA, 17 nt, Human
gggcggcaggggccugg

SEQ ID NO: 3665090 - RNA, 22 nt, Human
gggcggccuaugacuugggcac

SEQ ID NO: 3665091 - RNA, 21 nt, Human
gggcggugagaggggaacaga

SEQ ID NO: 3665092 - RNA, 18 nt, Human
gggcgugagaccugcccc

SEQ ID NO: 3665093 - RNA, 23 nt, Human
gggcuaagagcuagcgcugccgc

SEQ ID NO: 3665094 - RNA, 15 nt, Human
gggcuaccaggaaag

SEQ ID NO: 3665095 - RNA, 20 nt, Human
gggcuacccugagcugaggc

SEQ ID NO: 3665096 - RNA, 16 nt, Human
gggcuagaaccuggca

SEQ ID NO: 3665097 - RNA, 12 nt, Human
gggcuagaaucu

SEQ ID NO: 3665098 - RNA, 20 nt, Human
gggcuaggaaauccagggug

SEQ ID NO: 3665099 - RNA, 14 nt, Human
gggcuagggagacg

SEQ ID NO: 3665100 - RNA, 15 nt, Human
gggcuaguugggcuu

SEQ ID NO: 3665101 - RNA, 14 nt, Human
gggcuauggacaca

SEQ ID NO: 3665102 - RNA, 15 nt, Human
gggcuauggacacag

SEQ ID NO: 3665103 - RNA, 16 nt, Human
gggcucaagcagucua

SEQ ID NO: 3665104 - RNA, 14 nt, Human
gggcucacacaccu

SEQ ID NO: 3665105 - RNA, 17 nt, Human
gggcucagcaaggccac

SEQ ID NO: 3665106 - RNA, 18 nt, Human
gggcucagcaaggccacc

SEQ ID NO: 3665107 - RNA, 18 nt, Human
gggcucagcucuggcuca

SEQ ID NO: 3665108 - RNA, 23 nt, Human
gggcucagcucuggcucacagac

SEQ ID NO: 3665109 - RNA, 22 nt, Human
gggcucaggucacauaaaacuu

SEQ ID NO: 3665110 - RNA, 15 nt, Human
gggcucccagccagg

SEQ ID NO: 3665111 - RNA, 17 nt, Human
gggcucccagccaggcc

SEQ ID NO: 3665112 - RNA, 14 nt, Human
gggcucccaggggu

SEQ ID NO: 3665113 - RNA, 22 nt, Human
gggcucccaggggucucccugg

SEQ ID NO: 3665114 - RNA, 16 nt, Human
gggcuccccucuuccu

SEQ ID NO: 3665115 - RNA, 18 nt, Human
gggcuccccucuuccucu

SEQ ID NO: 3665116 - RNA, 21 nt, Human
gggcuccccuucgcguauuuc

SEQ ID NO: 3665117 - RNA, 13 nt, Human
gggcucccgcccg

SEQ ID NO: 3665118 - RNA, 19 nt, Human
gggcucccggguccuuggc

SEQ ID NO: 3665119 - RNA, 12 nt, Human
gggcucccugac

SEQ ID NO: 3665120 - RNA, 21 nt, Human
gggcucccuguaaccucuuca

SEQ ID NO: 3665121 - RNA, 17 nt, Human
gggcuccgugugggaga

SEQ ID NO: 3665122 - RNA, 14 nt, Human
gggcuccucccagc

SEQ ID NO: 3665123 - RNA, 22 nt, Human
gggcuccugcacuuacuugcuu

SEQ ID NO: 3665124 - RNA, 13 nt, Human
gggcuccuggacc

SEQ ID NO: 3665125 - RNA, 20 nt, Human
gggcuccuucuccaccccag

SEQ ID NO: 3665126 - RNA, 20 nt, Human
gggcuccuugugggccuggg

SEQ ID NO: 3665127 - RNA, 20 nt, Human
gggcuccuuucuccagccag

SEQ ID NO: 3665128 - RNA, 20 nt, Human
gggcucgaggggugggcugg

SEQ ID NO: 3665129 - RNA, 20 nt, Human
gggcucgccaugccgggggu

SEQ ID NO: 3665130 - RNA, 15 nt, Human
gggcucuaacgccug

SEQ ID NO: 3665131 - RNA, 16 nt, Human
gggcucuaacgccuga

SEQ ID NO: 3665132 - RNA, 17 nt, Human
gggcucuaacgccugag

SEQ ID NO: 3665133 - RNA, 19 nt, Human
gggcucuaacgccugagcc

SEQ ID NO: 3665134 - RNA, 20 nt, Human
gggcucuaacgccugagccc

SEQ ID NO: 3665135 - RNA, 13 nt, Human
gggcucuccaccu

SEQ ID NO: 3665136 - RNA, 19 nt, Human
gggcucucugcuguacaua

SEQ ID NO: 3665137 - RNA, 11 nt, Human
gggcucugagu

SEQ ID NO: 3665138 - RNA, 16 nt, Human
gggcucugaguacccc

SEQ ID NO: 3665139 - RNA, 15 nt, Human
gggcucugccacccu

SEQ ID NO: 3665140 - RNA, 21 nt, Human
gggcucugccccagcucuggc

SEQ ID NO: 3665141 - RNA, 15 nt, Human
gggcucugccccagu

SEQ ID NO: 3665142 - RNA, 21 nt, Human
gggcucugcccucccuccuuc

SEQ ID NO: 3665143 - RNA, 15 nt, Human
gggcucugccuccca

SEQ ID NO: 3665144 - RNA, 16 nt, Human
gggcucugugcaguca

SEQ ID NO: 3665145 - RNA, 14 nt, Human
gggcucugugggcu

SEQ ID NO: 3665146 - RNA, 23 nt, Human
gggcugaccuuccucgcagagag

SEQ ID NO: 3665147 - RNA, 14 nt, Human
gggcugacugggac

SEQ ID NO: 3665148 - RNA, 20 nt, Human
gggcugacugggccagggga

SEQ ID NO: 3665149 - RNA, 16 nt, Human
gggcugagcccuggca

SEQ ID NO: 3665150 - RNA, 13 nt, Human
gggcugagccugg

SEQ ID NO: 3665151 - RNA, 18 nt, Human
gggcugaggagcagcagg

SEQ ID NO: 3665152 - RNA, 14 nt, Human
gggcugagggagcc

SEQ ID NO: 3665153 - RNA, 17 nt, Human
gggcugagggccugcug

SEQ ID NO: 3665154 - RNA, 18 nt, Human
gggcugagggccugcugg

SEQ ID NO: 3665155 - RNA, 14 nt, Human
gggcugaucucagg

SEQ ID NO: 3665156 - RNA, 16 nt, Human
gggcugaucucaggga

SEQ ID NO: 3665157 - RNA, 14 nt, Human
gggcugcaccggcu

SEQ ID NO: 3665158 - RNA, 17 nt, Human
gggcugcaccggcuggc

SEQ ID NO: 3665159 - RNA, 19 nt, Human
gggcugcaccggcuggccu

SEQ ID NO: 3665160 - RNA, 18 nt, Human
gggcugcacucugugccc

SEQ ID NO: 3665161 - RNA, 19 nt, Human
gggcugcagcauguugcug

SEQ ID NO: 3665162 - RNA, 21 nt, Human
ggucccaagcugggccccagc

SEQ ID NO: 3665163 - RNA, 23 nt, Human
ggucccaaggcaaggggugccug

SEQ ID NO: 3665164 - RNA, 19 nt, Human
ggucccacaaaugggcgcc

SEQ ID NO: 3665165 - RNA, 19 nt, Human
gacagaugccuccuuccuc

SEQ ID NO: 3665166 - RNA, 14 nt, Human
gacagauuaauauu

SEQ ID NO: 3665167 - RNA, 20 nt, Human
gacagauucagucuugccuu

SEQ ID NO: 3665168 - RNA, 22 nt, Human
gacagcaacggggaggccaagu

SEQ ID NO: 3665169 - RNA, 15 nt, Human
gacagcagcucaggc

SEQ ID NO: 3665170 - RNA, 17 nt, Human
gacagcaggcagcgcca

SEQ ID NO: 3665171 - RNA, 23 nt, Human
gacagcagucuuaugcuuccaga

SEQ ID NO: 3665172 - RNA, 21 nt, Human
gacagcauggugcaugccgcu

SEQ ID NO: 3665173 - RNA, 22 nt, Human
gacagcauggugcaugccgcug

SEQ ID NO: 3665174 - RNA, 17 nt, Human
gacagccaaaggcuggc

SEQ ID NO: 3665175 - RNA, 22 nt, Human
gacagccaacuauggccugugg

SEQ ID NO: 3665176 - RNA, 14 nt, Human
gacagccacggcca

SEQ ID NO: 3665177 - RNA, 20 nt, Human
gacagccacggccaggccag

SEQ ID NO: 3665178 - RNA, 21 nt, Human
gacagccacggccaggccaga

SEQ ID NO: 3665179 - RNA, 11 nt, Human
gacagcccaga

SEQ ID NO: 3665180 - RNA, 21 nt, Human
gacagcccaggauacuggcac

SEQ ID NO: 3665181 - RNA, 15 nt, Human
gacagccccacccug

SEQ ID NO: 3665182 - RNA, 15 nt, Human
gacagccccucccuc

SEQ ID NO: 3665183 - RNA, 17 nt, Human
gacagccccucccuccu

SEQ ID NO: 3665184 - RNA, 19 nt, Human
gacagcccgauccuccccu

SEQ ID NO: 3665185 - RNA, 13 nt, Human
gacagcccgggcu

SEQ ID NO: 3665186 - RNA, 19 nt, Human
gacagcccgggcucugccu

SEQ ID NO: 3665187 - RNA, 13 nt, Human
gacagcccuccau

SEQ ID NO: 3665188 - RNA, 21 nt, Human
gacagcccuucuuuccacaga

SEQ ID NO: 3665189 - RNA, 19 nt, Human
gacagccucagugacccug

SEQ ID NO: 3665190 - RNA, 20 nt, Human
gacagccucccccugucccc

SEQ ID NO: 3665191 - RNA, 11 nt, Human
gacagccuggc

SEQ ID NO: 3665192 - RNA, 20 nt, Human
gacagccuguggcggugccu

SEQ ID NO: 3665193 - RNA, 18 nt, Human
gacagcucccucugccug

SEQ ID NO: 3665194 - RNA, 16 nt, Human
gacagcuccuucuguc

SEQ ID NO: 3665195 - RNA, 12 nt, Human
gacagcucugca

SEQ ID NO: 3665196 - RNA, 17 nt, Human
gacagcugauacuucau

SEQ ID NO: 3665197 - RNA, 12 nt, Human
gacagcugccug

SEQ ID NO: 3665198 - RNA, 13 nt, Human
gacagcugccugg

SEQ ID NO: 3665199 - RNA, 17 nt, Human
gacagcugcuccuagag

SEQ ID NO: 3665200 - RNA, 15 nt, Human
gacagcugucccugu

SEQ ID NO: 3665201 - RNA, 16 nt, Human
gacagcugucccuguc

SEQ ID NO: 3665202 - RNA, 18 nt, Human
gacagcugucccugucac

SEQ ID NO: 3665203 - RNA, 14 nt, Human
gacagcugugccuc

SEQ ID NO: 3665204 - RNA, 15 nt, Human
gacagcuuugcugcu

SEQ ID NO: 3665205 - RNA, 16 nt, Human
gacagcuuugcugcug

SEQ ID NO: 3665206 - RNA, 17 nt, Human
gacaggaaagggaaggc

SEQ ID NO: 3665207 - RNA, 16 nt, Human
gacaggacagcauggu

SEQ ID NO: 3665208 - RNA, 16 nt, Human
gacaggaccccagcuc

SEQ ID NO: 3665209 - RNA, 17 nt, Human
gacaggaccccagcucu

SEQ ID NO: 3665210 - RNA, 17 nt, Human
gacaggaccccugcagu

SEQ ID NO: 3665211 - RNA, 23 nt, Human
gacaggacuaacacucagaagcc

SEQ ID NO: 3665212 - RNA, 20 nt, Human
gacaggagggcaagggccau

SEQ ID NO: 3665213 - RNA, 13 nt, Human
gacaggauccagg

SEQ ID NO: 3665214 - RNA, 14 nt, Human
gacaggauguguuu

SEQ ID NO: 3665215 - RNA, 18 nt, Human
gacaggauguuugcucag

SEQ ID NO: 3665216 - RNA, 16 nt, Human
gacaggcaaauaaaag

SEQ ID NO: 3665217 - RNA, 13 nt, Human
gacaggcaagcac

SEQ ID NO: 3665218 - RNA, 18 nt, Human
gacaggcaagcaccuccu

SEQ ID NO: 3665219 - RNA, 21 nt, Human
gacaggcaagcaccuccugcc

SEQ ID NO: 3665220 - RNA, 15 nt, Human
gacaggcagccugga

SEQ ID NO: 3665221 - RNA, 18 nt, Human
gacaggcauguucucuga

SEQ ID NO: 3665222 - RNA, 22 nt, Human
gacaggcauguucucugaggac

SEQ ID NO: 3665223 - RNA, 15 nt, Human
gacaggccagguggu

SEQ ID NO: 3665224 - RNA, 19 nt, Human
gacaggcgagagaggagcc

SEQ ID NO: 3665225 - RNA, 23 nt, Human
gacaggcgagagaggagccagac

SEQ ID NO: 3665226 - RNA, 18 nt, Human
gacaggcucuuagcagcu

SEQ ID NO: 3665227 - RNA, 15 nt, Human
gacaggcugcggccc

SEQ ID NO: 3665228 - RNA, 21 nt, Human
gacaggcuggaagauagcugu

SEQ ID NO: 3665229 - RNA, 22 nt, Human
gacaggcuggaagauagcugug

SEQ ID NO: 3665230 - RNA, 20 nt, Human
gacagggaacaguauuucca

SEQ ID NO: 3665231 - RNA, 16 nt, Human
gacagggaagagcaga

SEQ ID NO: 3665232 - RNA, 20 nt, Human
gacagggaauuaggccccca

SEQ ID NO: 3665233 - RNA, 13 nt, Human
gacagggacccac

SEQ ID NO: 3665234 - RNA, 19 nt, Human
gacagggacccacuucaca

SEQ ID NO: 3665235 - RNA, 23 nt, Human
gacagggcacaccgggcacucag

SEQ ID NO: 3665236 - RNA, 14 nt, Human
gacagggcauggcc

SEQ ID NO: 3665237 - RNA, 10 nt, Human
gacagggcca

SEQ ID NO: 3665238 - RNA, 11 nt, Human
gacagggccag

SEQ ID NO: 3665239 - RNA, 13 nt, Human
gacagggccagug

SEQ ID NO: 3665240 - RNA, 16 nt, Human
gacagggcgggggugg

SEQ ID NO: 3665241 - RNA, 12 nt, Human
gacagggcuggc

SEQ ID NO: 3665242 - RNA, 17 nt, Human
gacagggcuggcccagc

SEQ ID NO: 3665243 - RNA, 19 nt, Human
gacagggcuggcccagccc

SEQ ID NO: 3665244 - RNA, 14 nt, Human
gacaggguccugcu

SEQ ID NO: 3665245 - RNA, 15 nt, Human
gacaggguccugcua

SEQ ID NO: 3665246 - RNA, 21 nt, Human
gacaggguuuggcugugucua

SEQ ID NO: 3665247 - RNA, 16 nt, Human
gacaggucccuccccu

SEQ ID NO: 3665248 - RNA, 16 nt, Human
gacaggugugccgaca

SEQ ID NO: 3665249 - RNA, 19 nt, Human
gacagguuugggaccccug

SEQ ID NO: 3665250 - RNA, 17 nt, Human
gacaguaacuugguuau

SEQ ID NO: 3665251 - RNA, 21 nt, Human
gacaguaacuugguuauacau

SEQ ID NO: 3665252 - RNA, 18 nt, Human
gacaguaauuguguuuac

SEQ ID NO: 3665253 - RNA, 14 nt, Human
gacaguauauaacu

SEQ ID NO: 3665254 - RNA, 18 nt, Human
gacaguaucccacaucca

SEQ ID NO: 3665255 - RNA, 21 nt, Human
gacaguaucccacauccaacu

SEQ ID NO: 3665256 - RNA, 16 nt, Human
gacagucaaggagugg

SEQ ID NO: 3665257 - RNA, 17 nt, Human
gacagucaucaucaggg

SEQ ID NO: 3665258 - RNA, 21 nt, Human
gacagucaucaucagggccug

SEQ ID NO: 3665259 - RNA, 15 nt, Human
gacaguccagccugg

SEQ ID NO: 3665260 - RNA, 17 nt, Human
gacaguccagccuggag

SEQ ID NO: 3665261 - RNA, 14 nt, Human
gacaguccugggag

SEQ ID NO: 3665262 - RNA, 15 nt, Human
gacaguccugggaga

SEQ ID NO: 3665263 - RNA, 17 nt, Human
gacagucguucccagug

SEQ ID NO: 3665264 - RNA, 13 nt, Human
gacagucucacca

SEQ ID NO: 3665265 - RNA, 23 nt, Human
gacagucuuuggguaccuauuuu

SEQ ID NO: 3665266 - RNA, 22 nt, Human
gacagugaaagaaaauaacaau

SEQ ID NO: 3665267 - RNA, 17 nt, Human
gacagugagguccuggg

SEQ ID NO: 3665268 - RNA, 19 nt, Human
gacagugagguccuggggg

SEQ ID NO: 3665269 - RNA, 19 nt, Human
gacagugauauuggaacuu

SEQ ID NO: 3665270 - RNA, 21 nt, Human
gacagugaucuccauauguua

SEQ ID NO: 3665271 - RNA, 21 nt, Human
gacagugccugggaauguauu

SEQ ID NO: 3665272 - RNA, 18 nt, Human
gacagugcuucagccuga

SEQ ID NO: 3665273 - RNA, 20 nt, Human
gacagugcuucagccugagg

SEQ ID NO: 3665274 - RNA, 15 nt, Human
gacagugggaaauau

SEQ ID NO: 3665275 - RNA, 21 nt, Human
gacaguguuccccgauaccau

SEQ ID NO: 3665276 - RNA, 14 nt, Human
gacaguuaagagaa

SEQ ID NO: 3665277 - RNA, 15 nt, Human
gacaguucacacccu

SEQ ID NO: 3665278 - RNA, 15 nt, Human
gacaguucauaugua

SEQ ID NO: 3665279 - RNA, 17 nt, Human
gacaguucauauguacc

SEQ ID NO: 3665280 - RNA, 18 nt, Human
gacaguucauucagggcc

SEQ ID NO: 3665281 - RNA, 14 nt, Human
gacaguugugcagg

SEQ ID NO: 3665282 - RNA, 19 nt, Human
gacaguuuaccaguugccu

SEQ ID NO: 3665283 - RNA, 23 nt, Human
gacaguuuaccaguugccuuuua

SEQ ID NO: 3665284 - RNA, 19 nt, Human
gacaguuuaucaugaagcc

SEQ ID NO: 3665285 - RNA, 20 nt, Human
gacaguuuaucaugaagccu

SEQ ID NO: 3665286 - RNA, 13 nt, Human
gacaguuuguaaa

SEQ ID NO: 3665287 - RNA, 12 nt, Human
gacauaaagcca

SEQ ID NO: 3665288 - RNA, 14 nt, Human
gacauaaaggaaaa

SEQ ID NO: 3665289 - RNA, 17 nt, Human
gacauaaaggaaaagac

SEQ ID NO: 3665290 - RNA, 22 nt, Human
gacauaaaguugauaaagauuu

SEQ ID NO: 3665291 - RNA, 17 nt, Human
gacauaaccacugcuuc

SEQ ID NO: 3665292 - RNA, 15 nt, Human
gacauacuugaaggg

SEQ ID NO: 3665293 - RNA, 20 nt, Human
gacauacuugaagggccaga

SEQ ID NO: 3665294 - RNA, 22 nt, Human
gacauacuugaagggccagagc

SEQ ID NO: 3665295 - RNA, 20 nt, Human
gacauagauauuuucacaau

SEQ ID NO: 3665296 - RNA, 20 nt, Human
gacauagcauccaaguggca

SEQ ID NO: 3665297 - RNA, 23 nt, Human
gacauaggccaugaaaaaaauga

SEQ ID NO: 3665298 - RNA, 20 nt, Human
gacauauauuuuuuaaaaua

SEQ ID NO: 3665299 - RNA, 20 nt, Human
gacauauucauuuggaaaua

SEQ ID NO: 3665300 - RNA, 11 nt, Human
gacauauuuaa

SEQ ID NO: 3665301 - RNA, 20 nt, Human
gacauauuuaauguuuuaaa

SEQ ID NO: 3665302 - RNA, 21 nt, Human
gacauauuuaauguuuuaaau

SEQ ID NO: 3665303 - RNA, 18 nt, Human
gacaucaaaaaaggcagu

SEQ ID NO: 3665304 - RNA, 19 nt, Human
gacaucaaaaaaggcaguu

SEQ ID NO: 3665305 - RNA, 18 nt, Human
gacaucacagcagccucc

SEQ ID NO: 3665306 - RNA, 18 nt, Human
gaccuaggauaucuucuc

SEQ ID NO: 3665307 - RNA, 21 nt, Human
gaccuagggaggaccuuaucu

SEQ ID NO: 3665308 - RNA, 20 nt, Human
gaccuagggauguucuggcc

SEQ ID NO: 3665309 - RNA, 22 nt, Human
gaccuagggauguucuggcccu

SEQ ID NO: 3665310 - RNA, 21 nt, Human
gaccuauguccuaaggacaca

SEQ ID NO: 3665311 - RNA, 14 nt, Human
gaccuauguuugcu

SEQ ID NO: 3665312 - RNA, 22 nt, Human
gaccuauguuugcucagaacac

SEQ ID NO: 3665313 - RNA, 16 nt, Human
gaccucaaaugaugug

SEQ ID NO: 3665314 - RNA, 20 nt, Human
gaccucacagugacccuucc

SEQ ID NO: 3665315 - RNA, 21 nt, Human
gaccucacagugacccuuccc

SEQ ID NO: 3665316 - RNA, 22 nt, Human
gaccucacagugacccuuccca

SEQ ID NO: 3665317 - RNA, 16 nt, Human
gaccucaccuaggaag

SEQ ID NO: 3665318 - RNA, 17 nt, Human
gaccucaccuaggaagu

SEQ ID NO: 3665319 - RNA, 16 nt, Human
gaccucacugugaccu

SEQ ID NO: 3665320 - RNA, 17 nt, Human
gaccucagaguccaggc

SEQ ID NO: 3665321 - RNA, 11 nt, Human
gaccucagccu

SEQ ID NO: 3665322 - RNA, 16 nt, Human
gaccucagccugugcu

SEQ ID NO: 3665323 - RNA, 19 nt, Human
gaccucagccugugcugcc

SEQ ID NO: 3665324 - RNA, 14 nt, Human
gaccucagccuucc

SEQ ID NO: 3665325 - RNA, 14 nt, Human
gaccucagcugcuu

SEQ ID NO: 3665326 - RNA, 18 nt, Human
gaccucaggcaaucugcc

SEQ ID NO: 3665327 - RNA, 17 nt, Human
gaccucaggcacuagcc

SEQ ID NO: 3665328 - RNA, 18 nt, Human
gaccucaggcacuagccu

SEQ ID NO: 3665329 - RNA, 21 nt, Human
gaccucaggcacuagccuuug

SEQ ID NO: 3665330 - RNA, 19 nt, Human
gaccucaggccugggggcu

SEQ ID NO: 3665331 - RNA, 13 nt, Human
gaccucaggugag

SEQ ID NO: 3665332 - RNA, 19 nt, Human
gaccucaggugagaagcag

SEQ ID NO: 3665333 - RNA, 21 nt, Human
gaccucaggugagaagcagag

SEQ ID NO: 3665334 - RNA, 14 nt, Human
gaccucauccaaac

SEQ ID NO: 3665335 - RNA, 17 nt, Human
gaccucaugcaucucca

SEQ ID NO: 3665336 - RNA, 14 nt, Human
gaccucccagcccu

SEQ ID NO: 3665337 - RNA, 22 nt, Human
gaccucccagcccuauggaugu

SEQ ID NO: 3665338 - RNA, 14 nt, Human
gaccucccccuccu

SEQ ID NO: 3665339 - RNA, 16 nt, Human
gaccucccccuccuuc

SEQ ID NO: 3665340 - RNA, 14 nt, Human
gaccucccuuccga

SEQ ID NO: 3665341 - RNA, 19 nt, Human
gaccucccuuccgacccuc

SEQ ID NO: 3665342 - RNA, 19 nt, Human
gaccucggugggcccagug

SEQ ID NO: 3665343 - RNA, 13 nt, Human
gaccucguccucc

SEQ ID NO: 3665344 - RNA, 15 nt, Human
gaccucguccucccc

SEQ ID NO: 3665345 - RNA, 24 nt, Human
gaccucguccucccccugccagug

SEQ ID NO: 3665346 - RNA, 15 nt, Human
gaccucgugcuuuaa

SEQ ID NO: 3665347 - RNA, 18 nt, Human
gaccucgugcuuuaagug

SEQ ID NO: 3665348 - RNA, 18 nt, Human
gaccucuacuuuccaggc

SEQ ID NO: 3665349 - RNA, 19 nt, Human
gaccucuccaucuucagcu

SEQ ID NO: 3665350 - RNA, 14 nt, Human
gaccucugacagca

SEQ ID NO: 3665351 - RNA, 16 nt, Human
gaccucugacagcagc

SEQ ID NO: 3665352 - RNA, 13 nt, Human
gaccucugggcuu

SEQ ID NO: 3665353 - RNA, 15 nt, Human
gaccucuggguuggg

SEQ ID NO: 3665354 - RNA, 12 nt, Human
gaccucuguugu

SEQ ID NO: 3665355 - RNA, 16 nt, Human
gaccucuguuguccuc

SEQ ID NO: 3665356 - RNA, 12 nt, Human
gaccugaagaau

SEQ ID NO: 3665357 - RNA, 24 nt, Human
gaccugaaggguugacuuuaccca

SEQ ID NO: 3665358 - RNA, 16 nt, Human
gaccugagaauguauc

SEQ ID NO: 3665359 - RNA, 14 nt, Human
gaccugagccugcc

SEQ ID NO: 3665360 - RNA, 18 nt, Human
gaccugagccugccgagc

SEQ ID NO: 3665361 - RNA, 13 nt, Human
gaccugaggcccu

SEQ ID NO: 3665362 - RNA, 20 nt, Human
gaccugaggcuccugugcua

SEQ ID NO: 3665363 - RNA, 17 nt, Human
gaccugaggcugugguc

SEQ ID NO: 3665364 - RNA, 14 nt, Human
gaccugaucacuag

SEQ ID NO: 3665365 - RNA, 14 nt, Human
gaccugauccugga

SEQ ID NO: 3665366 - RNA, 18 nt, Human
gaccugauccuggaggcc

SEQ ID NO: 3665367 - RNA, 16 nt, Human
gaccugcauuguaaau

SEQ ID NO: 3665368 - RNA, 19 nt, Human
gaccugccaggcaggggug

SEQ ID NO: 3665369 - RNA, 20 nt, Human
gaccugccuccugccugccc

SEQ ID NO: 3665370 - RNA, 15 nt, Human
gaccugccucggccu

SEQ ID NO: 3665371 - RNA, 22 nt, Human
gaccugccucucacacacauag

SEQ ID NO: 3665372 - RNA, 16 nt, Human
gaccugcggcugcugu

SEQ ID NO: 3665373 - RNA, 17 nt, Human
gaccugcuaggccagag

SEQ ID NO: 3665374 - RNA, 15 nt, Human
gaccugcuccgcugc

SEQ ID NO: 3665375 - RNA, 21 nt, Human
gaccugcuccgcugcuccuug

SEQ ID NO: 3665376 - RNA, 16 nt, Human
guaaagcuugucugau

SEQ ID NO: 3665377 - RNA, 15 nt, Human
guaaagguuuuuauu

SEQ ID NO: 3665378 - RNA, 22 nt, Human
guaaaguaucaggauacuauau

SEQ ID NO: 3665379 - RNA, 21 nt, Human
guaaaguauguaaacaggaga

SEQ ID NO: 3665380 - RNA, 17 nt, Human
guaaaguauguauuauu

SEQ ID NO: 3665381 - RNA, 15 nt, Human
guaaaguguaacaua

SEQ ID NO: 3665382 - RNA, 17 nt, Human
guaaaguguaacauaug

SEQ ID NO: 3665383 - RNA, 19 nt, Human
guaaaguguaacauaugca

SEQ ID NO: 3665384 - RNA, 11 nt, Human
guaaagugugg

SEQ ID NO: 3665385 - RNA, 23 nt, Human
guaaaguuuccgugcguggcacu

SEQ ID NO: 3665386 - RNA, 13 nt, Human
guaaauaaaaaga

SEQ ID NO: 3665387 - RNA, 14 nt, Human
guaaauaaaaagaa

SEQ ID NO: 3665388 - RNA, 18 nt, Human
guaaauaaauuguuugac

SEQ ID NO: 3665389 - RNA, 20 nt, Human
guaaauaaccccauucuuug

SEQ ID NO: 3665390 - RNA, 20 nt, Human
guaaauaacuggaaaacaga

SEQ ID NO: 3665391 - RNA, 19 nt, Human
guaaauaagagauuuggag

SEQ ID NO: 3665392 - RNA, 14 nt, Human
guaaauaauacauu

SEQ ID NO: 3665393 - RNA, 15 nt, Human
guaaauaauucuuuu

SEQ ID NO: 3665394 - RNA, 18 nt, Human
guaaauacaaguucuauu

SEQ ID NO: 3665395 - RNA, 20 nt, Human
guaaauacaaguucuauuua

SEQ ID NO: 3665396 - RNA, 19 nt, Human
guaaauacaauuuuuuuua

SEQ ID NO: 3665397 - RNA, 21 nt, Human
guaaauacaauuuuuuuuauu

SEQ ID NO: 3665398 - RNA, 17 nt, Human
guaaauacaugcauaua

SEQ ID NO: 3665399 - RNA, 16 nt, Human
guaaauacccauaugu

SEQ ID NO: 3665400 - RNA, 18 nt, Human
guaaauagcaacaugcuu

SEQ ID NO: 3665401 - RNA, 20 nt, Human
guaaauaggauuuuuagaau

SEQ ID NO: 3665402 - RNA, 17 nt, Human
guaaauagguucuucuu

SEQ ID NO: 3665403 - RNA, 17 nt, Human
guaaauaguauuugaga

SEQ ID NO: 3665404 - RNA, 20 nt, Human
guaaauaguuacuccagugc

SEQ ID NO: 3665405 - RNA, 15 nt, Human
guaaauauaaagacg

SEQ ID NO: 3665406 - RNA, 16 nt, Human
guaaauauaugaacau

SEQ ID NO: 3665407 - RNA, 21 nt, Human
guaaauaucccaaacugugau

SEQ ID NO: 3665408 - RNA, 16 nt, Human
guaaauaugaaucugc

SEQ ID NO: 3665409 - RNA, 13 nt, Human
guaaauauuuuaa

SEQ ID NO: 3665410 - RNA, 23 nt, Human
guaaauauuuuaaagaauugugu

SEQ ID NO: 3665411 - RNA, 21 nt, Human
guaaaucacgcuuuuugaaaa

SEQ ID NO: 3665412 - RNA, 21 nt, Human
guaaaucccauuauucaaagu

SEQ ID NO: 3665413 - RNA, 20 nt, Human
guaaauccugccauuuaaaa

SEQ ID NO: 3665414 - RNA, 21 nt, Human
guaaaucuaacauuauuacuu

SEQ ID NO: 3665415 - RNA, 13 nt, Human
guaaaucuacaca

SEQ ID NO: 3665416 - RNA, 19 nt, Human
guaaaucucuucuguguuu

SEQ ID NO: 3665417 - RNA, 17 nt, Human
guaaaugcagcgugaag

SEQ ID NO: 3665418 - RNA, 20 nt, Human
guaaaugggggugcauuuga

SEQ ID NO: 3665419 - RNA, 12 nt, Human
guaaauguaaac

SEQ ID NO: 3665420 - RNA, 18 nt, Human
guaaauguuauuucugca

SEQ ID NO: 3665421 - RNA, 20 nt, Human
guaaauguuauuucugcaaa

SEQ ID NO: 3665422 - RNA, 23 nt, Human
guaaauuaccaguaaaguguaac

SEQ ID NO: 3665423 - RNA, 23 nt, Human
guaaauuauauuugugcuauagu

SEQ ID NO: 3665424 - RNA, 22 nt, Human
guaaauuauucaguuaagaaaa

SEQ ID NO: 3665425 - RNA, 17 nt, Human
guaaauuauuuuaaauu

SEQ ID NO: 3665426 - RNA, 21 nt, Human
guaaauuauuuuaaauuauaa

SEQ ID NO: 3665427 - RNA, 22 nt, Human
guaaauucucuauuuuuuguaa

SEQ ID NO: 3665428 - RNA, 18 nt, Human
guaaauucugauuucuuu

SEQ ID NO: 3665429 - RNA, 19 nt, Human
guaaauuuagcauaucaau

SEQ ID NO: 3665430 - RNA, 17 nt, Human
guaaauuuaugugaugg

SEQ ID NO: 3665431 - RNA, 20 nt, Human
guaaauuuccccaacagugu

SEQ ID NO: 3665432 - RNA, 15 nt, Human
guaaauuuggcuucu

SEQ ID NO: 3665433 - RNA, 16 nt, Human
guaaauuuggcuucug

SEQ ID NO: 3665434 - RNA, 13 nt, Human
guaacaaaaauaa

SEQ ID NO: 3665435 - RNA, 13 nt, Human
guaacaaaugaac

SEQ ID NO: 3665436 - RNA, 16 nt, Human
guaacaagaaaacaua

SEQ ID NO: 3665437 - RNA, 13 nt, Human
guaacaagaaagg

SEQ ID NO: 3665438 - RNA, 21 nt, Human
guaacaagagugauucuugcu

SEQ ID NO: 3665439 - RNA, 16 nt, Human
guaacaagccagauuu

SEQ ID NO: 3665440 - RNA, 17 nt, Human
guaacaauacaaaugga

SEQ ID NO: 3665441 - RNA, 18 nt, Human
guaacaauacaaauggau

SEQ ID NO: 3665442 - RNA, 17 nt, Human
guaacaaugaagauaaa

SEQ ID NO: 3665443 - RNA, 23 nt, Human
guaacacagugccuucaauaaau

SEQ ID NO: 3665444 - RNA, 15 nt, Human
guaacacuaauauau

SEQ ID NO: 3665445 - RNA, 16 nt, Human
guaacacuaauauauu

SEQ ID NO: 3665446 - RNA, 20 nt, Human
guaacacuagggccuuggaa

SEQ ID NO: 3665447 - RNA, 15 nt, Human
guaacacuccucugc

SEQ ID NO: 3665448 - RNA, 16 nt, Human
guaacacuuuacaaug

SEQ ID NO: 3665449 - RNA, 15 nt, Human
guaacagaaagggca

SEQ ID NO: 3665450 - RNA, 20 nt, Human
gucagacauccauguuugua

SEQ ID NO: 3665451 - RNA, 16 nt, Human
gucagacccuggaggc

SEQ ID NO: 3665452 - RNA, 16 nt, Human
gucagacgccugagga

SEQ ID NO: 3665453 - RNA, 16 nt, Human
gucagacugcugggac

SEQ ID NO: 3665454 - RNA, 22 nt, Human
gucagacugcugggacuggcca

SEQ ID NO: 3665455 - RNA, 24 nt, Human
gucagacugcugggacuggccagg

SEQ ID NO: 3665456 - RNA, 18 nt, Human
gucagacuggcuggcugc

SEQ ID NO: 3665457 - RNA, 15 nt, Human
gucagacuuuaaaga

SEQ ID NO: 3665458 - RNA, 12 nt, Human
gucagagagaau

SEQ ID NO: 3665459 - RNA, 21 nt, Human
gucagaggagagauagccugu

SEQ ID NO: 3665460 - RNA, 16 nt, Human
gucagaggauggccag

SEQ ID NO: 3665461 - RNA, 20 nt, Human
gucagaggauggccaguguc

SEQ ID NO: 3665462 - RNA, 14 nt, Human
gucagauccaggag

SEQ ID NO: 3665463 - RNA, 17 nt, Human
gucagauccaggagcuc

SEQ ID NO: 3665464 - RNA, 18 nt, Human
gucagaucugccuaagga

SEQ ID NO: 3665465 - RNA, 21 nt, Human
gucagaucugccuaaggacuu

SEQ ID NO: 3665466 - RNA, 16 nt, Human
gucagaugagaacaaa

SEQ ID NO: 3665467 - RNA, 22 nt, Human
gucagaugagaacaaagcuguu

SEQ ID NO: 3665468 - RNA, 16 nt, Human
gucagauuccuuuccc

SEQ ID NO: 3665469 - RNA, 17 nt, Human
gucagauucuugcaucc

SEQ ID NO: 3665470 - RNA, 14 nt, Human
gucagauuuccagu

SEQ ID NO: 3665471 - RNA, 20 nt, Human
gucagcaaaaagcaaaauca

SEQ ID NO: 3665472 - RNA, 17 nt, Human
gucagcaaauuaauugg

SEQ ID NO: 3665473 - RNA, 20 nt, Human
gucagcagccucccugaaga

SEQ ID NO: 3665474 - RNA, 10 nt, Human
gucagccagg

SEQ ID NO: 3665475 - RNA, 12 nt, Human
gucagccagggc

SEQ ID NO: 3665476 - RNA, 23 nt, Human
gucagcccaaaccaccagaagcc

SEQ ID NO: 3665477 - RNA, 17 nt, Human
gucagccgggcccugag

SEQ ID NO: 3665478 - RNA, 15 nt, Human
gucagccuccagccu

SEQ ID NO: 3665479 - RNA, 18 nt, Human
gucagccuccagccucug

SEQ ID NO: 3665480 - RNA, 19 nt, Human
gucagccuccagccucugu

SEQ ID NO: 3665481 - RNA, 21 nt, Human
gucagcgcagguuuaguuuac

SEQ ID NO: 3665482 - RNA, 21 nt, Human
gucagcgccuggccuacccag

SEQ ID NO: 3665483 - RNA, 20 nt, Human
gucagcgugcuuagccuccu

SEQ ID NO: 3665484 - RNA, 15 nt, Human
gucagcguugcaugu

SEQ ID NO: 3665485 - RNA, 14 nt, Human
gucagcuacuaaug

SEQ ID NO: 3665486 - RNA, 19 nt, Human
gucagcuacuaaugauguu

SEQ ID NO: 3665487 - RNA, 23 nt, Human
gucagcuagaucauuuguucugg

SEQ ID NO: 3665488 - RNA, 12 nt, Human
gucagcuccagc

SEQ ID NO: 3665489 - RNA, 13 nt, Human
gucagcuccagcu

SEQ ID NO: 3665490 - RNA, 19 nt, Human
gucagcuccccucggagaa

SEQ ID NO: 3665491 - RNA, 16 nt, Human
gucagcucccuucucu

SEQ ID NO: 3665492 - RNA, 15 nt, Human
gucagcucucugccc

SEQ ID NO: 3665493 - RNA, 16 nt, Human
gucagcucucugcccu

SEQ ID NO: 3665494 - RNA, 17 nt, Human
gucagcugcucccuggc

SEQ ID NO: 3665495 - RNA, 22 nt, Human
gucagcugggacaccccgacuu

SEQ ID NO: 3665496 - RNA, 16 nt, Human
gucagcuuugccuucc

SEQ ID NO: 3665497 - RNA, 17 nt, Human
gucagcuuugccuucca

SEQ ID NO: 3665498 - RNA, 23 nt, Human
gucagcuuugccuuccacgcugu

SEQ ID NO: 3665499 - RNA, 14 nt, Human
gucaggaaagagaa

SEQ ID NO: 3665500 - RNA, 15 nt, Human
gucaggaacagaagg

SEQ ID NO: 3665501 - RNA, 16 nt, Human
gucaggaacagaagga

SEQ ID NO: 3665502 - RNA, 17 nt, Human
gucaggaaggaugagca

SEQ ID NO: 3665503 - RNA, 12 nt, Human
gucaggagagca

SEQ ID NO: 3665504 - RNA, 14 nt, Human
gucaggagagcagc

SEQ ID NO: 3665505 - RNA, 15 nt, Human
gucaggagagcagcg

SEQ ID NO: 3665506 - RNA, 15 nt, Human
gucaggaggcagaag

SEQ ID NO: 3665507 - RNA, 18 nt, Human
gucaggaguccaagacca

SEQ ID NO: 3665508 - RNA, 21 nt, Human
gucaggauugcgagagaugug

SEQ ID NO: 3665509 - RNA, 22 nt, Human
gucaggauugcgagagaugugu

SEQ ID NO: 3665510 - RNA, 23 nt, Human
gucaggauugcgagagaugugug

SEQ ID NO: 3665511 - RNA, 18 nt, Human
gucaggcacugggcauga

SEQ ID NO: 3665512 - RNA, 12 nt, Human
gucaggccacgg

SEQ ID NO: 3665513 - RNA, 18 nt, Human
gucaggccacggcagccu

SEQ ID NO: 3665514 - RNA, 13 nt, Human
gucaggcccuggu

SEQ ID NO: 3665515 - RNA, 22 nt, Human
gucaggcccuuauuuucaagaa

SEQ ID NO: 3665516 - RNA, 13 nt, Human
gucaggccugugu

SEQ ID NO: 3665517 - RNA, 15 nt, Human
gucaggccugugugu

SEQ ID NO: 3665518 - RNA, 19 nt, Human
gucaggcguagaucaccag

SEQ ID NO: 3665519 - RNA, 20 nt, Human
gucaggcuaauguuggcaga

SEQ ID NO: 3665520 - RNA, 19 nt, Human
gucaggcucucugggcuga

SEQ ID NO: 3665521 - RNA, 13 nt, Human
gucaggcugcugg

SEQ ID NO: 3665522 - RNA, 20 nt, Human
gucaggcugcuggcgccucu

SEQ ID NO: 3665523 - RNA, 11 nt, Human
gucaggcuggu

SEQ ID NO: 3665524 - RNA, 21 nt, Human
gucagggaccaaggaccccuc

SEQ ID NO: 3665525 - RNA, 22 nt, Human
gucagggagugcuggcucacag

SEQ ID NO: 3665526 - RNA, 12 nt, Human
gucagggcccaa

SEQ ID NO: 3665527 - RNA, 20 nt, Human
gucagggcccaagucccugu

SEQ ID NO: 3665528 - RNA, 19 nt, Human
gucagggcccagaggcuga

SEQ ID NO: 3665529 - RNA, 21 nt, Human
gucagggcccagaggcugagu

SEQ ID NO: 3665530 - RNA, 17 nt, Human
gucaggggcagcugacc

SEQ ID NO: 3665531 - RNA, 21 nt, Human
gucaggggugacacagacuca

SEQ ID NO: 3665532 - RNA, 22 nt, Human
gucagguggggcagcuugaggg

SEQ ID NO: 3665533 - RNA, 19 nt, Human
gucagguuauacuccuccu

SEQ ID NO: 3665534 - RNA, 15 nt, Human
gucagguuuaacauu

SEQ ID NO: 3665535 - RNA, 16 nt, Human
gucagguuuaacauuu

SEQ ID NO: 3665536 - RNA, 13 nt, Human
gucagguuugagu

SEQ ID NO: 3665537 - RNA, 13 nt, Human
gucaguacccacc

SEQ ID NO: 3665538 - RNA, 14 nt, Human
gucaguauccaggc

SEQ ID NO: 3665539 - RNA, 16 nt, Human
gucaguauccaggcuu

SEQ ID NO: 3665540 - RNA, 14 nt, Human
gucaguauuguuuu

SEQ ID NO: 3665541 - RNA, 16 nt, Human
gucaguauuguuuugg

SEQ ID NO: 3665542 - RNA, 13 nt, Human
gucagucacagcc

SEQ ID NO: 3665543 - RNA, 16 nt, Human
gucagucacagccacc

SEQ ID NO: 3665544 - RNA, 19 nt, Human
gucagucaugauggcacca

SEQ ID NO: 3665545 - RNA, 21 nt, Human
gucaguccaagggguccccuc

SEQ ID NO: 3665546 - RNA, 16 nt, Human
guacaaaauaaacaaa

SEQ ID NO: 3665547 - RNA, 20 nt, Human
guacaaaauccagcuaugaa

SEQ ID NO: 3665548 - RNA, 14 nt, Human
guacaaaauuaagc

SEQ ID NO: 3665549 - RNA, 20 nt, Human
guacaaaguauuaagcauau

SEQ ID NO: 3665550 - RNA, 21 nt, Human
guacaaaguauuaagcauaua

SEQ ID NO: 3665551 - RNA, 13 nt, Human
guacaaauauaag

SEQ ID NO: 3665552 - RNA, 22 nt, Human
guacaaauauaagaauaaaaug

SEQ ID NO: 3665553 - RNA, 22 nt, Human
guacaaauuauaaaaagccacu

SEQ ID NO: 3665554 - RNA, 23 nt, Human
guacaacggaggccugcgacccu

SEQ ID NO: 3665555 - RNA, 21 nt, Human
guacaagaagcauuuuguaag

SEQ ID NO: 3665556 - RNA, 17 nt, Human
guacaaggcgaucccau

SEQ ID NO: 3665557 - RNA, 13 nt, Human
guacaaguaguuc

SEQ ID NO: 3665558 - RNA, 21 nt, Human
guacaaguaguucuguauuug

SEQ ID NO: 3665559 - RNA, 12 nt, Human
guacaauauuua

SEQ ID NO: 3665560 - RNA, 15 nt, Human
guacaauauuuuaag

SEQ ID NO: 3665561 - RNA, 19 nt, Human
guacaauauuuuaagcauu

SEQ ID NO: 3665562 - RNA, 21 nt, Human
guacacaacuaguuuuguuua

SEQ ID NO: 3665563 - RNA, 20 nt, Human
guacacaauaagcaaaaaca

SEQ ID NO: 3665564 - RNA, 16 nt, Human
guacacagcaccagaa

SEQ ID NO: 3665565 - RNA, 15 nt, Human
guacacguguccugu

SEQ ID NO: 3665566 - RNA, 20 nt, Human
guacacucugagugaaagga

SEQ ID NO: 3665567 - RNA, 15 nt, Human
guacacugaauauuu

SEQ ID NO: 3665568 - RNA, 23 nt, Human
guacacugccuucucaacuccaa

SEQ ID NO: 3665569 - RNA, 18 nt, Human
guacacuguuucaaacuu

SEQ ID NO: 3665570 - RNA, 14 nt, Human
guacacuugugaau

SEQ ID NO: 3665571 - RNA, 14 nt, Human
guacagaauauuuc

SEQ ID NO: 3665572 - RNA, 18 nt, Human
guacagaaucauugcuua

SEQ ID NO: 3665573 - RNA, 23 nt, Human
guacagacagagaauaugucugc

SEQ ID NO: 3665574 - RNA, 17 nt, Human
guacagacguaugcuua

SEQ ID NO: 3665575 - RNA, 20 nt, Human
guacagagaacuaacacuau

SEQ ID NO: 3665576 - RNA, 21 nt, Human
guacagagaacuaacacuauu

SEQ ID NO: 3665577 - RNA, 15 nt, Human
guacagagaagccag

SEQ ID NO: 3665578 - RNA, 19 nt, Human
guacagagaagccagcuug

SEQ ID NO: 3665579 - RNA, 15 nt, Human
guacagagaagccau

SEQ ID NO: 3665580 - RNA, 16 nt, Human
guacagagaagccauc

SEQ ID NO: 3665581 - RNA, 20 nt, Human
guacagagaccucccuguuc

SEQ ID NO: 3665582 - RNA, 18 nt, Human
guacagagcccacgcccc

SEQ ID NO: 3665583 - RNA, 19 nt, Human
guacagaguggaauaagac

SEQ ID NO: 3665584 - RNA, 19 nt, Human
guacagauugcugcuucug

SEQ ID NO: 3665585 - RNA, 15 nt, Human
guacagcaugugccu

SEQ ID NO: 3665586 - RNA, 12 nt, Human
guacagcccaga

SEQ ID NO: 3665587 - RNA, 14 nt, Human
guacagcccagagg

SEQ ID NO: 3665588 - RNA, 16 nt, Human
guacagcccagaggcc

SEQ ID NO: 3665589 - RNA, 18 nt, Human
guacagcuguuuaagaug

SEQ ID NO: 3665590 - RNA, 18 nt, Human
guacaggaugcuuugguu

SEQ ID NO: 3665591 - RNA, 15 nt, Human
guacaggcagcacag

SEQ ID NO: 3665592 - RNA, 16 nt, Human
guacaggguuaucugc

SEQ ID NO: 3665593 - RNA, 16 nt, Human
guacaggguuuuuacc

SEQ ID NO: 3665594 - RNA, 14 nt, Human
guacagguacuuug

SEQ ID NO: 3665595 - RNA, 13 nt, Human
gagaaacagagac

SEQ ID NO: 3665596 - RNA, 17 nt, Human
gagaaacaguugguaac

SEQ ID NO: 3665597 - RNA, 22 nt, Human
gagaaacaguugguaacuuuug

SEQ ID NO: 3665598 - RNA, 14 nt, Human
gagaaaccagcuuc

SEQ ID NO: 3665599 - RNA, 23 nt, Human
guauaaaaucagccaauuauguu

SEQ ID NO: 3665600 - RNA, 16 nt, Human
guauaaacaagaaaaa

SEQ ID NO: 3665601 - RNA, 13 nt, Human
guauaaacauuaa

SEQ ID NO: 3665602 - RNA, 13 nt, Human
guauaaacuauca

SEQ ID NO: 3665603 - RNA, 17 nt, Human
guauaaacuaucaguuu

SEQ ID NO: 3665604 - RNA, 22 nt, Human
guauaaagaauaggacuuguuu

SEQ ID NO: 3665605 - RNA, 17 nt, Human
guauaaagaauuguggu

SEQ ID NO: 3665606 - RNA, 18 nt, Human
guauaaagcaacuguuau

SEQ ID NO: 3665607 - RNA, 20 nt, Human
guauaaagcaacuguuauga

SEQ ID NO: 3665608 - RNA, 21 nt, Human
guauaaagcaacuguuaugaa

SEQ ID NO: 3665609 - RNA, 23 nt, Human
guauaaagcaacuguuaugaaau

SEQ ID NO: 3665610 - RNA, 18 nt, Human
guauaaauaggagaggau

SEQ ID NO: 3665611 - RNA, 17 nt, Human
guauaaaugguugucug

SEQ ID NO: 3665612 - RNA, 12 nt, Human
guauaaauguau

SEQ ID NO: 3665613 - RNA, 13 nt, Human
guauaaauguaua

SEQ ID NO: 3665614 - RNA, 16 nt, Human
guauaaauguauauac

SEQ ID NO: 3665615 - RNA, 18 nt, Human
guauaaauguauauacac

SEQ ID NO: 3665616 - RNA, 19 nt, Human
guauaaauguauauacaca

SEQ ID NO: 3665617 - RNA, 13 nt, Human
guauaaauuuauu

SEQ ID NO: 3665618 - RNA, 20 nt, Human
guauaacacaauaugaauac

SEQ ID NO: 3665619 - RNA, 18 nt, Human
guauaacccuguuacaaa

SEQ ID NO: 3665620 - RNA, 21 nt, Human
guauaacuuuaacuucuguuu

SEQ ID NO: 3665621 - RNA, 15 nt, Human
guauaaguaagaaaa

SEQ ID NO: 3665622 - RNA, 20 nt, Human
guauaaguggaggcacuuua

SEQ ID NO: 3665623 - RNA, 15 nt, Human
guauaaguggugugu

SEQ ID NO: 3665624 - RNA, 14 nt, Human
guauaauaaaauua

SEQ ID NO: 3665625 - RNA, 13 nt, Human
guauaauacuuug

SEQ ID NO: 3665626 - RNA, 12 nt, Human
guauaauauaaa

SEQ ID NO: 3665627 - RNA, 21 nt, Human
guauaaugguugacuggguuu

SEQ ID NO: 3665628 - RNA, 23 nt, Human
guauaaugguugacuggguuucu

SEQ ID NO: 3665629 - RNA, 13 nt, Human
guauaauguuuau

SEQ ID NO: 3665630 - RNA, 15 nt, Human
guauaauuaacaugu

SEQ ID NO: 3665631 - RNA, 17 nt, Human
guauaauucacauugua

SEQ ID NO: 3665632 - RNA, 18 nt, Human
guauaauuggauuuccua

SEQ ID NO: 3665633 - RNA, 14 nt, Human
guauaauuguguga

SEQ ID NO: 3665634 - RNA, 21 nt, Human
guauaauuucgagauuuguag

SEQ ID NO: 3665635 - RNA, 22 nt, Human
guauaauuuuuuaaaguuacuu

SEQ ID NO: 3665636 - RNA, 23 nt, Human
guauacaccauauacuguucuuc

SEQ ID NO: 3665637 - RNA, 15 nt, Human
guauacguuuuucag

SEQ ID NO: 3665638 - RNA, 23 nt, Human
guauacuagggagccauuugaga

SEQ ID NO: 3665639 - RNA, 12 nt, Human
guauacuuuagu

SEQ ID NO: 3665640 - RNA, 14 nt, Human
guauacuuuaguau

SEQ ID NO: 3665641 - RNA, 14 nt, Human
guauagaaaugcug

SEQ ID NO: 3665642 - RNA, 15 nt, Human
guauagaauaggcac

SEQ ID NO: 3665643 - RNA, 19 nt, Human
guauagacaguuuguaaau

SEQ ID NO: 3665644 - RNA, 15 nt, Human
guauagagauaugca

SEQ ID NO: 3665645 - RNA, 16 nt, Human
guauagauguugcuaa

SEQ ID NO: 3665646 - RNA, 15 nt, Human
guauagcuguauuga

SEQ ID NO: 3665647 - RNA, 16 nt, Human
guauagcuguauugaa

SEQ ID NO: 3665648 - RNA, 17 nt, Human
guauagcuguauugaau

SEQ ID NO: 3665649 - RNA, 19 nt, Human
guauagcuguauugaauca

SEQ ID NO: 3665650 - RNA, 18 nt, Human
guauagguagauguucag

SEQ ID NO: 3665651 - RNA, 16 nt, Human
guauaguauuugaaaa

SEQ ID NO: 3665652 - RNA, 14 nt, Human
guauaguguaaaau

SEQ ID NO: 3665653 - RNA, 18 nt, Human
guauaguuauguaaauaa

SEQ ID NO: 3665654 - RNA, 12 nt, Human
guauaguugcuu

SEQ ID NO: 3665655 - RNA, 20 nt, Human
guauauaaugguuucaaaga

SEQ ID NO: 3665656 - RNA, 12 nt, Human
guauauacacau

SEQ ID NO: 3665657 - RNA, 16 nt, Human
guauauacacauauac

SEQ ID NO: 3665658 - RNA, 23 nt, Human
guauauacacccaagaugggcau

SEQ ID NO: 3665659 - RNA, 19 nt, Human
guauauauaagaaagacau

SEQ ID NO: 3665660 - RNA, 17 nt, Human
guauauauacauaacag

SEQ ID NO: 3665661 - RNA, 13 nt, Human
guauauaugugua

SEQ ID NO: 3665662 - RNA, 16 nt, Human
guauauauguguauau

SEQ ID NO: 3665663 - RNA, 23 nt, Human
guauauauguguauauauacaua

SEQ ID NO: 3665664 - RNA, 18 nt, Human
guauauauguguguuuaa

SEQ ID NO: 3665665 - RNA, 11 nt, Human
guauauauuua

SEQ ID NO: 3665666 - RNA, 22 nt, Human
guauauauuuugugugaaauug

SEQ ID NO: 3665667 - RNA, 14 nt, Human
guauaucagaaaag

SEQ ID NO: 3665668 - RNA, 19 nt, Human
guauaucauucuaaagaua

SEQ ID NO: 3665669 - RNA, 12 nt, Human
guauaucguuau

SEQ ID NO: 3665670 - RNA, 23 nt, Human
guauaucuagguuuaugacagua

SEQ ID NO: 3665671 - RNA, 21 nt, Human
guauaucuggacaagccaacu

SEQ ID NO: 3665672 - RNA, 14 nt, Human
guauaucugggcug

SEQ ID NO: 3665673 - RNA, 18 nt, Human
guauauggugguaauaag

SEQ ID NO: 3665674 - RNA, 23 nt, Human
guauauguagauguaugcacaca

SEQ ID NO: 3665675 - RNA, 22 nt, Human
guauaugucaagccauaauugu

SEQ ID NO: 3665676 - RNA, 15 nt, Human
guauaugucucaggu

SEQ ID NO: 3665677 - RNA, 21 nt, Human
guauaugucucaggucccugc

SEQ ID NO: 3665678 - RNA, 16 nt, Human
guauauguugggugca

SEQ ID NO: 3665679 - RNA, 19 nt, Human
guauauuaaaaaagagaca

SEQ ID NO: 3665680 - RNA, 15 nt, Human
guauauuaaaaaugg

SEQ ID NO: 3665681 - RNA, 16 nt, Human
guauauuaaaaauggu

SEQ ID NO: 3665682 - RNA, 21 nt, Human
guauauuaaaaaugguaaaau

SEQ ID NO: 3665683 - RNA, 13 nt, Human
guauauuacaaug

SEQ ID NO: 3665684 - RNA, 15 nt, Human
guauauuacaaugau

SEQ ID NO: 3665685 - RNA, 12 nt, Human
guauauuauaau

SEQ ID NO: 3665686 - RNA, 16 nt, Human
guauauuauguauuua

SEQ ID NO: 3665687 - RNA, 11 nt, Human
guauauuauuu

SEQ ID NO: 3665688 - RNA, 12 nt, Human
guauauucacuu

SEQ ID NO: 3665689 - RNA, 15 nt, Human
guauauucauauauu

SEQ ID NO: 3665690 - RNA, 13 nt, Human
guauauugguuuu

SEQ ID NO: 3665691 - RNA, 13 nt, Human
guauauuguguuu

SEQ ID NO: 3665692 - RNA, 13 nt, Human
guauauuuauagu

SEQ ID NO: 3665693 - RNA, 19 nt, Human
guauauuuauauaauuaug

SEQ ID NO: 3665694 - RNA, 14 nt, Human
guauauuuguacaa

SEQ ID NO: 3665695 - RNA, 14 nt, Human
guauauuuguauau

SEQ ID NO: 3665696 - RNA, 22 nt, Human
guauauuuguauuuaaaugaaa

SEQ ID NO: 3665697 - RNA, 21 nt, Human
guauauuuuauauuacugaca

SEQ ID NO: 3665698 - RNA, 15 nt, Human
guauauuuuccuaua

SEQ ID NO: 3665699 - RNA, 19 nt, Human
guauauuuuuuuaauuuaa

SEQ ID NO: 3665700 - RNA, 22 nt, Human
guaucaaaaugcucuuauuuca

SEQ ID NO: 3665701 - RNA, 20 nt, Human
guaucaaacagcucaggcug

SEQ ID NO: 3665702 - RNA, 15 nt, Human
guaucaaauaaaauu

SEQ ID NO: 3665703 - RNA, 19 nt, Human
guaucaaauauuagaugug

SEQ ID NO: 3665704 - RNA, 21 nt, Human
guaucaaauauuagaugugau

SEQ ID NO: 3665705 - RNA, 19 nt, Human
guaucaacacacauuuuaa

SEQ ID NO: 3665706 - RNA, 19 nt, Human
guaucaauaccaaauagcu

SEQ ID NO: 3665707 - RNA, 18 nt, Human
guaucaauccuuguucag

SEQ ID NO: 3665708 - RNA, 20 nt, Human
guaucacugucuuuccuaga

SEQ ID NO: 3665709 - RNA, 20 nt, Human
guaucagaauugaaacacuu

SEQ ID NO: 3665710 - RNA, 22 nt, Human
guaucaggacccagaggaaggg

SEQ ID NO: 3665711 - RNA, 18 nt, Human
guaucaggugcugccauc

SEQ ID NO: 3665712 - RNA, 14 nt, Human
guaucaguguuuau

SEQ ID NO: 3665713 - RNA, 15 nt, Human
guaucaguguuuuaa

SEQ ID NO: 3665714 - RNA, 17 nt, Human
guaucaguguuuuaaau

SEQ ID NO: 3665715 - RNA, 19 nt, Human
guaucaguguuuuaaauuc

SEQ ID NO: 3665716 - RNA, 12 nt, Human
guaucauagaaa

SEQ ID NO: 3665717 - RNA, 15 nt, Human
guaucauagaaaugu

SEQ ID NO: 3665718 - RNA, 14 nt, Human
guaucauauauuua

SEQ ID NO: 3665719 - RNA, 11 nt, Human
guaucaugcau

SEQ ID NO: 3665720 - RNA, 17 nt, Human
guaucaugcccugugca

SEQ ID NO: 3665721 - RNA, 19 nt, Human
guauccacuuugcacagcu

SEQ ID NO: 3665722 - RNA, 15 nt, Human
guauccagaauggaa

SEQ ID NO: 3665723 - RNA, 20 nt, Human
guauccagguucccucccag

SEQ ID NO: 3665724 - RNA, 11 nt, Human
guauccaguca

SEQ ID NO: 3665725 - RNA, 15 nt, Human
guauccauauuuuau

SEQ ID NO: 3665726 - RNA, 20 nt, Human
guauccaugggggcagggca

SEQ ID NO: 3665727 - RNA, 17 nt, Human
guauccauuaucaugug

SEQ ID NO: 3665728 - RNA, 18 nt, Human
guauccauuaucaugugu

SEQ ID NO: 3665729 - RNA, 18 nt, Human
guauccccccaucuugcu

SEQ ID NO: 3665730 - RNA, 17 nt, Human
guauccuccagguuuuu

SEQ ID NO: 3665731 - RNA, 20 nt, Human
guauccuccagguuuuucaa

SEQ ID NO: 3665732 - RNA, 21 nt, Human
guauccugcuucugauaugca

SEQ ID NO: 3665733 - RNA, 18 nt, Human
guauccugggggacccaa

SEQ ID NO: 3665734 - RNA, 16 nt, Human
guauccuucagccuga

SEQ ID NO: 3665735 - RNA, 15 nt, Human
guaucgauguuaugu

SEQ ID NO: 3665736 - RNA, 17 nt, Human
guaucggagacagugau

SEQ ID NO: 3665737 - RNA, 18 nt, Human
guaucggcacuguacaaa

SEQ ID NO: 3665738 - RNA, 17 nt, Human
guaucgggggcuggggc

SEQ ID NO: 3665739 - RNA, 15 nt, Human
guaucguaaccagcc

SEQ ID NO: 3665740 - RNA, 17 nt, Human
guaucguaaccagccag

SEQ ID NO: 3665741 - RNA, 16 nt, Human
gucuguguguguguau

SEQ ID NO: 3665742 - RNA, 14 nt, Human
gucuguguuuuaau

SEQ ID NO: 3665743 - RNA, 17 nt, Human
gucuguguuuugaaaga

SEQ ID NO: 3665744 - RNA, 14 nt, Human
gucuguuacacugg

SEQ ID NO: 3665745 - RNA, 15 nt, Human
gucuguucuugaagc

SEQ ID NO: 3665746 - RNA, 14 nt, Human
gucuguucuuucca

SEQ ID NO: 3665747 - RNA, 11 nt, Human
gucuguugagu

SEQ ID NO: 3665748 - RNA, 20 nt, Human
gucuguuggcaggcuggcca

SEQ ID NO: 3665749 - RNA, 21 nt, Human
gucuguuggcaggcuggccag

SEQ ID NO: 3665750 - RNA, 14 nt, Human
gucuguuuaagaaa

SEQ ID NO: 3665751 - RNA, 13 nt, Human
gucuguuuacugc

SEQ ID NO: 3665752 - RNA, 17 nt, Human
gucuguuuauaaacauu

SEQ ID NO: 3665753 - RNA, 21 nt, Human
gucuguuuggacugcagaagc

SEQ ID NO: 3665754 - RNA, 21 nt, Human
gucuguuuuccuuucucaccg

SEQ ID NO: 3665755 - RNA, 23 nt, Human
gucuguuuuguaaaguccccaga

SEQ ID NO: 3665756 - RNA, 20 nt, Human
gucuguuuuguguacuuuua

SEQ ID NO: 3665757 - RNA, 21 nt, Human
gucuuaaaaaguggaaaaaua

SEQ ID NO: 3665758 - RNA, 14 nt, Human
gucuuaaaaccugc

SEQ ID NO: 3665759 - RNA, 22 nt, Human
gucuuaaacuaaaugugcaaua

SEQ ID NO: 3665760 - RNA, 20 nt, Human
gucuuaaauaaaagaaaugc

SEQ ID NO: 3665761 - RNA, 19 nt, Human
gucuuaaggacaaagugcc

SEQ ID NO: 3665762 - RNA, 16 nt, Human
gucuuaaugaaguuug

SEQ ID NO: 3665763 - RNA, 17 nt, Human
gucuuaaugaaguuuga

SEQ ID NO: 3665764 - RNA, 19 nt, Human
gucuuaaugaaguuugaau

SEQ ID NO: 3665765 - RNA, 14 nt, Human
gucuuaauuaaaag

SEQ ID NO: 3665766 - RNA, 20 nt, Human
gucuuaauuaaguaaacuaa

SEQ ID NO: 3665767 - RNA, 20 nt, Human
gucuuaauuucuaucuuguu

SEQ ID NO: 3665768 - RNA, 18 nt, Human
gucuuacauaaaccauuu

SEQ ID NO: 3665769 - RNA, 19 nt, Human
gucuuagaaguggaccagg

SEQ ID NO: 3665770 - RNA, 18 nt, Human
gucuuagacuugaaauac

SEQ ID NO: 3665771 - RNA, 15 nt, Human
gucuuagauguauau

SEQ ID NO: 3665772 - RNA, 21 nt, Human
gucuuauauuuacaacacuuu

SEQ ID NO: 3665773 - RNA, 14 nt, Human
gucuuaugcuucca

SEQ ID NO: 3665774 - RNA, 23 nt, Human
gucuuauuaaaacacuucauuga

SEQ ID NO: 3665775 - RNA, 15 nt, Human
gucuuauuuuuagau

SEQ ID NO: 3665776 - RNA, 12 nt, Human
gagacaggaagg

SEQ ID NO: 3665777 - RNA, 16 nt, Human
gagacaggaccugacu

SEQ ID NO: 3665778 - RNA, 16 nt, Human
gagacaggcagagcug

SEQ ID NO: 3665779 - RNA, 19 nt, Human
gagacaggcagagcugcuc

SEQ ID NO: 3665780 - RNA, 20 nt, Human
gagacaggguuucaccaugu

SEQ ID NO: 3665781 - RNA, 17 nt, Human
gagacaguccagccugg

SEQ ID NO: 3665782 - RNA, 17 nt, Human
gagacagugcacaugaa

SEQ ID NO: 3665783 - RNA, 16 nt, Human
gagacaguucaagaaa

SEQ ID NO: 3665784 - RNA, 21 nt, Human
gagacaguuucuuagcuuuuu

SEQ ID NO: 3665785 - RNA, 15 nt, Human
gagacauacuugaag

SEQ ID NO: 3665786 - RNA, 21 nt, Human
gagacauacuugaagggccag

SEQ ID NO: 3665787 - RNA, 12 nt, Human
gagacauccagc

SEQ ID NO: 3665788 - RNA, 22 nt, Human
gagacauuaacucauuagacug

SEQ ID NO: 3665789 - RNA, 18 nt, Human
gagacauuccaaaacgaa

SEQ ID NO: 3665790 - RNA, 15 nt, Human
gagaccaaccugacc

SEQ ID NO: 3665791 - RNA, 16 nt, Human
gagaccaaccugacca

SEQ ID NO: 3665792 - RNA, 23 nt, Human
gagaccaagacucugaaaucuca

SEQ ID NO: 3665793 - RNA, 15 nt, Human
gagaccacuugggcg

SEQ ID NO: 3665794 - RNA, 16 nt, Human
gagaccagccugggca

SEQ ID NO: 3665795 - RNA, 17 nt, Human
gagaccaggagggcacu

SEQ ID NO: 3665796 - RNA, 18 nt, Human
gagaccaggcccuggcua

SEQ ID NO: 3665797 - RNA, 12 nt, Human
gagaccagggcu

SEQ ID NO: 3665798 - RNA, 13 nt, Human
gagaccagggcuc

SEQ ID NO: 3665799 - RNA, 20 nt, Human
gagaccaguugggagcacug

SEQ ID NO: 3665800 - RNA, 21 nt, Human
gagaccaguugggagcacugg

SEQ ID NO: 3665801 - RNA, 14 nt, Human
gagaccauccuggc

SEQ ID NO: 3665802 - RNA, 16 nt, Human
gagaccauccuggcua

SEQ ID NO: 3665803 - RNA, 14 nt, Human
gagacccaaggagg

SEQ ID NO: 3665804 - RNA, 18 nt, Human
gagacccagcccucaucc

SEQ ID NO: 3665805 - RNA, 15 nt, Human
gagacccucugccac

SEQ ID NO: 3665806 - RNA, 21 nt, Human
gagacccugucucaaaaaaag

SEQ ID NO: 3665807 - RNA, 16 nt, Human
gagaccgagccucugu

SEQ ID NO: 3665808 - RNA, 14 nt, Human
gagaccgagugaac

SEQ ID NO: 3665809 - RNA, 19 nt, Human
gagaccggccugccaggag

SEQ ID NO: 3665810 - RNA, 21 nt, Human
gagaccggccugccaggagga

SEQ ID NO: 3665811 - RNA, 22 nt, Human
gagaccgugaagauacuuugua

SEQ ID NO: 3665812 - RNA, 21 nt, Human
gagaccuaccucagguugcug

SEQ ID NO: 3665813 - RNA, 16 nt, Human
gagaccuauguaagaa

SEQ ID NO: 3665814 - RNA, 11 nt, Human
gagaccucagc

SEQ ID NO: 3665815 - RNA, 14 nt, Human
gagaccucagccau

SEQ ID NO: 3665816 - RNA, 16 nt, Human
gagaccucccuguuca

SEQ ID NO: 3665817 - RNA, 23 nt, Human
gagaccucccuguucaaggcccc

SEQ ID NO: 3665818 - RNA, 15 nt, Human
gagaccuccugccuc

SEQ ID NO: 3665819 - RNA, 16 nt, Human
gagaccuccugccucc

SEQ ID NO: 3665820 - RNA, 11 nt, Human
gagaccugccc

SEQ ID NO: 3665821 - RNA, 18 nt, Human
gagaccugcccucaagag

SEQ ID NO: 3665822 - RNA, 20 nt, Human
gagaccuggacacaggccug

SEQ ID NO: 3665823 - RNA, 16 nt, Human
gagaccugugugccag

SEQ ID NO: 3665824 - RNA, 16 nt, Human
gagacggagucccacc

SEQ ID NO: 3665825 - RNA, 18 nt, Human
gagacgggggcagagagg

SEQ ID NO: 3665826 - RNA, 22 nt, Human
gagacggugucuuguucuguca

SEQ ID NO: 3665827 - RNA, 18 nt, Human
gagacgguguuuugccau

SEQ ID NO: 3665828 - RNA, 20 nt, Human
gagacguggaaccucugucu

SEQ ID NO: 3665829 - RNA, 22 nt, Human
gagacguuuuuggaagaguagu

SEQ ID NO: 3665830 - RNA, 16 nt, Human
gagacuaagcccuguc

SEQ ID NO: 3665831 - RNA, 22 nt, Human
gagacuauuuaaacuuauaaau

SEQ ID NO: 3665832 - RNA, 14 nt, Human
gagacucagacagg

SEQ ID NO: 3665833 - RNA, 13 nt, Human
gagacucagccug

SEQ ID NO: 3665834 - RNA, 15 nt, Human
gagacucagugcaga

SEQ ID NO: 3665835 - RNA, 15 nt, Human
gagacuccauaguuu

SEQ ID NO: 3665836 - RNA, 16 nt, Human
gagacucccaugaagc

SEQ ID NO: 3665837 - RNA, 15 nt, Human
gagacuccugcaggc

SEQ ID NO: 3665838 - RNA, 20 nt, Human
gagacuccugcaggcagcca

SEQ ID NO: 3665839 - RNA, 22 nt, Human
gagacuccugcaggcagccagg

SEQ ID NO: 3665840 - RNA, 17 nt, Human
gagacuccugcccuguu

SEQ ID NO: 3665841 - RNA, 18 nt, Human
gagacucgcgacaaugca

SEQ ID NO: 3665842 - RNA, 19 nt, Human
gagacucuaggguccagug

SEQ ID NO: 3665843 - RNA, 13 nt, Human
gagacucuggccu

SEQ ID NO: 3665844 - RNA, 13 nt, Human
gagacucugucuc

SEQ ID NO: 3665845 - RNA, 15 nt, Human
gagacugcccagcua

SEQ ID NO: 3665846 - RNA, 23 nt, Human
gagacugcguucugcaagcauca

SEQ ID NO: 3665847 - RNA, 18 nt, Human
gagacugcuccugagccc

SEQ ID NO: 3665848 - RNA, 14 nt, Human
gagacugcuuccca

SEQ ID NO: 3665849 - RNA, 23 nt, Human
gagacugcuucccauccuacccu

SEQ ID NO: 3665850 - RNA, 21 nt, Human
gagacugggaagauaggcucu

SEQ ID NO: 3665851 - RNA, 14 nt, Human
gagacugggaaggc

SEQ ID NO: 3665852 - RNA, 22 nt, Human
gagacugggaaggcuugggauu

SEQ ID NO: 3665853 - RNA, 14 nt, Human
gagacuggggggcu

SEQ ID NO: 3665854 - RNA, 18 nt, Human
gagacuggggggcuugaa

SEQ ID NO: 3665855 - RNA, 19 nt, Human
gagacuggggggcuugaaa

SEQ ID NO: 3665856 - RNA, 15 nt, Human
gagacuggguaggaa

SEQ ID NO: 3665857 - RNA, 22 nt, Human
gagacugucucaagagggcacu

SEQ ID NO: 3665858 - RNA, 13 nt, Human
gagacugugcugu

SEQ ID NO: 3665859 - RNA, 17 nt, Human
gagacugugugugcccu

SEQ ID NO: 3665860 - RNA, 23 nt, Human
gagacugugugugcccucugggc

SEQ ID NO: 3665861 - RNA, 14 nt, Human
gagacuguuuggaa

SEQ ID NO: 3665862 - RNA, 20 nt, Human
gagacuuccaaaccugacag

SEQ ID NO: 3665863 - RNA, 13 nt, Human
gagacuugggaau

SEQ ID NO: 3665864 - RNA, 14 nt, Human
gagacuuguaguuu

SEQ ID NO: 3665865 - RNA, 20 nt, Human
gagacuuucuuucuguaggu

SEQ ID NO: 3665866 - RNA, 13 nt, Human
gagacuuugaugu

SEQ ID NO: 3665867 - RNA, 13 nt, Human
gagacuuuguaga

SEQ ID NO: 3665868 - RNA, 11 nt, Human
gagagaaaaaa

SEQ ID NO: 3665869 - RNA, 16 nt, Human
gagagaaaauaaaaag

SEQ ID NO: 3665870 - RNA, 17 nt, Human
gagagaaaauaaaaagu

SEQ ID NO: 3665871 - RNA, 13 nt, Human
gagagaaaauaua

SEQ ID NO: 3665872 - RNA, 17 nt, Human
gagagaaagugggugag

SEQ ID NO: 3665873 - RNA, 22 nt, Human
gagagaaagugugagcaaacua

SEQ ID NO: 3665874 - RNA, 21 nt, Human
gagagaaauaagugcccucuc

SEQ ID NO: 3665875 - RNA, 16 nt, Human
gagagaaauucuguua

SEQ ID NO: 3665876 - RNA, 21 nt, Human
gagagaaccuaacuguaucuu

SEQ ID NO: 3665877 - RNA, 15 nt, Human
gagagaagagcccca

SEQ ID NO: 3665878 - RNA, 18 nt, Human
gagagaaggaggggagca

SEQ ID NO: 3665879 - RNA, 12 nt, Human
gagagaagggga

SEQ ID NO: 3665880 - RNA, 13 nt, Human
gagagacaagaag

SEQ ID NO: 3665881 - RNA, 17 nt, Human
gagagacaagaagcaaa

SEQ ID NO: 3665882 - RNA, 18 nt, Human
gagagacacuggugggga

SEQ ID NO: 3665883 - RNA, 14 nt, Human
gagagacccaagga

SEQ ID NO: 3665884 - RNA, 19 nt, Human
gagagacccaaggaggaaa

SEQ ID NO: 3665885 - RNA, 20 nt, Human
gagagacccaaggaggaaaa

SEQ ID NO: 3665886 - RNA, 12 nt, Human
gagccagcagac

SEQ ID NO: 3665887 - RNA, 22 nt, Human
gagccagcagacauugucagca

SEQ ID NO: 3665888 - RNA, 12 nt, Human
gagccagcccuc

SEQ ID NO: 3665889 - RNA, 15 nt, Human
gagccagcccucccu

SEQ ID NO: 3665890 - RNA, 16 nt, Human
gagccagcccucccug

SEQ ID NO: 3665891 - RNA, 18 nt, Human
gagccagcucccucuauu

SEQ ID NO: 3665892 - RNA, 12 nt, Human
gagccaggagaa

SEQ ID NO: 3665893 - RNA, 15 nt, Human
gagccaggagaagcu

SEQ ID NO: 3665894 - RNA, 12 nt, Human
gagccaggcaca

SEQ ID NO: 3665895 - RNA, 14 nt, Human
gagccagggucuca

SEQ ID NO: 3665896 - RNA, 22 nt, Human
gagccagguaaugagggacugg

SEQ ID NO: 3665897 - RNA, 18 nt, Human
gagccaguaaacagagga

SEQ ID NO: 3665898 - RNA, 19 nt, Human
gagccagucuaguuccuga

SEQ ID NO: 3665899 - RNA, 21 nt, Human
gagccaguucaguaccuggag

SEQ ID NO: 3665900 - RNA, 22 nt, Human
gagccaguucaguaccuggagg

SEQ ID NO: 3665901 - RNA, 14 nt, Human
gagccauacauaaa

SEQ ID NO: 3665902 - RNA, 23 nt, Human
gagccauauaaguuugaaggaaa

SEQ ID NO: 3665903 - RNA, 22 nt, Human
gagccaucggugaaacuaacag

SEQ ID NO: 3665904 - RNA, 22 nt, Human
gagccaugauguggaguggggc

SEQ ID NO: 3665905 - RNA, 15 nt, Human
gagccauuuguccca

SEQ ID NO: 3665906 - RNA, 19 nt, Human
gagccauuugucccaagug

SEQ ID NO: 3665907 - RNA, 20 nt, Human
gagccauuugucccaagugc

SEQ ID NO: 3665908 - RNA, 14 nt, Human
gagccauuuuguga

SEQ ID NO: 3665909 - RNA, 11 nt, Human
gagcccacgcc

SEQ ID NO: 3665910 - RNA, 15 nt, Human
gagcccacgccccca

SEQ ID NO: 3665911 - RNA, 18 nt, Human
gagcccacggcuaagagg

SEQ ID NO: 3665912 - RNA, 22 nt, Human
gagcccacuccaucugguagaa

SEQ ID NO: 3665913 - RNA, 21 nt, Human
gagcccacugcccacccccuc

SEQ ID NO: 3665914 - RNA, 24 nt, Human
gagcccacuguccugggccugcag

SEQ ID NO: 3665915 - RNA, 22 nt, Human
gagcccagauugugccacugcu

SEQ ID NO: 3665916 - RNA, 17 nt, Human
gagcccagcccuguucu

SEQ ID NO: 3665917 - RNA, 20 nt, Human
gagcccagcccuguucuggg

SEQ ID NO: 3665918 - RNA, 11 nt, Human
gagcccaggag

SEQ ID NO: 3665919 - RNA, 23 nt, Human
gagcccaggaguucgaggcugca

SEQ ID NO: 3665920 - RNA, 16 nt, Human
gagcccaggccaggac

SEQ ID NO: 3665921 - RNA, 22 nt, Human
gagcccaggccaggacucugca

SEQ ID NO: 3665922 - RNA, 15 nt, Human
gagcccaggcgggag

SEQ ID NO: 3665923 - RNA, 22 nt, Human
gagcccagggcaucuugcuggc

SEQ ID NO: 3665924 - RNA, 16 nt, Human
gagcccagucuguuga

SEQ ID NO: 3665925 - RNA, 17 nt, Human
gagcccauacucagccu

SEQ ID NO: 3665926 - RNA, 20 nt, Human
gagcccauacucagccugcu

SEQ ID NO: 3665927 - RNA, 23 nt, Human
gagcccauguucugcccccagcc

SEQ ID NO: 3665928 - RNA, 16 nt, Human
gagccccacccucaga

SEQ ID NO: 3665929 - RNA, 12 nt, Human
gagccccacucu

SEQ ID NO: 3665930 - RNA, 13 nt, Human
gagccccacucuc

SEQ ID NO: 3665931 - RNA, 16 nt, Human
gagccccacucucaga

SEQ ID NO: 3665932 - RNA, 17 nt, Human
gagccccacucucagag

SEQ ID NO: 3665933 - RNA, 19 nt, Human
gagccccacucucagaggc

SEQ ID NO: 3665934 - RNA, 23 nt, Human
gagccccacucucagaggcccca

SEQ ID NO: 3665935 - RNA, 13 nt, Human
gagccccaggccu

SEQ ID NO: 3665936 - RNA, 14 nt, Human
gagccccagggaga

SEQ ID NO: 3665937 - RNA, 12 nt, Human
gagccccagggu

SEQ ID NO: 3665938 - RNA, 18 nt, Human
gagccccaucagcuccag

SEQ ID NO: 3665939 - RNA, 12 nt, Human
gagccccaucuu

SEQ ID NO: 3665940 - RNA, 20 nt, Human
gagccccaucuucacccagg

SEQ ID NO: 3665941 - RNA, 18 nt, Human
gagccccauuccugggaa

SEQ ID NO: 3665942 - RNA, 14 nt, Human
gagcccccacccug

SEQ ID NO: 3665943 - RNA, 22 nt, Human
gagcccccacccuguuccugcu

SEQ ID NO: 3665944 - RNA, 21 nt, Human
gagcccccagcuuccagcagg

SEQ ID NO: 3665945 - RNA, 13 nt, Human
gagcccccccaac

SEQ ID NO: 3665946 - RNA, 21 nt, Human
gagcccccgccccgccccaca

SEQ ID NO: 3665947 - RNA, 22 nt, Human
gagcccccgccccgccccacau

SEQ ID NO: 3665948 - RNA, 18 nt, Human
gagccccgcagaccuccc

SEQ ID NO: 3665949 - RNA, 15 nt, Human
gagccccgcccucuu

SEQ ID NO: 3665950 - RNA, 16 nt, Human
gagccccgcccucuuc

SEQ ID NO: 3665951 - RNA, 18 nt, Human
gagccccgcccucuuccu

SEQ ID NO: 3665952 - RNA, 21 nt, Human
gagccccgcccucuuccugac

SEQ ID NO: 3665953 - RNA, 13 nt, Human
gagccccuggucc

SEQ ID NO: 3665954 - RNA, 20 nt, Human
gagccccugguccugagggu

SEQ ID NO: 3665955 - RNA, 21 nt, Human
gagccccugucuagagaggga

SEQ ID NO: 3665956 - RNA, 13 nt, Human
gagccccuuccuu

SEQ ID NO: 3665957 - RNA, 19 nt, Human
gagccccuuccuugcucug

SEQ ID NO: 3665958 - RNA, 17 nt, Human
gagccccuucugcucag

SEQ ID NO: 3665959 - RNA, 22 nt, Human
gagccccuucugcucagcucug

SEQ ID NO: 3665960 - RNA, 23 nt, Human
gagcccgcacccccacccuuugg

SEQ ID NO: 3665961 - RNA, 14 nt, Human
gagcccgggagcug

SEQ ID NO: 3665962 - RNA, 22 nt, Human
gagcccgggagcugcugcccug

SEQ ID NO: 3665963 - RNA, 19 nt, Human
gagcccuaaccccuuccag

SEQ ID NO: 3665964 - RNA, 17 nt, Human
gagcccuacucccugca

SEQ ID NO: 3665965 - RNA, 18 nt, Human
gagcccuacucccugcag

SEQ ID NO: 3665966 - RNA, 21 nt, Human
gagcccucaaagugaggggaa

SEQ ID NO: 3665967 - RNA, 15 nt, Human
gagcccucagaaccc

SEQ ID NO: 3665968 - RNA, 15 nt, Human
gagcccuccgccuuc

SEQ ID NO: 3665969 - RNA, 17 nt, Human
gagcccuccgccuucac

SEQ ID NO: 3665970 - RNA, 17 nt, Human
gagcccugaggccuaga

SEQ ID NO: 3665971 - RNA, 18 nt, Human
gagcccugccucuccgcc

SEQ ID NO: 3665972 - RNA, 12 nt, Human
gagcccugggac

SEQ ID NO: 3665973 - RNA, 18 nt, Human
gagcccuguggaugagcc

SEQ ID NO: 3665974 - RNA, 22 nt, Human
gagcccuguggaugagcccuca

SEQ ID NO: 3665975 - RNA, 19 nt, Human
gagcccuuaucugugcuca

SEQ ID NO: 3665976 - RNA, 22 nt, Human
gagcccuucuauacccacccag

SEQ ID NO: 3665977 - RNA, 22 nt, Human
gagcccuugccuccccauuucc

SEQ ID NO: 3665978 - RNA, 20 nt, Human
gagccgagaucgcgccacug

SEQ ID NO: 3665979 - RNA, 13 nt, Human
gagccgcagagaa

SEQ ID NO: 3665980 - RNA, 16 nt, Human
gagccgcccaaggccu

SEQ ID NO: 3665981 - RNA, 19 nt, Human
gugcauuaucuagauacug

SEQ ID NO: 3665982 - RNA, 18 nt, Human
gugcauuggauaacacca

SEQ ID NO: 3665983 - RNA, 11 nt, Human
gugcauugugc

SEQ ID NO: 3665984 - RNA, 13 nt, Human
gugcauugugcuu

SEQ ID NO: 3665985 - RNA, 17 nt, Human
gugcauuuaugagcucu

SEQ ID NO: 3665986 - RNA, 19 nt, Human
gugcauuugaggucuguuc

SEQ ID NO: 3665987 - RNA, 20 nt, Human
gugcauuugaggucuguucu

SEQ ID NO: 3665988 - RNA, 21 nt, Human
gugcauuuggugguuucagaa

SEQ ID NO: 3665989 - RNA, 17 nt, Human
gugcauuuucccagaua

SEQ ID NO: 3665990 - RNA, 13 nt, Human
gugcauuuuugua

SEQ ID NO: 3665991 - RNA, 18 nt, Human
gugcauuuuugugaaaug

SEQ ID NO: 3665992 - RNA, 18 nt, Human
gugccaacacucaagaag

SEQ ID NO: 3665993 - RNA, 16 nt, Human
gugccaagcacagugc

SEQ ID NO: 3665994 - RNA, 11 nt, Human
gugccaaggac

SEQ ID NO: 3665995 - RNA, 20 nt, Human
gugccaauauguauuguaaa

SEQ ID NO: 3665996 - RNA, 22 nt, Human
gugccaauggaaccuccuuucu

SEQ ID NO: 3665997 - RNA, 12 nt, Human
gugccacccugg

SEQ ID NO: 3665998 - RNA, 15 nt, Human
gugccacccugggcu

SEQ ID NO: 3665999 - RNA, 22 nt, Human
gugccacccugggcucuguggg

SEQ ID NO: 3666000 - RNA, 18 nt, Human
gugccacugcccgagcug

SEQ ID NO: 3666001 - RNA, 19 nt, Human
gugccacugcccgagcugg

SEQ ID NO: 3666002 - RNA, 20 nt, Human
gugccacugcccgagcuggu

SEQ ID NO: 3666003 - RNA, 22 nt, Human
gugccacugcccgagcuggugc

SEQ ID NO: 3666004 - RNA, 15 nt, Human
gugccacuuaaugua

SEQ ID NO: 3666005 - RNA, 23 nt, Human
gugccacuuuacccaccuagaac

SEQ ID NO: 3666006 - RNA, 16 nt, Human
gugccagagaacccag

SEQ ID NO: 3666007 - RNA, 16 nt, Human
gugccagagccugggg

SEQ ID NO: 3666008 - RNA, 17 nt, Human
gugccagagccuggggc

SEQ ID NO: 3666009 - RNA, 20 nt, Human
gugccagaggaauccuggca

SEQ ID NO: 3666010 - RNA, 14 nt, Human
gugccagagguggg

SEQ ID NO: 3666011 - RNA, 17 nt, Human
gugccagaggugggcag

SEQ ID NO: 3666012 - RNA, 19 nt, Human
gugccagaggugggcaggu

SEQ ID NO: 3666013 - RNA, 22 nt, Human
gugccagaggugggcagguggu

SEQ ID NO: 3666014 - RNA, 19 nt, Human
gugccagcaaagccccaug

SEQ ID NO: 3666015 - RNA, 16 nt, Human
gugccagcaacugaau

SEQ ID NO: 3666016 - RNA, 22 nt, Human
gugccagccgugaugcucaggc

SEQ ID NO: 3666017 - RNA, 19 nt, Human
gugccaggaaacucuugcu

SEQ ID NO: 3666018 - RNA, 13 nt, Human
gugccaggaccag

SEQ ID NO: 3666019 - RNA, 21 nt, Human
gugccaggauggaaugauggg

SEQ ID NO: 3666020 - RNA, 19 nt, Human
gugccaggcccggggcugg

SEQ ID NO: 3666021 - RNA, 16 nt, Human
gugccagguccuugcc

SEQ ID NO: 3666022 - RNA, 20 nt, Human
gugccagguuuuuggucuga

SEQ ID NO: 3666023 - RNA, 18 nt, Human
gugccaguauuuuaaaau

SEQ ID NO: 3666024 - RNA, 19 nt, Human
gugccagucgcgcugccug

SEQ ID NO: 3666025 - RNA, 18 nt, Human
gugccauagucacauggc

SEQ ID NO: 3666026 - RNA, 16 nt, Human
gugccaucauugcugu

SEQ ID NO: 3666027 - RNA, 12 nt, Human
gugccaugucug

SEQ ID NO: 3666028 - RNA, 17 nt, Human
gugccauuuugcauuuu

SEQ ID NO: 3666029 - RNA, 19 nt, Human
gugcccaagccagaggcug

SEQ ID NO: 3666030 - RNA, 21 nt, Human
gugcucagggggcgccugugg

SEQ ID NO: 3666031 - RNA, 19 nt, Human
gugcucaguuguagaaugu

SEQ ID NO: 3666032 - RNA, 22 nt, Human
gugcucaguuguagaauguauu

SEQ ID NO: 3666033 - RNA, 22 nt, Human
gugcucaucagaaacaauuucu

SEQ ID NO: 3666034 - RNA, 13 nt, Human
gugcucauuuaag

SEQ ID NO: 3666035 - RNA, 13 nt, Human
gugcuccaggcag

SEQ ID NO: 3666036 - RNA, 16 nt, Human
gugcuccccucugaaa

SEQ ID NO: 3666037 - RNA, 17 nt, Human
gugcuccgugccuccac

SEQ ID NO: 3666038 - RNA, 18 nt, Human
gugcuccgugccuccacc

SEQ ID NO: 3666039 - RNA, 15 nt, Human
gugcucucaccagcu

SEQ ID NO: 3666040 - RNA, 15 nt, Human
gugcucuccaagccc

SEQ ID NO: 3666041 - RNA, 20 nt, Human
gugcucucugccacuggaag

SEQ ID NO: 3666042 - RNA, 16 nt, Human
gugcucugaucaucca

SEQ ID NO: 3666043 - RNA, 15 nt, Human
gugcucuuuguuuug

SEQ ID NO: 3666044 - RNA, 16 nt, Human
gugcucuuuguuuugu

SEQ ID NO: 3666045 - RNA, 14 nt, Human
gugcucuuuucucc

SEQ ID NO: 3666046 - RNA, 22 nt, Human
gugcugaacaaaaaauaaaaau

SEQ ID NO: 3666047 - RNA, 21 nt, Human
gugcugaagcuuauuaaugcu

SEQ ID NO: 3666048 - RNA, 19 nt, Human
gugcugaaugguuuucaaa

SEQ ID NO: 3666049 - RNA, 17 nt, Human
gugcugacagcugcucc

SEQ ID NO: 3666050 - RNA, 16 nt, Human
gugcugacccuccugu

SEQ ID NO: 3666051 - RNA, 18 nt, Human
gugcugacggccagggag

SEQ ID NO: 3666052 - RNA, 20 nt, Human
gugcugaguagaugcgcagc

SEQ ID NO: 3666053 - RNA, 20 nt, Human
gugcugaucgugcuaaauuu

SEQ ID NO: 3666054 - RNA, 22 nt, Human
gugcugaucgugcuaaauuuuc

SEQ ID NO: 3666055 - RNA, 14 nt, Human
gugcugcagcaccg

SEQ ID NO: 3666056 - RNA, 18 nt, Human
gugcugcagcucccuggc

SEQ ID NO: 3666057 - RNA, 22 nt, Human
gugcugccauccagguucagcu

SEQ ID NO: 3666058 - RNA, 19 nt, Human
gugcugcccgucuucagcc

SEQ ID NO: 3666059 - RNA, 16 nt, Human
gugcugcccugaagaa

SEQ ID NO: 3666060 - RNA, 12 nt, Human
gugcugcccugc

SEQ ID NO: 3666061 - RNA, 14 nt, Human
gugcugcccugccc

SEQ ID NO: 3666062 - RNA, 18 nt, Human
gugcugcccugcccaccu

SEQ ID NO: 3666063 - RNA, 18 nt, Human
gugcugccgcgcagugug

SEQ ID NO: 3666064 - RNA, 15 nt, Human
gugcugcuacccucc

SEQ ID NO: 3666065 - RNA, 21 nt, Human
gugcugcuacccucccugcug

SEQ ID NO: 3666066 - RNA, 14 nt, Human
gugcugcugcugcu

SEQ ID NO: 3666067 - RNA, 16 nt, Human
gugcugcugugugcuu

SEQ ID NO: 3666068 - RNA, 18 nt, Human
gugcuggaauucuaacaa

SEQ ID NO: 3666069 - RNA, 16 nt, Human
gugcuggaggugggag

SEQ ID NO: 3666070 - RNA, 17 nt, Human
gugcuggaggugggagc

SEQ ID NO: 3666071 - RNA, 18 nt, Human
gugcuggagguuggaucu

SEQ ID NO: 3666072 - RNA, 15 nt, Human
gugcuggcaaccacu

SEQ ID NO: 3666073 - RNA, 14 nt, Human
gugcuggcucacag

SEQ ID NO: 3666074 - RNA, 20 nt, Human
gugcuggcucacaguacagc

SEQ ID NO: 3666075 - RNA, 15 nt, Human
gugcuggcugcccag

SEQ ID NO: 3666076 - RNA, 20 nt, Human
gugcugggaaccucagggua

SEQ ID NO: 3666077 - RNA, 19 nt, Human
gugcugggacugagccagu

SEQ ID NO: 3666078 - RNA, 22 nt, Human
gugcugggacugagccaguccc

SEQ ID NO: 3666079 - RNA, 16 nt, Human
gugcugggagcuccac

SEQ ID NO: 3666080 - RNA, 19 nt, Human
gugcugggaggagggagag

SEQ ID NO: 3666081 - RNA, 23 nt, Human
gugcugggaggagggagagggag

SEQ ID NO: 3666082 - RNA, 15 nt, Human
gugcugggagggaua

SEQ ID NO: 3666083 - RNA, 21 nt, Human
gugcugggauuacaagcguga

SEQ ID NO: 3666084 - RNA, 20 nt, Human
gugcugggauuacaggcgug

SEQ ID NO: 3666085 - RNA, 20 nt, Human
gugcugggauuacaggugug

SEQ ID NO: 3666086 - RNA, 13 nt, Human
gugcugggcagcc

SEQ ID NO: 3666087 - RNA, 14 nt, Human
gugcugggcagccc

SEQ ID NO: 3666088 - RNA, 15 nt, Human
gugcugggcagcccg

SEQ ID NO: 3666089 - RNA, 15 nt, Human
gugcuggggccuggu

SEQ ID NO: 3666090 - RNA, 19 nt, Human
gugcuggggccugguuccc

SEQ ID NO: 3666091 - RNA, 19 nt, Human
gugcugguguaugugugaa

SEQ ID NO: 3666092 - RNA, 13 nt, Human
gugcugguguccu

SEQ ID NO: 3666093 - RNA, 15 nt, Human
gugcuguauaaaauc

SEQ ID NO: 3666094 - RNA, 20 nt, Human
gugcugucugaucugugcuu

SEQ ID NO: 3666095 - RNA, 18 nt, Human
gugcugugaccauuuaua

SEQ ID NO: 3666096 - RNA, 14 nt, Human
gugcugugagggag

SEQ ID NO: 3666097 - RNA, 15 nt, Human
gugcugugagggagg

SEQ ID NO: 3666098 - RNA, 13 nt, Human
gugcuguggaagc

SEQ ID NO: 3666099 - RNA, 14 nt, Human
gugcuguggaagca

SEQ ID NO: 3666100 - RNA, 17 nt, Human
gugcuguggccugggca

SEQ ID NO: 3666101 - RNA, 15 nt, Human
gugcugugguuccug

SEQ ID NO: 3666102 - RNA, 15 nt, Human
gugcuguguaaaguu

SEQ ID NO: 3666103 - RNA, 16 nt, Human
gugcuguguaaaguua

SEQ ID NO: 3666104 - RNA, 11 nt, Human
gugcugugugu

SEQ ID NO: 3666105 - RNA, 15 nt, Human
gugcuguuguuauga

SEQ ID NO: 3666106 - RNA, 17 nt, Human
gugcuguuguuaugaug

SEQ ID NO: 3666107 - RNA, 22 nt, Human
gugcuguuguuaugaugugcuu

SEQ ID NO: 3666108 - RNA, 15 nt, Human
gugcuguuucaaagu

SEQ ID NO: 3666109 - RNA, 13 nt, Human
gugcuguuucccg

SEQ ID NO: 3666110 - RNA, 21 nt, Human
gugcuguuuuguuauauaauu

SEQ ID NO: 3666111 - RNA, 21 nt, Human
gugcuuaucccauagccagga

SEQ ID NO: 3666112 - RNA, 16 nt, Human
gugcuuaugguaccag

SEQ ID NO: 3666113 - RNA, 18 nt, Human
gugcuuauguaugaggua

SEQ ID NO: 3666114 - RNA, 21 nt, Human
gugcuuauugauauucuaaga

SEQ ID NO: 3666115 - RNA, 15 nt, Human
gugcuucagccugag

SEQ ID NO: 3666116 - RNA, 16 nt, Human
gugcuuccaaggcaga

SEQ ID NO: 3666117 - RNA, 14 nt, Human
gugcuucgggcccu

SEQ ID NO: 3666118 - RNA, 21 nt, Human
gugcuucuaauauuuauugcu

SEQ ID NO: 3666119 - RNA, 21 nt, Human
gugcuucuaguucugccagga

SEQ ID NO: 3666120 - RNA, 16 nt, Human
gugcuucuccccagaa

SEQ ID NO: 3666121 - RNA, 21 nt, Human
gugcuucuccccagaauucac

SEQ ID NO: 3666122 - RNA, 21 nt, Human
gugcuugaaggcccugcugag

SEQ ID NO: 3666123 - RNA, 12 nt, Human
gugcuuggagga

SEQ ID NO: 3666124 - RNA, 13 nt, Human
gugcuuggcccag

SEQ ID NO: 3666125 - RNA, 16 nt, Human
gugcuuggcccaggag

SEQ ID NO: 3666126 - RNA, 20 nt, Human
gugcuuguuuuauaaaauuu

SEQ ID NO: 3666127 - RNA, 14 nt, Human
gugcuuuaaagaua

SEQ ID NO: 3666128 - RNA, 12 nt, Human
gugcuuuaagug

SEQ ID NO: 3666129 - RNA, 17 nt, Human
gugcuuuaugcugaaac

SEQ ID NO: 3666130 - RNA, 13 nt, Human
gugcuuuccagcu

SEQ ID NO: 3666131 - RNA, 16 nt, Human
gugcuuuccagcucac

SEQ ID NO: 3666132 - RNA, 22 nt, Human
gugcuuuccguggcacugcaua

SEQ ID NO: 3666133 - RNA, 19 nt, Human
gugcuuuccuuuuuuaaaa

SEQ ID NO: 3666134 - RNA, 20 nt, Human
gugcuuucuauuguacagaa

SEQ ID NO: 3666135 - RNA, 19 nt, Human
gugcuuuuauagaggcuag

SEQ ID NO: 3666136 - RNA, 19 nt, Human
gugcuuuuccuauuuguuu

SEQ ID NO: 3666137 - RNA, 23 nt, Human
gugcuuuuggcggggaggaggaa

SEQ ID NO: 3666138 - RNA, 18 nt, Human
guggaaaaauagccugcc

SEQ ID NO: 3666139 - RNA, 14 nt, Human
guggaaaaauauuu

SEQ ID NO: 3666140 - RNA, 19 nt, Human
guggaaaaaugagagaagg

SEQ ID NO: 3666141 - RNA, 17 nt, Human
guggaaauuaagaagaa

SEQ ID NO: 3666142 - RNA, 19 nt, Human
guggaaauuaagaagaaac

SEQ ID NO: 3666143 - RNA, 24 nt, Human
guggaaccucugucucauccuccu

SEQ ID NO: 3666144 - RNA, 22 nt, Human
guggaacguuuuuccuguucuu

SEQ ID NO: 3666145 - RNA, 14 nt, Human
guggaacugcugcc

SEQ ID NO: 3666146 - RNA, 15 nt, Human
guggaacugcugcca

SEQ ID NO: 3666147 - RNA, 17 nt, Human
guggaagagggcugcaa

SEQ ID NO: 3666148 - RNA, 15 nt, Human
guggaagaggggaca

SEQ ID NO: 3666149 - RNA, 20 nt, Human
guggaagaggggacaggucc

SEQ ID NO: 3666150 - RNA, 12 nt, Human
guggaagcaacc

SEQ ID NO: 3666151 - RNA, 13 nt, Human
guggaagcaacca

SEQ ID NO: 3666152 - RNA, 13 nt, Human
guggaagcccucc

SEQ ID NO: 3666153 - RNA, 19 nt, Human
guggaaguaguggagcccc

SEQ ID NO: 3666154 - RNA, 14 nt, Human
guggaagugugggu

SEQ ID NO: 3666155 - RNA, 19 nt, Human
guggaagugugggucugug

SEQ ID NO: 3666156 - RNA, 15 nt, Human
guggaauuucuuguu

SEQ ID NO: 3666157 - RNA, 24 nt, Human
guggacacagcucuucuccaggcu

SEQ ID NO: 3666158 - RNA, 15 nt, Human
guggacaccaggagu

SEQ ID NO: 3666159 - RNA, 13 nt, Human
guggacaccugcc

SEQ ID NO: 3666160 - RNA, 16 nt, Human
guggacaguccuggga

SEQ ID NO: 3666161 - RNA, 17 nt, Human
guggacauggcuguuca

SEQ ID NO: 3666162 - RNA, 13 nt, Human
guggaccaggaca

SEQ ID NO: 3666163 - RNA, 16 nt, Human
guggaccauggagugg

SEQ ID NO: 3666164 - RNA, 21 nt, Human
guggaccauggaguggcagcc

SEQ ID NO: 3666165 - RNA, 19 nt, Human
guggacccugaaaugugug

SEQ ID NO: 3666166 - RNA, 18 nt, Human
guggaccuuaggccuucc

SEQ ID NO: 3666167 - RNA, 13 nt, Human
guggaccuuccug

SEQ ID NO: 3666168 - RNA, 18 nt, Human
guggaccuuuuaaagugu

SEQ ID NO: 3666169 - RNA, 21 nt, Human
guggaccuuuuaaaguguuuc

SEQ ID NO: 3666170 - RNA, 15 nt, Human
guggacuaaaagaua

SEQ ID NO: 3666171 - RNA, 17 nt, Human
guggacucugcacaugu

SEQ ID NO: 3666172 - RNA, 20 nt, Human
guggacugaccuuguaaaag

SEQ ID NO: 3666173 - RNA, 15 nt, Human
guggacuggccccug

SEQ ID NO: 3666174 - RNA, 16 nt, Human
guggacuguucccuga

SEQ ID NO: 3666175 - RNA, 16 nt, Human
gugacccccagcuccg

SEQ ID NO: 3666176 - RNA, 15 nt, Human
gugaccccuccuggg

SEQ ID NO: 3666177 - RNA, 17 nt, Human
gugaccccuccuggggc

SEQ ID NO: 3666178 - RNA, 20 nt, Human
gugaccccuuuucagcuucu

SEQ ID NO: 3666179 - RNA, 22 nt, Human
gugaccccuuuucagcuucugc

SEQ ID NO: 3666180 - RNA, 16 nt, Human
gugacccgaccuggcc

SEQ ID NO: 3666181 - RNA, 21 nt, Human
gugacccucugaaugguccag

SEQ ID NO: 3666182 - RNA, 19 nt, Human
gugaccggacuuuucugca

SEQ ID NO: 3666183 - RNA, 18 nt, Human
gugaccuauaccuguguu

SEQ ID NO: 3666184 - RNA, 19 nt, Human
gugaccuccggccaggugc

SEQ ID NO: 3666185 - RNA, 13 nt, Human
gugaccucugccu

SEQ ID NO: 3666186 - RNA, 14 nt, Human
gugaccucugccug

SEQ ID NO: 3666187 - RNA, 23 nt, Human
gugaccugaggauuuaagggaug

SEQ ID NO: 3666188 - RNA, 12 nt, Human
gugaccugcuga

SEQ ID NO: 3666189 - RNA, 23 nt, Human
gugaccuguggggauuucuccca

SEQ ID NO: 3666190 - RNA, 22 nt, Human
gugaccuuaguguuucugugca

SEQ ID NO: 3666191 - RNA, 15 nt, Human
gugaccuucugggaa

SEQ ID NO: 3666192 - RNA, 16 nt, Human
gugacggcccucaucu

SEQ ID NO: 3666193 - RNA, 13 nt, Human
gugacggucccac

SEQ ID NO: 3666194 - RNA, 22 nt, Human
gugacggucccacacuggugac

SEQ ID NO: 3666195 - RNA, 24 nt, Human
gugacgguuccuacacaggacagg

SEQ ID NO: 3666196 - RNA, 16 nt, Human
gugacgucuggguggc

SEQ ID NO: 3666197 - RNA, 19 nt, Human
gugacgucuggguggcccu

SEQ ID NO: 3666198 - RNA, 15 nt, Human
gugacuaauuguaua

SEQ ID NO: 3666199 - RNA, 21 nt, Human
gugacuaauuguauaacaggu

SEQ ID NO: 3666200 - RNA, 11 nt, Human
gugacuagugc

SEQ ID NO: 3666201 - RNA, 17 nt, Human
gugacuagugcugaagc

SEQ ID NO: 3666202 - RNA, 18 nt, Human
gugacuagugcugaagcu

SEQ ID NO: 3666203 - RNA, 23 nt, Human
gugugaaccaccacacccagccc

SEQ ID NO: 3666204 - RNA, 13 nt, Human
gugugaagguccu

SEQ ID NO: 3666205 - RNA, 13 nt, Human
gugugaaguuaga

SEQ ID NO: 3666206 - RNA, 17 nt, Human
gugugaaguuagaauuc

SEQ ID NO: 3666207 - RNA, 14 nt, Human
gugugaaugaacac

SEQ ID NO: 3666208 - RNA, 11 nt, Human
gugugaaugug

SEQ ID NO: 3666209 - RNA, 15 nt, Human
gugugaaugugggca

SEQ ID NO: 3666210 - RNA, 23 nt, Human
gugugaaugugggcacuggccca

SEQ ID NO: 3666211 - RNA, 22 nt, Human
gugugacaaggauugcuacugu

SEQ ID NO: 3666212 - RNA, 22 nt, Human
gugugacaauucuguuuuuaau

SEQ ID NO: 3666213 - RNA, 23 nt, Human
gugugacagggccaguggggccu

SEQ ID NO: 3666214 - RNA, 15 nt, Human
gugugacaucagugg

SEQ ID NO: 3666215 - RNA, 12 nt, Human
gugugaccccuc

SEQ ID NO: 3666216 - RNA, 16 nt, Human
gugugaccccuccugg

SEQ ID NO: 3666217 - RNA, 18 nt, Human
gugugaccccuccugggg

SEQ ID NO: 3666218 - RNA, 15 nt, Human
gugugaccugagggc

SEQ ID NO: 3666219 - RNA, 17 nt, Human
gugugacuacuccccca

SEQ ID NO: 3666220 - RNA, 13 nt, Human
gugugagcaguga

SEQ ID NO: 3666221 - RNA, 18 nt, Human
gugugaggagcugcuggc

SEQ ID NO: 3666222 - RNA, 17 nt, Human
gugugaguaagagcugg

SEQ ID NO: 3666223 - RNA, 13 nt, Human
gugugagucacca

SEQ ID NO: 3666224 - RNA, 20 nt, Human
gugugagucaccaagcccag

SEQ ID NO: 3666225 - RNA, 11 nt, Human
gugugagugug

SEQ ID NO: 3666226 - RNA, 18 nt, Human
gugugauaaaucagucaa

SEQ ID NO: 3666227 - RNA, 19 nt, Human
gugugauccaguuuuucau

SEQ ID NO: 3666228 - RNA, 17 nt, Human
gugugaucccaagugcc

SEQ ID NO: 3666229 - RNA, 21 nt, Human
gugugaucuuaauauauuuga

SEQ ID NO: 3666230 - RNA, 22 nt, Human
gugugaucuuaauauauuugaa

SEQ ID NO: 3666231 - RNA, 21 nt, Human
gugugauugggaauaaauaug

SEQ ID NO: 3666232 - RNA, 16 nt, Human
gugugcaacagacaag

SEQ ID NO: 3666233 - RNA, 17 nt, Human
gugugcaaggcagccgu

SEQ ID NO: 3666234 - RNA, 20 nt, Human
gugugcacaaauauuuauuu

SEQ ID NO: 3666235 - RNA, 15 nt, Human
gugugcacgaguggg

SEQ ID NO: 3666236 - RNA, 19 nt, Human
gugugcacgcgugugcagg

SEQ ID NO: 3666237 - RNA, 23 nt, Human
gugugcacuaaggggcccggcca

SEQ ID NO: 3666238 - RNA, 13 nt, Human
gugugcagugaag

SEQ ID NO: 3666239 - RNA, 16 nt, Human
gugugcauauuguaca

SEQ ID NO: 3666240 - RNA, 13 nt, Human
gugugcccagcuu

SEQ ID NO: 3666241 - RNA, 18 nt, Human
gugugccccccauccugg

SEQ ID NO: 3666242 - RNA, 20 nt, Human
gugugccccccauccuggcc

SEQ ID NO: 3666243 - RNA, 16 nt, Human
gugugcccccuucaag

SEQ ID NO: 3666244 - RNA, 16 nt, Human
gugugcccucugggcu

SEQ ID NO: 3666245 - RNA, 13 nt, Human
gugugccucuagc

SEQ ID NO: 3666246 - RNA, 23 nt, Human
gugugccucuagcugaauugagc

SEQ ID NO: 3666247 - RNA, 16 nt, Human
gugugcgcucugugga

SEQ ID NO: 3666248 - RNA, 17 nt, Human
gugugcucaggagcccu

SEQ ID NO: 3666249 - RNA, 18 nt, Human
gugugcucaggagcccug

SEQ ID NO: 3666250 - RNA, 15 nt, Human
gugugcucuccauuc

SEQ ID NO: 3666251 - RNA, 21 nt, Human
gugugcucuccauucugcucc

SEQ ID NO: 3666252 - RNA, 15 nt, Human
gugugcucugcuuca

SEQ ID NO: 3666253 - RNA, 16 nt, Human
gugugcugagguguua

SEQ ID NO: 3666254 - RNA, 11 nt, Human
gugugcuggga

SEQ ID NO: 3666255 - RNA, 18 nt, Human
gugugcuuuaugcugaaa

SEQ ID NO: 3666256 - RNA, 20 nt, Human
guguggaaauuaagaagaaa

SEQ ID NO: 3666257 - RNA, 21 nt, Human
guguggaaguuauuaacuuua

SEQ ID NO: 3666258 - RNA, 22 nt, Human
guguggagaagccacaggccug

SEQ ID NO: 3666259 - RNA, 21 nt, Human
guguggagaagcggcuggcag

SEQ ID NO: 3666260 - RNA, 18 nt, Human
guguggagagggaaugug

SEQ ID NO: 3666261 - RNA, 21 nt, Human
guguggagucauuucugauuu

SEQ ID NO: 3666262 - RNA, 14 nt, Human
guguggcagcaggc

SEQ ID NO: 3666263 - RNA, 12 nt, Human
guguggcagugg

SEQ ID NO: 3666264 - RNA, 19 nt, Human
guguggccacuucugucca

SEQ ID NO: 3666265 - RNA, 15 nt, Human
guguggcuccccucu

SEQ ID NO: 3666266 - RNA, 15 nt, Human
guguggcugaggagg

SEQ ID NO: 3666267 - RNA, 13 nt, Human
gugugggaaggga

SEQ ID NO: 3666268 - RNA, 19 nt, Human
gugugggggccccgucuca

SEQ ID NO: 3666269 - RNA, 18 nt, Human
gugugggguucugcuggg

SEQ ID NO: 3666270 - RNA, 15 nt, Human
gugugguacagagaa

SEQ ID NO: 3666271 - RNA, 16 nt, Human
gugugguacagagaag

SEQ ID NO: 3666272 - RNA, 23 nt, Human
gugugguggguucuuuggaagga

SEQ ID NO: 3666273 - RNA, 13 nt, Human
guguguaauuguu

SEQ ID NO: 3666274 - RNA, 16 nt, Human
guguguaauuguuccu

SEQ ID NO: 3666275 - RNA, 15 nt, Human
guguguacucugucc

SEQ ID NO: 3666276 - RNA, 14 nt, Human
guguguagccaagg

SEQ ID NO: 3666277 - RNA, 21 nt, Human
guguguaugacuaaagagaga

SEQ ID NO: 3666278 - RNA, 18 nt, Human
guguguaugggugugugu

SEQ ID NO: 3666279 - RNA, 13 nt, Human
guguguauguggg

SEQ ID NO: 3666280 - RNA, 14 nt, Human
guguguauucuuaa

SEQ ID NO: 3666281 - RNA, 15 nt, Human
guguguauuguuccc

SEQ ID NO: 3666282 - RNA, 18 nt, Human
guguguccaaaacugccu

SEQ ID NO: 3666283 - RNA, 18 nt, Human
gugugucccaggcaggga

SEQ ID NO: 3666284 - RNA, 16 nt, Human
gugugucccccucugu

SEQ ID NO: 3666285 - RNA, 17 nt, Human
gugugucccccucuguc

SEQ ID NO: 3666286 - RNA, 18 nt, Human
gugugucccccucugucc

SEQ ID NO: 3666287 - RNA, 11 nt, Human
guguguccuug

SEQ ID NO: 3666288 - RNA, 19 nt, Human
gugugucuccugcaugcag

SEQ ID NO: 3666289 - RNA, 15 nt, Human
gugugucugcucagu

SEQ ID NO: 3666290 - RNA, 17 nt, Human
gugugugacaauucugu

SEQ ID NO: 3666291 - RNA, 11 nt, Human
gugugugcccu

SEQ ID NO: 3666292 - RNA, 21 nt, Human
gugugugcgccuacaggagug

SEQ ID NO: 3666293 - RNA, 10 nt, Human
gugugugcgu

SEQ ID NO: 3666294 - RNA, 21 nt, Human
guguguggguggauauaaaua

SEQ ID NO: 3666295 - RNA, 19 nt, Human
guguguguaugcgugugug

SEQ ID NO: 3666296 - RNA, 15 nt, Human
gugugugugucagcu

SEQ ID NO: 3666297 - RNA, 13 nt, Human
gugugugugugcg

SEQ ID NO: 3666298 - RNA, 13 nt, Human
guguguguguugc

SEQ ID NO: 3666299 - RNA, 16 nt, Human
guguguuaagcucugc

SEQ ID NO: 3666300 - RNA, 13 nt, Human
guguguuacaaug

SEQ ID NO: 3666301 - RNA, 19 nt, Human
guguguuacaauguaacuu

SEQ ID NO: 3666302 - RNA, 18 nt, Human
guguguuccaacugcccc

SEQ ID NO: 3666303 - RNA, 16 nt, Human
guguguuccaaguuuc

SEQ ID NO: 3666304 - RNA, 12 nt, Human
guguguuccugg

SEQ ID NO: 3666305 - RNA, 14 nt, Human
guguguugauacug

SEQ ID NO: 3666306 - RNA, 21 nt, Human
guguguugauacuguugcacg

SEQ ID NO: 3666307 - RNA, 15 nt, Human
guguguugccacagg

SEQ ID NO: 3666308 - RNA, 14 nt, Human
guguguugucucuu

SEQ ID NO: 3666309 - RNA, 16 nt, Human
guguguugucucuuga

SEQ ID NO: 3666310 - RNA, 16 nt, Human
guguguugucuugaaa

SEQ ID NO: 3666311 - RNA, 18 nt, Human
guguguuucauccuuccc

SEQ ID NO: 3666312 - RNA, 12 nt, Human
guguguuuuaaa

SEQ ID NO: 3666313 - RNA, 13 nt, Human
guguguuuuaaaa

SEQ ID NO: 3666314 - RNA, 14 nt, Human
guguguuuuucuau

SEQ ID NO: 3666315 - RNA, 21 nt, Human
guguguuuuugggaugucuua

SEQ ID NO: 3666316 - RNA, 19 nt, Human
guguuaaaugaaauuguaa

SEQ ID NO: 3666317 - RNA, 21 nt, Human
guguuaaaugugaugaauacu

SEQ ID NO: 3666318 - RNA, 14 nt, Human
guguuaagcucugc

SEQ ID NO: 3666319 - RNA, 18 nt, Human
guguuaauuuaaguuuug

SEQ ID NO: 3666320 - RNA, 12 nt, Human
guguuaauuuau

SEQ ID NO: 3666321 - RNA, 14 nt, Human
guucuuguuggugc

SEQ ID NO: 3666322 - RNA, 14 nt, Human
guucuuuaaacugu

SEQ ID NO: 3666323 - RNA, 14 nt, Human
guucuuuaauuuau

SEQ ID NO: 3666324 - RNA, 17 nt, Human
guucuuuaggagauuuu

SEQ ID NO: 3666325 - RNA, 22 nt, Human
guucuuuauauacaauaaugga

SEQ ID NO: 3666326 - RNA, 13 nt, Human
guucuuuccaaag

SEQ ID NO: 3666327 - RNA, 18 nt, Human
guucuuucuuccucugcu

SEQ ID NO: 3666328 - RNA, 23 nt, Human
guucuuugagggacugccucugc

SEQ ID NO: 3666329 - RNA, 14 nt, Human
guucuuuggauucu

SEQ ID NO: 3666330 - RNA, 15 nt, Human
guucuuugggccaga

SEQ ID NO: 3666331 - RNA, 19 nt, Human
guucuuuuugaaguauuua

SEQ ID NO: 3666332 - RNA, 14 nt, Human
guugaaaagccaug

SEQ ID NO: 3666333 - RNA, 22 nt, Human
guugaaaagccauguuuaagau

SEQ ID NO: 3666334 - RNA, 22 nt, Human
guugaaaauaaaguguauauuu

SEQ ID NO: 3666335 - RNA, 19 nt, Human
guugaaaauuauuuuaaac

SEQ ID NO: 3666336 - RNA, 18 nt, Human
guugaaaauucaaaaagu

SEQ ID NO: 3666337 - RNA, 18 nt, Human
guugaacaaaauaaauug

SEQ ID NO: 3666338 - RNA, 18 nt, Human
guugaaccaaaccucccu

SEQ ID NO: 3666339 - RNA, 15 nt, Human
guugaaccuauuucu

SEQ ID NO: 3666340 - RNA, 16 nt, Human
guugaaccuauuucuc

SEQ ID NO: 3666341 - RNA, 18 nt, Human
guugaagagguuuuaaag

SEQ ID NO: 3666342 - RNA, 18 nt, Human
guugaagcaaaucgaaug

SEQ ID NO: 3666343 - RNA, 13 nt, Human
guugaagccuuug

SEQ ID NO: 3666344 - RNA, 14 nt, Human
guugaagccuuugu

SEQ ID NO: 3666345 - RNA, 22 nt, Human
guugaagggagguggcaagagu

SEQ ID NO: 3666346 - RNA, 19 nt, Human
guugaagucaugcuccccu

SEQ ID NO: 3666347 - RNA, 18 nt, Human
guugaauaaaagugcaca

SEQ ID NO: 3666348 - RNA, 13 nt, Human
guugaauacuuuu

SEQ ID NO: 3666349 - RNA, 13 nt, Human
guugaauaugauu

SEQ ID NO: 3666350 - RNA, 15 nt, Human
guugaaugacaacag

SEQ ID NO: 3666351 - RNA, 16 nt, Human
guugaauggccugccu

SEQ ID NO: 3666352 - RNA, 21 nt, Human
guugaauuuuuuuuaacauuc

SEQ ID NO: 3666353 - RNA, 15 nt, Human
guugacacggccaug

SEQ ID NO: 3666354 - RNA, 20 nt, Human
guugacacggccaugaccac

SEQ ID NO: 3666355 - RNA, 22 nt, Human
guugacauaccuuuuauuuuuu

SEQ ID NO: 3666356 - RNA, 19 nt, Human
guugacauauuuaauguuu

SEQ ID NO: 3666357 - RNA, 22 nt, Human
guugacauauuuaauguuuuaa

SEQ ID NO: 3666358 - RNA, 23 nt, Human
guugacauauuuaauguuuuaaa

SEQ ID NO: 3666359 - RNA, 19 nt, Human
guugacaucacuggcaugg

SEQ ID NO: 3666360 - RNA, 19 nt, Human
guugacauucugaaugcuu

SEQ ID NO: 3666361 - RNA, 16 nt, Human
guugaccaugucuaug

SEQ ID NO: 3666362 - RNA, 19 nt, Human
guugacucuaguacuguga

SEQ ID NO: 3666363 - RNA, 22 nt, Human
guugacuuccaggcacgguuug

SEQ ID NO: 3666364 - RNA, 19 nt, Human
guugagaaucccaaauuug

SEQ ID NO: 3666365 - RNA, 15 nt, Human
guugagagugugacc

SEQ ID NO: 3666366 - RNA, 18 nt, Human
guugagccagcagacauu

SEQ ID NO: 3666367 - RNA, 22 nt, Human
guugagccagcagacauuguca

SEQ ID NO: 3666368 - RNA, 23 nt, Human
guugagccaggccugggucugug

SEQ ID NO: 3666369 - RNA, 14 nt, Human
guugagccuuuucc

SEQ ID NO: 3666370 - RNA, 24 nt, Human
guugagcucucggaacugcaugcu

SEQ ID NO: 3666371 - RNA, 16 nt, Human
guugaggaacuguaca

SEQ ID NO: 3666372 - RNA, 18 nt, Human
guugaggggcuccuggaa

SEQ ID NO: 3666373 - RNA, 23 nt, Human
guugagguggucugaauguucug

SEQ ID NO: 3666374 - RNA, 21 nt, Human
guugaguucagguagcugccc

SEQ ID NO: 3666375 - RNA, 22 nt, Human
guugaguucagguagcugcccc

SEQ ID NO: 3666376 - RNA, 15 nt, Human
guugauaaaaauacu

SEQ ID NO: 3666377 - RNA, 12 nt, Human
guugauaaaucc

SEQ ID NO: 3666378 - RNA, 18 nt, Human
guugauaaauuccacugg

SEQ ID NO: 3666379 - RNA, 21 nt, Human
guugauaaauuccacuggacu

SEQ ID NO: 3666380 - RNA, 12 nt, Human
guugauacuguu

SEQ ID NO: 3666381 - RNA, 15 nt, Human
guugauacuguugca

SEQ ID NO: 3666382 - RNA, 16 nt, Human
guugauacuguugcac

SEQ ID NO: 3666383 - RNA, 17 nt, Human
guugauacuguugcacg

SEQ ID NO: 3666384 - RNA, 18 nt, Human
guugauacuguugcacgu

SEQ ID NO: 3666385 - RNA, 21 nt, Human
guugauacuguugcacgugug

SEQ ID NO: 3666386 - RNA, 23 nt, Human
guugauagcaagugaauuuuucu

SEQ ID NO: 3666387 - RNA, 22 nt, Human
guugauagcacagacccugccc

SEQ ID NO: 3666388 - RNA, 15 nt, Human
guugaucuggaaccc

SEQ ID NO: 3666389 - RNA, 22 nt, Human
guugaugaucuuugcagacagg

SEQ ID NO: 3666390 - RNA, 21 nt, Human
guugaugccugugaacugaac

SEQ ID NO: 3666391 - RNA, 17 nt, Human
guugaugggaugauuga

SEQ ID NO: 3666392 - RNA, 22 nt, Human
guugaugggaugauugaagaaa

SEQ ID NO: 3666393 - RNA, 17 nt, Human
guugauggguucuaauu

SEQ ID NO: 3666394 - RNA, 21 nt, Human
guugauggugguauguuuuca

SEQ ID NO: 3666395 - RNA, 17 nt, Human
guugauguacugauuga

SEQ ID NO: 3666396 - RNA, 14 nt, Human
guugauuaaagaug

SEQ ID NO: 3666397 - RNA, 19 nt, Human
guugauuaauuucugccau

SEQ ID NO: 3666398 - RNA, 23 nt, Human
guugauucgguauccccccaucu

SEQ ID NO: 3666399 - RNA, 17 nt, Human
guugauugcuaaaugua

SEQ ID NO: 3666400 - RNA, 20 nt, Human
guugauugcuaaauguaaca

SEQ ID NO: 3666401 - RNA, 23 nt, Human
guugauuucagcaccuacagugu

SEQ ID NO: 3666402 - RNA, 23 nt, Human
guugauuuuuuuuuuuuuuuccu

SEQ ID NO: 3666403 - RNA, 13 nt, Human
guugcaaccacug

SEQ ID NO: 3666404 - RNA, 14 nt, Human
guugcaaccacugc

SEQ ID NO: 3666405 - RNA, 14 nt, Human
guugcaagauguga

SEQ ID NO: 3666406 - RNA, 16 nt, Human
guugcaagaugugaau

SEQ ID NO: 3666407 - RNA, 17 nt, Human
guugcaagaugugaauu

SEQ ID NO: 3666408 - RNA, 14 nt, Human
guugcaagccccuc

SEQ ID NO: 3666409 - RNA, 15 nt, Human
guugcaaggccgcug

SEQ ID NO: 3666410 - RNA, 17 nt, Human
guugcaaguacugcugu

SEQ ID NO: 3666411 - RNA, 15 nt, Human
guugcacacuuuggu

SEQ ID NO: 3666412 - RNA, 14 nt, Human
guugcacccagccc

SEQ ID NO: 3666413 - RNA, 16 nt, Human
guugcacccagcccug

SEQ ID NO: 3666414 - RNA, 23 nt, Human
guugcacccagcccuggucucag

SEQ ID NO: 3666415 - RNA, 21 nt, Human
guugcacguguguuuuucuau

SEQ ID NO: 3666416 - RNA, 14 nt, Human
guugcacuuuguag

SEQ ID NO: 3666417 - RNA, 23 nt, Human
guugcagcccugcugcugccugc

SEQ ID NO: 3666418 - RNA, 20 nt, Human
guugcagcuguuuuguugac

SEQ ID NO: 3666419 - RNA, 17 nt, Human
guugcagucacucuagu

SEQ ID NO: 3666420 - RNA, 16 nt, Human
guugcagugagcugag

SEQ ID NO: 3666421 - RNA, 16 nt, Human
guugcauagcaguaua

SEQ ID NO: 3666422 - RNA, 22 nt, Human
guggagaagccacaggccugag

SEQ ID NO: 3666423 - RNA, 19 nt, Human
guggagaagccauugucuu

SEQ ID NO: 3666424 - RNA, 13 nt, Human
guggagacagggc

SEQ ID NO: 3666425 - RNA, 14 nt, Human
guggagacugcucc

SEQ ID NO: 3666426 - RNA, 22 nt, Human
guggagacugcuccugagcccc

SEQ ID NO: 3666427 - RNA, 18 nt, Human
guggagacugcuucccau

SEQ ID NO: 3666428 - RNA, 19 nt, Human
guggagacuggggggcuug

SEQ ID NO: 3666429 - RNA, 14 nt, Human
guggagagcccggc

SEQ ID NO: 3666430 - RNA, 16 nt, Human
guggagagcuggugcc

SEQ ID NO: 3666431 - RNA, 14 nt, Human
guggagagggaaug

SEQ ID NO: 3666432 - RNA, 15 nt, Human
guggagagggaaugu

SEQ ID NO: 3666433 - RNA, 18 nt, Human
guggagaugucuucguac

SEQ ID NO: 3666434 - RNA, 21 nt, Human
guggagcacaaaagccucuca

SEQ ID NO: 3666435 - RNA, 17 nt, Human
guggagcaugggccugg

SEQ ID NO: 3666436 - RNA, 12 nt, Human
guggagccaggc

SEQ ID NO: 3666437 - RNA, 15 nt, Human
guggagccagggagc

SEQ ID NO: 3666438 - RNA, 23 nt, Human
guggagcccgcacccccacccuu

SEQ ID NO: 3666439 - RNA, 19 nt, Human
guggagccugacagccaga

SEQ ID NO: 3666440 - RNA, 21 nt, Human
guggagccuuuuaacugugca

SEQ ID NO: 3666441 - RNA, 16 nt, Human
guggagcucagccccg

SEQ ID NO: 3666442 - RNA, 23 nt, Human
guggagcuuaagccacugccucu

SEQ ID NO: 3666443 - RNA, 13 nt, Human
guggaggaaggau

SEQ ID NO: 3666444 - RNA, 16 nt, Human
guggaggaaggauugu

SEQ ID NO: 3666445 - RNA, 23 nt, Human
guggaggaaugcucccccauccu

SEQ ID NO: 3666446 - RNA, 15 nt, Human
guggaggagcagugc

SEQ ID NO: 3666447 - RNA, 20 nt, Human
guggaggagcucaggacacu

SEQ ID NO: 3666448 - RNA, 23 nt, Human
guggaggagcucaggacacuaau

SEQ ID NO: 3666449 - RNA, 17 nt, Human
guggaggaggaaggcaa

SEQ ID NO: 3666450 - RNA, 14 nt, Human
guggaggaggccug

SEQ ID NO: 3666451 - RNA, 14 nt, Human
guggaggagguugg

SEQ ID NO: 3666452 - RNA, 15 nt, Human
guggaggagguuggg

SEQ ID NO: 3666453 - RNA, 17 nt, Human
guggaggaguccaggcc

SEQ ID NO: 3666454 - RNA, 14 nt, Human
guggaggcacuuua

SEQ ID NO: 3666455 - RNA, 12 nt, Human
guggaggcugcu

SEQ ID NO: 3666456 - RNA, 12 nt, Human
guggagggaggc

SEQ ID NO: 3666457 - RNA, 15 nt, Human
guggagggaggcccc

SEQ ID NO: 3666458 - RNA, 16 nt, Human
guggagggcguggagg

SEQ ID NO: 3666459 - RNA, 19 nt, Human
guggagggguaggggcugg

SEQ ID NO: 3666460 - RNA, 16 nt, Human
guggagggguguggca

SEQ ID NO: 3666461 - RNA, 18 nt, Human
guggaggugucaggcugc

SEQ ID NO: 3666462 - RNA, 22 nt, Human
guggagucagccucgcaggccu

SEQ ID NO: 3666463 - RNA, 17 nt, Human
guggagucugccaccca

SEQ ID NO: 3666464 - RNA, 17 nt, Human
guggagugcaguggugc

SEQ ID NO: 3666465 - RNA, 21 nt, Human
gauauauaggcuauuuucuaa

SEQ ID NO: 3666466 - RNA, 14 nt, Human
gauauaucugaaaa

SEQ ID NO: 3666467 - RNA, 18 nt, Human
gauauaugcucugcaugu

SEQ ID NO: 3666468 - RNA, 14 nt, Human
gauauauuaaaaau

SEQ ID NO: 3666469 - RNA, 20 nt, Human
gauauauuaaaaauauaaaa

SEQ ID NO: 3666470 - RNA, 23 nt, Human
gauauauuuaaaaacaaaaggca

SEQ ID NO: 3666471 - RNA, 23 nt, Human
gauauauuuuacaauuuuuuauc

SEQ ID NO: 3666472 - RNA, 20 nt, Human
gauauauuuuauuuuuagaa

SEQ ID NO: 3666473 - RNA, 15 nt, Human
gauauauuuucuuuc

SEQ ID NO: 3666474 - RNA, 17 nt, Human
gauauauuuuuaagaua

SEQ ID NO: 3666475 - RNA, 13 nt, Human
gauaucaaaggca

SEQ ID NO: 3666476 - RNA, 13 nt, Human
gauaucagaauuu

SEQ ID NO: 3666477 - RNA, 17 nt, Human
gauaucagaauuugugu

SEQ ID NO: 3666478 - RNA, 19 nt, Human
gauauccauucuuucugau

SEQ ID NO: 3666479 - RNA, 13 nt, Human
gauaucucaucuc

SEQ ID NO: 3666480 - RNA, 14 nt, Human
gauaucucaucucu

SEQ ID NO: 3666481 - RNA, 16 nt, Human
gauaucugagggagga

SEQ ID NO: 3666482 - RNA, 15 nt, Human
gauaucuugaaauga

SEQ ID NO: 3666483 - RNA, 16 nt, Human
gauaucuuuucuuuag

SEQ ID NO: 3666484 - RNA, 14 nt, Human
gauaugaaaaauau

SEQ ID NO: 3666485 - RNA, 15 nt, Human
gauaugaaaaaugag

SEQ ID NO: 3666486 - RNA, 14 nt, Human
gauaugauuggcaa

SEQ ID NO: 3666487 - RNA, 16 nt, Human
gauaugccugcucuuu

SEQ ID NO: 3666488 - RNA, 14 nt, Human
gauaugcuuaguaa

SEQ ID NO: 3666489 - RNA, 17 nt, Human
gauauggcagaagacac

SEQ ID NO: 3666490 - RNA, 16 nt, Human
gauaugggacauuuuu

SEQ ID NO: 3666491 - RNA, 22 nt, Human
gauaugggacugagccuggccc

SEQ ID NO: 3666492 - RNA, 20 nt, Human
gauauguauguugugaauua

SEQ ID NO: 3666493 - RNA, 15 nt, Human
gauaugugaaacaau

SEQ ID NO: 3666494 - RNA, 23 nt, Human
gauauguuuuauuucauugguua

SEQ ID NO: 3666495 - RNA, 22 nt, Human
gauauuaauuuaucagauugcu

SEQ ID NO: 3666496 - RNA, 16 nt, Human
gauauuacuuuaucac

SEQ ID NO: 3666497 - RNA, 19 nt, Human
gauauuacuuuaucacuuu

SEQ ID NO: 3666498 - RNA, 22 nt, Human
gauauuacuuuaucacuuuuug

SEQ ID NO: 3666499 - RNA, 23 nt, Human
gauauuauucaccauguaaaaca

SEQ ID NO: 3666500 - RNA, 12 nt, Human
gauauuccauag

SEQ ID NO: 3666501 - RNA, 19 nt, Human
gauauuccaugaauguauc

SEQ ID NO: 3666502 - RNA, 18 nt, Human
gauauucuuuguuaauuu

SEQ ID NO: 3666503 - RNA, 20 nt, Human
gauauugaggccaagaauau

SEQ ID NO: 3666504 - RNA, 15 nt, Human
gauauuggaacuugc

SEQ ID NO: 3666505 - RNA, 22 nt, Human
gauauuguucaaacaauaucau

SEQ ID NO: 3666506 - RNA, 13 nt, Human
gauauuuaagaaa

SEQ ID NO: 3666507 - RNA, 15 nt, Human
gauauuuaagaaaau

SEQ ID NO: 3666508 - RNA, 16 nt, Human
gauauuuaagaaaaua

SEQ ID NO: 3666509 - RNA, 19 nt, Human
gauauuuauggggggagaa

SEQ ID NO: 3666510 - RNA, 17 nt, Human
gauauuuccaucauuaa

SEQ ID NO: 3666511 - RNA, 22 nt, Human
gauauuucccuccccuggggac

SEQ ID NO: 3666512 - RNA, 17 nt, Human
gauauuucucuaguagu

SEQ ID NO: 3666513 - RNA, 22 nt, Human
gauauuugucaugcugggauuu

SEQ ID NO: 3666514 - RNA, 19 nt, Human
gauauuuucaaauuguauc

SEQ ID NO: 3666515 - RNA, 19 nt, Human
gauauuuucaacgcagccc

SEQ ID NO: 3666516 - RNA, 21 nt, Human
gauauuuucaacgcagcccug

SEQ ID NO: 3666517 - RNA, 22 nt, Human
gauauuuucaacgcagcccugc

SEQ ID NO: 3666518 - RNA, 23 nt, Human
gauauuuucaacgcagcccugcu

SEQ ID NO: 3666519 - RNA, 18 nt, Human
gauauuuuguaaaaugua

SEQ ID NO: 3666520 - RNA, 17 nt, Human
gauauuuuuaucuuuau

SEQ ID NO: 3666521 - RNA, 22 nt, Human
gauauuuuucauaaacaaguuc

SEQ ID NO: 3666522 - RNA, 21 nt, Human
gauauuuuuucagaaauaugu

SEQ ID NO: 3666523 - RNA, 15 nt, Human
gauauuuuuuucuuu

SEQ ID NO: 3666524 - RNA, 17 nt, Human
gauauuuuuuucuuuuc

SEQ ID NO: 3666525 - RNA, 20 nt, Human
gaucaaaaaggcuuauaaaa

SEQ ID NO: 3666526 - RNA, 22 nt, Human
gaucaaaauaaaaagugacaca

SEQ ID NO: 3666527 - RNA, 12 nt, Human
gaucaaagauga

SEQ ID NO: 3666528 - RNA, 17 nt, Human
gaucaaaggcacacagc

SEQ ID NO: 3666529 - RNA, 16 nt, Human
gaucaaauguuuaauc

SEQ ID NO: 3666530 - RNA, 16 nt, Human
gaucaaauucuacaac

SEQ ID NO: 3666531 - RNA, 14 nt, Human
gaucaacaucuuuu

SEQ ID NO: 3666532 - RNA, 22 nt, Human
gaucaaccccuucgcuccugug

SEQ ID NO: 3666533 - RNA, 23 nt, Human
gaucaaccccuucgcuccugugu

SEQ ID NO: 3666534 - RNA, 14 nt, Human
gaucaagaaagugu

SEQ ID NO: 3666535 - RNA, 16 nt, Human
gaucaaggagaggagg

SEQ ID NO: 3666536 - RNA, 13 nt, Human
gaucaaggccuua

SEQ ID NO: 3666537 - RNA, 22 nt, Human
gaucaaggccuuauuggaaagc

SEQ ID NO: 3666538 - RNA, 23 nt, Human
gaucaaggccuuauuggaaagca

SEQ ID NO: 3666539 - RNA, 14 nt, Human
gaucaauccuuuau

SEQ ID NO: 3666540 - RNA, 15 nt, Human
gaucaauccuuuauu

SEQ ID NO: 3666541 - RNA, 14 nt, Human
gaucaaugacagag

SEQ ID NO: 3666542 - RNA, 23 nt, Human
gaucaauggcgcagugccucugg

SEQ ID NO: 3666543 - RNA, 18 nt, Human
gaucacaacgugcauugu

SEQ ID NO: 3666544 - RNA, 20 nt, Human
gaucacaacgugcauugugc

SEQ ID NO: 3666545 - RNA, 23 nt, Human
gaucacaacgugcauugugcuuc

SEQ ID NO: 3666546 - RNA, 13 nt, Human
gaucacaagaugg

SEQ ID NO: 3666547 - RNA, 15 nt, Human
gaucacacuauuuua

SEQ ID NO: 3666548 - RNA, 19 nt, Human
gaucacagagacauuccuc

SEQ ID NO: 3666549 - RNA, 14 nt, Human
gaucacagccucug

SEQ ID NO: 3666550 - RNA, 17 nt, Human
gaucacagcugcuuucu

SEQ ID NO: 3666551 - RNA, 18 nt, Human
gaucacauaacagaaugc

SEQ ID NO: 3666552 - RNA, 14 nt, Human
gaucaccagaauaa

SEQ ID NO: 3666553 - RNA, 15 nt, Human
gaucaccagcccggc

SEQ ID NO: 3666554 - RNA, 22 nt, Human
gaucaccagcccggccugcucc

SEQ ID NO: 3666555 - RNA, 14 nt, Human
gaucacgccacugc

SEQ ID NO: 3666556 - RNA, 18 nt, Human
gaucacgccacugcacua

SEQ ID NO: 3666557 - RNA, 23 nt, Human
gaucacgccacugcacuccagcc

SEQ ID NO: 3666558 - RNA, 24 nt, Human
gaucacgccacugcacuccagccu

SEQ ID NO: 3666559 - RNA, 14 nt, Human
gaucacgccuggcu

SEQ ID NO: 3666560 - RNA, 18 nt, Human
gaucacggcucacugcag

SEQ ID NO: 3666561 - RNA, 18 nt, Human
gaucacuagccugucauc

SEQ ID NO: 3666562 - RNA, 18 nt, Human
gaucacuaugcauuuuaa

SEQ ID NO: 3666563 - RNA, 20 nt, Human
gaucacugaaauaaaagcua

SEQ ID NO: 3666564 - RNA, 13 nt, Human
gaucacugaauuu

SEQ ID NO: 3666565 - RNA, 17 nt, Human
gaucacugaauuuauaa

SEQ ID NO: 3666566 - RNA, 15 nt, Human
gaucacugccacacu

SEQ ID NO: 3666567 - RNA, 13 nt, Human
gaucacugccaga

SEQ ID NO: 3666568 - RNA, 14 nt, Human
gaucacuguuuaga

SEQ ID NO: 3666569 - RNA, 18 nt, Human
gaucacuguuuagauuug

SEQ ID NO: 3666570 - RNA, 18 nt, Human
gaucagaaaaauggagca

SEQ ID NO: 3666571 - RNA, 22 nt, Human
gaucagaccuuggaucagauga

SEQ ID NO: 3666572 - RNA, 14 nt, Human
gaucagagcagcag

SEQ ID NO: 3666573 - RNA, 17 nt, Human
gaucagagcaggaccuc

SEQ ID NO: 3666574 - RNA, 20 nt, Human
gaucagaguaauccaagcaa

SEQ ID NO: 3666575 - RNA, 22 nt, Human
gaucagaugcuccaagauucua

SEQ ID NO: 3666576 - RNA, 15 nt, Human
gaucagauugcaugu

SEQ ID NO: 3666577 - RNA, 14 nt, Human
gaucagccagaagc

SEQ ID NO: 3666578 - RNA, 18 nt, Human
gaucagccagugaccaac

SEQ ID NO: 3666579 - RNA, 22 nt, Human
gaucagccccacccuggccuag

SEQ ID NO: 3666580 - RNA, 23 nt, Human
gaucagccccacccuggccuaga

SEQ ID NO: 3666581 - RNA, 14 nt, Human
guggcccuguccug

SEQ ID NO: 3666582 - RNA, 19 nt, Human
guggcccuguccugccaug

SEQ ID NO: 3666583 - RNA, 17 nt, Human
guggcccuuccuggaca

SEQ ID NO: 3666584 - RNA, 18 nt, Human
guggcccuuccuggacag

SEQ ID NO: 3666585 - RNA, 21 nt, Human
guggcccuuccuggacagcug

SEQ ID NO: 3666586 - RNA, 11 nt, Human
guggcccuugc

SEQ ID NO: 3666587 - RNA, 17 nt, Human
guggccgcccaaggccc

SEQ ID NO: 3666588 - RNA, 22 nt, Human
guggccuaaccugccgagaguc

SEQ ID NO: 3666589 - RNA, 15 nt, Human
guggccucccaacuc

SEQ ID NO: 3666590 - RNA, 21 nt, Human
guggccucccaacucacccca

SEQ ID NO: 3666591 - RNA, 22 nt, Human
guggccucgggacaccugcccu

SEQ ID NO: 3666592 - RNA, 24 nt, Human
guggccucugccccgucucaugag

SEQ ID NO: 3666593 - RNA, 17 nt, Human
guggccucuugagcagu

SEQ ID NO: 3666594 - RNA, 20 nt, Human
guggccucuugagcaguggc

SEQ ID NO: 3666595 - RNA, 20 nt, Human
guggccuggccaggagcucu

SEQ ID NO: 3666596 - RNA, 21 nt, Human
guggccuggccaggagcucuu

SEQ ID NO: 3666597 - RNA, 17 nt, Human
guggccuguggcugucg

SEQ ID NO: 3666598 - RNA, 18 nt, Human
guggccuguggcugucgg

SEQ ID NO: 3666599 - RNA, 17 nt, Human
guggccugugucccaug

SEQ ID NO: 3666600 - RNA, 19 nt, Human
guggccugugucccaugac

SEQ ID NO: 3666601 - RNA, 15 nt, Human
guggccuuccccagc

SEQ ID NO: 3666602 - RNA, 21 nt, Human
guggccuuccccagcaugcac

SEQ ID NO: 3666603 - RNA, 17 nt, Human
guggccuuccccagccu

SEQ ID NO: 3666604 - RNA, 20 nt, Human
guggcgaaaucccugcucac

SEQ ID NO: 3666605 - RNA, 15 nt, Human
guggcggccccagca

SEQ ID NO: 3666606 - RNA, 14 nt, Human
guggcgggcaccug

SEQ ID NO: 3666607 - RNA, 15 nt, Human
guggcgggcgccugu

SEQ ID NO: 3666608 - RNA, 22 nt, Human
guggcuaaaugccuaauaaaca

SEQ ID NO: 3666609 - RNA, 18 nt, Human
gaucauagauuucugauu

SEQ ID NO: 3666610 - RNA, 13 nt, Human
gaucauaguuuua

SEQ ID NO: 3666611 - RNA, 16 nt, Human
gaucauccacugugcc

SEQ ID NO: 3666612 - RNA, 19 nt, Human
gaucaucgccagaggugcu

SEQ ID NO: 3666613 - RNA, 13 nt, Human
gaucaugcauugu

SEQ ID NO: 3666614 - RNA, 14 nt, Human
gaucaugcauuguu

SEQ ID NO: 3666615 - RNA, 15 nt, Human
gaucaugcauuguug

SEQ ID NO: 3666616 - RNA, 15 nt, Human
gaucaugguguaaua

SEQ ID NO: 3666617 - RNA, 13 nt, Human
gaucauguacuuu

SEQ ID NO: 3666618 - RNA, 15 nt, Human
gaucauguacuuuuu

SEQ ID NO: 3666619 - RNA, 15 nt, Human
gaucauguguggaag

SEQ ID NO: 3666620 - RNA, 21 nt, Human
gaucauguguggaaguuauua

SEQ ID NO: 3666621 - RNA, 15 nt, Human
gaucauguuguuaaa

SEQ ID NO: 3666622 - RNA, 22 nt, Human
gaucauuuauuuuaagcacucu

SEQ ID NO: 3666623 - RNA, 21 nt, Human
gaucauuugcccuuaaggaca

SEQ ID NO: 3666624 - RNA, 16 nt, Human
gauccaaaagaagccc

SEQ ID NO: 3666625 - RNA, 12 nt, Human
gauccaaagacu

SEQ ID NO: 3666626 - RNA, 19 nt, Human
gauccaacuaaugccuuac

SEQ ID NO: 3666627 - RNA, 17 nt, Human
gauccaagcuaagcacu

SEQ ID NO: 3666628 - RNA, 16 nt, Human
gauccaagcugguccc

SEQ ID NO: 3666629 - RNA, 19 nt, Human
gauccaaguuuacucaacc

SEQ ID NO: 3666630 - RNA, 14 nt, Human
gauccacacacaga

SEQ ID NO: 3666631 - RNA, 19 nt, Human
gauccacccaccucagccu

SEQ ID NO: 3666632 - RNA, 12 nt, Human
gauccacccgcc

SEQ ID NO: 3666633 - RNA, 13 nt, Human
gauccaggagcuc

SEQ ID NO: 3666634 - RNA, 21 nt, Human
gauccaggccccucccucucc

SEQ ID NO: 3666635 - RNA, 12 nt, Human
gauccagggaca

SEQ ID NO: 3666636 - RNA, 22 nt, Human
gauccagggacagaggccccag

SEQ ID NO: 3666637 - RNA, 19 nt, Human
gauccagggaggcuggucc

SEQ ID NO: 3666638 - RNA, 17 nt, Human
gauccaguauaagacua

SEQ ID NO: 3666639 - RNA, 13 nt, Human
gauccauccagcu

SEQ ID NO: 3666640 - RNA, 17 nt, Human
gauccauguaacugccu

SEQ ID NO: 3666641 - RNA, 16 nt, Human
gauccauguagcagga

SEQ ID NO: 3666642 - RNA, 14 nt, Human
gauccauuucuaau

SEQ ID NO: 3666643 - RNA, 16 nt, Human
gauccauuuuuuauau

SEQ ID NO: 3666644 - RNA, 18 nt, Human
gaucccaacacugccagc

SEQ ID NO: 3666645 - RNA, 15 nt, Human
gaucccaggccccug

SEQ ID NO: 3666646 - RNA, 15 nt, Human
gaucccaguagaaaa

SEQ ID NO: 3666647 - RNA, 18 nt, Human
gauccccacgccacagcc

SEQ ID NO: 3666648 - RNA, 12 nt, Human
gaucccccagaa

SEQ ID NO: 3666649 - RNA, 13 nt, Human
gauccccgccugg

SEQ ID NO: 3666650 - RNA, 20 nt, Human
gauccccgccuggccaggag

SEQ ID NO: 3666651 - RNA, 14 nt, Human
gauccccucaggac

SEQ ID NO: 3666652 - RNA, 13 nt, Human
gauccccugagcc

SEQ ID NO: 3666653 - RNA, 14 nt, Human
gauccccugagccc

SEQ ID NO: 3666654 - RNA, 21 nt, Human
gaucccgccucuucuucuuca

SEQ ID NO: 3666655 - RNA, 17 nt, Human
gaucccguuuuccccau

SEQ ID NO: 3666656 - RNA, 15 nt, Human
gaucccuagcuguga

SEQ ID NO: 3666657 - RNA, 19 nt, Human
gaucccuagcugugaccuc

SEQ ID NO: 3666658 - RNA, 16 nt, Human
gaucccucauccucau

SEQ ID NO: 3666659 - RNA, 13 nt, Human
gaucccucccccc

SEQ ID NO: 3666660 - RNA, 19 nt, Human
gaucccugucuuuccuaag

SEQ ID NO: 3666661 - RNA, 14 nt, Human
gaucccuguguugu

SEQ ID NO: 3666662 - RNA, 19 nt, Human
gaucccuguguugucucua

SEQ ID NO: 3666663 - RNA, 24 nt, Human
gaucccuguguugucucuagagca

SEQ ID NO: 3666664 - RNA, 13 nt, Human
gaucccuuccacc

SEQ ID NO: 3666665 - RNA, 19 nt, Human
gaucccuuccaccugcucu

SEQ ID NO: 3666666 - RNA, 22 nt, Human
gaucccuuccaccugcucugcu

SEQ ID NO: 3666667 - RNA, 23 nt, Human
gaucccuuccaccugcucugcug

SEQ ID NO: 3666668 - RNA, 17 nt, Human
gauccgacugcuuugga

SEQ ID NO: 3666669 - RNA, 23 nt, Human
gauccgacuugaauuuucccacu

SEQ ID NO: 3666670 - RNA, 18 nt, Human
gauccuauccuccuaccu

SEQ ID NO: 3666671 - RNA, 18 nt, Human
gauccuauucucaccagg

SEQ ID NO: 3666672 - RNA, 19 nt, Human
gauccuauucucaccagga

SEQ ID NO: 3666673 - RNA, 16 nt, Human
gauccucccaccucag

SEQ ID NO: 3666674 - RNA, 15 nt, Human
gauccuccugcagac

SEQ ID NO: 3666675 - RNA, 16 nt, Human
gauccucucuggggcu

SEQ ID NO: 3666676 - RNA, 22 nt, Human
gauccugagccagauuucacuc

SEQ ID NO: 3666677 - RNA, 13 nt, Human
gauccuggaaauc

SEQ ID NO: 3666678 - RNA, 16 nt, Human
gauccugucuuuaagg

SEQ ID NO: 3666679 - RNA, 19 nt, Human
gauccugucuuuaaggaaa

SEQ ID NO: 3666680 - RNA, 20 nt, Human
gauccugucuuuaaggaaaa

SEQ ID NO: 3666681 - RNA, 23 nt, Human
gauccugugaggagccccaucug

SEQ ID NO: 3666682 - RNA, 22 nt, Human
gauccuuagagguccucuggag

SEQ ID NO: 3666683 - RNA, 17 nt, Human
gaucgaaccguuuugaa

SEQ ID NO: 3666684 - RNA, 13 nt, Human
gaucgcaguuugc

SEQ ID NO: 3666685 - RNA, 17 nt, Human
gaucgccuuccccaccc

SEQ ID NO: 3666686 - RNA, 23 nt, Human
gaucgcgccacuacacuccagcc

SEQ ID NO: 3666687 - RNA, 21 nt, Human
gaucgcggcggagcuggcccc

SEQ ID NO: 3666688 - RNA, 17 nt, Human
gaucggagccuccucuc

SEQ ID NO: 3666689 - RNA, 20 nt, Human
gaucggagccuccucucuca

SEQ ID NO: 3666690 - RNA, 13 nt, Human
gaucggcaggaca

SEQ ID NO: 3666691 - RNA, 22 nt, Human
gaucggccaucaagggaagaac

SEQ ID NO: 3666692 - RNA, 16 nt, Human
gaucgguuaacaaaua

SEQ ID NO: 3666693 - RNA, 20 nt, Human
gaucgucugguuagaaaaca

SEQ ID NO: 3666694 - RNA, 16 nt, Human
gaucgugacgcugaau

SEQ ID NO: 3666695 - RNA, 15 nt, Human
gaucgugcuaaauuu

SEQ ID NO: 3666696 - RNA, 22 nt, Human
gaucgugcuacugcacuccagc

SEQ ID NO: 3666697 - RNA, 16 nt, Human
gaucuaaauaaaaugc

SEQ ID NO: 3666698 - RNA, 18 nt, Human
gaucuaccagcauaaaua

SEQ ID NO: 3666699 - RNA, 17 nt, Human
gaucuaccccuuacuua

SEQ ID NO: 3666700 - RNA, 20 nt, Human
gaucuacuucuguaauugug

SEQ ID NO: 3666701 - RNA, 16 nt, Human
gaucuagaauguguuu

SEQ ID NO: 3666702 - RNA, 21 nt, Human
gaucuagaauguguuuucuga

SEQ ID NO: 3666703 - RNA, 17 nt, Human
gaucuagguuuaacuca

SEQ ID NO: 3666704 - RNA, 22 nt, Human
gaucuagguuuaacucagauca

SEQ ID NO: 3666705 - RNA, 17 nt, Human
gaucuaguucacucucc

SEQ ID NO: 3666706 - RNA, 13 nt, Human
gaucuauaaagcg

SEQ ID NO: 3666707 - RNA, 14 nt, Human
gaucuauuucaugu

SEQ ID NO: 3666708 - RNA, 16 nt, Human
gaucuauuucauguuu

SEQ ID NO: 3666709 - RNA, 20 nt, Human
gaucucaccaggcagccucu

SEQ ID NO: 3666710 - RNA, 23 nt, Human
gaucucaccaggcagccucuggg

SEQ ID NO: 3666711 - RNA, 15 nt, Human
gaucucacucugccc

SEQ ID NO: 3666712 - RNA, 14 nt, Human
gaucucagggaagc

SEQ ID NO: 3666713 - RNA, 21 nt, Human
gaucucauucaguauuaaagg

SEQ ID NO: 3666714 - RNA, 14 nt, Human
gaucuccaaagcuu

SEQ ID NO: 3666715 - RNA, 13 nt, Human
gaucuccaaggac

SEQ ID NO: 3666716 - RNA, 13 nt, Human
gaucucccugccg

SEQ ID NO: 3666717 - RNA, 18 nt, Human
gaucucccugccgccuca

SEQ ID NO: 3666718 - RNA, 14 nt, Human
gaucuccuugcccu

SEQ ID NO: 3666719 - RNA, 14 nt, Human
gaucucgguuugcc

SEQ ID NO: 3666720 - RNA, 20 nt, Human
gaucucgguuugccaaaauu

SEQ ID NO: 3666721 - RNA, 15 nt, Human
gaucucuaacuucac

SEQ ID NO: 3666722 - RNA, 17 nt, Human
gaucucucaggagcaca

SEQ ID NO: 3666723 - RNA, 21 nt, Human
gaucucucaggagcacaggca

SEQ ID NO: 3666724 - RNA, 19 nt, Human
gaucucugaagccacaaau

SEQ ID NO: 3666725 - RNA, 15 nt, Human
gaucucugcagggcc

SEQ ID NO: 3666726 - RNA, 16 nt, Human
gaucucugcagggccg

SEQ ID NO: 3666727 - RNA, 20 nt, Human
gaucucugcagggccgccag

SEQ ID NO: 3666728 - RNA, 14 nt, Human
gaucucuuccuguu

SEQ ID NO: 3666729 - RNA, 16 nt, Human
gaucucuugagccugg

SEQ ID NO: 3666730 - RNA, 17 nt, Human
gaucucuugagccuggg

SEQ ID NO: 3666731 - RNA, 18 nt, Human
gaucucuugagccuggga

SEQ ID NO: 3666732 - RNA, 12 nt, Human
gaucugaacaga

SEQ ID NO: 3666733 - RNA, 21 nt, Human
gaucugacaugauuccuuccu

SEQ ID NO: 3666734 - RNA, 13 nt, Human
gaucugacugcac

SEQ ID NO: 3666735 - RNA, 15 nt, Human
gaucugagucccagg

SEQ ID NO: 3666736 - RNA, 19 nt, Human
gaucugauaggguuuguga

SEQ ID NO: 3666737 - RNA, 23 nt, Human
gaucugauaggguuugugacagg

SEQ ID NO: 3666738 - RNA, 11 nt, Human
gaucugcccau

SEQ ID NO: 3666739 - RNA, 15 nt, Human
gaucugccuaaggac

SEQ ID NO: 3666740 - RNA, 17 nt, Human
gaucugccuaaggacuu

SEQ ID NO: 3666741 - RNA, 18 nt, Human
gaucugccuaaggacuuc

SEQ ID NO: 3666742 - RNA, 23 nt, Human
gaucugccuaaggacuucuuuaa

SEQ ID NO: 3666743 - RNA, 19 nt, Human
gaucugcggaucucagcuu

SEQ ID NO: 3666744 - RNA, 15 nt, Human
gaucugcucagcccu

SEQ ID NO: 3666745 - RNA, 17 nt, Human
gaucugcucagcccugg

SEQ ID NO: 3666746 - RNA, 18 nt, Human
guguaucguaaccagcca

SEQ ID NO: 3666747 - RNA, 15 nt, Human
guguaugacuaaaga

SEQ ID NO: 3666748 - RNA, 17 nt, Human
guguaugcacaugaacu

SEQ ID NO: 3666749 - RNA, 19 nt, Human
guguaugcuacuacaaaaa

SEQ ID NO: 3666750 - RNA, 14 nt, Human
guguaugcugcuuu

SEQ ID NO: 3666751 - RNA, 22 nt, Human
guguauggguguguguuugugu

SEQ ID NO: 3666752 - RNA, 16 nt, Human
guguaugugcgugugu

SEQ ID NO: 3666753 - RNA, 13 nt, Human
guguauguggggg

SEQ ID NO: 3666754 - RNA, 12 nt, Human
guguauguguau

SEQ ID NO: 3666755 - RNA, 15 nt, Human
guucaguguuucugg

SEQ ID NO: 3666756 - RNA, 12 nt, Human
guucaguuacag

SEQ ID NO: 3666757 - RNA, 20 nt, Human
guucaguuccucuuugcaug

SEQ ID NO: 3666758 - RNA, 18 nt, Human
guucaguuucuucugcgc

SEQ ID NO: 3666759 - RNA, 20 nt, Human
guucauaacagugccauugu

SEQ ID NO: 3666760 - RNA, 10 nt, Human
guucauacau

SEQ ID NO: 3666761 - RNA, 14 nt, Human
guucauacauuuga

SEQ ID NO: 3666762 - RNA, 17 nt, Human
guucauaccuaaguacu

SEQ ID NO: 3666763 - RNA, 19 nt, Human
guucauaccuaaguacugu

SEQ ID NO: 3666764 - RNA, 14 nt, Human
guucauagcccagu

SEQ ID NO: 3666765 - RNA, 18 nt, Human
guucauagggucucuuca

SEQ ID NO: 3666766 - RNA, 12 nt, Human
guucaucagugu

SEQ ID NO: 3666767 - RNA, 14 nt, Human
guucaucaguguua

SEQ ID NO: 3666768 - RNA, 16 nt, Human
guucaucaguguuaaa

SEQ ID NO: 3666769 - RNA, 15 nt, Human
guucauccaauccuc

SEQ ID NO: 3666770 - RNA, 18 nt, Human
guucauccaauccucacu

SEQ ID NO: 3666771 - RNA, 16 nt, Human
guucaucccuucucuu

SEQ ID NO: 3666772 - RNA, 18 nt, Human
guucaucccuucucuucc

SEQ ID NO: 3666773 - RNA, 19 nt, Human
guucaucccuucucuucca

SEQ ID NO: 3666774 - RNA, 17 nt, Human
guucauccuauuguuga

SEQ ID NO: 3666775 - RNA, 16 nt, Human
guucaucgauuuucua

SEQ ID NO: 3666776 - RNA, 17 nt, Human
guucaucguauaacaca

SEQ ID NO: 3666777 - RNA, 18 nt, Human
guucaucuugaauuguaa

SEQ ID NO: 3666778 - RNA, 17 nt, Human
guucaugaugcagucuc

SEQ ID NO: 3666779 - RNA, 23 nt, Human
guucaugaugcagucuccucuuu

SEQ ID NO: 3666780 - RNA, 16 nt, Human
guucaugccaccaugg

SEQ ID NO: 3666781 - RNA, 23 nt, Human
guucauggaacgcguugaaauug

SEQ ID NO: 3666782 - RNA, 20 nt, Human
guucaugggggagggggcag

SEQ ID NO: 3666783 - RNA, 15 nt, Human
guucauguagagaaa

SEQ ID NO: 3666784 - RNA, 15 nt, Human
guucauguuugcuuc

SEQ ID NO: 3666785 - RNA, 24 nt, Human
guucauguuugcuucauaaaugaa

SEQ ID NO: 3666786 - RNA, 16 nt, Human
guucauguuuggugca

SEQ ID NO: 3666787 - RNA, 16 nt, Human
guucauuagaaauauu

SEQ ID NO: 3666788 - RNA, 15 nt, Human
guucauuauuggaau

SEQ ID NO: 3666789 - RNA, 22 nt, Human
guucauuauuggaauuaaccug

SEQ ID NO: 3666790 - RNA, 14 nt, Human
guucauucauauua

SEQ ID NO: 3666791 - RNA, 14 nt, Human
guucauuccuccag

SEQ ID NO: 3666792 - RNA, 15 nt, Human
guucauucuucagau

SEQ ID NO: 3666793 - RNA, 19 nt, Human
guucauuguaauguuacug

SEQ ID NO: 3666794 - RNA, 23 nt, Human
guucauuguaauguuacugauca

SEQ ID NO: 3666795 - RNA, 16 nt, Human
guucauuugugugcuc

SEQ ID NO: 3666796 - RNA, 17 nt, Human
guuccaaacaugagguu

SEQ ID NO: 3666797 - RNA, 23 nt, Human
guuccaaacaugagguucucucu

SEQ ID NO: 3666798 - RNA, 14 nt, Human
guuccaaauucagu

SEQ ID NO: 3666799 - RNA, 20 nt, Human
guuccaaauucaguuucaua

SEQ ID NO: 3666800 - RNA, 16 nt, Human
guuccaagacauuguc

SEQ ID NO: 3666801 - RNA, 14 nt, Human
guuccaaggccagg

SEQ ID NO: 3666802 - RNA, 21 nt, Human
guuuuuuuuuuuuuuuuggcu

SEQ ID NO: 3666803 - RNA, 17 nt, Human
uaaaaaaaaaaaaguua

SEQ ID NO: 3666804 - RNA, 15 nt, Human
uaaaaaaaaaaguca

SEQ ID NO: 3666805 - RNA, 21 nt, Human
uaaaaaaaaaaguuacagaaa

SEQ ID NO: 3666806 - RNA, 14 nt, Human
uaaaaaaaaaauug

SEQ ID NO: 3666807 - RNA, 19 nt, Human
uaaaaaaaaagaucuguuu

SEQ ID NO: 3666808 - RNA, 16 nt, Human
uaaaaaaaaaggcaua

SEQ ID NO: 3666809 - RNA, 21 nt, Human
uaaaaaaaaauagaugucuuu

SEQ ID NO: 3666810 - RNA, 13 nt, Human
uaaaaaaaacaaa

SEQ ID NO: 3666811 - RNA, 18 nt, Human
uaaaaaaaacaaaaagaa

SEQ ID NO: 3666812 - RNA, 12 nt, Human
uaaaaaaaagaa

SEQ ID NO: 3666813 - RNA, 14 nt, Human
uaaaaaaagaaaaa

SEQ ID NO: 3666814 - RNA, 15 nt, Human
uaaaaaaagagaauu

SEQ ID NO: 3666815 - RNA, 12 nt, Human
uaaaaaaauuua

SEQ ID NO: 3666816 - RNA, 12 nt, Human
uaaaaaacacug

SEQ ID NO: 3666817 - RNA, 19 nt, Human
uaaaaaacuaaaaacuaga

SEQ ID NO: 3666818 - RNA, 21 nt, Human
uaaaaaacuaucuuuuugcuu

SEQ ID NO: 3666819 - RNA, 15 nt, Human
uaaaaaacuuguaaa

SEQ ID NO: 3666820 - RNA, 12 nt, Human
uaaaaaagauaa

SEQ ID NO: 3666821 - RNA, 13 nt, Human
uaaaaaagauaaa

SEQ ID NO: 3666822 - RNA, 18 nt, Human
uaaaaaagcauacuucua

SEQ ID NO: 3666823 - RNA, 17 nt, Human
uaaaaaagcuuaaaacu

SEQ ID NO: 3666824 - RNA, 18 nt, Human
uaaaaaagcuuaaaacuu

SEQ ID NO: 3666825 - RNA, 12 nt, Human
uaaaaaagucuc

SEQ ID NO: 3666826 - RNA, 21 nt, Human
uaaaaaagucucuauuuaaau

SEQ ID NO: 3666827 - RNA, 20 nt, Human
uaaaaaaguuuaaaauguau

SEQ ID NO: 3666828 - RNA, 17 nt, Human
uaaaaaauaauaauaca

SEQ ID NO: 3666829 - RNA, 17 nt, Human
uaaaaaauggugccuga

SEQ ID NO: 3666830 - RNA, 12 nt, Human
uaaaaaaugguu

SEQ ID NO: 3666831 - RNA, 15 nt, Human
uaaaaaaugugugua

SEQ ID NO: 3666832 - RNA, 23 nt, Human
uaaaaaauguguguauucuuaaa

SEQ ID NO: 3666833 - RNA, 21 nt, Human
uaaaaaauuuaaaaagcccaa

SEQ ID NO: 3666834 - RNA, 14 nt, Human
uaaaaaauuuuaaa

SEQ ID NO: 3666835 - RNA, 15 nt, Human
uaaaaaauuuuguaa

SEQ ID NO: 3666836 - RNA, 17 nt, Human
uaaaaaauuuuguaauu

SEQ ID NO: 3666837 - RNA, 23 nt, Human
uaaaaacaaaaacaucccaagau

SEQ ID NO: 3666838 - RNA, 22 nt, Human
uaaaaacagauuuggaaagacu

SEQ ID NO: 3666839 - RNA, 19 nt, Human
uaaaaacagcauugcuuuc

SEQ ID NO: 3666840 - RNA, 20 nt, Human
uaaaaacagcauugcuuucu

SEQ ID NO: 3666841 - RNA, 15 nt, Human
uaaaaacauaacaua

SEQ ID NO: 3666842 - RNA, 19 nt, Human
uaaaaacauugccuuugaa

SEQ ID NO: 3666843 - RNA, 21 nt, Human
uaaaaacauugccuuugaaug

SEQ ID NO: 3666844 - RNA, 17 nt, Human
uaaaaacccacaaaaau

SEQ ID NO: 3666845 - RNA, 16 nt, Human
uaaaaaccgaauaaau

SEQ ID NO: 3666846 - RNA, 18 nt, Human
uaaaaaccgaauaaaugu

SEQ ID NO: 3666847 - RNA, 20 nt, Human
uaaaaacuaguaguucucuu

SEQ ID NO: 3666848 - RNA, 15 nt, Human
uaaaaacugaaguuc

SEQ ID NO: 3666849 - RNA, 12 nt, Human
uaaaaagaaaaa

SEQ ID NO: 3666850 - RNA, 17 nt, Human
uaaaaagaaaacaaaac

SEQ ID NO: 3666851 - RNA, 13 nt, Human
uaaaaagaaggaa

SEQ ID NO: 3666852 - RNA, 15 nt, Human
uaaaaagaagugcug

SEQ ID NO: 3666853 - RNA, 12 nt, Human
uaaaaagauaau

SEQ ID NO: 3666854 - RNA, 23 nt, Human
uaaaaagauaaucucagugcuuu

SEQ ID NO: 3666855 - RNA, 16 nt, Human
uaaaaagauuagcaag

SEQ ID NO: 3666856 - RNA, 14 nt, Human
uaaaaagcaaaaau

SEQ ID NO: 3666857 - RNA, 17 nt, Human
uaaaaagccagggcugg

SEQ ID NO: 3666858 - RNA, 12 nt, Human
uaaaaagcccaa

SEQ ID NO: 3666859 - RNA, 20 nt, Human
uaaaaagcccaaccucuucc

SEQ ID NO: 3666860 - RNA, 13 nt, Human
uaaaaagcugacc

SEQ ID NO: 3666861 - RNA, 20 nt, Human
uaaaaagcuuccaugauucu

SEQ ID NO: 3666862 - RNA, 17 nt, Human
uaaaaagcuuuugucua

SEQ ID NO: 3666863 - RNA, 15 nt, Human
uaaaaaggaacugca

SEQ ID NO: 3666864 - RNA, 18 nt, Human
uaaaaaggaacugcagca

SEQ ID NO: 3666865 - RNA, 20 nt, Human
uaaaaaggaauccacuccca

SEQ ID NO: 3666866 - RNA, 20 nt, Human
uaaaaaggagaauuuuuccu

SEQ ID NO: 3666867 - RNA, 17 nt, Human
uaaaaaggcuaaaugga

SEQ ID NO: 3666868 - RNA, 20 nt, Human
uaaaaagggcagggcaucuc

SEQ ID NO: 3666869 - RNA, 15 nt, Human
uaaaaaggugaccau

SEQ ID NO: 3666870 - RNA, 13 nt, Human
uaaaaaguauugc

SEQ ID NO: 3666871 - RNA, 22 nt, Human
uaaaaaguccauaccuuauaua

SEQ ID NO: 3666872 - RNA, 17 nt, Human
uaaaaagucuucacucu

SEQ ID NO: 3666873 - RNA, 14 nt, Human
uaaaaagucuuuua

SEQ ID NO: 3666874 - RNA, 16 nt, Human
uaaaaagucuuuuaaa

SEQ ID NO: 3666875 - RNA, 17 nt, Human
uaaaaagugacacagca

SEQ ID NO: 3666876 - RNA, 18 nt, Human
uaaaaagugacacagcag

SEQ ID NO: 3666877 - RNA, 12 nt, Human
uaaaaaguggaa

SEQ ID NO: 3666878 - RNA, 14 nt, Human
uaaaaaguguuuaa

SEQ ID NO: 3666879 - RNA, 17 nt, Human
uaaaaaguguuuaaaug

SEQ ID NO: 3666880 - RNA, 12 nt, Human
uaaaaaguuaaa

SEQ ID NO: 3666881 - RNA, 15 nt, Human
uaaaaaguuguucaa

SEQ ID NO: 3666882 - RNA, 19 nt, Human
uaaaaauaaaaaacacugg

SEQ ID NO: 3666883 - RNA, 21 nt, Human
uaaaaauaaaaaacacuggga

SEQ ID NO: 3666884 - RNA, 21 nt, Human
uaaaaauaaaaaagaucccaa

SEQ ID NO: 3666885 - RNA, 12 nt, Human
uaaaaauaaagc

SEQ ID NO: 3666886 - RNA, 17 nt, Human
uaaaaauaaauagaaaa

SEQ ID NO: 3666887 - RNA, 14 nt, Human
uaaaaauaaauccc

SEQ ID NO: 3666888 - RNA, 19 nt, Human
uaaaaauaaaucccaugga

SEQ ID NO: 3666889 - RNA, 14 nt, Human
uaaaaauaaauuca

SEQ ID NO: 3666890 - RNA, 17 nt, Human
uaaaaauaaauuugguu

SEQ ID NO: 3666891 - RNA, 11 nt, Human
uaaaaauaacc

SEQ ID NO: 3666892 - RNA, 14 nt, Human
uaaaaauacaaaca

SEQ ID NO: 3666893 - RNA, 14 nt, Human
uaaaaauauaaaac

SEQ ID NO: 3666894 - RNA, 13 nt, Human
uaaaaauauauau

SEQ ID NO: 3666895 - RNA, 22 nt, Human
uaaaaauaugcuaauucucaga

SEQ ID NO: 3666896 - RNA, 23 nt, Human
uaaaaauauggaacuucuaauau

SEQ ID NO: 3666897 - RNA, 19 nt, Human
uaaaaauauuguuucugca

SEQ ID NO: 3666898 - RNA, 15 nt, Human
uaaaaaucacacugu

SEQ ID NO: 3666899 - RNA, 11 nt, Human
uaaaaaucaua

SEQ ID NO: 3666900 - RNA, 17 nt, Human
uaaaaaucauaaacugu

SEQ ID NO: 3666901 - RNA, 18 nt, Human
gauucccaagcucugcuc

SEQ ID NO: 3666902 - RNA, 22 nt, Human
gauucccaagcucugcuccucu

SEQ ID NO: 3666903 - RNA, 22 nt, Human
gauucccaccaaggucuucagc

SEQ ID NO: 3666904 - RNA, 13 nt, Human
gauucccaggagu

SEQ ID NO: 3666905 - RNA, 17 nt, Human
gauucccaggaugagca

SEQ ID NO: 3666906 - RNA, 14 nt, Human
gauucccucuccca

SEQ ID NO: 3666907 - RNA, 18 nt, Human
gauucccucucccaggcc

SEQ ID NO: 3666908 - RNA, 20 nt, Human
gauucccucucccaggcccc

SEQ ID NO: 3666909 - RNA, 18 nt, Human
gauuccggauccuaagca

SEQ ID NO: 3666910 - RNA, 22 nt, Human
gauuccuaagccacuugaaaug

SEQ ID NO: 3666911 - RNA, 12 nt, Human
gauuccugaccc

SEQ ID NO: 3666912 - RNA, 16 nt, Human
gauuccugacccaggc

SEQ ID NO: 3666913 - RNA, 19 nt, Human
gauuccugacccaggccgc

SEQ ID NO: 3666914 - RNA, 13 nt, Human
gauuccuucccau

SEQ ID NO: 3666915 - RNA, 15 nt, Human
gauuccuuccuguuc

SEQ ID NO: 3666916 - RNA, 14 nt, Human
gauuccuuuaacaa

SEQ ID NO: 3666917 - RNA, 21 nt, Human
gauuccuuugaagaggaaaau

SEQ ID NO: 3666918 - RNA, 10 nt, Human
gauuccuuuu

SEQ ID NO: 3666919 - RNA, 16 nt, Human
gauuccuuuucuuguu

SEQ ID NO: 3666920 - RNA, 12 nt, Human
gauucuaaaaug

SEQ ID NO: 3666921 - RNA, 12 nt, Human
gauucuaaagau

SEQ ID NO: 3666922 - RNA, 14 nt, Human
gauucuaaagauuc

SEQ ID NO: 3666923 - RNA, 16 nt, Human
gauucuaaagauucua

SEQ ID NO: 3666924 - RNA, 15 nt, Human
gauucuaaugucuuc

SEQ ID NO: 3666925 - RNA, 22 nt, Human
gauucuacuuuaagcacuacau

SEQ ID NO: 3666926 - RNA, 23 nt, Human
gauucuacuuuaagcacuacaua

SEQ ID NO: 3666927 - RNA, 19 nt, Human
gauucuagaucagaugcuc

SEQ ID NO: 3666928 - RNA, 23 nt, Human
gauucuagaucagaugcuccaag

SEQ ID NO: 3666929 - RNA, 15 nt, Human
gauucuauaguucua

SEQ ID NO: 3666930 - RNA, 18 nt, Human
gauucuauaguucuagac

SEQ ID NO: 3666931 - RNA, 18 nt, Human
gauucucaaaggagcgag

SEQ ID NO: 3666932 - RNA, 23 nt, Human
gauucucagggucucugcugccg

SEQ ID NO: 3666933 - RNA, 14 nt, Human
gauucuccugccuc

SEQ ID NO: 3666934 - RNA, 15 nt, Human
gauucuccugccuca

SEQ ID NO: 3666935 - RNA, 20 nt, Human
gauucuccugccucagccuc

SEQ ID NO: 3666936 - RNA, 18 nt, Human
gauucuccuucagcccuc

SEQ ID NO: 3666937 - RNA, 11 nt, Human
gauucucucca

SEQ ID NO: 3666938 - RNA, 22 nt, Human
gauucucuggcuguaaggcucu

SEQ ID NO: 3666939 - RNA, 23 nt, Human
gauucucuggcuguaaggcucua

SEQ ID NO: 3666940 - RNA, 22 nt, Human
gauucucugugucuaagauucu

SEQ ID NO: 3666941 - RNA, 16 nt, Human
gauucucuugccucaa

SEQ ID NO: 3666942 - RNA, 23 nt, Human
gauucugaccuuaaaugcaacca

SEQ ID NO: 3666943 - RNA, 14 nt, Human
gauucugagagcug

SEQ ID NO: 3666944 - RNA, 12 nt, Human
gauucugccuuu

SEQ ID NO: 3666945 - RNA, 17 nt, Human
gauucugccuuugccag

SEQ ID NO: 3666946 - RNA, 19 nt, Human
gauucugcuggccucugcg

SEQ ID NO: 3666947 - RNA, 19 nt, Human
gauucuguguguuuucaua

SEQ ID NO: 3666948 - RNA, 16 nt, Human
gauucuuaaaguugaa

SEQ ID NO: 3666949 - RNA, 17 nt, Human
gauucuuaaaguugaau

SEQ ID NO: 3666950 - RNA, 21 nt, Human
gauucuuaaaguugaauuuau

SEQ ID NO: 3666951 - RNA, 17 nt, Human
gauucuuccucccuccc

SEQ ID NO: 3666952 - RNA, 13 nt, Human
gauucuucugcuu

SEQ ID NO: 3666953 - RNA, 21 nt, Human
gauucuucugcuucagccucc

SEQ ID NO: 3666954 - RNA, 15 nt, Human
gauucuuguauuuau

SEQ ID NO: 3666955 - RNA, 21 nt, Human
gauucuuguuuugcuuccccu

SEQ ID NO: 3666956 - RNA, 20 nt, Human
gauucuuuccugaggcuggg

SEQ ID NO: 3666957 - RNA, 22 nt, Human
gauucuuuccugaggcugggcu

SEQ ID NO: 3666958 - RNA, 23 nt, Human
gauucuuuuguauguaacaauug

SEQ ID NO: 3666959 - RNA, 14 nt, Human
gauucuuuuucuga

SEQ ID NO: 3666960 - RNA, 14 nt, Human
gauugaaaacuuuu

SEQ ID NO: 3666961 - RNA, 21 nt, Human
gauugaaaacuuuucucagau

SEQ ID NO: 3666962 - RNA, 16 nt, Human
gauugacagcuuugcu

SEQ ID NO: 3666963 - RNA, 12 nt, Human
gauugaccugcu

SEQ ID NO: 3666964 - RNA, 23 nt, Human
gauugacgggacuguugguauug

SEQ ID NO: 3666965 - RNA, 16 nt, Human
gauugagaagaggaca

SEQ ID NO: 3666966 - RNA, 18 nt, Human
gauugagaaggagagaaa

SEQ ID NO: 3666967 - RNA, 13 nt, Human
guucucaaugaaa

SEQ ID NO: 3666968 - RNA, 16 nt, Human
guucucaaugugaaaa

SEQ ID NO: 3666969 - RNA, 14 nt, Human
guucucaauuccaa

SEQ ID NO: 3666970 - RNA, 21 nt, Human
guucucacacuggucugcugu

SEQ ID NO: 3666971 - RNA, 14 nt, Human
guucucagcucccc

SEQ ID NO: 3666972 - RNA, 15 nt, Human
guucucagcuccccc

SEQ ID NO: 3666973 - RNA, 17 nt, Human
guucucagcucccccug

SEQ ID NO: 3666974 - RNA, 14 nt, Human
guucucagggcucc

SEQ ID NO: 3666975 - RNA, 11 nt, Human
guucucaucuu

SEQ ID NO: 3666976 - RNA, 18 nt, Human
guucuccagucauuaugu

SEQ ID NO: 3666977 - RNA, 16 nt, Human
guucucccugggaggc

SEQ ID NO: 3666978 - RNA, 22 nt, Human
guucuccguuagcuccuguggc

SEQ ID NO: 3666979 - RNA, 23 nt, Human
guucuccguuagcuccuguggcc

SEQ ID NO: 3666980 - RNA, 15 nt, Human
guucucuagaaagaa

SEQ ID NO: 3666981 - RNA, 22 nt, Human
guucucuaucauuuaauaauau

SEQ ID NO: 3666982 - RNA, 21 nt, Human
guucucucccaggggcuggcu

SEQ ID NO: 3666983 - RNA, 13 nt, Human
guucucuccuucu

SEQ ID NO: 3666984 - RNA, 22 nt, Human
guucucucugccugugagccag

SEQ ID NO: 3666985 - RNA, 15 nt, Human
guucucucuuugcau

SEQ ID NO: 3666986 - RNA, 11 nt, Human
guucucugccc

SEQ ID NO: 3666987 - RNA, 15 nt, Human
guucucugggagaaa

SEQ ID NO: 3666988 - RNA, 16 nt, Human
guucucugggagaaaa

SEQ ID NO: 3666989 - RNA, 16 nt, Human
guucucuuaaaaggua

SEQ ID NO: 3666990 - RNA, 14 nt, Human
guucucuucuugaa

SEQ ID NO: 3666991 - RNA, 15 nt, Human
guucugaaauaaacu

SEQ ID NO: 3666992 - RNA, 20 nt, Human
guucugaaaugucaguucug

SEQ ID NO: 3666993 - RNA, 15 nt, Human
guucugaagaagaug

SEQ ID NO: 3666994 - RNA, 18 nt, Human
guucugaauaauuucuua

SEQ ID NO: 3666995 - RNA, 13 nt, Human
guucugacuugac

SEQ ID NO: 3666996 - RNA, 20 nt, Human
guucugagauggcucccagg

SEQ ID NO: 3666997 - RNA, 16 nt, Human
guucugagcugccagu

SEQ ID NO: 3666998 - RNA, 18 nt, Human
guucugagcugccagugg

SEQ ID NO: 3666999 - RNA, 19 nt, Human
guucugauccuaguuccac

SEQ ID NO: 3667000 - RNA, 15 nt, Human
guucugcaaauagaa

SEQ ID NO: 3667001 - RNA, 15 nt, Human
guucugcagguugaa

SEQ ID NO: 3667002 - RNA, 14 nt, Human
guucugccaggaga

SEQ ID NO: 3667003 - RNA, 17 nt, Human
guucugcccccagccca

SEQ ID NO: 3667004 - RNA, 13 nt, Human
guucugccucucc

SEQ ID NO: 3667005 - RNA, 15 nt, Human
guucugccugccagc

SEQ ID NO: 3667006 - RNA, 23 nt, Human
guucugccugccagcugcacuga

SEQ ID NO: 3667007 - RNA, 15 nt, Human
guucugcucaucauu

SEQ ID NO: 3667008 - RNA, 18 nt, Human
guucugcucaucauucuc

SEQ ID NO: 3667009 - RNA, 14 nt, Human
guucugcuccucuc

SEQ ID NO: 3667010 - RNA, 15 nt, Human
guucugcuccucucc

SEQ ID NO: 3667011 - RNA, 14 nt, Human
guucugcuggccug

SEQ ID NO: 3667012 - RNA, 20 nt, Human
guucuggaaaagaacuguuu

SEQ ID NO: 3667013 - RNA, 20 nt, Human
guucuggaggaaagggagga

SEQ ID NO: 3667014 - RNA, 17 nt, Human
guucuggauggugugcc

SEQ ID NO: 3667015 - RNA, 12 nt, Human
guucuggcucuu

SEQ ID NO: 3667016 - RNA, 22 nt, Human
guucuggcugccccaaccugcu

SEQ ID NO: 3667017 - RNA, 15 nt, Human
guucugggacacagu

SEQ ID NO: 3667018 - RNA, 16 nt, Human
guucugggacacaguu

SEQ ID NO: 3667019 - RNA, 18 nt, Human
guucugggcucuuuccuc

SEQ ID NO: 3667020 - RNA, 14 nt, Human
guucuggggccccu

SEQ ID NO: 3667021 - RNA, 20 nt, Human
guucuggggggacccagugc

SEQ ID NO: 3667022 - RNA, 11 nt, Human
guucugggugg

SEQ ID NO: 3667023 - RNA, 18 nt, Human
guucugggugguugcccu

SEQ ID NO: 3667024 - RNA, 15 nt, Human
guucuggugugaacu

SEQ ID NO: 3667025 - RNA, 21 nt, Human
guucugguuagcucagcccca

SEQ ID NO: 3667026 - RNA, 23 nt, Human
guucugguuagcucagccccagc

SEQ ID NO: 3667027 - RNA, 11 nt, Human
guucugucccu

SEQ ID NO: 3667028 - RNA, 18 nt, Human
guucugucccuugccccc

SEQ ID NO: 3667029 - RNA, 17 nt, Human
guucugucucauaugau

SEQ ID NO: 3667030 - RNA, 11 nt, Human
guucugugcac

SEQ ID NO: 3667031 - RNA, 14 nt, Human
guucuguggaaagu

SEQ ID NO: 3667032 - RNA, 16 nt, Human
guucuguggaaagugu

SEQ ID NO: 3667033 - RNA, 19 nt, Human
guucuguggaaaguguaaa

SEQ ID NO: 3667034 - RNA, 21 nt, Human
guucuguggaaaguguaaagc

SEQ ID NO: 3667035 - RNA, 18 nt, Human
guucugugguuccucugc

SEQ ID NO: 3667036 - RNA, 16 nt, Human
guucugugguuucaug

SEQ ID NO: 3667037 - RNA, 19 nt, Human
guucugugguuucauguua

SEQ ID NO: 3667038 - RNA, 19 nt, Human
guucuguguauuuaauugu

SEQ ID NO: 3667039 - RNA, 14 nt, Human
guucuguuaacuga

SEQ ID NO: 3667040 - RNA, 16 nt, Human
guucuguuaacugaau

SEQ ID NO: 3667041 - RNA, 21 nt, Human
guucuguuaacugaauaccac

SEQ ID NO: 3667042 - RNA, 19 nt, Human
guucuguuacaaaauguaa

SEQ ID NO: 3667043 - RNA, 22 nt, Human
guucuguuacaaaauguaacug

SEQ ID NO: 3667044 - RNA, 23 nt, Human
guucuguuauauccccugcuacc

SEQ ID NO: 3667045 - RNA, 14 nt, Human
guucuguuuacauc

SEQ ID NO: 3667046 - RNA, 15 nt, Human
guuucucccgugcuu

SEQ ID NO: 3667047 - RNA, 20 nt, Human
guuucucccucucacugucu

SEQ ID NO: 3667048 - RNA, 19 nt, Human
guuucucucuacagugcca

SEQ ID NO: 3667049 - RNA, 13 nt, Human
guuucucugcugu

SEQ ID NO: 3667050 - RNA, 14 nt, Human
guuucucuguggcu

SEQ ID NO: 3667051 - RNA, 18 nt, Human
guuucucuuagaaaagcu

SEQ ID NO: 3667052 - RNA, 20 nt, Human
guuucucuucuagaugauuu

SEQ ID NO: 3667053 - RNA, 13 nt, Human
guuucucuucucc

SEQ ID NO: 3667054 - RNA, 19 nt, Human
guuucucuuugauuauuug

SEQ ID NO: 3667055 - RNA, 13 nt, Human
guuucugaaaaga

SEQ ID NO: 3667056 - RNA, 22 nt, Human
guuucugaaaagaaauaauaau

SEQ ID NO: 3667057 - RNA, 17 nt, Human
guuucugacucugagcu

SEQ ID NO: 3667058 - RNA, 14 nt, Human
guuucugagaaaag

SEQ ID NO: 3667059 - RNA, 20 nt, Human
guuucugaguuccugcaugc

SEQ ID NO: 3667060 - RNA, 19 nt, Human
guuucugauuaaugcuaaa

SEQ ID NO: 3667061 - RNA, 14 nt, Human
guuucugcaguagu

SEQ ID NO: 3667062 - RNA, 18 nt, Human
guuucugccgcagcccug

SEQ ID NO: 3667063 - RNA, 22 nt, Human
guuucugccgcagcccugcaga

SEQ ID NO: 3667064 - RNA, 22 nt, Human
guuucuggacccuuauaaaauc

SEQ ID NO: 3667065 - RNA, 22 nt, Human
guuucuggguccugaagaauua

SEQ ID NO: 3667066 - RNA, 14 nt, Human
guuucuggucucua

SEQ ID NO: 3667067 - RNA, 18 nt, Human
guuucugguggucuguug

SEQ ID NO: 3667068 - RNA, 15 nt, Human
guuucuguacuuuuu

SEQ ID NO: 3667069 - RNA, 16 nt, Human
guuucuguccugcugg

SEQ ID NO: 3667070 - RNA, 15 nt, Human
guuucuguccuguaa

SEQ ID NO: 3667071 - RNA, 19 nt, Human
guuucuguccuguaacugu

SEQ ID NO: 3667072 - RNA, 21 nt, Human
guuucugugguuggcugggaa

SEQ ID NO: 3667073 - RNA, 14 nt, Human
guuucuguucugug

SEQ ID NO: 3667074 - RNA, 20 nt, Human
guuucuguucuguggaaagu

SEQ ID NO: 3667075 - RNA, 22 nt, Human
guuucuguucuguggaaagugu

SEQ ID NO: 3667076 - RNA, 22 nt, Human
guuucuuaaauaagaaacuuuu

SEQ ID NO: 3667077 - RNA, 15 nt, Human
guuucuuaauuugga

SEQ ID NO: 3667078 - RNA, 13 nt, Human
guuucuuagcuuu

SEQ ID NO: 3667079 - RNA, 16 nt, Human
guuucuuagcuuuuua

SEQ ID NO: 3667080 - RNA, 23 nt, Human
guuucuucauccggcagccugga

SEQ ID NO: 3667081 - RNA, 11 nt, Human
guuucuuccug

SEQ ID NO: 3667082 - RNA, 13 nt, Human
guuucuugcuugu

SEQ ID NO: 3667083 - RNA, 13 nt, Human
guuucuuguuuau

SEQ ID NO: 3667084 - RNA, 15 nt, Human
guuucuuuaaaauug

SEQ ID NO: 3667085 - RNA, 21 nt, Human
guuucuuuaaccuuguauaaa

SEQ ID NO: 3667086 - RNA, 19 nt, Human
guuucuuuauuuuguguaa

SEQ ID NO: 3667087 - RNA, 12 nt, Human
guuucuuugaau

SEQ ID NO: 3667088 - RNA, 18 nt, Human
guuucuuugaauuuucau

SEQ ID NO: 3667089 - RNA, 19 nt, Human
guuucuuugaauuuucauu

SEQ ID NO: 3667090 - RNA, 20 nt, Human
guuucuuugaauuuucauuu

SEQ ID NO: 3667091 - RNA, 21 nt, Human
guuucuuugaauuuucauuuu

SEQ ID NO: 3667092 - RNA, 14 nt, Human
guuucuuuguaaug

SEQ ID NO: 3667093 - RNA, 17 nt, Human
guuucuuuguaaugaaa

SEQ ID NO: 3667094 - RNA, 20 nt, Human
guuucuuuuguauguaaaug

SEQ ID NO: 3667095 - RNA, 19 nt, Human
guuucuuuuuaaguaaugu

SEQ ID NO: 3667096 - RNA, 13 nt, Human
guuucuuuuugaa

SEQ ID NO: 3667097 - RNA, 16 nt, Human
guuucuuuuugaaucu

SEQ ID NO: 3667098 - RNA, 14 nt, Human
guuugaaaacuuca

SEQ ID NO: 3667099 - RNA, 18 nt, Human
guuugaaaacuucagaag

SEQ ID NO: 3667100 - RNA, 11 nt, Human
guuugaaaagc

SEQ ID NO: 3667101 - RNA, 13 nt, Human
guuugaaaauauu

SEQ ID NO: 3667102 - RNA, 22 nt, Human
guuugaaaugaggucuguuuaa

SEQ ID NO: 3667103 - RNA, 14 nt, Human
guuugaaauucuga

SEQ ID NO: 3667104 - RNA, 21 nt, Human
guuugaaauucugaauuugca

SEQ ID NO: 3667105 - RNA, 23 nt, Human
guuugaaauucugaauuugcaaa

SEQ ID NO: 3667106 - RNA, 21 nt, Human
guuugaagccugcccuugucu

SEQ ID NO: 3667107 - RNA, 18 nt, Human
guuugaauauggacaaga

SEQ ID NO: 3667108 - RNA, 17 nt, Human
guuugaauguuaaauaa

SEQ ID NO: 3667109 - RNA, 15 nt, Human
guuugacauuguaug

SEQ ID NO: 3667110 - RNA, 18 nt, Human
guuugacuagaugaugga

SEQ ID NO: 3667111 - RNA, 19 nt, Human
guuugacuagaugauggau

SEQ ID NO: 3667112 - RNA, 11 nt, Human
guuugagaaau

SEQ ID NO: 3667113 - RNA, 23 nt, Human
guuugagcucugcagcccaggga

SEQ ID NO: 3667114 - RNA, 14 nt, Human
guuugagcugccuu

SEQ ID NO: 3667115 - RNA, 18 nt, Human
guuugagcugccuucccu

SEQ ID NO: 3667116 - RNA, 18 nt, Human
guuugaggaaauuugcag

SEQ ID NO: 3667117 - RNA, 14 nt, Human
guuugauaaauagu

SEQ ID NO: 3667118 - RNA, 15 nt, Human
guuugauaaauagug

SEQ ID NO: 3667119 - RNA, 20 nt, Human
guuugaugaggcccuccaca

SEQ ID NO: 3667120 - RNA, 17 nt, Human
guuugauuaaauucuug

SEQ ID NO: 3667121 - RNA, 19 nt, Human
guuugauuaaauucuugca

SEQ ID NO: 3667122 - RNA, 22 nt, Human
guuugauuaaauucuugcaaag

SEQ ID NO: 3667123 - RNA, 19 nt, Human
guuugauucagacagcugc

SEQ ID NO: 3667124 - RNA, 21 nt, Human
guuugauucagacagcugccu

SEQ ID NO: 3667125 - RNA, 22 nt, Human
guuugauucagacagcugccug

SEQ ID NO: 3667126 - RNA, 15 nt, Human
guuugauuucauuaa

SEQ ID NO: 3667127 - RNA, 21 nt, Human
guuugauuuuagcugcagaac

SEQ ID NO: 3667128 - RNA, 13 nt, Human
guuugcaaggaag

SEQ ID NO: 3667129 - RNA, 15 nt, Human
guuugcaaggaagcc

SEQ ID NO: 3667130 - RNA, 22 nt, Human
guuugcaaggaagccacagcug

SEQ ID NO: 3667131 - RNA, 17 nt, Human
guuugcaccuuucuagu

SEQ ID NO: 3667132 - RNA, 23 nt, Human
guuugcacguuaugguguuucuc

SEQ ID NO: 3667133 - RNA, 17 nt, Human
guuugcacuaucuuuca

SEQ ID NO: 3667134 - RNA, 17 nt, Human
guuugcacucaaaucuu

SEQ ID NO: 3667135 - RNA, 21 nt, Human
guuugcacucaaaucuuaaga

SEQ ID NO: 3667136 - RNA, 20 nt, Human
guuugcacuguaugcuggac

SEQ ID NO: 3667137 - RNA, 15 nt, Human
guuugcaggggugac

SEQ ID NO: 3667138 - RNA, 22 nt, Human
guuugcagguggccaaguuccu

SEQ ID NO: 3667139 - RNA, 23 nt, Human
guuugcauauaagggaaguaguu

SEQ ID NO: 3667140 - RNA, 14 nt, Human
guuugcauuucaga

SEQ ID NO: 3667141 - RNA, 20 nt, Human
guuugccacuuugcaaagga

SEQ ID NO: 3667142 - RNA, 23 nt, Human
guuugcccaaaauuuauuuuaua

SEQ ID NO: 3667143 - RNA, 19 nt, Human
guuugccgguggugcaggu

SEQ ID NO: 3667144 - RNA, 22 nt, Human
guuugccuccguccccugccca

SEQ ID NO: 3667145 - RNA, 15 nt, Human
guuugccuuccagaa

SEQ ID NO: 3667146 - RNA, 18 nt, Human
guuugccuucuacuuuua

SEQ ID NO: 3667147 - RNA, 18 nt, Human
guuugcuaucuuaauuuu

SEQ ID NO: 3667148 - RNA, 20 nt, Human
guuugcuaucuuaauuuugg

SEQ ID NO: 3667149 - RNA, 17 nt, Human
guuugcuauuagagcau

SEQ ID NO: 3667150 - RNA, 22 nt, Human
guuugcuccccuuccccuuccu

SEQ ID NO: 3667151 - RNA, 19 nt, Human
guuugcugaacaccuugug

SEQ ID NO: 3667152 - RNA, 16 nt, Human
guuugcuuauuguucc

SEQ ID NO: 3667153 - RNA, 15 nt, Human
guuugcuucaugugu

SEQ ID NO: 3667154 - RNA, 20 nt, Human
guuugcuuugcccuucuuuc

SEQ ID NO: 3667155 - RNA, 17 nt, Human
guuuggaagauccugug

SEQ ID NO: 3667156 - RNA, 15 nt, Human
guuuggaauauuaaa

SEQ ID NO: 3667157 - RNA, 16 nt, Human
guuuggaauauuaaaa

SEQ ID NO: 3667158 - RNA, 15 nt, Human
guuuggaaugcuucu

SEQ ID NO: 3667159 - RNA, 16 nt, Human
guuuggaccccagcug

SEQ ID NO: 3667160 - RNA, 17 nt, Human
guuuggaccccagcugg

SEQ ID NO: 3667161 - RNA, 23 nt, Human
guuuggacuuuguauacuuuaaa

SEQ ID NO: 3667162 - RNA, 21 nt, Human
guuuggaggagcaaaggcuga

SEQ ID NO: 3667163 - RNA, 20 nt, Human
guuuggauucuuauguagca

SEQ ID NO: 3667164 - RNA, 17 nt, Human
guuuggcaauaguuugc

SEQ ID NO: 3667165 - RNA, 11 nt, Human
guuuggccaga

SEQ ID NO: 3667166 - RNA, 15 nt, Human
guuuggccaucucug

SEQ ID NO: 3667167 - RNA, 21 nt, Human
guuuggcgggccaaggacugc

SEQ ID NO: 3667168 - RNA, 15 nt, Human
guuuggcugugucua

SEQ ID NO: 3667169 - RNA, 17 nt, Human
guuuggcugugucuaaa

SEQ ID NO: 3667170 - RNA, 14 nt, Human
guuuggcuuccucc

SEQ ID NO: 3667171 - RNA, 18 nt, Human
guuuggcuuucagggagg

SEQ ID NO: 3667172 - RNA, 21 nt, Human
guuugggcagaagggagaagg

SEQ ID NO: 3667173 - RNA, 11 nt, Human
guuugggcuuc

SEQ ID NO: 3667174 - RNA, 13 nt, Human
guuugggcuucag

SEQ ID NO: 3667175 - RNA, 19 nt, Human
uaaauccuuuuucuuuaua

SEQ ID NO: 3667176 - RNA, 18 nt, Human
uaaaucgcuuuugauaau

SEQ ID NO: 3667177 - RNA, 19 nt, Human
uaaaucgcuuuugauaauc

SEQ ID NO: 3667178 - RNA, 14 nt, Human
uaaaucuaaaucua

SEQ ID NO: 3667179 - RNA, 15 nt, Human
uaaaucuacacacgg

SEQ ID NO: 3667180 - RNA, 20 nt, Human
uaaaucuaugaaguauauaa

SEQ ID NO: 3667181 - RNA, 20 nt, Human
uaaaucuauuuauuaauauu

SEQ ID NO: 3667182 - RNA, 15 nt, Human
uaaaucuccaaaaua

SEQ ID NO: 3667183 - RNA, 18 nt, Human
uaaaucuguaagcucuuu

SEQ ID NO: 3667184 - RNA, 15 nt, Human
uaaaucugugaacuu

SEQ ID NO: 3667185 - RNA, 19 nt, Human
uaaaucugugaacuugaaa

SEQ ID NO: 3667186 - RNA, 13 nt, Human
uaaaucugugaug

SEQ ID NO: 3667187 - RNA, 14 nt, Human
uaaaucugugauga

SEQ ID NO: 3667188 - RNA, 15 nt, Human
uaaaucugugaugau

SEQ ID NO: 3667189 - RNA, 15 nt, Human
uaaaucuuaauguuc

SEQ ID NO: 3667190 - RNA, 11 nt, Human
guuuggggcga

SEQ ID NO: 3667191 - RNA, 20 nt, Human
guuugggggacguuucucau

SEQ ID NO: 3667192 - RNA, 22 nt, Human
guuuggguauccugcccagugu

SEQ ID NO: 3667193 - RNA, 17 nt, Human
guuugguauuguauuua

SEQ ID NO: 3667194 - RNA, 17 nt, Human
guuuggucuggacugac

SEQ ID NO: 3667195 - RNA, 13 nt, Human
guuuggugcuuuu

SEQ ID NO: 3667196 - RNA, 13 nt, Human
guuugguucaaau

SEQ ID NO: 3667197 - RNA, 14 nt, Human
guuugguuccucuc

SEQ ID NO: 3667198 - RNA, 16 nt, Human
guuugguuuacauuua

SEQ ID NO: 3667199 - RNA, 16 nt, Human
guuugguuuuaaaaua

SEQ ID NO: 3667200 - RNA, 14 nt, Human
guuugguuuuuauu

SEQ ID NO: 3667201 - RNA, 15 nt, Human
guuuguaaaaaugua

SEQ ID NO: 3667202 - RNA, 13 nt, Human
guuuguaaaacua

SEQ ID NO: 3667203 - RNA, 19 nt, Human
guuuguaaauguuauuucu

SEQ ID NO: 3667204 - RNA, 20 nt, Human
guuuguaaauuaacuuuuau

SEQ ID NO: 3667205 - RNA, 14 nt, Human
guuuguagguaaaa

SEQ ID NO: 3667206 - RNA, 22 nt, Human
guuuguagugccacuguuguuu

SEQ ID NO: 3667207 - RNA, 16 nt, Human
guuuguauaacuucuu

SEQ ID NO: 3667208 - RNA, 20 nt, Human
guuugucaucagauggaaau

SEQ ID NO: 3667209 - RNA, 15 nt, Human
guuugucauuagccu

SEQ ID NO: 3667210 - RNA, 22 nt, Human
guuuguccugaugcuuuugucu

SEQ ID NO: 3667211 - RNA, 18 nt, Human
guuugucgcucaugugug

SEQ ID NO: 3667212 - RNA, 19 nt, Human
guuugucuauuuuaaaaua

SEQ ID NO: 3667213 - RNA, 19 nt, Human
guuugucucaguuggaaau

SEQ ID NO: 3667214 - RNA, 15 nt, Human
guuugucucuccuuu

SEQ ID NO: 3667215 - RNA, 17 nt, Human
guuugucucuccuuuuc

SEQ ID NO: 3667216 - RNA, 15 nt, Human
guuugucuucucccc

SEQ ID NO: 3667217 - RNA, 19 nt, Human
guuugugcuguaaagaguu

SEQ ID NO: 3667218 - RNA, 12 nt, Human
guuuguggccuc

SEQ ID NO: 3667219 - RNA, 15 nt, Human
guuuguggcuauuaa

SEQ ID NO: 3667220 - RNA, 13 nt, Human
guuuguggcuggg

SEQ ID NO: 3667221 - RNA, 20 nt, Human
guuuguggcugggggcagga

SEQ ID NO: 3667222 - RNA, 22 nt, Human
guuuguguauuuacgcuuugau

SEQ ID NO: 3667223 - RNA, 14 nt, Human
guuugugugucuua

SEQ ID NO: 3667224 - RNA, 14 nt, Human
guuuguuaaaacug

SEQ ID NO: 3667225 - RNA, 15 nt, Human
guuuguuaaaacugg

SEQ ID NO: 3667226 - RNA, 18 nt, Human
guuuguuccccaagacau

SEQ ID NO: 3667227 - RNA, 19 nt, Human
guuuguugagcugguaaca

SEQ ID NO: 3667228 - RNA, 16 nt, Human
guuuguugcuggcuug

SEQ ID NO: 3667229 - RNA, 19 nt, Human
guuuguuuauuagaugaau

SEQ ID NO: 3667230 - RNA, 10 nt, Human
guuuguuuca

SEQ ID NO: 3667231 - RNA, 18 nt, Human
guuuguuucaagaaccug

SEQ ID NO: 3667232 - RNA, 18 nt, Human
guuuguuucucccccugg

SEQ ID NO: 3667233 - RNA, 18 nt, Human
guuuguuucugaaaggga

SEQ ID NO: 3667234 - RNA, 13 nt, Human
guuuguuuguugc

SEQ ID NO: 3667235 - RNA, 18 nt, Human
guuuguuuuccuuuuauu

SEQ ID NO: 3667236 - RNA, 13 nt, Human
guuuguuuuugcu

SEQ ID NO: 3667237 - RNA, 19 nt, Human
guuuguuuuuuguuuuucu

SEQ ID NO: 3667238 - RNA, 23 nt, Human
guuuguuuuuuguuuuucugcuu

SEQ ID NO: 3667239 - RNA, 12 nt, Human
guuuguuuuuuu

SEQ ID NO: 3667240 - RNA, 20 nt, Human
guuuuaaaaaggaacugcag

SEQ ID NO: 3667241 - RNA, 22 nt, Human
guuuuaaaaaggaacugcagca

SEQ ID NO: 3667242 - RNA, 18 nt, Human
guuuuaaaacuggaccug

SEQ ID NO: 3667243 - RNA, 21 nt, Human
guuuuaaaauaaaaauucuga

SEQ ID NO: 3667244 - RNA, 24 nt, Human
guuuuaaaauaaaaauucugaaug

SEQ ID NO: 3667245 - RNA, 12 nt, Human
guuuuaaaauua

SEQ ID NO: 3667246 - RNA, 22 nt, Human
guuuuaaagaccugacaccuuu

SEQ ID NO: 3667247 - RNA, 13 nt, Human
guuuuaaauguac

SEQ ID NO: 3667248 - RNA, 14 nt, Human
guuuuaaauucuga

SEQ ID NO: 3667249 - RNA, 19 nt, Human
guuuuaaauuuauuucaaa

SEQ ID NO: 3667250 - RNA, 14 nt, Human
guuuuaacaaaaac

SEQ ID NO: 3667251 - RNA, 22 nt, Human
guuuuaacaauuuccuuuauau

SEQ ID NO: 3667252 - RNA, 20 nt, Human
guuuuaaccgcacaugcaca

SEQ ID NO: 3667253 - RNA, 15 nt, Human
guuuuaacuguggau

SEQ ID NO: 3667254 - RNA, 16 nt, Human
guuuuaacuguggaua

SEQ ID NO: 3667255 - RNA, 14 nt, Human
guuuuaacuuuguu

SEQ ID NO: 3667256 - RNA, 14 nt, Human
guuuuaagaaaugu

SEQ ID NO: 3667257 - RNA, 18 nt, Human
guuuuaaggaugcuugua

SEQ ID NO: 3667258 - RNA, 18 nt, Human
guuuuaaguuguuugcau

SEQ ID NO: 3667259 - RNA, 18 nt, Human
guuuuaaucugaaauucu

SEQ ID NO: 3667260 - RNA, 16 nt, Human
guuuuaauuccaugaa

SEQ ID NO: 3667261 - RNA, 19 nt, Human
guuuuaauugaaggaaaga

SEQ ID NO: 3667262 - RNA, 20 nt, Human
guuuuaauugaaggaaagau

SEQ ID NO: 3667263 - RNA, 12 nt, Human
guuuuacaaagg

SEQ ID NO: 3667264 - RNA, 16 nt, Human
guuuuacaaguuggag

SEQ ID NO: 3667265 - RNA, 16 nt, Human
guuuuacagauuuauu

SEQ ID NO: 3667266 - RNA, 22 nt, Human
guuuuacagauuuauuccuuug

SEQ ID NO: 3667267 - RNA, 15 nt, Human
guuuuacugcagcuu

SEQ ID NO: 3667268 - RNA, 18 nt, Human
guuuuacugcagcuuugu

SEQ ID NO: 3667269 - RNA, 19 nt, Human
guuuuagaaacaauaugga

SEQ ID NO: 3667270 - RNA, 18 nt, Human
guuuuagacaaauacuca

SEQ ID NO: 3667271 - RNA, 22 nt, Human
guuuuagacaaauacucaugug

SEQ ID NO: 3667272 - RNA, 21 nt, Human
guuuuaggacaaacagcucag

SEQ ID NO: 3667273 - RNA, 17 nt, Human
guuuuagguagaaaaac

SEQ ID NO: 3667274 - RNA, 12 nt, Human
guuuuagguucu

SEQ ID NO: 3667275 - RNA, 13 nt, Human
guuuuagguucua

SEQ ID NO: 3667276 - RNA, 12 nt, Human
guuuuauaagca

SEQ ID NO: 3667277 - RNA, 18 nt, Human
guuuuauacuguacuuaa

SEQ ID NO: 3667278 - RNA, 11 nt, Human
guuuuauauau

SEQ ID NO: 3667279 - RNA, 20 nt, Human
guuuuauauauuauauggaa

SEQ ID NO: 3667280 - RNA, 19 nt, Human
guuuuauauuuuuauagac

SEQ ID NO: 3667281 - RNA, 18 nt, Human
guuuuaucacauguaugu

SEQ ID NO: 3667282 - RNA, 21 nt, Human
guuuuaucacauguauguuuu

SEQ ID NO: 3667283 - RNA, 21 nt, Human
guuuuaugagaaagccuucuu

SEQ ID NO: 3667284 - RNA, 19 nt, Human
guuuuaugagauggaucac

SEQ ID NO: 3667285 - RNA, 22 nt, Human
guuuuaugagauggaucacaua

SEQ ID NO: 3667286 - RNA, 11 nt, Human
guuuuaugaua

SEQ ID NO: 3667287 - RNA, 20 nt, Human
guuuuaugguuacuucuucu

SEQ ID NO: 3667288 - RNA, 17 nt, Human
guuuuauucuugguuuu

SEQ ID NO: 3667289 - RNA, 12 nt, Human
guuuuauuuaua

SEQ ID NO: 3667290 - RNA, 17 nt, Human
guuuuauuuauauuuau

SEQ ID NO: 3667291 - RNA, 22 nt, Human
guuuuauuuauauuuauugacu

SEQ ID NO: 3667292 - RNA, 19 nt, Human
guuuucaaccucuagaauu

SEQ ID NO: 3667293 - RNA, 13 nt, Human
guuuucaagucaa

SEQ ID NO: 3667294 - RNA, 18 nt, Human
guuuucaauuuuaaacau

SEQ ID NO: 3667295 - RNA, 19 nt, Human
guuuucagaaaaagaaaug

SEQ ID NO: 3667296 - RNA, 19 nt, Human
guuuucagaaccucuuccc

SEQ ID NO: 3667297 - RNA, 20 nt, Human
guuuucagaaccucuucccc

SEQ ID NO: 3667298 - RNA, 16 nt, Human
guuuucagaagaaaua

SEQ ID NO: 3667299 - RNA, 22 nt, Human
guuuucagcuaggaacaaaucu

SEQ ID NO: 3667300 - RNA, 24 nt, Human
guuuucaggaguggguugauuuca

SEQ ID NO: 3667301 - RNA, 16 nt, Human
guuuucaguuuguaua

SEQ ID NO: 3667302 - RNA, 14 nt, Human
guuuucauaauaaa

SEQ ID NO: 3667303 - RNA, 14 nt, Human
guuuucaucaagac

SEQ ID NO: 3667304 - RNA, 18 nt, Human
guuuucauccauaacuga

SEQ ID NO: 3667305 - RNA, 20 nt, Human
guuuuccacuaauuuugcau

SEQ ID NO: 3667306 - RNA, 17 nt, Human
guuuuccaugaaaacgu

SEQ ID NO: 3667307 - RNA, 16 nt, Human
guuuucccuccuugga

SEQ ID NO: 3667308 - RNA, 16 nt, Human
guuuuccuaaaugcag

SEQ ID NO: 3667309 - RNA, 15 nt, Human
guuuuccucccuucu

SEQ ID NO: 3667310 - RNA, 17 nt, Human
guuuuccucucaauaaa

SEQ ID NO: 3667311 - RNA, 19 nt, Human
guuuuccuuugucaucauu

SEQ ID NO: 3667312 - RNA, 19 nt, Human
guuuucgaagcucagccca

SEQ ID NO: 3667313 - RNA, 23 nt, Human
guuuucgaagcucagcccacccc

SEQ ID NO: 3667314 - RNA, 23 nt, Human
guuuucuaguguaucaaaaugcu

SEQ ID NO: 3667315 - RNA, 23 nt, Human
guuuucucaacaaauggaaugcc

SEQ ID NO: 3667316 - RNA, 21 nt, Human
guuuucuccucccaggaacug

SEQ ID NO: 3667317 - RNA, 17 nt, Human
guuuucucucggcuccc

SEQ ID NO: 3667318 - RNA, 12 nt, Human
guuuucucuuga

SEQ ID NO: 3667319 - RNA, 19 nt, Human
guuuucucuugagagggug

SEQ ID NO: 3667320 - RNA, 20 nt, Human
guuuucucuuuguggggcuu

SEQ ID NO: 3667321 - RNA, 17 nt, Human
guuuucugaaaauauaa

SEQ ID NO: 3667322 - RNA, 13 nt, Human
guuuucugagccc

SEQ ID NO: 3667323 - RNA, 16 nt, Human
guuuucugagggaaag

SEQ ID NO: 3667324 - RNA, 15 nt, Human
guuuucuguagucau

SEQ ID NO: 3667325 - RNA, 17 nt, Human
guuuucuguagucauuu

SEQ ID NO: 3667326 - RNA, 11 nt, Human
guuuucuguuc

SEQ ID NO: 3667327 - RNA, 20 nt, Human
guuuucuuaaccagaucauu

SEQ ID NO: 3667328 - RNA, 16 nt, Human
guuuucuugauaauuu

SEQ ID NO: 3667329 - RNA, 19 nt, Human
guuuucuuguugcuuuguu

SEQ ID NO: 3667330 - RNA, 16 nt, Human
guuuucuuucuuuaaa

SEQ ID NO: 3667331 - RNA, 20 nt, Human
guuuucuuugcaaaguauug

SEQ ID NO: 3667332 - RNA, 22 nt, Human
guuuugaaaaccuaaaagacag

SEQ ID NO: 3667333 - RNA, 15 nt, Human
guuuugaaaagcuau

SEQ ID NO: 3667334 - RNA, 17 nt, Human
guuuugaagauucuaug

SEQ ID NO: 3667335 - RNA, 15 nt, Human
gcaccuggggagugg

SEQ ID NO: 3667336 - RNA, 12 nt, Human
gcaccuguacag

SEQ ID NO: 3667337 - RNA, 19 nt, Human
gcaccuguacucaggaggc

SEQ ID NO: 3667338 - RNA, 21 nt, Human
gcaccuguacucaggaggcug

SEQ ID NO: 3667339 - RNA, 15 nt, Human
gcaccuguaguccca

SEQ ID NO: 3667340 - RNA, 11 nt, Human
gcaccuguccc

SEQ ID NO: 3667341 - RNA, 23 nt, Human
gcaccuguccccacccuccacuc

SEQ ID NO: 3667342 - RNA, 12 nt, Human
gcaccugucugc

SEQ ID NO: 3667343 - RNA, 15 nt, Human
gcaccugucugcucc

SEQ ID NO: 3667344 - RNA, 21 nt, Human
gcaccuuaccaacuuucugua

SEQ ID NO: 3667345 - RNA, 18 nt, Human
gcaccuuagacagucccu

SEQ ID NO: 3667346 - RNA, 21 nt, Human
gcaccuuagacagucccugcc

SEQ ID NO: 3667347 - RNA, 19 nt, Human
gcaccuucccccuccccca

SEQ ID NO: 3667348 - RNA, 16 nt, Human
gcaccuuccucacuuc

SEQ ID NO: 3667349 - RNA, 14 nt, Human
gcaccuugugccug

SEQ ID NO: 3667350 - RNA, 13 nt, Human
gcaccuuucuagu

SEQ ID NO: 3667351 - RNA, 23 nt, Human
gcaccuuuuacugugauguuugu

SEQ ID NO: 3667352 - RNA, 14 nt, Human
gcacgacgcccucu

SEQ ID NO: 3667353 - RNA, 17 nt, Human
gcacgacgcccucuccc

SEQ ID NO: 3667354 - RNA, 16 nt, Human
gcacgauuucuguuua

SEQ ID NO: 3667355 - RNA, 12 nt, Human
gcacgcaguggc

SEQ ID NO: 3667356 - RNA, 17 nt, Human
gcacgcccaugugugag

SEQ ID NO: 3667357 - RNA, 13 nt, Human
gcacgccugcccc

SEQ ID NO: 3667358 - RNA, 12 nt, Human
gcacgcuguggg

SEQ ID NO: 3667359 - RNA, 20 nt, Human
gcacgcuugcguaugucugu

SEQ ID NO: 3667360 - RNA, 21 nt, Human
gcacggaccaugcgacacugg

SEQ ID NO: 3667361 - RNA, 14 nt, Human
gcacggcagccaca

SEQ ID NO: 3667362 - RNA, 18 nt, Human
gcacggccucgcgucugu

SEQ ID NO: 3667363 - RNA, 19 nt, Human
gcacggcucuguccccagc

SEQ ID NO: 3667364 - RNA, 13 nt, Human
gcacggguggucc

SEQ ID NO: 3667365 - RNA, 15 nt, Human
gcacggguggucccc

SEQ ID NO: 3667366 - RNA, 20 nt, Human
gcacgguggacccagacaca

SEQ ID NO: 3667367 - RNA, 21 nt, Human
gcacguaaaguacuuguaguu

SEQ ID NO: 3667368 - RNA, 22 nt, Human
gcacguagcugaggccggaugc

SEQ ID NO: 3667369 - RNA, 20 nt, Human
gcacguaguagggucaggcc

SEQ ID NO: 3667370 - RNA, 21 nt, Human
gcacguaguagggucaggcca

SEQ ID NO: 3667371 - RNA, 15 nt, Human
gcacguauuuuaaua

SEQ ID NO: 3667372 - RNA, 16 nt, Human
gcacguggagagcugg

SEQ ID NO: 3667373 - RNA, 18 nt, Human
gcacguggcauguggccu

SEQ ID NO: 3667374 - RNA, 17 nt, Human
gcacguggccucuugag

SEQ ID NO: 3667375 - RNA, 19 nt, Human
gcacguggccucuugagca

SEQ ID NO: 3667376 - RNA, 18 nt, Human
gcacgugguaaaacacuu

SEQ ID NO: 3667377 - RNA, 22 nt, Human
gcacguuaugguguuucucccu

SEQ ID NO: 3667378 - RNA, 20 nt, Human
gcacuaaagcaguggacacc

SEQ ID NO: 3667379 - RNA, 17 nt, Human
gcacuaaaguuaguaaa

SEQ ID NO: 3667380 - RNA, 20 nt, Human
gcacuaacguugagccccug

SEQ ID NO: 3667381 - RNA, 14 nt, Human
gcacuaaggggccc

SEQ ID NO: 3667382 - RNA, 15 nt, Human
gcacuaagucucuuu

SEQ ID NO: 3667383 - RNA, 19 nt, Human
gcacuaagucucuuuuuua

SEQ ID NO: 3667384 - RNA, 23 nt, Human
gcacuaagucucuuuuuuacaaa

SEQ ID NO: 3667385 - RNA, 19 nt, Human
gcacuaauuugauguuuac

SEQ ID NO: 3667386 - RNA, 14 nt, Human
gcacuacauaaacu

SEQ ID NO: 3667387 - RNA, 15 nt, Human
gcacuacauaaacug

SEQ ID NO: 3667388 - RNA, 21 nt, Human
gcacuacaugugguuuauaga

SEQ ID NO: 3667389 - RNA, 16 nt, Human
gcacuacuccucugca

SEQ ID NO: 3667390 - RNA, 19 nt, Human
gcacuacuccucugcagug

SEQ ID NO: 3667391 - RNA, 15 nt, Human
gcacuacucugugcc

SEQ ID NO: 3667392 - RNA, 21 nt, Human
gcacuacugggugucauuuca

SEQ ID NO: 3667393 - RNA, 14 nt, Human
uaagccuucaaaac

SEQ ID NO: 3667394 - RNA, 12 nt, Human
uaagccuugucg

SEQ ID NO: 3667395 - RNA, 15 nt, Human
uaagccuuuccauaa

SEQ ID NO: 3667396 - RNA, 16 nt, Human
uaagccuuuccauaag

SEQ ID NO: 3667397 - RNA, 22 nt, Human
uaagcuaacccccuucuacuga

SEQ ID NO: 3667398 - RNA, 14 nt, Human
uaagcuacugccau

SEQ ID NO: 3667399 - RNA, 16 nt, Human
uaagcuacugccaucc

SEQ ID NO: 3667400 - RNA, 23 nt, Human
uaagcuaggauguugcucagaag

SEQ ID NO: 3667401 - RNA, 18 nt, Human
uaagcuaguugaauacuu

SEQ ID NO: 3667402 - RNA, 19 nt, Human
uaagcuaguugaauacuug

SEQ ID NO: 3667403 - RNA, 20 nt, Human
uaagcuaguugaauacuuga

SEQ ID NO: 3667404 - RNA, 22 nt, Human
uaagcuaguugaauacuugaac

SEQ ID NO: 3667405 - RNA, 19 nt, Human
uaagcuauccguguugcag

SEQ ID NO: 3667406 - RNA, 13 nt, Human
uaagcuaugugaa

SEQ ID NO: 3667407 - RNA, 14 nt, Human
uaagcuauuugaug

SEQ ID NO: 3667408 - RNA, 14 nt, Human
uaagcuauuuuucu

SEQ ID NO: 3667409 - RNA, 17 nt, Human
uaagcucuuugaaacaa

SEQ ID NO: 3667410 - RNA, 13 nt, Human
uaagcugaaaaua

SEQ ID NO: 3667411 - RNA, 14 nt, Human
uaagcugaaaauau

SEQ ID NO: 3667412 - RNA, 18 nt, Human
uaagcugauccugcggag

SEQ ID NO: 3667413 - RNA, 15 nt, Human
uaagcugcagcuucc

SEQ ID NO: 3667414 - RNA, 12 nt, Human
uaagcuguaaaa

SEQ ID NO: 3667415 - RNA, 13 nt, Human
uaagcugugucug

SEQ ID NO: 3667416 - RNA, 11 nt, Human
uaagcuguuuc

SEQ ID NO: 3667417 - RNA, 18 nt, Human
uaagcuguuugguuuuaa

SEQ ID NO: 3667418 - RNA, 21 nt, Human
uaagcuguuugguuuuaaaau

SEQ ID NO: 3667419 - RNA, 15 nt, Human
uaagcuuaugcuuaa

SEQ ID NO: 3667420 - RNA, 14 nt, Human
uaagcuuauuuaau

SEQ ID NO: 3667421 - RNA, 20 nt, Human
uaagcuuccaggaaaaagga

SEQ ID NO: 3667422 - RNA, 15 nt, Human
uaagcuuugacacug

SEQ ID NO: 3667423 - RNA, 17 nt, Human
uaagcuuugccagcugc

SEQ ID NO: 3667424 - RNA, 17 nt, Human
uaaggaaaaaaagacaa

SEQ ID NO: 3667425 - RNA, 22 nt, Human
uaaggaaaacuaccuguauuua

SEQ ID NO: 3667426 - RNA, 10 nt, Human
uaaggaaacu

SEQ ID NO: 3667427 - RNA, 19 nt, Human
uaaggaaacuggguuccug

SEQ ID NO: 3667428 - RNA, 17 nt, Human
uaaggaaccaacaaucu

SEQ ID NO: 3667429 - RNA, 19 nt, Human
uaaggaaccuuccuuccug

SEQ ID NO: 3667430 - RNA, 20 nt, Human
uaaggaagaucacuuugcuc

SEQ ID NO: 3667431 - RNA, 9 nt, Human
uaaggaaua

SEQ ID NO: 3667432 - RNA, 17 nt, Human
uaaggaauaccuguccc

SEQ ID NO: 3667433 - RNA, 18 nt, Human
uaaggaauaccugucccc

SEQ ID NO: 3667434 - RNA, 14 nt, Human
uaaggaauauggga

SEQ ID NO: 3667435 - RNA, 23 nt, Human
uaaggaccguggcccugcccucu

SEQ ID NO: 3667436 - RNA, 14 nt, Human
uaaggacugacuga

SEQ ID NO: 3667437 - RNA, 19 nt, Human
uaaggagaaaucuauagaa

SEQ ID NO: 3667438 - RNA, 20 nt, Human
uaaggaggggaaaaaaaugu

SEQ ID NO: 3667439 - RNA, 19 nt, Human
uaaggaguaaucuguguac

SEQ ID NO: 3667440 - RNA, 17 nt, Human
uaaggauacaggcugga

SEQ ID NO: 3667441 - RNA, 21 nt, Human
uaaggauacaggcuggaaagu

SEQ ID NO: 3667442 - RNA, 19 nt, Human
uaaggaucagaacagcaga

SEQ ID NO: 3667443 - RNA, 17 nt, Human
uaaggaugcuaaaccuu

SEQ ID NO: 3667444 - RNA, 23 nt, Human
uaaggaugcuuguacauaaugcg

SEQ ID NO: 3667445 - RNA, 12 nt, Human
uaaggaugggaa

SEQ ID NO: 3667446 - RNA, 20 nt, Human
uaaggaugggguuaugaacc

SEQ ID NO: 3667447 - RNA, 17 nt, Human
uaaggauguagcuuuuc

SEQ ID NO: 3667448 - RNA, 19 nt, Human
uaaggaugucacagggcca

SEQ ID NO: 3667449 - RNA, 12 nt, Human
uaaggauuuuau

SEQ ID NO: 3667450 - RNA, 19 nt, Human
uaaggcaacugaacaaaaa

SEQ ID NO: 3667451 - RNA, 14 nt, Human
uaaggcaaucaugg

SEQ ID NO: 3667452 - RNA, 18 nt, Human
uaaggcaugugugaaaca

SEQ ID NO: 3667453 - RNA, 22 nt, Human
uaaggccaaguacacugagagc

SEQ ID NO: 3667454 - RNA, 22 nt, Human
uaaggcccccucucaggagcca

SEQ ID NO: 3667455 - RNA, 20 nt, Human
uaaggccgaagaaggguccu

SEQ ID NO: 3667456 - RNA, 16 nt, Human
uaaggccugugggggg

SEQ ID NO: 3667457 - RNA, 16 nt, Human
uaaggcguggagcugc

SEQ ID NO: 3667458 - RNA, 12 nt, Human
uaaggcucuaga

SEQ ID NO: 3667459 - RNA, 14 nt, Human
uaaggcucuagauc

SEQ ID NO: 3667460 - RNA, 20 nt, Human
uaaggcugaggaaaggccag

SEQ ID NO: 3667461 - RNA, 14 nt, Human
uaaggcuucaauuu

SEQ ID NO: 3667462 - RNA, 23 nt, Human
uaaggcuucaauuuauugcacaa

SEQ ID NO: 3667463 - RNA, 17 nt, Human
uaagggaacaaguugag

SEQ ID NO: 3667464 - RNA, 15 nt, Human
uaagggaagacauuu

SEQ ID NO: 3667465 - RNA, 16 nt, Human
uaagggaagacauuuc

SEQ ID NO: 3667466 - RNA, 17 nt, Human
uaagggaagacauuucu

SEQ ID NO: 3667467 - RNA, 20 nt, Human
uaagggacauguuuugauaa

SEQ ID NO: 3667468 - RNA, 15 nt, Human
uaagggacugauguu

SEQ ID NO: 3667469 - RNA, 22 nt, Human
uaagggaggaggagcuucuggg

SEQ ID NO: 3667470 - RNA, 14 nt, Human
uaagggauuucuua

SEQ ID NO: 3667471 - RNA, 16 nt, Human
uaagggauuucuuagg

SEQ ID NO: 3667472 - RNA, 14 nt, Human
uaagggcagaguca

SEQ ID NO: 3667473 - RNA, 18 nt, Human
uaagggcaugccuugugc

SEQ ID NO: 3667474 - RNA, 17 nt, Human
uaagggucgaaagcucu

SEQ ID NO: 3667475 - RNA, 13 nt, Human
uaagggugggugc

SEQ ID NO: 3667476 - RNA, 21 nt, Human
uaagguaccuuucacauagag

SEQ ID NO: 3667477 - RNA, 20 nt, Human
uaagguauaucauucuaaag

SEQ ID NO: 3667478 - RNA, 18 nt, Human
uaaggucuguuugcuguu

SEQ ID NO: 3667479 - RNA, 19 nt, Human
uaaggucuguuugcuguug

SEQ ID NO: 3667480 - RNA, 18 nt, Human
uaauaaaguauuccaccu

SEQ ID NO: 3667481 - RNA, 10 nt, Human
uaauaaagug

SEQ ID NO: 3667482 - RNA, 18 nt, Human
uaauaaaguguuuucaga

SEQ ID NO: 3667483 - RNA, 15 nt, Human
uaauaaauagagcaa

SEQ ID NO: 3667484 - RNA, 12 nt, Human
uaauaaauaguu

SEQ ID NO: 3667485 - RNA, 15 nt, Human
uaauaaauucagaua

SEQ ID NO: 3667486 - RNA, 17 nt, Human
uaauaaauugaaauugu

SEQ ID NO: 3667487 - RNA, 20 nt, Human
uaauaaauugaaauugugaa

SEQ ID NO: 3667488 - RNA, 17 nt, Human
uaauaacagugcauauu

SEQ ID NO: 3667489 - RNA, 13 nt, Human
uaauaaccagaca

SEQ ID NO: 3667490 - RNA, 15 nt, Human
uaauaaccagacaca

SEQ ID NO: 3667491 - RNA, 15 nt, Human
uaauaacugugaagu

SEQ ID NO: 3667492 - RNA, 17 nt, Human
uaauaacuguguacugu

SEQ ID NO: 3667493 - RNA, 11 nt, Human
uaauaagaaaa

SEQ ID NO: 3667494 - RNA, 19 nt, Human
uaauaagaaugguugccuu

SEQ ID NO: 3667495 - RNA, 19 nt, Human
uaauaagacauaacguuuu

SEQ ID NO: 3667496 - RNA, 22 nt, Human
uaauaagacauaacguuuuucc

SEQ ID NO: 3667497 - RNA, 15 nt, Human
uaauaagcacuguaa

SEQ ID NO: 3667498 - RNA, 19 nt, Human
uaauaagcuacuagcaaaa

SEQ ID NO: 3667499 - RNA, 12 nt, Human
uaauaagcuagu

SEQ ID NO: 3667500 - RNA, 17 nt, Human
uaauaagcuaguugaau

SEQ ID NO: 3667501 - RNA, 23 nt, Human
uaauaagcuaguugaauacuuga

SEQ ID NO: 3667502 - RNA, 15 nt, Human
uaauaagggaaaaau

SEQ ID NO: 3667503 - RNA, 16 nt, Human
uaauaagguuuuaauu

SEQ ID NO: 3667504 - RNA, 16 nt, Human
uaauaauaaagaauag

SEQ ID NO: 3667505 - RNA, 14 nt, Human
uaauaauaaauagu

SEQ ID NO: 3667506 - RNA, 18 nt, Human
uaauaauaaauaguucuu

SEQ ID NO: 3667507 - RNA, 14 nt, Human
uaauaauaauguuu

SEQ ID NO: 3667508 - RNA, 20 nt, Human
uaauaauaccucaauguuug

SEQ ID NO: 3667509 - RNA, 14 nt, Human
uaauaauauacuug

SEQ ID NO: 3667510 - RNA, 14 nt, Human
uaauaaucaagagc

SEQ ID NO: 3667511 - RNA, 20 nt, Human
uaauaaucaagagccuuaaa

SEQ ID NO: 3667512 - RNA, 22 nt, Human
uaauaaucaagagccuuaaaac

SEQ ID NO: 3667513 - RNA, 23 nt, Human
uaauaaucauuggauucugagag

SEQ ID NO: 3667514 - RNA, 20 nt, Human
uaauaaucucacauauacaa

SEQ ID NO: 3667515 - RNA, 18 nt, Human
uaauaaucuuguuucuga

SEQ ID NO: 3667516 - RNA, 21 nt, Human
uaauaaugagcuauuaaaacu

SEQ ID NO: 3667517 - RNA, 22 nt, Human
uaauaaugagcuauuaaaacuc

SEQ ID NO: 3667518 - RNA, 23 nt, Human
uaauaaugagcuauuaaaacuca

SEQ ID NO: 3667519 - RNA, 13 nt, Human
uaauaaugugaau

SEQ ID NO: 3667520 - RNA, 18 nt, Human
uaauaauguuaaccaagg

SEQ ID NO: 3667521 - RNA, 15 nt, Human
uaauaauguuucaaa

SEQ ID NO: 3667522 - RNA, 22 nt, Human
uaauaauuauaugcuauuucua

SEQ ID NO: 3667523 - RNA, 14 nt, Human
uaauacaaacuaau

SEQ ID NO: 3667524 - RNA, 14 nt, Human
uaauacaaaggcuu

SEQ ID NO: 3667525 - RNA, 18 nt, Human
uaauacaccacuacauuc

SEQ ID NO: 3667526 - RNA, 22 nt, Human
uaauacacuaauuccuuucuau

SEQ ID NO: 3667527 - RNA, 16 nt, Human
uaauacacuugcccug

SEQ ID NO: 3667528 - RNA, 18 nt, Human
uaauacagcaacaauuua

SEQ ID NO: 3667529 - RNA, 15 nt, Human
uaauacagcugagcu

SEQ ID NO: 3667530 - RNA, 17 nt, Human
uaauacauuaaagcagu

SEQ ID NO: 3667531 - RNA, 16 nt, Human
uaauaccacagcuuuu

SEQ ID NO: 3667532 - RNA, 11 nt, Human
uaauaccucaa

SEQ ID NO: 3667533 - RNA, 18 nt, Human
uaauaccucaauguuuga

SEQ ID NO: 3667534 - RNA, 23 nt, Human
uaauaccucuaauaguauaaacc

SEQ ID NO: 3667535 - RNA, 18 nt, Human
uaauaccucugugugcuc

SEQ ID NO: 3667536 - RNA, 20 nt, Human
uaauaccugggugauuacau

SEQ ID NO: 3667537 - RNA, 17 nt, Human
uaauaccuuagaaggua

SEQ ID NO: 3667538 - RNA, 20 nt, Human
uaauacgaauuguuucacaa

SEQ ID NO: 3667539 - RNA, 15 nt, Human
uaauacuaccuugaa

SEQ ID NO: 3667540 - RNA, 15 nt, Human
uaauacuaguuguga

SEQ ID NO: 3667541 - RNA, 23 nt, Human
uaauacuaguugugaccuuagug

SEQ ID NO: 3667542 - RNA, 13 nt, Human
uaauacugaacca

SEQ ID NO: 3667543 - RNA, 14 nt, Human
uaauacugaaccac

SEQ ID NO: 3667544 - RNA, 20 nt, Human
uaauacugaaccacuuguag

SEQ ID NO: 3667545 - RNA, 19 nt, Human
uaauacugcugagauacau

SEQ ID NO: 3667546 - RNA, 21 nt, Human
uaauacugguauuuuuacuua

SEQ ID NO: 3667547 - RNA, 12 nt, Human
uaauacuguauu

SEQ ID NO: 3667548 - RNA, 15 nt, Human
uaauacuguuauucu

SEQ ID NO: 3667549 - RNA, 16 nt, Human
uaauacuguuauucuu

SEQ ID NO: 3667550 - RNA, 17 nt, Human
uaauacuucuugugugu

SEQ ID NO: 3667551 - RNA, 15 nt, Human
uaauagaaaugucuc

SEQ ID NO: 3667552 - RNA, 22 nt, Human
uaauagaauaaaggcaguuuuc

SEQ ID NO: 3667553 - RNA, 21 nt, Human
uaauagaauauaauuaucgga

SEQ ID NO: 3667554 - RNA, 14 nt, Human
uaauagacaauuua

SEQ ID NO: 3667555 - RNA, 17 nt, Human
gcacuagccaaaccuca

SEQ ID NO: 3667556 - RNA, 20 nt, Human
gcacuagccuuuggcucugg

SEQ ID NO: 3667557 - RNA, 22 nt, Human
gcacuagccuuuggcucuggag

SEQ ID NO: 3667558 - RNA, 21 nt, Human
gcacuaggcacccagcugcca

SEQ ID NO: 3667559 - RNA, 15 nt, Human
gcacuaucuuuaaac

SEQ ID NO: 3667560 - RNA, 15 nt, Human
gcacuauuuauuuac

SEQ ID NO: 3667561 - RNA, 16 nt, Human
gcacucacacaggacc

SEQ ID NO: 3667562 - RNA, 16 nt, Human
gcacucacagaccugg

SEQ ID NO: 3667563 - RNA, 16 nt, Human
gcacucagaagacacu

SEQ ID NO: 3667564 - RNA, 14 nt, Human
gcacucaggcucuc

SEQ ID NO: 3667565 - RNA, 17 nt, Human
gcacucauuuucuauaa

SEQ ID NO: 3667566 - RNA, 20 nt, Human
gcacuccaaccuaaccugug

SEQ ID NO: 3667567 - RNA, 17 nt, Human
gcacuccagccugggca

SEQ ID NO: 3667568 - RNA, 23 nt, Human
gcacuccaugcuuagucacugcc

SEQ ID NO: 3667569 - RNA, 17 nt, Human
gcacucccaccugacac

SEQ ID NO: 3667570 - RNA, 17 nt, Human
gcacucccuccagcaca

SEQ ID NO: 3667571 - RNA, 14 nt, Human
gcacuccggaggua

SEQ ID NO: 3667572 - RNA, 19 nt, Human
gcacuccucccugauguac

SEQ ID NO: 3667573 - RNA, 21 nt, Human
gcacucgggaaaccuggggcu

SEQ ID NO: 3667574 - RNA, 11 nt, Human
gcacucuagau

SEQ ID NO: 3667575 - RNA, 14 nt, Human
gcacucuagccgga

SEQ ID NO: 3667576 - RNA, 18 nt, Human
gcacucuagccggaguga

SEQ ID NO: 3667577 - RNA, 13 nt, Human
gcacucuggcagc

SEQ ID NO: 3667578 - RNA, 14 nt, Human
gcacucuggcagca

SEQ ID NO: 3667579 - RNA, 21 nt, Human
gcacugaaggcuuucagggcc

SEQ ID NO: 3667580 - RNA, 21 nt, Human
gcacugaauaaauuguacagc

SEQ ID NO: 3667581 - RNA, 12 nt, Human
gcacugacauug

SEQ ID NO: 3667582 - RNA, 16 nt, Human
gcacugacccuuccag

SEQ ID NO: 3667583 - RNA, 20 nt, Human
gcacugacugggaccaggca

SEQ ID NO: 3667584 - RNA, 21 nt, Human
gcacugagauauuuauuguuu

SEQ ID NO: 3667585 - RNA, 11 nt, Human
gcacugagccc

SEQ ID NO: 3667586 - RNA, 14 nt, Human
gcacugagcccccc

SEQ ID NO: 3667587 - RNA, 18 nt, Human
gcacugaggaagaacggg

SEQ ID NO: 3667588 - RNA, 13 nt, Human
gcacugagggcca

SEQ ID NO: 3667589 - RNA, 24 nt, Human
gcacugagggccacacuauuacca

SEQ ID NO: 3667590 - RNA, 13 nt, Human
gcacugaugcugc

SEQ ID NO: 3667591 - RNA, 20 nt, Human
gcacugauguuguguuuuua

SEQ ID NO: 3667592 - RNA, 14 nt, Human
gcacugccacuggg

SEQ ID NO: 3667593 - RNA, 15 nt, Human
gcacugccaggaggg

SEQ ID NO: 3667594 - RNA, 17 nt, Human
gcacugccaggagggac

SEQ ID NO: 3667595 - RNA, 13 nt, Human
gcacugcccuggu

SEQ ID NO: 3667596 - RNA, 13 nt, Human
gcacugccucuca

SEQ ID NO: 3667597 - RNA, 19 nt, Human
gcacugccugcucccaucc

SEQ ID NO: 3667598 - RNA, 23 nt, Human
gcacugcuaggcgagugccagga

SEQ ID NO: 3667599 - RNA, 18 nt, Human
gcacugcugcccagccuc

SEQ ID NO: 3667600 - RNA, 21 nt, Human
gcacugcuggguggcccaucc

SEQ ID NO: 3667601 - RNA, 13 nt, Human
gcacugcuuccag

SEQ ID NO: 3667602 - RNA, 17 nt, Human
gcacuggaguccagucu

SEQ ID NO: 3667603 - RNA, 14 nt, Human
gcacuggagugcag

SEQ ID NO: 3667604 - RNA, 23 nt, Human
gcacuggaguggcucgccaggcc

SEQ ID NO: 3667605 - RNA, 17 nt, Human
gcacuggcaaacagggc

SEQ ID NO: 3667606 - RNA, 20 nt, Human
gcacuggcaaacagggccuc

SEQ ID NO: 3667607 - RNA, 23 nt, Human
gcacuggcaaacagggccucugc

SEQ ID NO: 3667608 - RNA, 20 nt, Human
gcacuggcauugucccugug

SEQ ID NO: 3667609 - RNA, 14 nt, Human
gcacuggccccacc

SEQ ID NO: 3667610 - RNA, 16 nt, Human
gcacuggcgaggagag

SEQ ID NO: 3667611 - RNA, 18 nt, Human
gcacugggaggcuccccu

SEQ ID NO: 3667612 - RNA, 14 nt, Human
gcacugggcucccg

SEQ ID NO: 3667613 - RNA, 15 nt, Human
gcacuggggagcccg

SEQ ID NO: 3667614 - RNA, 23 nt, Human
gcacuggggcaggggccgggggc

SEQ ID NO: 3667615 - RNA, 18 nt, Human
gcacuggguugacuuuca

SEQ ID NO: 3667616 - RNA, 24 nt, Human
gcacugguggcccgacagccuggc

SEQ ID NO: 3667617 - RNA, 22 nt, Human
gcacugguggcuugcaguuugc

SEQ ID NO: 3667618 - RNA, 17 nt, Human
gcacuguaguucuaaga

SEQ ID NO: 3667619 - RNA, 15 nt, Human
gcacuguaugcugga

SEQ ID NO: 3667620 - RNA, 20 nt, Human
gcacugucacuuugcucugg

SEQ ID NO: 3667621 - RNA, 17 nt, Human
gcacugucccuugccuc

SEQ ID NO: 3667622 - RNA, 18 nt, Human
gcacugucccuugccuca

SEQ ID NO: 3667623 - RNA, 23 nt, Human
gcacugucccuugccucaaugcc

SEQ ID NO: 3667624 - RNA, 14 nt, Human
gcacuguccugcuc

SEQ ID NO: 3667625 - RNA, 23 nt, Human
uacaacauaaucuaguuuacaga

SEQ ID NO: 3667626 - RNA, 23 nt, Human
uacaaccaagcucucugcaucua

SEQ ID NO: 3667627 - RNA, 21 nt, Human
uacaaccucccucuuguuuug

SEQ ID NO: 3667628 - RNA, 22 nt, Human
uacaaccucccucuuguuuugu

SEQ ID NO: 3667629 - RNA, 15 nt, Human
uacaaccuucauuua

SEQ ID NO: 3667630 - RNA, 15 nt, Human
uacaacggaggccug

SEQ ID NO: 3667631 - RNA, 22 nt, Human
uacaacggagucaaaaauuaaa

SEQ ID NO: 3667632 - RNA, 14 nt, Human
uacaacugaguccu

SEQ ID NO: 3667633 - RNA, 18 nt, Human
uacaacuuaaauaauaaa

SEQ ID NO: 3667634 - RNA, 21 nt, Human
uacaagaagcauuuuguaagu

SEQ ID NO: 3667635 - RNA, 15 nt, Human
uacaagaaguuuauu

SEQ ID NO: 3667636 - RNA, 19 nt, Human
uacaagagcagccuguggc

SEQ ID NO: 3667637 - RNA, 20 nt, Human
uacaagagcagccuguggca

SEQ ID NO: 3667638 - RNA, 21 nt, Human
uacaagauuagaagcugaaaa

SEQ ID NO: 3667639 - RNA, 20 nt, Human
uacaagauugaaaaucuugu

SEQ ID NO: 3667640 - RNA, 21 nt, Human
uacaagccauucuaaggaaau

SEQ ID NO: 3667641 - RNA, 14 nt, Human
uacaagcccccccu

SEQ ID NO: 3667642 - RNA, 16 nt, Human
uacaagcgugagccac

SEQ ID NO: 3667643 - RNA, 19 nt, Human
uacaagcgugagccacugc

SEQ ID NO: 3667644 - RNA, 19 nt, Human
uacaaguaacaaaaauaaa

SEQ ID NO: 3667645 - RNA, 15 nt, Human
uacaaguaguucugu

SEQ ID NO: 3667646 - RNA, 20 nt, Human
uacaaguauacuuauauuuc

SEQ ID NO: 3667647 - RNA, 17 nt, Human
uacaaguauucugccuu

SEQ ID NO: 3667648 - RNA, 14 nt, Human
uacaagucaguagg

SEQ ID NO: 3667649 - RNA, 18 nt, Human
uacaagucaguuucuaca

SEQ ID NO: 3667650 - RNA, 15 nt, Human
uacaaguguauauca

SEQ ID NO: 3667651 - RNA, 16 nt, Human
uacaaguuuauauaua

SEQ ID NO: 3667652 - RNA, 14 nt, Human
uacaaguuucaucc

SEQ ID NO: 3667653 - RNA, 15 nt, Human
uacaaguuucaucca

SEQ ID NO: 3667654 - RNA, 18 nt, Human
uacaaguuucauccagaa

SEQ ID NO: 3667655 - RNA, 21 nt, Human
uacaauaaaacuuugcugcca

SEQ ID NO: 3667656 - RNA, 13 nt, Human
uacaauaaaagua

SEQ ID NO: 3667657 - RNA, 20 nt, Human
uacaauaaaaucuugaaaau

SEQ ID NO: 3667658 - RNA, 13 nt, Human
uacaauaaacuau

SEQ ID NO: 3667659 - RNA, 14 nt, Human
uacaauaaauugcu

SEQ ID NO: 3667660 - RNA, 23 nt, Human
uacaauaaauugcuaauguugcu

SEQ ID NO: 3667661 - RNA, 16 nt, Human
uacaauaauggaaaaa

SEQ ID NO: 3667662 - RNA, 16 nt, Human
uacaauaauucuauga

SEQ ID NO: 3667663 - RNA, 13 nt, Human
uacaauauauaaa

SEQ ID NO: 3667664 - RNA, 20 nt, Human
uacaauauauaaaaauauau

SEQ ID NO: 3667665 - RNA, 15 nt, Human
uacaauauauauucu

SEQ ID NO: 3667666 - RNA, 16 nt, Human
uacaauauguacauuu

SEQ ID NO: 3667667 - RNA, 12 nt, Human
uacaauauuuaa

SEQ ID NO: 3667668 - RNA, 14 nt, Human
uacaauauuuaaaa

SEQ ID NO: 3667669 - RNA, 17 nt, Human
uacaauauuuaaaauuu

SEQ ID NO: 3667670 - RNA, 17 nt, Human
uacaauauuugugugcu

SEQ ID NO: 3667671 - RNA, 15 nt, Human
uacaauauuuuaagc

SEQ ID NO: 3667672 - RNA, 18 nt, Human
uacaauauuuuaagcauu

SEQ ID NO: 3667673 - RNA, 18 nt, Human
uacaaucagcugcuuugu

SEQ ID NO: 3667674 - RNA, 23 nt, Human
uacaaucagcugcuuuguuaccu

SEQ ID NO: 3667675 - RNA, 22 nt, Human
uacaaucauugcugaaaauggu

SEQ ID NO: 3667676 - RNA, 23 nt, Human
uacaaucauugcugaaaauggua

SEQ ID NO: 3667677 - RNA, 15 nt, Human
uacaaucgcaaauca

SEQ ID NO: 3667678 - RNA, 16 nt, Human
uacaaucuauuuauug

SEQ ID NO: 3667679 - RNA, 15 nt, Human
uacaaugaacacuua

SEQ ID NO: 3667680 - RNA, 18 nt, Human
uacaaugacuuuauugca

SEQ ID NO: 3667681 - RNA, 13 nt, Human
uacaauguaauua

SEQ ID NO: 3667682 - RNA, 14 nt, Human
uacaauguaauuau

SEQ ID NO: 3667683 - RNA, 18 nt, Human
uacaauguauuuauuuaa

SEQ ID NO: 3667684 - RNA, 15 nt, Human
uacaaugugaacuuu

SEQ ID NO: 3667685 - RNA, 16 nt, Human
uacaaugugacuuuga

SEQ ID NO: 3667686 - RNA, 17 nt, Human
uacaauguguuuuucuc

SEQ ID NO: 3667687 - RNA, 20 nt, Human
uacaauguguuuuucuccag

SEQ ID NO: 3667688 - RNA, 16 nt, Human
uacaauguucauccca

SEQ ID NO: 3667689 - RNA, 16 nt, Human
uacaauucauuguguu

SEQ ID NO: 3667690 - RNA, 21 nt, Human
uacaauucauuguguuaccug

SEQ ID NO: 3667691 - RNA, 14 nt, Human
uacaauugaaauga

SEQ ID NO: 3667692 - RNA, 20 nt, Human
uacaauugaacuuaaauaaa

SEQ ID NO: 3667693 - RNA, 19 nt, Human
uacaauuucuuuugguuca

SEQ ID NO: 3667694 - RNA, 19 nt, Human
uacaauuuucucccaggaa

SEQ ID NO: 3667695 - RNA, 21 nt, Human
uacaauuuucucccaggaagc

SEQ ID NO: 3667696 - RNA, 12 nt, Human
uacaauuuuguu

SEQ ID NO: 3667697 - RNA, 17 nt, Human
uacaauuuuuuaucaug

SEQ ID NO: 3667698 - RNA, 23 nt, Human
uacaauuuuuuaucaugcauguc

SEQ ID NO: 3667699 - RNA, 19 nt, Human
uacaauuuuuuuuauuagu

SEQ ID NO: 3667700 - RNA, 13 nt, Human
uacacaaaaucaa

SEQ ID NO: 3667701 - RNA, 23 nt, Human
uacacaaaucuauuuaauuagga

SEQ ID NO: 3667702 - RNA, 18 nt, Human
uacacaauagaauuauaa

SEQ ID NO: 3667703 - RNA, 21 nt, Human
uacacaaugguuuucuugugu

SEQ ID NO: 3667704 - RNA, 17 nt, Human
uacacaaugguuuuuaa

SEQ ID NO: 3667705 - RNA, 13 nt, Human
uacacaauucuua

SEQ ID NO: 3667706 - RNA, 16 nt, Human
uacacacacaaagaga

SEQ ID NO: 3667707 - RNA, 18 nt, Human
uacacacacacacacagc

SEQ ID NO: 3667708 - RNA, 19 nt, Human
uacacacacacacacagcc

SEQ ID NO: 3667709 - RNA, 21 nt, Human
uacacacacacacacagccac

SEQ ID NO: 3667710 - RNA, 22 nt, Human
uacacacacacacacagccaca

SEQ ID NO: 3667711 - RNA, 19 nt, Human
uacacacacacgcgugcac

SEQ ID NO: 3667712 - RNA, 15 nt, Human
uacacacacagaugu

SEQ ID NO: 3667713 - RNA, 23 nt, Human
uacacacgcugccuucgguaccc

SEQ ID NO: 3667714 - RNA, 16 nt, Human
uacacacgugcaauuu

SEQ ID NO: 3667715 - RNA, 23 nt, Human
uacacacgugcaauuuguuugug

SEQ ID NO: 3667716 - RNA, 16 nt, Human
uacacacucaaaucaa

SEQ ID NO: 3667717 - RNA, 17 nt, Human
uacacacugcauguuug

SEQ ID NO: 3667718 - RNA, 22 nt, Human
uacacacugcauguuugugauu

SEQ ID NO: 3667719 - RNA, 17 nt, Human
uacacacuuuauuuacu

SEQ ID NO: 3667720 - RNA, 18 nt, Human
uacacagaaacacugccu

SEQ ID NO: 3667721 - RNA, 22 nt, Human
uacacagaucacagcuucagcc

SEQ ID NO: 3667722 - RNA, 17 nt, Human
uacacagcaccagaaug

SEQ ID NO: 3667723 - RNA, 15 nt, Human
uacacagcucuagac

SEQ ID NO: 3667724 - RNA, 22 nt, Human
uacacaggacagggguuccuuc

SEQ ID NO: 3667725 - RNA, 23 nt, Human
uacacaggauccuauucucacca

SEQ ID NO: 3667726 - RNA, 20 nt, Human
uacacagggauguacaaggc

SEQ ID NO: 3667727 - RNA, 16 nt, Human
uacacauacaguuuua

SEQ ID NO: 3667728 - RNA, 18 nt, Human
uacacauauaccuauaau

SEQ ID NO: 3667729 - RNA, 20 nt, Human
uacacauauuugaagggucu

SEQ ID NO: 3667730 - RNA, 22 nt, Human
uacacaucagccaucaacuaaa

SEQ ID NO: 3667731 - RNA, 14 nt, Human
uacacaucuuccac

SEQ ID NO: 3667732 - RNA, 16 nt, Human
uacacauguauccuuu

SEQ ID NO: 3667733 - RNA, 15 nt, Human
uacacauuagauuuu

SEQ ID NO: 3667734 - RNA, 18 nt, Human
uacacauucaauaagcau

SEQ ID NO: 3667735 - RNA, 17 nt, Human
uacacauuugcuacugu

SEQ ID NO: 3667736 - RNA, 15 nt, Human
uacacauuuguacag

SEQ ID NO: 3667737 - RNA, 19 nt, Human
uacacauuuuauuuuauua

SEQ ID NO: 3667738 - RNA, 22 nt, Human
uacacauuuuauuuuauuaugc

SEQ ID NO: 3667739 - RNA, 17 nt, Human
uacacauuuuucagaua

SEQ ID NO: 3667740 - RNA, 19 nt, Human
uacaccacacacaacagcc

SEQ ID NO: 3667741 - RNA, 23 nt, Human
uacaccacacacaacagccaaca

SEQ ID NO: 3667742 - RNA, 15 nt, Human
uacaccacuacauuc

SEQ ID NO: 3667743 - RNA, 18 nt, Human
uacaccacuacauucugu

SEQ ID NO: 3667744 - RNA, 19 nt, Human
uacaccacuacauucuguu

SEQ ID NO: 3667745 - RNA, 12 nt, Human
uacaccacucug

SEQ ID NO: 3667746 - RNA, 16 nt, Human
uacaccauauacuguu

SEQ ID NO: 3667747 - RNA, 19 nt, Human
uacaccauguuugagcuca

SEQ ID NO: 3667748 - RNA, 24 nt, Human
uacaccauguuugagcucagaccc

SEQ ID NO: 3667749 - RNA, 19 nt, Human
uacaccauuaucuuggaaa

SEQ ID NO: 3667750 - RNA, 19 nt, Human
uacacccagaccccaggcu

SEQ ID NO: 3667751 - RNA, 16 nt, Human
uacacccuuuuccagc

SEQ ID NO: 3667752 - RNA, 17 nt, Human
uacaccuaugucauuuc

SEQ ID NO: 3667753 - RNA, 21 nt, Human
uacaccuaugucauuucauuu

SEQ ID NO: 3667754 - RNA, 22 nt, Human
uacaccucguuagggaagagaa

SEQ ID NO: 3667755 - RNA, 23 nt, Human
uacaccuggcugagguuccucug

SEQ ID NO: 3667756 - RNA, 20 nt, Human
uacaccuugccuugcuguuu

SEQ ID NO: 3667757 - RNA, 18 nt, Human
uacaccuuucuccuuugu

SEQ ID NO: 3667758 - RNA, 15 nt, Human
uacacgaaagagaga

SEQ ID NO: 3667759 - RNA, 22 nt, Human
uaacuguuuauauguguugaaa

SEQ ID NO: 3667760 - RNA, 11 nt, Human
uaacuguuuca

SEQ ID NO: 3667761 - RNA, 23 nt, Human
uaacuuaaaaauguaaauauucu

SEQ ID NO: 3667762 - RNA, 14 nt, Human
uaacuuaaauagua

SEQ ID NO: 3667763 - RNA, 14 nt, Human
uaacuuaauaauca

SEQ ID NO: 3667764 - RNA, 17 nt, Human
uaacuuaauaaucaaga

SEQ ID NO: 3667765 - RNA, 14 nt, Human
uaacuuacuuccaa

SEQ ID NO: 3667766 - RNA, 21 nt, Human
uaacuuagacucuaguauuua

SEQ ID NO: 3667767 - RNA, 15 nt, Human
uaacuuaguuuugca

SEQ ID NO: 3667768 - RNA, 16 nt, Human
uaagccccagcaagca

SEQ ID NO: 3667769 - RNA, 22 nt, Human
uaagcccugucgagacacuugc

SEQ ID NO: 3667770 - RNA, 14 nt, Human
uaagcccuugaaga

SEQ ID NO: 3667771 - RNA, 16 nt, Human
uaagccuaaaaguggg

SEQ ID NO: 3667772 - RNA, 15 nt, Human
uaagccuaccugcuc

SEQ ID NO: 3667773 - RNA, 19 nt, Human
uaagccucaaauuugaaca

SEQ ID NO: 3667774 - RNA, 20 nt, Human
gcagcugagaaaaugaguga

SEQ ID NO: 3667775 - RNA, 12 nt, Human
gcagcugagcag

SEQ ID NO: 3667776 - RNA, 14 nt, Human
gcagcugagcaggg

SEQ ID NO: 3667777 - RNA, 19 nt, Human
gcagcugagcagggccggg

SEQ ID NO: 3667778 - RNA, 17 nt, Human
gcagcugauuuuaacaa

SEQ ID NO: 3667779 - RNA, 18 nt, Human
gcagcugauuuuaacaau

SEQ ID NO: 3667780 - RNA, 21 nt, Human
gcagcugccaggagcacggcu

SEQ ID NO: 3667781 - RNA, 17 nt, Human
gcagcugccuccccucc

SEQ ID NO: 3667782 - RNA, 22 nt, Human
gcagcugccuccccuccucugc

SEQ ID NO: 3667783 - RNA, 15 nt, Human
gcagcugcgcgggcu

SEQ ID NO: 3667784 - RNA, 19 nt, Human
gcagcugcgguccacccag

SEQ ID NO: 3667785 - RNA, 23 nt, Human
gcagcugcgguccacccaggagc

SEQ ID NO: 3667786 - RNA, 23 nt, Human
gcagcugcuauccccaucucccu

SEQ ID NO: 3667787 - RNA, 22 nt, Human
gcagcugcuauuuauuuuccua

SEQ ID NO: 3667788 - RNA, 14 nt, Human
gcagcuggacagag

SEQ ID NO: 3667789 - RNA, 22 nt, Human
gcagcugggcccaacccugucu

SEQ ID NO: 3667790 - RNA, 12 nt, Human
gcagcugggcug

SEQ ID NO: 3667791 - RNA, 22 nt, Human
gcagcugucccuugcuugccug

SEQ ID NO: 3667792 - RNA, 17 nt, Human
gcagcuguuagagucca

SEQ ID NO: 3667793 - RNA, 16 nt, Human
gcagcuguugucucuu

SEQ ID NO: 3667794 - RNA, 18 nt, Human
gcagcuguugucucuucu

SEQ ID NO: 3667795 - RNA, 21 nt, Human
gcagcuguuuuaguuaaauuu

SEQ ID NO: 3667796 - RNA, 19 nt, Human
gcagcuuagaguuggccau

SEQ ID NO: 3667797 - RNA, 19 nt, Human
gcagcuuagggcccuggag

SEQ ID NO: 3667798 - RNA, 21 nt, Human
gcagcuuagggcccuggaggc

SEQ ID NO: 3667799 - RNA, 15 nt, Human
gcagcuuauucacaa

SEQ ID NO: 3667800 - RNA, 13 nt, Human
gcagcuuauuguu

SEQ ID NO: 3667801 - RNA, 13 nt, Human
gcagcuuccuguc

SEQ ID NO: 3667802 - RNA, 15 nt, Human
gcagcuucugccacu

SEQ ID NO: 3667803 - RNA, 21 nt, Human
gcagcuucugcccccugcaga

SEQ ID NO: 3667804 - RNA, 21 nt, Human
gcagcuugaggguugggcugg

SEQ ID NO: 3667805 - RNA, 12 nt, Human
gcagcuugcccc

SEQ ID NO: 3667806 - RNA, 14 nt, Human
gcagcuuguagcca

SEQ ID NO: 3667807 - RNA, 15 nt, Human
gcagcuuguagccag

SEQ ID NO: 3667808 - RNA, 20 nt, Human
gcagcuuuaaacucagggac

SEQ ID NO: 3667809 - RNA, 14 nt, Human
gcagcuuuauguuc

SEQ ID NO: 3667810 - RNA, 15 nt, Human
gcagcuuucuagaag

SEQ ID NO: 3667811 - RNA, 23 nt, Human
gcaggaaaaggugauauccauuc

SEQ ID NO: 3667812 - RNA, 21 nt, Human
gcaggaaaguuuacccaugaa

SEQ ID NO: 3667813 - RNA, 18 nt, Human
gcaggaacaaacagggcu

SEQ ID NO: 3667814 - RNA, 20 nt, Human
gcaggaagcauucagagagc

SEQ ID NO: 3667815 - RNA, 18 nt, Human
gcaggaagcucagacugg

SEQ ID NO: 3667816 - RNA, 15 nt, Human
gcaggaagcugcucc

SEQ ID NO: 3667817 - RNA, 16 nt, Human
gcaggaagcugcuccg

SEQ ID NO: 3667818 - RNA, 16 nt, Human
gcaggaagcugugaga

SEQ ID NO: 3667819 - RNA, 13 nt, Human
gcaggaaggagag

SEQ ID NO: 3667820 - RNA, 16 nt, Human
gcaggaaggagagccu

SEQ ID NO: 3667821 - RNA, 23 nt, Human
gcaggaaggagagccugcugcau

SEQ ID NO: 3667822 - RNA, 21 nt, Human
gcaggaaggagcugccuggac

SEQ ID NO: 3667823 - RNA, 17 nt, Human
gcaggaauguguggcag

SEQ ID NO: 3667824 - RNA, 15 nt, Human
gcaggaccagcccac

SEQ ID NO: 3667825 - RNA, 18 nt, Human
gcaggaccagcccacgcu

SEQ ID NO: 3667826 - RNA, 22 nt, Human
gcaggaccagcccacgcugacu

SEQ ID NO: 3667827 - RNA, 20 nt, Human
gcaggaccucugaaacccug

SEQ ID NO: 3667828 - RNA, 20 nt, Human
gcaggaccugccuguagccc

SEQ ID NO: 3667829 - RNA, 19 nt, Human
gcaggaccuucgggcugug

SEQ ID NO: 3667830 - RNA, 14 nt, Human
gcaggacuccaggc

SEQ ID NO: 3667831 - RNA, 17 nt, Human
gcaggacuccaggccca

SEQ ID NO: 3667832 - RNA, 18 nt, Human
gcaggacuccaggcccaa

SEQ ID NO: 3667833 - RNA, 22 nt, Human
gcaggacuccaggcccaaggcu

SEQ ID NO: 3667834 - RNA, 14 nt, Human
gcaggacugauguc

SEQ ID NO: 3667835 - RNA, 19 nt, Human
gcaggacugaugucuccua

SEQ ID NO: 3667836 - RNA, 23 nt, Human
gcaggacugaugucuccuaagca

SEQ ID NO: 3667837 - RNA, 19 nt, Human
gcaggacugcacagcgucc

SEQ ID NO: 3667838 - RNA, 22 nt, Human
gcaggacuuccccggagggcug

SEQ ID NO: 3667839 - RNA, 20 nt, Human
gcaggagaggagagccagag

SEQ ID NO: 3667840 - RNA, 22 nt, Human
gcaggagaggagagccagagaa

SEQ ID NO: 3667841 - RNA, 18 nt, Human
gcaggagauugagaagga

SEQ ID NO: 3667842 - RNA, 22 nt, Human
gcaggagauugagaaggagaga

SEQ ID NO: 3667843 - RNA, 23 nt, Human
gcaggagauugagaaggagagaa

SEQ ID NO: 3667844 - RNA, 14 nt, Human
gcaggagcucagau

SEQ ID NO: 3667845 - RNA, 11 nt, Human
gcaggaggaag

SEQ ID NO: 3667846 - RNA, 12 nt, Human
gcaggaggaagg

SEQ ID NO: 3667847 - RNA, 13 nt, Human
gcaggaggaggug

SEQ ID NO: 3667848 - RNA, 14 nt, Human
gcaggaggaggugc

SEQ ID NO: 3667849 - RNA, 20 nt, Human
gcaggaggaggugccaacag

SEQ ID NO: 3667850 - RNA, 23 nt, Human
gcaggaggauugcuugagcccag

SEQ ID NO: 3667851 - RNA, 18 nt, Human
gcaggaggccccuggccc

SEQ ID NO: 3667852 - RNA, 21 nt, Human
gcaggagggacagucucacca

SEQ ID NO: 3667853 - RNA, 14 nt, Human
gcaggaguagcuga

SEQ ID NO: 3667854 - RNA, 16 nt, Human
gcaggaguagcugagc

SEQ ID NO: 3667855 - RNA, 18 nt, Human
gcaggaguagcugagcuc

SEQ ID NO: 3667856 - RNA, 19 nt, Human
gcaggaucucaccaggcag

SEQ ID NO: 3667857 - RNA, 20 nt, Human
gcaggaucucaccaggcagc

SEQ ID NO: 3667858 - RNA, 21 nt, Human
gcaggaucucaccaggcagcc

SEQ ID NO: 3667859 - RNA, 18 nt, Human
gcaggauucagccggagg

SEQ ID NO: 3667860 - RNA, 20 nt, Human
gcaggauucuuccucccucc

SEQ ID NO: 3667861 - RNA, 19 nt, Human
gcaggauuuguucucuguc

SEQ ID NO: 3667862 - RNA, 15 nt, Human
gcaggcacagcacag

SEQ ID NO: 3667863 - RNA, 20 nt, Human
gcaggcacgggugguccccg

SEQ ID NO: 3667864 - RNA, 23 nt, Human
gcaggcagacacggaucugagaa

SEQ ID NO: 3667865 - RNA, 19 nt, Human
gcaggcagaggcccaggcu

SEQ ID NO: 3667866 - RNA, 20 nt, Human
gcaggcagaggcccaggcug

SEQ ID NO: 3667867 - RNA, 21 nt, Human
gcaggcagaggcccaggcugc

SEQ ID NO: 3667868 - RNA, 20 nt, Human
gcaggcagaucaccugaggu

SEQ ID NO: 3667869 - RNA, 9 nt, Human
gcaggcagc

SEQ ID NO: 3667870 - RNA, 21 nt, Human
gcaggcagccagcaucugggc

SEQ ID NO: 3667871 - RNA, 13 nt, Human
gcaggcagccagg

SEQ ID NO: 3667872 - RNA, 14 nt, Human
gcaggcagccaggc

SEQ ID NO: 3667873 - RNA, 16 nt, Human
gcaggcagccaggcca

SEQ ID NO: 3667874 - RNA, 17 nt, Human
gcaggcagccaggccac

SEQ ID NO: 3667875 - RNA, 13 nt, Human
gcaggcagccuug

SEQ ID NO: 3667876 - RNA, 13 nt, Human
gcaggcagcgcca

SEQ ID NO: 3667877 - RNA, 15 nt, Human
gcaggcaggcuccca

SEQ ID NO: 3667878 - RNA, 14 nt, Human
gcaggcagggcucu

SEQ ID NO: 3667879 - RNA, 15 nt, Human
gcaggcagggcucuc

SEQ ID NO: 3667880 - RNA, 19 nt, Human
gcaggcagggcucuccugg

SEQ ID NO: 3667881 - RNA, 20 nt, Human
gcaggcagggcucuccuggc

SEQ ID NO: 3667882 - RNA, 11 nt, Human
gcaggcagggg

SEQ ID NO: 3667883 - RNA, 14 nt, Human
gcaggcaucugauu

SEQ ID NO: 3667884 - RNA, 19 nt, Human
gcaggcauggcccugggcg

SEQ ID NO: 3667885 - RNA, 20 nt, Human
gcaggccaagagcagaggca

SEQ ID NO: 3667886 - RNA, 21 nt, Human
gcaggccaaggccuucuccuc

SEQ ID NO: 3667887 - RNA, 15 nt, Human
gcaggccaaggucug

SEQ ID NO: 3667888 - RNA, 16 nt, Human
gcaggccaaggucuga

SEQ ID NO: 3667889 - RNA, 21 nt, Human
gcaggccacacuucaaacuac

SEQ ID NO: 3667890 - RNA, 18 nt, Human
gcaggccaccuggcucuc

SEQ ID NO: 3667891 - RNA, 22 nt, Human
gcaggccagcugugguuuucuu

SEQ ID NO: 3667892 - RNA, 17 nt, Human
gcaggccaggccagcug

SEQ ID NO: 3667893 - RNA, 16 nt, Human
gcaggcccacccugcu

SEQ ID NO: 3667894 - RNA, 21 nt, Human
gcaggcccugcacuguccugc

SEQ ID NO: 3667895 - RNA, 12 nt, Human
gcaggcccuggc

SEQ ID NO: 3667896 - RNA, 14 nt, Human
gcaggcccuggccu

SEQ ID NO: 3667897 - RNA, 22 nt, Human
gcaggcgcaagggaggcccagc

SEQ ID NO: 3667898 - RNA, 15 nt, Human
gcaggcggugggcac

SEQ ID NO: 3667899 - RNA, 17 nt, Human
gcaggcuaaggcgugga

SEQ ID NO: 3667900 - RNA, 22 nt, Human
gcaggcuaaggcguggagcugc

SEQ ID NO: 3667901 - RNA, 16 nt, Human
gcaggcuacacugaca

SEQ ID NO: 3667902 - RNA, 15 nt, Human
gcaggcucacugcca

SEQ ID NO: 3667903 - RNA, 12 nt, Human
gcaggcucucag

SEQ ID NO: 3667904 - RNA, 17 nt, Human
gcaggcucucaggccag

SEQ ID NO: 3667905 - RNA, 18 nt, Human
gcaggcucucaggccagc

SEQ ID NO: 3667906 - RNA, 11 nt, Human
gcaggcugaca

SEQ ID NO: 3667907 - RNA, 15 nt, Human
gcaggcugacaucug

SEQ ID NO: 3667908 - RNA, 12 nt, Human
gcaggcugauuu

SEQ ID NO: 3667909 - RNA, 18 nt, Human
gcaggcugccagugccug

SEQ ID NO: 3667910 - RNA, 14 nt, Human
gcaggcuggaguua

SEQ ID NO: 3667911 - RNA, 18 nt, Human
gcaggcuggcaccgccuu

SEQ ID NO: 3667912 - RNA, 14 nt, Human
uacucuuucuguau

SEQ ID NO: 3667913 - RNA, 17 nt, Human
uacucuuugagauagaa

SEQ ID NO: 3667914 - RNA, 22 nt, Human
uacucuuugagauagaagaacu

SEQ ID NO: 3667915 - RNA, 14 nt, Human
uacugaaaacuuca

SEQ ID NO: 3667916 - RNA, 22 nt, Human
uacugaacaaucaaagcacuug

SEQ ID NO: 3667917 - RNA, 16 nt, Human
uacugaaccacuugua

SEQ ID NO: 3667918 - RNA, 23 nt, Human
uacugaaccacuuguagauuuga

SEQ ID NO: 3667919 - RNA, 19 nt, Human
uacugaaggaaaaacacaa

SEQ ID NO: 3667920 - RNA, 20 nt, Human
uacugaaggaaaaacacaag

SEQ ID NO: 3667921 - RNA, 17 nt, Human
uacugaagguaaaauug

SEQ ID NO: 3667922 - RNA, 19 nt, Human
uacugaauuuuuuuguaau

SEQ ID NO: 3667923 - RNA, 23 nt, Human
uacugacacuuugccagaaagca

SEQ ID NO: 3667924 - RNA, 13 nt, Human
uacugacaugugg

SEQ ID NO: 3667925 - RNA, 17 nt, Human
uacugacugagaauaua

SEQ ID NO: 3667926 - RNA, 19 nt, Human
uacugagagugaacaaauu

SEQ ID NO: 3667927 - RNA, 18 nt, Human
uacugagcagugauauuc

SEQ ID NO: 3667928 - RNA, 23 nt, Human
uacugagccuuguaauucuaaau

SEQ ID NO: 3667929 - RNA, 17 nt, Human
uacugagcuucucugug

SEQ ID NO: 3667930 - RNA, 18 nt, Human
uacugagcuucucuguga

SEQ ID NO: 3667931 - RNA, 16 nt, Human
uacugaucaugcauug

SEQ ID NO: 3667932 - RNA, 14 nt, Human
uacugauggaauuu

SEQ ID NO: 3667933 - RNA, 23 nt, Human
uacugauguuccuagugaaagag

SEQ ID NO: 3667934 - RNA, 17 nt, Human
uacugauguuccuuugg

SEQ ID NO: 3667935 - RNA, 22 nt, Human
uacugauuauuuucuucaucca

SEQ ID NO: 3667936 - RNA, 18 nt, Human
uacugauucacugcaugg

SEQ ID NO: 3667937 - RNA, 16 nt, Human
uacugauugagaaguu

SEQ ID NO: 3667938 - RNA, 22 nt, Human
uacugauuugggcugaauguau

SEQ ID NO: 3667939 - RNA, 21 nt, Human
uacugcaaaucaggcuuuugu

SEQ ID NO: 3667940 - RNA, 20 nt, Human
uacugcaccauuuaaaaaca

SEQ ID NO: 3667941 - RNA, 17 nt, Human
uacugcacuccagccug

SEQ ID NO: 3667942 - RNA, 20 nt, Human
uacugcacuccagccugggg

SEQ ID NO: 3667943 - RNA, 17 nt, Human
uacugcagaauacagua

SEQ ID NO: 3667944 - RNA, 22 nt, Human
uacugcagaauacaguaagcug

SEQ ID NO: 3667945 - RNA, 15 nt, Human
uacugcagcaccucc

SEQ ID NO: 3667946 - RNA, 16 nt, Human
uacugcagcaccucca

SEQ ID NO: 3667947 - RNA, 12 nt, Human
uacugcagccuc

SEQ ID NO: 3667948 - RNA, 12 nt, Human
uacugcagggcc

SEQ ID NO: 3667949 - RNA, 14 nt, Human
uacugcagggccag

SEQ ID NO: 3667950 - RNA, 11 nt, Human
uacugcaguug

SEQ ID NO: 3667951 - RNA, 19 nt, Human
uacugcaguugaaagggca

SEQ ID NO: 3667952 - RNA, 15 nt, Human
uacugcauacuuuuu

SEQ ID NO: 3667953 - RNA, 17 nt, Human
uacugcauacuuuuuaa

SEQ ID NO: 3667954 - RNA, 18 nt, Human
uacugcauacuuuuuaaa

SEQ ID NO: 3667955 - RNA, 13 nt, Human
uacugcaugcacu

SEQ ID NO: 3667956 - RNA, 14 nt, Human
uacugcauucuucu

SEQ ID NO: 3667957 - RNA, 17 nt, Human
uacugcauucuucugau

SEQ ID NO: 3667958 - RNA, 11 nt, Human
uacugccaaag

SEQ ID NO: 3667959 - RNA, 12 nt, Human
uacugccagaug

SEQ ID NO: 3667960 - RNA, 21 nt, Human
uacugccagaugcugauguuc

SEQ ID NO: 3667961 - RNA, 20 nt, Human
uacugcccaggccugccugu

SEQ ID NO: 3667962 - RNA, 19 nt, Human
uacugcccggggcagcugc

SEQ ID NO: 3667963 - RNA, 22 nt, Human
uacugcccggggcagcugccag

SEQ ID NO: 3667964 - RNA, 22 nt, Human
uacugccgucagugcugugcug

SEQ ID NO: 3667965 - RNA, 20 nt, Human
uacugccugaauaaagagcc

SEQ ID NO: 3667966 - RNA, 16 nt, Human
uacugccugcuugggg

SEQ ID NO: 3667967 - RNA, 13 nt, Human
uacugccuugaaa

SEQ ID NO: 3667968 - RNA, 19 nt, Human
uacugcgacuuucugccug

SEQ ID NO: 3667969 - RNA, 20 nt, Human
uacugcuacagcaauuucua

SEQ ID NO: 3667970 - RNA, 19 nt, Human
uacugcuagucuuaagaac

SEQ ID NO: 3667971 - RNA, 13 nt, Human
uacugcucugaga

SEQ ID NO: 3667972 - RNA, 20 nt, Human
uacugcugagauacauacag

SEQ ID NO: 3667973 - RNA, 20 nt, Human
uacugcuuaauucaaauaau

SEQ ID NO: 3667974 - RNA, 23 nt, Human
uacugcuucuaccaacuggaagc

SEQ ID NO: 3667975 - RNA, 17 nt, Human
uacugcuuuaaucagaa

SEQ ID NO: 3667976 - RNA, 14 nt, Human
uacuggauuguacu

SEQ ID NO: 3667977 - RNA, 12 nt, Human
uacuggcgugga

SEQ ID NO: 3667978 - RNA, 21 nt, Human
uacuggcguggauuaaacuua

SEQ ID NO: 3667979 - RNA, 23 nt, Human
uacuggcguggauuaaacuuaug

SEQ ID NO: 3667980 - RNA, 18 nt, Human
uacugggcccugagucug

SEQ ID NO: 3667981 - RNA, 22 nt, Human
uacuggggaaacuggccauggc

SEQ ID NO: 3667982 - RNA, 22 nt, Human
uacugggugucauuucauucca

SEQ ID NO: 3667983 - RNA, 23 nt, Human
uacugggugucauuucauuccau

SEQ ID NO: 3667984 - RNA, 23 nt, Human
uaauguugugaauaauuacagug

SEQ ID NO: 3667985 - RNA, 14 nt, Human
uaauguuguuauuu

SEQ ID NO: 3667986 - RNA, 23 nt, Human
uaauguuguuccuuuugaaagaa

SEQ ID NO: 3667987 - RNA, 15 nt, Human
uaauguuuaugagcc

SEQ ID NO: 3667988 - RNA, 18 nt, Human
uaauguuuaugagccaga

SEQ ID NO: 3667989 - RNA, 22 nt, Human
uaauguuuauuaaaugcuucau

SEQ ID NO: 3667990 - RNA, 20 nt, Human
uaauguuuuaaauguacaga

SEQ ID NO: 3667991 - RNA, 13 nt, Human
uaauguuuucaaa

SEQ ID NO: 3667992 - RNA, 14 nt, Human
uaauguuuucaaaa

SEQ ID NO: 3667993 - RNA, 13 nt, Human
uaauguuuucuuu

SEQ ID NO: 3667994 - RNA, 18 nt, Human
uaauguuuucuuugcaaa

SEQ ID NO: 3667995 - RNA, 20 nt, Human
uaauguuuucuuugcaaagu

SEQ ID NO: 3667996 - RNA, 21 nt, Human
uaauguuuucuuugcaaagua

SEQ ID NO: 3667997 - RNA, 16 nt, Human
uaauguuuuuaaauau

SEQ ID NO: 3667998 - RNA, 16 nt, Human
uaauguuuuuaauauu

SEQ ID NO: 3667999 - RNA, 21 nt, Human
uaauguuuuuugccacagcuu

SEQ ID NO: 3668000 - RNA, 18 nt, Human
uaauuaaaaaguuaaucu

SEQ ID NO: 3668001 - RNA, 12 nt, Human
uaauuaaagugu

SEQ ID NO: 3668002 - RNA, 20 nt, Human
uaauuaacauauaauauaug

SEQ ID NO: 3668003 - RNA, 17 nt, Human
uaauuaacauguuaaac

SEQ ID NO: 3668004 - RNA, 18 nt, Human
uaauuaacauguuaaacc

SEQ ID NO: 3668005 - RNA, 21 nt, Human
uaauuaacauguuaaaccaug

SEQ ID NO: 3668006 - RNA, 19 nt, Human
uaauuaaccuuacuaauua

SEQ ID NO: 3668007 - RNA, 21 nt, Human
uaauuaaguaaacuaaugagu

SEQ ID NO: 3668008 - RNA, 20 nt, Human
uaauuaaguacuauguauca

SEQ ID NO: 3668009 - RNA, 17 nt, Human
uaauuaauauauuaaaa

SEQ ID NO: 3668010 - RNA, 15 nt, Human
uaauuaaucaugaau

SEQ ID NO: 3668011 - RNA, 21 nt, Human
uaauuaaucaugaauguguaa

SEQ ID NO: 3668012 - RNA, 20 nt, Human
uaauuaaugaaauaucugua

SEQ ID NO: 3668013 - RNA, 21 nt, Human
uaauuaaugaaauaucuguau

SEQ ID NO: 3668014 - RNA, 21 nt, Human
uaauuaauugggccagcuuuu

SEQ ID NO: 3668015 - RNA, 19 nt, Human
uaauuacagugccuaaaau

SEQ ID NO: 3668016 - RNA, 22 nt, Human
uaauuacagugccuaaaauaag

SEQ ID NO: 3668017 - RNA, 17 nt, Human
uaauuaccaaccuguua

SEQ ID NO: 3668018 - RNA, 15 nt, Human
uaauuacgauaagga

SEQ ID NO: 3668019 - RNA, 20 nt, Human
uaauuacgauaaggaagaaa

SEQ ID NO: 3668020 - RNA, 22 nt, Human
uaauuacuuauuguauuuaugu

SEQ ID NO: 3668021 - RNA, 17 nt, Human
uaauuagauccauuaau

SEQ ID NO: 3668022 - RNA, 18 nt, Human
uaauuagauccauuaauu

SEQ ID NO: 3668023 - RNA, 13 nt, Human
uaauuagguuaac

SEQ ID NO: 3668024 - RNA, 14 nt, Human
uaauuagugccacu

SEQ ID NO: 3668025 - RNA, 19 nt, Human
uaauuagugccacuuaaug

SEQ ID NO: 3668026 - RNA, 12 nt, Human
uaauuagugcua

SEQ ID NO: 3668027 - RNA, 15 nt, Human
uaauuagugcuaagu

SEQ ID NO: 3668028 - RNA, 20 nt, Human
uaauuagugcuaagugugaa

SEQ ID NO: 3668029 - RNA, 21 nt, Human
uaauuagugcuaagugugaac

SEQ ID NO: 3668030 - RNA, 14 nt, Human
uaauuauauaacug

SEQ ID NO: 3668031 - RNA, 19 nt, Human
uaauuauaucugaggaauu

SEQ ID NO: 3668032 - RNA, 21 nt, Human
uaauuauaucugaggaauucu

SEQ ID NO: 3668033 - RNA, 14 nt, Human
uaauuauccaggaa

SEQ ID NO: 3668034 - RNA, 21 nt, Human
uaauuaucggaagcagugccu

SEQ ID NO: 3668035 - RNA, 18 nt, Human
uaauuaucgggaacagug

SEQ ID NO: 3668036 - RNA, 19 nt, Human
uaauuaucgggaacagugu

SEQ ID NO: 3668037 - RNA, 20 nt, Human
uaauuaucgggaacaguguu

SEQ ID NO: 3668038 - RNA, 21 nt, Human
uaauuaugccuuuuuugauca

SEQ ID NO: 3668039 - RNA, 17 nt, Human
uaauuauggagucauuu

SEQ ID NO: 3668040 - RNA, 15 nt, Human
uaauuauguuauuga

SEQ ID NO: 3668041 - RNA, 15 nt, Human
uaauuauuauaaaaa

SEQ ID NO: 3668042 - RNA, 19 nt, Human
uaauuauuauaaaaauauu

SEQ ID NO: 3668043 - RNA, 13 nt, Human
uaauuauuauuaa

SEQ ID NO: 3668044 - RNA, 12 nt, Human
uaauuauuauuu

SEQ ID NO: 3668045 - RNA, 22 nt, Human
uaauuauuauuuauauauguau

SEQ ID NO: 3668046 - RNA, 22 nt, Human
uaauuauuguuuauauuuucaa

SEQ ID NO: 3668047 - RNA, 16 nt, Human
uaauuauuuauguaug

SEQ ID NO: 3668048 - RNA, 18 nt, Human
uaauuauuuauguauggu

SEQ ID NO: 3668049 - RNA, 17 nt, Human
uaauuauuuauuacaua

SEQ ID NO: 3668050 - RNA, 18 nt, Human
uaauuauuuuaauuaggu

SEQ ID NO: 3668051 - RNA, 16 nt, Human
uaauuauuuugguacu

SEQ ID NO: 3668052 - RNA, 21 nt, Human
uaauucaaagcaccaaaauaa

SEQ ID NO: 3668053 - RNA, 22 nt, Human
uaauucaaagcucuauuaagau

SEQ ID NO: 3668054 - RNA, 21 nt, Human
uaauucacagugcucuuuucu

SEQ ID NO: 3668055 - RNA, 19 nt, Human
uaauuucugccauuucaug

SEQ ID NO: 3668056 - RNA, 18 nt, Human
uaauuucugucagaaugc

SEQ ID NO: 3668057 - RNA, 20 nt, Human
uaauuucuucaaaauguaua

SEQ ID NO: 3668058 - RNA, 21 nt, Human
uaauuucuucaaaauguauau

SEQ ID NO: 3668059 - RNA, 18 nt, Human
uaauuucuuugccuguuc

SEQ ID NO: 3668060 - RNA, 22 nt, Human
uaauuugaaaacauaaucugca

SEQ ID NO: 3668061 - RNA, 20 nt, Human
uaauuugaagguagaauguu

SEQ ID NO: 3668062 - RNA, 12 nt, Human
uaauuugaucuu

SEQ ID NO: 3668063 - RNA, 17 nt, Human
uaauuugaugagguauu

SEQ ID NO: 3668064 - RNA, 20 nt, Human
uaauuugaugagguauuuuu

SEQ ID NO: 3668065 - RNA, 16 nt, Human
uaauuugauuaacaaa

SEQ ID NO: 3668066 - RNA, 12 nt, Human
uaauuugcauua

SEQ ID NO: 3668067 - RNA, 17 nt, Human
uaauuugcauuaaauuc

SEQ ID NO: 3668068 - RNA, 22 nt, Human
uaauuugccaaaauaaugucuu

SEQ ID NO: 3668069 - RNA, 20 nt, Human
uaauuuggaaacuaauaaaa

SEQ ID NO: 3668070 - RNA, 23 nt, Human
uaauuuggaaacuaauaaaauau

SEQ ID NO: 3668071 - RNA, 17 nt, Human
uaauuuggagcacaaaa

SEQ ID NO: 3668072 - RNA, 12 nt, Human
uaauuuggcagg

SEQ ID NO: 3668073 - RNA, 15 nt, Human
uaauuugguuuucac

SEQ ID NO: 3668074 - RNA, 13 nt, Human
uaauuuguaaagu

SEQ ID NO: 3668075 - RNA, 16 nt, Human
uaauuuguaaaguugg

SEQ ID NO: 3668076 - RNA, 18 nt, Human
uaauuugugauacaaugc

SEQ ID NO: 3668077 - RNA, 19 nt, Human
uaauuugugauacaaugcu

SEQ ID NO: 3668078 - RNA, 13 nt, Human
uaauuuguguaau

SEQ ID NO: 3668079 - RNA, 20 nt, Human
uaauuuguguaauaaagugu

SEQ ID NO: 3668080 - RNA, 21 nt, Human
uaauuuguguaauaaaguguu

SEQ ID NO: 3668081 - RNA, 15 nt, Human
uaauuuguguguuuu

SEQ ID NO: 3668082 - RNA, 21 nt, Human
uaauuuguuggggcuuuacau

SEQ ID NO: 3668083 - RNA, 15 nt, Human
uaauuuuaaaaaugg

SEQ ID NO: 3668084 - RNA, 14 nt, Human
uaauuuuaaagugc

SEQ ID NO: 3668085 - RNA, 22 nt, Human
uaauuuuaaccaaaacaugucu

SEQ ID NO: 3668086 - RNA, 15 nt, Human
uaauuuuacacauua

SEQ ID NO: 3668087 - RNA, 18 nt, Human
uaauuuuacacgcuuuug

SEQ ID NO: 3668088 - RNA, 21 nt, Human
uaauuuuacacgcuuuuguga

SEQ ID NO: 3668089 - RNA, 23 nt, Human
uaauuuuaguauucauucugcau

SEQ ID NO: 3668090 - RNA, 15 nt, Human
uaauuuuauuccaga

SEQ ID NO: 3668091 - RNA, 14 nt, Human
uaauuuuauuuugu

SEQ ID NO: 3668092 - RNA, 17 nt, Human
uaauuuuccuaauaaag

SEQ ID NO: 3668093 - RNA, 22 nt, Human
uaauuuuccuuuaauaugaaau

SEQ ID NO: 3668094 - RNA, 12 nt, Human
uaauuuucuacc

SEQ ID NO: 3668095 - RNA, 12 nt, Human
uaauuuucucaa

SEQ ID NO: 3668096 - RNA, 13 nt, Human
uaauuuuggaauu

SEQ ID NO: 3668097 - RNA, 18 nt, Human
uaauuuugguuguauucu

SEQ ID NO: 3668098 - RNA, 16 nt, Human
uaauuuuguaaaggug

SEQ ID NO: 3668099 - RNA, 13 nt, Human
uaauuuuguauuu

SEQ ID NO: 3668100 - RNA, 15 nt, Human
uaauuuuguauuuuc

SEQ ID NO: 3668101 - RNA, 21 nt, Human
uaauuuuguauuuuccaagug

SEQ ID NO: 3668102 - RNA, 13 nt, Human
uaauuuugugaag

SEQ ID NO: 3668103 - RNA, 18 nt, Human
uaauuuugugaagcaaaa

SEQ ID NO: 3668104 - RNA, 17 nt, Human
uaauuuuuacagaauug

SEQ ID NO: 3668105 - RNA, 22 nt, Human
uaauuuuuacagaauugcuugu

SEQ ID NO: 3668106 - RNA, 21 nt, Human
uaauuuuuacccuaaugucuu

SEQ ID NO: 3668107 - RNA, 12 nt, Human
uaauuuuuauau

SEQ ID NO: 3668108 - RNA, 18 nt, Human
uaauuuuuauauuugaaa

SEQ ID NO: 3668109 - RNA, 18 nt, Human
uaauuuuuauuucuuccu

SEQ ID NO: 3668110 - RNA, 17 nt, Human
uaauuuuucacuucaaa

SEQ ID NO: 3668111 - RNA, 13 nt, Human
uaauuuuuccaac

SEQ ID NO: 3668112 - RNA, 16 nt, Human
uaauuuuuccuauauu

SEQ ID NO: 3668113 - RNA, 12 nt, Human
uaauuuuucugu

SEQ ID NO: 3668114 - RNA, 20 nt, Human
uaauuuuugauacuaagcau

SEQ ID NO: 3668115 - RNA, 17 nt, Human
uaauuuuuguauuauuu

SEQ ID NO: 3668116 - RNA, 21 nt, Human
uaauuuuuguauuuuuaguag

SEQ ID NO: 3668117 - RNA, 13 nt, Human
uaauuuuuuacua

SEQ ID NO: 3668118 - RNA, 17 nt, Human
uaauuuuuuauucaagu

SEQ ID NO: 3668119 - RNA, 16 nt, Human
uaauuuuuugguacaa

SEQ ID NO: 3668120 - RNA, 14 nt, Human
uaauuuuuuuaauu

SEQ ID NO: 3668121 - RNA, 21 nt, Human
uaauuuuuuuauguuuuguuu

SEQ ID NO: 3668122 - RNA, 14 nt, Human
uaauuuuuuuauug

SEQ ID NO: 3668123 - RNA, 15 nt, Human
uaauuuuuuuauugu

SEQ ID NO: 3668124 - RNA, 16 nt, Human
uaauuuuuuuauuguu

SEQ ID NO: 3668125 - RNA, 18 nt, Human
uaauuuuuuugagacaga

SEQ ID NO: 3668126 - RNA, 18 nt, Human
uaauuuuuuuuucauaga

SEQ ID NO: 3668127 - RNA, 13 nt, Human
uacaaaaacacag

SEQ ID NO: 3668128 - RNA, 16 nt, Human
uacaaaaacacagcaa

SEQ ID NO: 3668129 - RNA, 15 nt, Human
uacaaaaagcauaaa

SEQ ID NO: 3668130 - RNA, 14 nt, Human
uacaaaaauaaauu

SEQ ID NO: 3668131 - RNA, 14 nt, Human
uacaaaaauauaaa

SEQ ID NO: 3668132 - RNA, 19 nt, Human
uacaaaaaucagccagaca

SEQ ID NO: 3668133 - RNA, 12 nt, Human
uacaaaacauua

SEQ ID NO: 3668134 - RNA, 14 nt, Human
uacaaaacauuaaa

SEQ ID NO: 3668135 - RNA, 13 nt, Human
uacaaaagaugua

SEQ ID NO: 3668136 - RNA, 11 nt, Human
uacaaaauaaa

SEQ ID NO: 3668137 - RNA, 20 nt, Human
uacaaaauaaacaaauaaca

SEQ ID NO: 3668138 - RNA, 19 nt, Human
uacaaaauaaaguuacauu

SEQ ID NO: 3668139 - RNA, 18 nt, Human
uacaaaauguaacuguua

SEQ ID NO: 3668140 - RNA, 17 nt, Human
uacaaacaagcauauaa

SEQ ID NO: 3668141 - RNA, 14 nt, Human
uacaaacaaucucu

SEQ ID NO: 3668142 - RNA, 12 nt, Human
uacaaacaaugg

SEQ ID NO: 3668143 - RNA, 17 nt, Human
uacaaacaugugguuaa

SEQ ID NO: 3668144 - RNA, 22 nt, Human
uacaaacugcaauagagacugu

SEQ ID NO: 3668145 - RNA, 13 nt, Human
uacaaagaaauaa

SEQ ID NO: 3668146 - RNA, 19 nt, Human
uacaaagaaccaagaaaaa

SEQ ID NO: 3668147 - RNA, 14 nt, Human
uacaaagaagacau

SEQ ID NO: 3668148 - RNA, 15 nt, Human
uacaaagaagacaug

SEQ ID NO: 3668149 - RNA, 21 nt, Human
uacaaagagguguacagguac

SEQ ID NO: 3668150 - RNA, 17 nt, Human
uacaaagcccuuuuaua

SEQ ID NO: 3668151 - RNA, 17 nt, Human
uacaaagcgugcacaag

SEQ ID NO: 3668152 - RNA, 17 nt, Human
uacaaaggcuguauuca

SEQ ID NO: 3668153 - RNA, 18 nt, Human
uacaaaggcuuauuaauu

SEQ ID NO: 3668154 - RNA, 16 nt, Human
gcauugcucuggaucu

SEQ ID NO: 3668155 - RNA, 20 nt, Human
gcauugcuuucugaaauuag

SEQ ID NO: 3668156 - RNA, 16 nt, Human
gcauuggaagacccca

SEQ ID NO: 3668157 - RNA, 17 nt, Human
gcauuggauacagcagu

SEQ ID NO: 3668158 - RNA, 15 nt, Human
gcauuggcagcaggu

SEQ ID NO: 3668159 - RNA, 13 nt, Human
gcauugggauuuu

SEQ ID NO: 3668160 - RNA, 21 nt, Human
gcauuguaagcguauggcuuu

SEQ ID NO: 3668161 - RNA, 12 nt, Human
gcauuguccucu

SEQ ID NO: 3668162 - RNA, 17 nt, Human
gcauugugauuggccug

SEQ ID NO: 3668163 - RNA, 16 nt, Human
gcauuguugagguggu

SEQ ID NO: 3668164 - RNA, 12 nt, Human
gcauuuaaaaga

SEQ ID NO: 3668165 - RNA, 23 nt, Human
gcauuuaagaauugccagucuuu

SEQ ID NO: 3668166 - RNA, 17 nt, Human
gcauuuacuuugaauuu

SEQ ID NO: 3668167 - RNA, 18 nt, Human
gcauuuaugguaaucaua

SEQ ID NO: 3668168 - RNA, 16 nt, Human
gcauuuauuugugaug

SEQ ID NO: 3668169 - RNA, 12 nt, Human
gcauuucagaaa

SEQ ID NO: 3668170 - RNA, 21 nt, Human
gcauuucagaaagccuuucau

SEQ ID NO: 3668171 - RNA, 20 nt, Human
gcauuucauucuucucuagc

SEQ ID NO: 3668172 - RNA, 15 nt, Human
gcauuucccacccug

SEQ ID NO: 3668173 - RNA, 12 nt, Human
gcauuuccuggg

SEQ ID NO: 3668174 - RNA, 18 nt, Human
gcauuucugaauagaaau

SEQ ID NO: 3668175 - RNA, 21 nt, Human
gcauuugaggucuguucuuuc

SEQ ID NO: 3668176 - RNA, 14 nt, Human
gcauuugaguuuau

SEQ ID NO: 3668177 - RNA, 20 nt, Human
gcauuugauaaugauaaaac

SEQ ID NO: 3668178 - RNA, 21 nt, Human
gcauuugauaaugauaaaaca

SEQ ID NO: 3668179 - RNA, 21 nt, Human
gcauuugaucuguugcaagcc

SEQ ID NO: 3668180 - RNA, 22 nt, Human
gcauuuggauuggggucccucu

SEQ ID NO: 3668181 - RNA, 16 nt, Human
gcauuugguuuuucac

SEQ ID NO: 3668182 - RNA, 17 nt, Human
gcauuuguaaauauuaa

SEQ ID NO: 3668183 - RNA, 11 nt, Human
gcauuugucua

SEQ ID NO: 3668184 - RNA, 12 nt, Human
gcauuugugaaa

SEQ ID NO: 3668185 - RNA, 13 nt, Human
gcauuugugaggc

SEQ ID NO: 3668186 - RNA, 13 nt, Human
gcauuugugauca

SEQ ID NO: 3668187 - RNA, 21 nt, Human
gcauuugugcuagaaauuuuc

SEQ ID NO: 3668188 - RNA, 15 nt, Human
gcauuugugucaucu

SEQ ID NO: 3668189 - RNA, 15 nt, Human
gcauuuguguguuac

SEQ ID NO: 3668190 - RNA, 16 nt, Human
gcauuuguguugaaga

SEQ ID NO: 3668191 - RNA, 12 nt, Human
gcauuuguucac

SEQ ID NO: 3668192 - RNA, 18 nt, Human
gcauuuguugguuuauca

SEQ ID NO: 3668193 - RNA, 18 nt, Human
gcauuuguuuauguaauu

SEQ ID NO: 3668194 - RNA, 20 nt, Human
gcauuuguuuauguaauuuc

SEQ ID NO: 3668195 - RNA, 16 nt, Human
gcauuuuauugcuuga

SEQ ID NO: 3668196 - RNA, 18 nt, Human
gcauuuucaccccacccu

SEQ ID NO: 3668197 - RNA, 20 nt, Human
gcauuuucccccuuggcucu

SEQ ID NO: 3668198 - RNA, 21 nt, Human
gcauuuuccucugcuuugaaa

SEQ ID NO: 3668199 - RNA, 17 nt, Human
gcauuuucugcaucucc

SEQ ID NO: 3668200 - RNA, 18 nt, Human
gcauuuucugcaucucca

SEQ ID NO: 3668201 - RNA, 11 nt, Human
uaccucccucc

SEQ ID NO: 3668202 - RNA, 12 nt, Human
uaccucccuccc

SEQ ID NO: 3668203 - RNA, 15 nt, Human
uaccucccuugccuu

SEQ ID NO: 3668204 - RNA, 13 nt, Human
uaccuccucaggg

SEQ ID NO: 3668205 - RNA, 17 nt, Human
uaccuccucagggaugg

SEQ ID NO: 3668206 - RNA, 23 nt, Human
uaccuccucagggauggccguug

SEQ ID NO: 3668207 - RNA, 19 nt, Human
uaccuccuccccccuccuc

SEQ ID NO: 3668208 - RNA, 11 nt, Human
uaccuccuccu

SEQ ID NO: 3668209 - RNA, 19 nt, Human
uaccuccucucaguguuuu

SEQ ID NO: 3668210 - RNA, 16 nt, Human
uaccuccugcccagga

SEQ ID NO: 3668211 - RNA, 18 nt, Human
uaccucggugccuuccuc

SEQ ID NO: 3668212 - RNA, 15 nt, Human
uaccucuauauacca

SEQ ID NO: 3668213 - RNA, 12 nt, Human
uaccucucuguc

SEQ ID NO: 3668214 - RNA, 21 nt, Human
uaccucucuuauagaauauuu

SEQ ID NO: 3668215 - RNA, 16 nt, Human
gccagaugcugauguu

SEQ ID NO: 3668216 - RNA, 19 nt, Human
gccagaugcugauguucag

SEQ ID NO: 3668217 - RNA, 12 nt, Human
gccagaugcugc

SEQ ID NO: 3668218 - RNA, 14 nt, Human
gccagauggggccu

SEQ ID NO: 3668219 - RNA, 24 nt, Human
gccagauucuuuccugaggcuggg

SEQ ID NO: 3668220 - RNA, 13 nt, Human
gccagauuucacu

SEQ ID NO: 3668221 - RNA, 18 nt, Human
gccagauuucacucuccu

SEQ ID NO: 3668222 - RNA, 19 nt, Human
gccagauuuuccugaaaac

SEQ ID NO: 3668223 - RNA, 12 nt, Human
gccagauuuuuu

SEQ ID NO: 3668224 - RNA, 13 nt, Human
gccagauuuuuua

SEQ ID NO: 3668225 - RNA, 23 nt, Human
gccagcaaagaggacucgcuugu

SEQ ID NO: 3668226 - RNA, 17 nt, Human
gccagcaacacagagca

SEQ ID NO: 3668227 - RNA, 19 nt, Human
gccagcaagaguuaggggc

SEQ ID NO: 3668228 - RNA, 20 nt, Human
gccagcacagaaacagagga

SEQ ID NO: 3668229 - RNA, 15 nt, Human
gccagcaccggacca

SEQ ID NO: 3668230 - RNA, 19 nt, Human
gccagcaccggaccagccu

SEQ ID NO: 3668231 - RNA, 15 nt, Human
gccagcagacauugu

SEQ ID NO: 3668232 - RNA, 14 nt, Human
gccagcagcaccug

SEQ ID NO: 3668233 - RNA, 19 nt, Human
gccagcagcaccugcccua

SEQ ID NO: 3668234 - RNA, 13 nt, Human
gccagcagcagca

SEQ ID NO: 3668235 - RNA, 15 nt, Human
gccagcagcagcagg

SEQ ID NO: 3668236 - RNA, 17 nt, Human
gccagcagccagcucuc

SEQ ID NO: 3668237 - RNA, 18 nt, Human
gccagcaggcucucaggc

SEQ ID NO: 3668238 - RNA, 19 nt, Human
gccagcaggcucucaggcc

SEQ ID NO: 3668239 - RNA, 19 nt, Human
gccagccaaacacacagaa

SEQ ID NO: 3668240 - RNA, 15 nt, Human
gccagccaagcucug

SEQ ID NO: 3668241 - RNA, 16 nt, Human
gccagccaagcucugc

SEQ ID NO: 3668242 - RNA, 19 nt, Human
gccagccaagcucugcagu

SEQ ID NO: 3668243 - RNA, 16 nt, Human
gccagccacucuacca

SEQ ID NO: 3668244 - RNA, 18 nt, Human
gccagccaggcgggcuca

SEQ ID NO: 3668245 - RNA, 17 nt, Human
gccagccccacacagcu

SEQ ID NO: 3668246 - RNA, 17 nt, Human
gccagccccggcccugg

SEQ ID NO: 3668247 - RNA, 16 nt, Human
gccagccccucccacc

SEQ ID NO: 3668248 - RNA, 15 nt, Human
gccagccccucuucc

SEQ ID NO: 3668249 - RNA, 20 nt, Human
gccagccccucuuccccaau

SEQ ID NO: 3668250 - RNA, 20 nt, Human
gccagccccuggccccagga

SEQ ID NO: 3668251 - RNA, 20 nt, Human
gccagccccuuagacagagg

SEQ ID NO: 3668252 - RNA, 10 nt, Human
gccagcccuc

SEQ ID NO: 3668253 - RNA, 17 nt, Human
gccagcccucccugucc

SEQ ID NO: 3668254 - RNA, 14 nt, Human
gccagcccugccug

SEQ ID NO: 3668255 - RNA, 17 nt, Human
gccagcccugccuggag

SEQ ID NO: 3668256 - RNA, 18 nt, Human
gccagcccugccuggagg

SEQ ID NO: 3668257 - RNA, 20 nt, Human
gccagcccugccuggaggac

SEQ ID NO: 3668258 - RNA, 24 nt, Human
gccagccgagcaggaggccuagga

SEQ ID NO: 3668259 - RNA, 22 nt, Human
gccagccgcucuccugccacau

SEQ ID NO: 3668260 - RNA, 20 nt, Human
gccagccgugaugcucaggc

SEQ ID NO: 3668261 - RNA, 18 nt, Human
gccagccuccgagaggga

SEQ ID NO: 3668262 - RNA, 12 nt, Human
gccagccuccuc

SEQ ID NO: 3668263 - RNA, 13 nt, Human
gccagccuccucu

SEQ ID NO: 3668264 - RNA, 17 nt, Human
gccagccugaccuuccu

SEQ ID NO: 3668265 - RNA, 22 nt, Human
gccagccugaccuuccuuccug

SEQ ID NO: 3668266 - RNA, 11 nt, Human
gccagccuggc

SEQ ID NO: 3668267 - RNA, 17 nt, Human
gccagccuggccuccug

SEQ ID NO: 3668268 - RNA, 20 nt, Human
gccagccuggccuccugccu

SEQ ID NO: 3668269 - RNA, 14 nt, Human
gccagccuggcugg

SEQ ID NO: 3668270 - RNA, 20 nt, Human
gccagccuggggccuggcag

SEQ ID NO: 3668271 - RNA, 14 nt, Human
gccagccuugacca

SEQ ID NO: 3668272 - RNA, 21 nt, Human
gccagccuugaccauucucca

SEQ ID NO: 3668273 - RNA, 22 nt, Human
gccagccuugaccauucuccac

SEQ ID NO: 3668274 - RNA, 17 nt, Human
gccagccuugagcccug

SEQ ID NO: 3668275 - RNA, 20 nt, Human
gccagccuugagcccuggcu

SEQ ID NO: 3668276 - RNA, 12 nt, Human
gccagcgaacuu

SEQ ID NO: 3668277 - RNA, 16 nt, Human
gccagcgccucccucc

SEQ ID NO: 3668278 - RNA, 23 nt, Human
gccagcgccucccuccaccccag

SEQ ID NO: 3668279 - RNA, 19 nt, Human
gccagcgucggucugugcc

SEQ ID NO: 3668280 - RNA, 17 nt, Human
gccagcucacagugcug

SEQ ID NO: 3668281 - RNA, 13 nt, Human
gccagcucuguau

SEQ ID NO: 3668282 - RNA, 15 nt, Human
gccagcucuguauca

SEQ ID NO: 3668283 - RNA, 17 nt, Human
gccagcucuuccuagcu

SEQ ID NO: 3668284 - RNA, 16 nt, Human
gccagcugaugacuca

SEQ ID NO: 3668285 - RNA, 18 nt, Human
gccagcugaugacucaag

SEQ ID NO: 3668286 - RNA, 14 nt, Human
gccagcugcagcug

SEQ ID NO: 3668287 - RNA, 20 nt, Human
gccagcugcaggaaucaaaa

SEQ ID NO: 3668288 - RNA, 18 nt, Human
gccagcugcaucuacuca

SEQ ID NO: 3668289 - RNA, 19 nt, Human
gccagcugcaucuacucag

SEQ ID NO: 3668290 - RNA, 22 nt, Human
gccagcugcaucuacucaggcc

SEQ ID NO: 3668291 - RNA, 18 nt, Human
gccagcugccccagccag

SEQ ID NO: 3668292 - RNA, 15 nt, Human
gccagcugcccuaug

SEQ ID NO: 3668293 - RNA, 22 nt, Human
gccagcugcccuaugggccugc

SEQ ID NO: 3668294 - RNA, 13 nt, Human
gccagcugccucc

SEQ ID NO: 3668295 - RNA, 17 nt, Human
gccagcuggaggcaggg

SEQ ID NO: 3668296 - RNA, 14 nt, Human
gccagcuggcagca

SEQ ID NO: 3668297 - RNA, 13 nt, Human
gccagcuggccuu

SEQ ID NO: 3668298 - RNA, 19 nt, Human
gccagcugggaucugacug

SEQ ID NO: 3668299 - RNA, 20 nt, Human
gccagcuuguuuacaugcuu

SEQ ID NO: 3668300 - RNA, 23 nt, Human
gccagcuuguuuacaugcuuauu

SEQ ID NO: 3668301 - RNA, 12 nt, Human
gccaggaagcca

SEQ ID NO: 3668302 - RNA, 15 nt, Human
gccaggaagccagca

SEQ ID NO: 3668303 - RNA, 18 nt, Human
gccaggaagccagcaggc

SEQ ID NO: 3668304 - RNA, 19 nt, Human
gccaggaaguagcacaggc

SEQ ID NO: 3668305 - RNA, 13 nt, Human
gccaggaauauug

SEQ ID NO: 3668306 - RNA, 14 nt, Human
gccaggacaggccc

SEQ ID NO: 3668307 - RNA, 19 nt, Human
gccaggacagucagcucuc

SEQ ID NO: 3668308 - RNA, 22 nt, Human
gccaggacaugcaauaaaauuu

SEQ ID NO: 3668309 - RNA, 21 nt, Human
gccaggacuccccaggccagg

SEQ ID NO: 3668310 - RNA, 14 nt, Human
gccaggacucugca

SEQ ID NO: 3668311 - RNA, 16 nt, Human
gccaggacugagcccc

SEQ ID NO: 3668312 - RNA, 9 nt, Human
gccaggaga

SEQ ID NO: 3668313 - RNA, 15 nt, Human
gccaggagaagcuca

SEQ ID NO: 3668314 - RNA, 17 nt, Human
gccaggagagcuuaggg

SEQ ID NO: 3668315 - RNA, 21 nt, Human
gccaggagcacggcucugucc

SEQ ID NO: 3668316 - RNA, 21 nt, Human
gccaggagcaggcacgggugg

SEQ ID NO: 3668317 - RNA, 20 nt, Human
gccaggagcucuucaggccu

SEQ ID NO: 3668318 - RNA, 23 nt, Human
gccaggagcugggcagaaggcca

SEQ ID NO: 3668319 - RNA, 23 nt, Human
gccaggagcugucaccaaggaaa

SEQ ID NO: 3668320 - RNA, 13 nt, Human
gccaggagggaca

SEQ ID NO: 3668321 - RNA, 19 nt, Human
gccaggagggacaaaggag

SEQ ID NO: 3668322 - RNA, 21 nt, Human
gccaggagggacaaaggagcc

SEQ ID NO: 3668323 - RNA, 18 nt, Human
gccaggaggugccacugg

SEQ ID NO: 3668324 - RNA, 19 nt, Human
gccaggaguuugagaccag

SEQ ID NO: 3668325 - RNA, 22 nt, Human
gccaggauggaacacggccaca

SEQ ID NO: 3668326 - RNA, 14 nt, Human
gccaggauggcgca

SEQ ID NO: 3668327 - RNA, 14 nt, Human
gccaggcacaggca

SEQ ID NO: 3668328 - RNA, 20 nt, Human
gccaggcacaggcagggcag

SEQ ID NO: 3668329 - RNA, 20 nt, Human
gccaggcacccccuggagag

SEQ ID NO: 3668330 - RNA, 14 nt, Human
gccaggcaggggug

SEQ ID NO: 3668331 - RNA, 19 nt, Human
gccaggcagguagccaggg

SEQ ID NO: 3668332 - RNA, 18 nt, Human
gccaggcaggugccugga

SEQ ID NO: 3668333 - RNA, 15 nt, Human
gccaggccaccagga

SEQ ID NO: 3668334 - RNA, 19 nt, Human
gccaggccaccaggauggc

SEQ ID NO: 3668335 - RNA, 19 nt, Human
gccaggccacuggccccug

SEQ ID NO: 3668336 - RNA, 15 nt, Human
gccaggccagccucc

SEQ ID NO: 3668337 - RNA, 23 nt, Human
gccaggcccccaagccugcaguc

SEQ ID NO: 3668338 - RNA, 17 nt, Human
gccaggcccccaccaca

SEQ ID NO: 3668339 - RNA, 19 nt, Human
gccaggccggcgagcccug

SEQ ID NO: 3668340 - RNA, 20 nt, Human
gccaggccggcgagcccugu

SEQ ID NO: 3668341 - RNA, 23 nt, Human
gccaggccucucccuccuccagg

SEQ ID NO: 3668342 - RNA, 21 nt, Human
gccaggccucucucaccucuc

SEQ ID NO: 3668343 - RNA, 21 nt, Human
gccaggccugggucugugucu

SEQ ID NO: 3668344 - RNA, 22 nt, Human
gccaggcgcuagcacagcuccc

SEQ ID NO: 3668345 - RNA, 14 nt, Human
gccaggcuccuucc

SEQ ID NO: 3668346 - RNA, 16 nt, Human
uauaacuagcuagaag

SEQ ID NO: 3668347 - RNA, 14 nt, Human
uauaacuaguccuu

SEQ ID NO: 3668348 - RNA, 18 nt, Human
uauaacuaguccuuuacu

SEQ ID NO: 3668349 - RNA, 15 nt, Human
uauaacucauuuguu

SEQ ID NO: 3668350 - RNA, 16 nt, Human
uauaacugaaggagaa

SEQ ID NO: 3668351 - RNA, 19 nt, Human
uauaacugccuuaaaacuu

SEQ ID NO: 3668352 - RNA, 18 nt, Human
uauaacuuaaaaaaauga

SEQ ID NO: 3668353 - RNA, 22 nt, Human
uauaacuuaaaaauguaaauau

SEQ ID NO: 3668354 - RNA, 21 nt, Human
uauaacuuauauuguaagaaa

SEQ ID NO: 3668355 - RNA, 22 nt, Human
uauaacuuauauuguaagaaau

SEQ ID NO: 3668356 - RNA, 16 nt, Human
uauaacuucuuaaaag

SEQ ID NO: 3668357 - RNA, 19 nt, Human
uauaacuugucuaaauaag

SEQ ID NO: 3668358 - RNA, 17 nt, Human
uauaacuuuaacuucug

SEQ ID NO: 3668359 - RNA, 16 nt, Human
uauaacuuuagaaaua

SEQ ID NO: 3668360 - RNA, 20 nt, Human
uauaacuuuuuauauucuca

SEQ ID NO: 3668361 - RNA, 16 nt, Human
uauaagaaaaauguga

SEQ ID NO: 3668362 - RNA, 15 nt, Human
uauaagaaagacauc

SEQ ID NO: 3668363 - RNA, 17 nt, Human
uauaagaaagacaucuu

SEQ ID NO: 3668364 - RNA, 13 nt, Human
uauaagaaagccu

SEQ ID NO: 3668365 - RNA, 19 nt, Human
uauaagaauaaaauguuga

SEQ ID NO: 3668366 - RNA, 16 nt, Human
uauaagaggcugauaa

SEQ ID NO: 3668367 - RNA, 22 nt, Human
uauaagauuccaaaaagcacau

SEQ ID NO: 3668368 - RNA, 15 nt, Human
uauaagcaaauuuca

SEQ ID NO: 3668369 - RNA, 22 nt, Human
uauaagcaaauuucaaaagaca

SEQ ID NO: 3668370 - RNA, 18 nt, Human
uauaagcacugaaaaaca

SEQ ID NO: 3668371 - RNA, 21 nt, Human
uauaagcaucauuauuuaugu

SEQ ID NO: 3668372 - RNA, 18 nt, Human
uauaagcauugaaauuau

SEQ ID NO: 3668373 - RNA, 19 nt, Human
uauaagcauugaaauuaua

SEQ ID NO: 3668374 - RNA, 18 nt, Human
uauaagccaaaauuaagg

SEQ ID NO: 3668375 - RNA, 23 nt, Human
uauaagccaaaauuaagguguuu

SEQ ID NO: 3668376 - RNA, 16 nt, Human
uauaagcccacuguua

SEQ ID NO: 3668377 - RNA, 21 nt, Human
uauaagcccuugauuggaagg

SEQ ID NO: 3668378 - RNA, 23 nt, Human
uauaaggaaagcaauaaaugaau

SEQ ID NO: 3668379 - RNA, 16 nt, Human
uauaaggugcucucuu

SEQ ID NO: 3668380 - RNA, 18 nt, Human
uauaaguaacuuuauucu

SEQ ID NO: 3668381 - RNA, 18 nt, Human
uauaaguaagaaaauauu

SEQ ID NO: 3668382 - RNA, 16 nt, Human
uauaaguagcaggcca

SEQ ID NO: 3668383 - RNA, 15 nt, Human
uauaagucacaaaga

SEQ ID NO: 3668384 - RNA, 14 nt, Human
uauaagugaaguga

SEQ ID NO: 3668385 - RNA, 19 nt, Human
uauaagugauugcugguuu

SEQ ID NO: 3668386 - RNA, 13 nt, Human
uauaagugcugua

SEQ ID NO: 3668387 - RNA, 15 nt, Human
uauaagugcuguaua

SEQ ID NO: 3668388 - RNA, 16 nt, Human
uauaagugcuguauaa

SEQ ID NO: 3668389 - RNA, 17 nt, Human
uauaagugcuguauaaa

SEQ ID NO: 3668390 - RNA, 20 nt, Human
uauaagugcuguauaaaauc

SEQ ID NO: 3668391 - RNA, 14 nt, Human
uauaaguguacaua

SEQ ID NO: 3668392 - RNA, 15 nt, Human
uauaaguguacauau

SEQ ID NO: 3668393 - RNA, 15 nt, Human
uauaaguguguguuu

SEQ ID NO: 3668394 - RNA, 17 nt, Human
uauaaguucacaaaaug

SEQ ID NO: 3668395 - RNA, 14 nt, Human
uauaauaaaaggaa

SEQ ID NO: 3668396 - RNA, 14 nt, Human
uauaauaaaggacu

SEQ ID NO: 3668397 - RNA, 19 nt, Human
uauaauaaaggacuguaau

SEQ ID NO: 3668398 - RNA, 22 nt, Human
uauaauaaaggacuguaaucuu

SEQ ID NO: 3668399 - RNA, 17 nt, Human
uauaauagcaacuuuug

SEQ ID NO: 3668400 - RNA, 20 nt, Human
uauaauauacuauauuuaug

SEQ ID NO: 3668401 - RNA, 20 nt, Human
uauaauauauauauauauca

SEQ ID NO: 3668402 - RNA, 13 nt, Human
uauaauauauguu

SEQ ID NO: 3668403 - RNA, 17 nt, Human
uauaauauauguuuuaa

SEQ ID NO: 3668404 - RNA, 15 nt, Human
uauaauauauuugug

SEQ ID NO: 3668405 - RNA, 14 nt, Human
uauaauaucuaaag

SEQ ID NO: 3668406 - RNA, 16 nt, Human
uauaauauugaaaauu

SEQ ID NO: 3668407 - RNA, 22 nt, Human
uauaaucaucaaguaauacaaa

SEQ ID NO: 3668408 - RNA, 21 nt, Human
uauaaucucuucuuauacaga

SEQ ID NO: 3668409 - RNA, 19 nt, Human
uauaaucugucaaaacacu

SEQ ID NO: 3668410 - RNA, 22 nt, Human
uauaaucugucaaaacacugug

SEQ ID NO: 3668411 - RNA, 17 nt, Human
uauaaucuuauaauugu

SEQ ID NO: 3668412 - RNA, 14 nt, Human
uauaaugaaaacau

SEQ ID NO: 3668413 - RNA, 15 nt, Human
uauaaugaauaaauc

SEQ ID NO: 3668414 - RNA, 19 nt, Human
uauaauggacagauuaaua

SEQ ID NO: 3668415 - RNA, 19 nt, Human
uauaaugguuucaaagauu

SEQ ID NO: 3668416 - RNA, 23 nt, Human
uauaaugguuucaaagauucaaa

SEQ ID NO: 3668417 - RNA, 20 nt, Human
uauaauguauucauauuugu

SEQ ID NO: 3668418 - RNA, 17 nt, Human
uauaaugucauuaaaca

SEQ ID NO: 3668419 - RNA, 15 nt, Human
uauaaugugaaaugu

SEQ ID NO: 3668420 - RNA, 16 nt, Human
uauaaugugaaaugua

SEQ ID NO: 3668421 - RNA, 16 nt, Human
uagaaauaauaugcau

SEQ ID NO: 3668422 - RNA, 21 nt, Human
uagaaauagcuccguggagca

SEQ ID NO: 3668423 - RNA, 22 nt, Human
uagaaauagcuccguggagcag

SEQ ID NO: 3668424 - RNA, 15 nt, Human
uagaaauauaauuga

SEQ ID NO: 3668425 - RNA, 20 nt, Human
uagaaauaucugaaaaugua

SEQ ID NO: 3668426 - RNA, 23 nt, Human
uagaaauaucugaaaauguaugu

SEQ ID NO: 3668427 - RNA, 14 nt, Human
uagaaauaugauuu

SEQ ID NO: 3668428 - RNA, 15 nt, Human
uagaaauauucacau

SEQ ID NO: 3668429 - RNA, 16 nt, Human
uagaaauauuuuaaaa

SEQ ID NO: 3668430 - RNA, 13 nt, Human
uagaaaucauuuu

SEQ ID NO: 3668431 - RNA, 16 nt, Human
uagaaaugguuguauu

SEQ ID NO: 3668432 - RNA, 15 nt, Human
uagaaaugugaauga

SEQ ID NO: 3668433 - RNA, 19 nt, Human
uagaaauuacacccaaaga

SEQ ID NO: 3668434 - RNA, 22 nt, Human
uagaaauuaccagaguuguucu

SEQ ID NO: 3668435 - RNA, 16 nt, Human
uagaaauuaccugugg

SEQ ID NO: 3668436 - RNA, 22 nt, Human
uagaaauuagaaaaaaauuacu

SEQ ID NO: 3668437 - RNA, 23 nt, Human
uagaaauuagaaaaaaauuacua

SEQ ID NO: 3668438 - RNA, 14 nt, Human
uagaaauuuccaga

SEQ ID NO: 3668439 - RNA, 14 nt, Human
uagaaauuuuguaa

SEQ ID NO: 3668440 - RNA, 15 nt, Human
uagaaauuuuguaag

SEQ ID NO: 3668441 - RNA, 16 nt, Human
uagaacaaaggacaga

SEQ ID NO: 3668442 - RNA, 13 nt, Human
uagaacaaggcug

SEQ ID NO: 3668443 - RNA, 17 nt, Human
uagaacacacacacuua

SEQ ID NO: 3668444 - RNA, 15 nt, Human
uagaacacuaauuca

SEQ ID NO: 3668445 - RNA, 18 nt, Human
uagaacacuaauucauaa

SEQ ID NO: 3668446 - RNA, 23 nt, Human
uagaacacuauuuucagaaucug

SEQ ID NO: 3668447 - RNA, 12 nt, Human
uagaacagaaaa

SEQ ID NO: 3668448 - RNA, 12 nt, Human
uagaacagguuu

SEQ ID NO: 3668449 - RNA, 14 nt, Human
uagaacagguuuuu

SEQ ID NO: 3668450 - RNA, 18 nt, Human
uagaacaguggaaacuau

SEQ ID NO: 3668451 - RNA, 16 nt, Human
uagaacauaaagcaaa

SEQ ID NO: 3668452 - RNA, 22 nt, Human
uagaacauaaagcaaauagaca

SEQ ID NO: 3668453 - RNA, 18 nt, Human
uagaacaucccugccagc

SEQ ID NO: 3668454 - RNA, 22 nt, Human
uagaacauggagagcuagaacc

SEQ ID NO: 3668455 - RNA, 23 nt, Human
uagaaccaagaagggcuagaacc

SEQ ID NO: 3668456 - RNA, 21 nt, Human
uagaacccucuguuccuuccc

SEQ ID NO: 3668457 - RNA, 22 nt, Human
uagaacccucuguuccuucccu

SEQ ID NO: 3668458 - RNA, 14 nt, Human
uagaaccuagaagg

SEQ ID NO: 3668459 - RNA, 17 nt, Human
uagaaccuagaagggcu

SEQ ID NO: 3668460 - RNA, 13 nt, Human
uagaaccuggaga

SEQ ID NO: 3668461 - RNA, 22 nt, Human
uagaaccuggagagcuagaacc

SEQ ID NO: 3668462 - RNA, 17 nt, Human
uagaaccuggagggcug

SEQ ID NO: 3668463 - RNA, 17 nt, Human
uagaacucacucugggc

SEQ ID NO: 3668464 - RNA, 18 nt, Human
uagaacucacucugggcu

SEQ ID NO: 3668465 - RNA, 15 nt, Human
uagaacucccuuuca

SEQ ID NO: 3668466 - RNA, 22 nt, Human
uagaacuggagaggcuagaacc

SEQ ID NO: 3668467 - RNA, 18 nt, Human
uagaacuggguaaaugca

SEQ ID NO: 3668468 - RNA, 15 nt, Human
uagaacugucuguga

SEQ ID NO: 3668469 - RNA, 21 nt, Human
uagaacuugcagcugauguug

SEQ ID NO: 3668470 - RNA, 22 nt, Human
uagaacuuggauguaccugccc

SEQ ID NO: 3668471 - RNA, 17 nt, Human
uagaacuuuuuuaaaua

SEQ ID NO: 3668472 - RNA, 18 nt, Human
uagaacuuuuuuaaauaa

SEQ ID NO: 3668473 - RNA, 15 nt, Human
uagaagaaaaaagaa

SEQ ID NO: 3668474 - RNA, 23 nt, Human
uagaagaaaugaaauuuuaccaa

SEQ ID NO: 3668475 - RNA, 12 nt, Human
uagaagaacugc

SEQ ID NO: 3668476 - RNA, 18 nt, Human
uagaagaagcuaugucaa

SEQ ID NO: 3668477 - RNA, 21 nt, Human
uagaagaauacaaacauauuu

SEQ ID NO: 3668478 - RNA, 22 nt, Human
uagaagagagagguugaaaaac

SEQ ID NO: 3668479 - RNA, 23 nt, Human
uagaagauauuagucuuggggca

SEQ ID NO: 3668480 - RNA, 18 nt, Human
uagaagauggcacuuaua

SEQ ID NO: 3668481 - RNA, 15 nt, Human
uagaagauguuugcu

SEQ ID NO: 3668482 - RNA, 23 nt, Human
uagaagcaaauuaaacgguaaca

SEQ ID NO: 3668483 - RNA, 22 nt, Human
uagaagcacuacaccuugccuu

SEQ ID NO: 3668484 - RNA, 22 nt, Human
uagaagcauuccuucuuugaua

SEQ ID NO: 3668485 - RNA, 16 nt, Human
uagaagcuguaguagc

SEQ ID NO: 3668486 - RNA, 11 nt, Human
uagaaggaaac

SEQ ID NO: 3668487 - RNA, 17 nt, Human
uagaagggaaagcccau

SEQ ID NO: 3668488 - RNA, 22 nt, Human
uagaagggcuagaaccuggaga

SEQ ID NO: 3668489 - RNA, 24 nt, Human
uagaagggcuagaaccuggagagc

SEQ ID NO: 3668490 - RNA, 16 nt, Human
uauaguguguugugcu

SEQ ID NO: 3668491 - RNA, 15 nt, Human
uauaguuaacacacu

SEQ ID NO: 3668492 - RNA, 13 nt, Human
uauaguuacugug

SEQ ID NO: 3668493 - RNA, 16 nt, Human
uauaguuacuguguaa

SEQ ID NO: 3668494 - RNA, 22 nt, Human
uauaguuacuguguaauuagug

SEQ ID NO: 3668495 - RNA, 18 nt, Human
uauaguuaggauagcauu

SEQ ID NO: 3668496 - RNA, 22 nt, Human
uauaguuauguaaauaauucuu

SEQ ID NO: 3668497 - RNA, 21 nt, Human
uauaguucaugucugcuauca

SEQ ID NO: 3668498 - RNA, 22 nt, Human
uauaguuccuaagaagcuucua

SEQ ID NO: 3668499 - RNA, 23 nt, Human
uauaguuccuaagaagcuucuaa

SEQ ID NO: 3668500 - RNA, 13 nt, Human
uauaguucuaggc

SEQ ID NO: 3668501 - RNA, 13 nt, Human
uauaguuucagau

SEQ ID NO: 3668502 - RNA, 18 nt, Human
uauaguuuguacaugcau

SEQ ID NO: 3668503 - RNA, 22 nt, Human
uauaguuuuacuuuuaaacugu

SEQ ID NO: 3668504 - RNA, 23 nt, Human
uauaguuuugaauccuuugccug

SEQ ID NO: 3668505 - RNA, 18 nt, Human
uauauaaaaagaaaagau

SEQ ID NO: 3668506 - RNA, 19 nt, Human
uauauaaaaagaaaagaua

SEQ ID NO: 3668507 - RNA, 20 nt, Human
uauauaaaaagaaaagauaa

SEQ ID NO: 3668508 - RNA, 15 nt, Human
uauauaaaaauauau

SEQ ID NO: 3668509 - RNA, 12 nt, Human
uauauaaaaaug

SEQ ID NO: 3668510 - RNA, 15 nt, Human
uauauaaaaauggcu

SEQ ID NO: 3668511 - RNA, 21 nt, Human
uauauaaaccuaaaaaagaua

SEQ ID NO: 3668512 - RNA, 23 nt, Human
uauauaaagagaaaauugaauuu

SEQ ID NO: 3668513 - RNA, 12 nt, Human
uauauaaaguau

SEQ ID NO: 3668514 - RNA, 19 nt, Human
uauauaaaguauucuuuuu

SEQ ID NO: 3668515 - RNA, 11 nt, Human
uauauaaauaa

SEQ ID NO: 3668516 - RNA, 14 nt, Human
uauauaaaugggaa

SEQ ID NO: 3668517 - RNA, 12 nt, Human
uauauaaaugua

SEQ ID NO: 3668518 - RNA, 13 nt, Human
uauauaaauguau

SEQ ID NO: 3668519 - RNA, 13 nt, Human
uauauaacagaua

SEQ ID NO: 3668520 - RNA, 14 nt, Human
uauauaacauauau

SEQ ID NO: 3668521 - RNA, 18 nt, Human
uauauaacauauauggaa

SEQ ID NO: 3668522 - RNA, 15 nt, Human
uauauaagaaagaca

SEQ ID NO: 3668523 - RNA, 16 nt, Human
uauauaagaaagacau

SEQ ID NO: 3668524 - RNA, 23 nt, Human
uauauaagagcaugaaauuuuua

SEQ ID NO: 3668525 - RNA, 23 nt, Human
uauauaauacugacugagaauau

SEQ ID NO: 3668526 - RNA, 12 nt, Human
uauauaauaucu

SEQ ID NO: 3668527 - RNA, 13 nt, Human
uauauaauucacu

SEQ ID NO: 3668528 - RNA, 17 nt, Human
uauauaauucuguacau

SEQ ID NO: 3668529 - RNA, 22 nt, Human
uauauaauuuuuuuauguuuug

SEQ ID NO: 3668530 - RNA, 20 nt, Human
uauauacaaccugcuugggu

SEQ ID NO: 3668531 - RNA, 17 nt, Human
uauauacaauaacauaa

SEQ ID NO: 3668532 - RNA, 22 nt, Human
uauauacaauaacauaauuugu

SEQ ID NO: 3668533 - RNA, 16 nt, Human
uauauacaauaaugga

SEQ ID NO: 3668534 - RNA, 14 nt, Human
uauauacacacaca

SEQ ID NO: 3668535 - RNA, 18 nt, Human
uauauacacacacaaaga

SEQ ID NO: 3668536 - RNA, 22 nt, Human
uauauacacacacaaagagagu

SEQ ID NO: 3668537 - RNA, 16 nt, Human
uauauacagaggaaau

SEQ ID NO: 3668538 - RNA, 23 nt, Human
uauauacaguaacuuuaugugua

SEQ ID NO: 3668539 - RNA, 15 nt, Human
uauauacauauguag

SEQ ID NO: 3668540 - RNA, 23 nt, Human
uauauacaucacguuaaaguagg

SEQ ID NO: 3668541 - RNA, 16 nt, Human
uauauacaugugugua

SEQ ID NO: 3668542 - RNA, 16 nt, Human
uauauaccaaagcaca

SEQ ID NO: 3668543 - RNA, 21 nt, Human
uauauaccaaagcacauuuua

SEQ ID NO: 3668544 - RNA, 20 nt, Human
uauauacccguacaacgugu

SEQ ID NO: 3668545 - RNA, 17 nt, Human
uauauacgaacaaaaca

SEQ ID NO: 3668546 - RNA, 20 nt, Human
uauauacucaagagugguau

SEQ ID NO: 3668547 - RNA, 14 nt, Human
uauauagaaugcug

SEQ ID NO: 3668548 - RNA, 16 nt, Human
uauauagacagcuuug

SEQ ID NO: 3668549 - RNA, 16 nt, Human
uauauagagauguuuu

SEQ ID NO: 3668550 - RNA, 19 nt, Human
uauauagagauguuuuuaa

SEQ ID NO: 3668551 - RNA, 21 nt, Human
uauauagauuauaacuugucu

SEQ ID NO: 3668552 - RNA, 18 nt, Human
uauauagcaagacauuau

SEQ ID NO: 3668553 - RNA, 22 nt, Human
uauauagcagcaaaaauauaaa

SEQ ID NO: 3668554 - RNA, 15 nt, Human
uauauagcaguaaaa

SEQ ID NO: 3668555 - RNA, 16 nt, Human
uauauagcaguaaaaa

SEQ ID NO: 3668556 - RNA, 18 nt, Human
uauauagcuggcaagaau

SEQ ID NO: 3668557 - RNA, 14 nt, Human
uauauagcuugaaa

SEQ ID NO: 3668558 - RNA, 18 nt, Human
uauauaggcaucacauuu

SEQ ID NO: 3668559 - RNA, 15 nt, Human
uauauagugcuauau

SEQ ID NO: 3668560 - RNA, 17 nt, Human
uauauaguuuacuauuu

SEQ ID NO: 3668561 - RNA, 13 nt, Human
uauauauaaaacg

SEQ ID NO: 3668562 - RNA, 13 nt, Human
uauauauaaaccu

SEQ ID NO: 3668563 - RNA, 16 nt, Human
uauauauaaaccuaaa

SEQ ID NO: 3668564 - RNA, 13 nt, Human
uauauauaaagua

SEQ ID NO: 3668565 - RNA, 15 nt, Human
uauauauaaaguaua

SEQ ID NO: 3668566 - RNA, 11 nt, Human
uauauauaaau

SEQ ID NO: 3668567 - RNA, 20 nt, Human
uauauauaauucuguacaua

SEQ ID NO: 3668568 - RNA, 15 nt, Human
uauauauacacacac

SEQ ID NO: 3668569 - RNA, 22 nt, Human
uauauauacauacacuuguaua

SEQ ID NO: 3668570 - RNA, 13 nt, Human
uauauauauaaaa

SEQ ID NO: 3668571 - RNA, 14 nt, Human
uauauauauaaagu

SEQ ID NO: 3668572 - RNA, 15 nt, Human
uauauauauaauaua

SEQ ID NO: 3668573 - RNA, 13 nt, Human
uauauaucaaaua

SEQ ID NO: 3668574 - RNA, 15 nt, Human
uauauaucaguuuga

SEQ ID NO: 3668575 - RNA, 20 nt, Human
uauauaucuaucuauuugag

SEQ ID NO: 3668576 - RNA, 22 nt, Human
uauauaugaaaacuauacaaca

SEQ ID NO: 3668577 - RNA, 21 nt, Human
uauauaugcacuuaauuuguu

SEQ ID NO: 3668578 - RNA, 19 nt, Human
uauauaugccuuuuuccua

SEQ ID NO: 3668579 - RNA, 20 nt, Human
uauauauguguauauauaca

SEQ ID NO: 3668580 - RNA, 22 nt, Human
uauauauguguauauauacaua

SEQ ID NO: 3668581 - RNA, 23 nt, Human
uauauauguguauauauacauac

SEQ ID NO: 3668582 - RNA, 14 nt, Human
uauauauguguaug

SEQ ID NO: 3668583 - RNA, 17 nt, Human
uauauauguguguuuaa

SEQ ID NO: 3668584 - RNA, 20 nt, Human
uauauauucuuauaaaaaug

SEQ ID NO: 3668585 - RNA, 14 nt, Human
uauauauuuauaac

SEQ ID NO: 3668586 - RNA, 14 nt, Human
uauauauuuuaauu

SEQ ID NO: 3668587 - RNA, 16 nt, Human
uauauauuuuguguga

SEQ ID NO: 3668588 - RNA, 22 nt, Human
uauauauuuuuuucugaaauuu

SEQ ID NO: 3668589 - RNA, 19 nt, Human
uauaucacauguuuucucu

SEQ ID NO: 3668590 - RNA, 16 nt, Human
uagaguguuguugaga

SEQ ID NO: 3668591 - RNA, 12 nt, Human
uagaguuaagaa

SEQ ID NO: 3668592 - RNA, 23 nt, Human
uagaguuaagaagcuguuguaca

SEQ ID NO: 3668593 - RNA, 15 nt, Human
uagaguuagacuguu

SEQ ID NO: 3668594 - RNA, 14 nt, Human
uagaguucauccca

SEQ ID NO: 3668595 - RNA, 12 nt, Human
uagaguugcuga

SEQ ID NO: 3668596 - RNA, 12 nt, Human
uagaguuuaaca

SEQ ID NO: 3668597 - RNA, 13 nt, Human
uagaguuuaacac

SEQ ID NO: 3668598 - RNA, 22 nt, Human
uagaguuucaaccaugaagucu

SEQ ID NO: 3668599 - RNA, 13 nt, Human
uagaguuucuguu

SEQ ID NO: 3668600 - RNA, 21 nt, Human
uagaguuucuguuugauucuu

SEQ ID NO: 3668601 - RNA, 19 nt, Human
uagauaaaacaucuuugaa

SEQ ID NO: 3668602 - RNA, 15 nt, Human
uagauaaaagcugaa

SEQ ID NO: 3668603 - RNA, 18 nt, Human
uagauaaauaaauauaug

SEQ ID NO: 3668604 - RNA, 16 nt, Human
uagauaaauauuugac

SEQ ID NO: 3668605 - RNA, 13 nt, Human
uagauaacucuuu

SEQ ID NO: 3668606 - RNA, 13 nt, Human
uagauaauauugu

SEQ ID NO: 3668607 - RNA, 12 nt, Human
uagauacaauaa

SEQ ID NO: 3668608 - RNA, 14 nt, Human
uagauacaauaaau

SEQ ID NO: 3668609 - RNA, 16 nt, Human
uagauacaaucagcug

SEQ ID NO: 3668610 - RNA, 23 nt, Human
uagauacccuacgcuguccagaa

SEQ ID NO: 3668611 - RNA, 23 nt, Human
uagauauaaauuuuuaagagaaa

SEQ ID NO: 3668612 - RNA, 20 nt, Human
uagauauaaugaacaaaauu

SEQ ID NO: 3668613 - RNA, 16 nt, Human
uagauauagagucauu

SEQ ID NO: 3668614 - RNA, 20 nt, Human
uagauaucuuuuuauugaug

SEQ ID NO: 3668615 - RNA, 15 nt, Human
uagauaugaaagcug

SEQ ID NO: 3668616 - RNA, 22 nt, Human
uagauauguauucuuuucucag

SEQ ID NO: 3668617 - RNA, 14 nt, Human
uagauauuacuuua

SEQ ID NO: 3668618 - RNA, 17 nt, Human
uagauauuacuuuauca

SEQ ID NO: 3668619 - RNA, 22 nt, Human
uagauauuacuuuaucacuuuu

SEQ ID NO: 3668620 - RNA, 22 nt, Human
uagauauugaggccaagaauau

SEQ ID NO: 3668621 - RNA, 14 nt, Human
uagauauuuggcuu

SEQ ID NO: 3668622 - RNA, 18 nt, Human
uagauauuuggcuuaaau

SEQ ID NO: 3668623 - RNA, 19 nt, Human
uagauauuuggcuuaaaua

SEQ ID NO: 3668624 - RNA, 21 nt, Human
uagauauuuggcuuaaauaua

SEQ ID NO: 3668625 - RNA, 24 nt, Human
uagauauuuucacaaugucaguau

SEQ ID NO: 3668626 - RNA, 13 nt, Human
uagauauuuuuca

SEQ ID NO: 3668627 - RNA, 20 nt, Human
uagauauuuuucauaaacaa

SEQ ID NO: 3668628 - RNA, 20 nt, Human
uagaucaaauaguugcauag

SEQ ID NO: 3668629 - RNA, 17 nt, Human
uagaucacgagaucaag

SEQ ID NO: 3668630 - RNA, 20 nt, Human
uagaucagaugcuccaagau

SEQ ID NO: 3668631 - RNA, 23 nt, Human
uagaucagaugcuccaagauucu

SEQ ID NO: 3668632 - RNA, 15 nt, Human
uagaucauaaggcuu

SEQ ID NO: 3668633 - RNA, 21 nt, Human
uagaucauaaggcuucaaaau

SEQ ID NO: 3668634 - RNA, 14 nt, Human
uagaucaugaagaa

SEQ ID NO: 3668635 - RNA, 11 nt, Human
uauguaacaug

SEQ ID NO: 3668636 - RNA, 12 nt, Human
uauguaacaugu

SEQ ID NO: 3668637 - RNA, 14 nt, Human
uauguaacugcauu

SEQ ID NO: 3668638 - RNA, 16 nt, Human
uauguaagagcaccuu

SEQ ID NO: 3668639 - RNA, 23 nt, Human
uauguaaugaaguaaagccauua

SEQ ID NO: 3668640 - RNA, 17 nt, Human
uauguaaugcaaaauuu

SEQ ID NO: 3668641 - RNA, 23 nt, Human
uauguaaugugugguggccucag

SEQ ID NO: 3668642 - RNA, 23 nt, Human
uauguacaauauuuuaagcauua

SEQ ID NO: 3668643 - RNA, 15 nt, Human
uauguacaugagaag

SEQ ID NO: 3668644 - RNA, 10 nt, Human
uauguaccaa

SEQ ID NO: 3668645 - RNA, 16 nt, Human
uauguacccucugaaa

SEQ ID NO: 3668646 - RNA, 17 nt, Human
uauguacuaguacugug

SEQ ID NO: 3668647 - RNA, 13 nt, Human
uauguagaagcau

SEQ ID NO: 3668648 - RNA, 22 nt, Human
uauguagacuauauacaugugu

SEQ ID NO: 3668649 - RNA, 16 nt, Human
uauguagauauuuggc

SEQ ID NO: 3668650 - RNA, 22 nt, Human
uauguagauauuuggcuuaaau

SEQ ID NO: 3668651 - RNA, 13 nt, Human
gccccugagccca

SEQ ID NO: 3668652 - RNA, 15 nt, Human
gccccugagcccacu

SEQ ID NO: 3668653 - RNA, 13 nt, Human
gccccugcacaaa

SEQ ID NO: 3668654 - RNA, 15 nt, Human
gccccugcagcacgg

SEQ ID NO: 3668655 - RNA, 14 nt, Human
gccccugccacccu

SEQ ID NO: 3668656 - RNA, 17 nt, Human
gccccugccacccuggg

SEQ ID NO: 3668657 - RNA, 15 nt, Human
gccccugccccagcc

SEQ ID NO: 3668658 - RNA, 21 nt, Human
gccccugccccagcccaaguc

SEQ ID NO: 3668659 - RNA, 20 nt, Human
gccccugccccgucaccauc

SEQ ID NO: 3668660 - RNA, 19 nt, Human
gccccugccccucaugcca

SEQ ID NO: 3668661 - RNA, 21 nt, Human
gccccugccuuggggucaggu

SEQ ID NO: 3668662 - RNA, 12 nt, Human
gccccugcuggu

SEQ ID NO: 3668663 - RNA, 15 nt, Human
gccccugcugguuca

SEQ ID NO: 3668664 - RNA, 16 nt, Human
gccccugcugguucag

SEQ ID NO: 3668665 - RNA, 22 nt, Human
gccccugcugguucaggguugg

SEQ ID NO: 3668666 - RNA, 19 nt, Human
gccccuggacaagcagagg

SEQ ID NO: 3668667 - RNA, 19 nt, Human
gccccuggaggcugccucc

SEQ ID NO: 3668668 - RNA, 15 nt, Human
gccccuggaugcagc

SEQ ID NO: 3668669 - RNA, 22 nt, Human
gccccuggcagagaugccuccc

SEQ ID NO: 3668670 - RNA, 17 nt, Human
gccccuggcagccccug

SEQ ID NO: 3668671 - RNA, 14 nt, Human
gccccuggcuggga

SEQ ID NO: 3668672 - RNA, 16 nt, Human
gccccuggcugggacg

SEQ ID NO: 3668673 - RNA, 23 nt, Human
gccccuggcugggacguggcuca

SEQ ID NO: 3668674 - RNA, 18 nt, Human
gccccugggcuuggccug

SEQ ID NO: 3668675 - RNA, 22 nt, Human
gccccugggcuuggccugcugu

SEQ ID NO: 3668676 - RNA, 12 nt, Human
gccccuggggcc

SEQ ID NO: 3668677 - RNA, 21 nt, Human
gccccugggguggccaccagu

SEQ ID NO: 3668678 - RNA, 20 nt, Human
gccccugggugggugguggg

SEQ ID NO: 3668679 - RNA, 22 nt, Human
gccccuggguggguggugggga

SEQ ID NO: 3668680 - RNA, 17 nt, Human
gccccuguauggcacug

SEQ ID NO: 3668681 - RNA, 18 nt, Human
gccccuguggagacuggg

SEQ ID NO: 3668682 - RNA, 22 nt, Human
gccccuguuaccuaauuagagc

SEQ ID NO: 3668683 - RNA, 21 nt, Human
gccccuguucuggcagaguug

SEQ ID NO: 3668684 - RNA, 17 nt, Human
gccccuuagacagaggc

SEQ ID NO: 3668685 - RNA, 23 nt, Human
gccccuucacuucugaccacacu

SEQ ID NO: 3668686 - RNA, 22 nt, Human
gccccuucauugauuuccugug

SEQ ID NO: 3668687 - RNA, 15 nt, Human
gccccuuccccaugg

SEQ ID NO: 3668688 - RNA, 16 nt, Human
gccccuuccccauggg

SEQ ID NO: 3668689 - RNA, 12 nt, Human
gccccuuccccc

SEQ ID NO: 3668690 - RNA, 17 nt, Human
gccccuucccccuccaa

SEQ ID NO: 3668691 - RNA, 16 nt, Human
gccccuuccccgaggg

SEQ ID NO: 3668692 - RNA, 12 nt, Human
gccccuucccuu

SEQ ID NO: 3668693 - RNA, 14 nt, Human
gccccuuccgccac

SEQ ID NO: 3668694 - RNA, 17 nt, Human
gccccuuccgccacugg

SEQ ID NO: 3668695 - RNA, 19 nt, Human
gccccuuccgccacugggg

SEQ ID NO: 3668696 - RNA, 19 nt, Human
gccccuucuacacucuccu

SEQ ID NO: 3668697 - RNA, 20 nt, Human
gccccuucuacacucuccug

SEQ ID NO: 3668698 - RNA, 16 nt, Human
gccccuucucucccug

SEQ ID NO: 3668699 - RNA, 20 nt, Human
gccccuucugacccaugcug

SEQ ID NO: 3668700 - RNA, 20 nt, Human
gccccuucugcucagcucug

SEQ ID NO: 3668701 - RNA, 23 nt, Human
gccccuucugcucagcucugggc

SEQ ID NO: 3668702 - RNA, 15 nt, Human
gccccuuggacacgc

SEQ ID NO: 3668703 - RNA, 20 nt, Human
gccccuuuacggacaccccc

SEQ ID NO: 3668704 - RNA, 13 nt, Human
gccccuuuccaaa

SEQ ID NO: 3668705 - RNA, 16 nt, Human
gccccuuugcugaccc

SEQ ID NO: 3668706 - RNA, 19 nt, Human
gccccuuugggcccugcau

SEQ ID NO: 3668707 - RNA, 21 nt, Human
gccccuuuuuacuccccuuga

SEQ ID NO: 3668708 - RNA, 23 nt, Human
gccccuuuuucauauguugcuca

SEQ ID NO: 3668709 - RNA, 24 nt, Human
gcccgaagcaugaacagugcaccu

SEQ ID NO: 3668710 - RNA, 12 nt, Human
gcccgacagccu

SEQ ID NO: 3668711 - RNA, 22 nt, Human
gcccgacauggcuccggccucu

SEQ ID NO: 3668712 - RNA, 14 nt, Human
gcccgagcagcuga

SEQ ID NO: 3668713 - RNA, 16 nt, Human
gcccgagcagcugagc

SEQ ID NO: 3668714 - RNA, 17 nt, Human
gcccgagcagcugagca

SEQ ID NO: 3668715 - RNA, 19 nt, Human
gcccgagcagcugagcagg

SEQ ID NO: 3668716 - RNA, 23 nt, Human
gcccgagcagcugagcagggccg

SEQ ID NO: 3668717 - RNA, 15 nt, Human
gcccgagcuggugca

SEQ ID NO: 3668718 - RNA, 18 nt, Human
gcccgagcuguuuauguu

SEQ ID NO: 3668719 - RNA, 21 nt, Human
gcccgaggaggugucucaggc

SEQ ID NO: 3668720 - RNA, 22 nt, Human
gcccgaggaggugucucaggcu

SEQ ID NO: 3668721 - RNA, 16 nt, Human
gcccgaggcaccagug

SEQ ID NO: 3668722 - RNA, 22 nt, Human
gcccgagggaggggaagcuucu

SEQ ID NO: 3668723 - RNA, 16 nt, Human
gcccgcacagcagccu

SEQ ID NO: 3668724 - RNA, 17 nt, Human
gcccgcagaccucugga

SEQ ID NO: 3668725 - RNA, 23 nt, Human
gcccgcagagcgcgccccuagcc

SEQ ID NO: 3668726 - RNA, 16 nt, Human
gcccgcaugcagcagc

SEQ ID NO: 3668727 - RNA, 21 nt, Human
gcccgccaagguagccauccc

SEQ ID NO: 3668728 - RNA, 14 nt, Human
gcccgcccacuguc

SEQ ID NO: 3668729 - RNA, 20 nt, Human
gcccgcccacuguccugggc

SEQ ID NO: 3668730 - RNA, 22 nt, Human
gcccgcccacuguccugggcgc

SEQ ID NO: 3668731 - RNA, 15 nt, Human
gcccgccccugcagc

SEQ ID NO: 3668732 - RNA, 12 nt, Human
gcccgccugcca

SEQ ID NO: 3668733 - RNA, 23 nt, Human
gcccgccugccaguccuagcugc

SEQ ID NO: 3668734 - RNA, 14 nt, Human
gcccgccugcccac

SEQ ID NO: 3668735 - RNA, 16 nt, Human
gcccgccugcccaccu

SEQ ID NO: 3668736 - RNA, 23 nt, Human
gcccgccugcccaccugccuggc

SEQ ID NO: 3668737 - RNA, 14 nt, Human
gcccgccuggcaga

SEQ ID NO: 3668738 - RNA, 16 nt, Human
gcccgcgccacaggac

SEQ ID NO: 3668739 - RNA, 13 nt, Human
gcccgcucccagu

SEQ ID NO: 3668740 - RNA, 22 nt, Human
gcccgcucuacaucuucugccu

SEQ ID NO: 3668741 - RNA, 18 nt, Human
gcccgcugggcugagccc

SEQ ID NO: 3668742 - RNA, 14 nt, Human
gcccgcuugccucg

SEQ ID NO: 3668743 - RNA, 22 nt, Human
gcccggagauuggacggccuga

SEQ ID NO: 3668744 - RNA, 17 nt, Human
gcccggauucugggagg

SEQ ID NO: 3668745 - RNA, 15 nt, Human
gcccggcagggcggg

SEQ ID NO: 3668746 - RNA, 17 nt, Human
gcccggcagggcgggca

SEQ ID NO: 3668747 - RNA, 14 nt, Human
gcccggccugcucc

SEQ ID NO: 3668748 - RNA, 18 nt, Human
gcccggccugcucccagc

SEQ ID NO: 3668749 - RNA, 20 nt, Human
gcccggcgccuggccuccag

SEQ ID NO: 3668750 - RNA, 14 nt, Human
gcccggcuccaggc

SEQ ID NO: 3668751 - RNA, 17 nt, Human
gcccggcuccaggcucc

SEQ ID NO: 3668752 - RNA, 18 nt, Human
gcccggcuccaggcuccu

SEQ ID NO: 3668753 - RNA, 14 nt, Human
gcccggcuccuggu

SEQ ID NO: 3668754 - RNA, 14 nt, Human
gcccggcugguuuu

SEQ ID NO: 3668755 - RNA, 23 nt, Human
gcccgggaaggucaccagcacca

SEQ ID NO: 3668756 - RNA, 14 nt, Human
gcccgggagcugcu

SEQ ID NO: 3668757 - RNA, 19 nt, Human
gcccgggagcugcugcccu

SEQ ID NO: 3668758 - RNA, 13 nt, Human
gcccgggcccaga

SEQ ID NO: 3668759 - RNA, 14 nt, Human
gcccgggcccagag

SEQ ID NO: 3668760 - RNA, 21 nt, Human
gcccggggcagcagcagcccu

SEQ ID NO: 3668761 - RNA, 23 nt, Human
gcccggggcagcagcagcccugc

SEQ ID NO: 3668762 - RNA, 16 nt, Human
gcccguccugccugug

SEQ ID NO: 3668763 - RNA, 13 nt, Human
gcccgucucucuc

SEQ ID NO: 3668764 - RNA, 15 nt, Human
gcccgucucucuccc

SEQ ID NO: 3668765 - RNA, 19 nt, Human
gcccgucuguccaucugcc

SEQ ID NO: 3668766 - RNA, 21 nt, Human
gcccgucuguccaucugcccg

SEQ ID NO: 3668767 - RNA, 16 nt, Human
gcccgucuucagccua

SEQ ID NO: 3668768 - RNA, 14 nt, Human
gcccguguacauag

SEQ ID NO: 3668769 - RNA, 15 nt, Human
gcccguguggccccu

SEQ ID NO: 3668770 - RNA, 16 nt, Human
gcccguguggccccuu

SEQ ID NO: 3668771 - RNA, 16 nt, Human
gcccguugucucccug

SEQ ID NO: 3668772 - RNA, 20 nt, Human
gcccguugucucccuggccc

SEQ ID NO: 3668773 - RNA, 22 nt, Human
gcccuaaaguguauuuuuuuac

SEQ ID NO: 3668774 - RNA, 21 nt, Human
gcccuaaccucugagucacca

SEQ ID NO: 3668775 - RNA, 21 nt, Human
gcccuaagauugaaaaggaag

SEQ ID NO: 3668776 - RNA, 17 nt, Human
gcccuaagcagaaagug

SEQ ID NO: 3668777 - RNA, 19 nt, Human
gcccuaaugcgcaggcugg

SEQ ID NO: 3668778 - RNA, 20 nt, Human
gcccuaaugcgcaggcuggc

SEQ ID NO: 3668779 - RNA, 18 nt, Human
gcccuggagccaacugcu

SEQ ID NO: 3668780 - RNA, 22 nt, Human
gcccuggaggcggugcggcagg

SEQ ID NO: 3668781 - RNA, 17 nt, Human
gcccuggaggugccagc

SEQ ID NO: 3668782 - RNA, 23 nt, Human
gcccuggaggugccagcaaagcc

SEQ ID NO: 3668783 - RNA, 24 nt, Human
gcccuggaggugccagcaaagccc

SEQ ID NO: 3668784 - RNA, 14 nt, Human
gcccuggagguggc

SEQ ID NO: 3668785 - RNA, 15 nt, Human
gcccuggagucaugc

SEQ ID NO: 3668786 - RNA, 18 nt, Human
gcccuggaucagcguggc

SEQ ID NO: 3668787 - RNA, 21 nt, Human
gcccuggaucagcguggccuu

SEQ ID NO: 3668788 - RNA, 22 nt, Human
gcccuggaucagcguggccuug

SEQ ID NO: 3668789 - RNA, 12 nt, Human
gcccuggcagcc

SEQ ID NO: 3668790 - RNA, 13 nt, Human
gcccuggccccca

SEQ ID NO: 3668791 - RNA, 20 nt, Human
gcccuggccuccccugccac

SEQ ID NO: 3668792 - RNA, 21 nt, Human
gcccuggccuccccugccacc

SEQ ID NO: 3668793 - RNA, 15 nt, Human
gcccuggccugcugg

SEQ ID NO: 3668794 - RNA, 17 nt, Human
gcccuggccugcugggc

SEQ ID NO: 3668795 - RNA, 20 nt, Human
gcccuggcucccacaggccc

SEQ ID NO: 3668796 - RNA, 13 nt, Human
gcccuggcugaag

SEQ ID NO: 3668797 - RNA, 14 nt, Human
gcccuggcugaagg

SEQ ID NO: 3668798 - RNA, 21 nt, Human
gcccuggcugaaggacuguga

SEQ ID NO: 3668799 - RNA, 17 nt, Human
gcccuggcugcugcccc

SEQ ID NO: 3668800 - RNA, 14 nt, Human
gcccugggaccgcu

SEQ ID NO: 3668801 - RNA, 22 nt, Human
gcccugggaccgcuacaccacu

SEQ ID NO: 3668802 - RNA, 23 nt, Human
gcccugggagaaucgcuccugca

SEQ ID NO: 3668803 - RNA, 13 nt, Human
gcccugggaggcu

SEQ ID NO: 3668804 - RNA, 16 nt, Human
gcccugggaggcucug

SEQ ID NO: 3668805 - RNA, 18 nt, Human
gcccugggaggcucugga

SEQ ID NO: 3668806 - RNA, 19 nt, Human
gcccugggaggcucuggag

SEQ ID NO: 3668807 - RNA, 21 nt, Human
gcccugggaggcucuggagcc

SEQ ID NO: 3668808 - RNA, 17 nt, Human
gcccugggcucggaggc

SEQ ID NO: 3668809 - RNA, 16 nt, Human
gcccugggcuggaauc

SEQ ID NO: 3668810 - RNA, 19 nt, Human
gcccuggggccuguacugc

SEQ ID NO: 3668811 - RNA, 15 nt, Human
gcccuggggcugauc

SEQ ID NO: 3668812 - RNA, 21 nt, Human
gcccuggggcugaucucaggg

SEQ ID NO: 3668813 - RNA, 16 nt, Human
gcccugguagggcagu

SEQ ID NO: 3668814 - RNA, 14 nt, Human
gcccugguccaggg

SEQ ID NO: 3668815 - RNA, 18 nt, Human
gcccugguccagggaagc

SEQ ID NO: 3668816 - RNA, 14 nt, Human
gcccuggucucagc

SEQ ID NO: 3668817 - RNA, 21 nt, Human
gcccuggugcgaauggacuuu

SEQ ID NO: 3668818 - RNA, 14 nt, Human
gcccugguggcagu

SEQ ID NO: 3668819 - RNA, 20 nt, Human
uauuaacaauuaauugucuu

SEQ ID NO: 3668820 - RNA, 12 nt, Human
uauuaacuacau

SEQ ID NO: 3668821 - RNA, 18 nt, Human
uauuaacuuaauaaucaa

SEQ ID NO: 3668822 - RNA, 24 nt, Human
uauuaagaaagacuaucuaaaugu

SEQ ID NO: 3668823 - RNA, 13 nt, Human
uauuaagaaugaa

SEQ ID NO: 3668824 - RNA, 16 nt, Human
uauuaagaaugaaaua

SEQ ID NO: 3668825 - RNA, 20 nt, Human
uauuaagagguaagacuuag

SEQ ID NO: 3668826 - RNA, 16 nt, Human
uauuaagauggauucu

SEQ ID NO: 3668827 - RNA, 22 nt, Human
uauuaagauuauaauuguugca

SEQ ID NO: 3668828 - RNA, 20 nt, Human
uauuaagcaguaaaaacugu

SEQ ID NO: 3668829 - RNA, 15 nt, Human
uauuaagcaucagaa

SEQ ID NO: 3668830 - RNA, 16 nt, Human
uauuaagcaugacaga

SEQ ID NO: 3668831 - RNA, 20 nt, Human
uauuaagcaugacagaaaau

SEQ ID NO: 3668832 - RNA, 21 nt, Human
uauuaagcccacaguauauuu

SEQ ID NO: 3668833 - RNA, 13 nt, Human
uauuaagcuuuuu

SEQ ID NO: 3668834 - RNA, 19 nt, Human
uauuaagcuuuuuggaauc

SEQ ID NO: 3668835 - RNA, 14 nt, Human
uauuaaggaagaca

SEQ ID NO: 3668836 - RNA, 18 nt, Human
uauuaaggauguagcuuu

SEQ ID NO: 3668837 - RNA, 20 nt, Human
uauuaaggauguagcuuuuc

SEQ ID NO: 3668838 - RNA, 16 nt, Human
uauuaagguguggcuu

SEQ ID NO: 3668839 - RNA, 17 nt, Human
uauuaauaguaauuugu

SEQ ID NO: 3668840 - RNA, 18 nt, Human
uauuaauaguaauuugua

SEQ ID NO: 3668841 - RNA, 18 nt, Human
uauuaauauauaucugcu

SEQ ID NO: 3668842 - RNA, 23 nt, Human
uauuaauauauauuaucuuuuca

SEQ ID NO: 3668843 - RNA, 13 nt, Human
uauuaaucacugu

SEQ ID NO: 3668844 - RNA, 23 nt, Human
uauuaaucacuguguauauuuga

SEQ ID NO: 3668845 - RNA, 11 nt, Human
uauuaaucuug

SEQ ID NO: 3668846 - RNA, 21 nt, Human
uauuaaucuuggauagcuaau

SEQ ID NO: 3668847 - RNA, 13 nt, Human
uauuaaugcacuu

SEQ ID NO: 3668848 - RNA, 15 nt, Human
uauuaaugcccagac

SEQ ID NO: 3668849 - RNA, 13 nt, Human
uauuaaugcuaag

SEQ ID NO: 3668850 - RNA, 17 nt, Human
uauuaauuuaugcagaa

SEQ ID NO: 3668851 - RNA, 14 nt, Human
uauuaauuuuaguu

SEQ ID NO: 3668852 - RNA, 21 nt, Human
uauuaauuuuaguuuuucauu

SEQ ID NO: 3668853 - RNA, 16 nt, Human
uauuacaaaaacaaaa

SEQ ID NO: 3668854 - RNA, 14 nt, Human
uauuacaaugauca

SEQ ID NO: 3668855 - RNA, 23 nt, Human
uauuacacaaauacuuauucauu

SEQ ID NO: 3668856 - RNA, 16 nt, Human
uauuacacucuguaau

SEQ ID NO: 3668857 - RNA, 19 nt, Human
uauuacacucuguaauuga

SEQ ID NO: 3668858 - RNA, 13 nt, Human
uauuacacuguau

SEQ ID NO: 3668859 - RNA, 19 nt, Human
uauuacacuguauuuguau

SEQ ID NO: 3668860 - RNA, 19 nt, Human
uauuacagauaaaauguaa

SEQ ID NO: 3668861 - RNA, 15 nt, Human
uauuacaguguuuau

SEQ ID NO: 3668862 - RNA, 16 nt, Human
uauuacaguguuuauc

SEQ ID NO: 3668863 - RNA, 19 nt, Human
uauuacaguguuuauccuu

SEQ ID NO: 3668864 - RNA, 12 nt, Human
uauuacaucuuu

SEQ ID NO: 3668865 - RNA, 15 nt, Human
uauuacauuuucagu

SEQ ID NO: 3668866 - RNA, 20 nt, Human
uauuaccaccaucccgugcu

SEQ ID NO: 3668867 - RNA, 20 nt, Human
uauuaccagcaagaauaaaa

SEQ ID NO: 3668868 - RNA, 22 nt, Human
uauuacccaagaaguaaagaug

SEQ ID NO: 3668869 - RNA, 22 nt, Human
uauuacccccuccuucagacac

SEQ ID NO: 3668870 - RNA, 11 nt, Human
uauuaccucug

SEQ ID NO: 3668871 - RNA, 20 nt, Human
uauuacgaaguucaagauca

SEQ ID NO: 3668872 - RNA, 21 nt, Human
uauuacgaaguucaagaucaa

SEQ ID NO: 3668873 - RNA, 16 nt, Human
uauuacgguuugcccc

SEQ ID NO: 3668874 - RNA, 16 nt, Human
uauuacguaugucugg

SEQ ID NO: 3668875 - RNA, 14 nt, Human
uauuacuaaauuga

SEQ ID NO: 3668876 - RNA, 22 nt, Human
uauuacuagacugccacaagga

SEQ ID NO: 3668877 - RNA, 19 nt, Human
uauuacuuguaaauauaaa

SEQ ID NO: 3668878 - RNA, 14 nt, Human
uauuacuuguugca

SEQ ID NO: 3668879 - RNA, 21 nt, Human
uauuacuuguugcaaaggucu

SEQ ID NO: 3668880 - RNA, 14 nt, Human
uauuacuuuaucac

SEQ ID NO: 3668881 - RNA, 23 nt, Human
uauuacuuuaucacuuuuugaac

SEQ ID NO: 3668882 - RNA, 16 nt, Human
uauuagaaaacuuugu

SEQ ID NO: 3668883 - RNA, 16 nt, Human
uauuagacuuuagaaa

SEQ ID NO: 3668884 - RNA, 12 nt, Human
uauuagagaaga

SEQ ID NO: 3668885 - RNA, 16 nt, Human
uauuagagcauugaau

SEQ ID NO: 3668886 - RNA, 22 nt, Human
uauuagaucaaauaguugcaua

SEQ ID NO: 3668887 - RNA, 20 nt, Human
uauuagaugugauuuaauag

SEQ ID NO: 3668888 - RNA, 12 nt, Human
uauuagauguuc

SEQ ID NO: 3668889 - RNA, 23 nt, Human
uauuagcagcugacuuucaaagu

SEQ ID NO: 3668890 - RNA, 23 nt, Human
uauuagccacaaaauugggaaag

SEQ ID NO: 3668891 - RNA, 19 nt, Human
uauuagccaggaucauggu

SEQ ID NO: 3668892 - RNA, 23 nt, Human
uauuagccaggaucaugguguaa

SEQ ID NO: 3668893 - RNA, 21 nt, Human
uauuagccagguaaugugaau

SEQ ID NO: 3668894 - RNA, 20 nt, Human
uauuagcgacaacagauugg

SEQ ID NO: 3668895 - RNA, 21 nt, Human
uauuagcgacaacagauugga

SEQ ID NO: 3668896 - RNA, 16 nt, Human
uauuagggagaaaauu

SEQ ID NO: 3668897 - RNA, 15 nt, Human
uauuagguugucacg

SEQ ID NO: 3668898 - RNA, 20 nt, Human
uauuaguauuguuguccuuu

SEQ ID NO: 3668899 - RNA, 21 nt, Human
uauuaguauuguuguccuuuu

SEQ ID NO: 3668900 - RNA, 19 nt, Human
uauuagugaccucagcuuu

SEQ ID NO: 3668901 - RNA, 21 nt, Human
uauuagugaccucagcuuuga

SEQ ID NO: 3668902 - RNA, 18 nt, Human
uauuagugauauuucucu

SEQ ID NO: 3668903 - RNA, 16 nt, Human
uauuagugcuuugcca

SEQ ID NO: 3668904 - RNA, 16 nt, Human
uauuaguguaugcuuu

SEQ ID NO: 3668905 - RNA, 21 nt, Human
uauuaguguuauaugaacaua

SEQ ID NO: 3668906 - RNA, 23 nt, Human
uauuaguucccugucucuugaaa

SEQ ID NO: 3668907 - RNA, 17 nt, Human
uauuauaaaaauauuaa

SEQ ID NO: 3668908 - RNA, 13 nt, Human
uauuauaaacaag

SEQ ID NO: 3668909 - RNA, 16 nt, Human
uauuauaaaggauaaa

SEQ ID NO: 3668910 - RNA, 15 nt, Human
uauuauaaauauaua

SEQ ID NO: 3668911 - RNA, 20 nt, Human
uauuauaaauauauauaaag

SEQ ID NO: 3668912 - RNA, 15 nt, Human
uauuauaaauuaugu

SEQ ID NO: 3668913 - RNA, 13 nt, Human
uauuauaagcauu

SEQ ID NO: 3668914 - RNA, 19 nt, Human
uauuauaaucuuauaauug

SEQ ID NO: 3668915 - RNA, 19 nt, Human
uauuauaauuuuuuucaau

SEQ ID NO: 3668916 - RNA, 14 nt, Human
uauuauacauguga

SEQ ID NO: 3668917 - RNA, 14 nt, Human
uauuauaccuuuuu

SEQ ID NO: 3668918 - RNA, 15 nt, Human
uauuauacuguauua

SEQ ID NO: 3668919 - RNA, 19 nt, Human
uauuauacuguauuaagag

SEQ ID NO: 3668920 - RNA, 17 nt, Human
uauuauagagcagaaau

SEQ ID NO: 3668921 - RNA, 18 nt, Human
uauuauagagcagaaauu

SEQ ID NO: 3668922 - RNA, 19 nt, Human
uauuauagagcagaaauuc

SEQ ID NO: 3668923 - RNA, 16 nt, Human
uaucauacaaaucagu

SEQ ID NO: 3668924 - RNA, 15 nt, Human
uaucauagaaaugua

SEQ ID NO: 3668925 - RNA, 16 nt, Human
uaucaucaguauugaa

SEQ ID NO: 3668926 - RNA, 17 nt, Human
uaucaucuaccuagauu

SEQ ID NO: 3668927 - RNA, 12 nt, Human
uaucaugaagcc

SEQ ID NO: 3668928 - RNA, 14 nt, Human
uaucaugaagccug

SEQ ID NO: 3668929 - RNA, 18 nt, Human
uaucaugaauuuuaaagu

SEQ ID NO: 3668930 - RNA, 13 nt, Human
uaucaugacaugu

SEQ ID NO: 3668931 - RNA, 14 nt, Human
uaucaugacauguu

SEQ ID NO: 3668932 - RNA, 16 nt, Human
uaucaugagugaauaa

SEQ ID NO: 3668933 - RNA, 15 nt, Human
uaucaugcaaaauau

SEQ ID NO: 3668934 - RNA, 15 nt, Human
uaucaugcaaaugcu

SEQ ID NO: 3668935 - RNA, 23 nt, Human
uaucaugcacacaauuagauuuc

SEQ ID NO: 3668936 - RNA, 17 nt, Human
uaucaugcauguccugu

SEQ ID NO: 3668937 - RNA, 19 nt, Human
uaucaugcauguccuguaa

SEQ ID NO: 3668938 - RNA, 17 nt, Human
uaucaugcuuugaaaaa

SEQ ID NO: 3668939 - RNA, 14 nt, Human
uaucauggaaauau

SEQ ID NO: 3668940 - RNA, 21 nt, Human
uaucauguaaagaaaugucuu

SEQ ID NO: 3668941 - RNA, 17 nt, Human
uaucaugugaaaucauu

SEQ ID NO: 3668942 - RNA, 22 nt, Human
uaucaugugaaaucauucauuu

SEQ ID NO: 3668943 - RNA, 17 nt, Human
uaucauguguaaucaau

SEQ ID NO: 3668944 - RNA, 20 nt, Human
uaucauguguaaucaauaaa

SEQ ID NO: 3668945 - RNA, 18 nt, Human
uaucauuaaaagaacaua

SEQ ID NO: 3668946 - RNA, 12 nt, Human
uaucauuaaagu

SEQ ID NO: 3668947 - RNA, 14 nt, Human
uaucauucuaaaga

SEQ ID NO: 3668948 - RNA, 22 nt, Human
uaucauuuaauaauauacuugu

SEQ ID NO: 3668949 - RNA, 15 nt, Human
uaucauuucuuaacc

SEQ ID NO: 3668950 - RNA, 17 nt, Human
uaucauuucuuaaccca

SEQ ID NO: 3668951 - RNA, 20 nt, Human
uaucauuuucuuuuuuaacc

SEQ ID NO: 3668952 - RNA, 15 nt, Human
uaucauuuuuguaca

SEQ ID NO: 3668953 - RNA, 17 nt, Human
uaucauuuuuguacagu

SEQ ID NO: 3668954 - RNA, 18 nt, Human
uaucauuuuuuccuguuu

SEQ ID NO: 3668955 - RNA, 22 nt, Human
uauccaaaauguguauuucuua

SEQ ID NO: 3668956 - RNA, 19 nt, Human
uauccaacaucaacaucuu

SEQ ID NO: 3668957 - RNA, 18 nt, Human
uauccaaccaacuugguu

SEQ ID NO: 3668958 - RNA, 14 nt, Human
uauccaaucuuguu

SEQ ID NO: 3668959 - RNA, 16 nt, Human
uauccacaugaaaaua

SEQ ID NO: 3668960 - RNA, 12 nt, Human
uauccacccagc

SEQ ID NO: 3668961 - RNA, 20 nt, Human
uauccacccagcccauucuc

SEQ ID NO: 3668962 - RNA, 21 nt, Human
uauccagaauggaauuuugcu

SEQ ID NO: 3668963 - RNA, 18 nt, Human
uauccagaggacccaacu

SEQ ID NO: 3668964 - RNA, 15 nt, Human
uauccaggcaccagg

SEQ ID NO: 3668965 - RNA, 18 nt, Human
uauccaggcaccaggacu

SEQ ID NO: 3668966 - RNA, 18 nt, Human
uauccagguaauccaaga

SEQ ID NO: 3668967 - RNA, 15 nt, Human
uauccaggucaacag

SEQ ID NO: 3668968 - RNA, 17 nt, Human
uauccaggucaacagaa

SEQ ID NO: 3668969 - RNA, 11 nt, Human
uauccagucua

SEQ ID NO: 3668970 - RNA, 22 nt, Human
uauccauauugagucaaauggu

SEQ ID NO: 3668971 - RNA, 17 nt, Human
uauccaugggggcaggg

SEQ ID NO: 3668972 - RNA, 18 nt, Human
uauccaugggggcagggc

SEQ ID NO: 3668973 - RNA, 20 nt, Human
uauccaugggggcagggcau

SEQ ID NO: 3668974 - RNA, 20 nt, Human
uauccauguacuuguuugca

SEQ ID NO: 3668975 - RNA, 14 nt, Human
uauccauuaucaug

SEQ ID NO: 3668976 - RNA, 15 nt, Human
uauccauuaucaugu

SEQ ID NO: 3668977 - RNA, 17 nt, Human
uauccauuaucaugugu

SEQ ID NO: 3668978 - RNA, 16 nt, Human
uauccauucuuucuga

SEQ ID NO: 3668979 - RNA, 22 nt, Human
uaucccaccugacauguccuuc

SEQ ID NO: 3668980 - RNA, 14 nt, Human
uaucccagaaauua

SEQ ID NO: 3668981 - RNA, 16 nt, Human
uaucccagcugccuag

SEQ ID NO: 3668982 - RNA, 21 nt, Human
uauccccaucucccugccugg

SEQ ID NO: 3668983 - RNA, 22 nt, Human
uauccccaucucccugccuggc

SEQ ID NO: 3668984 - RNA, 17 nt, Human
uauccccccaucuugcu

SEQ ID NO: 3668985 - RNA, 14 nt, Human
uauccccugcuacc

SEQ ID NO: 3668986 - RNA, 16 nt, Human
uaucccggcugcccuu

SEQ ID NO: 3668987 - RNA, 15 nt, Human
uaucccucaccugua

SEQ ID NO: 3668988 - RNA, 12 nt, Human
uaucccuuccgg

SEQ ID NO: 3668989 - RNA, 19 nt, Human
uaucccuuggacauuuuau

SEQ ID NO: 3668990 - RNA, 16 nt, Human
uauccuaaacaucauu

SEQ ID NO: 3668991 - RNA, 12 nt, Human
uauccuaauaaa

SEQ ID NO: 3668992 - RNA, 19 nt, Human
uauccuaauaaaaagguga

SEQ ID NO: 3668993 - RNA, 22 nt, Human
uauccuaauaaaaaggugacca

SEQ ID NO: 3668994 - RNA, 15 nt, Human
uauccuacaacaaga

SEQ ID NO: 3668995 - RNA, 19 nt, Human
uauccuagcacaugcuuca

SEQ ID NO: 3668996 - RNA, 24 nt, Human
uauccuagcacaugcuucaauagu

SEQ ID NO: 3668997 - RNA, 20 nt, Human
uauccuagucauucuucccu

SEQ ID NO: 3668998 - RNA, 12 nt, Human
uauccuccaggu

SEQ ID NO: 3668999 - RNA, 13 nt, Human
uauccuccagguu

SEQ ID NO: 3669000 - RNA, 17 nt, Human
uauccuccagguuuuuc

SEQ ID NO: 3669001 - RNA, 21 nt, Human
uauccuccagguuuuucaauu

SEQ ID NO: 3669002 - RNA, 23 nt, Human
uauccuccagguuuuucaauuaa

SEQ ID NO: 3669003 - RNA, 12 nt, Human
uauccucccugu

SEQ ID NO: 3669004 - RNA, 17 nt, Human
uauccucccuguaacuu

SEQ ID NO: 3669005 - RNA, 14 nt, Human
uauccucucuuccu

SEQ ID NO: 3669006 - RNA, 15 nt, Human
uauccucucuuccuc

SEQ ID NO: 3669007 - RNA, 14 nt, Human
uauccucugaucuc

SEQ ID NO: 3669008 - RNA, 20 nt, Human
uauccucugaucuccauggc

SEQ ID NO: 3669009 - RNA, 14 nt, Human
uauccucuguugau

SEQ ID NO: 3669010 - RNA, 16 nt, Human
uauccucuuuagaguu

SEQ ID NO: 3669011 - RNA, 23 nt, Human
uauccucuuuagaguuagacugu

SEQ ID NO: 3669012 - RNA, 14 nt, Human
uauccugaaauuuc

SEQ ID NO: 3669013 - RNA, 16 nt, Human
uauccugaaauuucag

SEQ ID NO: 3669014 - RNA, 23 nt, Human
uauccugacuucuaauaucauuc

SEQ ID NO: 3669015 - RNA, 18 nt, Human
uauccugagagcccagaa

SEQ ID NO: 3669016 - RNA, 13 nt, Human
uauccugagccau

SEQ ID NO: 3669017 - RNA, 22 nt, Human
uauccugauuauaggauuuuaa

SEQ ID NO: 3669018 - RNA, 15 nt, Human
uauccugcauuguua

SEQ ID NO: 3669019 - RNA, 20 nt, Human
uauccugccucagcccgcca

SEQ ID NO: 3669020 - RNA, 22 nt, Human
uauccugcuucugauaugcagu

SEQ ID NO: 3669021 - RNA, 20 nt, Human
uauccuggagcauuguguau

SEQ ID NO: 3669022 - RNA, 22 nt, Human
uauccugggggacccaauguag

SEQ ID NO: 3669023 - RNA, 19 nt, Human
uauccugugacauguaaca

SEQ ID NO: 3669024 - RNA, 17 nt, Human
uauuuugaaguuuacau

SEQ ID NO: 3669025 - RNA, 15 nt, Human
uauuuugaaucaaua

SEQ ID NO: 3669026 - RNA, 23 nt, Human
uauuuugaaucaauaauauauuu

SEQ ID NO: 3669027 - RNA, 14 nt, Human
uauuuugauaauaa

SEQ ID NO: 3669028 - RNA, 15 nt, Human
uauuuugauaauaau

SEQ ID NO: 3669029 - RNA, 18 nt, Human
uauuuugauaauaauauu

SEQ ID NO: 3669030 - RNA, 12 nt, Human
uauuuugaucuu

SEQ ID NO: 3669031 - RNA, 18 nt, Human
uauuuugaucuucaacaa

SEQ ID NO: 3669032 - RNA, 16 nt, Human
uauuuugauuauugua

SEQ ID NO: 3669033 - RNA, 17 nt, Human
uauuuugauuauuguau

SEQ ID NO: 3669034 - RNA, 21 nt, Human
uauuuugcaguucccacauua

SEQ ID NO: 3669035 - RNA, 18 nt, Human
uauuuuggaaagaagaaa

SEQ ID NO: 3669036 - RNA, 16 nt, Human
uauuuuggagaaauua

SEQ ID NO: 3669037 - RNA, 19 nt, Human
uauuuugguucuuaguucu

SEQ ID NO: 3669038 - RNA, 22 nt, Human
uauuuuguaaaauguauuaugu

SEQ ID NO: 3669039 - RNA, 15 nt, Human
uauuuuguaugaaau

SEQ ID NO: 3669040 - RNA, 14 nt, Human
uauuuuguaugcaa

SEQ ID NO: 3669041 - RNA, 20 nt, Human
uauuuuguauuauugcuguu

SEQ ID NO: 3669042 - RNA, 12 nt, Human
uauuuugucuaa

SEQ ID NO: 3669043 - RNA, 14 nt, Human
uauuuugucuaaaa

SEQ ID NO: 3669044 - RNA, 13 nt, Human
uauuuugugaaga

SEQ ID NO: 3669045 - RNA, 23 nt, Human
uauuuuguggaggcagugucauu

SEQ ID NO: 3669046 - RNA, 17 nt, Human
uauuuugugugaccaac

SEQ ID NO: 3669047 - RNA, 16 nt, Human
uauuuuguucauacau

SEQ ID NO: 3669048 - RNA, 17 nt, Human
uauuuuguuucuuuuaa

SEQ ID NO: 3669049 - RNA, 13 nt, Human
uauuuuuaaaaga

SEQ ID NO: 3669050 - RNA, 17 nt, Human
uauuuuuaaaagaucuu

SEQ ID NO: 3669051 - RNA, 14 nt, Human
uauuuuuaagauaa

SEQ ID NO: 3669052 - RNA, 21 nt, Human
uauuuuuaauauauacuauga

SEQ ID NO: 3669053 - RNA, 14 nt, Human
uauuuuuaauuaau

SEQ ID NO: 3669054 - RNA, 16 nt, Human
uauuuuuacaugcaga

SEQ ID NO: 3669055 - RNA, 18 nt, Human
uauuuuuacauucugaau

SEQ ID NO: 3669056 - RNA, 15 nt, Human
uauuuuuacugccac

SEQ ID NO: 3669057 - RNA, 16 nt, Human
uauuuuuacugccacu

SEQ ID NO: 3669058 - RNA, 19 nt, Human
uauuuuuagacucaucaau

SEQ ID NO: 3669059 - RNA, 22 nt, Human
uauuuuuauaaauauaagccuu

SEQ ID NO: 3669060 - RNA, 21 nt, Human
uauuuuuauacucuuccuauu

SEQ ID NO: 3669061 - RNA, 19 nt, Human
uauuuuuauagauuugacc

SEQ ID NO: 3669062 - RNA, 18 nt, Human
uauuuuuauauaauaucu

SEQ ID NO: 3669063 - RNA, 19 nt, Human
uauuuuuauauaauaucua

SEQ ID NO: 3669064 - RNA, 15 nt, Human
uauuuuucaaggaag

SEQ ID NO: 3669065 - RNA, 18 nt, Human
uauuuuucaauaaagcau

SEQ ID NO: 3669066 - RNA, 22 nt, Human
uauuuuucacucuaagucaugu

SEQ ID NO: 3669067 - RNA, 16 nt, Human
uauuuuucauaaacaa

SEQ ID NO: 3669068 - RNA, 15 nt, Human
ucaaacuuacuauuu

SEQ ID NO: 3669069 - RNA, 22 nt, Human
ucaaacuuccagugcaacacug

SEQ ID NO: 3669070 - RNA, 16 nt, Human
ucaaagaaaugcugau

SEQ ID NO: 3669071 - RNA, 13 nt, Human
ucaaagaaauuuc

SEQ ID NO: 3669072 - RNA, 20 nt, Human
ucaaagaaauuuccacucag

SEQ ID NO: 3669073 - RNA, 15 nt, Human
ucaaagaacaaacau

SEQ ID NO: 3669074 - RNA, 22 nt, Human
ucaaagaaggauggcaccuaaa

SEQ ID NO: 3669075 - RNA, 19 nt, Human
ucaaagaccuuguguguau

SEQ ID NO: 3669076 - RNA, 22 nt, Human
ucaaagauauuuugcuuuguga

SEQ ID NO: 3669077 - RNA, 16 nt, Human
ucaaagcaaggaaacu

SEQ ID NO: 3669078 - RNA, 14 nt, Human
ucaaagcaaugcau

SEQ ID NO: 3669079 - RNA, 21 nt, Human
ucaaagcaauugaaaugcauu

SEQ ID NO: 3669080 - RNA, 19 nt, Human
ucaaagcaggggaguaugc

SEQ ID NO: 3669081 - RNA, 20 nt, Human
ucaaagcaugggauuauuag

SEQ ID NO: 3669082 - RNA, 15 nt, Human
ucaaagccacacucu

SEQ ID NO: 3669083 - RNA, 18 nt, Human
ucaaagccacauuauuuc

SEQ ID NO: 3669084 - RNA, 21 nt, Human
ucaaagccccauuaacugcuu

SEQ ID NO: 3669085 - RNA, 11 nt, Human
ucaaagccuuc

SEQ ID NO: 3669086 - RNA, 19 nt, Human
ucaaagcucacaccaaauu

SEQ ID NO: 3669087 - RNA, 19 nt, Human
ucaaagcuguguguuugga

SEQ ID NO: 3669088 - RNA, 21 nt, Human
ucaaagcuuccauuccacauc

SEQ ID NO: 3669089 - RNA, 15 nt, Human
ucaaagcuuuuugaa

SEQ ID NO: 3669090 - RNA, 15 nt, Human
ucaaaggacaaagug

SEQ ID NO: 3669091 - RNA, 22 nt, Human
ucaaaggagagucacagaacaa

SEQ ID NO: 3669092 - RNA, 17 nt, Human
ucaaagggacggucagu

SEQ ID NO: 3669093 - RNA, 19 nt, Human
ucaaagguagccaucaugg

SEQ ID NO: 3669094 - RNA, 12 nt, Human
ucaaagguucua

SEQ ID NO: 3669095 - RNA, 14 nt, Human
ucaaaguaaaacuu

SEQ ID NO: 3669096 - RNA, 19 nt, Human
ucaaagucaugauguuuuu

SEQ ID NO: 3669097 - RNA, 18 nt, Human
ucaaagucauuaaagaca

SEQ ID NO: 3669098 - RNA, 20 nt, Human
ucaaagucucaaugaaauag

SEQ ID NO: 3669099 - RNA, 13 nt, Human
ucaaaguuuaaua

SEQ ID NO: 3669100 - RNA, 15 nt, Human
ucaaaguuuugaaaa

SEQ ID NO: 3669101 - RNA, 13 nt, Human
ucaaaguuuuguu

SEQ ID NO: 3669102 - RNA, 14 nt, Human
ucaaauaaaaauaa

SEQ ID NO: 3669103 - RNA, 14 nt, Human
ucaaauaaacacug

SEQ ID NO: 3669104 - RNA, 18 nt, Human
ucaaauaacuaaaaggua

SEQ ID NO: 3669105 - RNA, 16 nt, Human
ucaaauacacauuugc

SEQ ID NO: 3669106 - RNA, 22 nt, Human
ucaaauacauuuaaaacauuaa

SEQ ID NO: 3669107 - RNA, 12 nt, Human
ucaaauacuuua

SEQ ID NO: 3669108 - RNA, 22 nt, Human
ucaaauauauucagccuggcuu

SEQ ID NO: 3669109 - RNA, 18 nt, Human
ucaaauaucucuauuuaa

SEQ ID NO: 3669110 - RNA, 14 nt, Human
ucaaauaugcaaag

SEQ ID NO: 3669111 - RNA, 16 nt, Human
ucaaauaugcaaagca

SEQ ID NO: 3669112 - RNA, 19 nt, Human
ucaaauaugcaaagcacug

SEQ ID NO: 3669113 - RNA, 20 nt, Human
ucaaaucaaucuguaaaacu

SEQ ID NO: 3669114 - RNA, 22 nt, Human
ucaaaucagguuuucuuuuaag

SEQ ID NO: 3669115 - RNA, 14 nt, Human
ucaaaucagucagu

SEQ ID NO: 3669116 - RNA, 15 nt, Human
ucaaauccaggaccc

SEQ ID NO: 3669117 - RNA, 16 nt, Human
ucaaauccaggacccu

SEQ ID NO: 3669118 - RNA, 21 nt, Human
ucaaauccuuccaaaaauuau

SEQ ID NO: 3669119 - RNA, 14 nt, Human
ucaaaucuauucag

SEQ ID NO: 3669120 - RNA, 18 nt, Human
ucaaaucuauucagacaa

SEQ ID NO: 3669121 - RNA, 19 nt, Human
ucaaaugacccaaagacca

SEQ ID NO: 3669122 - RNA, 21 nt, Human
ucaaaugaugugccugcuuca

SEQ ID NO: 3669123 - RNA, 16 nt, Human
ucaaaugcaguauauu

SEQ ID NO: 3669124 - RNA, 18 nt, Human
ucaaaugcuagaaaaauu

SEQ ID NO: 3669125 - RNA, 21 nt, Human
ucaaaugcuuggcuucucaua

SEQ ID NO: 3669126 - RNA, 23 nt, Human
ucaaauggaaaggagaggaaaga

SEQ ID NO: 3669127 - RNA, 18 nt, Human
ucaaaugggcugcugcuu

SEQ ID NO: 3669128 - RNA, 19 nt, Human
ucaaauggggccagaucca

SEQ ID NO: 3669129 - RNA, 20 nt, Human
ucaaaugguaggcauuuccu

SEQ ID NO: 3669130 - RNA, 16 nt, Human
ucaaaugguaucuuuu

SEQ ID NO: 3669131 - RNA, 16 nt, Human
ucaaauguguuuuggu

SEQ ID NO: 3669132 - RNA, 20 nt, Human
ucaaauguucuaaguuucua

SEQ ID NO: 3669133 - RNA, 21 nt, Human
ucaaauguucuaaguuucuaa

SEQ ID NO: 3669134 - RNA, 22 nt, Human
ucaaauguucuaaguuucuaag

SEQ ID NO: 3669135 - RNA, 22 nt, Human
ucaaauuaauaaucuuauuagg

SEQ ID NO: 3669136 - RNA, 13 nt, Human
ucaaauuaauugu

SEQ ID NO: 3669137 - RNA, 14 nt, Human
ucaaauucuucuga

SEQ ID NO: 3669138 - RNA, 20 nt, Human
ucaaauuggacuuucaaaau

SEQ ID NO: 3669139 - RNA, 12 nt, Human
ucaaauuguauc

SEQ ID NO: 3669140 - RNA, 13 nt, Human
ucaaauuguaucu

SEQ ID NO: 3669141 - RNA, 14 nt, Human
ucaaauuguaucua

SEQ ID NO: 3669142 - RNA, 22 nt, Human
ucaaauugugcaguacuuugug

SEQ ID NO: 3669143 - RNA, 12 nt, Human
ucaaauuucaca

SEQ ID NO: 3669144 - RNA, 14 nt, Human
ucaaauuucuaaau

SEQ ID NO: 3669145 - RNA, 14 nt, Human
ucaaauuuuaucug

SEQ ID NO: 3669146 - RNA, 18 nt, Human
ucaacaaaaauugucccu

SEQ ID NO: 3669147 - RNA, 15 nt, Human
ucaacaaagcacagu

SEQ ID NO: 3669148 - RNA, 22 nt, Human
ucaacaaauauucacuggcccc

SEQ ID NO: 3669149 - RNA, 16 nt, Human
ucaacaaauugcccuu

SEQ ID NO: 3669150 - RNA, 14 nt, Human
ucaacaacuacuac

SEQ ID NO: 3669151 - RNA, 18 nt, Human
ucaacaagaaauaauaga

SEQ ID NO: 3669152 - RNA, 16 nt, Human
ucaacaagaagaauuu

SEQ ID NO: 3669153 - RNA, 20 nt, Human
ucaacaagauuuccuugugc

SEQ ID NO: 3669154 - RNA, 16 nt, Human
ucaacaagggagagac

SEQ ID NO: 3669155 - RNA, 19 nt, Human
ucaacaagggagagaccuc

SEQ ID NO: 3669156 - RNA, 22 nt, Human
ucaacaagggagagaccucauc

SEQ ID NO: 3669157 - RNA, 17 nt, Human
ucaacaauucuaaaaug

SEQ ID NO: 3669158 - RNA, 14 nt, Human
ucaacacccaguuu

SEQ ID NO: 3669159 - RNA, 23 nt, Human
ucaacacuaccagcguauauaua

SEQ ID NO: 3669160 - RNA, 18 nt, Human
ucaacacucccuucccau

SEQ ID NO: 3669161 - RNA, 15 nt, Human
ucaacagaagcauuu

SEQ ID NO: 3669162 - RNA, 12 nt, Human
ucaacagaauga

SEQ ID NO: 3669163 - RNA, 19 nt, Human
ucaacagaaugaaaaauga

SEQ ID NO: 3669164 - RNA, 22 nt, Human
ucaacagagaaggcaggaaugu

SEQ ID NO: 3669165 - RNA, 22 nt, Human
ucaacagauuauuuuggaaagu

SEQ ID NO: 3669166 - RNA, 22 nt, Human
ucaacagcaagugugaauacug

SEQ ID NO: 3669167 - RNA, 19 nt, Human
ucaacagcagggugggcuu

SEQ ID NO: 3669168 - RNA, 22 nt, Human
ucaacagcguuccuagagaaga

SEQ ID NO: 3669169 - RNA, 23 nt, Human
ucaacaggccucagggcuccuug

SEQ ID NO: 3669170 - RNA, 14 nt, Human
ucaacagggcagca

SEQ ID NO: 3669171 - RNA, 18 nt, Human
ucaacaguaaaccacuga

SEQ ID NO: 3669172 - RNA, 15 nt, Human
ucaacagugaagaca

SEQ ID NO: 3669173 - RNA, 16 nt, Human
ucaacagugagagacu

SEQ ID NO: 3669174 - RNA, 23 nt, Human
ucaacaguuuuccuaugcuuuga

SEQ ID NO: 3669175 - RNA, 17 nt, Human
ucaacauaccuuggcca

SEQ ID NO: 3669176 - RNA, 20 nt, Human
ucaacaucaauguucauugu

SEQ ID NO: 3669177 - RNA, 23 nt, Human
ucaacaucaauguucauuguaau

SEQ ID NO: 3669178 - RNA, 17 nt, Human
ucaacaucacugaaacc

SEQ ID NO: 3669179 - RNA, 20 nt, Human
ucaacauccugccagcccca

SEQ ID NO: 3669180 - RNA, 15 nt, Human
ucaacaugaaacacc

SEQ ID NO: 3669181 - RNA, 21 nt, Human
ucaacauggcuacuugcuuug

SEQ ID NO: 3669182 - RNA, 20 nt, Human
ucaacauguuacugaccagc

SEQ ID NO: 3669183 - RNA, 14 nt, Human
ucaacauuucucaa

SEQ ID NO: 3669184 - RNA, 14 nt, Human
ucaaccacaaaacu

SEQ ID NO: 3669185 - RNA, 17 nt, Human
ucaaccaccuuucagau

SEQ ID NO: 3669186 - RNA, 23 nt, Human
ucaaccacuguaaaaugaaauua

SEQ ID NO: 3669187 - RNA, 12 nt, Human
ucaaccagacag

SEQ ID NO: 3669188 - RNA, 19 nt, Human
ucaaccagacagaggguca

SEQ ID NO: 3669189 - RNA, 14 nt, Human
uaugaaacuugugu

SEQ ID NO: 3669190 - RNA, 19 nt, Human
uaugaaacuuguguaaaua

SEQ ID NO: 3669191 - RNA, 21 nt, Human
uaugaaacuuguguaaauaca

SEQ ID NO: 3669192 - RNA, 23 nt, Human
uaugaaagaauauauuuauuuaa

SEQ ID NO: 3669193 - RNA, 19 nt, Human
uaugaaagcaacaaagaaa

SEQ ID NO: 3669194 - RNA, 20 nt, Human
uaugaaauuuaauauagcua

SEQ ID NO: 3669195 - RNA, 20 nt, Human
uaugaaauuuuuuuucaugc

SEQ ID NO: 3669196 - RNA, 14 nt, Human
uaugaacaacucca

SEQ ID NO: 3669197 - RNA, 14 nt, Human
uaugaacagacuuu

SEQ ID NO: 3669198 - RNA, 17 nt, Human
uaugaacauacaaaugc

SEQ ID NO: 3669199 - RNA, 14 nt, Human
uaugaacauauugu

SEQ ID NO: 3669200 - RNA, 19 nt, Human
uaugaacauauuguugaaa

SEQ ID NO: 3669201 - RNA, 22 nt, Human
uaugaacccuuccugagcuuua

SEQ ID NO: 3669202 - RNA, 20 nt, Human
uaugaacccuuuguuucuug

SEQ ID NO: 3669203 - RNA, 21 nt, Human
uaugaacccuuuguuucuugu

SEQ ID NO: 3669204 - RNA, 18 nt, Human
uaugaacucaucauuuuu

SEQ ID NO: 3669205 - RNA, 14 nt, Human
uaugaacuuaacau

SEQ ID NO: 3669206 - RNA, 23 nt, Human
uaugaacuuaacaugcuguguaa

SEQ ID NO: 3669207 - RNA, 20 nt, Human
uaugaacuugaggacacaug

SEQ ID NO: 3669208 - RNA, 15 nt, Human
uaugaagaaaaaaua

SEQ ID NO: 3669209 - RNA, 14 nt, Human
uaugaagaaaauac

SEQ ID NO: 3669210 - RNA, 22 nt, Human
uaugaagaaaauacuuaaaugu

SEQ ID NO: 3669211 - RNA, 14 nt, Human
uaugaagaacugag

SEQ ID NO: 3669212 - RNA, 18 nt, Human
gccugggaaagccccugc

SEQ ID NO: 3669213 - RNA, 17 nt, Human
gccugggacuuccaugc

SEQ ID NO: 3669214 - RNA, 14 nt, Human
gccugggaucccuc

SEQ ID NO: 3669215 - RNA, 23 nt, Human
gccugggaucccucauccucaua

SEQ ID NO: 3669216 - RNA, 21 nt, Human
gccugggauuucuaugcagug

SEQ ID NO: 3669217 - RNA, 18 nt, Human
gccugggcaacagagcaa

SEQ ID NO: 3669218 - RNA, 12 nt, Human
gccugggcaaga

SEQ ID NO: 3669219 - RNA, 11 nt, Human
gccugggcaga

SEQ ID NO: 3669220 - RNA, 15 nt, Human
gccugggcagaagga

SEQ ID NO: 3669221 - RNA, 16 nt, Human
gccugggcagaaggaa

SEQ ID NO: 3669222 - RNA, 18 nt, Human
gccugggcagaaggaaga

SEQ ID NO: 3669223 - RNA, 18 nt, Human
gccugggcagccaggcug

SEQ ID NO: 3669224 - RNA, 23 nt, Human
gccugggcagccaggcugccaag

SEQ ID NO: 3669225 - RNA, 16 nt, Human
gccugggcaggaggga

SEQ ID NO: 3669226 - RNA, 13 nt, Human
gccugggccagag

SEQ ID NO: 3669227 - RNA, 23 nt, Human
gccugggcccaucucccugcuuu

SEQ ID NO: 3669228 - RNA, 15 nt, Human
gccugggccccagcu

SEQ ID NO: 3669229 - RNA, 18 nt, Human
gccugggccuauggagag

SEQ ID NO: 3669230 - RNA, 17 nt, Human
gccugggccuggcuccc

SEQ ID NO: 3669231 - RNA, 12 nt, Human
gccugggcuagg

SEQ ID NO: 3669232 - RNA, 23 nt, Human
gccugggcucccuugugcguggg

SEQ ID NO: 3669233 - RNA, 13 nt, Human
gccugggcuccug

SEQ ID NO: 3669234 - RNA, 15 nt, Human
gccugggcuccugga

SEQ ID NO: 3669235 - RNA, 16 nt, Human
gccugggcuccuggac

SEQ ID NO: 3669236 - RNA, 15 nt, Human
gccugggcugggaaa

SEQ ID NO: 3669237 - RNA, 15 nt, Human
gccugggcuguuggc

SEQ ID NO: 3669238 - RNA, 15 nt, Human
gccuggggccugaga

SEQ ID NO: 3669239 - RNA, 17 nt, Human
gccuggggcgggccccu

SEQ ID NO: 3669240 - RNA, 23 nt, Human
gccuggggcuccuuucuccagcc

SEQ ID NO: 3669241 - RNA, 21 nt, Human
gccugggggaguuuuccucua

SEQ ID NO: 3669242 - RNA, 15 nt, Human
gccugggggccuggc

SEQ ID NO: 3669243 - RNA, 19 nt, Human
gccugggggccuggcuggc

SEQ ID NO: 3669244 - RNA, 22 nt, Human
gccugggggcugggcagaggaa

SEQ ID NO: 3669245 - RNA, 18 nt, Human
gccuggggugacccggca

SEQ ID NO: 3669246 - RNA, 14 nt, Human
gccugggguggggu

SEQ ID NO: 3669247 - RNA, 16 nt, Human
gccuggggugggguca

SEQ ID NO: 3669248 - RNA, 22 nt, Human
ucaccuaagagauucugauuug

SEQ ID NO: 3669249 - RNA, 21 nt, Human
ucaccuaauguuuaugagcca

SEQ ID NO: 3669250 - RNA, 22 nt, Human
ucaccuaauguuuaugagccag

SEQ ID NO: 3669251 - RNA, 19 nt, Human
ucaccuacucacacaggca

SEQ ID NO: 3669252 - RNA, 15 nt, Human
ucaccuagagccaga

SEQ ID NO: 3669253 - RNA, 20 nt, Human
ucaccuagcugaauguuuuu

SEQ ID NO: 3669254 - RNA, 21 nt, Human
ucaccucacucagcaccacuc

SEQ ID NO: 3669255 - RNA, 17 nt, Human
ucaccucagauggcagc

SEQ ID NO: 3669256 - RNA, 19 nt, Human
ucaccucagauggcagcuu

SEQ ID NO: 3669257 - RNA, 21 nt, Human
ucaccucagauggcagcuuuu

SEQ ID NO: 3669258 - RNA, 23 nt, Human
ucaccucagauggcagcuuuuaa

SEQ ID NO: 3669259 - RNA, 13 nt, Human
ucaccucagccuc

SEQ ID NO: 3669260 - RNA, 23 nt, Human
ucaccucaugcccacccccugcc

SEQ ID NO: 3669261 - RNA, 13 nt, Human
ucaccuccccucc

SEQ ID NO: 3669262 - RNA, 14 nt, Human
ucaccuccccuccu

SEQ ID NO: 3669263 - RNA, 17 nt, Human
ucaccuccccuccuugc

SEQ ID NO: 3669264 - RNA, 15 nt, Human
ucaccuccugcuggg

SEQ ID NO: 3669265 - RNA, 20 nt, Human
ucaccucuaaaacaguccuu

SEQ ID NO: 3669266 - RNA, 18 nt, Human
ucaccucuacccaaaccc

SEQ ID NO: 3669267 - RNA, 12 nt, Human
ucaccucugccu

SEQ ID NO: 3669268 - RNA, 14 nt, Human
ucaccucugccuca

SEQ ID NO: 3669269 - RNA, 17 nt, Human
ucaccucuuaaagaaaa

SEQ ID NO: 3669270 - RNA, 16 nt, Human
ucaccugaagacucau

SEQ ID NO: 3669271 - RNA, 15 nt, Human
ucaccugaggucggg

SEQ ID NO: 3669272 - RNA, 12 nt, Human
ucaccugauuca

SEQ ID NO: 3669273 - RNA, 18 nt, Human
ucaccugauucaacuaaa

SEQ ID NO: 3669274 - RNA, 13 nt, Human
ucaccugccccuc

SEQ ID NO: 3669275 - RNA, 12 nt, Human
ucaccugccugu

SEQ ID NO: 3669276 - RNA, 11 nt, Human
ucaccugcugg

SEQ ID NO: 3669277 - RNA, 15 nt, Human
ucaccugcuggcccc

SEQ ID NO: 3669278 - RNA, 13 nt, Human
ucaccugcuucuc

SEQ ID NO: 3669279 - RNA, 12 nt, Human
ucaccuggcccu

SEQ ID NO: 3669280 - RNA, 14 nt, Human
ucaccuggcccugc

SEQ ID NO: 3669281 - RNA, 17 nt, Human
ucaccuggggcugcugg

SEQ ID NO: 3669282 - RNA, 22 nt, Human
ucaccuggggcugcuggccuga

SEQ ID NO: 3669283 - RNA, 19 nt, Human
ucaccuggggugugggagg

SEQ ID NO: 3669284 - RNA, 16 nt, Human
ucaccuguaaaacuuu

SEQ ID NO: 3669285 - RNA, 19 nt, Human
ucaccuguaaaacuuuauu

SEQ ID NO: 3669286 - RNA, 16 nt, Human
ucaccuguaaaccuga

SEQ ID NO: 3669287 - RNA, 16 nt, Human
ucaccuguacucuucc

SEQ ID NO: 3669288 - RNA, 18 nt, Human
ucaccuguacucuuccga

SEQ ID NO: 3669289 - RNA, 23 nt, Human
ucaccuguuacugaaagugguuu

SEQ ID NO: 3669290 - RNA, 14 nt, Human
ucaccuguugcuua

SEQ ID NO: 3669291 - RNA, 21 nt, Human
ucaccuguugcuuacaauuuu

SEQ ID NO: 3669292 - RNA, 18 nt, Human
ucaccuguuuuuaagcug

SEQ ID NO: 3669293 - RNA, 18 nt, Human
ucaccuuaggcagggaag

SEQ ID NO: 3669294 - RNA, 16 nt, Human
ucaccuucaguaaccc

SEQ ID NO: 3669295 - RNA, 12 nt, Human
ucaccuucccuu

SEQ ID NO: 3669296 - RNA, 17 nt, Human
ucaccuugaagaaccuc

SEQ ID NO: 3669297 - RNA, 21 nt, Human
ucaccuugcaacacacagaca

SEQ ID NO: 3669298 - RNA, 18 nt, Human
ucaccuuggcaccagaca

SEQ ID NO: 3669299 - RNA, 15 nt, Human
ucaccuugguuccug

SEQ ID NO: 3669300 - RNA, 20 nt, Human
ucaccuuguguguuccaagu

SEQ ID NO: 3669301 - RNA, 18 nt, Human
ucaccuuguuucucaacu

SEQ ID NO: 3669302 - RNA, 17 nt, Human
ucaccuuuacuuuagaa

SEQ ID NO: 3669303 - RNA, 15 nt, Human
ucaccuuuguagcac

SEQ ID NO: 3669304 - RNA, 19 nt, Human
ucaccuuuguagcacucag

SEQ ID NO: 3669305 - RNA, 12 nt, Human
ucaccuuugucc

SEQ ID NO: 3669306 - RNA, 14 nt, Human
ucaccuuugucccc

SEQ ID NO: 3669307 - RNA, 15 nt, Human
ucaccuuugucccca

SEQ ID NO: 3669308 - RNA, 17 nt, Human
ucaccuuuguccccacc

SEQ ID NO: 3669309 - RNA, 22 nt, Human
ucaccuuuguccccaccgcaga

SEQ ID NO: 3669310 - RNA, 17 nt, Human
ucaccuuuguguauuuu

SEQ ID NO: 3669311 - RNA, 12 nt, Human
ucaccuuuuaaa

SEQ ID NO: 3669312 - RNA, 22 nt, Human
ucaccuuuuaaauccuguugaa

SEQ ID NO: 3669313 - RNA, 16 nt, Human
ucacgaaguguugcau

SEQ ID NO: 3669314 - RNA, 22 nt, Human
ucacgaaguguugcauggaugu

SEQ ID NO: 3669315 - RNA, 19 nt, Human
ucacgaauauuaugcccag

SEQ ID NO: 3669316 - RNA, 13 nt, Human
ucacgauucauuu

SEQ ID NO: 3669317 - RNA, 16 nt, Human
ucacgcaccucccauc

SEQ ID NO: 3669318 - RNA, 14 nt, Human
ucacgccacugcac

SEQ ID NO: 3669319 - RNA, 16 nt, Human
ucacgccacugcacua

SEQ ID NO: 3669320 - RNA, 19 nt, Human
ucacgccuaugaucccagc

SEQ ID NO: 3669321 - RNA, 21 nt, Human
ucacgccuguaaucccagcac

SEQ ID NO: 3669322 - RNA, 23 nt, Human
ucacgccuguaaucccagcacuu

SEQ ID NO: 3669323 - RNA, 20 nt, Human
ucacgccuguaauccuagca

SEQ ID NO: 3669324 - RNA, 21 nt, Human
ucacgcuccccgccuguuccc

SEQ ID NO: 3669325 - RNA, 15 nt, Human
ucacgcuucacagug

SEQ ID NO: 3669326 - RNA, 14 nt, Human
ucacgcuucuucuu

SEQ ID NO: 3669327 - RNA, 16 nt, Human
ucacggaagagccuug

SEQ ID NO: 3669328 - RNA, 15 nt, Human
ucacggcucacugca

SEQ ID NO: 3669329 - RNA, 17 nt, Human
ucacgggacuauuucca

SEQ ID NO: 3669330 - RNA, 20 nt, Human
ucacguaaagcuagaaauga

SEQ ID NO: 3669331 - RNA, 13 nt, Human
ucacgucacacuu

SEQ ID NO: 3669332 - RNA, 16 nt, Human
ucacgucauaggaagu

SEQ ID NO: 3669333 - RNA, 17 nt, Human
ucacgucauaggaaguu

SEQ ID NO: 3669334 - RNA, 20 nt, Human
ucacguccugagaaagcuca

SEQ ID NO: 3669335 - RNA, 17 nt, Human
ucacgugcagcucaagg

SEQ ID NO: 3669336 - RNA, 17 nt, Human
ucacguuagaggaaaaa

SEQ ID NO: 3669337 - RNA, 18 nt, Human
ucacguuagaggaaaaau

SEQ ID NO: 3669338 - RNA, 19 nt, Human
ucacuaaaaggaagacagu

SEQ ID NO: 3669339 - RNA, 13 nt, Human
ucacuaaacucug

SEQ ID NO: 3669340 - RNA, 15 nt, Human
ucacuaaagcaugaa

SEQ ID NO: 3669341 - RNA, 22 nt, Human
ucacuaaagcaugaaaugugaa

SEQ ID NO: 3669342 - RNA, 14 nt, Human
ucacuaacauuaua

SEQ ID NO: 3669343 - RNA, 15 nt, Human
ucacuaacauuauau

SEQ ID NO: 3669344 - RNA, 21 nt, Human
ucacuaacauuauauugcaau

SEQ ID NO: 3669345 - RNA, 18 nt, Human
ucacuaauucauuaaucu

SEQ ID NO: 3669346 - RNA, 16 nt, Human
ucacuaauuuuuguau

SEQ ID NO: 3669347 - RNA, 22 nt, Human
ucacuaccauuguaacuuggau

SEQ ID NO: 3669348 - RNA, 14 nt, Human
ucacuaccuccuca

SEQ ID NO: 3669349 - RNA, 19 nt, Human
ucacuaccuccucagggau

SEQ ID NO: 3669350 - RNA, 22 nt, Human
ucacuacucacagucucuuuaa

SEQ ID NO: 3669351 - RNA, 12 nt, Human
ucacuacugcag

SEQ ID NO: 3669352 - RNA, 19 nt, Human
ucacuagaauggauaaaau

SEQ ID NO: 3669353 - RNA, 14 nt, Human
ucacuagccaugau

SEQ ID NO: 3669354 - RNA, 20 nt, Human
ucacuagugaccccuucccu

SEQ ID NO: 3669355 - RNA, 13 nt, Human
ucacuauaaaugg

SEQ ID NO: 3669356 - RNA, 19 nt, Human
ucacuauaaugugaaaugu

SEQ ID NO: 3669357 - RNA, 19 nt, Human
ucaaauaaaaauucuagau

SEQ ID NO: 3669358 - RNA, 23 nt, Human
ucaaauaaaacuagugacagcuu

SEQ ID NO: 3669359 - RNA, 13 nt, Human
ucaaauaagaaau

SEQ ID NO: 3669360 - RNA, 19 nt, Human
ucaaauaaguauuuauaau

SEQ ID NO: 3669361 - RNA, 11 nt, Human
ucaaauaauac

SEQ ID NO: 3669362 - RNA, 19 nt, Human
ucaaauaauaccuuagaag

SEQ ID NO: 3669363 - RNA, 21 nt, Human
ucaaauaauaccuuagaaggu

SEQ ID NO: 3669364 - RNA, 15 nt, Human
ucaaauacuuuaaag

SEQ ID NO: 3669365 - RNA, 21 nt, Human
ucaaauauauucagccuggcu

SEQ ID NO: 3669366 - RNA, 23 nt, Human
ucaaauauauucagccuggcuuc

SEQ ID NO: 3669367 - RNA, 17 nt, Human
ucaaauaugcaaagcac

SEQ ID NO: 3669368 - RNA, 16 nt, Human
ucaaauauuagaugug

SEQ ID NO: 3669369 - RNA, 16 nt, Human
ucaaaucagguuuucu

SEQ ID NO: 3669370 - RNA, 15 nt, Human
ucaaaucagucagug

SEQ ID NO: 3669371 - RNA, 16 nt, Human
ucaaauccacccauau

SEQ ID NO: 3669372 - RNA, 14 nt, Human
ucaaauccaggacc

SEQ ID NO: 3669373 - RNA, 19 nt, Human
ucaaauccuuccaaaaauu

SEQ ID NO: 3669374 - RNA, 16 nt, Human
ucaaauccuugaagau

SEQ ID NO: 3669375 - RNA, 20 nt, Human
ucaaaucuaccacuguauga

SEQ ID NO: 3669376 - RNA, 15 nt, Human
ucaaaucuauucaga

SEQ ID NO: 3669377 - RNA, 17 nt, Human
ucaaaucuauucagaca

SEQ ID NO: 3669378 - RNA, 14 nt, Human
ucaaaugaaaugua

SEQ ID NO: 3669379 - RNA, 22 nt, Human
ucaaaugaauaaugccuuugua

SEQ ID NO: 3669380 - RNA, 23 nt, Human
ucaaaugaauggaggaacuuucc

SEQ ID NO: 3669381 - RNA, 17 nt, Human
ucaaaugacccaaagac

SEQ ID NO: 3669382 - RNA, 22 nt, Human
ucaaaugaguaacauuugcugu

SEQ ID NO: 3669383 - RNA, 15 nt, Human
ucaaaugaugugcaa

SEQ ID NO: 3669384 - RNA, 19 nt, Human
ucaaaugcaguauauuucu

SEQ ID NO: 3669385 - RNA, 20 nt, Human
ucaaaugcaguauauuucuu

SEQ ID NO: 3669386 - RNA, 15 nt, Human
ucaaauggaaaggag

SEQ ID NO: 3669387 - RNA, 18 nt, Human
ucaaauggggccagaucc

SEQ ID NO: 3669388 - RNA, 20 nt, Human
ucaaauggggccagauccag

SEQ ID NO: 3669389 - RNA, 15 nt, Human
ucaaauguaaaguuu

SEQ ID NO: 3669390 - RNA, 22 nt, Human
ucaaauguaauguggcuucugg

SEQ ID NO: 3669391 - RNA, 18 nt, Human
ucaaauguguuuuggucc

SEQ ID NO: 3669392 - RNA, 23 nt, Human
ucaaauguucuaaguuucuaaga

SEQ ID NO: 3669393 - RNA, 12 nt, Human
ucaaauguuuaa

SEQ ID NO: 3669394 - RNA, 20 nt, Human
ucaaauguuuaaucauauaa

SEQ ID NO: 3669395 - RNA, 10 nt, Human
ucaaauuaau

SEQ ID NO: 3669396 - RNA, 17 nt, Human
ucaaauuaauuguguga

SEQ ID NO: 3669397 - RNA, 18 nt, Human
ucaaauuaauugugugaa

SEQ ID NO: 3669398 - RNA, 16 nt, Human
ucaaauuagaagacau

SEQ ID NO: 3669399 - RNA, 13 nt, Human
ucaaauucaaaua

SEQ ID NO: 3669400 - RNA, 21 nt, Human
ucaaauuccuauuuuuaaaua

SEQ ID NO: 3669401 - RNA, 15 nt, Human
ucaaauucuucugaa

SEQ ID NO: 3669402 - RNA, 16 nt, Human
ucaaauugagagaaug

SEQ ID NO: 3669403 - RNA, 13 nt, Human
ucaaauuguaauu

SEQ ID NO: 3669404 - RNA, 13 nt, Human
ucaaauuuaaagg

SEQ ID NO: 3669405 - RNA, 23 nt, Human
ucaaauuuagaaacuaauugacu

SEQ ID NO: 3669406 - RNA, 18 nt, Human
ucaaauuuauuuccaaug

SEQ ID NO: 3669407 - RNA, 16 nt, Human
ucaaauuucuaaaucu

SEQ ID NO: 3669408 - RNA, 17 nt, Human
ucaaauuucuaaaucuc

SEQ ID NO: 3669409 - RNA, 22 nt, Human
ucaaauuuuaucugccucucuu

SEQ ID NO: 3669410 - RNA, 20 nt, Human
ucaaauuuuuuaaaagagac

SEQ ID NO: 3669411 - RNA, 15 nt, Human
ucaacaaaaauuguc

SEQ ID NO: 3669412 - RNA, 14 nt, Human
ucaacaaacuauuu

SEQ ID NO: 3669413 - RNA, 14 nt, Human
ucaacaaagaaaca

SEQ ID NO: 3669414 - RNA, 20 nt, Human
ucaacaaagaaacaaagaug

SEQ ID NO: 3669415 - RNA, 15 nt, Human
ucaacaaagaaauau

SEQ ID NO: 3669416 - RNA, 18 nt, Human
ucaacaaagaaauauuau

SEQ ID NO: 3669417 - RNA, 14 nt, Human
ucaacaaagcacag

SEQ ID NO: 3669418 - RNA, 23 nt, Human
ucaacaaagcacaguguuaaaug

SEQ ID NO: 3669419 - RNA, 14 nt, Human
ucaacaaccaggga

SEQ ID NO: 3669420 - RNA, 15 nt, Human
ucaacaagaagaauu

SEQ ID NO: 3669421 - RNA, 21 nt, Human
ucaacaaggcaaaaacaaaga

SEQ ID NO: 3669422 - RNA, 20 nt, Human
ucaacaaggcuugcugcaga

SEQ ID NO: 3669423 - RNA, 17 nt, Human
ucaacaauaaaauuuuu

SEQ ID NO: 3669424 - RNA, 14 nt, Human
ucaacaccaugauu

SEQ ID NO: 3669425 - RNA, 22 nt, Human
ucaacacccaguuuccuuggga

SEQ ID NO: 3669426 - RNA, 18 nt, Human
ucaacaccuuaauaugcu

SEQ ID NO: 3669427 - RNA, 20 nt, Human
ucaacagaagcauuuguauu

SEQ ID NO: 3669428 - RNA, 22 nt, Human
ucaacagaagcauuuguauuuu

SEQ ID NO: 3669429 - RNA, 14 nt, Human
ucaacagaaugaaa

SEQ ID NO: 3669430 - RNA, 15 nt, Human
ucaacagaaugaaaa

SEQ ID NO: 3669431 - RNA, 23 nt, Human
ucaacagaaugaaaaaugaaaga

SEQ ID NO: 3669432 - RNA, 12 nt, Human
ucaacagagaag

SEQ ID NO: 3669433 - RNA, 17 nt, Human
ucaacagagaaggcagg

SEQ ID NO: 3669434 - RNA, 16 nt, Human
ucaacagagacugaau

SEQ ID NO: 3669435 - RNA, 18 nt, Human
ucaacagcuaugcuggua

SEQ ID NO: 3669436 - RNA, 15 nt, Human
ucaacagcuccccau

SEQ ID NO: 3669437 - RNA, 16 nt, Human
ucaacaggccucaggg

SEQ ID NO: 3669438 - RNA, 17 nt, Human
ucaacaggccucagggc

SEQ ID NO: 3669439 - RNA, 22 nt, Human
ucaacaggccucagggcuccuu

SEQ ID NO: 3669440 - RNA, 23 nt, Human
ucaacaggggcgugaggucccag

SEQ ID NO: 3669441 - RNA, 17 nt, Human
ucaacagugaagacaga

SEQ ID NO: 3669442 - RNA, 18 nt, Human
ucaacagugaagacagaa

SEQ ID NO: 3669443 - RNA, 22 nt, Human
ucaacagugaagacagaaguuu

SEQ ID NO: 3669444 - RNA, 14 nt, Human
ucaacaguuuuccu

SEQ ID NO: 3669445 - RNA, 16 nt, Human
ucaacaucaauguuca

SEQ ID NO: 3669446 - RNA, 15 nt, Human
ucaacaucacugaaa

SEQ ID NO: 3669447 - RNA, 14 nt, Human
ucaacauuuacaug

SEQ ID NO: 3669448 - RNA, 16 nt, Human
ucaacauuuacaugua

SEQ ID NO: 3669449 - RNA, 13 nt, Human
ucaaccaaauggu

SEQ ID NO: 3669450 - RNA, 16 nt, Human
ucaaccaaaugguaca

SEQ ID NO: 3669451 - RNA, 18 nt, Human
ucaaccaaaugguacaaa

SEQ ID NO: 3669452 - RNA, 20 nt, Human
ucaaccaaaugguacaaaac

SEQ ID NO: 3669453 - RNA, 15 nt, Human
ucaaccaauguagaa

SEQ ID NO: 3669454 - RNA, 20 nt, Human
ucaaccagggauuguuucug

SEQ ID NO: 3669455 - RNA, 12 nt, Human
ucagccccucuu

SEQ ID NO: 3669456 - RNA, 19 nt, Human
ucagcccuaggguggagag

SEQ ID NO: 3669457 - RNA, 13 nt, Human
ucagcccucccug

SEQ ID NO: 3669458 - RNA, 15 nt, Human
ucagcccucccugcc

SEQ ID NO: 3669459 - RNA, 13 nt, Human
ucagcccugaccc

SEQ ID NO: 3669460 - RNA, 14 nt, Human
ucagcccugcccuu

SEQ ID NO: 3669461 - RNA, 12 nt, Human
ucagcccuggag

SEQ ID NO: 3669462 - RNA, 19 nt, Human
ucagcccugggccccacca

SEQ ID NO: 3669463 - RNA, 21 nt, Human
ucagccgagccgggccugggg

SEQ ID NO: 3669464 - RNA, 22 nt, Human
ucagccgagccgggccuggggc

SEQ ID NO: 3669465 - RNA, 23 nt, Human
ucagccuagccgaccucagccuu

SEQ ID NO: 3669466 - RNA, 18 nt, Human
ucagccuaggggucaggg

SEQ ID NO: 3669467 - RNA, 17 nt, Human
ucagccuccagccucug

SEQ ID NO: 3669468 - RNA, 16 nt, Human
ucagccucccaaagug

SEQ ID NO: 3669469 - RNA, 19 nt, Human
ucagccucccaaagugcug

SEQ ID NO: 3669470 - RNA, 20 nt, Human
ucagccucccaaguagcugg

SEQ ID NO: 3669471 - RNA, 20 nt, Human
ucagccucccgaauagcugg

SEQ ID NO: 3669472 - RNA, 22 nt, Human
ucagccucccgaauagcuggga

SEQ ID NO: 3669473 - RNA, 18 nt, Human
ucagccucccgaguagcu

SEQ ID NO: 3669474 - RNA, 21 nt, Human
ucagccucccgaguagcugag

SEQ ID NO: 3669475 - RNA, 20 nt, Human
ucagccuccggaguagcugg

SEQ ID NO: 3669476 - RNA, 21 nt, Human
ucagccuccugaguagcugga

SEQ ID NO: 3669477 - RNA, 14 nt, Human
ucagccuccugugu

SEQ ID NO: 3669478 - RNA, 16 nt, Human
ucagccuccuguguag

SEQ ID NO: 3669479 - RNA, 21 nt, Human
ucagccucuuaaagcugccug

SEQ ID NO: 3669480 - RNA, 20 nt, Human
ucagccugaggcugagacug

SEQ ID NO: 3669481 - RNA, 19 nt, Human
ucagccuggcuucaaauug

SEQ ID NO: 3669482 - RNA, 10 nt, Human
ucagccuggg

SEQ ID NO: 3669483 - RNA, 19 nt, Human
ucagccugggacaguuuau

SEQ ID NO: 3669484 - RNA, 13 nt, Human
ucagccugggcgc

SEQ ID NO: 3669485 - RNA, 17 nt, Human
ucagccuggugggccuc

SEQ ID NO: 3669486 - RNA, 18 nt, Human
ucagccuggugggccucc

SEQ ID NO: 3669487 - RNA, 17 nt, Human
ucagccugucucuucca

SEQ ID NO: 3669488 - RNA, 12 nt, Human
ucagccugugcu

SEQ ID NO: 3669489 - RNA, 17 nt, Human
ucagccuuaagaaccau

SEQ ID NO: 3669490 - RNA, 22 nt, Human
ucagccuucccccucccagggc

SEQ ID NO: 3669491 - RNA, 22 nt, Human
ucagccuuccccuugcccaggg

SEQ ID NO: 3669492 - RNA, 17 nt, Human
ucagccuugccagagau

SEQ ID NO: 3669493 - RNA, 22 nt, Human
ucagccuuggauaaugcuguug

SEQ ID NO: 3669494 - RNA, 23 nt, Human
ucagcgacuccguuggccacucc

SEQ ID NO: 3669495 - RNA, 14 nt, Human
ucagcgccuggccu

SEQ ID NO: 3669496 - RNA, 14 nt, Human
ucagcguugcaugu

SEQ ID NO: 3669497 - RNA, 15 nt, Human
ucagcuaagcucacg

SEQ ID NO: 3669498 - RNA, 19 nt, Human
ucagcuaagggaagacauu

SEQ ID NO: 3669499 - RNA, 23 nt, Human
ucagcuaagggaagacauuucuu

SEQ ID NO: 3669500 - RNA, 19 nt, Human
ucagcuacccacuauccuu

SEQ ID NO: 3669501 - RNA, 19 nt, Human
ucaggaugagggaaaagaa

SEQ ID NO: 3669502 - RNA, 20 nt, Human
ucaggaugauacacuaugaa

SEQ ID NO: 3669503 - RNA, 13 nt, Human
ucaggaugcccag

SEQ ID NO: 3669504 - RNA, 22 nt, Human
ucaggaugcccagggccacucu

SEQ ID NO: 3669505 - RNA, 20 nt, Human
ucaggcacacaaggggcccu

SEQ ID NO: 3669506 - RNA, 13 nt, Human
ucaggcacagguc

SEQ ID NO: 3669507 - RNA, 19 nt, Human
ucaggcaccagucccuguc

SEQ ID NO: 3669508 - RNA, 15 nt, Human
ucaggcacuagccuu

SEQ ID NO: 3669509 - RNA, 18 nt, Human
ucaggcacugggcaugag

SEQ ID NO: 3669510 - RNA, 12 nt, Human
ucaggcagccag

SEQ ID NO: 3669511 - RNA, 13 nt, Human
ucaggcagccagu

SEQ ID NO: 3669512 - RNA, 23 nt, Human
ucaggcaggcaccuagcaauucc

SEQ ID NO: 3669513 - RNA, 16 nt, Human
ucaggcaggggccucc

SEQ ID NO: 3669514 - RNA, 18 nt, Human
ucaggcauaggccugggu

SEQ ID NO: 3669515 - RNA, 22 nt, Human
ucaggcauaggccugggugcug

SEQ ID NO: 3669516 - RNA, 17 nt, Human
ucaggcauuuucccccu

SEQ ID NO: 3669517 - RNA, 19 nt, Human
ucaggccaccugcccccuu

SEQ ID NO: 3669518 - RNA, 17 nt, Human
ucaggccacggcagccu

SEQ ID NO: 3669519 - RNA, 13 nt, Human
ucaggccacuuga

SEQ ID NO: 3669520 - RNA, 20 nt, Human
ucaggccagcugcuugggcu

SEQ ID NO: 3669521 - RNA, 13 nt, Human
ucaggccaggccc

SEQ ID NO: 3669522 - RNA, 19 nt, Human
ucaggccaggcccucugcc

SEQ ID NO: 3669523 - RNA, 22 nt, Human
ucaggccaggcccucugcccac

SEQ ID NO: 3669524 - RNA, 19 nt, Human
ucaggccaggugcaguggc

SEQ ID NO: 3669525 - RNA, 22 nt, Human
ucaggccaucaucaguggagcc

SEQ ID NO: 3669526 - RNA, 20 nt, Human
ucaggcccccaccuggcuca

SEQ ID NO: 3669527 - RNA, 19 nt, Human
ucaggcccccgccuuggcc

SEQ ID NO: 3669528 - RNA, 20 nt, Human
ucaggcccccgccuuggccu

SEQ ID NO: 3669529 - RNA, 21 nt, Human
ucaggccggcagccccagccu

SEQ ID NO: 3669530 - RNA, 17 nt, Human
ucaggccucccucucuc

SEQ ID NO: 3669531 - RNA, 11 nt, Human
ucaggccucug

SEQ ID NO: 3669532 - RNA, 21 nt, Human
ucaggccugggggcugggcag

SEQ ID NO: 3669533 - RNA, 18 nt, Human
ucaggccuuugagcucag

SEQ ID NO: 3669534 - RNA, 15 nt, Human
ucaggcuccauuagg

SEQ ID NO: 3669535 - RNA, 16 nt, Human
ucaggcucuucuccuu

SEQ ID NO: 3669536 - RNA, 20 nt, Human
ucaggcugcagcuggacaga

SEQ ID NO: 3669537 - RNA, 12 nt, Human
ucaggcugccug

SEQ ID NO: 3669538 - RNA, 16 nt, Human
ucaggcugcuggagga

SEQ ID NO: 3669539 - RNA, 19 nt, Human
ucaggcugcuggaggaaaa

SEQ ID NO: 3669540 - RNA, 14 nt, Human
ucaggcugcuggcg

SEQ ID NO: 3669541 - RNA, 19 nt, Human
ucaggcugcuggcgccucu

SEQ ID NO: 3669542 - RNA, 22 nt, Human
ucaggcugcuggcgccucugca

SEQ ID NO: 3669543 - RNA, 18 nt, Human
ucaggcuugaaaugcauu

SEQ ID NO: 3669544 - RNA, 15 nt, Human
ucaggcuugauaaua

SEQ ID NO: 3669545 - RNA, 20 nt, Human
ucaggcuuucacuauuuccu

SEQ ID NO: 3669546 - RNA, 19 nt, Human
ucagggaaaagcagcucuc

SEQ ID NO: 3669547 - RNA, 18 nt, Human
ucagggaaagugggacag

SEQ ID NO: 3669548 - RNA, 22 nt, Human
ucagggaaccguuauuauaauu

SEQ ID NO: 3669549 - RNA, 15 nt, Human
ucagggaagcccagc

SEQ ID NO: 3669550 - RNA, 21 nt, Human
ucagggaagcccagcuccagg

SEQ ID NO: 3669551 - RNA, 16 nt, Human
ucagggaccacagcaa

SEQ ID NO: 3669552 - RNA, 21 nt, Human
ucagggagcagggaaggccug

SEQ ID NO: 3669553 - RNA, 22 nt, Human
ucagggagugcuggcucacagu

SEQ ID NO: 3669554 - RNA, 15 nt, Human
ucagggaucuugcau

SEQ ID NO: 3669555 - RNA, 20 nt, Human
ucagggauuuuuuuuuuaaa

SEQ ID NO: 3669556 - RNA, 14 nt, Human
ucagggcagauuuu

SEQ ID NO: 3669557 - RNA, 15 nt, Human
ucagggcagccugcc

SEQ ID NO: 3669558 - RNA, 19 nt, Human
ucagggcagcgccaggcug

SEQ ID NO: 3669559 - RNA, 17 nt, Human
ucagggccaggccucuc

SEQ ID NO: 3669560 - RNA, 14 nt, Human
ucagggccaugccu

SEQ ID NO: 3669561 - RNA, 13 nt, Human
ucagggccaugcu

SEQ ID NO: 3669562 - RNA, 15 nt, Human
ucagggcccaagucc

SEQ ID NO: 3669563 - RNA, 18 nt, Human
ucagggcccaagucccug

SEQ ID NO: 3669564 - RNA, 19 nt, Human
ucagggcccaagucccugu

SEQ ID NO: 3669565 - RNA, 13 nt, Human
ucagggcccagag

SEQ ID NO: 3669566 - RNA, 20 nt, Human
ucagggcuccugccuucugu

SEQ ID NO: 3669567 - RNA, 12 nt, Human
ucagggcugaca

SEQ ID NO: 3669568 - RNA, 22 nt, Human
ucagggcuucuaguuucucuua

SEQ ID NO: 3669569 - RNA, 18 nt, Human
ucaggggacucagcccug

SEQ ID NO: 3669570 - RNA, 18 nt, Human
ucaggggcccuggagcag

SEQ ID NO: 3669571 - RNA, 20 nt, Human
ucaggggcugcccgcuccca

SEQ ID NO: 3669572 - RNA, 14 nt, Human
ucaggggcuguuug

SEQ ID NO: 3669573 - RNA, 12 nt, Human
ucagggggccag

SEQ ID NO: 3669574 - RNA, 13 nt, Human
ucagggggccagg

SEQ ID NO: 3669575 - RNA, 17 nt, Human
ucagggggcgccugugg

SEQ ID NO: 3669576 - RNA, 20 nt, Human
ucagggggguugugaggccu

SEQ ID NO: 3669577 - RNA, 17 nt, Human
ucaggggugacacagac

SEQ ID NO: 3669578 - RNA, 18 nt, Human
ucaggggugacacagacu

SEQ ID NO: 3669579 - RNA, 19 nt, Human
ucaggggugacacagacuc

SEQ ID NO: 3669580 - RNA, 19 nt, Human
ucaggggugugcggccuuu

SEQ ID NO: 3669581 - RNA, 23 nt, Human
ucaggggugugcggccuuuggcu

SEQ ID NO: 3669582 - RNA, 18 nt, Human
ucagggguucgagaccag

SEQ ID NO: 3669583 - RNA, 13 nt, Human
ucagggucccugg

SEQ ID NO: 3669584 - RNA, 18 nt, Human
ucagggucccugguggca

SEQ ID NO: 3669585 - RNA, 12 nt, Human
ucagggucucug

SEQ ID NO: 3669586 - RNA, 22 nt, Human
ucagggugcagcccaaucugcc

SEQ ID NO: 3669587 - RNA, 16 nt, Human
ucaggguuggccccug

SEQ ID NO: 3669588 - RNA, 15 nt, Human
ucagguaacaggcag

SEQ ID NO: 3669589 - RNA, 23 nt, Human
ucagguaacaggcagauacagga

SEQ ID NO: 3669590 - RNA, 18 nt, Human
ucagguaaucgaccugcc

SEQ ID NO: 3669591 - RNA, 19 nt, Human
ucagguaaucgaccugccu

SEQ ID NO: 3669592 - RNA, 17 nt, Human
ucagguacagagaagga

SEQ ID NO: 3669593 - RNA, 16 nt, Human
ucagguaguacuaaga

SEQ ID NO: 3669594 - RNA, 19 nt, Human
ucagguaguugcaauugaa

SEQ ID NO: 3669595 - RNA, 15 nt, Human
ucagguauguugccu

SEQ ID NO: 3669596 - RNA, 15 nt, Human
ucagguauuaagaaa

SEQ ID NO: 3669597 - RNA, 16 nt, Human
ucagguccucagagaa

SEQ ID NO: 3669598 - RNA, 16 nt, Human
ucagguccugcucagc

SEQ ID NO: 3669599 - RNA, 18 nt, Human
ucagguccugcucagcag

SEQ ID NO: 3669600 - RNA, 19 nt, Human
ucaggucucccacguggga

SEQ ID NO: 3669601 - RNA, 21 nt, Human
ucaggucucccacgugggaga

SEQ ID NO: 3669602 - RNA, 17 nt, Human
ucaggugaaaauguuca

SEQ ID NO: 3669603 - RNA, 16 nt, Human
ucaggugacaugugaa

SEQ ID NO: 3669604 - RNA, 17 nt, Human
ucaggugacaugugaaa

SEQ ID NO: 3669605 - RNA, 21 nt, Human
ucaggugacaugugaaaccuu

SEQ ID NO: 3669606 - RNA, 22 nt, Human
ucaggugaccaaaauccccuuc

SEQ ID NO: 3669607 - RNA, 23 nt, Human
ucaggugagaagcagaggaagga

SEQ ID NO: 3669608 - RNA, 16 nt, Human
ucaggugauccaccca

SEQ ID NO: 3669609 - RNA, 15 nt, Human
ucaggugcuggggcc

SEQ ID NO: 3669610 - RNA, 16 nt, Human
ucagguggggcagcuu

SEQ ID NO: 3669611 - RNA, 18 nt, Human
ucagguggggcagcuuga

SEQ ID NO: 3669612 - RNA, 21 nt, Human
ucagguggggcagcuugaggg

SEQ ID NO: 3669613 - RNA, 15 nt, Human
ucaggugucccugca

SEQ ID NO: 3669614 - RNA, 18 nt, Human
ucaggugucccugcacuu

SEQ ID NO: 3669615 - RNA, 18 nt, Human
ucagguucaguauuaugu

SEQ ID NO: 3669616 - RNA, 16 nt, Human
ucagguucuccuugau

SEQ ID NO: 3669617 - RNA, 15 nt, Human
ucagguugcugguug

SEQ ID NO: 3669618 - RNA, 17 nt, Human
ucagguugcugguugcu

SEQ ID NO: 3669619 - RNA, 19 nt, Human
ucagguuguaguaaagaaa

SEQ ID NO: 3669620 - RNA, 15 nt, Human
ucagguuuaacauuu

SEQ ID NO: 3669621 - RNA, 17 nt, Human
ucagguuugaguagagg

SEQ ID NO: 3669622 - RNA, 14 nt, Human
ucagguuuguuuug

SEQ ID NO: 3669623 - RNA, 19 nt, Human
ucagguuuucuuuuaagaa

SEQ ID NO: 3669624 - RNA, 20 nt, Human
ucagguuuucuuuuaagaau

SEQ ID NO: 3669625 - RNA, 23 nt, Human
ucaaguauuauaccuuuuuuaga

SEQ ID NO: 3669626 - RNA, 15 nt, Human
ucaaguauuggcaaa

SEQ ID NO: 3669627 - RNA, 16 nt, Human
ucaaguauuuaagccu

SEQ ID NO: 3669628 - RNA, 22 nt, Human
ucaaguauuuaagccuaaagau

SEQ ID NO: 3669629 - RNA, 12 nt, Human
ucaaguauuugg

SEQ ID NO: 3669630 - RNA, 15 nt, Human
ucaagucacucccaa

SEQ ID NO: 3669631 - RNA, 22 nt, Human
ucaaguccucuuuucugagagg

SEQ ID NO: 3669632 - RNA, 18 nt, Human
ucaaguccuuaccucuuc

SEQ ID NO: 3669633 - RNA, 20 nt, Human
ucaagucuuucucuuucccu

SEQ ID NO: 3669634 - RNA, 23 nt, Human
ucaagucuuucucuuucccuggu

SEQ ID NO: 3669635 - RNA, 23 nt, Human
ucaagugaaaaaggaggaagaga

SEQ ID NO: 3669636 - RNA, 15 nt, Human
ucaagugaaucuaaa

SEQ ID NO: 3669637 - RNA, 20 nt, Human
ucaagugaucugcccaccuc

SEQ ID NO: 3669638 - RNA, 21 nt, Human
ucaagugauucucaugccuca

SEQ ID NO: 3669639 - RNA, 20 nt, Human
ucaagugauucuccugccuc

SEQ ID NO: 3669640 - RNA, 21 nt, Human
ucaagugauucuccugccuca

SEQ ID NO: 3669641 - RNA, 19 nt, Human
ucaagugcaugcucucugc

SEQ ID NO: 3669642 - RNA, 21 nt, Human
ucaagugcaugcucucugcag

SEQ ID NO: 3669643 - RNA, 22 nt, Human
ucaagugcaugcucucugcagc

SEQ ID NO: 3669644 - RNA, 23 nt, Human
ucaagugcccucuccgagcuggu

SEQ ID NO: 3669645 - RNA, 20 nt, Human
ucacucccuucuaccugcca

SEQ ID NO: 3669646 - RNA, 23 nt, Human
ucacucccuucuccuugauaaca

SEQ ID NO: 3669647 - RNA, 14 nt, Human
ucacuccggugugc

SEQ ID NO: 3669648 - RNA, 19 nt, Human
ucacuccggugugccugca

SEQ ID NO: 3669649 - RNA, 23 nt, Human
ucacuccggugugccugcagccc

SEQ ID NO: 3669650 - RNA, 19 nt, Human
ucacuccugagaccccugg

SEQ ID NO: 3669651 - RNA, 13 nt, Human
ucacuccugcugu

SEQ ID NO: 3669652 - RNA, 15 nt, Human
ucacuccugcuguaa

SEQ ID NO: 3669653 - RNA, 14 nt, Human
ucacucggcacccu

SEQ ID NO: 3669654 - RNA, 17 nt, Human
ucacucuaagauguuau

SEQ ID NO: 3669655 - RNA, 22 nt, Human
ucacucuaagauguuauauuuu

SEQ ID NO: 3669656 - RNA, 20 nt, Human
ucacucuagucaaugacaug

SEQ ID NO: 3669657 - RNA, 12 nt, Human
ucacucucagga

SEQ ID NO: 3669658 - RNA, 13 nt, Human
ucacucucagugc

SEQ ID NO: 3669659 - RNA, 14 nt, Human
ucacucuccuuggu

SEQ ID NO: 3669660 - RNA, 15 nt, Human
ucacucucugaagau

SEQ ID NO: 3669661 - RNA, 11 nt, Human
ucacucugcca

SEQ ID NO: 3669662 - RNA, 21 nt, Human
ucacucugccagggcagugcu

SEQ ID NO: 3669663 - RNA, 14 nt, Human
ucacucugcuaccu

SEQ ID NO: 3669664 - RNA, 14 nt, Human
ucacucugcugcuu

SEQ ID NO: 3669665 - RNA, 12 nt, Human
ucacucuggcag

SEQ ID NO: 3669666 - RNA, 14 nt, Human
ucacucuggcagcu

SEQ ID NO: 3669667 - RNA, 13 nt, Human
ucacucugggcug

SEQ ID NO: 3669668 - RNA, 21 nt, Human
ucacucuguucauuccuccag

SEQ ID NO: 3669669 - RNA, 12 nt, Human
ucacucuuaggc

SEQ ID NO: 3669670 - RNA, 23 nt, Human
ucacucuuauugcccacgcugga

SEQ ID NO: 3669671 - RNA, 17 nt, Human
ucacucuuccagaaucc

SEQ ID NO: 3669672 - RNA, 21 nt, Human
ucacucuuccagaaucccaag

SEQ ID NO: 3669673 - RNA, 17 nt, Human
ucacucuucucagccac

SEQ ID NO: 3669674 - RNA, 17 nt, Human
ucacucuuggagccugc

SEQ ID NO: 3669675 - RNA, 18 nt, Human
ucacucuuggagccugca

SEQ ID NO: 3669676 - RNA, 21 nt, Human
ucacucuuguggauguuuuaa

SEQ ID NO: 3669677 - RNA, 11 nt, Human
ucacucuuuau

SEQ ID NO: 3669678 - RNA, 18 nt, Human
ucacugaaauaaaagcua

SEQ ID NO: 3669679 - RNA, 23 nt, Human
ucacugaaugcuucugacuucau

SEQ ID NO: 3669680 - RNA, 16 nt, Human
ucacugacacaaagga

SEQ ID NO: 3669681 - RNA, 11 nt, Human
ucauguuuggu

SEQ ID NO: 3669682 - RNA, 19 nt, Human
ucauguuuggugcauagaa

SEQ ID NO: 3669683 - RNA, 21 nt, Human
ucauguuuuaaagcuugcuca

SEQ ID NO: 3669684 - RNA, 13 nt, Human
ucauguuuuaaca

SEQ ID NO: 3669685 - RNA, 14 nt, Human
ucauguuuuaacaa

SEQ ID NO: 3669686 - RNA, 16 nt, Human
ucauguuuuaacaaaa

SEQ ID NO: 3669687 - RNA, 18 nt, Human
ucauguuuuaacaaaaac

SEQ ID NO: 3669688 - RNA, 15 nt, Human
ucauguuuugugacu

SEQ ID NO: 3669689 - RNA, 12 nt, Human
ucauguuuuuga

SEQ ID NO: 3669690 - RNA, 15 nt, Human
ucauguuuuugauca

SEQ ID NO: 3669691 - RNA, 17 nt, Human
ucauuaaacuuuuuuaa

SEQ ID NO: 3669692 - RNA, 15 nt, Human
ucauuaaagacagga

SEQ ID NO: 3669693 - RNA, 15 nt, Human
ucauuaaagcauuua

SEQ ID NO: 3669694 - RNA, 13 nt, Human
ucauuaaaguucu

SEQ ID NO: 3669695 - RNA, 14 nt, Human
ucauuaaauuaccu

SEQ ID NO: 3669696 - RNA, 18 nt, Human
ucauuaagcccucuucca

SEQ ID NO: 3669697 - RNA, 13 nt, Human
ucauuaaugacac

SEQ ID NO: 3669698 - RNA, 15 nt, Human
ucauuaaugacacuu

SEQ ID NO: 3669699 - RNA, 19 nt, Human
ucauuaaugacacuugucc

SEQ ID NO: 3669700 - RNA, 14 nt, Human
ucauuaauguguug

SEQ ID NO: 3669701 - RNA, 15 nt, Human
ucauuaauuaacccc

SEQ ID NO: 3669702 - RNA, 15 nt, Human
ucauuacccuucccu

SEQ ID NO: 3669703 - RNA, 22 nt, Human
ucauuaccuuuuaccagcuuuu

SEQ ID NO: 3669704 - RNA, 12 nt, Human
ucauuacuaaaa

SEQ ID NO: 3669705 - RNA, 15 nt, Human
ucauuacuugauuaa

SEQ ID NO: 3669706 - RNA, 17 nt, Human
ucauuacuuguugccua

SEQ ID NO: 3669707 - RNA, 16 nt, Human
ucauuacuuuugaagu

SEQ ID NO: 3669708 - RNA, 18 nt, Human
ucauuagacuccuccucc

SEQ ID NO: 3669709 - RNA, 13 nt, Human
ucauuagagcagg

SEQ ID NO: 3669710 - RNA, 15 nt, Human
ucauuagagcaggcg

SEQ ID NO: 3669711 - RNA, 19 nt, Human
ucauuagccugaguagaaa

SEQ ID NO: 3669712 - RNA, 20 nt, Human
ucauuagccugaguagaaag

SEQ ID NO: 3669713 - RNA, 17 nt, Human
ucauuagcugugauuuu

SEQ ID NO: 3669714 - RNA, 16 nt, Human
ucauuaggauggcuag

SEQ ID NO: 3669715 - RNA, 22 nt, Human
ucauuagucauguuuaucugcu

SEQ ID NO: 3669716 - RNA, 23 nt, Human
ucauuaguuuugaagauucuaug

SEQ ID NO: 3669717 - RNA, 17 nt, Human
ucauuauagauccccca

SEQ ID NO: 3669718 - RNA, 20 nt, Human
ucauuaucucaaaacugcac

SEQ ID NO: 3669719 - RNA, 22 nt, Human
ucauuaugcacuugggagaaaa

SEQ ID NO: 3669720 - RNA, 18 nt, Human
ucauuauuggaauuaacc

SEQ ID NO: 3669721 - RNA, 21 nt, Human
ucauuauuggaauuaaccugg

SEQ ID NO: 3669722 - RNA, 11 nt, Human
ucauuauuuau

SEQ ID NO: 3669723 - RNA, 22 nt, Human
ucauuauuuauguauugugcaa

SEQ ID NO: 3669724 - RNA, 18 nt, Human
ucauuauuuauuaaauuu

SEQ ID NO: 3669725 - RNA, 16 nt, Human
ucauuauuugcagaga

SEQ ID NO: 3669726 - RNA, 13 nt, Human
ucauuauuuuauu

SEQ ID NO: 3669727 - RNA, 17 nt, Human
ucauuauuuuuccacuu

SEQ ID NO: 3669728 - RNA, 18 nt, Human
ucauucaaaaguugaaau

SEQ ID NO: 3669729 - RNA, 22 nt, Human
ucauucaaaaguugaaauuaac

SEQ ID NO: 3669730 - RNA, 21 nt, Human
ucauucaacccaccugcgucu

SEQ ID NO: 3669731 - RNA, 16 nt, Human
ucauucaauauugaca

SEQ ID NO: 3669732 - RNA, 20 nt, Human
ucauucaauauugacauuug

SEQ ID NO: 3669733 - RNA, 20 nt, Human
ucauucacaucgcagauucu

SEQ ID NO: 3669734 - RNA, 14 nt, Human
ucauucagaaaaaa

SEQ ID NO: 3669735 - RNA, 14 nt, Human
ucauucagaaaugu

SEQ ID NO: 3669736 - RNA, 14 nt, Human
ucauucagagucag

SEQ ID NO: 3669737 - RNA, 20 nt, Human
ucauucagagucagccagga

SEQ ID NO: 3669738 - RNA, 19 nt, Human
ucauucagcagcaaauuuu

SEQ ID NO: 3669739 - RNA, 21 nt, Human
ucauucagcagcaaauuuuca

SEQ ID NO: 3669740 - RNA, 15 nt, Human
ucauucauacuuaaa

SEQ ID NO: 3669741 - RNA, 19 nt, Human
ucauucauacuuaaaaauu

SEQ ID NO: 3669742 - RNA, 20 nt, Human
ucauucauauuacaauauuu

SEQ ID NO: 3669743 - RNA, 16 nt, Human
ucauucauuuauucau

SEQ ID NO: 3669744 - RNA, 14 nt, Human
ucauucauuuuaua

SEQ ID NO: 3669745 - RNA, 20 nt, Human
ucauucauuuuauauugaaa

SEQ ID NO: 3669746 - RNA, 21 nt, Human
ucauuccaacuucccaguuca

SEQ ID NO: 3669747 - RNA, 14 nt, Human
ucauuccagaggaa

SEQ ID NO: 3669748 - RNA, 18 nt, Human
ucauuccaugugcccagu

SEQ ID NO: 3669749 - RNA, 19 nt, Human
ucauuccaugugcccaguu

SEQ ID NO: 3669750 - RNA, 20 nt, Human
ucauuccaugugcccaguua

SEQ ID NO: 3669751 - RNA, 16 nt, Human
ucauuccauucuggaa

SEQ ID NO: 3669752 - RNA, 13 nt, Human
ucauuccauugcc

SEQ ID NO: 3669753 - RNA, 19 nt, Human
ucauucccucgucuuuccc

SEQ ID NO: 3669754 - RNA, 20 nt, Human
ucauucccuucgacagcauu

SEQ ID NO: 3669755 - RNA, 21 nt, Human
ucauucccuucgacagcauuu

SEQ ID NO: 3669756 - RNA, 22 nt, Human
ucauucccuucgacagcauuuu

SEQ ID NO: 3669757 - RNA, 17 nt, Human
ucauuccguugucugug

SEQ ID NO: 3669758 - RNA, 12 nt, Human
ucauuccuccag

SEQ ID NO: 3669759 - RNA, 14 nt, Human
ucauuccuccaggu

SEQ ID NO: 3669760 - RNA, 20 nt, Human
ucauuccugaaagaaacagu

SEQ ID NO: 3669761 - RNA, 13 nt, Human
ucauuccugccug

SEQ ID NO: 3669762 - RNA, 21 nt, Human
ucauuccuucuuuuuaaaaug

SEQ ID NO: 3669763 - RNA, 23 nt, Human
ucauuccuugagaaaaacaauga

SEQ ID NO: 3669764 - RNA, 23 nt, Human
ucauucgcuacuaugauuuaauu

SEQ ID NO: 3669765 - RNA, 18 nt, Human
ucauucgggccccaccug

SEQ ID NO: 3669766 - RNA, 13 nt, Human
ucauucuaaagau

SEQ ID NO: 3669767 - RNA, 15 nt, Human
ucauucuaucaagcc

SEQ ID NO: 3669768 - RNA, 15 nt, Human
ucauucuccugccug

SEQ ID NO: 3669769 - RNA, 16 nt, Human
ucauucugcaaguaua

SEQ ID NO: 3669770 - RNA, 19 nt, Human
ucauucugcauugcuagau

SEQ ID NO: 3669771 - RNA, 22 nt, Human
ucauucugcauugcuagauaaa

SEQ ID NO: 3669772 - RNA, 18 nt, Human
ucauucuuauuucaugaa

SEQ ID NO: 3669773 - RNA, 12 nt, Human
ucauucuucugu

SEQ ID NO: 3669774 - RNA, 14 nt, Human
ucauugaaauguca

SEQ ID NO: 3669775 - RNA, 17 nt, Human
ucauugaagucagaugu

SEQ ID NO: 3669776 - RNA, 18 nt, Human
ucauugaauuauaaaagc

SEQ ID NO: 3669777 - RNA, 12 nt, Human
ucauugaccuga

SEQ ID NO: 3669778 - RNA, 14 nt, Human
ucauugaccugagg

SEQ ID NO: 3669779 - RNA, 22 nt, Human
ucauugaccugaggcccuucuc

SEQ ID NO: 3669780 - RNA, 21 nt, Human
ucauugacuuuuauaaagcau

SEQ ID NO: 3669781 - RNA, 24 nt, Human
ucauugacuuuuauaaagcauguu

SEQ ID NO: 3669782 - RNA, 18 nt, Human
ucauugagaguuuugucu

SEQ ID NO: 3669783 - RNA, 19 nt, Human
ucauugagaguuuugucuu

SEQ ID NO: 3669784 - RNA, 19 nt, Human
ucauugauaugaaaaauau

SEQ ID NO: 3669785 - RNA, 13 nt, Human
ucauugccagugu

SEQ ID NO: 3669786 - RNA, 16 nt, Human
ucauugccagugucuu

SEQ ID NO: 3669787 - RNA, 17 nt, Human
ucauugccagugucuuu

SEQ ID NO: 3669788 - RNA, 22 nt, Human
ucauugccagugucuuucuuug

SEQ ID NO: 3669789 - RNA, 17 nt, Human
ucauugccuuaacugga

SEQ ID NO: 3669790 - RNA, 17 nt, Human
gcuccuggacucauugc

SEQ ID NO: 3669791 - RNA, 18 nt, Human
gcuccuggagccuuugaa

SEQ ID NO: 3669792 - RNA, 18 nt, Human
gcuccuggcccacugcau

SEQ ID NO: 3669793 - RNA, 14 nt, Human
gcuccugucugcca

SEQ ID NO: 3669794 - RNA, 19 nt, Human
gcuccugucugccagccag

SEQ ID NO: 3669795 - RNA, 20 nt, Human
gcuccugucugccagccagc

SEQ ID NO: 3669796 - RNA, 12 nt, Human
gcuccugugccc

SEQ ID NO: 3669797 - RNA, 13 nt, Human
gcuccugugcccu

SEQ ID NO: 3669798 - RNA, 16 nt, Human
gcuccugugcuuuccc

SEQ ID NO: 3669799 - RNA, 15 nt, Human
gcuccuguggcccca

SEQ ID NO: 3669800 - RNA, 13 nt, Human
gcuccugugucuu

SEQ ID NO: 3669801 - RNA, 22 nt, Human
gcuccuguuuugcacagccaaa

SEQ ID NO: 3669802 - RNA, 16 nt, Human
gcuccuuagcugccaa

SEQ ID NO: 3669803 - RNA, 19 nt, Human
gcuccuucccuugcuacca

SEQ ID NO: 3669804 - RNA, 20 nt, Human
gcuccuuccucugaggcuga

SEQ ID NO: 3669805 - RNA, 19 nt, Human
gcuccuuccugucuuccug

SEQ ID NO: 3669806 - RNA, 21 nt, Human
gcuccuucucucuuacauuga

SEQ ID NO: 3669807 - RNA, 20 nt, Human
gcuccuugggaggaagcaga

SEQ ID NO: 3669808 - RNA, 15 nt, Human
gcuccuugugccaga

SEQ ID NO: 3669809 - RNA, 16 nt, Human
gcuccuugugggccug

SEQ ID NO: 3669810 - RNA, 22 nt, Human
gcuccuugugggccugggcucc

SEQ ID NO: 3669811 - RNA, 23 nt, Human
gcuccuuuacaaaagaaauaccu

SEQ ID NO: 3669812 - RNA, 13 nt, Human
gcuccuuuccccu

SEQ ID NO: 3669813 - RNA, 16 nt, Human
gcuccuuucuccagcc

SEQ ID NO: 3669814 - RNA, 18 nt, Human
gcuccuuucuccagccag

SEQ ID NO: 3669815 - RNA, 19 nt, Human
gcuccuuucuccagccagc

SEQ ID NO: 3669816 - RNA, 20 nt, Human
gcuccuuucuccagccagca

SEQ ID NO: 3669817 - RNA, 19 nt, Human
gcuccuuucugaucuucac

SEQ ID NO: 3669818 - RNA, 13 nt, Human
gcuccuuugugug

SEQ ID NO: 3669819 - RNA, 22 nt, Human
gcuccuuugugugugugucagc

SEQ ID NO: 3669820 - RNA, 18 nt, Human
gcucgacuauagaaaacu

SEQ ID NO: 3669821 - RNA, 19 nt, Human
gcucgagcaugccuggaug

SEQ ID NO: 3669822 - RNA, 16 nt, Human
gcucgaggggugggcu

SEQ ID NO: 3669823 - RNA, 20 nt, Human
gcucgauccaaauugugcuu

SEQ ID NO: 3669824 - RNA, 20 nt, Human
gcucgcaccccccuguucua

SEQ ID NO: 3669825 - RNA, 13 nt, Human
gcucgccaugccg

SEQ ID NO: 3669826 - RNA, 16 nt, Human
gcucgcccuccuuucu

SEQ ID NO: 3669827 - RNA, 12 nt, Human
gcucgccuuccc

SEQ ID NO: 3669828 - RNA, 22 nt, Human
gcucgcugcugcgcccugggcu

SEQ ID NO: 3669829 - RNA, 16 nt, Human
gcucgcuguugcugaa

SEQ ID NO: 3669830 - RNA, 23 nt, Human
gcucggagaagagcgcaguguuu

SEQ ID NO: 3669831 - RNA, 18 nt, Human
gcucggaggccccaaagg

SEQ ID NO: 3669832 - RNA, 14 nt, Human
gcucggaggcugcc

SEQ ID NO: 3669833 - RNA, 12 nt, Human
gcucgggcccag

SEQ ID NO: 3669834 - RNA, 15 nt, Human
gcucgggcccaggcc

SEQ ID NO: 3669835 - RNA, 18 nt, Human
gcucggggugcacaggag

SEQ ID NO: 3669836 - RNA, 20 nt, Human
gcucggggugcacaggaggg

SEQ ID NO: 3669837 - RNA, 17 nt, Human
gcucgguacccggggcc

SEQ ID NO: 3669838 - RNA, 21 nt, Human
gcucgucggggggacagcucc

SEQ ID NO: 3669839 - RNA, 19 nt, Human
gcucguguauccuggggcu

SEQ ID NO: 3669840 - RNA, 13 nt, Human
gcucuaaaauauu

SEQ ID NO: 3669841 - RNA, 15 nt, Human
gcucuaaaauauuua

SEQ ID NO: 3669842 - RNA, 19 nt, Human
gcucuaaaauauuuaugaa

SEQ ID NO: 3669843 - RNA, 13 nt, Human
gcucuaacgccug

SEQ ID NO: 3669844 - RNA, 17 nt, Human
gcucuaacgccugagcc

SEQ ID NO: 3669845 - RNA, 18 nt, Human
gcucuaacgccugagccc

SEQ ID NO: 3669846 - RNA, 23 nt, Human
gcucuaacgccugagcccaggga

SEQ ID NO: 3669847 - RNA, 15 nt, Human
gcucuaauguuugca

SEQ ID NO: 3669848 - RNA, 12 nt, Human
gcucuaauugaa

SEQ ID NO: 3669849 - RNA, 22 nt, Human
gcucuacagcuaaucagcauuc

SEQ ID NO: 3669850 - RNA, 18 nt, Human
gcucuacaucuucugccu

SEQ ID NO: 3669851 - RNA, 20 nt, Human
gcucuacaucuucugccuua

SEQ ID NO: 3669852 - RNA, 18 nt, Human
gcucuacccagggccugc

SEQ ID NO: 3669853 - RNA, 12 nt, Human
uccaagauucua

SEQ ID NO: 3669854 - RNA, 11 nt, Human
uccaagcaaag

SEQ ID NO: 3669855 - RNA, 17 nt, Human
uccaagcaaauguuaca

SEQ ID NO: 3669856 - RNA, 17 nt, Human
uccaagcauuuagaugu

SEQ ID NO: 3669857 - RNA, 15 nt, Human
uccaagccagcaagc

SEQ ID NO: 3669858 - RNA, 19 nt, Human
uccaagcccagcccaugga

SEQ ID NO: 3669859 - RNA, 22 nt, Human
uccaagcccaguucagcuuggg

SEQ ID NO: 3669860 - RNA, 23 nt, Human
uccaagccccaucuucuaaaugg

SEQ ID NO: 3669861 - RNA, 17 nt, Human
uccaagcucacucccca

SEQ ID NO: 3669862 - RNA, 14 nt, Human
uccaagcuccaucu

SEQ ID NO: 3669863 - RNA, 13 nt, Human
uccaagcucccag

SEQ ID NO: 3669864 - RNA, 18 nt, Human
uccaagcucccugcccca

SEQ ID NO: 3669865 - RNA, 20 nt, Human
uccaaggaaaccacagcugc

SEQ ID NO: 3669866 - RNA, 19 nt, Human
uccaaggaacuaauuucuu

SEQ ID NO: 3669867 - RNA, 16 nt, Human
uccaaggagaaacaga

SEQ ID NO: 3669868 - RNA, 23 nt, Human
uccaaggagaaacagagacaggc

SEQ ID NO: 3669869 - RNA, 21 nt, Human
uccaaggagcugagaauagaa

SEQ ID NO: 3669870 - RNA, 20 nt, Human
uccaaggaggggcuguaaaa

SEQ ID NO: 3669871 - RNA, 12 nt, Human
uccaaggaguuc

SEQ ID NO: 3669872 - RNA, 23 nt, Human
uccaaggcagaagcagcagggga

SEQ ID NO: 3669873 - RNA, 22 nt, Human
uccaaggcauuuuagcggggag

SEQ ID NO: 3669874 - RNA, 16 nt, Human
uccaaggugauguugu

SEQ ID NO: 3669875 - RNA, 15 nt, Human
uccaagguggucugc

SEQ ID NO: 3669876 - RNA, 14 nt, Human
uccaagucacugca

SEQ ID NO: 3669877 - RNA, 20 nt, Human
uccaagugaacacuagccag

SEQ ID NO: 3669878 - RNA, 21 nt, Human
uccaagugaacacuagccaga

SEQ ID NO: 3669879 - RNA, 20 nt, Human
uccaaguggccuccgucacu

SEQ ID NO: 3669880 - RNA, 11 nt, Human
uccaagugugc

SEQ ID NO: 3669881 - RNA, 13 nt, Human
uccaagugugcau

SEQ ID NO: 3669882 - RNA, 18 nt, Human
uccaagugugugugcgug

SEQ ID NO: 3669883 - RNA, 17 nt, Human
uccaaguuaaauguaga

SEQ ID NO: 3669884 - RNA, 17 nt, Human
uccaaguuguucgggcc

SEQ ID NO: 3669885 - RNA, 15 nt, Human
uccaaguuuccaaac

SEQ ID NO: 3669886 - RNA, 12 nt, Human
uccaauaaacag

SEQ ID NO: 3669887 - RNA, 23 nt, Human
uccaauaaaugugaaauucuguc

SEQ ID NO: 3669888 - RNA, 16 nt, Human
uccaauaggaaugcua

SEQ ID NO: 3669889 - RNA, 21 nt, Human
uccaaucaaucuugcauguaa

SEQ ID NO: 3669890 - RNA, 14 nt, Human
uccaauccucacug

SEQ ID NO: 3669891 - RNA, 16 nt, Human
uccaauccugcccccu

SEQ ID NO: 3669892 - RNA, 18 nt, Human
uccaauccugcccccuga

SEQ ID NO: 3669893 - RNA, 12 nt, Human
uccaaugagcuu

SEQ ID NO: 3669894 - RNA, 15 nt, Human
uccaaugagcuuucu

SEQ ID NO: 3669895 - RNA, 22 nt, Human
uccaaugccacauacuugcagc

SEQ ID NO: 3669896 - RNA, 22 nt, Human
uccaaugccucuugucuuccua

SEQ ID NO: 3669897 - RNA, 19 nt, Human
uccaaugucugcugaggag

SEQ ID NO: 3669898 - RNA, 19 nt, Human
uccaauguuuagcaaauac

SEQ ID NO: 3669899 - RNA, 16 nt, Human
uccaauuaaggauuuu

SEQ ID NO: 3669900 - RNA, 19 nt, Human
uccaauuccuugcacauag

SEQ ID NO: 3669901 - RNA, 15 nt, Human
uccaauucuccuuua

SEQ ID NO: 3669902 - RNA, 17 nt, Human
uccaauuuuaauuuagu

SEQ ID NO: 3669903 - RNA, 18 nt, Human
uccaauuuucuggaauac

SEQ ID NO: 3669904 - RNA, 20 nt, Human
uccacaaaauaaccaauccu

SEQ ID NO: 3669905 - RNA, 14 nt, Human
uccacaaagaaaau

SEQ ID NO: 3669906 - RNA, 21 nt, Human
uccacaaauuauuaaugaaaa

SEQ ID NO: 3669907 - RNA, 16 nt, Human
uccacaagagcccagg

SEQ ID NO: 3669908 - RNA, 21 nt, Human
uccacaagugccgcaaauugu

SEQ ID NO: 3669909 - RNA, 15 nt, Human
uccacacaagggaag

SEQ ID NO: 3669910 - RNA, 18 nt, Human
uccacacacacaaaaaaa

SEQ ID NO: 3669911 - RNA, 21 nt, Human
uccacacacacaaaaaaagac

SEQ ID NO: 3669912 - RNA, 12 nt, Human
uccacacacaga

SEQ ID NO: 3669913 - RNA, 20 nt, Human
uccacacacagcugggcugu

SEQ ID NO: 3669914 - RNA, 15 nt, Human
uccacacacgcagga

SEQ ID NO: 3669915 - RNA, 13 nt, Human
uccacacccccac

SEQ ID NO: 3669916 - RNA, 12 nt, Human
uccacacccgcg

SEQ ID NO: 3669917 - RNA, 22 nt, Human
uccacaccuggcacugcugugc

SEQ ID NO: 3669918 - RNA, 15 nt, Human
uccacaccuuuuauu

SEQ ID NO: 3669919 - RNA, 15 nt, Human
uccacacugcacaau

SEQ ID NO: 3669920 - RNA, 10 nt, Human
uccacagacg

SEQ ID NO: 3669921 - RNA, 15 nt, Human
uccacagauuguuuc

SEQ ID NO: 3669922 - RNA, 16 nt, Human
uccacagauuguuucu

SEQ ID NO: 3669923 - RNA, 15 nt, Human
uccacagccauccca

SEQ ID NO: 3669924 - RNA, 22 nt, Human
uccacagccaucccagccuugg

SEQ ID NO: 3669925 - RNA, 16 nt, Human
uccacagccgcagccu

SEQ ID NO: 3669926 - RNA, 19 nt, Human
uccacagcgagggcagcug

SEQ ID NO: 3669927 - RNA, 23 nt, Human
uccacagcuuccuguccccaucu

SEQ ID NO: 3669928 - RNA, 15 nt, Human
uccacagggucccac

SEQ ID NO: 3669929 - RNA, 16 nt, Human
uccacagggucccaca

SEQ ID NO: 3669930 - RNA, 20 nt, Human
uccacagggucccacagcca

SEQ ID NO: 3669931 - RNA, 17 nt, Human
uccacaggucuagacua

SEQ ID NO: 3669932 - RNA, 20 nt, Human
uccacaguggaaccagccca

SEQ ID NO: 3669933 - RNA, 13 nt, Human
uccacaguucagu

SEQ ID NO: 3669934 - RNA, 23 nt, Human
uccacaguucaguggcagggcuc

SEQ ID NO: 3669935 - RNA, 24 nt, Human
uccauuuuuacaaguuauaguacu

SEQ ID NO: 3669936 - RNA, 15 nt, Human
uccauuuuuuauauu

SEQ ID NO: 3669937 - RNA, 23 nt, Human
uccauuuuuucaagguaauuucu

SEQ ID NO: 3669938 - RNA, 12 nt, Human
ucccaaaagcua

SEQ ID NO: 3669939 - RNA, 17 nt, Human
ucccaaaaucaccguac

SEQ ID NO: 3669940 - RNA, 15 nt, Human
ucccaaaauuguuuu

SEQ ID NO: 3669941 - RNA, 18 nt, Human
ucccaaacccuucagugc

SEQ ID NO: 3669942 - RNA, 22 nt, Human
ucccaaacgcccuuuccuccuc

SEQ ID NO: 3669943 - RNA, 19 nt, Human
ucccaaagccagaaccaga

SEQ ID NO: 3669944 - RNA, 16 nt, Human
ucccaaaggacuccac

SEQ ID NO: 3669945 - RNA, 22 nt, Human
ucccaaaggacuccacccaucc

SEQ ID NO: 3669946 - RNA, 21 nt, Human
ucccaaaguccugggauuaca

SEQ ID NO: 3669947 - RNA, 18 nt, Human
ucccaaagugcugagauu

SEQ ID NO: 3669948 - RNA, 20 nt, Human
ucccaaagugcugagauuac

SEQ ID NO: 3669949 - RNA, 14 nt, Human
ucccaaagugcugg

SEQ ID NO: 3669950 - RNA, 19 nt, Human
ucccaaauccuucccaagu

SEQ ID NO: 3669951 - RNA, 20 nt, Human
ucccaaaugugugcccagcu

SEQ ID NO: 3669952 - RNA, 21 nt, Human
ucccaaaugugugcccagcuu

SEQ ID NO: 3669953 - RNA, 15 nt, Human
ucccaacaagcagcu

SEQ ID NO: 3669954 - RNA, 14 nt, Human
ucccaacacugcca

SEQ ID NO: 3669955 - RNA, 18 nt, Human
ucccaacacuucagacug

SEQ ID NO: 3669956 - RNA, 15 nt, Human
ucccaacagccaugc

SEQ ID NO: 3669957 - RNA, 17 nt, Human
ucccaacagccaugccc

SEQ ID NO: 3669958 - RNA, 16 nt, Human
ucccaacagucauguu

SEQ ID NO: 3669959 - RNA, 11 nt, Human
ucccaacaucg

SEQ ID NO: 3669960 - RNA, 14 nt, Human
ucccaaccagugcc

SEQ ID NO: 3669961 - RNA, 15 nt, Human
ucccaacccuggcuu

SEQ ID NO: 3669962 - RNA, 13 nt, Human
ucccaacucaccc

SEQ ID NO: 3669963 - RNA, 16 nt, Human
ucccaacucaccccag

SEQ ID NO: 3669964 - RNA, 17 nt, Human
ucccaacucaccccagc

SEQ ID NO: 3669965 - RNA, 18 nt, Human
ucccaacucaccccagcc

SEQ ID NO: 3669966 - RNA, 20 nt, Human
ucccaacuugccuuugaaga

SEQ ID NO: 3669967 - RNA, 14 nt, Human
ucccaacuuguaaa

SEQ ID NO: 3669968 - RNA, 19 nt, Human
ucccaagaacagcaggccc

SEQ ID NO: 3669969 - RNA, 21 nt, Human
ucccaagaacagcaggcccac

SEQ ID NO: 3669970 - RNA, 22 nt, Human
ucccaagaacagcaggcccacc

SEQ ID NO: 3669971 - RNA, 23 nt, Human
ucccaagaacagcaggcccaccu

SEQ ID NO: 3669972 - RNA, 13 nt, Human
ucccaagaaugca

SEQ ID NO: 3669973 - RNA, 14 nt, Human
ucccaagauguuga

SEQ ID NO: 3669974 - RNA, 23 nt, Human
ucccaagauguugauuuuuacug

SEQ ID NO: 3669975 - RNA, 14 nt, Human
ucccaagauuuuuu

SEQ ID NO: 3669976 - RNA, 20 nt, Human
ucccaagcaccugggauuac

SEQ ID NO: 3669977 - RNA, 20 nt, Human
ucccaagcuaucuaaaguuu

SEQ ID NO: 3669978 - RNA, 12 nt, Human
ucccaagcucug

SEQ ID NO: 3669979 - RNA, 14 nt, Human
ucccaagcucugcu

SEQ ID NO: 3669980 - RNA, 20 nt, Human
ucccaagcuggagugcagug

SEQ ID NO: 3669981 - RNA, 13 nt, Human
ucccaagcuggcu

SEQ ID NO: 3669982 - RNA, 16 nt, Human
ucccaagcuggcuggg

SEQ ID NO: 3669983 - RNA, 17 nt, Human
ucccaagcuggcugggg

SEQ ID NO: 3669984 - RNA, 16 nt, Human
ucccaagcugggcccc

SEQ ID NO: 3669985 - RNA, 22 nt, Human
ucccaagcugggccccagccca

SEQ ID NO: 3669986 - RNA, 12 nt, Human
ucccaaggaaag

SEQ ID NO: 3669987 - RNA, 17 nt, Human
ucccaaggagaacaaau

SEQ ID NO: 3669988 - RNA, 22 nt, Human
ucccaaggcucugagcaaaugu

SEQ ID NO: 3669989 - RNA, 18 nt, Human
ucccaagggauggugccc

SEQ ID NO: 3669990 - RNA, 19 nt, Human
ucccaaggggccugagcag

SEQ ID NO: 3669991 - RNA, 16 nt, Human
ucccaagguucugggu

SEQ ID NO: 3669992 - RNA, 21 nt, Human
ucccaagguuggagcccaggg

SEQ ID NO: 3669993 - RNA, 23 nt, Human
ucccaagguuggagcccagggca

SEQ ID NO: 3669994 - RNA, 20 nt, Human
ucccaaguaacugggauuac

SEQ ID NO: 3669995 - RNA, 18 nt, Human
ucccaaguaagaggcugg

SEQ ID NO: 3669996 - RNA, 16 nt, Human
ucccaaguagaaucuc

SEQ ID NO: 3669997 - RNA, 15 nt, Human
ucccaagugccaaag

SEQ ID NO: 3669998 - RNA, 16 nt, Human
ucccaaguggugccua

SEQ ID NO: 3669999 - RNA, 15 nt, Human
ucccaaguguacuau

SEQ ID NO: 3670000 - RNA, 19 nt, Human
ucccaaguuuccauagcaa

SEQ ID NO: 3670001 - RNA, 21 nt, Human
ucccaaguuuccauagcaaca

SEQ ID NO: 3670002 - RNA, 23 nt, Human
ucccaaguuuuaggacaaacagc

SEQ ID NO: 3670003 - RNA, 16 nt, Human
ucccaaucagcacuga

SEQ ID NO: 3670004 - RNA, 13 nt, Human
ucccaaugguguu

SEQ ID NO: 3670005 - RNA, 22 nt, Human
ucccaaugguguuuuucuugua

SEQ ID NO: 3670006 - RNA, 19 nt, Human
ucccaauuaggaaguguaa

SEQ ID NO: 3670007 - RNA, 14 nt, Human
ucccacaagccucu

SEQ ID NO: 3670008 - RNA, 18 nt, Human
ucccacaggacauuucuc

SEQ ID NO: 3670009 - RNA, 14 nt, Human
ucccacaggcagcu

SEQ ID NO: 3670010 - RNA, 17 nt, Human
ucccacaggcagcuuua

SEQ ID NO: 3670011 - RNA, 21 nt, Human
ucccacaggcccuuccucucc

SEQ ID NO: 3670012 - RNA, 18 nt, Human
ucccacagguucaggcga

SEQ ID NO: 3670013 - RNA, 21 nt, Human
ucccacagucccaucugcuuc

SEQ ID NO: 3670014 - RNA, 19 nt, Human
ucccacauccaacuccagc

SEQ ID NO: 3670015 - RNA, 20 nt, Human
ucccacauccaacuccagca

SEQ ID NO: 3670016 - RNA, 21 nt, Human
ucccacaucccugggccugcu

SEQ ID NO: 3670017 - RNA, 23 nt, Human
ucccacaucccugggccugcugc

SEQ ID NO: 3670018 - RNA, 19 nt, Human
ucccaccaacccucagagc

SEQ ID NO: 3670019 - RNA, 15 nt, Human
ucccaccacucccug

SEQ ID NO: 3670020 - RNA, 16 nt, Human
ucccaccacucccugg

SEQ ID NO: 3670021 - RNA, 22 nt, Human
ucccacccacaugugacacaua

SEQ ID NO: 3670022 - RNA, 14 nt, Human
ucccaccccacaca

SEQ ID NO: 3670023 - RNA, 20 nt, Human
ucccaccccacacacgccag

SEQ ID NO: 3670024 - RNA, 12 nt, Human
ucccaccccacc

SEQ ID NO: 3670025 - RNA, 18 nt, Human
ucccaccccacccccuuc

SEQ ID NO: 3670026 - RNA, 22 nt, Human
ucccaccccauuuucugugggc

SEQ ID NO: 3670027 - RNA, 22 nt, Human
ucccacccccacccccagcuca

SEQ ID NO: 3670028 - RNA, 12 nt, Human
ucccacccccag

SEQ ID NO: 3670029 - RNA, 15 nt, Human
ucccacccccagccc

SEQ ID NO: 3670030 - RNA, 17 nt, Human
ucccacccgaugcugcu

SEQ ID NO: 3670031 - RNA, 14 nt, Human
ucccacccguggug

SEQ ID NO: 3670032 - RNA, 12 nt, Human
ucccacccucuu

SEQ ID NO: 3670033 - RNA, 11 nt, Human
ucccacccugu

SEQ ID NO: 3670034 - RNA, 23 nt, Human
ucccaccgcccagcggcuugccu

SEQ ID NO: 3670035 - RNA, 22 nt, Human
ucccaccucaaaugggucuggg

SEQ ID NO: 3670036 - RNA, 16 nt, Human
ucccaccuccagcccg

SEQ ID NO: 3670037 - RNA, 13 nt, Human
ucccaccuccagu

SEQ ID NO: 3670038 - RNA, 17 nt, Human
ucccaccuccaucccag

SEQ ID NO: 3670039 - RNA, 17 nt, Human
ucccaccucccugccca

SEQ ID NO: 3670040 - RNA, 18 nt, Human
ucccaccucccugcccag

SEQ ID NO: 3670041 - RNA, 21 nt, Human
ucccaccuccugacacccuuc

SEQ ID NO: 3670042 - RNA, 14 nt, Human
ucccaccucucuca

SEQ ID NO: 3670043 - RNA, 18 nt, Human
ucccaccucucucacucc

SEQ ID NO: 3670044 - RNA, 20 nt, Human
ucccaccucucucacuccuu

SEQ ID NO: 3670045 - RNA, 22 nt, Human
ucccaccucucucacuccuuga

SEQ ID NO: 3670046 - RNA, 18 nt, Human
ucccaccucugugaccuc

SEQ ID NO: 3670047 - RNA, 22 nt, Human
ucccaccucugugaccucaggc

SEQ ID NO: 3670048 - RNA, 19 nt, Human
ucccaccugacacaccagg

SEQ ID NO: 3670049 - RNA, 14 nt, Human
ucccaccuggcucu

SEQ ID NO: 3670050 - RNA, 16 nt, Human
ucccaccuggcucugu

SEQ ID NO: 3670051 - RNA, 20 nt, Human
ucccaccuggcucuguggcg

SEQ ID NO: 3670052 - RNA, 18 nt, Human
ucccacgagggugccgug

SEQ ID NO: 3670053 - RNA, 23 nt, Human
ucccacggaaaaugccaaucucu

SEQ ID NO: 3670054 - RNA, 14 nt, Human
ucccacgugucuuc

SEQ ID NO: 3670055 - RNA, 18 nt, Human
ucccacucaagccaagca

SEQ ID NO: 3670056 - RNA, 17 nt, Human
ucccacucacaacagcu

SEQ ID NO: 3670057 - RNA, 22 nt, Human
ucccacucacaacagcugccug

SEQ ID NO: 3670058 - RNA, 23 nt, Human
ucccacucaccccggcagacgcc

SEQ ID NO: 3670059 - RNA, 16 nt, Human
ucccacuccaagccag

SEQ ID NO: 3670060 - RNA, 14 nt, Human
ucccacuccuagga

SEQ ID NO: 3670061 - RNA, 15 nt, Human
ucaggcccaggcacu

SEQ ID NO: 3670062 - RNA, 16 nt, Human
ucaggcccggcagggc

SEQ ID NO: 3670063 - RNA, 15 nt, Human
ucaggccgaaggagg

SEQ ID NO: 3670064 - RNA, 18 nt, Human
ucaggccggcagccccag

SEQ ID NO: 3670065 - RNA, 17 nt, Human
ucaggccuagaggccug

SEQ ID NO: 3670066 - RNA, 18 nt, Human
ucaggccuauaaccccag

SEQ ID NO: 3670067 - RNA, 22 nt, Human
ucaggccuauaaccccagcucc

SEQ ID NO: 3670068 - RNA, 15 nt, Human
ucaggcuacuagaau

SEQ ID NO: 3670069 - RNA, 13 nt, Human
ucaggcuagaugu

SEQ ID NO: 3670070 - RNA, 16 nt, Human
ucaggcuccauuagga

SEQ ID NO: 3670071 - RNA, 12 nt, Human
ucaggcucccag

SEQ ID NO: 3670072 - RNA, 15 nt, Human
ucaggcucucugggc

SEQ ID NO: 3670073 - RNA, 17 nt, Human
ucaggcucucugggcug

SEQ ID NO: 3670074 - RNA, 19 nt, Human
ucaggcucugcccugcccu

SEQ ID NO: 3670075 - RNA, 16 nt, Human
ucaggcugaaaacaau

SEQ ID NO: 3670076 - RNA, 14 nt, Human
ucaggcugagcuga

SEQ ID NO: 3670077 - RNA, 13 nt, Human
ucaggcugaggug

SEQ ID NO: 3670078 - RNA, 12 nt, Human
ucaggcugcagc

SEQ ID NO: 3670079 - RNA, 14 nt, Human
gcugcccagaguug

SEQ ID NO: 3670080 - RNA, 17 nt, Human
gcugcccagaguugcug

SEQ ID NO: 3670081 - RNA, 16 nt, Human
gcugcccauuucguga

SEQ ID NO: 3670082 - RNA, 18 nt, Human
gcugccccaaccugcuga

SEQ ID NO: 3670083 - RNA, 16 nt, Human
gcugccccagccagau

SEQ ID NO: 3670084 - RNA, 18 nt, Human
gcugccccaucagugcuc

SEQ ID NO: 3670085 - RNA, 21 nt, Human
gcugccccaucuccccucagc

SEQ ID NO: 3670086 - RNA, 22 nt, Human
gcugccccaucuccccucagcu

SEQ ID NO: 3670087 - RNA, 20 nt, Human
gcugccccaugaagccacag

SEQ ID NO: 3670088 - RNA, 20 nt, Human
gcugcccccagagccacagu

SEQ ID NO: 3670089 - RNA, 19 nt, Human
gcugcccccggcccccugg

SEQ ID NO: 3670090 - RNA, 13 nt, Human
gcugccccggccc

SEQ ID NO: 3670091 - RNA, 22 nt, Human
gcugccccucaucucucugccc

SEQ ID NO: 3670092 - RNA, 14 nt, Human
gcugccccucccug

SEQ ID NO: 3670093 - RNA, 15 nt, Human
gcugccccucucacc

SEQ ID NO: 3670094 - RNA, 19 nt, Human
gcugccccucucugggccu

SEQ ID NO: 3670095 - RNA, 23 nt, Human
gcugccccucucugggccucaga

SEQ ID NO: 3670096 - RNA, 15 nt, Human
gcugccccuggcagc

SEQ ID NO: 3670097 - RNA, 19 nt, Human
gcugccccuggcagccccu

SEQ ID NO: 3670098 - RNA, 17 nt, Human
gcugccccuggcucuga

SEQ ID NO: 3670099 - RNA, 18 nt, Human
gcugcccggcgcccucug

SEQ ID NO: 3670100 - RNA, 20 nt, Human
gcugcccggcgcccucuguc

SEQ ID NO: 3670101 - RNA, 19 nt, Human
gcugcccgucuucagccua

SEQ ID NO: 3670102 - RNA, 17 nt, Human
gcugcccuaugggccug

SEQ ID NO: 3670103 - RNA, 14 nt, Human
gcugcccuccaucc

SEQ ID NO: 3670104 - RNA, 21 nt, Human
gcugcccuccaucccgacaug

SEQ ID NO: 3670105 - RNA, 22 nt, Human
gcugcccuccugugcucagccc

SEQ ID NO: 3670106 - RNA, 16 nt, Human
gcugcccuccuugucc

SEQ ID NO: 3670107 - RNA, 22 nt, Human
gcugcccuccuuguccacccac

SEQ ID NO: 3670108 - RNA, 12 nt, Human
gcugcccucucc

SEQ ID NO: 3670109 - RNA, 14 nt, Human
gcugcccucuccug

SEQ ID NO: 3670110 - RNA, 18 nt, Human
gcugcccucuccugggca

SEQ ID NO: 3670111 - RNA, 20 nt, Human
gcugcccucuccugggcagc

SEQ ID NO: 3670112 - RNA, 16 nt, Human
gcugcccugagaagcu

SEQ ID NO: 3670113 - RNA, 21 nt, Human
gcugcccugagaagcugcucc

SEQ ID NO: 3670114 - RNA, 20 nt, Human
gcugcccugagcgccuggau

SEQ ID NO: 3670115 - RNA, 14 nt, Human
gcugcccugcccac

SEQ ID NO: 3670116 - RNA, 18 nt, Human
gcugcccugcccaccugg

SEQ ID NO: 3670117 - RNA, 21 nt, Human
gcugcccuggaggaaccgaaa

SEQ ID NO: 3670118 - RNA, 15 nt, Human
gcugcccuggcccug

SEQ ID NO: 3670119 - RNA, 23 nt, Human
gcugcccuggcccugaggugugg

SEQ ID NO: 3670120 - RNA, 13 nt, Human
gcugcccuggugc

SEQ ID NO: 3670121 - RNA, 14 nt, Human
gcugccgcacccca

SEQ ID NO: 3670122 - RNA, 20 nt, Human
gcugccgccucccagccugg

SEQ ID NO: 3670123 - RNA, 19 nt, Human
gcugccggggcagcccccu

SEQ ID NO: 3670124 - RNA, 19 nt, Human
gcugccggucgcccuuugc

SEQ ID NO: 3670125 - RNA, 18 nt, Human
gcugccgugccgccugca

SEQ ID NO: 3670126 - RNA, 22 nt, Human
gcugccgugccgccugcacucc

SEQ ID NO: 3670127 - RNA, 22 nt, Human
gcugccguggggccgccgccuc

SEQ ID NO: 3670128 - RNA, 14 nt, Human
gcugccuaaaucca

SEQ ID NO: 3670129 - RNA, 16 nt, Human
gcugccuaaguggcug

SEQ ID NO: 3670130 - RNA, 20 nt, Human
gcugccuagauucagggaaa

SEQ ID NO: 3670131 - RNA, 17 nt, Human
gcugccuaggauucaca

SEQ ID NO: 3670132 - RNA, 15 nt, Human
gcugccuccacuccc

SEQ ID NO: 3670133 - RNA, 17 nt, Human
gcugccuccccaacccu

SEQ ID NO: 3670134 - RNA, 20 nt, Human
gcugccuccccaacccugcc

SEQ ID NO: 3670135 - RNA, 20 nt, Human
gcugccuccccuccucugcu

SEQ ID NO: 3670136 - RNA, 12 nt, Human
gcugccucccug

SEQ ID NO: 3670137 - RNA, 19 nt, Human
gcugccucccuguccaccc

SEQ ID NO: 3670138 - RNA, 19 nt, Human
gcugccucggauccccuuc

SEQ ID NO: 3670139 - RNA, 21 nt, Human
gcugccucuaccugacacucc

SEQ ID NO: 3670140 - RNA, 18 nt, Human
gcugccucucgguggcca

SEQ ID NO: 3670141 - RNA, 13 nt, Human
gcugccucuuucc

SEQ ID NO: 3670142 - RNA, 23 nt, Human
gcugccugagcaccucccagccc

SEQ ID NO: 3670143 - RNA, 11 nt, Human
gcugccugagu

SEQ ID NO: 3670144 - RNA, 17 nt, Human
gcugccugcccacacag

SEQ ID NO: 3670145 - RNA, 22 nt, Human
gcugccugcccguaaacacgcc

SEQ ID NO: 3670146 - RNA, 15 nt, Human
gcugccugccugucu

SEQ ID NO: 3670147 - RNA, 16 nt, Human
gcugccugccugucug

SEQ ID NO: 3670148 - RNA, 22 nt, Human
gcugccugcgcccaccccgcuc

SEQ ID NO: 3670149 - RNA, 22 nt, Human
gcugccuggagccccacugccc

SEQ ID NO: 3670150 - RNA, 19 nt, Human
gcugccuggcccccagcug

SEQ ID NO: 3670151 - RNA, 22 nt, Human
gcugccuggcccccagcugugg

SEQ ID NO: 3670152 - RNA, 14 nt, Human
gcugccugggcugu

SEQ ID NO: 3670153 - RNA, 16 nt, Human
gcugccugggcuguug

SEQ ID NO: 3670154 - RNA, 22 nt, Human
gcugccugggcuguuggcacuc

SEQ ID NO: 3670155 - RNA, 23 nt, Human
gcugccugggcuguuggcacuca

SEQ ID NO: 3670156 - RNA, 12 nt, Human
gcugccuguagu

SEQ ID NO: 3670157 - RNA, 16 nt, Human
gcugccuguaguuagg

SEQ ID NO: 3670158 - RNA, 19 nt, Human
gcugccuguaguuaggaaa

SEQ ID NO: 3670159 - RNA, 20 nt, Human
gcugccuuagaaccuuucuu

SEQ ID NO: 3670160 - RNA, 13 nt, Human
gcugccuucccua

SEQ ID NO: 3670161 - RNA, 21 nt, Human
gcugccuucgguacccaccac

SEQ ID NO: 3670162 - RNA, 19 nt, Human
gcugccuucuggauucuug

SEQ ID NO: 3670163 - RNA, 23 nt, Human
gcugccuuggcucagacauguuu

SEQ ID NO: 3670164 - RNA, 15 nt, Human
gcugcgauacuggca

SEQ ID NO: 3670165 - RNA, 16 nt, Human
gcugcgcccugggcuc

SEQ ID NO: 3670166 - RNA, 17 nt, Human
gcugcggccccuccccc

SEQ ID NO: 3670167 - RNA, 18 nt, Human
gcugcggcguacaggcug

SEQ ID NO: 3670168 - RNA, 19 nt, Human
gcugcgguccacccaggag

SEQ ID NO: 3670169 - RNA, 18 nt, Human
gcugcgugccccugcugc

SEQ ID NO: 3670170 - RNA, 21 nt, Human
gcugcuaaaucuccuauuuuu

SEQ ID NO: 3670171 - RNA, 20 nt, Human
gcugcuaaucuucagggcac

SEQ ID NO: 3670172 - RNA, 18 nt, Human
gcugcuacaaagaagaca

SEQ ID NO: 3670173 - RNA, 23 nt, Human
gcugcuacaaagaagacauguuu

SEQ ID NO: 3670174 - RNA, 14 nt, Human
gcugcuacccagaa

SEQ ID NO: 3670175 - RNA, 17 nt, Human
gcugcuacccucccugc

SEQ ID NO: 3670176 - RNA, 20 nt, Human
gcugcuacccucccugcugu

SEQ ID NO: 3670177 - RNA, 21 nt, Human
gcugcuacccucccugcuguc

SEQ ID NO: 3670178 - RNA, 23 nt, Human
gcugcuacccucccugcuguccc

SEQ ID NO: 3670179 - RNA, 23 nt, Human
gcugcuacuuaauuccuuucuca

SEQ ID NO: 3670180 - RNA, 16 nt, Human
gcugcuagaacuuuuu

SEQ ID NO: 3670181 - RNA, 22 nt, Human
gcugcuagaacuuuuuuaaaua

SEQ ID NO: 3670182 - RNA, 20 nt, Human
gcugcuagagugacucacua

SEQ ID NO: 3670183 - RNA, 15 nt, Human
gcugcuauagccugg

SEQ ID NO: 3670184 - RNA, 17 nt, Human
gcugcuauccccaucuc

SEQ ID NO: 3670185 - RNA, 14 nt, Human
gcugcuccaggccu

SEQ ID NO: 3670186 - RNA, 19 nt, Human
gcugcuccaggccugcagc

SEQ ID NO: 3670187 - RNA, 15 nt, Human
gcugcucccaccugg

SEQ ID NO: 3670188 - RNA, 20 nt, Human
gcugcucccaccuggcucug

SEQ ID NO: 3670189 - RNA, 16 nt, Human
gcugcuccccagcagc

SEQ ID NO: 3670190 - RNA, 21 nt, Human
gcugcucccucagacuggggc

SEQ ID NO: 3670191 - RNA, 19 nt, Human
gcugcuccuagagggaggg

SEQ ID NO: 3670192 - RNA, 21 nt, Human
gcugcuccuagagggaggggc

SEQ ID NO: 3670193 - RNA, 23 nt, Human
gcugcuccuagagggaggggccu

SEQ ID NO: 3670194 - RNA, 13 nt, Human
gcugcuccucaug

SEQ ID NO: 3670195 - RNA, 18 nt, Human
gcugcuccuuagcugcca

SEQ ID NO: 3670196 - RNA, 19 nt, Human
gcugcuccuuagcugccaa

SEQ ID NO: 3670197 - RNA, 23 nt, Human
gcugcuccuuagcugccaagccc

SEQ ID NO: 3670198 - RNA, 17 nt, Human
gcugcuccuuccuucac

SEQ ID NO: 3670199 - RNA, 14 nt, Human
gcugcuccuuggcu

SEQ ID NO: 3670200 - RNA, 19 nt, Human
gcugcucggggugcacagg

SEQ ID NO: 3670201 - RNA, 20 nt, Human
gcugcucggggugcacagga

SEQ ID NO: 3670202 - RNA, 21 nt, Human
gcugcucggggugcacaggag

SEQ ID NO: 3670203 - RNA, 23 nt, Human
gcugcucggggugcacaggaggg

SEQ ID NO: 3670204 - RNA, 14 nt, Human
gcugcucugagcca

SEQ ID NO: 3670205 - RNA, 19 nt, Human
gcugcucugcccagagcug

SEQ ID NO: 3670206 - RNA, 13 nt, Human
gcugcucugcccc

SEQ ID NO: 3670207 - RNA, 23 nt, Human
gcugcucugccccagcuugggca

SEQ ID NO: 3670208 - RNA, 22 nt, Human
gcugcugaaaaccaucuggccu

SEQ ID NO: 3670209 - RNA, 13 nt, Human
gcugcugaaacaa

SEQ ID NO: 3670210 - RNA, 15 nt, Human
gcugcugaagaugaa

SEQ ID NO: 3670211 - RNA, 15 nt, Human
gcugcugaaggcucg

SEQ ID NO: 3670212 - RNA, 18 nt, Human
gcugcugaaggcucgagc

SEQ ID NO: 3670213 - RNA, 12 nt, Human
gcugcugacagu

SEQ ID NO: 3670214 - RNA, 12 nt, Human
gcugcugaccaa

SEQ ID NO: 3670215 - RNA, 15 nt, Human
gcugcugagaaccug

SEQ ID NO: 3670216 - RNA, 16 nt, Human
gcugcugagaaccugg

SEQ ID NO: 3670217 - RNA, 19 nt, Human
gcugcugagaaccuggccu

SEQ ID NO: 3670218 - RNA, 20 nt, Human
gcugcugagaaccuggccuu

SEQ ID NO: 3670219 - RNA, 15 nt, Human
gcugcugagccgcag

SEQ ID NO: 3670220 - RNA, 17 nt, Human
gcugcugaucgccuucc

SEQ ID NO: 3670221 - RNA, 20 nt, Human
gcugcugaucgccuucccca

SEQ ID NO: 3670222 - RNA, 13 nt, Human
ucccuccacccca

SEQ ID NO: 3670223 - RNA, 14 nt, Human
ucccuccaccccag

SEQ ID NO: 3670224 - RNA, 14 nt, Human
ucccuccaccuccc

SEQ ID NO: 3670225 - RNA, 15 nt, Human
ucccuccaccucccu

SEQ ID NO: 3670226 - RNA, 17 nt, Human
ucccuccaccucccugc

SEQ ID NO: 3670227 - RNA, 21 nt, Human
ucccuccaccucccugcaaua

SEQ ID NO: 3670228 - RNA, 20 nt, Human
ucccuccacguucaccccuc

SEQ ID NO: 3670229 - RNA, 14 nt, Human
ucccuccagcacaa

SEQ ID NO: 3670230 - RNA, 13 nt, Human
ucccucccaccuc

SEQ ID NO: 3670231 - RNA, 23 nt, Human
ucccucccagagcaccugcuguc

SEQ ID NO: 3670232 - RNA, 22 nt, Human
ucccucccagaggagccaccag

SEQ ID NO: 3670233 - RNA, 13 nt, Human
ucccucccaggac

SEQ ID NO: 3670234 - RNA, 18 nt, Human
ucccucccaucaugcccg

SEQ ID NO: 3670235 - RNA, 15 nt, Human
ucccuccccagcucc

SEQ ID NO: 3670236 - RNA, 14 nt, Human
ucccucccccccau

SEQ ID NO: 3670237 - RNA, 14 nt, Human
ucccucccccuugu

SEQ ID NO: 3670238 - RNA, 17 nt, Human
ucccuccccugcccucg

SEQ ID NO: 3670239 - RNA, 16 nt, Human
ucccuccccugcccug

SEQ ID NO: 3670240 - RNA, 19 nt, Human
ucccuccccugcccugguc

SEQ ID NO: 3670241 - RNA, 15 nt, Human
ucccuccccuucucu

SEQ ID NO: 3670242 - RNA, 13 nt, Human
ucccucccuccac

SEQ ID NO: 3670243 - RNA, 16 nt, Human
ucccucccuccaccuc

SEQ ID NO: 3670244 - RNA, 16 nt, Human
ucccucccugcuguca

SEQ ID NO: 3670245 - RNA, 14 nt, Human
ucccucccuugggg

SEQ ID NO: 3670246 - RNA, 15 nt, Human
ucccucccuuugaaa

SEQ ID NO: 3670247 - RNA, 14 nt, Human
ucccuccgggaccu

SEQ ID NO: 3670248 - RNA, 14 nt, Human
ucccuccuccaggc

SEQ ID NO: 3670249 - RNA, 16 nt, Human
ucccuccuccaggccu

SEQ ID NO: 3670250 - RNA, 21 nt, Human
ucccuccuccaggccugccuc

SEQ ID NO: 3670251 - RNA, 20 nt, Human
ucccuccucccaugucacug

SEQ ID NO: 3670252 - RNA, 16 nt, Human
ucccuccucugcccgg

SEQ ID NO: 3670253 - RNA, 22 nt, Human
ucccuccugcccgccacacaga

SEQ ID NO: 3670254 - RNA, 16 nt, Human
ucccuccugccgacuc

SEQ ID NO: 3670255 - RNA, 14 nt, Human
ucccuccugcuacu

SEQ ID NO: 3670256 - RNA, 22 nt, Human
ucccuccuggugucaccccaga

SEQ ID NO: 3670257 - RNA, 11 nt, Human
ucccuccuugg

SEQ ID NO: 3670258 - RNA, 17 nt, Human
ucccucgaacccacacu

SEQ ID NO: 3670259 - RNA, 20 nt, Human
ucccucgaacccacacugca

SEQ ID NO: 3670260 - RNA, 20 nt, Human
ucccucggaguucuucuuga

SEQ ID NO: 3670261 - RNA, 16 nt, Human
ucccucgucuuuccca

SEQ ID NO: 3670262 - RNA, 14 nt, Human
ucccucuaauuuau

SEQ ID NO: 3670263 - RNA, 16 nt, Human
ucccucuaauuuaucu

SEQ ID NO: 3670264 - RNA, 22 nt, Human
ucccucuacuaaggcuuuccua

SEQ ID NO: 3670265 - RNA, 15 nt, Human
ucccucuacugggag

SEQ ID NO: 3670266 - RNA, 23 nt, Human
ucccucuacugggagccuaccca

SEQ ID NO: 3670267 - RNA, 17 nt, Human
ucccucucaacacccag

SEQ ID NO: 3670268 - RNA, 16 nt, Human
ucccucucaggaucca

SEQ ID NO: 3670269 - RNA, 20 nt, Human
ucccucucaggcaugccugu

SEQ ID NO: 3670270 - RNA, 22 nt, Human
ucccucucaggcaugccugugu

SEQ ID NO: 3670271 - RNA, 23 nt, Human
ucccucucaggcaugccugugug

SEQ ID NO: 3670272 - RNA, 21 nt, Human
ucccucucauuuagccugucc

SEQ ID NO: 3670273 - RNA, 22 nt, Human
ucccucucauuuagccuguccu

SEQ ID NO: 3670274 - RNA, 20 nt, Human
ucccucuccauaaccccacc

SEQ ID NO: 3670275 - RNA, 23 nt, Human
uccaaccuaaccccuuuccugcg

SEQ ID NO: 3670276 - RNA, 19 nt, Human
uccaaccuaaccugugucu

SEQ ID NO: 3670277 - RNA, 21 nt, Human
uccaaccugcaaagaucuguc

SEQ ID NO: 3670278 - RNA, 14 nt, Human
uccaaccuucccaa

SEQ ID NO: 3670279 - RNA, 18 nt, Human
uccaacguggggcagcac

SEQ ID NO: 3670280 - RNA, 19 nt, Human
uccaacguggggcagcaca

SEQ ID NO: 3670281 - RNA, 15 nt, Human
uccaacguuuggaag

SEQ ID NO: 3670282 - RNA, 19 nt, Human
uccaacuaaugccuuacuc

SEQ ID NO: 3670283 - RNA, 21 nt, Human
uccaacuacuaauagaauaaa

SEQ ID NO: 3670284 - RNA, 23 nt, Human
uccaacuacuaauagaauaaagg

SEQ ID NO: 3670285 - RNA, 21 nt, Human
uccaacuccaacauccacucu

SEQ ID NO: 3670286 - RNA, 11 nt, Human
uccaacuccag

SEQ ID NO: 3670287 - RNA, 14 nt, Human
uccaacugcaacuc

SEQ ID NO: 3670288 - RNA, 12 nt, Human
uccaagaagccc

SEQ ID NO: 3670289 - RNA, 16 nt, Human
uccaagaagcccagga

SEQ ID NO: 3670290 - RNA, 19 nt, Human
uccaagaagcccaggaaag

SEQ ID NO: 3670291 - RNA, 19 nt, Human
uccaagaauagcaucugua

SEQ ID NO: 3670292 - RNA, 18 nt, Human
uccaagaaucuaucugcu

SEQ ID NO: 3670293 - RNA, 20 nt, Human
uccaagacaugucuguucua

SEQ ID NO: 3670294 - RNA, 17 nt, Human
uccaagacauugucaau

SEQ ID NO: 3670295 - RNA, 14 nt, Human
uccaagaccagacu

SEQ ID NO: 3670296 - RNA, 19 nt, Human
uccaagaccuguugguucc

SEQ ID NO: 3670297 - RNA, 14 nt, Human
uccaagacucuaga

SEQ ID NO: 3670298 - RNA, 16 nt, Human
uccaagacucuagagu

SEQ ID NO: 3670299 - RNA, 21 nt, Human
uccaagagcuacauaauuuag

SEQ ID NO: 3670300 - RNA, 19 nt, Human
uccaagaggguccuuuagu

SEQ ID NO: 3670301 - RNA, 16 nt, Human
uccaagagucugauga

SEQ ID NO: 3670302 - RNA, 22 nt, Human
uccaagauauuuuaaaaucugu

SEQ ID NO: 3670303 - RNA, 20 nt, Human
uccaagauuuaaaugccaua

SEQ ID NO: 3670304 - RNA, 18 nt, Human
uccaagcaaauguuacau

SEQ ID NO: 3670305 - RNA, 23 nt, Human
uccaagcagccugagcaacucuu

SEQ ID NO: 3670306 - RNA, 14 nt, Human
uccaagcagcuuag

SEQ ID NO: 3670307 - RNA, 15 nt, Human
uccaagcagcuuaga

SEQ ID NO: 3670308 - RNA, 23 nt, Human
uccaagcauaccaacacgagcag

SEQ ID NO: 3670309 - RNA, 20 nt, Human
uccaagcauuuagauguaua

SEQ ID NO: 3670310 - RNA, 15 nt, Human
uccaagccagcggga

SEQ ID NO: 3670311 - RNA, 15 nt, Human
uccaagccccaucuu

SEQ ID NO: 3670312 - RNA, 19 nt, Human
uccaagccccaucuucuaa

SEQ ID NO: 3670313 - RNA, 12 nt, Human
uccaagcccugg

SEQ ID NO: 3670314 - RNA, 20 nt, Human
uccaagccucauguccacug

SEQ ID NO: 3670315 - RNA, 14 nt, Human
uccaagccuccaca

SEQ ID NO: 3670316 - RNA, 17 nt, Human
uccaagccuccacagcg

SEQ ID NO: 3670317 - RNA, 11 nt, Human
uccaagccugc

SEQ ID NO: 3670318 - RNA, 21 nt, Human
uccaagcgaggucaacagaga

SEQ ID NO: 3670319 - RNA, 22 nt, Human
uccaagcgaggucaacagagaa

SEQ ID NO: 3670320 - RNA, 14 nt, Human
uccaagcuaagcac

SEQ ID NO: 3670321 - RNA, 22 nt, Human
uccaagcucacuccccaacccc

SEQ ID NO: 3670322 - RNA, 12 nt, Human
uccaagcuccca

SEQ ID NO: 3670323 - RNA, 16 nt, Human
uccaagcucccaggca

SEQ ID NO: 3670324 - RNA, 11 nt, Human
uccaagcuggu

SEQ ID NO: 3670325 - RNA, 22 nt, Human
uccaagcuuccauagcugcugc

SEQ ID NO: 3670326 - RNA, 23 nt, Human
uccaaggaaaccacagcugcugg

SEQ ID NO: 3670327 - RNA, 23 nt, Human
uccaaggacagaaggcuccugcc

SEQ ID NO: 3670328 - RNA, 15 nt, Human
uccaaggagaaacag

SEQ ID NO: 3670329 - RNA, 19 nt, Human
uccaaggagaaacagagac

SEQ ID NO: 3670330 - RNA, 22 nt, Human
uccaaggagaaacagagacagg

SEQ ID NO: 3670331 - RNA, 19 nt, Human
uccaaggagcugagaauag

SEQ ID NO: 3670332 - RNA, 16 nt, Human
uccaaggcagaagcag

SEQ ID NO: 3670333 - RNA, 22 nt, Human
uccaagggcuucugcacccucc

SEQ ID NO: 3670334 - RNA, 23 nt, Human
uccaagggcuucugcacccucca

SEQ ID NO: 3670335 - RNA, 15 nt, Human
uccaagguucccuug

SEQ ID NO: 3670336 - RNA, 16 nt, Human
uccaagguucccuugu

SEQ ID NO: 3670337 - RNA, 15 nt, Human
uccaagguuuaaaga

SEQ ID NO: 3670338 - RNA, 16 nt, Human
uccaagguuuaaagag

SEQ ID NO: 3670339 - RNA, 19 nt, Human
uccaagguuuaaagagucu

SEQ ID NO: 3670340 - RNA, 22 nt, Human
uccaagguuuaaagagucuaga

SEQ ID NO: 3670341 - RNA, 17 nt, Human
uccaaguccaauaagac

SEQ ID NO: 3670342 - RNA, 17 nt, Human
uccaagucucaguggcu

SEQ ID NO: 3670343 - RNA, 21 nt, Human
uccaagucuuugcuauuguga

SEQ ID NO: 3670344 - RNA, 18 nt, Human
uccaagugccagaggugg

SEQ ID NO: 3670345 - RNA, 14 nt, Human
uccaagugugcaua

SEQ ID NO: 3670346 - RNA, 20 nt, Human
uccaagugugcauauuguac

SEQ ID NO: 3670347 - RNA, 15 nt, Human
uccaaguuaaaugua

SEQ ID NO: 3670348 - RNA, 17 nt, Human
uccaauaaaaugccuca

SEQ ID NO: 3670349 - RNA, 19 nt, Human
uccaauaggaaugcuaaca

SEQ ID NO: 3670350 - RNA, 14 nt, Human
uccaauaugugauu

SEQ ID NO: 3670351 - RNA, 16 nt, Human
uccaauaugugauuuu

SEQ ID NO: 3670352 - RNA, 13 nt, Human
uccaauauuucug

SEQ ID NO: 3670353 - RNA, 15 nt, Human
uccaauauuucugcu

SEQ ID NO: 3670354 - RNA, 16 nt, Human
uccaauauuucugcuu

SEQ ID NO: 3670355 - RNA, 23 nt, Human
uccaauauuucugcuuucuuuga

SEQ ID NO: 3670356 - RNA, 20 nt, Human
uccaaucaaucuugcaugua

SEQ ID NO: 3670357 - RNA, 23 nt, Human
uccaaucagagaccaggcccugg

SEQ ID NO: 3670358 - RNA, 15 nt, Human
uccaauccucacugg

SEQ ID NO: 3670359 - RNA, 17 nt, Human
uccaauccucacugggu

SEQ ID NO: 3670360 - RNA, 18 nt, Human
uccaauccucacugggug

SEQ ID NO: 3670361 - RNA, 14 nt, Human
uccaauccugcccc

SEQ ID NO: 3670362 - RNA, 22 nt, Human
uccaauccuggcucuguggcuu

SEQ ID NO: 3670363 - RNA, 19 nt, Human
uccaaucucaaggaaucuu

SEQ ID NO: 3670364 - RNA, 17 nt, Human
uccaaucuuguuuccaa

SEQ ID NO: 3670365 - RNA, 17 nt, Human
uccaaugagcuuucuga

SEQ ID NO: 3670366 - RNA, 18 nt, Human
ucccuggcccccucccug

SEQ ID NO: 3670367 - RNA, 13 nt, Human
ucccuggccuguu

SEQ ID NO: 3670368 - RNA, 24 nt, Human
ucccuggccuuucauauuuuagcu

SEQ ID NO: 3670369 - RNA, 11 nt, Human
ucccuggcgca

SEQ ID NO: 3670370 - RNA, 19 nt, Human
ucccuggcggccccaacuc

SEQ ID NO: 3670371 - RNA, 20 nt, Human
ucccuggcucucagaaggua

SEQ ID NO: 3670372 - RNA, 16 nt, Human
ucccuggcugcccugg

SEQ ID NO: 3670373 - RNA, 19 nt, Human
ucccuggcugcccuggccc

SEQ ID NO: 3670374 - RNA, 22 nt, Human
ucccuggcugcccuggcccuga

SEQ ID NO: 3670375 - RNA, 17 nt, Human
ucccuggcuuccuuacu

SEQ ID NO: 3670376 - RNA, 12 nt, Human
ucccuggcuucu

SEQ ID NO: 3670377 - RNA, 11 nt, Human
ucccuggcuug

SEQ ID NO: 3670378 - RNA, 21 nt, Human
ucccuggcuuguaacuccacc

SEQ ID NO: 3670379 - RNA, 17 nt, Human
ucccugggaucuggugg

SEQ ID NO: 3670380 - RNA, 16 nt, Human
ucccugggcagaaagu

SEQ ID NO: 3670381 - RNA, 24 nt, Human
ucccugggccagggucugugugaa

SEQ ID NO: 3670382 - RNA, 18 nt, Human
ucccugggccugcugcug

SEQ ID NO: 3670383 - RNA, 13 nt, Human
ucccugggccuug

SEQ ID NO: 3670384 - RNA, 14 nt, Human
ucccugggccuugg

SEQ ID NO: 3670385 - RNA, 15 nt, Human
ucccugggccuuggg

SEQ ID NO: 3670386 - RNA, 20 nt, Human
ucccuggggaaaacuugcag

SEQ ID NO: 3670387 - RNA, 20 nt, Human
ucccuggggcuagggggagc

SEQ ID NO: 3670388 - RNA, 18 nt, Human
ucccugggggaagcccug

SEQ ID NO: 3670389 - RNA, 21 nt, Human
ucccugggggaagcccuggau

SEQ ID NO: 3670390 - RNA, 22 nt, Human
ucccuggguuagacugccagcu

SEQ ID NO: 3670391 - RNA, 14 nt, Human
ucccuggucccuug

SEQ ID NO: 3670392 - RNA, 23 nt, Human
ucccuggugagagggccgggcag

SEQ ID NO: 3670393 - RNA, 15 nt, Human
ucccuggugcuuaug

SEQ ID NO: 3670394 - RNA, 20 nt, Human
ucccugguggcagcucaccu

SEQ ID NO: 3670395 - RNA, 14 nt, Human
ucccuguaaccucu

SEQ ID NO: 3670396 - RNA, 22 nt, Human
ucccuguaaccucuucagaggc

SEQ ID NO: 3670397 - RNA, 23 nt, Human
ucccuguaaccucuucagaggcc

SEQ ID NO: 3670398 - RNA, 12 nt, Human
ucccuguaacuu

SEQ ID NO: 3670399 - RNA, 21 nt, Human
ucccuguaauuguuguuugua

SEQ ID NO: 3670400 - RNA, 16 nt, Human
ucccuguaggauuuuu

SEQ ID NO: 3670401 - RNA, 19 nt, Human
ucccuguaggguccaacca

SEQ ID NO: 3670402 - RNA, 22 nt, Human
ucccuguauuuucuuucucuac

SEQ ID NO: 3670403 - RNA, 14 nt, Human
ucccugucaccaag

SEQ ID NO: 3670404 - RNA, 15 nt, Human
ucccugucaccaagc

SEQ ID NO: 3670405 - RNA, 17 nt, Human
ucccugucaccucuucc

SEQ ID NO: 3670406 - RNA, 14 nt, Human
ucccugucuuuccu

SEQ ID NO: 3670407 - RNA, 20 nt, Human
ucccugucuuuccuaagacc

SEQ ID NO: 3670408 - RNA, 23 nt, Human
ucccugucuuuccuaagaccugg

SEQ ID NO: 3670409 - RNA, 12 nt, Human
ucccugugaggg

SEQ ID NO: 3670410 - RNA, 16 nt, Human
ucccuguuccccagag

SEQ ID NO: 3670411 - RNA, 14 nt, Human
ucccuguucuuccu

SEQ ID NO: 3670412 - RNA, 18 nt, Human
ucccuguucuuccuccag

SEQ ID NO: 3670413 - RNA, 11 nt, Human
ucccuguuuaa

SEQ ID NO: 3670414 - RNA, 16 nt, Human
ucccuguuuaauauuu

SEQ ID NO: 3670415 - RNA, 19 nt, Human
ucccuguuuucugagcccg

SEQ ID NO: 3670416 - RNA, 16 nt, Human
ucccuuaacaguugua

SEQ ID NO: 3670417 - RNA, 17 nt, Human
ucccuuaacaguuguau

SEQ ID NO: 3670418 - RNA, 19 nt, Human
ucccuuaagaaugaguuuc

SEQ ID NO: 3670419 - RNA, 21 nt, Human
ucccuuaauauccuaaacauc

SEQ ID NO: 3670420 - RNA, 15 nt, Human
ucccuuacuuugcug

SEQ ID NO: 3670421 - RNA, 14 nt, Human
ucccuucacauagu

SEQ ID NO: 3670422 - RNA, 14 nt, Human
ucccuucaccuccu

SEQ ID NO: 3670423 - RNA, 12 nt, Human
ucccuucagccc

SEQ ID NO: 3670424 - RNA, 17 nt, Human
ucccuucagcccccagc

SEQ ID NO: 3670425 - RNA, 19 nt, Human
ucccuucagcccccagccc

SEQ ID NO: 3670426 - RNA, 16 nt, Human
ucccuucaguacccuc

SEQ ID NO: 3670427 - RNA, 16 nt, Human
ucccuucauacuugaa

SEQ ID NO: 3670428 - RNA, 13 nt, Human
ucccuucaucucc

SEQ ID NO: 3670429 - RNA, 14 nt, Human
ucccuuccacugcc

SEQ ID NO: 3670430 - RNA, 18 nt, Human
ucccuuccacugccucug

SEQ ID NO: 3670431 - RNA, 19 nt, Human
ucccuuccacugccucugc

SEQ ID NO: 3670432 - RNA, 17 nt, Human
ucccuuccagaugguca

SEQ ID NO: 3670433 - RNA, 19 nt, Human
ucccuuccaguuuauucca

SEQ ID NO: 3670434 - RNA, 16 nt, Human
ucccuucccaccucuc

SEQ ID NO: 3670435 - RNA, 16 nt, Human
ucccuucccauaagcu

SEQ ID NO: 3670436 - RNA, 21 nt, Human
ucccuuccccucccuggcucc

SEQ ID NO: 3670437 - RNA, 14 nt, Human
ucccuucccuccuc

SEQ ID NO: 3670438 - RNA, 12 nt, Human
gcuguuggucau

SEQ ID NO: 3670439 - RNA, 12 nt, Human
gcuguuguacau

SEQ ID NO: 3670440 - RNA, 13 nt, Human
gcuguuguacauu

SEQ ID NO: 3670441 - RNA, 15 nt, Human
gcuguuguacauuua

SEQ ID NO: 3670442 - RNA, 18 nt, Human
gcuguugucccucugcua

SEQ ID NO: 3670443 - RNA, 16 nt, Human
gcuguugucucuucuc

SEQ ID NO: 3670444 - RNA, 16 nt, Human
gcuguuuauuuuauau

SEQ ID NO: 3670445 - RNA, 11 nt, Human
gcuguuuccuu

SEQ ID NO: 3670446 - RNA, 17 nt, Human
gcuguuuggguuuccaa

SEQ ID NO: 3670447 - RNA, 20 nt, Human
gcuguuuguuugacaaagaa

SEQ ID NO: 3670448 - RNA, 15 nt, Human
gcuguuuuccucccu

SEQ ID NO: 3670449 - RNA, 14 nt, Human
gcuguuuuguuaua

SEQ ID NO: 3670450 - RNA, 18 nt, Human
gcuguuuuguucuguggu

SEQ ID NO: 3670451 - RNA, 15 nt, Human
gcuguuuuuguugug

SEQ ID NO: 3670452 - RNA, 12 nt, Human
gcuuaaaacuuu

SEQ ID NO: 3670453 - RNA, 16 nt, Human
gcuuaaaacuuuucaa

SEQ ID NO: 3670454 - RNA, 19 nt, Human
gcuuaaaauaaacaguugu

SEQ ID NO: 3670455 - RNA, 17 nt, Human
gcuuaaaauaagcaggu

SEQ ID NO: 3670456 - RNA, 18 nt, Human
gcuuaaagaauucaaauu

SEQ ID NO: 3670457 - RNA, 23 nt, Human
gcuuaaaggcaguauuuuguguc

SEQ ID NO: 3670458 - RNA, 20 nt, Human
gcuuaaaggugucuuccucc

SEQ ID NO: 3670459 - RNA, 22 nt, Human
gcuuaaaggugucuuccuccca

SEQ ID NO: 3670460 - RNA, 23 nt, Human
gcuuaaaggugucuuccucccaa

SEQ ID NO: 3670461 - RNA, 13 nt, Human
gcuuaaaugugaa

SEQ ID NO: 3670462 - RNA, 23 nt, Human
gcuuaaaugugaauuacuaacuu

SEQ ID NO: 3670463 - RNA, 15 nt, Human
gcuuaaauuucuuau

SEQ ID NO: 3670464 - RNA, 14 nt, Human
gcuuaaauuuuaac

SEQ ID NO: 3670465 - RNA, 19 nt, Human
gcuuaacagggaacgugau

SEQ ID NO: 3670466 - RNA, 17 nt, Human
gcuuaacuucacauauu

SEQ ID NO: 3670467 - RNA, 13 nt, Human
gcuuaagaaaaaa

SEQ ID NO: 3670468 - RNA, 16 nt, Human
gcuuaagcagaagcau

SEQ ID NO: 3670469 - RNA, 17 nt, Human
gcuuaagggaguuuaau

SEQ ID NO: 3670470 - RNA, 19 nt, Human
gcuuaauaaaaaugacaga

SEQ ID NO: 3670471 - RNA, 12 nt, Human
gcuuaauaccaa

SEQ ID NO: 3670472 - RNA, 17 nt, Human
gcuuaaucagauagaua

SEQ ID NO: 3670473 - RNA, 16 nt, Human
gcuuaaucauuuucau

SEQ ID NO: 3670474 - RNA, 21 nt, Human
gcuuaaucauuuucauuccua

SEQ ID NO: 3670475 - RNA, 12 nt, Human
gcuuaauguuua

SEQ ID NO: 3670476 - RNA, 14 nt, Human
gcuuaauguuuauu

SEQ ID NO: 3670477 - RNA, 23 nt, Human
gcuuaauguuuauuccugauaau

SEQ ID NO: 3670478 - RNA, 22 nt, Human
gcuuaauuauugauguuuucau

SEQ ID NO: 3670479 - RNA, 14 nt, Human
gcuuaauucaaaua

SEQ ID NO: 3670480 - RNA, 19 nt, Human
gcuuacaagccagcuggag

SEQ ID NO: 3670481 - RNA, 14 nt, Human
gcuuacaauucccu

SEQ ID NO: 3670482 - RNA, 12 nt, Human
gcuuacaauuuu

SEQ ID NO: 3670483 - RNA, 14 nt, Human
gcuuacaauuuuuu

SEQ ID NO: 3670484 - RNA, 21 nt, Human
gcuuacaauuuuuuuaauuuu

SEQ ID NO: 3670485 - RNA, 22 nt, Human
gcuuacaauuuuuuuaauuuug

SEQ ID NO: 3670486 - RNA, 18 nt, Human
gcuuacaugagaacagac

SEQ ID NO: 3670487 - RNA, 14 nt, Human
gcuuacauuuuuac

SEQ ID NO: 3670488 - RNA, 19 nt, Human
gcuuacauuuuuacaauaa

SEQ ID NO: 3670489 - RNA, 14 nt, Human
gcuuaccucccacc

SEQ ID NO: 3670490 - RNA, 13 nt, Human
gcuuaccugaccu

SEQ ID NO: 3670491 - RNA, 23 nt, Human
gcuuaccugaccucuugcugucu

SEQ ID NO: 3670492 - RNA, 22 nt, Human
gcuuaccuggcccaucagggua

SEQ ID NO: 3670493 - RNA, 15 nt, Human
gcuuacggcccuggc

SEQ ID NO: 3670494 - RNA, 19 nt, Human
gcuuacggcccuggccuug

SEQ ID NO: 3670495 - RNA, 17 nt, Human
gcuuacugauauauuuu

SEQ ID NO: 3670496 - RNA, 19 nt, Human
gcuuagaaauaacagaaga

SEQ ID NO: 3670497 - RNA, 15 nt, Human
gcuuagacauaacaa

SEQ ID NO: 3670498 - RNA, 14 nt, Human
gcuuagaccucagc

SEQ ID NO: 3670499 - RNA, 15 nt, Human
gcuuagaccucagcc

SEQ ID NO: 3670500 - RNA, 23 nt, Human
gcuuagaccucagccugugcugc

SEQ ID NO: 3670501 - RNA, 18 nt, Human
gcuuagagaauguucucc

SEQ ID NO: 3670502 - RNA, 18 nt, Human
gcuuagaggcaugggcuu

SEQ ID NO: 3670503 - RNA, 21 nt, Human
gcuuagaggcaugggcuugcu

SEQ ID NO: 3670504 - RNA, 22 nt, Human
gcuuagcaggagaggagagcca

SEQ ID NO: 3670505 - RNA, 22 nt, Human
gcuuagccuccugaccugaggc

SEQ ID NO: 3670506 - RNA, 20 nt, Human
gcuuagcucaauuagugugg

SEQ ID NO: 3670507 - RNA, 23 nt, Human
gcuuagcuuuagaaacagugcaa

SEQ ID NO: 3670508 - RNA, 19 nt, Human
gcuuagcuuugcucugcca

SEQ ID NO: 3670509 - RNA, 12 nt, Human
gcuuaggagaga

SEQ ID NO: 3670510 - RNA, 13 nt, Human
gcuuaggagagac

SEQ ID NO: 3670511 - RNA, 13 nt, Human
uccucuccuggag

SEQ ID NO: 3670512 - RNA, 18 nt, Human
uccucucuaaccuccuuu

SEQ ID NO: 3670513 - RNA, 12 nt, Human
uccucucugccc

SEQ ID NO: 3670514 - RNA, 15 nt, Human
uccucucugcccuaa

SEQ ID NO: 3670515 - RNA, 14 nt, Human
uccucugaaacagc

SEQ ID NO: 3670516 - RNA, 18 nt, Human
uccucugaaacagcugcc

SEQ ID NO: 3670517 - RNA, 21 nt, Human
uccucugaggaugauguacuu

SEQ ID NO: 3670518 - RNA, 14 nt, Human
uccucugaggcuga

SEQ ID NO: 3670519 - RNA, 12 nt, Human
uccucugcacuc

SEQ ID NO: 3670520 - RNA, 18 nt, Human
uccucugcagcugaccuc

SEQ ID NO: 3670521 - RNA, 14 nt, Human
uccucugccaccuc

SEQ ID NO: 3670522 - RNA, 16 nt, Human
uccucugcccgggagc

SEQ ID NO: 3670523 - RNA, 18 nt, Human
uccucugcuaaauugaug

SEQ ID NO: 3670524 - RNA, 23 nt, Human
uccucugcuaaauugauguugau

SEQ ID NO: 3670525 - RNA, 20 nt, Human
uccucugcucaccgcccauc

SEQ ID NO: 3670526 - RNA, 16 nt, Human
uccucugcugcuggcu

SEQ ID NO: 3670527 - RNA, 17 nt, Human
uccucugcugcuggcug

SEQ ID NO: 3670528 - RNA, 17 nt, Human
uccucugcuuaaaaacu

SEQ ID NO: 3670529 - RNA, 14 nt, Human
uccucugcuugcca

SEQ ID NO: 3670530 - RNA, 19 nt, Human
uccucugcuugccuggaga

SEQ ID NO: 3670531 - RNA, 17 nt, Human
uccucugcuuugaaagc

SEQ ID NO: 3670532 - RNA, 22 nt, Human
uccucuggacggcaggcucacu

SEQ ID NO: 3670533 - RNA, 12 nt, Human
uccucuggagcc

SEQ ID NO: 3670534 - RNA, 13 nt, Human
uccucuggagcca

SEQ ID NO: 3670535 - RNA, 23 nt, Human
uccucuggcuuggccacagccag

SEQ ID NO: 3670536 - RNA, 22 nt, Human
uccucuguccaggcacugcugc

SEQ ID NO: 3670537 - RNA, 19 nt, Human
uccucuguccugcuucuga

SEQ ID NO: 3670538 - RNA, 14 nt, Human
uccucugucugccc

SEQ ID NO: 3670539 - RNA, 19 nt, Human
uccucuguucaaagcugcc

SEQ ID NO: 3670540 - RNA, 23 nt, Human
uccucuguucaaagcugccuguc

SEQ ID NO: 3670541 - RNA, 20 nt, Human
uccucuucaccccggcaggc

SEQ ID NO: 3670542 - RNA, 17 nt, Human
uccucuucccccaagau

SEQ ID NO: 3670543 - RNA, 15 nt, Human
uccucuuccccuugc

SEQ ID NO: 3670544 - RNA, 16 nt, Human
uccucuuccucugagg

SEQ ID NO: 3670545 - RNA, 20 nt, Human
uccucuucuacucacuuuuc

SEQ ID NO: 3670546 - RNA, 23 nt, Human
uccucuucuacucacuuuuccca

SEQ ID NO: 3670547 - RNA, 19 nt, Human
uccucuucuauuuuguaaa

SEQ ID NO: 3670548 - RNA, 15 nt, Human
uccucuucugacgug

SEQ ID NO: 3670549 - RNA, 17 nt, Human
uccucuugacccugcac

SEQ ID NO: 3670550 - RNA, 17 nt, Human
uccucuugcauuucacu

SEQ ID NO: 3670551 - RNA, 19 nt, Human
uccucuugccacugccucu

SEQ ID NO: 3670552 - RNA, 12 nt, Human
uccucuugccau

SEQ ID NO: 3670553 - RNA, 13 nt, Human
uccucuugcucaa

SEQ ID NO: 3670554 - RNA, 20 nt, Human
uccucuugucugauuucuua

SEQ ID NO: 3670555 - RNA, 15 nt, Human
uccucuuuagaguua

SEQ ID NO: 3670556 - RNA, 18 nt, Human
uccucuuuaguuuuuggu

SEQ ID NO: 3670557 - RNA, 18 nt, Human
uccucuuucagaaaacag

SEQ ID NO: 3670558 - RNA, 13 nt, Human
uccucuuucagcu

SEQ ID NO: 3670559 - RNA, 15 nt, Human
uccucuuucagcucc

SEQ ID NO: 3670560 - RNA, 16 nt, Human
uccucuuucagcuccu

SEQ ID NO: 3670561 - RNA, 11 nt, Human
uccucuuucca

SEQ ID NO: 3670562 - RNA, 12 nt, Human
uccucuuuccau

SEQ ID NO: 3670563 - RNA, 15 nt, Human
uccucuuucucuccc

SEQ ID NO: 3670564 - RNA, 23 nt, Human
uccucuuugcuuugcuuucugcu

SEQ ID NO: 3670565 - RNA, 19 nt, Human
uccucuuuggucuacacug

SEQ ID NO: 3670566 - RNA, 21 nt, Human
uccucuuuggucuacacugug

SEQ ID NO: 3670567 - RNA, 11 nt, Human
uccucuuuguu

SEQ ID NO: 3670568 - RNA, 22 nt, Human
uccucuuuuguuguuucuuaau

SEQ ID NO: 3670569 - RNA, 13 nt, Human
uccucuuuuucca

SEQ ID NO: 3670570 - RNA, 21 nt, Human
uccugaaaacccuugccaugu

SEQ ID NO: 3670571 - RNA, 22 nt, Human
uccugaaaacccuugccaugug

SEQ ID NO: 3670572 - RNA, 16 nt, Human
uccugaaacgcuccuu

SEQ ID NO: 3670573 - RNA, 21 nt, Human
uccugaaacgcuccuuugugu

SEQ ID NO: 3670574 - RNA, 23 nt, Human
uccugaaacuauauuuugucaua

SEQ ID NO: 3670575 - RNA, 18 nt, Human
uccugaaagaaacaguua

SEQ ID NO: 3670576 - RNA, 23 nt, Human
uccugaacagcauggcacucccu

SEQ ID NO: 3670577 - RNA, 23 nt, Human
uccugaaccgcacagcucaggag

SEQ ID NO: 3670578 - RNA, 20 nt, Human
uccugaaccugaugcugacu

SEQ ID NO: 3670579 - RNA, 14 nt, Human
uccugaagaauuaa

SEQ ID NO: 3670580 - RNA, 14 nt, Human
uccugaagaggcgg

SEQ ID NO: 3670581 - RNA, 22 nt, Human
uccugaauccaaacuaauccau

SEQ ID NO: 3670582 - RNA, 19 nt, Human
uccugaaugaaauaucaga

SEQ ID NO: 3670583 - RNA, 21 nt, Human
uccugaauuuuauuuuuuggg

SEQ ID NO: 3670584 - RNA, 15 nt, Human
uccugacaccccacu

SEQ ID NO: 3670585 - RNA, 19 nt, Human
uccugacaccccacuuagc

SEQ ID NO: 3670586 - RNA, 21 nt, Human
uccugacacccuucucccacu

SEQ ID NO: 3670587 - RNA, 15 nt, Human
uccugacacugcugg

SEQ ID NO: 3670588 - RNA, 13 nt, Human
uccugacacuuua

SEQ ID NO: 3670589 - RNA, 16 nt, Human
uccugacaucacagca

SEQ ID NO: 3670590 - RNA, 18 nt, Human
uccugacaucacagcagc

SEQ ID NO: 3670591 - RNA, 19 nt, Human
uccugacaucacagcagcc

SEQ ID NO: 3670592 - RNA, 16 nt, Human
uccugaccacccuccc

SEQ ID NO: 3670593 - RNA, 21 nt, Human
uccugaccaguugcagucacu

SEQ ID NO: 3670594 - RNA, 22 nt, Human
uccugaccaguugcagucacuc

SEQ ID NO: 3670595 - RNA, 16 nt, Human
uccugacccagucccc

SEQ ID NO: 3670596 - RNA, 15 nt, Human
uccugaccugucuca

SEQ ID NO: 3670597 - RNA, 22 nt, Human
uccugacggcgcccccagugug

SEQ ID NO: 3670598 - RNA, 18 nt, Human
uccugacuauuauguugu

SEQ ID NO: 3670599 - RNA, 22 nt, Human
uccugacuauuauguuguuaga

SEQ ID NO: 3670600 - RNA, 14 nt, Human
uccugacucugccc

SEQ ID NO: 3670601 - RNA, 16 nt, Human
uccugacucugccccc

SEQ ID NO: 3670602 - RNA, 15 nt, Human
uccugacuggugcug

SEQ ID NO: 3670603 - RNA, 22 nt, Human
uccugacuucaggggcugcccg

SEQ ID NO: 3670604 - RNA, 13 nt, Human
uccugacuucuaa

SEQ ID NO: 3670605 - RNA, 13 nt, Human
uccugacuuuuaa

SEQ ID NO: 3670606 - RNA, 19 nt, Human
uccugagaaaaaagguucc

SEQ ID NO: 3670607 - RNA, 15 nt, Human
uccugagaaagcuca

SEQ ID NO: 3670608 - RNA, 13 nt, Human
uccugagaagcau

SEQ ID NO: 3670609 - RNA, 16 nt, Human
uccugagaccccuggc

SEQ ID NO: 3670610 - RNA, 17 nt, Human
uccugagaccccuggcc

SEQ ID NO: 3670611 - RNA, 20 nt, Human
uccugagaccccuggccucc

SEQ ID NO: 3670612 - RNA, 21 nt, Human
uccugagaccccuggccuccg

SEQ ID NO: 3670613 - RNA, 13 nt, Human
uccugagagcugc

SEQ ID NO: 3670614 - RNA, 14 nt, Human
uccugagcacugcc

SEQ ID NO: 3670615 - RNA, 15 nt, Human
uccugagcacugcca

SEQ ID NO: 3670616 - RNA, 17 nt, Human
uccugagcacugccagg

SEQ ID NO: 3670617 - RNA, 18 nt, Human
uccugagcacugccagga

SEQ ID NO: 3670618 - RNA, 19 nt, Human
uccugagcacugccaggag

SEQ ID NO: 3670619 - RNA, 23 nt, Human
uccugagccagugucaggaggaa

SEQ ID NO: 3670620 - RNA, 12 nt, Human
uccugagccccg

SEQ ID NO: 3670621 - RNA, 22 nt, Human
uccugagccccgcccucuuccu

SEQ ID NO: 3670622 - RNA, 23 nt, Human
uccugagccccgcccucuuccug

SEQ ID NO: 3670623 - RNA, 13 nt, Human
uccugagcuagga

SEQ ID NO: 3670624 - RNA, 14 nt, Human
uccugagcucagcg

SEQ ID NO: 3670625 - RNA, 15 nt, Human
uccugagcuuuaugg

SEQ ID NO: 3670626 - RNA, 18 nt, Human
uccugaggacagcugucc

SEQ ID NO: 3670627 - RNA, 15 nt, Human
uccugaggcuccacu

SEQ ID NO: 3670628 - RNA, 16 nt, Human
uccugaggcuccacuu

SEQ ID NO: 3670629 - RNA, 21 nt, Human
uccugaggcuccacuuggucu

SEQ ID NO: 3670630 - RNA, 15 nt, Human
uccugaggcugggcu

SEQ ID NO: 3670631 - RNA, 16 nt, Human
uccugaggcugggcuc

SEQ ID NO: 3670632 - RNA, 17 nt, Human
uccugaggcuuuggauu

SEQ ID NO: 3670633 - RNA, 21 nt, Human
uccugagggaggaccuggggc

SEQ ID NO: 3670634 - RNA, 23 nt, Human
uccugaggggagacagagcaacc

SEQ ID NO: 3670635 - RNA, 19 nt, Human
uccugaggguccccaccug

SEQ ID NO: 3670636 - RNA, 22 nt, Human
uccugaggguccccaccuggga

SEQ ID NO: 3670637 - RNA, 19 nt, Human
uccugaguagcuggauuac

SEQ ID NO: 3670638 - RNA, 16 nt, Human
uccugaguggccaggg

SEQ ID NO: 3670639 - RNA, 21 nt, Human
uccugauaaaacaacagcucg

SEQ ID NO: 3670640 - RNA, 23 nt, Human
uccugauaugauuuaaaacaugu

SEQ ID NO: 3670641 - RNA, 20 nt, Human
uccugauccacuuuggggga

SEQ ID NO: 3670642 - RNA, 21 nt, Human
ggaaacuaggugcauauuuau

SEQ ID NO: 3670643 - RNA, 22 nt, Human
ggaaacucaccugcuggccccu

SEQ ID NO: 3670644 - RNA, 14 nt, Human
ggaaacucagggcu

SEQ ID NO: 3670645 - RNA, 20 nt, Human
ggaaacuccacaucugccuu

SEQ ID NO: 3670646 - RNA, 21 nt, Human
ggaaacuccacaucugccuua

SEQ ID NO: 3670647 - RNA, 15 nt, Human
ggaaacucuugcuau

SEQ ID NO: 3670648 - RNA, 12 nt, Human
ggaaacugaaug

SEQ ID NO: 3670649 - RNA, 13 nt, Human
ggaaacugccagc

SEQ ID NO: 3670650 - RNA, 21 nt, Human
ggaaacuuccaagaccugacu

SEQ ID NO: 3670651 - RNA, 19 nt, Human
ggaaacuugucacuugcau

SEQ ID NO: 3670652 - RNA, 18 nt, Human
ggaaagaagagccggagc

SEQ ID NO: 3670653 - RNA, 15 nt, Human
ggaaagacacugccu

SEQ ID NO: 3670654 - RNA, 20 nt, Human
ggaaagacacugccugggcu

SEQ ID NO: 3670655 - RNA, 19 nt, Human
uccugggccccucccuacc

SEQ ID NO: 3670656 - RNA, 19 nt, Human
uccugggcgcccuggaagc

SEQ ID NO: 3670657 - RNA, 11 nt, Human
ucccaggaccc

SEQ ID NO: 3670658 - RNA, 12 nt, Human
ucccaggacccu

SEQ ID NO: 3670659 - RNA, 13 nt, Human
ucccaggacccug

SEQ ID NO: 3670660 - RNA, 16 nt, Human
ucccaggacccugaag

SEQ ID NO: 3670661 - RNA, 22 nt, Human
ucccaggagacaguucaagaaa

SEQ ID NO: 3670662 - RNA, 18 nt, Human
ucccaggaguucugcuca

SEQ ID NO: 3670663 - RNA, 19 nt, Human
ucccaggaguucugcucau

SEQ ID NO: 3670664 - RNA, 16 nt, Human
ucccaggaugagcauc

SEQ ID NO: 3670665 - RNA, 24 nt, Human
ucccaggaugagcaucccaggauc

SEQ ID NO: 3670666 - RNA, 19 nt, Human
ucccaggcaaggcugugga

SEQ ID NO: 3670667 - RNA, 15 nt, Human
ucccaggcagggaga

SEQ ID NO: 3670668 - RNA, 18 nt, Human
ucccaggcauuccccagg

SEQ ID NO: 3670669 - RNA, 20 nt, Human
ucccaggcauuccccaggag

SEQ ID NO: 3670670 - RNA, 22 nt, Human
ucccaggcauuccccaggaggc

SEQ ID NO: 3670671 - RNA, 24 nt, Human
ucccaggcauuccccaggaggcca

SEQ ID NO: 3670672 - RNA, 12 nt, Human
ucccaggcccac

SEQ ID NO: 3670673 - RNA, 11 nt, Human
ucccaggcccc

SEQ ID NO: 3670674 - RNA, 18 nt, Human
ucccaggccccaugaccu

SEQ ID NO: 3670675 - RNA, 22 nt, Human
ucccaggccccaugaccuccag

SEQ ID NO: 3670676 - RNA, 18 nt, Human
ucccaggcgccccuuccc

SEQ ID NO: 3670677 - RNA, 21 nt, Human
ucccaggcgccccuucccccu

SEQ ID NO: 3670678 - RNA, 15 nt, Human
ucccaggcuggggcu

SEQ ID NO: 3670679 - RNA, 16 nt, Human
ucccaggcuggggcug

SEQ ID NO: 3670680 - RNA, 19 nt, Human
ucccagggagcaagggcag

SEQ ID NO: 3670681 - RNA, 21 nt, Human
ucccagggagcaugagaggag

SEQ ID NO: 3670682 - RNA, 22 nt, Human
ucccagggagcaugagaggagg

SEQ ID NO: 3670683 - RNA, 16 nt, Human
ucccagggccagggcc

SEQ ID NO: 3670684 - RNA, 20 nt, Human
ucccagggccagggcccugc

SEQ ID NO: 3670685 - RNA, 17 nt, Human
ucccaggggaccacacc

SEQ ID NO: 3670686 - RNA, 18 nt, Human
ucccaggggcucccuccg

SEQ ID NO: 3670687 - RNA, 17 nt, Human
ucccaggggucucccug

SEQ ID NO: 3670688 - RNA, 19 nt, Human
ucccaggggucucccuggc

SEQ ID NO: 3670689 - RNA, 21 nt, Human
ucccaggggucucccuggcuc

SEQ ID NO: 3670690 - RNA, 23 nt, Human
ucccaggguagcccgccugccag

SEQ ID NO: 3670691 - RNA, 19 nt, Human
ucccaggguuuuaacuuug

SEQ ID NO: 3670692 - RNA, 16 nt, Human
ucccagguaccagcug

SEQ ID NO: 3670693 - RNA, 19 nt, Human
ucccagguaccagcugcgc

SEQ ID NO: 3670694 - RNA, 17 nt, Human
ucccaggugcagccaga

SEQ ID NO: 3670695 - RNA, 15 nt, Human
ucccagguguuaaca

SEQ ID NO: 3670696 - RNA, 23 nt, Human
ucccagguguuaacauuccaaga

SEQ ID NO: 3670697 - RNA, 17 nt, Human
ucccagguuggcucugc

SEQ ID NO: 3670698 - RNA, 19 nt, Human
ucccagguuggcucugcca

SEQ ID NO: 3670699 - RNA, 22 nt, Human
ucccagucaccuuguggcaagc

SEQ ID NO: 3670700 - RNA, 23 nt, Human
ucccaguccccagcccuucacau

SEQ ID NO: 3670701 - RNA, 15 nt, Human
ucccagugaauucuu

SEQ ID NO: 3670702 - RNA, 19 nt, Human
ucccagugacacuucagag

SEQ ID NO: 3670703 - RNA, 18 nt, Human
ucccaguggccucaaccc

SEQ ID NO: 3670704 - RNA, 22 nt, Human
ucccaguggccucaacccuccc

SEQ ID NO: 3670705 - RNA, 16 nt, Human
ucccaguggcugcugc

SEQ ID NO: 3670706 - RNA, 18 nt, Human
ucccaguggcugcugccc

SEQ ID NO: 3670707 - RNA, 19 nt, Human
ucccaguggcugcugccca

SEQ ID NO: 3670708 - RNA, 15 nt, Human
ucccagugggaggcg

SEQ ID NO: 3670709 - RNA, 17 nt, Human
ucccagugggaggggca

SEQ ID NO: 3670710 - RNA, 23 nt, Human
ucccagugggaggggcaggcuga

SEQ ID NO: 3670711 - RNA, 15 nt, Human
ucccagugucuuccu

SEQ ID NO: 3670712 - RNA, 19 nt, Human
ucccagugucuuccugugg

SEQ ID NO: 3670713 - RNA, 20 nt, Human
ucccaguucaggagucccaa

SEQ ID NO: 3670714 - RNA, 22 nt, Human
ucccaguuggagcuccagccug

SEQ ID NO: 3670715 - RNA, 13 nt, Human
ucccaguuuuguu

SEQ ID NO: 3670716 - RNA, 18 nt, Human
ucccauaaccgcugauuc

SEQ ID NO: 3670717 - RNA, 14 nt, Human
ucccauaccaccca

SEQ ID NO: 3670718 - RNA, 18 nt, Human
ucccauagauacucucuu

SEQ ID NO: 3670719 - RNA, 19 nt, Human
ucccauagauacucucuuc

SEQ ID NO: 3670720 - RNA, 16 nt, Human
ucccauagucccugcc

SEQ ID NO: 3670721 - RNA, 20 nt, Human
ucccauaucaaaagacacag

SEQ ID NO: 3670722 - RNA, 15 nt, Human
ucccauauccugccu

SEQ ID NO: 3670723 - RNA, 18 nt, Human
ucccauauccugccucag

SEQ ID NO: 3670724 - RNA, 15 nt, Human
ucccaucacccgcua

SEQ ID NO: 3670725 - RNA, 23 nt, Human
ucccaucacguguacuggcuccu

SEQ ID NO: 3670726 - RNA, 18 nt, Human
ucccaucccacugcuccc

SEQ ID NO: 3670727 - RNA, 13 nt, Human
ucccaucccaucc

SEQ ID NO: 3670728 - RNA, 15 nt, Human
ucccaucccauccca

SEQ ID NO: 3670729 - RNA, 17 nt, Human
ucccaucccaucccauc

SEQ ID NO: 3670730 - RNA, 16 nt, Human
ucccaucccccugccc

SEQ ID NO: 3670731 - RNA, 18 nt, Human
ucccaucccccugcccuc

SEQ ID NO: 3670732 - RNA, 19 nt, Human
ucccaucccccugcccucg

SEQ ID NO: 3670733 - RNA, 15 nt, Human
ucccauccccugugg

SEQ ID NO: 3670734 - RNA, 18 nt, Human
ucccaucccgcucuuuuc

SEQ ID NO: 3670735 - RNA, 19 nt, Human
ucccaucccgcucuuuucc

SEQ ID NO: 3670736 - RNA, 20 nt, Human
ucccaucccgcucuuuuccu

SEQ ID NO: 3670737 - RNA, 14 nt, Human
ucccauccuacccu

SEQ ID NO: 3670738 - RNA, 18 nt, Human
ucccauccuacccucggg

SEQ ID NO: 3670739 - RNA, 23 nt, Human
ucccaucuaagcugcagcuuccu

SEQ ID NO: 3670740 - RNA, 20 nt, Human
ucccaucucacacaugagca

SEQ ID NO: 3670741 - RNA, 19 nt, Human
ucccaucugcaccccuucu

SEQ ID NO: 3670742 - RNA, 14 nt, Human
ucccaucugggagu

SEQ ID NO: 3670743 - RNA, 15 nt, Human
ucccaucuuccaagg

SEQ ID NO: 3670744 - RNA, 23 nt, Human
ucccaucuuuuuaaccucuguuc

SEQ ID NO: 3670745 - RNA, 14 nt, Human
ucccaugaacacac

SEQ ID NO: 3670746 - RNA, 16 nt, Human
ucccaugaagccuuuu

SEQ ID NO: 3670747 - RNA, 19 nt, Human
ucccaugaagccuuuugaa

SEQ ID NO: 3670748 - RNA, 18 nt, Human
ucccaugacccaccccug

SEQ ID NO: 3670749 - RNA, 22 nt, Human
ucccaugacccaccccugugcu

SEQ ID NO: 3670750 - RNA, 16 nt, Human
ucccaugcaggcccuu

SEQ ID NO: 3670751 - RNA, 22 nt, Human
ucccauggacacuccagugcca

SEQ ID NO: 3670752 - RNA, 17 nt, Human
ucccauggagccccagc

SEQ ID NO: 3670753 - RNA, 18 nt, Human
ucccauggagccccagcc

SEQ ID NO: 3670754 - RNA, 19 nt, Human
ucccauggagccccagccc

SEQ ID NO: 3670755 - RNA, 21 nt, Human
ucccauggagccccagccccc

SEQ ID NO: 3670756 - RNA, 11 nt, Human
ucccauggugc

SEQ ID NO: 3670757 - RNA, 16 nt, Human
ucccauguaacagaaa

SEQ ID NO: 3670758 - RNA, 19 nt, Human
ucccauguaacagaaaggg

SEQ ID NO: 3670759 - RNA, 13 nt, Human
ucccaugugcaua

SEQ ID NO: 3670760 - RNA, 20 nt, Human
ucccauuaaucauuucccca

SEQ ID NO: 3670761 - RNA, 21 nt, Human
ucccauuaaucauuuccccau

SEQ ID NO: 3670762 - RNA, 14 nt, Human
ucccauuauucaaa

SEQ ID NO: 3670763 - RNA, 18 nt, Human
ucccauuauucaaaguug

SEQ ID NO: 3670764 - RNA, 13 nt, Human
ucccauuccccca

SEQ ID NO: 3670765 - RNA, 19 nt, Human
ucccauucccccagugcgg

SEQ ID NO: 3670766 - RNA, 13 nt, Human
ucccauuccugaa

SEQ ID NO: 3670767 - RNA, 14 nt, Human
ucccauuccugaag

SEQ ID NO: 3670768 - RNA, 14 nt, Human
ucccauugcccugg

SEQ ID NO: 3670769 - RNA, 15 nt, Human
ucccauugcccuggu

SEQ ID NO: 3670770 - RNA, 17 nt, Human
ucccauugucccucugc

SEQ ID NO: 3670771 - RNA, 22 nt, Human
ucccauugucuucugaccucua

SEQ ID NO: 3670772 - RNA, 16 nt, Human
ucccauuguggcuccu

SEQ ID NO: 3670773 - RNA, 21 nt, Human
ucccauuuagaauggugauuu

SEQ ID NO: 3670774 - RNA, 23 nt, Human
ucccauuuagaauggugauuuua

SEQ ID NO: 3670775 - RNA, 16 nt, Human
ucccauuuaucgcaga

SEQ ID NO: 3670776 - RNA, 17 nt, Human
ucccauuuaucuaaaua

SEQ ID NO: 3670777 - RNA, 13 nt, Human
ucccauuucagcu

SEQ ID NO: 3670778 - RNA, 21 nt, Human
ucccauuucuaaaggccucuu

SEQ ID NO: 3670779 - RNA, 23 nt, Human
ucccauuucuaccuaagucagcu

SEQ ID NO: 3670780 - RNA, 14 nt, Human
ucccauuucuuaau

SEQ ID NO: 3670781 - RNA, 22 nt, Human
ucccauuuucagacugcuuuaa

SEQ ID NO: 3670782 - RNA, 18 nt, Human
ucccauuuuggaaguuuu

SEQ ID NO: 3670783 - RNA, 14 nt, Human
uccccaaaacaaag

SEQ ID NO: 3670784 - RNA, 17 nt, Human
uccccaaaacaaagucu

SEQ ID NO: 3670785 - RNA, 21 nt, Human
uccccaaaacaaagucuuugg

SEQ ID NO: 3670786 - RNA, 23 nt, Human
uccccaaaggcuuugcccugcug

SEQ ID NO: 3670787 - RNA, 14 nt, Human
uccccaaagggugu

SEQ ID NO: 3670788 - RNA, 18 nt, Human
uccccaaaucaauacacu

SEQ ID NO: 3670789 - RNA, 15 nt, Human
uccccaacagcgccc

SEQ ID NO: 3670790 - RNA, 17 nt, Human
uccccaacagcgcccaa

SEQ ID NO: 3670791 - RNA, 22 nt, Human
uccccaaccgugucugucuggc

SEQ ID NO: 3670792 - RNA, 19 nt, Human
uccccaacugaccaccuuu

SEQ ID NO: 3670793 - RNA, 17 nt, Human
uccccaagaaagccuca

SEQ ID NO: 3670794 - RNA, 22 nt, Human
uccccaaguacaaccacaccca

SEQ ID NO: 3670795 - RNA, 20 nt, Human
uccccaauaauugcagaacu

SEQ ID NO: 3670796 - RNA, 16 nt, Human
uccccaaugagacuug

SEQ ID NO: 3670797 - RNA, 19 nt, Human
uccccaaugagacuugccu

SEQ ID NO: 3670798 - RNA, 22 nt, Human
ggacugggagcccccagccugu

SEQ ID NO: 3670799 - RNA, 23 nt, Human
ggacuggggaugugggagggagc

SEQ ID NO: 3670800 - RNA, 15 nt, Human
ggacugggggccaga

SEQ ID NO: 3670801 - RNA, 11 nt, Human
ggacuggguuu

SEQ ID NO: 3670802 - RNA, 9 nt, Human
ggacuggug

SEQ ID NO: 3670803 - RNA, 21 nt, Human
ggacuggugcccuccucacuc

SEQ ID NO: 3670804 - RNA, 19 nt, Human
ggacugguggccccugccu

SEQ ID NO: 3670805 - RNA, 21 nt, Human
ggacuguaaguugggcuugcu

SEQ ID NO: 3670806 - RNA, 21 nt, Human
ggacugugacaggcagcagag

SEQ ID NO: 3670807 - RNA, 17 nt, Human
ggacuguggugacuuug

SEQ ID NO: 3670808 - RNA, 22 nt, Human
ggacuguggugacuuuggauaa

SEQ ID NO: 3670809 - RNA, 17 nt, Human
ggacugugugcucagga

SEQ ID NO: 3670810 - RNA, 22 nt, Human
ggacugugugcucaggagcccu

SEQ ID NO: 3670811 - RNA, 23 nt, Human
ggacuguugacauccaagcuucc

SEQ ID NO: 3670812 - RNA, 21 nt, Human
ggacuguuuuuuccugagcuu

SEQ ID NO: 3670813 - RNA, 20 nt, Human
ggacuuaacggcuccaggau

SEQ ID NO: 3670814 - RNA, 23 nt, Human
ggacuuaagcaucuggcucuaau

SEQ ID NO: 3670815 - RNA, 15 nt, Human
ggacuuagaaagcag

SEQ ID NO: 3670816 - RNA, 19 nt, Human
ggacuucaaagcaagcugg

SEQ ID NO: 3670817 - RNA, 21 nt, Human
ggacuucacgaaguguugcau

SEQ ID NO: 3670818 - RNA, 15 nt, Human
ggacuuccaugccuu

SEQ ID NO: 3670819 - RNA, 20 nt, Human
ggacuuccuguccagcucca

SEQ ID NO: 3670820 - RNA, 21 nt, Human
ggacuuccuguccagcuccaa

SEQ ID NO: 3670821 - RNA, 22 nt, Human
ggacuucuuuaauuuuggaauu

SEQ ID NO: 3670822 - RNA, 19 nt, Human
ggacuugaacuuuccugga

SEQ ID NO: 3670823 - RNA, 18 nt, Human
ggacuugaggauuuugag

SEQ ID NO: 3670824 - RNA, 15 nt, Human
ggacuuggaagcucc

SEQ ID NO: 3670825 - RNA, 17 nt, Human
ggacuuggaagcuccgc

SEQ ID NO: 3670826 - RNA, 19 nt, Human
ggacuuguauauuuguaca

SEQ ID NO: 3670827 - RNA, 20 nt, Human
ggacuuguauauuuguacaa

SEQ ID NO: 3670828 - RNA, 20 nt, Human
ggacuuucucuaauaauaaa

SEQ ID NO: 3670829 - RNA, 14 nt, Human
ggacuuugcacacu

SEQ ID NO: 3670830 - RNA, 22 nt, Human
ggacuuugcugauuuccccucu

SEQ ID NO: 3670831 - RNA, 12 nt, Human
ggacuuuguaca

SEQ ID NO: 3670832 - RNA, 21 nt, Human
ggacuuuguuaguuucuccaa

SEQ ID NO: 3670833 - RNA, 18 nt, Human
ggacuuuuauuuccagug

SEQ ID NO: 3670834 - RNA, 22 nt, Human
ggacuuuucguuaacauugacc

SEQ ID NO: 3670835 - RNA, 13 nt, Human
ggacuuuucugca

SEQ ID NO: 3670836 - RNA, 13 nt, Human
ggagaaaacacuu

SEQ ID NO: 3670837 - RNA, 15 nt, Human
ggagaaaaggaaaag

SEQ ID NO: 3670838 - RNA, 20 nt, Human
ggagaaaauucaauuguaaa

SEQ ID NO: 3670839 - RNA, 11 nt, Human
ggagaaacaca

SEQ ID NO: 3670840 - RNA, 23 nt, Human
ggagaaagcugacuuggcuggug

SEQ ID NO: 3670841 - RNA, 22 nt, Human
ggagaaauacuugaacuugccu

SEQ ID NO: 3670842 - RNA, 18 nt, Human
ggagaaaugaaaaaauau

SEQ ID NO: 3670843 - RNA, 17 nt, Human
ggagaaauguuguucau

SEQ ID NO: 3670844 - RNA, 15 nt, Human
ggagaaauugacaga

SEQ ID NO: 3670845 - RNA, 16 nt, Human
ggagaaccaccuaccc

SEQ ID NO: 3670846 - RNA, 15 nt, Human
ggagaaccucaggcu

SEQ ID NO: 3670847 - RNA, 19 nt, Human
ggagaagaaagaacuaucu

SEQ ID NO: 3670848 - RNA, 23 nt, Human
ggagaagaaagaggugaccccag

SEQ ID NO: 3670849 - RNA, 13 nt, Human
ggagaagaaguca

SEQ ID NO: 3670850 - RNA, 13 nt, Human
ggagaagagagga

SEQ ID NO: 3670851 - RNA, 15 nt, Human
ggagaagagcuguuc

SEQ ID NO: 3670852 - RNA, 23 nt, Human
ggagaagagcuguucacagccag

SEQ ID NO: 3670853 - RNA, 19 nt, Human
ucgcccaugcuggagugca

SEQ ID NO: 3670854 - RNA, 15 nt, Human
ucgccccagaucacc

SEQ ID NO: 3670855 - RNA, 22 nt, Human
ucgccccagaucaccagcccgg

SEQ ID NO: 3670856 - RNA, 14 nt, Human
ucgccccagcaggu

SEQ ID NO: 3670857 - RNA, 14 nt, Human
ucgccccuggcaga

SEQ ID NO: 3670858 - RNA, 14 nt, Human
ucgcccucccaggc

SEQ ID NO: 3670859 - RNA, 17 nt, Human
ucgcccucccaggcucu

SEQ ID NO: 3670860 - RNA, 18 nt, Human
ucgcccuccuuucugugc

SEQ ID NO: 3670861 - RNA, 22 nt, Human
ucgcccuuacuucuugcccugg

SEQ ID NO: 3670862 - RNA, 14 nt, Human
ucgccguggcugcg

SEQ ID NO: 3670863 - RNA, 17 nt, Human
ucgccucggaucagcug

SEQ ID NO: 3670864 - RNA, 21 nt, Human
ucgccugacaaccacuggucu

SEQ ID NO: 3670865 - RNA, 14 nt, Human
ucgccuggccugag

SEQ ID NO: 3670866 - RNA, 15 nt, Human
ucgccuggccugagg

SEQ ID NO: 3670867 - RNA, 12 nt, Human
ucgccuguaauc

SEQ ID NO: 3670868 - RNA, 21 nt, Human
ucgccuuagcauguuugcuga

SEQ ID NO: 3670869 - RNA, 15 nt, Human
ucgccuuccaccucu

SEQ ID NO: 3670870 - RNA, 12 nt, Human
ucgccuucccca

SEQ ID NO: 3670871 - RNA, 14 nt, Human
ucgccuucccuccu

SEQ ID NO: 3670872 - RNA, 22 nt, Human
ucgccuuucagcaggcagccuu

SEQ ID NO: 3670873 - RNA, 23 nt, Human
ucgccuuucccaggugcuacacc

SEQ ID NO: 3670874 - RNA, 13 nt, Human
ucgcgacaaugca

SEQ ID NO: 3670875 - RNA, 16 nt, Human
ucgcgacaaugcaaac

SEQ ID NO: 3670876 - RNA, 14 nt, Human
ucgcgcucaguaaa

SEQ ID NO: 3670877 - RNA, 14 nt, Human
ucgcgcucugcuca

SEQ ID NO: 3670878 - RNA, 12 nt, Human
ucgcgcugccug

SEQ ID NO: 3670879 - RNA, 17 nt, Human
ucgcggcccucaguagu

SEQ ID NO: 3670880 - RNA, 21 nt, Human
ucgcggccucuucucucagac

SEQ ID NO: 3670881 - RNA, 20 nt, Human
ucgcgugcccucgcugcuuc

SEQ ID NO: 3670882 - RNA, 21 nt, Human
ucgcuacuggcauaguuucau

SEQ ID NO: 3670883 - RNA, 21 nt, Human
ucgcuagcaguggcaggcaga

SEQ ID NO: 3670884 - RNA, 23 nt, Human
ucgcuagcauuucccaacacaaa

SEQ ID NO: 3670885 - RNA, 18 nt, Human
ucgcucaaucaagaaaau

SEQ ID NO: 3670886 - RNA, 23 nt, Human
ucgcuccaacuccaacauccacu

SEQ ID NO: 3670887 - RNA, 18 nt, Human
ucgcuccccacucugcuc

SEQ ID NO: 3670888 - RNA, 20 nt, Human
ucgcuccccacucugcucug

SEQ ID NO: 3670889 - RNA, 16 nt, Human
ucgcuccucaaccccu

SEQ ID NO: 3670890 - RNA, 22 nt, Human
ucgcuccucaaccccuccccuc

SEQ ID NO: 3670891 - RNA, 14 nt, Human
ucgcuccugcccac

SEQ ID NO: 3670892 - RNA, 18 nt, Human
ucgcucugucacccaggc

SEQ ID NO: 3670893 - RNA, 18 nt, Human
ucgcucuguugcccaggc

SEQ ID NO: 3670894 - RNA, 21 nt, Human
ucgcucuguugcccaggcugg

SEQ ID NO: 3670895 - RNA, 13 nt, Human
ucgcucuuugaga

SEQ ID NO: 3670896 - RNA, 17 nt, Human
ucgcugacuucauggaa

SEQ ID NO: 3670897 - RNA, 19 nt, Human
ucgcugauauauguguuuu

SEQ ID NO: 3670898 - RNA, 18 nt, Human
ucgcugaugcugggcugg

SEQ ID NO: 3670899 - RNA, 19 nt, Human
ucgcugaugcugggcuggg

SEQ ID NO: 3670900 - RNA, 20 nt, Human
ucgcugaugcugggcugggu

SEQ ID NO: 3670901 - RNA, 19 nt, Human
ucgcugccagcucuguauc

SEQ ID NO: 3670902 - RNA, 20 nt, Human
ucgcuggacucucagucucu

SEQ ID NO: 3670903 - RNA, 15 nt, Human
ucgcuggcccccacu

SEQ ID NO: 3670904 - RNA, 20 nt, Human
ucgcuggcccccacuggcug

SEQ ID NO: 3670905 - RNA, 21 nt, Human
ucgcuggcccccacuggcugu

SEQ ID NO: 3670906 - RNA, 23 nt, Human
ucgcugugucagcauagaaguaa

SEQ ID NO: 3670907 - RNA, 21 nt, Human
ucgcuguuaccgccugucucu

SEQ ID NO: 3670908 - RNA, 12 nt, Human
ucgcuguugcug

SEQ ID NO: 3670909 - RNA, 17 nt, Human
ucgcuguugcugaauag

SEQ ID NO: 3670910 - RNA, 14 nt, Human
ucgcuucccccaua

SEQ ID NO: 3670911 - RNA, 16 nt, Human
ucgcuucccccauagc

SEQ ID NO: 3670912 - RNA, 14 nt, Human
ucgcuucuugccuc

SEQ ID NO: 3670913 - RNA, 16 nt, Human
ucgcuucuugccucug

SEQ ID NO: 3670914 - RNA, 16 nt, Human
ucgcuuggcuccaugc

SEQ ID NO: 3670915 - RNA, 16 nt, Human
ucgcuuguaaauacca

SEQ ID NO: 3670916 - RNA, 15 nt, Human
ucgcuuuugauaauc

SEQ ID NO: 3670917 - RNA, 19 nt, Human
ucggaaaaauaaucaaaag

SEQ ID NO: 3670918 - RNA, 14 nt, Human
ucggaacagcagau

SEQ ID NO: 3670919 - RNA, 20 nt, Human
ucggaaccgcucaccuagag

SEQ ID NO: 3670920 - RNA, 18 nt, Human
ucggaacugcaugcugcu

SEQ ID NO: 3670921 - RNA, 18 nt, Human
ucggaacuguccuuuccu

SEQ ID NO: 3670922 - RNA, 19 nt, Human
ucggaacuguccuuuccuu

SEQ ID NO: 3670923 - RNA, 21 nt, Human
ucggacaagacccccagcacu

SEQ ID NO: 3670924 - RNA, 22 nt, Human
ucggacuaagccuaccugcucu

SEQ ID NO: 3670925 - RNA, 14 nt, Human
ucggagacagugau

SEQ ID NO: 3670926 - RNA, 21 nt, Human
ucggagacagugaucuccaua

SEQ ID NO: 3670927 - RNA, 14 nt, Human
ucggagcccugucu

SEQ ID NO: 3670928 - RNA, 12 nt, Human
ucggaggcccca

SEQ ID NO: 3670929 - RNA, 23 nt, Human
ucggaggcugcccccggcccccu

SEQ ID NO: 3670930 - RNA, 14 nt, Human
ucggaggcuuggga

SEQ ID NO: 3670931 - RNA, 20 nt, Human
ucggagggaauugaggucug

SEQ ID NO: 3670932 - RNA, 19 nt, Human
ucggaguaucugggaacug

SEQ ID NO: 3670933 - RNA, 23 nt, Human
ucggauaguugcuauuuuuguaa

SEQ ID NO: 3670934 - RNA, 14 nt, Human
ucggaucagcugag

SEQ ID NO: 3670935 - RNA, 19 nt, Human
ucggaucagcugagccuuc

SEQ ID NO: 3670936 - RNA, 16 nt, Human
ucggaucaggcuccca

SEQ ID NO: 3670937 - RNA, 13 nt, Human
ucggauccccuuc

SEQ ID NO: 3670938 - RNA, 15 nt, Human
ucggauccccuuccu

SEQ ID NO: 3670939 - RNA, 13 nt, Human
ucggauuuuuucc

SEQ ID NO: 3670940 - RNA, 16 nt, Human
ucggcccacagcuccc

SEQ ID NO: 3670941 - RNA, 15 nt, Human
ucggccccaccagug

SEQ ID NO: 3670942 - RNA, 11 nt, Human
ucuaaagcaaa

SEQ ID NO: 3670943 - RNA, 20 nt, Human
ucuaaagccauuguaguccu

SEQ ID NO: 3670944 - RNA, 16 nt, Human
ucuaaagcugccagcc

SEQ ID NO: 3670945 - RNA, 13 nt, Human
ucuaaaggaguuu

SEQ ID NO: 3670946 - RNA, 18 nt, Human
ucuaaaggaguuuauguu

SEQ ID NO: 3670947 - RNA, 19 nt, Human
ucuaaaggcuaccuuugua

SEQ ID NO: 3670948 - RNA, 14 nt, Human
ucuaaagguccaca

SEQ ID NO: 3670949 - RNA, 17 nt, Human
ucuaaaguuauauuuca

SEQ ID NO: 3670950 - RNA, 12 nt, Human
ucuaaaguucua

SEQ ID NO: 3670951 - RNA, 20 nt, Human
ucuaaaguucuaagauucug

SEQ ID NO: 3670952 - RNA, 12 nt, Human
ucuaaaguuuac

SEQ ID NO: 3670953 - RNA, 17 nt, Human
ucuaaaguuuacaguaa

SEQ ID NO: 3670954 - RNA, 19 nt, Human
ucuaaaguuuacaguaaau

SEQ ID NO: 3670955 - RNA, 17 nt, Human
ucuaaauaaaaugcuag

SEQ ID NO: 3670956 - RNA, 17 nt, Human
ucuaaauaccugcccug

SEQ ID NO: 3670957 - RNA, 23 nt, Human
ucuaaauauuuccuuaaacugug

SEQ ID NO: 3670958 - RNA, 17 nt, Human
ucuaaaucuauuuauua

SEQ ID NO: 3670959 - RNA, 20 nt, Human
ucuaaaucuauuuauuaaua

SEQ ID NO: 3670960 - RNA, 21 nt, Human
ucuaaaucuauuuauuaauau

SEQ ID NO: 3670961 - RNA, 14 nt, Human
ucuaaaucugucca

SEQ ID NO: 3670962 - RNA, 14 nt, Human
ucuaaaugcauauc

SEQ ID NO: 3670963 - RNA, 22 nt, Human
ucuaaauguuuggcauguaaau

SEQ ID NO: 3670964 - RNA, 16 nt, Human
ucuaaauucuuucauu

SEQ ID NO: 3670965 - RNA, 13 nt, Human
ucuaaauugaaua

SEQ ID NO: 3670966 - RNA, 17 nt, Human
ucuaaauugaauaaugg

SEQ ID NO: 3670967 - RNA, 13 nt, Human
ucuaaauuugaau

SEQ ID NO: 3670968 - RNA, 17 nt, Human
ucuaaauuugaauguua

SEQ ID NO: 3670969 - RNA, 18 nt, Human
ucuaaauuugaauguuaa

SEQ ID NO: 3670970 - RNA, 18 nt, Human
ucuaaauuuuauaucuug

SEQ ID NO: 3670971 - RNA, 19 nt, Human
ucuaacacuggcauguuca

SEQ ID NO: 3670972 - RNA, 13 nt, Human
ucuaacagcacca

SEQ ID NO: 3670973 - RNA, 22 nt, Human
ucuaacagcaccaaaucaaaau

SEQ ID NO: 3670974 - RNA, 13 nt, Human
ucuaacagcccuc

SEQ ID NO: 3670975 - RNA, 20 nt, Human
ucuaacagcccuccucugca

SEQ ID NO: 3670976 - RNA, 22 nt, Human
ucuaacagcccuccucugcacu

SEQ ID NO: 3670977 - RNA, 22 nt, Human
ucuaacagugaaguuuuacugu

SEQ ID NO: 3670978 - RNA, 23 nt, Human
ucuaacauuugagucccuuccag

SEQ ID NO: 3670979 - RNA, 19 nt, Human
ucuaaccacagcuccuuuu

SEQ ID NO: 3670980 - RNA, 15 nt, Human
ucuaacccucccaug

SEQ ID NO: 3670981 - RNA, 18 nt, Human
ucuaaccucaucuucuuc

SEQ ID NO: 3670982 - RNA, 18 nt, Human
ucuaaccucgcccucucc

SEQ ID NO: 3670983 - RNA, 22 nt, Human
ucuaaccuugaaugcugccagu

SEQ ID NO: 3670984 - RNA, 14 nt, Human
ucuaaccuuuacau

SEQ ID NO: 3670985 - RNA, 15 nt, Human
ucuaacuacaaaggu

SEQ ID NO: 3670986 - RNA, 14 nt, Human
ucuaacucagaauu

SEQ ID NO: 3670987 - RNA, 12 nt, Human
ucuaacuguaua

SEQ ID NO: 3670988 - RNA, 12 nt, Human
ucuaagaaaccc

SEQ ID NO: 3670989 - RNA, 17 nt, Human
ucuaagaauaauaaaau

SEQ ID NO: 3670990 - RNA, 20 nt, Human
ucuaagaauuuuaucuguuu

SEQ ID NO: 3670991 - RNA, 18 nt, Human
ucuaagacucaaauguuc

SEQ ID NO: 3670992 - RNA, 23 nt, Human
ucuaagacuuacucuaagaucuu

SEQ ID NO: 3670993 - RNA, 12 nt, Human
ucuaagaucuua

SEQ ID NO: 3670994 - RNA, 15 nt, Human
ucuaagaucuuagau

SEQ ID NO: 3670995 - RNA, 19 nt, Human
ucuaagaucuuagauucuc

SEQ ID NO: 3670996 - RNA, 18 nt, Human
ucuaagaugugauauucu

SEQ ID NO: 3670997 - RNA, 21 nt, Human
ucuaagaugugauauucuaag

SEQ ID NO: 3670998 - RNA, 22 nt, Human
ucuaagaugugauauucuaaga

SEQ ID NO: 3670999 - RNA, 16 nt, Human
ucuaagauguuauauu

SEQ ID NO: 3671000 - RNA, 23 nt, Human
ucuaagauguuauauuuuucuua

SEQ ID NO: 3671001 - RNA, 18 nt, Human
ucuaagauuaauagcauu

SEQ ID NO: 3671002 - RNA, 13 nt, Human
ucuaagauucuaa

SEQ ID NO: 3671003 - RNA, 16 nt, Human
ucuaagauucuaaagg

SEQ ID NO: 3671004 - RNA, 15 nt, Human
ucuaagauucuaaug

SEQ ID NO: 3671005 - RNA, 19 nt, Human
ucuaagauucuaaugauga

SEQ ID NO: 3671006 - RNA, 13 nt, Human
ucuaagauucuga

SEQ ID NO: 3671007 - RNA, 17 nt, Human
ucuaagcauaaaagaug

SEQ ID NO: 3671008 - RNA, 16 nt, Human
ucuaagccugaagggg

SEQ ID NO: 3671009 - RNA, 17 nt, Human
ucuaagccuuuccauaa

SEQ ID NO: 3671010 - RNA, 14 nt, Human
ucuaagcugcagcu

SEQ ID NO: 3671011 - RNA, 11 nt, Human
ucuaaggacaa

SEQ ID NO: 3671012 - RNA, 21 nt, Human
ucuaaggaccugaaauuccaa

SEQ ID NO: 3671013 - RNA, 23 nt, Human
ucuaaggaugucacagggccaac

SEQ ID NO: 3671014 - RNA, 20 nt, Human
ucuaaggccuaggauucuaa

SEQ ID NO: 3671015 - RNA, 17 nt, Human
ucuaaggcucugagagu

SEQ ID NO: 3671016 - RNA, 22 nt, Human
ucuaaggcucugagagucuaga

SEQ ID NO: 3671017 - RNA, 16 nt, Human
ucuaaggcuguuugcu

SEQ ID NO: 3671018 - RNA, 15 nt, Human
ggagcauggcuguga

SEQ ID NO: 3671019 - RNA, 22 nt, Human
ggagcauuggggauguuuuucu

SEQ ID NO: 3671020 - RNA, 15 nt, Human
ggagcauuuggagag

SEQ ID NO: 3671021 - RNA, 17 nt, Human
ggagccaacugcugcuu

SEQ ID NO: 3671022 - RNA, 16 nt, Human
ggagccaauggagacu

SEQ ID NO: 3671023 - RNA, 18 nt, Human
ggagccacuaacuagagc

SEQ ID NO: 3671024 - RNA, 23 nt, Human
ggagccaugcgcccccuccgccc

SEQ ID NO: 3671025 - RNA, 20 nt, Human
ggagcccacgcucacccccu

SEQ ID NO: 3671026 - RNA, 18 nt, Human
ggagcccacuguccuggg

SEQ ID NO: 3671027 - RNA, 20 nt, Human
ggagcccacuguccugggcc

SEQ ID NO: 3671028 - RNA, 22 nt, Human
ggagcccacuguccugggccug

SEQ ID NO: 3671029 - RNA, 23 nt, Human
ggagcccacuguccugggccugc

SEQ ID NO: 3671030 - RNA, 12 nt, Human
ggagcccaggag

SEQ ID NO: 3671031 - RNA, 13 nt, Human
ggagcccaggagu

SEQ ID NO: 3671032 - RNA, 14 nt, Human
ggagcccaggccag

SEQ ID NO: 3671033 - RNA, 20 nt, Human
ggagccccaggccucugugu

SEQ ID NO: 3671034 - RNA, 23 nt, Human
ggagccccaggccucuguguccu

SEQ ID NO: 3671035 - RNA, 12 nt, Human
ggagccccaggg

SEQ ID NO: 3671036 - RNA, 14 nt, Human
ggagcccccacccu

SEQ ID NO: 3671037 - RNA, 15 nt, Human
ggagcccccacccug

SEQ ID NO: 3671038 - RNA, 17 nt, Human
ggagcccccagccuguc

SEQ ID NO: 3671039 - RNA, 20 nt, Human
ggagcccccgccccgcccca

SEQ ID NO: 3671040 - RNA, 16 nt, Human
ggagccccgaggccuu

SEQ ID NO: 3671041 - RNA, 22 nt, Human
ggagccccgaggccuucucuga

SEQ ID NO: 3671042 - RNA, 15 nt, Human
ggagccccugggugg

SEQ ID NO: 3671043 - RNA, 14 nt, Human
ggagcccgcacccc

SEQ ID NO: 3671044 - RNA, 16 nt, Human
ggagcccgcaccccca

SEQ ID NO: 3671045 - RNA, 21 nt, Human
ggagcccgcacccccacccuu

SEQ ID NO: 3671046 - RNA, 12 nt, Human
ggagcccugccu

SEQ ID NO: 3671047 - RNA, 17 nt, Human
ggagcccuggagacccc

SEQ ID NO: 3671048 - RNA, 20 nt, Human
ggagcccugggaggcucugg

SEQ ID NO: 3671049 - RNA, 18 nt, Human
ggagcccugucuccucuc

SEQ ID NO: 3671050 - RNA, 22 nt, Human
ggagccgaagcccaggggccgg

SEQ ID NO: 3671051 - RNA, 21 nt, Human
ggagccgagaucacgccacug

SEQ ID NO: 3671052 - RNA, 13 nt, Human
ggagccgcagcag

SEQ ID NO: 3671053 - RNA, 20 nt, Human
ggagccgcuggcagaaggga

SEQ ID NO: 3671054 - RNA, 15 nt, Human
ggagccgggccgcag

SEQ ID NO: 3671055 - RNA, 18 nt, Human
ggagccgguaacuguccu

SEQ ID NO: 3671056 - RNA, 20 nt, Human
ggagccgguaacuguccugu

SEQ ID NO: 3671057 - RNA, 14 nt, Human
ggagccuaggacca

SEQ ID NO: 3671058 - RNA, 21 nt, Human
ggagccucauccgaggcaggg

SEQ ID NO: 3671059 - RNA, 15 nt, Human
ggagccucccugccu

SEQ ID NO: 3671060 - RNA, 12 nt, Human
ggagccuccugc

SEQ ID NO: 3671061 - RNA, 13 nt, Human
ggagccugacagc

SEQ ID NO: 3671062 - RNA, 21 nt, Human
ggagccugcaggguggugcug

SEQ ID NO: 3671063 - RNA, 20 nt, Human
ggagccuggcacaggacuga

SEQ ID NO: 3671064 - RNA, 12 nt, Human
ggagccuggugc

SEQ ID NO: 3671065 - RNA, 14 nt, Human
ggagcggaaagcag

SEQ ID NO: 3671066 - RNA, 19 nt, Human
ggagcggauugcaaagcaa

SEQ ID NO: 3671067 - RNA, 17 nt, Human
ggagcgggaccuguggc

SEQ ID NO: 3671068 - RNA, 14 nt, Human
ggagcgggucugcu

SEQ ID NO: 3671069 - RNA, 15 nt, Human
ggagcgguggcccug

SEQ ID NO: 3671070 - RNA, 15 nt, Human
ggagcuaaggcucua

SEQ ID NO: 3671071 - RNA, 12 nt, Human
ggagcuagccag

SEQ ID NO: 3671072 - RNA, 15 nt, Human
ggagcuagccagagg

SEQ ID NO: 3671073 - RNA, 20 nt, Human
ggagcucacuguggugucug

SEQ ID NO: 3671074 - RNA, 23 nt, Human
ggagcucacuguggugucugugu

SEQ ID NO: 3671075 - RNA, 13 nt, Human
ggagcuccagccu

SEQ ID NO: 3671076 - RNA, 15 nt, Human
ggagcuccagccuga

SEQ ID NO: 3671077 - RNA, 13 nt, Human
ggagcuccccucc

SEQ ID NO: 3671078 - RNA, 16 nt, Human
ggagcuccccucccca

SEQ ID NO: 3671079 - RNA, 18 nt, Human
ggagcuccucuccuggag

SEQ ID NO: 3671080 - RNA, 11 nt, Human
ggagcuccugg

SEQ ID NO: 3671081 - RNA, 12 nt, Human
ggagcugcaggg

SEQ ID NO: 3671082 - RNA, 17 nt, Human
ggagcugccuggacccg

SEQ ID NO: 3671083 - RNA, 17 nt, Human
ggagcugccuuggcuca

SEQ ID NO: 3671084 - RNA, 19 nt, Human
ggagcugcuauagccuggg

SEQ ID NO: 3671085 - RNA, 13 nt, Human
ggagcugcuggcu

SEQ ID NO: 3671086 - RNA, 15 nt, Human
ggagcugcuggcuug

SEQ ID NO: 3671087 - RNA, 17 nt, Human
ggagcuggaguccacug

SEQ ID NO: 3671088 - RNA, 18 nt, Human
uccugacccauugcuguu

SEQ ID NO: 3671089 - RNA, 15 nt, Human
uccugaccucaggca

SEQ ID NO: 3671090 - RNA, 18 nt, Human
uccugacgaaacuggccc

SEQ ID NO: 3671091 - RNA, 21 nt, Human
uccugacgaaacuggccccgg

SEQ ID NO: 3671092 - RNA, 22 nt, Human
uccugacuccuaccugcccugg

SEQ ID NO: 3671093 - RNA, 23 nt, Human
uccugacuccuaccugcccugga

SEQ ID NO: 3671094 - RNA, 17 nt, Human
uccugacucugcccccu

SEQ ID NO: 3671095 - RNA, 20 nt, Human
uccugacugaaaguaggggg

SEQ ID NO: 3671096 - RNA, 13 nt, Human
uccugacuggugc

SEQ ID NO: 3671097 - RNA, 23 nt, Human
uccugacugucucccgggacuac

SEQ ID NO: 3671098 - RNA, 14 nt, Human
uccugagaccccug

SEQ ID NO: 3671099 - RNA, 18 nt, Human
uccugagagcugcaugug

SEQ ID NO: 3671100 - RNA, 19 nt, Human
uccugagagcugcaugugu

SEQ ID NO: 3671101 - RNA, 13 nt, Human
uccugagccagau

SEQ ID NO: 3671102 - RNA, 14 nt, Human
uccugagccagauu

SEQ ID NO: 3671103 - RNA, 17 nt, Human
uccugagccagauuuca

SEQ ID NO: 3671104 - RNA, 19 nt, Human
uccugagccagauuucacu

SEQ ID NO: 3671105 - RNA, 21 nt, Human
uccugagccagauuucacucu

SEQ ID NO: 3671106 - RNA, 14 nt, Human
uccugagccccagg

SEQ ID NO: 3671107 - RNA, 17 nt, Human
uccugagcccccagcuu

SEQ ID NO: 3671108 - RNA, 19 nt, Human
uccugagcccccagcuucc

SEQ ID NO: 3671109 - RNA, 13 nt, Human
uccugagcucagc

SEQ ID NO: 3671110 - RNA, 19 nt, Human
uccugagcucagcguggag

SEQ ID NO: 3671111 - RNA, 22 nt, Human
uccugagcuuggccagaagggg

SEQ ID NO: 3671112 - RNA, 13 nt, Human
uccugagcuuuau

SEQ ID NO: 3671113 - RNA, 16 nt, Human
uccugaggacagcugu

SEQ ID NO: 3671114 - RNA, 19 nt, Human
uccugaggaucagaaagua

SEQ ID NO: 3671115 - RNA, 20 nt, Human
uccugaggcuccacuugguc

SEQ ID NO: 3671116 - RNA, 13 nt, Human
uccugaggcugag

SEQ ID NO: 3671117 - RNA, 12 nt, Human
uccugaggcugg

SEQ ID NO: 3671118 - RNA, 19 nt, Human
uccugaggcugggcucccu

SEQ ID NO: 3671119 - RNA, 15 nt, Human
uccugaggggcaucu

SEQ ID NO: 3671120 - RNA, 16 nt, Human
uccugaggggcaucug

SEQ ID NO: 3671121 - RNA, 20 nt, Human
uccugauaaagcacagcugu

SEQ ID NO: 3671122 - RNA, 19 nt, Human
uccugauaauaauugauca

SEQ ID NO: 3671123 - RNA, 21 nt, Human
uccugauccacuuugggggag

SEQ ID NO: 3671124 - RNA, 14 nt, Human
uccugaugacccag

SEQ ID NO: 3671125 - RNA, 16 nt, Human
uccugaugacccaggc

SEQ ID NO: 3671126 - RNA, 20 nt, Human
uccugaugacccaggcugcc

SEQ ID NO: 3671127 - RNA, 21 nt, Human
uccugauggcaggauggccug

SEQ ID NO: 3671128 - RNA, 21 nt, Human
uccugauggucagcucccuuc

SEQ ID NO: 3671129 - RNA, 19 nt, Human
uccugcaaaauuuuauagc

SEQ ID NO: 3671130 - RNA, 23 nt, Human
uccugcaaccaaacucccaucag

SEQ ID NO: 3671131 - RNA, 14 nt, Human
uccugcaaugaaag

SEQ ID NO: 3671132 - RNA, 18 nt, Human
uccugcaaugaagucucu

SEQ ID NO: 3671133 - RNA, 15 nt, Human
uccugcaauuuucua

SEQ ID NO: 3671134 - RNA, 16 nt, Human
uccugcaauuuucuaa

SEQ ID NO: 3671135 - RNA, 21 nt, Human
uccugcacaguuuucuggcug

SEQ ID NO: 3671136 - RNA, 18 nt, Human
uccugcaccggggccugg

SEQ ID NO: 3671137 - RNA, 19 nt, Human
uccugcagcaaacacucca

SEQ ID NO: 3671138 - RNA, 15 nt, Human
uccugcagcagagcc

SEQ ID NO: 3671139 - RNA, 17 nt, Human
uccugcagcaugguccc

SEQ ID NO: 3671140 - RNA, 22 nt, Human
uccugcagcauggucccugccu

SEQ ID NO: 3671141 - RNA, 12 nt, Human
uccugcagcccc

SEQ ID NO: 3671142 - RNA, 13 nt, Human
uccugcagcccca

SEQ ID NO: 3671143 - RNA, 22 nt, Human
uccugcagccuccuccugacca

SEQ ID NO: 3671144 - RNA, 17 nt, Human
uccugcaggcagccagg

SEQ ID NO: 3671145 - RNA, 11 nt, Human
uccugcaugca

SEQ ID NO: 3671146 - RNA, 22 nt, Human
uccugcauucacccagacagcu

SEQ ID NO: 3671147 - RNA, 16 nt, Human
uccugccaccagucac

SEQ ID NO: 3671148 - RNA, 17 nt, Human
uccugccaccagucacu

SEQ ID NO: 3671149 - RNA, 22 nt, Human
uccugccacccagccccagcca

SEQ ID NO: 3671150 - RNA, 13 nt, Human
uccugccaccugc

SEQ ID NO: 3671151 - RNA, 13 nt, Human
uccugccagcccc

SEQ ID NO: 3671152 - RNA, 17 nt, Human
uccugccaguguggaac

SEQ ID NO: 3671153 - RNA, 16 nt, Human
uccugcccaggagagc

SEQ ID NO: 3671154 - RNA, 19 nt, Human
uccugcccaggagagccag

SEQ ID NO: 3671155 - RNA, 14 nt, Human
uccugcccaguccc

SEQ ID NO: 3671156 - RNA, 19 nt, Human
uccugcccaguguuguuug

SEQ ID NO: 3671157 - RNA, 21 nt, Human
uccugcccccacaccuggccc

SEQ ID NO: 3671158 - RNA, 19 nt, Human
uccugcccccugaaacuua

SEQ ID NO: 3671159 - RNA, 22 nt, Human
uccugcccccugaaacuuauuu

SEQ ID NO: 3671160 - RNA, 21 nt, Human
uccugcccgcagaccucugga

SEQ ID NO: 3671161 - RNA, 16 nt, Human
uccugcccugcuguuu

SEQ ID NO: 3671162 - RNA, 11 nt, Human
uccugcccugg

SEQ ID NO: 3671163 - RNA, 14 nt, Human
uccugcccugggag

SEQ ID NO: 3671164 - RNA, 14 nt, Human
uccugccgacuccu

SEQ ID NO: 3671165 - RNA, 15 nt, Human
uccugccgacuccug

SEQ ID NO: 3671166 - RNA, 18 nt, Human
uccugccgcagagcuggc

SEQ ID NO: 3671167 - RNA, 16 nt, Human
uccugccggagaggaa

SEQ ID NO: 3671168 - RNA, 17 nt, Human
uccugccggagaggaag

SEQ ID NO: 3671169 - RNA, 14 nt, Human
uccugccucagccu

SEQ ID NO: 3671170 - RNA, 19 nt, Human
uccugccucagccucccaa

SEQ ID NO: 3671171 - RNA, 18 nt, Human
uccugccucagccucccg

SEQ ID NO: 3671172 - RNA, 21 nt, Human
uccugccuccuugauauuugu

SEQ ID NO: 3671173 - RNA, 15 nt, Human
uccugccucuacugg

SEQ ID NO: 3671174 - RNA, 22 nt, Human
uccugccucuacugggaaggcu

SEQ ID NO: 3671175 - RNA, 20 nt, Human
uccugccugccccucucccg

SEQ ID NO: 3671176 - RNA, 13 nt, Human
uccugccuggcca

SEQ ID NO: 3671177 - RNA, 18 nt, Human
uccugccuggucuccugc

SEQ ID NO: 3671178 - RNA, 17 nt, Human
uccugccugucugcccc

SEQ ID NO: 3671179 - RNA, 14 nt, Human
uccugccugugcug

SEQ ID NO: 3671180 - RNA, 14 nt, Human
uccugccuguggcc

SEQ ID NO: 3671181 - RNA, 15 nt, Human
uccugccuguggcca

SEQ ID NO: 3671182 - RNA, 17 nt, Human
uccugccuuagagccag

SEQ ID NO: 3671183 - RNA, 16 nt, Human
uccugccuuccuccug

SEQ ID NO: 3671184 - RNA, 22 nt, Human
uccugccuuccuccugggcccu

SEQ ID NO: 3671185 - RNA, 23 nt, Human
uccugccuuccuccugggcccuc

SEQ ID NO: 3671186 - RNA, 14 nt, Human
uccugccuucuguc

SEQ ID NO: 3671187 - RNA, 23 nt, Human
uccugccuucuguccugguguca

SEQ ID NO: 3671188 - RNA, 21 nt, Human
uccugccuuggccucccaagu

SEQ ID NO: 3671189 - RNA, 14 nt, Human
uccugccuuugccu

SEQ ID NO: 3671190 - RNA, 14 nt, Human
uccugcgggugggg

SEQ ID NO: 3671191 - RNA, 14 nt, Human
uccugcguccuccu

SEQ ID NO: 3671192 - RNA, 18 nt, Human
uccugcguccuccucacc

SEQ ID NO: 3671193 - RNA, 15 nt, Human
uccugcguguucuca

SEQ ID NO: 3671194 - RNA, 17 nt, Human
uccugcuaaaacaauga

SEQ ID NO: 3671195 - RNA, 20 nt, Human
uccugcuaacggugcucagg

SEQ ID NO: 3671196 - RNA, 18 nt, Human
uccugcuaaguuaauguu

SEQ ID NO: 3671197 - RNA, 14 nt, Human
uccugcuacucugu

SEQ ID NO: 3671198 - RNA, 19 nt, Human
uccugcuauuucccaagcu

SEQ ID NO: 3671199 - RNA, 15 nt, Human
uccugcuccacagug

SEQ ID NO: 3671200 - RNA, 13 nt, Human
uccugcuccagaa

SEQ ID NO: 3671201 - RNA, 14 nt, Human
uccugcuccagaau

SEQ ID NO: 3671202 - RNA, 20 nt, Human
uccugcuccagaauuuggaa

SEQ ID NO: 3671203 - RNA, 15 nt, Human
uccugcucucuaccc

SEQ ID NO: 3671204 - RNA, 13 nt, Human
uccugcucugcuc

SEQ ID NO: 3671205 - RNA, 20 nt, Human
uccugcugagccucacagca

SEQ ID NO: 3671206 - RNA, 12 nt, Human
uccugcugcacc

SEQ ID NO: 3671207 - RNA, 22 nt, Human
uccugcugcaccaacccagccg

SEQ ID NO: 3671208 - RNA, 16 nt, Human
uccugcugcagagggg

SEQ ID NO: 3671209 - RNA, 18 nt, Human
uccugcugcagaggggca

SEQ ID NO: 3671210 - RNA, 15 nt, Human
uccugcugcucccuc

SEQ ID NO: 3671211 - RNA, 19 nt, Human
uccugcugcucccucagac

SEQ ID NO: 3671212 - RNA, 14 nt, Human
uccugcugcugucu

SEQ ID NO: 3671213 - RNA, 15 nt, Human
uccugcugcugucug

SEQ ID NO: 3671214 - RNA, 13 nt, Human
uccugcugggcag

SEQ ID NO: 3671215 - RNA, 22 nt, Human
uccugcuguaaauuuggcuucu

SEQ ID NO: 3671216 - RNA, 14 nt, Human
uccugcuguuacau

SEQ ID NO: 3671217 - RNA, 22 nt, Human
uccugcuugaugggauucugga

SEQ ID NO: 3671218 - RNA, 23 nt, Human
uccugcuugaugggauucuggac

SEQ ID NO: 3671219 - RNA, 17 nt, Human
uccugcuugccaaggca

SEQ ID NO: 3671220 - RNA, 14 nt, Human
uccuggaaaccaca

SEQ ID NO: 3671221 - RNA, 22 nt, Human
uccuggaagcgcgagggccuca

SEQ ID NO: 3671222 - RNA, 23 nt, Human
uccuggaagugcuaauuuugaaa

SEQ ID NO: 3671223 - RNA, 15 nt, Human
uccuggacagcugug

SEQ ID NO: 3671224 - RNA, 18 nt, Human
uccuggacagcugugccu

SEQ ID NO: 3671225 - RNA, 22 nt, Human
uccuggacagcugugccucgcu

SEQ ID NO: 3671226 - RNA, 14 nt, Human
uccuggacauuuuu

SEQ ID NO: 3671227 - RNA, 18 nt, Human
ggaugccaucugugggca

SEQ ID NO: 3671228 - RNA, 19 nt, Human
ggaugccaucugugggcac

SEQ ID NO: 3671229 - RNA, 22 nt, Human
ggaugcccagggccacucugcc

SEQ ID NO: 3671230 - RNA, 23 nt, Human
ggaugcccagggccacucugccu

SEQ ID NO: 3671231 - RNA, 12 nt, Human
ggaugcccugga

SEQ ID NO: 3671232 - RNA, 13 nt, Human
ggaugcccuggag

SEQ ID NO: 3671233 - RNA, 22 nt, Human
uccuguggccccacccugggcc

SEQ ID NO: 3671234 - RNA, 23 nt, Human
uccuguggccccacccugggccc

SEQ ID NO: 3671235 - RNA, 17 nt, Human
uccuguggccugccagu

SEQ ID NO: 3671236 - RNA, 23 nt, Human
uccugugggggaagagcacagcc

SEQ ID NO: 3671237 - RNA, 19 nt, Human
uccugugugauugacagcu

SEQ ID NO: 3671238 - RNA, 15 nt, Human
uccuguguggagagg

SEQ ID NO: 3671239 - RNA, 16 nt, Human
uccuguguggagaggg

SEQ ID NO: 3671240 - RNA, 22 nt, Human
uccuguguggagagggaaugug

SEQ ID NO: 3671241 - RNA, 18 nt, Human
uccugugugguuuagugu

SEQ ID NO: 3671242 - RNA, 15 nt, Human
ggcaauauucucugu

SEQ ID NO: 3671243 - RNA, 18 nt, Human
ggcaauauucucuguaca

SEQ ID NO: 3671244 - RNA, 20 nt, Human
ggcaauauucucuguacaua

SEQ ID NO: 3671245 - RNA, 16 nt, Human
ggcaaugguaguuucu

SEQ ID NO: 3671246 - RNA, 18 nt, Human
ggcaaugguaguuucugu

SEQ ID NO: 3671247 - RNA, 19 nt, Human
ggcaauuaauuccuucagc

SEQ ID NO: 3671248 - RNA, 19 nt, Human
ggcaauucuccugccuuug

SEQ ID NO: 3671249 - RNA, 11 nt, Human
ggcaauuuugu

SEQ ID NO: 3671250 - RNA, 15 nt, Human
ggcacaagaaucacu

SEQ ID NO: 3671251 - RNA, 14 nt, Human
ggcacaagacugac

SEQ ID NO: 3671252 - RNA, 18 nt, Human
ggcacaaguccuggaugu

SEQ ID NO: 3671253 - RNA, 12 nt, Human
ggcacaauaaau

SEQ ID NO: 3671254 - RNA, 20 nt, Human
ggcacacaaggggcccuugg

SEQ ID NO: 3671255 - RNA, 21 nt, Human
ggcacacaaggggcccuugga

SEQ ID NO: 3671256 - RNA, 21 nt, Human
ggcacacaccuguagucccag

SEQ ID NO: 3671257 - RNA, 21 nt, Human
ggcacacacugugcuuucuau

SEQ ID NO: 3671258 - RNA, 13 nt, Human
ggcacaccgggca

SEQ ID NO: 3671259 - RNA, 15 nt, Human
ggcacacgccuccca

SEQ ID NO: 3671260 - RNA, 19 nt, Human
ggcacacgccucccacugg

SEQ ID NO: 3671261 - RNA, 18 nt, Human
ggcacacgcugcucugcc

SEQ ID NO: 3671262 - RNA, 24 nt, Human
ggcacagaaaauggaagacagcuc

SEQ ID NO: 3671263 - RNA, 16 nt, Human
ggcacagaaaccucua

SEQ ID NO: 3671264 - RNA, 17 nt, Human
ggcacagccggggccug

SEQ ID NO: 3671265 - RNA, 21 nt, Human
ggcacagccggggccugccua

SEQ ID NO: 3671266 - RNA, 14 nt, Human
ggcacagccugcac

SEQ ID NO: 3671267 - RNA, 13 nt, Human
ggcacagccuggc

SEQ ID NO: 3671268 - RNA, 18 nt, Human
ggcacagcggggccccag

SEQ ID NO: 3671269 - RNA, 22 nt, Human
ggcacaggacugauucugggau

SEQ ID NO: 3671270 - RNA, 16 nt, Human
ggcacaggagcuaccu

SEQ ID NO: 3671271 - RNA, 20 nt, Human
ggcacaggaggcaggcaugg

SEQ ID NO: 3671272 - RNA, 23 nt, Human
ggcacaggaggcaggcauggccc

SEQ ID NO: 3671273 - RNA, 17 nt, Human
ggcacaggccauggaug

SEQ ID NO: 3671274 - RNA, 14 nt, Human
ggcacaggcccccu

SEQ ID NO: 3671275 - RNA, 13 nt, Human
ggcacagggagag

SEQ ID NO: 3671276 - RNA, 19 nt, Human
ggcacagggcaugaaauga

SEQ ID NO: 3671277 - RNA, 20 nt, Human
ggcacagggccuggcccaug

SEQ ID NO: 3671278 - RNA, 12 nt, Human
ggcacagggucu

SEQ ID NO: 3671279 - RNA, 18 nt, Human
ggcacagggucugcucuu

SEQ ID NO: 3671280 - RNA, 17 nt, Human
ggcacaguaugucccau

SEQ ID NO: 3671281 - RNA, 21 nt, Human
ggcacaguuuucugagaaaga

SEQ ID NO: 3671282 - RNA, 15 nt, Human
ggcacaucauuucaa

SEQ ID NO: 3671283 - RNA, 18 nt, Human
ggcacauccuaugcaaua

SEQ ID NO: 3671284 - RNA, 12 nt, Human
ggcacauuuuuu

SEQ ID NO: 3671285 - RNA, 10 nt, Human
ggcaccaaag

SEQ ID NO: 3671286 - RNA, 18 nt, Human
ggcaccaaagaugcagcc

SEQ ID NO: 3671287 - RNA, 22 nt, Human
ggcaccacugcacuccagccug

SEQ ID NO: 3671288 - RNA, 19 nt, Human
ggcaccagacacccaggac

SEQ ID NO: 3671289 - RNA, 12 nt, Human
ggcaccagaggc

SEQ ID NO: 3671290 - RNA, 22 nt, Human
ggcaccagaggcugcagaaggc

SEQ ID NO: 3671291 - RNA, 15 nt, Human
ggcaccagcagccug

SEQ ID NO: 3671292 - RNA, 17 nt, Human
ggcaccagcagccugga

SEQ ID NO: 3671293 - RNA, 14 nt, Human
ggcaccaucucccu

SEQ ID NO: 3671294 - RNA, 19 nt, Human
ggcaccauucaggaaccug

SEQ ID NO: 3671295 - RNA, 18 nt, Human
ggcacccaagaccucagg

SEQ ID NO: 3671296 - RNA, 21 nt, Human
ggcacccaagaccucagggca

SEQ ID NO: 3671297 - RNA, 14 nt, Human
ggcacccacccugg

SEQ ID NO: 3671298 - RNA, 14 nt, Human
ggcacccccagccu

SEQ ID NO: 3671299 - RNA, 19 nt, Human
ggcacccccagccugggcc

SEQ ID NO: 3671300 - RNA, 20 nt, Human
ggcacccccagccugggccu

SEQ ID NO: 3671301 - RNA, 15 nt, Human
ggcacccccugcagc

SEQ ID NO: 3671302 - RNA, 18 nt, Human
ggcacccccuggagagaa

SEQ ID NO: 3671303 - RNA, 18 nt, Human
ggcacccggccccugcug

SEQ ID NO: 3671304 - RNA, 20 nt, Human
ggcacccucuggccgccuag

SEQ ID NO: 3671305 - RNA, 15 nt, Human
ggcaccgaagcccag

SEQ ID NO: 3671306 - RNA, 23 nt, Human
ggcaccgaagcccagagggucug

SEQ ID NO: 3671307 - RNA, 15 nt, Human
ggcaccgagaauguu

SEQ ID NO: 3671308 - RNA, 16 nt, Human
ggcaccuaauccaggc

SEQ ID NO: 3671309 - RNA, 19 nt, Human
ggcaccuaauccaggcaga

SEQ ID NO: 3671310 - RNA, 19 nt, Human
ggcaccuauagucccagcu

SEQ ID NO: 3671311 - RNA, 16 nt, Human
ggcaccugggcccugg

SEQ ID NO: 3671312 - RNA, 23 nt, Human
ggcaccugggcccuggggccugu

SEQ ID NO: 3671313 - RNA, 17 nt, Human
ggcaccuggggaguggg

SEQ ID NO: 3671314 - RNA, 22 nt, Human
ggcaccugguggccaugcuccu

SEQ ID NO: 3671315 - RNA, 22 nt, Human
ggcaccugucugcuccagcucu

SEQ ID NO: 3671316 - RNA, 16 nt, Human
ggcaccuuuuacugug

SEQ ID NO: 3671317 - RNA, 17 nt, Human
ggcacgaacccaccugc

SEQ ID NO: 3671318 - RNA, 18 nt, Human
ggcacgaacccaccugcu

SEQ ID NO: 3671319 - RNA, 15 nt, Human
ggcacgggcccguga

SEQ ID NO: 3671320 - RNA, 17 nt, Human
ggcacgggugguccccg

SEQ ID NO: 3671321 - RNA, 20 nt, Human
ggcacggucuucccucuucc

SEQ ID NO: 3671322 - RNA, 16 nt, Human
ggcacuagccaaagcg

SEQ ID NO: 3671323 - RNA, 15 nt, Human
ggcacuagccuuugg

SEQ ID NO: 3671324 - RNA, 19 nt, Human
ggcacuauuuauuuacaaa

SEQ ID NO: 3671325 - RNA, 17 nt, Human
ggcacucacagaccugg

SEQ ID NO: 3671326 - RNA, 23 nt, Human
ggcacucacagaccuggagcccc

SEQ ID NO: 3671327 - RNA, 20 nt, Human
ggcacucagaagacacugau

SEQ ID NO: 3671328 - RNA, 14 nt, Human
ggcacuccaaccua

SEQ ID NO: 3671329 - RNA, 18 nt, Human
ggcacucccuccagcaca

SEQ ID NO: 3671330 - RNA, 19 nt, Human
ggcacugagagagcgcagc

SEQ ID NO: 3671331 - RNA, 12 nt, Human
ggcacugagccc

SEQ ID NO: 3671332 - RNA, 19 nt, Human
ggcacugagcccccccaac

SEQ ID NO: 3671333 - RNA, 23 nt, Human
ggcacugagcccccccaacacug

SEQ ID NO: 3671334 - RNA, 14 nt, Human
ggcacugcaggggc

SEQ ID NO: 3671335 - RNA, 12 nt, Human
ggcacugcccug

SEQ ID NO: 3671336 - RNA, 14 nt, Human
ggcacugcccuggu

SEQ ID NO: 3671337 - RNA, 12 nt, Human
ggcacugccuga

SEQ ID NO: 3671338 - RNA, 12 nt, Human
ggcacugcuggg

SEQ ID NO: 3671339 - RNA, 14 nt, Human
ggcacugcugugcu

SEQ ID NO: 3671340 - RNA, 16 nt, Human
ggcacugcuuccagug

SEQ ID NO: 3671341 - RNA, 22 nt, Human
ggcacugcuuccagugaggcuc

SEQ ID NO: 3671342 - RNA, 24 nt, Human
ggcacugcuuccagugaggcucug

SEQ ID NO: 3671343 - RNA, 17 nt, Human
ggcacuggaccccagca

SEQ ID NO: 3671344 - RNA, 22 nt, Human
ggcacuggcaaacagggccucu

SEQ ID NO: 3671345 - RNA, 20 nt, Human
ggcacuggcauugucccugu

SEQ ID NO: 3671346 - RNA, 16 nt, Human
ggcacugggcaugagg

SEQ ID NO: 3671347 - RNA, 12 nt, Human
ggcacugggcug

SEQ ID NO: 3671348 - RNA, 13 nt, Human
ggcacugggcugu

SEQ ID NO: 3671349 - RNA, 15 nt, Human
ggcacuggggcaggg

SEQ ID NO: 3671350 - RNA, 15 nt, Human
ggcacugguggcccg

SEQ ID NO: 3671351 - RNA, 24 nt, Human
ggcacuguacuaggcgugagaagc

SEQ ID NO: 3671352 - RNA, 13 nt, Human
ggcacuguggccu

SEQ ID NO: 3671353 - RNA, 13 nt, Human
ggcacuucacaga

SEQ ID NO: 3671354 - RNA, 14 nt, Human
ggcacuucacagag

SEQ ID NO: 3671355 - RNA, 13 nt, Human
ggcacuucccugc

SEQ ID NO: 3671356 - RNA, 13 nt, Human
ggcacuucugccu

SEQ ID NO: 3671357 - RNA, 15 nt, Human
ggcacuucugccuga

SEQ ID NO: 3671358 - RNA, 15 nt, Human
ggcacuugccugggu

SEQ ID NO: 3671359 - RNA, 12 nt, Human
ggcacuuugggg

SEQ ID NO: 3671360 - RNA, 10 nt, Human
ggcagaaaga

SEQ ID NO: 3671361 - RNA, 18 nt, Human
ggcagaaagcagaggcug

SEQ ID NO: 3671362 - RNA, 22 nt, Human
ggcagaaaggaaaaccugaaga

SEQ ID NO: 3671363 - RNA, 17 nt, Human
ggcagaaauacagucuu

SEQ ID NO: 3671364 - RNA, 20 nt, Human
ggcagaacacuaaccugacc

SEQ ID NO: 3671365 - RNA, 20 nt, Human
ggcagaacagccgcuccugu

SEQ ID NO: 3671366 - RNA, 17 nt, Human
ggcagaagaauugaacc

SEQ ID NO: 3671367 - RNA, 12 nt, Human
ggcagaagacac

SEQ ID NO: 3671368 - RNA, 20 nt, Human
ggcagaagacaccagagcag

SEQ ID NO: 3671369 - RNA, 22 nt, Human
ggcagaagacaccagagcagau

SEQ ID NO: 3671370 - RNA, 17 nt, Human
ggcagaaggcaaaccca

SEQ ID NO: 3671371 - RNA, 16 nt, Human
ggcagaaggccaagag

SEQ ID NO: 3671372 - RNA, 21 nt, Human
ggcagaaguaggggaagaaua

SEQ ID NO: 3671373 - RNA, 20 nt, Human
ggcagacacagggacuugaa

SEQ ID NO: 3671374 - RNA, 17 nt, Human
ggcagacacggaucuga

SEQ ID NO: 3671375 - RNA, 21 nt, Human
ggcagacacggaucugagaau

SEQ ID NO: 3671376 - RNA, 13 nt, Human
ggcagacagcagc

SEQ ID NO: 3671377 - RNA, 16 nt, Human
ggcagacagcagcuca

SEQ ID NO: 3671378 - RNA, 14 nt, Human
ggccagccccacag

SEQ ID NO: 3671379 - RNA, 19 nt, Human
ggccagccccacagcccac

SEQ ID NO: 3671380 - RNA, 14 nt, Human
ggccagccccuccc

SEQ ID NO: 3671381 - RNA, 15 nt, Human
ggccagccccuccca

SEQ ID NO: 3671382 - RNA, 21 nt, Human
ggccagccccucccaccacag

SEQ ID NO: 3671383 - RNA, 19 nt, Human
ggccagccccuuagacaga

SEQ ID NO: 3671384 - RNA, 14 nt, Human
ggccagcccggcug

SEQ ID NO: 3671385 - RNA, 19 nt, Human
ggccagcccggcugguuuu

SEQ ID NO: 3671386 - RNA, 19 nt, Human
ggccagccgcucuccugcc

SEQ ID NO: 3671387 - RNA, 14 nt, Human
ggccagccucaccc

SEQ ID NO: 3671388 - RNA, 15 nt, Human
ggccagccucacccu

SEQ ID NO: 3671389 - RNA, 17 nt, Human
ggccagccucacccuug

SEQ ID NO: 3671390 - RNA, 16 nt, Human
ggccagccuccgagag

SEQ ID NO: 3671391 - RNA, 19 nt, Human
ggccagccuccgagaggga

SEQ ID NO: 3671392 - RNA, 20 nt, Human
ggccagccuccgagagggag

SEQ ID NO: 3671393 - RNA, 13 nt, Human
ggccagccuggau

SEQ ID NO: 3671394 - RNA, 12 nt, Human
ggccagccuggc

SEQ ID NO: 3671395 - RNA, 14 nt, Human
ggccagccuggccu

SEQ ID NO: 3671396 - RNA, 18 nt, Human
ggccagccuggccuccug

SEQ ID NO: 3671397 - RNA, 20 nt, Human
ggccagccuggccuccugcc

SEQ ID NO: 3671398 - RNA, 21 nt, Human
ggccagccuggccuccugccu

SEQ ID NO: 3671399 - RNA, 22 nt, Human
ggccagccuggggccuggcagg

SEQ ID NO: 3671400 - RNA, 11 nt, Human
ggccagcuccg

SEQ ID NO: 3671401 - RNA, 19 nt, Human
ggccagcugccccagccag

SEQ ID NO: 3671402 - RNA, 20 nt, Human
ggccagcugccccagccaga

SEQ ID NO: 3671403 - RNA, 15 nt, Human
ggccagcuggaggca

SEQ ID NO: 3671404 - RNA, 16 nt, Human
ggccagcuggcagcag

SEQ ID NO: 3671405 - RNA, 17 nt, Human
ggccagcuggcagcaga

SEQ ID NO: 3671406 - RNA, 18 nt, Human
ggccagcuggcagcagag

SEQ ID NO: 3671407 - RNA, 18 nt, Human
ggccagcugugguuuucu

SEQ ID NO: 3671408 - RNA, 20 nt, Human
ggccaggaaguagcacaggc

SEQ ID NO: 3671409 - RNA, 22 nt, Human
ggccaggaaguagcacaggcug

SEQ ID NO: 3671410 - RNA, 15 nt, Human
ggccaggacugagcc

SEQ ID NO: 3671411 - RNA, 21 nt, Human
ggccaggagcaggcacgggug

SEQ ID NO: 3671412 - RNA, 13 nt, Human
ggccaggagccuc

SEQ ID NO: 3671413 - RNA, 14 nt, Human
ggccaggccagagg

SEQ ID NO: 3671414 - RNA, 17 nt, Human
ggccaggccagcugccu

SEQ ID NO: 3671415 - RNA, 14 nt, Human
ggccaggcccucug

SEQ ID NO: 3671416 - RNA, 16 nt, Human
ggccaggcccucugcc

SEQ ID NO: 3671417 - RNA, 21 nt, Human
ggccaggcugaugggacagaa

SEQ ID NO: 3671418 - RNA, 18 nt, Human
ggccaggcugccuggccu

SEQ ID NO: 3671419 - RNA, 15 nt, Human
ggccaggcugcucuu

SEQ ID NO: 3671420 - RNA, 11 nt, Human
ggccaggcugg

SEQ ID NO: 3671421 - RNA, 18 nt, Human
ggccaggcugggucgccc

SEQ ID NO: 3671422 - RNA, 22 nt, Human
ggccaggcugggucgcccugga

SEQ ID NO: 3671423 - RNA, 16 nt, Human
ggccaggcuggucuca

SEQ ID NO: 3671424 - RNA, 17 nt, Human
ggccagggagaagcucc

SEQ ID NO: 3671425 - RNA, 18 nt, Human
ggccagggagaagcuccu

SEQ ID NO: 3671426 - RNA, 16 nt, Human
ggccagggcccugcag

SEQ ID NO: 3671427 - RNA, 19 nt, Human
ggccagggccuggaagaca

SEQ ID NO: 3671428 - RNA, 19 nt, Human
ggccagggcuauagcucag

SEQ ID NO: 3671429 - RNA, 11 nt, Human
ggccagggcug

SEQ ID NO: 3671430 - RNA, 16 nt, Human
ggccagggugagagcu

SEQ ID NO: 3671431 - RNA, 21 nt, Human
ggccaggucccagcuugagcu

SEQ ID NO: 3671432 - RNA, 19 nt, Human
ggccagguggccacuccag

SEQ ID NO: 3671433 - RNA, 23 nt, Human
ggccaggugggcgggcagcacag

SEQ ID NO: 3671434 - RNA, 16 nt, Human
ggccaguaccuuucca

SEQ ID NO: 3671435 - RNA, 17 nt, Human
ggccagucccugaggca

SEQ ID NO: 3671436 - RNA, 16 nt, Human
ggccaguccugccugg

SEQ ID NO: 3671437 - RNA, 18 nt, Human
ggccaguccugccuggcc

SEQ ID NO: 3671438 - RNA, 15 nt, Human
ggccagucugggcug

SEQ ID NO: 3671439 - RNA, 16 nt, Human
ggccagucugggcugc

SEQ ID NO: 3671440 - RNA, 13 nt, Human
ggccagucugugg

SEQ ID NO: 3671441 - RNA, 14 nt, Human
ggccagucugugga

SEQ ID NO: 3671442 - RNA, 18 nt, Human
ggccagucuguggaucag

SEQ ID NO: 3671443 - RNA, 16 nt, Human
ggccaguggggccugu

SEQ ID NO: 3671444 - RNA, 17 nt, Human
ggccaguggggccugug

SEQ ID NO: 3671445 - RNA, 16 nt, Human
ggccagugugacaagg

SEQ ID NO: 3671446 - RNA, 19 nt, Human
ggccagugugaucccaagu

SEQ ID NO: 3671447 - RNA, 16 nt, Human
ggccauacuggccucg

SEQ ID NO: 3671448 - RNA, 23 nt, Human
ggccauacuggccucgccuggcc

SEQ ID NO: 3671449 - RNA, 14 nt, Human
ggccaucccuguga

SEQ ID NO: 3671450 - RNA, 15 nt, Human
ucugagguuuuauuu

SEQ ID NO: 3671451 - RNA, 15 nt, Human
ucugagucagagcca

SEQ ID NO: 3671452 - RNA, 24 nt, Human
ucugagucccaggagcugcccaga

SEQ ID NO: 3671453 - RNA, 14 nt, Human
ucugagugcaaacu

SEQ ID NO: 3671454 - RNA, 22 nt, Human
ucugagugcaaacuucagaguu

SEQ ID NO: 3671455 - RNA, 22 nt, Human
ucugagugccuucuguggggac

SEQ ID NO: 3671456 - RNA, 23 nt, Human
ucugaguuguuaccccaagcgcc

SEQ ID NO: 3671457 - RNA, 15 nt, Human
ucugaguuuaccauu

SEQ ID NO: 3671458 - RNA, 15 nt, Human
ucugaguuucauucu

SEQ ID NO: 3671459 - RNA, 14 nt, Human
ucugaguuuugugu

SEQ ID NO: 3671460 - RNA, 20 nt, Human
ucugaguuuuguguuuguug

SEQ ID NO: 3671461 - RNA, 14 nt, Human
ucugauaacuagau

SEQ ID NO: 3671462 - RNA, 15 nt, Human
ucugauaaugaaaau

SEQ ID NO: 3671463 - RNA, 16 nt, Human
ucugauacagaaaagu

SEQ ID NO: 3671464 - RNA, 13 nt, Human
ucugauacuuuuu

SEQ ID NO: 3671465 - RNA, 19 nt, Human
ucugauacuuuuuugaaau

SEQ ID NO: 3671466 - RNA, 23 nt, Human
ucugauaggaaugugaaagcacg

SEQ ID NO: 3671467 - RNA, 22 nt, Human
ucugauaggguuugugacaggg

SEQ ID NO: 3671468 - RNA, 20 nt, Human
ucugauaucuauaguagaca

SEQ ID NO: 3671469 - RNA, 14 nt, Human
ucugauaugggacu

SEQ ID NO: 3671470 - RNA, 15 nt, Human
ucugauaugggacug

SEQ ID NO: 3671471 - RNA, 21 nt, Human
ucugauaugggacugagccug

SEQ ID NO: 3671472 - RNA, 14 nt, Human
ucugauauguuugu

SEQ ID NO: 3671473 - RNA, 20 nt, Human
ucugauauuccaugaaugua

SEQ ID NO: 3671474 - RNA, 22 nt, Human
ucugaucacugaaauaaaagcu

SEQ ID NO: 3671475 - RNA, 11 nt, Human
ucugauccagu

SEQ ID NO: 3671476 - RNA, 21 nt, Human
ucugaucccucuacagagcuu

SEQ ID NO: 3671477 - RNA, 21 nt, Human
ucugaucgugacgcugaauaa

SEQ ID NO: 3671478 - RNA, 21 nt, Human
ucugaucuccauggcuuccuc

SEQ ID NO: 3671479 - RNA, 22 nt, Human
ucugaugaaaaauugcugacug

SEQ ID NO: 3671480 - RNA, 15 nt, Human
ucugaugaaauguua

SEQ ID NO: 3671481 - RNA, 12 nt, Human
ucugaugaaucu

SEQ ID NO: 3671482 - RNA, 21 nt, Human
ucugauggccuuaauuuccuu

SEQ ID NO: 3671483 - RNA, 23 nt, Human
ucugauggccuuaauuuccuuuu

SEQ ID NO: 3671484 - RNA, 18 nt, Human
ucugauggcuucuccagg

SEQ ID NO: 3671485 - RNA, 19 nt, Human
ucugauuaaaaugcuuccu

SEQ ID NO: 3671486 - RNA, 16 nt, Human
ucugauuagcuuugug

SEQ ID NO: 3671487 - RNA, 21 nt, Human
ucugauuagcuuuguguuugg

SEQ ID NO: 3671488 - RNA, 19 nt, Human
ucugauucccugauuuaau

SEQ ID NO: 3671489 - RNA, 16 nt, Human
ucugauuggacauuuu

SEQ ID NO: 3671490 - RNA, 20 nt, Human
ucugauuggacauuuucuuc

SEQ ID NO: 3671491 - RNA, 23 nt, Human
ucugauuggacauuuucuucaga

SEQ ID NO: 3671492 - RNA, 13 nt, Human
ucugauuggcuca

SEQ ID NO: 3671493 - RNA, 17 nt, Human
ucugauuggcuuguaga

SEQ ID NO: 3671494 - RNA, 21 nt, Human
ucugauuguaacguugcugug

SEQ ID NO: 3671495 - RNA, 22 nt, Human
ucugauuguaacguugcugugg

SEQ ID NO: 3671496 - RNA, 13 nt, Human
ucugauuucaggg

SEQ ID NO: 3671497 - RNA, 22 nt, Human
ucugauuuguaacccacugaga

SEQ ID NO: 3671498 - RNA, 17 nt, Human
ucugauuuuauguaaaa

SEQ ID NO: 3671499 - RNA, 19 nt, Human
ucugcaaaaauauuuauaa

SEQ ID NO: 3671500 - RNA, 15 nt, Human
ucugcaaaaggagag

SEQ ID NO: 3671501 - RNA, 23 nt, Human
ucugcaaaaugaggaauguauau

SEQ ID NO: 3671502 - RNA, 24 nt, Human
ucugcaaacaccaacauguuggga

SEQ ID NO: 3671503 - RNA, 23 nt, Human
ucugcaaagcauguuuugcaugu

SEQ ID NO: 3671504 - RNA, 22 nt, Human
ucugcaacuuuaagcagcucuu

SEQ ID NO: 3671505 - RNA, 17 nt, Human
ucugcaaggucuuuggu

SEQ ID NO: 3671506 - RNA, 12 nt, Human
ucugcaagucag

SEQ ID NO: 3671507 - RNA, 14 nt, Human
ucugcaagucagag

SEQ ID NO: 3671508 - RNA, 16 nt, Human
ucugcaagucagagga

SEQ ID NO: 3671509 - RNA, 21 nt, Human
ucugcaaugggcacugggaug

SEQ ID NO: 3671510 - RNA, 16 nt, Human
ucugcaauucaaaagu

SEQ ID NO: 3671511 - RNA, 23 nt, Human
ucugcaauucaaaaguuccaaga

SEQ ID NO: 3671512 - RNA, 21 nt, Human
ucugcaauuccccucugcugc

SEQ ID NO: 3671513 - RNA, 22 nt, Human
ucugcaauuccccucugcugcu

SEQ ID NO: 3671514 - RNA, 15 nt, Human
ucugcaauuucuacu

SEQ ID NO: 3671515 - RNA, 14 nt, Human
ucugcacacagcac

SEQ ID NO: 3671516 - RNA, 15 nt, Human
ucugcacagauggau

SEQ ID NO: 3671517 - RNA, 17 nt, Human
ucugcacaugucuugua

SEQ ID NO: 3671518 - RNA, 15 nt, Human
ucugcacccaggggu

SEQ ID NO: 3671519 - RNA, 16 nt, Human
ucugcaccccccuggg

SEQ ID NO: 3671520 - RNA, 20 nt, Human
ucugcaccccuucucuccuc

SEQ ID NO: 3671521 - RNA, 14 nt, Human
ucugcacccuccac

SEQ ID NO: 3671522 - RNA, 20 nt, Human
ucugccuuaaaaccaaagag

SEQ ID NO: 3671523 - RNA, 13 nt, Human
ucugccuuagagg

SEQ ID NO: 3671524 - RNA, 15 nt, Human
ucugccuuagucuca

SEQ ID NO: 3671525 - RNA, 15 nt, Human
ucugccuuccuugcu

SEQ ID NO: 3671526 - RNA, 13 nt, Human
ucugccuugccuu

SEQ ID NO: 3671527 - RNA, 20 nt, Human
ucugccuuuauuguguuugu

SEQ ID NO: 3671528 - RNA, 20 nt, Human
ucugccuuugacauuuaauu

SEQ ID NO: 3671529 - RNA, 21 nt, Human
ucugccuuugccaggugacug

SEQ ID NO: 3671530 - RNA, 13 nt, Human
ucugccuuugcuc

SEQ ID NO: 3671531 - RNA, 21 nt, Human
ucugccuuuuguucauuucau

SEQ ID NO: 3671532 - RNA, 14 nt, Human
ucugcgaaguccua

SEQ ID NO: 3671533 - RNA, 13 nt, Human
ucugcgccucagg

SEQ ID NO: 3671534 - RNA, 14 nt, Human
ucugcggaccccag

SEQ ID NO: 3671535 - RNA, 15 nt, Human
ucugcggaccccagc

SEQ ID NO: 3671536 - RNA, 22 nt, Human
ucugcggaccccagcugugagc

SEQ ID NO: 3671537 - RNA, 15 nt, Human
ucugcgucuguguug

SEQ ID NO: 3671538 - RNA, 17 nt, Human
ucugcgugggucagaag

SEQ ID NO: 3671539 - RNA, 19 nt, Human
ucugcgugucaccugugcu

SEQ ID NO: 3671540 - RNA, 19 nt, Human
ucugcuaaauugauguuga

SEQ ID NO: 3671541 - RNA, 17 nt, Human
ucugcuaaauuucaaau

SEQ ID NO: 3671542 - RNA, 17 nt, Human
ucugcuaccucacuggg

SEQ ID NO: 3671543 - RNA, 21 nt, Human
ucugcuaccuugccccaaccc

SEQ ID NO: 3671544 - RNA, 14 nt, Human
ucugcuauauauaa

SEQ ID NO: 3671545 - RNA, 19 nt, Human
ucugcucacauaucuguca

SEQ ID NO: 3671546 - RNA, 20 nt, Human
ucugcucacauaucugucau

SEQ ID NO: 3671547 - RNA, 21 nt, Human
ucugcucaccgcccaucaggg

SEQ ID NO: 3671548 - RNA, 15 nt, Human
ucugcucagcagcua

SEQ ID NO: 3671549 - RNA, 16 nt, Human
ucugcucagccaagcu

SEQ ID NO: 3671550 - RNA, 17 nt, Human
ucugcucagccaagcuu

SEQ ID NO: 3671551 - RNA, 18 nt, Human
ucugcucagcccuggagg

SEQ ID NO: 3671552 - RNA, 19 nt, Human
ucugcucagcccuggaggu

SEQ ID NO: 3671553 - RNA, 14 nt, Human
ucugcucagcucug

SEQ ID NO: 3671554 - RNA, 22 nt, Human
ucugcucaguaauuugaggaca

SEQ ID NO: 3671555 - RNA, 14 nt, Human
ucugcucaucauuc

SEQ ID NO: 3671556 - RNA, 15 nt, Human
ucugcucauucuaau

SEQ ID NO: 3671557 - RNA, 12 nt, Human
ucugcuccacca

SEQ ID NO: 3671558 - RNA, 12 nt, Human
ucugcuccaccc

SEQ ID NO: 3671559 - RNA, 20 nt, Human
ucugcuccacccuuggccug

SEQ ID NO: 3671560 - RNA, 23 nt, Human
ucugcuccacccuuggccugucu

SEQ ID NO: 3671561 - RNA, 14 nt, Human
ucugcuccagacag

SEQ ID NO: 3671562 - RNA, 15 nt, Human
ucugcuccagcucug

SEQ ID NO: 3671563 - RNA, 12 nt, Human
ucugcucccaag

SEQ ID NO: 3671564 - RNA, 23 nt, Human
ucugcucccaaggggccugagca

SEQ ID NO: 3671565 - RNA, 16 nt, Human
ucugcucccccuuuuc

SEQ ID NO: 3671566 - RNA, 20 nt, Human
ucugcucccccuuuucccuc

SEQ ID NO: 3671567 - RNA, 22 nt, Human
ucugcuccccuaaagccucaaa

SEQ ID NO: 3671568 - RNA, 13 nt, Human
ucugcuccucucc

SEQ ID NO: 3671569 - RNA, 14 nt, Human
ucugcuccucucca

SEQ ID NO: 3671570 - RNA, 18 nt, Human
ucugcuccucuccaggca

SEQ ID NO: 3671571 - RNA, 18 nt, Human
ucugcuccucuccccagc

SEQ ID NO: 3671572 - RNA, 12 nt, Human
ucugcuccugga

SEQ ID NO: 3671573 - RNA, 21 nt, Human
ucugcuccuuuccccuuccuu

SEQ ID NO: 3671574 - RNA, 16 nt, Human
ucugcucgccuuagca

SEQ ID NO: 3671575 - RNA, 15 nt, Human
ucugcucggccgucu

SEQ ID NO: 3671576 - RNA, 18 nt, Human
ucugcucggccgucuuca

SEQ ID NO: 3671577 - RNA, 12 nt, Human
ucugcucuccuu

SEQ ID NO: 3671578 - RNA, 13 nt, Human
ucugcucuccuuc

SEQ ID NO: 3671579 - RNA, 15 nt, Human
ucugcucuccuuccu

SEQ ID NO: 3671580 - RNA, 20 nt, Human
ucugcucuccuuccuggagc

SEQ ID NO: 3671581 - RNA, 14 nt, Human
ucugcucugcccuu

SEQ ID NO: 3671582 - RNA, 17 nt, Human
ucugcucuuucucugcc

SEQ ID NO: 3671583 - RNA, 17 nt, Human
ucugcugacagacacag

SEQ ID NO: 3671584 - RNA, 20 nt, Human
ucugcugacagacacaggcc

SEQ ID NO: 3671585 - RNA, 18 nt, Human
ucugcugaccugcugacc

SEQ ID NO: 3671586 - RNA, 16 nt, Human
ucugcugaggguccag

SEQ ID NO: 3671587 - RNA, 22 nt, Human
ucugcugauccucccaggcuuc

SEQ ID NO: 3671588 - RNA, 13 nt, Human
ucugcugcccucc

SEQ ID NO: 3671589 - RNA, 14 nt, Human
ucugcugcccucca

SEQ ID NO: 3671590 - RNA, 18 nt, Human
ucugcugcccuccauccc

SEQ ID NO: 3671591 - RNA, 22 nt, Human
ucugcugccgccccacccagau

SEQ ID NO: 3671592 - RNA, 19 nt, Human
ucugcugccucccucugcu

SEQ ID NO: 3671593 - RNA, 23 nt, Human
ucugcugccugcccgcacagcag

SEQ ID NO: 3671594 - RNA, 14 nt, Human
ucugcugcuggcug

SEQ ID NO: 3671595 - RNA, 18 nt, Human
ucugcugcugucccuccc

SEQ ID NO: 3671596 - RNA, 13 nt, Human
ucugcuggaguuu

SEQ ID NO: 3671597 - RNA, 16 nt, Human
ucugcuggauaaaaug

SEQ ID NO: 3671598 - RNA, 22 nt, Human
ucugcuggauaaaaugagguuc

SEQ ID NO: 3671599 - RNA, 23 nt, Human
ucugcuggcaucaagagguggga

SEQ ID NO: 3671600 - RNA, 13 nt, Human
ucugcuggccucu

SEQ ID NO: 3671601 - RNA, 14 nt, Human
ucugcuggccugga

SEQ ID NO: 3671602 - RNA, 16 nt, Human
ucugcuggccuggauc

SEQ ID NO: 3671603 - RNA, 16 nt, Human
ucugcuggccuggccg

SEQ ID NO: 3671604 - RNA, 13 nt, Human
ucugcugggcugg

SEQ ID NO: 3671605 - RNA, 21 nt, Human
ucugcuggucacuucuucugu

SEQ ID NO: 3671606 - RNA, 15 nt, Human
ucugcuguuccagug

SEQ ID NO: 3671607 - RNA, 23 nt, Human
ucugcuuacaauucccugcuguc

SEQ ID NO: 3671608 - RNA, 17 nt, Human
ucugcuuagaaauaaca

SEQ ID NO: 3671609 - RNA, 22 nt, Human
ucugcuuagaaauaacagaaga

SEQ ID NO: 3671610 - RNA, 16 nt, Human
ucugcuuaggagagac

SEQ ID NO: 3671611 - RNA, 21 nt, Human
ucugcuuaugcaguuuuucag

SEQ ID NO: 3671612 - RNA, 18 nt, Human
ucugcuucaauaaaucuu

SEQ ID NO: 3671613 - RNA, 15 nt, Human
ucuaguuuacagaaa

SEQ ID NO: 3671614 - RNA, 21 nt, Human
ucuaguuuacagaaaaaucuu

SEQ ID NO: 3671615 - RNA, 14 nt, Human
ucuaguuucccaca

SEQ ID NO: 3671616 - RNA, 22 nt, Human
ucuaguuugauuaaauucuugc

SEQ ID NO: 3671617 - RNA, 18 nt, Human
ucuaguuugcauuccuga

SEQ ID NO: 3671618 - RNA, 14 nt, Human
ucuaguuuucaguu

SEQ ID NO: 3671619 - RNA, 16 nt, Human
ucuauaaaacucugca

SEQ ID NO: 3671620 - RNA, 17 nt, Human
ucuauaaaauagauaua

SEQ ID NO: 3671621 - RNA, 19 nt, Human
ucuauaaaauagauauaaa

SEQ ID NO: 3671622 - RNA, 15 nt, Human
ucuauaaagcauuua

SEQ ID NO: 3671623 - RNA, 16 nt, Human
ucuauaaagcauuuaa

SEQ ID NO: 3671624 - RNA, 22 nt, Human
ucuauaacaaaggauacuuauu

SEQ ID NO: 3671625 - RNA, 20 nt, Human
ucuauaaccaaaugaaauau

SEQ ID NO: 3671626 - RNA, 13 nt, Human
ucuauaaggccau

SEQ ID NO: 3671627 - RNA, 14 nt, Human
ucuauaaggccaua

SEQ ID NO: 3671628 - RNA, 22 nt, Human
ucuauaaggccauaaaacaggu

SEQ ID NO: 3671629 - RNA, 22 nt, Human
ucuauaauuuaaauauaugcua

SEQ ID NO: 3671630 - RNA, 13 nt, Human
ucuauaauuucca

SEQ ID NO: 3671631 - RNA, 14 nt, Human
ucuauaauuuuaca

SEQ ID NO: 3671632 - RNA, 16 nt, Human
ucuauacaaauauaaa

SEQ ID NO: 3671633 - RNA, 21 nt, Human
ucuauacaaauauaaaucuua

SEQ ID NO: 3671634 - RNA, 16 nt, Human
ucuauacaucucuccc

SEQ ID NO: 3671635 - RNA, 15 nt, Human
ucuauacccacccag

SEQ ID NO: 3671636 - RNA, 13 nt, Human
ucuauagaaagug

SEQ ID NO: 3671637 - RNA, 15 nt, Human
ucuauagaaaguguu

SEQ ID NO: 3671638 - RNA, 17 nt, Human
ucuauagaacugaauga

SEQ ID NO: 3671639 - RNA, 18 nt, Human
ucuauaggaacauaugaa

SEQ ID NO: 3671640 - RNA, 13 nt, Human
ucuauauauaauu

SEQ ID NO: 3671641 - RNA, 14 nt, Human
ucuauauauauaau

SEQ ID NO: 3671642 - RNA, 18 nt, Human
ucuauauuagaucaaaua

SEQ ID NO: 3671643 - RNA, 22 nt, Human
ucuauauuauugcccaugauau

SEQ ID NO: 3671644 - RNA, 19 nt, Human
ucuauauuuucauucuccu

SEQ ID NO: 3671645 - RNA, 20 nt, Human
ucuaucaaccccagacacug

SEQ ID NO: 3671646 - RNA, 14 nt, Human
ucuaucaagcccag

SEQ ID NO: 3671647 - RNA, 21 nt, Human
ucuaucaaguauuauaccuuu

SEQ ID NO: 3671648 - RNA, 14 nt, Human
ucuaucagagaaaa

SEQ ID NO: 3671649 - RNA, 15 nt, Human
ucuaucauuaaaguu

SEQ ID NO: 3671650 - RNA, 16 nt, Human
ucuaucauuaaaguuc

SEQ ID NO: 3671651 - RNA, 17 nt, Human
ucuaucauuuaauaaua

SEQ ID NO: 3671652 - RNA, 19 nt, Human
ucuaucauuuuuguacagu

SEQ ID NO: 3671653 - RNA, 23 nt, Human
ucuaucauuuuuguacaguuugc

SEQ ID NO: 3671654 - RNA, 15 nt, Human
ucuauccaaacaugu

SEQ ID NO: 3671655 - RNA, 22 nt, Human
ucuauccaaacauguauuuaug

SEQ ID NO: 3671656 - RNA, 14 nt, Human
ucuauccacagaga

SEQ ID NO: 3671657 - RNA, 15 nt, Human
ucuauccacagagag

SEQ ID NO: 3671658 - RNA, 16 nt, Human
ucuauccuacaacaag

SEQ ID NO: 3671659 - RNA, 14 nt, Human
ucuauccucuguaa

SEQ ID NO: 3671660 - RNA, 13 nt, Human
ucuaucuaaauga

SEQ ID NO: 3671661 - RNA, 15 nt, Human
ucuaucuauuugagg

SEQ ID NO: 3671662 - RNA, 14 nt, Human
ucuaucucacagca

SEQ ID NO: 3671663 - RNA, 18 nt, Human
ucuaucucacagcacacu

SEQ ID NO: 3671664 - RNA, 15 nt, Human
ucuaucugggccugg

SEQ ID NO: 3671665 - RNA, 16 nt, Human
ucuaucuuauauaguu

SEQ ID NO: 3671666 - RNA, 14 nt, Human
ucuaucuuccaaau

SEQ ID NO: 3671667 - RNA, 23 nt, Human
ucuaucuuccaaaugcaauuuga

SEQ ID NO: 3671668 - RNA, 12 nt, Human
ucucugcccauu

SEQ ID NO: 3671669 - RNA, 13 nt, Human
ggccuggccuggc

SEQ ID NO: 3671670 - RNA, 23 nt, Human
ggccuggcgggaugggccaccgc

SEQ ID NO: 3671671 - RNA, 14 nt, Human
ggccuggcucccuc

SEQ ID NO: 3671672 - RNA, 14 nt, Human
ggccuggcuccgcu

SEQ ID NO: 3671673 - RNA, 17 nt, Human
ggccuggcuggcugagg

SEQ ID NO: 3671674 - RNA, 11 nt, Human
ggccugggccc

SEQ ID NO: 3671675 - RNA, 23 nt, Human
ggccugggccguaucuccggcuc

SEQ ID NO: 3671676 - RNA, 18 nt, Human
ggccugggccuggcuccc

SEQ ID NO: 3671677 - RNA, 14 nt, Human
ggccugggcuccug

SEQ ID NO: 3671678 - RNA, 15 nt, Human
ggccuggggccugag

SEQ ID NO: 3671679 - RNA, 22 nt, Human
ggccugggggcugggcagagga

SEQ ID NO: 3671680 - RNA, 21 nt, Human
ggccuggggugacccggcacc

SEQ ID NO: 3671681 - RNA, 14 nt, Human
ggccugggucugug

SEQ ID NO: 3671682 - RNA, 19 nt, Human
ggccugggucugugucucu

SEQ ID NO: 3671683 - RNA, 21 nt, Human
ggccugggugcuggcugccca

SEQ ID NO: 3671684 - RNA, 21 nt, Human
ggccugguccaugauggaguc

SEQ ID NO: 3671685 - RNA, 19 nt, Human
ggccugguguucuguggga

SEQ ID NO: 3671686 - RNA, 19 nt, Human
ggccugguugaagaagaug

SEQ ID NO: 3671687 - RNA, 19 nt, Human
ggccuguacaaaagggaca

SEQ ID NO: 3671688 - RNA, 14 nt, Human
ggccuguacugccu

SEQ ID NO: 3671689 - RNA, 16 nt, Human
ggccuguacugccugc

SEQ ID NO: 3671690 - RNA, 18 nt, Human
ggccuguacugccugcuu

SEQ ID NO: 3671691 - RNA, 17 nt, Human
ggccuguagaguugcug

SEQ ID NO: 3671692 - RNA, 22 nt, Human
ggccuguccacaggcuucugag

SEQ ID NO: 3671693 - RNA, 14 nt, Human
ggccugucccuggc

SEQ ID NO: 3671694 - RNA, 19 nt, Human
ggccugucucauccccagg

SEQ ID NO: 3671695 - RNA, 19 nt, Human
ggccuguggaaugagugug

SEQ ID NO: 3671696 - RNA, 15 nt, Human
ggccuguggcugucg

SEQ ID NO: 3671697 - RNA, 20 nt, Human
ggccugugggagccugcaaa

SEQ ID NO: 3671698 - RNA, 22 nt, Human
ggccugugucccaugacccacc

SEQ ID NO: 3671699 - RNA, 22 nt, Human
ggccugugugugaaaggaagcu

SEQ ID NO: 3671700 - RNA, 19 nt, Human
ggccuguguucuuccuggc

SEQ ID NO: 3671701 - RNA, 17 nt, Human
ggccuguuuggccucuc

SEQ ID NO: 3671702 - RNA, 18 nt, Human
ggccuguuuggccucucu

SEQ ID NO: 3671703 - RNA, 21 nt, Human
ggccuguuuuagaagguucuc

SEQ ID NO: 3671704 - RNA, 13 nt, Human
ggccuuaauuucc

SEQ ID NO: 3671705 - RNA, 15 nt, Human
ggccuuaauuuccuu

SEQ ID NO: 3671706 - RNA, 16 nt, Human
ggccuuagugggccag

SEQ ID NO: 3671707 - RNA, 16 nt, Human
ggccuuccccagccuc

SEQ ID NO: 3671708 - RNA, 22 nt, Human
ggccuucccuguuuucccccca

SEQ ID NO: 3671709 - RNA, 13 nt, Human
ggccuuccugccc

SEQ ID NO: 3671710 - RNA, 22 nt, Human
ggccuucggccuccauccugag

SEQ ID NO: 3671711 - RNA, 16 nt, Human
ggccuucucugaagga

SEQ ID NO: 3671712 - RNA, 23 nt, Human
ggccuugacaucaguuccuuugu

SEQ ID NO: 3671713 - RNA, 18 nt, Human
ggccuugcggcuccucag

SEQ ID NO: 3671714 - RNA, 19 nt, Human
ggccuugcggcuccucagg

SEQ ID NO: 3671715 - RNA, 18 nt, Human
ggccuuggccuggagcac

SEQ ID NO: 3671716 - RNA, 15 nt, Human
ggccuugugguccaa

SEQ ID NO: 3671717 - RNA, 18 nt, Human
ggccuugugguccaaaua

SEQ ID NO: 3671718 - RNA, 15 nt, Human
ggccuuguucucucu

SEQ ID NO: 3671719 - RNA, 13 nt, Human
ggccuuguucugu

SEQ ID NO: 3671720 - RNA, 18 nt, Human
ggccuuguucugucacca

SEQ ID NO: 3671721 - RNA, 17 nt, Human
ggccuuucccuaagcca

SEQ ID NO: 3671722 - RNA, 13 nt, Human
ggccuuuccucuc

SEQ ID NO: 3671723 - RNA, 19 nt, Human
ggccuuugagcccacaaag

SEQ ID NO: 3671724 - RNA, 23 nt, Human
ggccuuugagcccacaaagccuu

SEQ ID NO: 3671725 - RNA, 13 nt, Human
ggccuuugagcuc

SEQ ID NO: 3671726 - RNA, 21 nt, Human
ggccuuuuaacauuuuguucu

SEQ ID NO: 3671727 - RNA, 18 nt, Human
ggcgaaaucccugcucac

SEQ ID NO: 3671728 - RNA, 22 nt, Human
ggcgaaaucccugcucacugca

SEQ ID NO: 3671729 - RNA, 15 nt, Human
ggcgaaucauuuguu

SEQ ID NO: 3671730 - RNA, 13 nt, Human
ggcgaaucucaaa

SEQ ID NO: 3671731 - RNA, 18 nt, Human
ggcgacaguuuuccuucu

SEQ ID NO: 3671732 - RNA, 16 nt, Human
ggcgaccgcccuccgc

SEQ ID NO: 3671733 - RNA, 22 nt, Human
ggcgagagucuggcccuagacu

SEQ ID NO: 3671734 - RNA, 18 nt, Human
ggcgaggacgacuucugc

SEQ ID NO: 3671735 - RNA, 11 nt, Human
ggcgaggcaga

SEQ ID NO: 3671736 - RNA, 15 nt, Human
ggcgaggcagaggac

SEQ ID NO: 3671737 - RNA, 19 nt, Human
ggcgaggcagaggacagau

SEQ ID NO: 3671738 - RNA, 15 nt, Human
ggcgagucacugccu

SEQ ID NO: 3671739 - RNA, 15 nt, Human
ggcgagugccaggac

SEQ ID NO: 3671740 - RNA, 18 nt, Human
ggcgauccaccugucuca

SEQ ID NO: 3671741 - RNA, 22 nt, Human
ggcgauccaccugucucagccu

SEQ ID NO: 3671742 - RNA, 14 nt, Human
ggcgcaagccugua

SEQ ID NO: 3671743 - RNA, 17 nt, Human
ggcgcacccuccccucc

SEQ ID NO: 3671744 - RNA, 18 nt, Human
ggcgcacccuccccuccc

SEQ ID NO: 3671745 - RNA, 17 nt, Human
ggcgcagccaaggccga

SEQ ID NO: 3671746 - RNA, 14 nt, Human
ggcgcaggccguga

SEQ ID NO: 3671747 - RNA, 17 nt, Human
ggcgccaccagcucugc

SEQ ID NO: 3671748 - RNA, 13 nt, Human
ggcgcccaccucc

SEQ ID NO: 3671749 - RNA, 18 nt, Human
ggcgccccaacccgugga

SEQ ID NO: 3671750 - RNA, 15 nt, Human
ggcgcccccagugug

SEQ ID NO: 3671751 - RNA, 20 nt, Human
ggcgccccgcaccuguacag

SEQ ID NO: 3671752 - RNA, 21 nt, Human
ggcgccccgcaccuguacagu

SEQ ID NO: 3671753 - RNA, 15 nt, Human
ggcgccccugccacc

SEQ ID NO: 3671754 - RNA, 16 nt, Human
ggcgcccucuguccug

SEQ ID NO: 3671755 - RNA, 17 nt, Human
ggcgcccucuguccuga

SEQ ID NO: 3671756 - RNA, 14 nt, Human
ggcgcccuggaagc

SEQ ID NO: 3671757 - RNA, 18 nt, Human
ggcgcccuuggcuucugu

SEQ ID NO: 3671758 - RNA, 20 nt, Human
ggcgccgcaaaccacacugg

SEQ ID NO: 3671759 - RNA, 21 nt, Human
ggcgccgucuccaggggcugc

SEQ ID NO: 3671760 - RNA, 17 nt, Human
ggcgccgugcugggcag

SEQ ID NO: 3671761 - RNA, 13 nt, Human
ggcgccucugcaa

SEQ ID NO: 3671762 - RNA, 22 nt, Human
ggcgcgcaccuguaaucccagc

SEQ ID NO: 3671763 - RNA, 19 nt, Human
ggcgcgguggcucacgccu

SEQ ID NO: 3671764 - RNA, 21 nt, Human
ggcgcuagaggccauggaggc

SEQ ID NO: 3671765 - RNA, 19 nt, Human
ggcgcuagcacagcucccu

SEQ ID NO: 3671766 - RNA, 23 nt, Human
ggcgcucgaaguugaucucccca

SEQ ID NO: 3671767 - RNA, 17 nt, Human
ggcgcugccccuggcag

SEQ ID NO: 3671768 - RNA, 18 nt, Human
ggcgcugccccuggcagc

SEQ ID NO: 3671769 - RNA, 16 nt, Human
ggcgcuggcccagccg

SEQ ID NO: 3671770 - RNA, 22 nt, Human
ggcggaaagccuguaagccugc

SEQ ID NO: 3671771 - RNA, 19 nt, Human
ggcggagaguacagugagc

SEQ ID NO: 3671772 - RNA, 20 nt, Human
ggcggagaguacagugagcc

SEQ ID NO: 3671773 - RNA, 13 nt, Human
ggcggagcuggcc

SEQ ID NO: 3671774 - RNA, 15 nt, Human
ggcggagcuggcccc

SEQ ID NO: 3671775 - RNA, 20 nt, Human
ggcggagcuggccccgccgc

SEQ ID NO: 3671776 - RNA, 12 nt, Human
ggcggcagcagc

SEQ ID NO: 3671777 - RNA, 11 nt, Human
ggcggcgccgg

SEQ ID NO: 3671778 - RNA, 20 nt, Human
ggcggcuggggucccagcag

SEQ ID NO: 3671779 - RNA, 18 nt, Human
ggcgggacagugcugcag

SEQ ID NO: 3671780 - RNA, 16 nt, Human
ggcgggagcaucucuu

SEQ ID NO: 3671781 - RNA, 15 nt, Human
ggcgggcagcacagc

SEQ ID NO: 3671782 - RNA, 17 nt, Human
ggcgggccaaggacugc

SEQ ID NO: 3671783 - RNA, 20 nt, Human
ggcgggcgaaucacgagguc

SEQ ID NO: 3671784 - RNA, 14 nt, Human
ggcgggcggucagg

SEQ ID NO: 3671785 - RNA, 16 nt, Human
ggcggggaggaggaaa

SEQ ID NO: 3671786 - RNA, 12 nt, Human
ggcggggguggc

SEQ ID NO: 3671787 - RNA, 14 nt, Human
ggcggggguggcgg

SEQ ID NO: 3671788 - RNA, 22 nt, Human
ggcgggugccuguaaucccagc

SEQ ID NO: 3671789 - RNA, 20 nt, Human
ggcggguggaucacgagguc

SEQ ID NO: 3671790 - RNA, 16 nt, Human
ggcgggugggggugga

SEQ ID NO: 3671791 - RNA, 14 nt, Human
ggcggucccagcuc

SEQ ID NO: 3671792 - RNA, 14 nt, Human
ggcgguggacuuga

SEQ ID NO: 3671793 - RNA, 22 nt, Human
ggcggugggcacccacccuggg

SEQ ID NO: 3671794 - RNA, 14 nt, Human
ggcguaaguacaga

SEQ ID NO: 3671795 - RNA, 21 nt, Human
ggcguaaguacagagaagcca

SEQ ID NO: 3671796 - RNA, 14 nt, Human
ggcguacaggcugg

SEQ ID NO: 3671797 - RNA, 17 nt, Human
ggcguaggcuacagaga

SEQ ID NO: 3671798 - RNA, 22 nt, Human
ggcguaggcuacagagaagccu

SEQ ID NO: 3671799 - RNA, 16 nt, Human
ggcgucagccuccagc

SEQ ID NO: 3671800 - RNA, 19 nt, Human
ggcgucagccuccagccuc

SEQ ID NO: 3671801 - RNA, 22 nt, Human
ggcgucagccuccagccucugu

SEQ ID NO: 3671802 - RNA, 15 nt, Human
ggcgugaacccagga

SEQ ID NO: 3671803 - RNA, 15 nt, Human
ggcgugacucaccca

SEQ ID NO: 3671804 - RNA, 16 nt, Human
ggcgugagaccugccc

SEQ ID NO: 3671805 - RNA, 20 nt, Human
ggcguggagagcccggcgcc

SEQ ID NO: 3671806 - RNA, 16 nt, Human
ggcguggagccaggga

SEQ ID NO: 3671807 - RNA, 15 nt, Human
ggcguggagggaggc

SEQ ID NO: 3671808 - RNA, 16 nt, Human
ggcguggauuaaacuu

SEQ ID NO: 3671809 - RNA, 16 nt, Human
ggcguggcaaauauaa

SEQ ID NO: 3671810 - RNA, 15 nt, Human
ggcguggucacugcu

SEQ ID NO: 3671811 - RNA, 18 nt, Human
ggcguggucacugcuguc

SEQ ID NO: 3671812 - RNA, 16 nt, Human
ggcgugguggcgggca

SEQ ID NO: 3671813 - RNA, 20 nt, Human
ucuugccccaacccccagca

SEQ ID NO: 3671814 - RNA, 17 nt, Human
ucuugcccgcucaggcu

SEQ ID NO: 3671815 - RNA, 15 nt, Human
ucuugcccuucccug

SEQ ID NO: 3671816 - RNA, 20 nt, Human
ucuugcccuucccugucccu

SEQ ID NO: 3671817 - RNA, 20 nt, Human
ucuugccuauauuuuccuga

SEQ ID NO: 3671818 - RNA, 18 nt, Human
ucuugccucagcuucccc

SEQ ID NO: 3671819 - RNA, 19 nt, Human
ucuugccucagcuucccca

SEQ ID NO: 3671820 - RNA, 14 nt, Human
ucuugccuccaggu

SEQ ID NO: 3671821 - RNA, 19 nt, Human
ucuugccuccaggugcaga

SEQ ID NO: 3671822 - RNA, 15 nt, Human
ucuugccucugugcu

SEQ ID NO: 3671823 - RNA, 16 nt, Human
ucuugccucugugcug

SEQ ID NO: 3671824 - RNA, 21 nt, Human
ucuugccugaacuccugccau

SEQ ID NO: 3671825 - RNA, 16 nt, Human
ucuugccuuacacaaa

SEQ ID NO: 3671826 - RNA, 17 nt, Human
ucuugccuuuuucauua

SEQ ID NO: 3671827 - RNA, 19 nt, Human
ucuugcgaauccaagcucc

SEQ ID NO: 3671828 - RNA, 15 nt, Human
ucuugcuaaucagug

SEQ ID NO: 3671829 - RNA, 17 nt, Human
ucuugcuaaucaguguc

SEQ ID NO: 3671830 - RNA, 21 nt, Human
ucuugcuaucggggaagccag

SEQ ID NO: 3671831 - RNA, 14 nt, Human
ucuugcucccuuca

SEQ ID NO: 3671832 - RNA, 15 nt, Human
ucuugcucucuuuua

SEQ ID NO: 3671833 - RNA, 13 nt, Human
ucuugcucugcug

SEQ ID NO: 3671834 - RNA, 23 nt, Human
ucuugcucugcugacagacacag

SEQ ID NO: 3671835 - RNA, 22 nt, Human
ggcuaaggcguggagcugccug

SEQ ID NO: 3671836 - RNA, 20 nt, Human
ggcuaagugauccucccacc

SEQ ID NO: 3671837 - RNA, 13 nt, Human
ggcuaauuuaaca

SEQ ID NO: 3671838 - RNA, 18 nt, Human
ggcuaauuuuuguuuugu

SEQ ID NO: 3671839 - RNA, 15 nt, Human
ggcuacacagggaug

SEQ ID NO: 3671840 - RNA, 11 nt, Human
ggcuacagaga

SEQ ID NO: 3671841 - RNA, 14 nt, Human
ggcuacagagaagc

SEQ ID NO: 3671842 - RNA, 16 nt, Human
ggcuacagagaagccu

SEQ ID NO: 3671843 - RNA, 12 nt, Human
ggcuacccuccc

SEQ ID NO: 3671844 - RNA, 13 nt, Human
ggcuacgccucuu

SEQ ID NO: 3671845 - RNA, 13 nt, Human
ggcuacucugugc

SEQ ID NO: 3671846 - RNA, 15 nt, Human
ggcuacucugugcca

SEQ ID NO: 3671847 - RNA, 18 nt, Human
ggcuacucugugccagag

SEQ ID NO: 3671848 - RNA, 22 nt, Human
ggcuacucugugccagagccug

SEQ ID NO: 3671849 - RNA, 23 nt, Human
ggcuacugcagcuuuacaugcaa

SEQ ID NO: 3671850 - RNA, 23 nt, Human
ggcuacuucggggcugggaaguc

SEQ ID NO: 3671851 - RNA, 15 nt, Human
ggcuacuugcuuuga

SEQ ID NO: 3671852 - RNA, 15 nt, Human
ggcuagaacuggaga

SEQ ID NO: 3671853 - RNA, 16 nt, Human
ggcuagaggccagccc

SEQ ID NO: 3671854 - RNA, 16 nt, Human
ggcuagagguucaaag

SEQ ID NO: 3671855 - RNA, 13 nt, Human
ggcuagaguccuc

SEQ ID NO: 3671856 - RNA, 18 nt, Human
ggcuagaguccucacucc

SEQ ID NO: 3671857 - RNA, 20 nt, Human
ggcuagaguccucacuccca

SEQ ID NO: 3671858 - RNA, 15 nt, Human
ggcuagcuggagccu

SEQ ID NO: 3671859 - RNA, 22 nt, Human
ggcuagggagacgccaugugau

SEQ ID NO: 3671860 - RNA, 16 nt, Human
ggcuagucaagcuccu

SEQ ID NO: 3671861 - RNA, 17 nt, Human
ggcuagucaagcuccuc

SEQ ID NO: 3671862 - RNA, 14 nt, Human
ggcuagucagagag

SEQ ID NO: 3671863 - RNA, 16 nt, Human
ggcuaguugggcuucc

SEQ ID NO: 3671864 - RNA, 12 nt, Human
ggcuaugcauuu

SEQ ID NO: 3671865 - RNA, 17 nt, Human
ggcuauggacacagggu

SEQ ID NO: 3671866 - RNA, 21 nt, Human
ggcuauggggauagaugugug

SEQ ID NO: 3671867 - RNA, 17 nt, Human
ggcuauguauaaaauac

SEQ ID NO: 3671868 - RNA, 15 nt, Human
ggcuauuuaccaggg

SEQ ID NO: 3671869 - RNA, 16 nt, Human
ggcuauuuguaaaucu

SEQ ID NO: 3671870 - RNA, 14 nt, Human
ggcucaagcagucu

SEQ ID NO: 3671871 - RNA, 19 nt, Human
ggcucaagcgauucuccug

SEQ ID NO: 3671872 - RNA, 16 nt, Human
ggcucacaccuguaau

SEQ ID NO: 3671873 - RNA, 12 nt, Human
ggcucacacuga

SEQ ID NO: 3671874 - RNA, 16 nt, Human
ggcucacccaguccug

SEQ ID NO: 3671875 - RNA, 21 nt, Human
ggcucacgccuaugaucccag

SEQ ID NO: 3671876 - RNA, 17 nt, Human
ggcucacgccuguaauc

SEQ ID NO: 3671877 - RNA, 13 nt, Human
ggcucacgugugu

SEQ ID NO: 3671878 - RNA, 22 nt, Human
ggcucacucagcacuuggcccu

SEQ ID NO: 3671879 - RNA, 16 nt, Human
ggcucacugcagccuc

SEQ ID NO: 3671880 - RNA, 13 nt, Human
ggcucacugccag

SEQ ID NO: 3671881 - RNA, 16 nt, Human
ggcucacugccaggcc

SEQ ID NO: 3671882 - RNA, 20 nt, Human
ggcucacugccaggccagcc

SEQ ID NO: 3671883 - RNA, 21 nt, Human
ggcucacugccaggccagccu

SEQ ID NO: 3671884 - RNA, 17 nt, Human
ggcucacuggcuuugaa

SEQ ID NO: 3671885 - RNA, 13 nt, Human
ggcucagagaugu

SEQ ID NO: 3671886 - RNA, 18 nt, Human
ggcucagagaugugcacc

SEQ ID NO: 3671887 - RNA, 18 nt, Human
ggcucagagccggggugg

SEQ ID NO: 3671888 - RNA, 15 nt, Human
ggcucagagggggac

SEQ ID NO: 3671889 - RNA, 17 nt, Human
ggcucagaugaaaugca

SEQ ID NO: 3671890 - RNA, 13 nt, Human
ggcucagcaaggc

SEQ ID NO: 3671891 - RNA, 15 nt, Human
ggcucagcaaggcca

SEQ ID NO: 3671892 - RNA, 19 nt, Human
ggcucagcaaggccaccuc

SEQ ID NO: 3671893 - RNA, 20 nt, Human
ggcucagcucggggagccuu

SEQ ID NO: 3671894 - RNA, 16 nt, Human
ggcucaggucacauaa

SEQ ID NO: 3671895 - RNA, 20 nt, Human
ggcucagguggggucacucu

SEQ ID NO: 3671896 - RNA, 18 nt, Human
ggcucagugaaguugcug

SEQ ID NO: 3671897 - RNA, 19 nt, Human
ggcucagugaaguugcugc

SEQ ID NO: 3671898 - RNA, 18 nt, Human
ggcucagugcaaccucug

SEQ ID NO: 3671899 - RNA, 21 nt, Human
ggcucauauuccugcagccug

SEQ ID NO: 3671900 - RNA, 22 nt, Human
ggcucauauuccugcagccugg

SEQ ID NO: 3671901 - RNA, 22 nt, Human
ggcuccacacacacaaaaaaag

SEQ ID NO: 3671902 - RNA, 16 nt, Human
ggcuccacuuggucug

SEQ ID NO: 3671903 - RNA, 17 nt, Human
ggcuccagaugcagggc

SEQ ID NO: 3671904 - RNA, 13 nt, Human
ggcuccaggagca

SEQ ID NO: 3671905 - RNA, 18 nt, Human
ggcuccaggccagggggc

SEQ ID NO: 3671906 - RNA, 14 nt, Human
ggcuccaggcuccu

SEQ ID NO: 3671907 - RNA, 15 nt, Human
ggcuccaggcuccuu

SEQ ID NO: 3671908 - RNA, 15 nt, Human
ggcuccagucugcug

SEQ ID NO: 3671909 - RNA, 22 nt, Human
ggcuccagucugcugcccucca

SEQ ID NO: 3671910 - RNA, 13 nt, Human
ggcuccaugccag

SEQ ID NO: 3671911 - RNA, 14 nt, Human
ggcuccaugccagc

SEQ ID NO: 3671912 - RNA, 11 nt, Human
ggcuccaugcu

SEQ ID NO: 3671913 - RNA, 15 nt, Human
ggcucccacagagac

SEQ ID NO: 3671914 - RNA, 18 nt, Human
ggcucccacaggcccuuc

SEQ ID NO: 3671915 - RNA, 19 nt, Human
ggcucccacaggcccuucc

SEQ ID NO: 3671916 - RNA, 21 nt, Human
ggcucccacaggcccuuccuc

SEQ ID NO: 3671917 - RNA, 17 nt, Human
ggcucccagccaggccc

SEQ ID NO: 3671918 - RNA, 18 nt, Human
ggcucccagccaggcccu

SEQ ID NO: 3671919 - RNA, 22 nt, Human
ggcucccaggagccugcccagc

SEQ ID NO: 3671920 - RNA, 17 nt, Human
ggcucccagggacaccu

SEQ ID NO: 3671921 - RNA, 13 nt, Human
ggcucccaggggc

SEQ ID NO: 3671922 - RNA, 20 nt, Human
ggcucccaggggucucccug

SEQ ID NO: 3671923 - RNA, 19 nt, Human
ggcucccaugaccauacug

SEQ ID NO: 3671924 - RNA, 12 nt, Human
ggcuccccucua

SEQ ID NO: 3671925 - RNA, 15 nt, Human
ggcuccccucuuccu

SEQ ID NO: 3671926 - RNA, 17 nt, Human
ggcuccccucuuccucu

SEQ ID NO: 3671927 - RNA, 13 nt, Human
ggcuccccugggg

SEQ ID NO: 3671928 - RNA, 17 nt, Human
ggcucccggguccuugg

SEQ ID NO: 3671929 - RNA, 16 nt, Human
ggcucccguggccugu

SEQ ID NO: 3671930 - RNA, 22 nt, Human
ggcucccguguaucuggacacu

SEQ ID NO: 3671931 - RNA, 17 nt, Human
ggcucccuccgccccca

SEQ ID NO: 3671932 - RNA, 16 nt, Human
ggcucccuccuccagg

SEQ ID NO: 3671933 - RNA, 17 nt, Human
ggcucccugacugggag

SEQ ID NO: 3671934 - RNA, 16 nt, Human
ggcucccuggggggag

SEQ ID NO: 3671935 - RNA, 22 nt, Human
ggcuccgacuugugcacaggca

SEQ ID NO: 3671936 - RNA, 22 nt, Human
ggcuccgcccuuagucccccaa

SEQ ID NO: 3671937 - RNA, 17 nt, Human
ggcuccggccucugccu

SEQ ID NO: 3671938 - RNA, 22 nt, Human
ggcuccgucaguaucaggccug

SEQ ID NO: 3671939 - RNA, 16 nt, Human
ggcuccgugugggaga

SEQ ID NO: 3671940 - RNA, 23 nt, Human
ggcuccuccaggguggcagcaac

SEQ ID NO: 3671941 - RNA, 13 nt, Human
ggcuccucccagc

SEQ ID NO: 3671942 - RNA, 14 nt, Human
ggcuccucccuccc

SEQ ID NO: 3671943 - RNA, 11 nt, Human
ggcuccugauc

SEQ ID NO: 3671944 - RNA, 12 nt, Human
ggcuccugccac

SEQ ID NO: 3671945 - RNA, 12 nt, Human
ggcuccugcccc

SEQ ID NO: 3671946 - RNA, 13 nt, Human
ggcuccugccccc

SEQ ID NO: 3671947 - RNA, 12 nt, Human
ggcuccugcugc

SEQ ID NO: 3671948 - RNA, 14 nt, Human
ggcuccugcugcac

SEQ ID NO: 3671949 - RNA, 15 nt, Human
ggcuccugcugcacc

SEQ ID NO: 3671950 - RNA, 22 nt, Human
ggcuccugcugcaccaacccag

SEQ ID NO: 3671951 - RNA, 11 nt, Human
ggcuccuggac

SEQ ID NO: 3671952 - RNA, 12 nt, Human
ggcuccuggacc

SEQ ID NO: 3671953 - RNA, 12 nt, Human
ggcuccuggacu

SEQ ID NO: 3671954 - RNA, 23 nt, Human
ggcuccuggucaccuaggaagcc

SEQ ID NO: 3671955 - RNA, 19 nt, Human
ggcuccuugugccagagaa

SEQ ID NO: 3671956 - RNA, 17 nt, Human
ggcuccuugugggccug

SEQ ID NO: 3671957 - RNA, 19 nt, Human
ggcuccuugugggccuggg

SEQ ID NO: 3671958 - RNA, 17 nt, Human
ggcuccuuucuccagcc

SEQ ID NO: 3671959 - RNA, 23 nt, Human
gggaaaucgagugccgcaucuca

SEQ ID NO: 3671960 - RNA, 18 nt, Human
gggaaaugcugauuuaaa

SEQ ID NO: 3671961 - RNA, 23 nt, Human
gggaaauguuuuguaaacauuua

SEQ ID NO: 3671962 - RNA, 15 nt, Human
gggaacacuggggac

SEQ ID NO: 3671963 - RNA, 16 nt, Human
gggaacagacaggaga

SEQ ID NO: 3671964 - RNA, 13 nt, Human
gggaacagccacu

SEQ ID NO: 3671965 - RNA, 20 nt, Human
gggaacaguguuucccauaa

SEQ ID NO: 3671966 - RNA, 16 nt, Human
gggaacauggggagga

SEQ ID NO: 3671967 - RNA, 22 nt, Human
gggaacauuucuguaaauacca

SEQ ID NO: 3671968 - RNA, 17 nt, Human
gggaaccccuuucccac

SEQ ID NO: 3671969 - RNA, 19 nt, Human
gggaacccugcccacuccc

SEQ ID NO: 3671970 - RNA, 11 nt, Human
gggaaccuccc

SEQ ID NO: 3671971 - RNA, 14 nt, Human
gggaaccucccaga

SEQ ID NO: 3671972 - RNA, 16 nt, Human
gggaaccuccccagcc

SEQ ID NO: 3671973 - RNA, 20 nt, Human
gggaaccuccccagccugcg

SEQ ID NO: 3671974 - RNA, 13 nt, Human
gggaaccuggaac

SEQ ID NO: 3671975 - RNA, 14 nt, Human
gggaaccugugucc

SEQ ID NO: 3671976 - RNA, 15 nt, Human
gggaacucccaagaa

SEQ ID NO: 3671977 - RNA, 14 nt, Human
gggaacucugacaa

SEQ ID NO: 3671978 - RNA, 21 nt, Human
gggaacucugacaagggcuga

SEQ ID NO: 3671979 - RNA, 12 nt, Human
gggaacuggcca

SEQ ID NO: 3671980 - RNA, 16 nt, Human
gggaacuggccaagcu

SEQ ID NO: 3671981 - RNA, 21 nt, Human
gggaagaaacacuuucucuuc

SEQ ID NO: 3671982 - RNA, 14 nt, Human
gggaagacaguggc

SEQ ID NO: 3671983 - RNA, 16 nt, Human
gggaagacaguggccc

SEQ ID NO: 3671984 - RNA, 22 nt, Human
gggaagacuccuagcuguccuu

SEQ ID NO: 3671985 - RNA, 18 nt, Human
gggaagagacagcccagg

SEQ ID NO: 3671986 - RNA, 20 nt, Human
gggaagagcacagcccuccc

SEQ ID NO: 3671987 - RNA, 16 nt, Human
gggaagagcuuagaaa

SEQ ID NO: 3671988 - RNA, 12 nt, Human
gggaagaggccu

SEQ ID NO: 3671989 - RNA, 22 nt, Human
gggaagcagaauagcaaggugc

SEQ ID NO: 3671990 - RNA, 13 nt, Human
gggaagcagcagc

SEQ ID NO: 3671991 - RNA, 12 nt, Human
gggaagcccugg

SEQ ID NO: 3671992 - RNA, 23 nt, Human
gggaagcggagguugcagggagc

SEQ ID NO: 3671993 - RNA, 16 nt, Human
gggaagcuacagguua

SEQ ID NO: 3671994 - RNA, 20 nt, Human
gggaagcuucugucuccagc

SEQ ID NO: 3671995 - RNA, 21 nt, Human
gggaagcuucugucuccagcu

SEQ ID NO: 3671996 - RNA, 20 nt, Human
gggaagcuucuuaaaugaga

SEQ ID NO: 3671997 - RNA, 22 nt, Human
gggaaggaagaggaagagugca

SEQ ID NO: 3671998 - RNA, 18 nt, Human
gggaaggacuuggcgcgc

SEQ ID NO: 3671999 - RNA, 20 nt, Human
gggaaggaggguuagggagg

SEQ ID NO: 3672000 - RNA, 22 nt, Human
gggaaggauucugcuggccucu

SEQ ID NO: 3672001 - RNA, 13 nt, Human
gggaaggccugac

SEQ ID NO: 3672002 - RNA, 21 nt, Human
gggaaggcuacuucggggcug

SEQ ID NO: 3672003 - RNA, 13 nt, Human
gggaagggagagc

SEQ ID NO: 3672004 - RNA, 16 nt, Human
gggaagggagccaagg

SEQ ID NO: 3672005 - RNA, 12 nt, Human
gggaagggccag

SEQ ID NO: 3672006 - RNA, 18 nt, Human
gggaaggggacccccgcc

SEQ ID NO: 3672007 - RNA, 14 nt, Human
gggaaggggcggug

SEQ ID NO: 3672008 - RNA, 15 nt, Human
gggaaguaguccuug

SEQ ID NO: 3672009 - RNA, 18 nt, Human
gggaaguaguuaucaugu

SEQ ID NO: 3672010 - RNA, 22 nt, Human
gggaaguaguuaucauguuagu

SEQ ID NO: 3672011 - RNA, 19 nt, Human
gggaagucccugggaggcc

SEQ ID NO: 3672012 - RNA, 21 nt, Human
gggaagugacaaggccccaga

SEQ ID NO: 3672013 - RNA, 14 nt, Human
gggaaguuaaaggg

SEQ ID NO: 3672014 - RNA, 22 nt, Human
gggaaguugcauuccuuugucu

SEQ ID NO: 3672015 - RNA, 18 nt, Human
gggaauauuugaaucuug

SEQ ID NO: 3672016 - RNA, 12 nt, Human
gggaaucaagau

SEQ ID NO: 3672017 - RNA, 15 nt, Human
gggaauccaagccuc

SEQ ID NO: 3672018 - RNA, 18 nt, Human
gggaaugagcccagagaa

SEQ ID NO: 3672019 - RNA, 20 nt, Human
gggaaugaggcuugcugaga

SEQ ID NO: 3672020 - RNA, 13 nt, Human
gggaaugaggggg

SEQ ID NO: 3672021 - RNA, 17 nt, Human
gggaaugccugagugcc

SEQ ID NO: 3672022 - RNA, 15 nt, Human
gggaauggcagcugc

SEQ ID NO: 3672023 - RNA, 21 nt, Human
gggaauguauuauucugcagc

SEQ ID NO: 3672024 - RNA, 21 nt, Human
gggaauguuugccucugccuc

SEQ ID NO: 3672025 - RNA, 12 nt, Human
gggaauucucuu

SEQ ID NO: 3672026 - RNA, 18 nt, Human
gggaauugugugauguuu

SEQ ID NO: 3672027 - RNA, 13 nt, Human
gggaauuuccucu

SEQ ID NO: 3672028 - RNA, 16 nt, Human
gggacaaagaggccuu

SEQ ID NO: 3672029 - RNA, 20 nt, Human
gggacaaguagccaccugag

SEQ ID NO: 3672030 - RNA, 18 nt, Human
gggacacaaaacuccgcc

SEQ ID NO: 3672031 - RNA, 20 nt, Human
gggacaccaagccuuggcuc

SEQ ID NO: 3672032 - RNA, 18 nt, Human
gggacaccagccaggcuc

SEQ ID NO: 3672033 - RNA, 22 nt, Human
gggacaccagccaggcucugug

SEQ ID NO: 3672034 - RNA, 14 nt, Human
gggacacccuguga

SEQ ID NO: 3672035 - RNA, 14 nt, Human
gggacaccuaggcu

SEQ ID NO: 3672036 - RNA, 14 nt, Human
gggacacgggcagc

SEQ ID NO: 3672037 - RNA, 20 nt, Human
gggacagaggccccagccuc

SEQ ID NO: 3672038 - RNA, 14 nt, Human
gggacagaggccug

SEQ ID NO: 3672039 - RNA, 17 nt, Human
gggacagaggccugccc

SEQ ID NO: 3672040 - RNA, 23 nt, Human
gggacagaggggguggccuccca

SEQ ID NO: 3672041 - RNA, 22 nt, Human
gggacagaguagccagguucug

SEQ ID NO: 3672042 - RNA, 16 nt, Human
gggacagcccagagcc

SEQ ID NO: 3672043 - RNA, 13 nt, Human
gggacagcuccuu

SEQ ID NO: 3672044 - RNA, 19 nt, Human
ugaaagaguuaagaauguc

SEQ ID NO: 3672045 - RNA, 12 nt, Human
ugaaagauuaaa

SEQ ID NO: 3672046 - RNA, 14 nt, Human
ugaaagauuguggg

SEQ ID NO: 3672047 - RNA, 12 nt, Human
ugaaagcaaaaa

SEQ ID NO: 3672048 - RNA, 15 nt, Human
ugaaagcaaaaaugc

SEQ ID NO: 3672049 - RNA, 20 nt, Human
ugaaagcagggaauuucuau

SEQ ID NO: 3672050 - RNA, 22 nt, Human
ugaaagcagggaauuucuaucu

SEQ ID NO: 3672051 - RNA, 15 nt, Human
ugaaagcauccaugu

SEQ ID NO: 3672052 - RNA, 23 nt, Human
ugaaagccaaggagucacugaga

SEQ ID NO: 3672053 - RNA, 14 nt, Human
ugaaagccauuugu

SEQ ID NO: 3672054 - RNA, 15 nt, Human
ugaaagccccagaaa

SEQ ID NO: 3672055 - RNA, 17 nt, Human
ugaaagccccagaaauc

SEQ ID NO: 3672056 - RNA, 17 nt, Human
ugaaagccuuagggaag

SEQ ID NO: 3672057 - RNA, 22 nt, Human
ugaaagccuuagggaagcuggc

SEQ ID NO: 3672058 - RNA, 22 nt, Human
ugaaagcuccucgagggcaggg

SEQ ID NO: 3672059 - RNA, 22 nt, Human
ugaaagcugauuacugucaaua

SEQ ID NO: 3672060 - RNA, 16 nt, Human
ugaaagcugauuuuuu

SEQ ID NO: 3672061 - RNA, 12 nt, Human
ugaaaggaaauu

SEQ ID NO: 3672062 - RNA, 17 nt, Human
ugaaaggaauuuugcua

SEQ ID NO: 3672063 - RNA, 15 nt, Human
ugaaaggacccugug

SEQ ID NO: 3672064 - RNA, 20 nt, Human
ugaaaggcaggccuauuuca

SEQ ID NO: 3672065 - RNA, 21 nt, Human
ugaaaggcaggccuauuucau

SEQ ID NO: 3672066 - RNA, 19 nt, Human
ugaaaggcauucucugaag

SEQ ID NO: 3672067 - RNA, 11 nt, Human
ugaaaggcuuu

SEQ ID NO: 3672068 - RNA, 15 nt, Human
ugaaaggcuuuucaa

SEQ ID NO: 3672069 - RNA, 23 nt, Human
ugaaagggaguauuacaaaaaca

SEQ ID NO: 3672070 - RNA, 16 nt, Human
ugaaagggcccagaga

SEQ ID NO: 3672071 - RNA, 19 nt, Human
ugaaagguacuauauuugc

SEQ ID NO: 3672072 - RNA, 15 nt, Human
ugaaagguacuucaa

SEQ ID NO: 3672073 - RNA, 19 nt, Human
ugaaagguuagagaauaaa

SEQ ID NO: 3672074 - RNA, 19 nt, Human
ugaaagucacggcugcgca

SEQ ID NO: 3672075 - RNA, 15 nt, Human
ugaaagucagaugcc

SEQ ID NO: 3672076 - RNA, 18 nt, Human
ugaaaguccagaaacugu

SEQ ID NO: 3672077 - RNA, 15 nt, Human
ugaaagucuguccuu

SEQ ID NO: 3672078 - RNA, 23 nt, Human
ugaaagucuguccuugaaggacu

SEQ ID NO: 3672079 - RNA, 17 nt, Human
ugaaagucuugugacua

SEQ ID NO: 3672080 - RNA, 23 nt, Human
ugaaagucuugugacuagugcug

SEQ ID NO: 3672081 - RNA, 21 nt, Human
ugaaagugaauaaacuucagc

SEQ ID NO: 3672082 - RNA, 20 nt, Human
ugaaagugaugacauauuuu

SEQ ID NO: 3672083 - RNA, 17 nt, Human
ugaaagugccuuugcag

SEQ ID NO: 3672084 - RNA, 21 nt, Human
ugaaagugccuuugcagcuca

SEQ ID NO: 3672085 - RNA, 15 nt, Human
ugaaaguuacccacu

SEQ ID NO: 3672086 - RNA, 22 nt, Human
ugaaaguuacccacugaagccc

SEQ ID NO: 3672087 - RNA, 14 nt, Human
ugaaaguucuugcu

SEQ ID NO: 3672088 - RNA, 14 nt, Human
ugaaaguuguacau

SEQ ID NO: 3672089 - RNA, 19 nt, Human
ugaaaguuguacaugaaau

SEQ ID NO: 3672090 - RNA, 20 nt, Human
ugaaaguuuucagaaccucu

SEQ ID NO: 3672091 - RNA, 22 nt, Human
ugaaaguuuugaguagauauua

SEQ ID NO: 3672092 - RNA, 14 nt, Human
ugaaaguuuuguaa

SEQ ID NO: 3672093 - RNA, 12 nt, Human
ugaaauaaaaua

SEQ ID NO: 3672094 - RNA, 13 nt, Human
ugaaauaaacguc

SEQ ID NO: 3672095 - RNA, 22 nt, Human
ugaaauaaacgucuuaaauauu

SEQ ID NO: 3672096 - RNA, 23 nt, Human
ugaaauaaacgucuuaaauauuc

SEQ ID NO: 3672097 - RNA, 21 nt, Human
ugaaauaaagaaauugcaaua

SEQ ID NO: 3672098 - RNA, 18 nt, Human
ugaaauaacaaaauggac

SEQ ID NO: 3672099 - RNA, 16 nt, Human
ugaaauaacauggccu

SEQ ID NO: 3672100 - RNA, 17 nt, Human
ugaaauaacauggccuu

SEQ ID NO: 3672101 - RNA, 18 nt, Human
ugaaauaaccguaaaggu

SEQ ID NO: 3672102 - RNA, 17 nt, Human
ugaaauaagccagacau

SEQ ID NO: 3672103 - RNA, 10 nt, Human
gggacucugc

SEQ ID NO: 3672104 - RNA, 18 nt, Human
gggacugaagccaaaguu

SEQ ID NO: 3672105 - RNA, 11 nt, Human
gggacugagag

SEQ ID NO: 3672106 - RNA, 13 nt, Human
gggacugagccag

SEQ ID NO: 3672107 - RNA, 14 nt, Human
gggacugccaccuc

SEQ ID NO: 3672108 - RNA, 15 nt, Human
gggacugcuaaauaa

SEQ ID NO: 3672109 - RNA, 16 nt, Human
gggacugcuaaauaaa

SEQ ID NO: 3672110 - RNA, 18 nt, Human
gggacugcugcugccugg

SEQ ID NO: 3672111 - RNA, 19 nt, Human
gggacugcugcugccuggc

SEQ ID NO: 3672112 - RNA, 19 nt, Human
gggacuggaaccagggaga

SEQ ID NO: 3672113 - RNA, 20 nt, Human
gggacugggagccgcagcag

SEQ ID NO: 3672114 - RNA, 12 nt, Human
gggacuggguuu

SEQ ID NO: 3672115 - RNA, 21 nt, Human
gggacuggguuuggaccccag

SEQ ID NO: 3672116 - RNA, 18 nt, Human
gggacuugaaucuuucca

SEQ ID NO: 3672117 - RNA, 18 nt, Human
gggacuuggaagcuccgc

SEQ ID NO: 3672118 - RNA, 23 nt, Human
gggacuuggaagcuccgcuuucu

SEQ ID NO: 3672119 - RNA, 14 nt, Human
gggacuugugucug

SEQ ID NO: 3672120 - RNA, 23 nt, Human
gggacuuugcugauuuccccucu

SEQ ID NO: 3672121 - RNA, 10 nt, Human
gggagaaaac

SEQ ID NO: 3672122 - RNA, 13 nt, Human
gggagaaaauuca

SEQ ID NO: 3672123 - RNA, 12 nt, Human
gggagaaauacu

SEQ ID NO: 3672124 - RNA, 21 nt, Human
gggagaaccaaaaagaggcua

SEQ ID NO: 3672125 - RNA, 21 nt, Human
gggagacaccucagagccccg

SEQ ID NO: 3672126 - RNA, 15 nt, Human
gggagacaugugaca

SEQ ID NO: 3672127 - RNA, 20 nt, Human
gggagaccggccugccagga

SEQ ID NO: 3672128 - RNA, 18 nt, Human
gggagacgguuuccaggg

SEQ ID NO: 3672129 - RNA, 19 nt, Human
gggagacugggcugaggga

SEQ ID NO: 3672130 - RNA, 13 nt, Human
gggagagacccuu

SEQ ID NO: 3672131 - RNA, 18 nt, Human
gggagagagacguguaca

SEQ ID NO: 3672132 - RNA, 12 nt, Human
gggagagagaga

SEQ ID NO: 3672133 - RNA, 12 nt, Human
gggagagcaggc

SEQ ID NO: 3672134 - RNA, 14 nt, Human
gggagagcaggcug

SEQ ID NO: 3672135 - RNA, 16 nt, Human
gggagagcccaggagc

SEQ ID NO: 3672136 - RNA, 14 nt, Human
gggagagccccugg

SEQ ID NO: 3672137 - RNA, 13 nt, Human
gggagagccugcu

SEQ ID NO: 3672138 - RNA, 21 nt, Human
gggagaggauuuuuuucugag

SEQ ID NO: 3672139 - RNA, 20 nt, Human
gggagagggcgcaggccgug

SEQ ID NO: 3672140 - RNA, 19 nt, Human
gggagaucggggccagagg

SEQ ID NO: 3672141 - RNA, 20 nt, Human
gggagaucggggccagaggc

SEQ ID NO: 3672142 - RNA, 19 nt, Human
gggagauggaucaaucaaa

SEQ ID NO: 3672143 - RNA, 17 nt, Human
gggagauucaagggacc

SEQ ID NO: 3672144 - RNA, 13 nt, Human
gggagcagagaca

SEQ ID NO: 3672145 - RNA, 12 nt, Human
gggagcagcccc

SEQ ID NO: 3672146 - RNA, 21 nt, Human
gggagcaggagauugagaagg

SEQ ID NO: 3672147 - RNA, 13 nt, Human
gggagcaggcagc

SEQ ID NO: 3672148 - RNA, 22 nt, Human
gggagccaaaaucucaagaaau

SEQ ID NO: 3672149 - RNA, 11 nt, Human
gggagccaagg

SEQ ID NO: 3672150 - RNA, 15 nt, Human
gggagccauuugaga

SEQ ID NO: 3672151 - RNA, 20 nt, Human
gggagcccacuguccugggc

SEQ ID NO: 3672152 - RNA, 12 nt, Human
gggagccccagg

SEQ ID NO: 3672153 - RNA, 21 nt, Human
gggagccccagggucuucccu

SEQ ID NO: 3672154 - RNA, 21 nt, Human
gggagcccccagccugucaga

SEQ ID NO: 3672155 - RNA, 20 nt, Human
gggagccuaggaccacucag

SEQ ID NO: 3672156 - RNA, 12 nt, Human
gggagccucccu

SEQ ID NO: 3672157 - RNA, 17 nt, Human
gggagccuccugcccag

SEQ ID NO: 3672158 - RNA, 21 nt, Human
gggagccugaucaccugcccu

SEQ ID NO: 3672159 - RNA, 22 nt, Human
gggagccuuugguucuggccag

SEQ ID NO: 3672160 - RNA, 23 nt, Human
gggagcucaggaaccgaggcagg

SEQ ID NO: 3672161 - RNA, 19 nt, Human
gggagcuccacucugcuuc

SEQ ID NO: 3672162 - RNA, 22 nt, Human
gggagcuccucuccuggaggau

SEQ ID NO: 3672163 - RNA, 12 nt, Human
gggagcucugca

SEQ ID NO: 3672164 - RNA, 14 nt, Human
gggagcucugucug

SEQ ID NO: 3672165 - RNA, 12 nt, Human
gggagcugccaa

SEQ ID NO: 3672166 - RNA, 21 nt, Human
gggagcugccuguucagcucc

SEQ ID NO: 3672167 - RNA, 22 nt, Human
gggagcugccuguucagcucca

SEQ ID NO: 3672168 - RNA, 22 nt, Human
gggagcuggcuccagccuggaa

SEQ ID NO: 3672169 - RNA, 19 nt, Human
gggagcugggcccgacaug

SEQ ID NO: 3672170 - RNA, 14 nt, Human
gggagcugggccug

SEQ ID NO: 3672171 - RNA, 16 nt, Human
gggaggaagcagaaua

SEQ ID NO: 3672172 - RNA, 20 nt, Human
gggaggaagcagaauaaagc

SEQ ID NO: 3672173 - RNA, 23 nt, Human
gggaggaagcagguugaggggcu

SEQ ID NO: 3672174 - RNA, 21 nt, Human
gggaggaccagggcagggcca

SEQ ID NO: 3672175 - RNA, 19 nt, Human
gggaggaccugacccuacu

SEQ ID NO: 3672176 - RNA, 13 nt, Human
gggaggaccuggg

SEQ ID NO: 3672177 - RNA, 19 nt, Human
gggaggaccuggggcacag

SEQ ID NO: 3672178 - RNA, 17 nt, Human
gggaggacgcucucugg

SEQ ID NO: 3672179 - RNA, 20 nt, Human
gggaggacgcucucuggccu

SEQ ID NO: 3672180 - RNA, 21 nt, Human
gggaggagaggggaagggcca

SEQ ID NO: 3672181 - RNA, 15 nt, Human
gggaggaggcagaga

SEQ ID NO: 3672182 - RNA, 13 nt, Human
gggaggagggaga

SEQ ID NO: 3672183 - RNA, 14 nt, Human
gggaggagggagag

SEQ ID NO: 3672184 - RNA, 18 nt, Human
gggaggagggagagggag

SEQ ID NO: 3672185 - RNA, 12 nt, Human
gggaggagggca

SEQ ID NO: 3672186 - RNA, 23 nt, Human
gggaggaucacuggagcccagga

SEQ ID NO: 3672187 - RNA, 23 nt, Human
gggaggaucucuugagccuggga

SEQ ID NO: 3672188 - RNA, 22 nt, Human
gggaggauguucugggacacag

SEQ ID NO: 3672189 - RNA, 21 nt, Human
gggaggauugcuugagcucag

SEQ ID NO: 3672190 - RNA, 19 nt, Human
gggaggccaagaguggccc

SEQ ID NO: 3672191 - RNA, 13 nt, Human
gggaggccaagga

SEQ ID NO: 3672192 - RNA, 19 nt, Human
gggaggccaaggugggagg

SEQ ID NO: 3672193 - RNA, 19 nt, Human
gggaggccaucuggagagc

SEQ ID NO: 3672194 - RNA, 21 nt, Human
gggaggcggacguuccagccg

SEQ ID NO: 3672195 - RNA, 18 nt, Human
gggaggcggagaguacag

SEQ ID NO: 3672196 - RNA, 20 nt, Human
gggaggcggagcuugcagug

SEQ ID NO: 3672197 - RNA, 19 nt, Human
gggaggcugaggcaggaga

SEQ ID NO: 3672198 - RNA, 13 nt, Human
gggagggaaaagg

SEQ ID NO: 3672199 - RNA, 18 nt, Human
gggagggaagggagccaa

SEQ ID NO: 3672200 - RNA, 15 nt, Human
gggagggagggcucc

SEQ ID NO: 3672201 - RNA, 22 nt, Human
gggagggauucugguuccaggg

SEQ ID NO: 3672202 - RNA, 21 nt, Human
gggagggcggcaggggccugg

SEQ ID NO: 3672203 - RNA, 14 nt, Human
gggagggcucugag

SEQ ID NO: 3672204 - RNA, 20 nt, Human
gggagggcucugaggcgccc

SEQ ID NO: 3672205 - RNA, 17 nt, Human
gggaggggaagcuucug

SEQ ID NO: 3672206 - RNA, 12 nt, Human
gggaggggaagu

SEQ ID NO: 3672207 - RNA, 13 nt, Human
gggaggggcaggc

SEQ ID NO: 3672208 - RNA, 19 nt, Human
gggaggggcgcuggcccag

SEQ ID NO: 3672209 - RNA, 22 nt, Human
ucugucaagaguaguuauauaa

SEQ ID NO: 3672210 - RNA, 19 nt, Human
ucugucacaguaaaaauaa

SEQ ID NO: 3672211 - RNA, 22 nt, Human
ucugucacaguaaaaauaaaau

SEQ ID NO: 3672212 - RNA, 16 nt, Human
ucugucacccaggcug

SEQ ID NO: 3672213 - RNA, 17 nt, Human
ucugucacugcaggcac

SEQ ID NO: 3672214 - RNA, 13 nt, Human
ucugucacuuaau

SEQ ID NO: 3672215 - RNA, 18 nt, Human
ucugucagaaugcuauug

SEQ ID NO: 3672216 - RNA, 21 nt, Human
ucugucagaugagaacaaagc

SEQ ID NO: 3672217 - RNA, 22 nt, Human
ucugucagaugagaacaaagcu

SEQ ID NO: 3672218 - RNA, 24 nt, Human
ucugucagaugagaacaaagcugu

SEQ ID NO: 3672219 - RNA, 16 nt, Human
ucugucaggagagcag

SEQ ID NO: 3672220 - RNA, 17 nt, Human
ucugucaggagagcagc

SEQ ID NO: 3672221 - RNA, 19 nt, Human
ucugucagucacagccacc

SEQ ID NO: 3672222 - RNA, 22 nt, Human
ucugucaugaacauguuccuga

SEQ ID NO: 3672223 - RNA, 23 nt, Human
ucugucauuugagcagggcucag

SEQ ID NO: 3672224 - RNA, 13 nt, Human
ucugucauuuguu

SEQ ID NO: 3672225 - RNA, 15 nt, Human
ucuguccaaaggagg

SEQ ID NO: 3672226 - RNA, 16 nt, Human
ucuguccaaaggaggc

SEQ ID NO: 3672227 - RNA, 19 nt, Human
ucuguccaaaggaggcugg

SEQ ID NO: 3672228 - RNA, 13 nt, Human
ucuguccaaggaa

SEQ ID NO: 3672229 - RNA, 13 nt, Human
ucuguccagggcc

SEQ ID NO: 3672230 - RNA, 17 nt, Human
ucugucccacuuggcau

SEQ ID NO: 3672231 - RNA, 14 nt, Human
ucugucccauuccc

SEQ ID NO: 3672232 - RNA, 18 nt, Human
ucugucccauucccuggg

SEQ ID NO: 3672233 - RNA, 19 nt, Human
ucuguccccuucucucauc

SEQ ID NO: 3672234 - RNA, 20 nt, Human
ucuguccccuucucucaucu

SEQ ID NO: 3672235 - RNA, 21 nt, Human
ucuguccccuucucucaucuc

SEQ ID NO: 3672236 - RNA, 20 nt, Human
ucugucccgggguccugugg

SEQ ID NO: 3672237 - RNA, 23 nt, Human
ucugucccuagguguuuuguuca

SEQ ID NO: 3672238 - RNA, 15 nt, Human
ucugucccuguuaga

SEQ ID NO: 3672239 - RNA, 22 nt, Human
ucugucccuugccccccuggcc

SEQ ID NO: 3672240 - RNA, 15 nt, Human
ucugucccuugcugu

SEQ ID NO: 3672241 - RNA, 16 nt, Human
ucugucccuugcugua

SEQ ID NO: 3672242 - RNA, 19 nt, Human
ucuguccgagcuuugaaaa

SEQ ID NO: 3672243 - RNA, 15 nt, Human
ucuguccgagugugc

SEQ ID NO: 3672244 - RNA, 17 nt, Human
ucuguccgagugugcca

SEQ ID NO: 3672245 - RNA, 14 nt, Human
ucuguccuacucug

SEQ ID NO: 3672246 - RNA, 20 nt, Human
ucuguccuacucugugucag

SEQ ID NO: 3672247 - RNA, 22 nt, Human
ugacagggcacaccgggcacuc

SEQ ID NO: 3672248 - RNA, 17 nt, Human
ugacagggccagugggg

SEQ ID NO: 3672249 - RNA, 23 nt, Human
ugacagggccaguggggccugug

SEQ ID NO: 3672250 - RNA, 21 nt, Human
ugacagggcggggguggcggc

SEQ ID NO: 3672251 - RNA, 15 nt, Human
ugacagguaaacuau

SEQ ID NO: 3672252 - RNA, 17 nt, Human
ugacagguaaauuaaga

SEQ ID NO: 3672253 - RNA, 17 nt, Human
ugacaguaacuugguua

SEQ ID NO: 3672254 - RNA, 20 nt, Human
ugacaguaauuguguuuaca

SEQ ID NO: 3672255 - RNA, 14 nt, Human
ugacagucaucauc

SEQ ID NO: 3672256 - RNA, 19 nt, Human
ugacagucaucaucagggc

SEQ ID NO: 3672257 - RNA, 12 nt, Human
ugacagugaggu

SEQ ID NO: 3672258 - RNA, 16 nt, Human
ugacaguggaacuaca

SEQ ID NO: 3672259 - RNA, 18 nt, Human
ugacaguggcguuuguaa

SEQ ID NO: 3672260 - RNA, 17 nt, Human
ugacaguucugaagaau

SEQ ID NO: 3672261 - RNA, 16 nt, Human
ugacaguuuuucuguu

SEQ ID NO: 3672262 - RNA, 18 nt, Human
ugacauaaaaacaacuuu

SEQ ID NO: 3672263 - RNA, 23 nt, Human
ugacauaaguauuuaauucaugu

SEQ ID NO: 3672264 - RNA, 21 nt, Human
ugacauacgcuuuuaaugaaa

SEQ ID NO: 3672265 - RNA, 17 nt, Human
ugacauagucuggcugu

SEQ ID NO: 3672266 - RNA, 11 nt, Human
ugacauauuua

SEQ ID NO: 3672267 - RNA, 12 nt, Human
ugacauauuuaa

SEQ ID NO: 3672268 - RNA, 16 nt, Human
ugacauauuuaauguu

SEQ ID NO: 3672269 - RNA, 19 nt, Human
ugacauauuuaauguuuua

SEQ ID NO: 3672270 - RNA, 20 nt, Human
ugacauauuuaauguuuuaa

SEQ ID NO: 3672271 - RNA, 23 nt, Human
ugacauauuuaauguuuuaaaug

SEQ ID NO: 3672272 - RNA, 20 nt, Human
ugacaucaagaaucuucugu

SEQ ID NO: 3672273 - RNA, 18 nt, Human
ugacaucacagcagccuc

SEQ ID NO: 3672274 - RNA, 14 nt, Human
ugacaucacuggca

SEQ ID NO: 3672275 - RNA, 18 nt, Human
ugacaucacuuguacaaa

SEQ ID NO: 3672276 - RNA, 20 nt, Human
ugacaucacuuguacaaaau

SEQ ID NO: 3672277 - RNA, 23 nt, Human
ugacaucacuuguacaaaauaaa

SEQ ID NO: 3672278 - RNA, 17 nt, Human
ugacaucaguggcaugg

SEQ ID NO: 3672279 - RNA, 23 nt, Human
ugacaucaguuccuuugugugua

SEQ ID NO: 3672280 - RNA, 13 nt, Human
ugacauccaagcu

SEQ ID NO: 3672281 - RNA, 20 nt, Human
ugacaucgccaguaaaauua

SEQ ID NO: 3672282 - RNA, 19 nt, Human
ugacaucggaaaaauaauc

SEQ ID NO: 3672283 - RNA, 21 nt, Human
ugacaucggaaaaauaaucaa

SEQ ID NO: 3672284 - RNA, 14 nt, Human
ugacaucucagggg

SEQ ID NO: 3672285 - RNA, 19 nt, Human
ugacaucucaggggccaga

SEQ ID NO: 3672286 - RNA, 22 nt, Human
ugacaucucaggggccagagga

SEQ ID NO: 3672287 - RNA, 13 nt, Human
ugacaucucugca

SEQ ID NO: 3672288 - RNA, 14 nt, Human
ugacaucucugcaa

SEQ ID NO: 3672289 - RNA, 23 nt, Human
ugacaucucugcaaucuucucag

SEQ ID NO: 3672290 - RNA, 12 nt, Human
ugacaucucuuu

SEQ ID NO: 3672291 - RNA, 14 nt, Human
ugacaucucuuuga

SEQ ID NO: 3672292 - RNA, 19 nt, Human
ugacaucuuuuuaaagcuu

SEQ ID NO: 3672293 - RNA, 18 nt, Human
ugacaugauuccuuccug

SEQ ID NO: 3672294 - RNA, 19 nt, Human
ugacaugauuccuuccugu

SEQ ID NO: 3672295 - RNA, 14 nt, Human
ugacaugcacugac

SEQ ID NO: 3672296 - RNA, 17 nt, Human
ugacaugcaucaucuca

SEQ ID NO: 3672297 - RNA, 21 nt, Human
ugacaugcgggcugggcagcu

SEQ ID NO: 3672298 - RNA, 15 nt, Human
ugacauggaaaugaa

SEQ ID NO: 3672299 - RNA, 12 nt, Human
ugacauguacag

SEQ ID NO: 3672300 - RNA, 15 nt, Human
ugacauguacagaga

SEQ ID NO: 3672301 - RNA, 16 nt, Human
ugacaugucccuacac

SEQ ID NO: 3672302 - RNA, 16 nt, Human
ugacaugugaaaccuu

SEQ ID NO: 3672303 - RNA, 17 nt, Human
ugacaugugaaaccuuu

SEQ ID NO: 3672304 - RNA, 19 nt, Human
ugacauguguuggcagccu

SEQ ID NO: 3672305 - RNA, 21 nt, Human
ugacauuaacaguuuuccaug

SEQ ID NO: 3672306 - RNA, 18 nt, Human
ugacauucaccugcccca

SEQ ID NO: 3672307 - RNA, 17 nt, Human
ugacauucaugccuggc

SEQ ID NO: 3672308 - RNA, 19 nt, Human
ugacauucugaaugcuucu

SEQ ID NO: 3672309 - RNA, 13 nt, Human
ugacauugaaauc

SEQ ID NO: 3672310 - RNA, 20 nt, Human
ugacauugaaaucuaggaaa

SEQ ID NO: 3672311 - RNA, 17 nt, Human
ugacauugcaccuggau

SEQ ID NO: 3672312 - RNA, 14 nt, Human
ugacauugccaaaa

SEQ ID NO: 3672313 - RNA, 19 nt, Human
ugacauugccaaaaaggau

SEQ ID NO: 3672314 - RNA, 15 nt, Human
ugacauugcguuuga

SEQ ID NO: 3672315 - RNA, 19 nt, Human
ugacauugcguuugaccuu

SEQ ID NO: 3672316 - RNA, 19 nt, Human
ugacauuguauguaucuau

SEQ ID NO: 3672317 - RNA, 15 nt, Human
ugacauuuauauauu

SEQ ID NO: 3672318 - RNA, 16 nt, Human
ugacauuuauauauug

SEQ ID NO: 3672319 - RNA, 21 nt, Human
ugacauuuauuuuucauuuag

SEQ ID NO: 3672320 - RNA, 21 nt, Human
ugacauuuauuuuucucauga

SEQ ID NO: 3672321 - RNA, 22 nt, Human
ugacauuucuucuagugaugau

SEQ ID NO: 3672322 - RNA, 21 nt, Human
ugacauuuggaguguuccccu

SEQ ID NO: 3672323 - RNA, 21 nt, Human
ugacauuugggagacauguga

SEQ ID NO: 3672324 - RNA, 23 nt, Human
ugacauuugggagacaugugaca

SEQ ID NO: 3672325 - RNA, 16 nt, Human
ugacauuugucauuuu

SEQ ID NO: 3672326 - RNA, 15 nt, Human
ugaccaaaaguuaca

SEQ ID NO: 3672327 - RNA, 22 nt, Human
ugaccaaaaguuacauguuugc

SEQ ID NO: 3672328 - RNA, 21 nt, Human
ugaccaaauaucaccaggacu

SEQ ID NO: 3672329 - RNA, 18 nt, Human
ugaccaacaggcuguucu

SEQ ID NO: 3672330 - RNA, 18 nt, Human
ugaccaacuagacauucu

SEQ ID NO: 3672331 - RNA, 22 nt, Human
ugaccaacuagacauucugucg

SEQ ID NO: 3672332 - RNA, 15 nt, Human
ugaccaacuguguug

SEQ ID NO: 3672333 - RNA, 19 nt, Human
ugaccaagaacugcaugga

SEQ ID NO: 3672334 - RNA, 15 nt, Human
ugaccaagagagaaa

SEQ ID NO: 3672335 - RNA, 14 nt, Human
ugaccaagcaggaa

SEQ ID NO: 3672336 - RNA, 15 nt, Human
ugaccaagcaggaag

SEQ ID NO: 3672337 - RNA, 16 nt, Human
ugaccaagcaggaagc

SEQ ID NO: 3672338 - RNA, 18 nt, Human
ugaccaagcaggaagcuc

SEQ ID NO: 3672339 - RNA, 19 nt, Human
ugaccaagcaggaagcuca

SEQ ID NO: 3672340 - RNA, 21 nt, Human
ugaccaagcaggaagcucaga

SEQ ID NO: 3672341 - RNA, 18 nt, Human
ugaccaauauuguacagu

SEQ ID NO: 3672342 - RNA, 16 nt, Human
ugaccaauuuuaacuu

SEQ ID NO: 3672343 - RNA, 19 nt, Human
ugaccacacuccagcuggg

SEQ ID NO: 3672344 - RNA, 20 nt, Human
ugaccacacuccagcuggga

SEQ ID NO: 3672345 - RNA, 18 nt, Human
ugaccacacuuccugucc

SEQ ID NO: 3672346 - RNA, 23 nt, Human
ugaccacacuuccuguccagaga

SEQ ID NO: 3672347 - RNA, 22 nt, Human
ugaccacagcaucauuuugcau

SEQ ID NO: 3672348 - RNA, 21 nt, Human
ugaccacauagcaugaggcca

SEQ ID NO: 3672349 - RNA, 13 nt, Human
ugaccacccuccc

SEQ ID NO: 3672350 - RNA, 14 nt, Human
ugaccacucagaga

SEQ ID NO: 3672351 - RNA, 18 nt, Human
ugaccacucagagacaug

SEQ ID NO: 3672352 - RNA, 20 nt, Human
ugaccacugcagaagacagu

SEQ ID NO: 3672353 - RNA, 18 nt, Human
ugaccacuugaggccuga

SEQ ID NO: 3672354 - RNA, 20 nt, Human
ugaccacuugaggccugauc

SEQ ID NO: 3672355 - RNA, 22 nt, Human
ugaccagcagaucccagcucac

SEQ ID NO: 3672356 - RNA, 17 nt, Human
ugaccagcucccccucc

SEQ ID NO: 3672357 - RNA, 18 nt, Human
ugaccagcucccccuccc

SEQ ID NO: 3672358 - RNA, 20 nt, Human
ugaccagcucccccucccuc

SEQ ID NO: 3672359 - RNA, 22 nt, Human
ugaccagcucccccucccuccc

SEQ ID NO: 3672360 - RNA, 20 nt, Human
ugaccaggccugggccagag

SEQ ID NO: 3672361 - RNA, 22 nt, Human
ugaccaggggugauuucagaga

SEQ ID NO: 3672362 - RNA, 23 nt, Human
ugaccaguuuaaccugaugcagu

SEQ ID NO: 3672363 - RNA, 19 nt, Human
ugaccauccacucuacccu

SEQ ID NO: 3672364 - RNA, 14 nt, Human
ugaccaucugcuuu

SEQ ID NO: 3672365 - RNA, 15 nt, Human
ugaccaugaaagacu

SEQ ID NO: 3672366 - RNA, 18 nt, Human
ugaccaugcucaucugcu

SEQ ID NO: 3672367 - RNA, 13 nt, Human
ugaccauucucca

SEQ ID NO: 3672368 - RNA, 20 nt, Human
ugaccauucuccaccugcca

SEQ ID NO: 3672369 - RNA, 23 nt, Human
ugaccauucuccaccugccaggg

SEQ ID NO: 3672370 - RNA, 14 nt, Human
ugacccaauuaagu

SEQ ID NO: 3672371 - RNA, 13 nt, Human
ugacccacagccu

SEQ ID NO: 3672372 - RNA, 17 nt, Human
ugacccaccccugugcu

SEQ ID NO: 3672373 - RNA, 17 nt, Human
ugacccacugguuccuu

SEQ ID NO: 3672374 - RNA, 17 nt, Human
ugacccacuucucauca

SEQ ID NO: 3672375 - RNA, 23 nt, Human
ugacccacuucucaucacacaca

SEQ ID NO: 3672376 - RNA, 21 nt, Human
ugacccagccccuugagaaac

SEQ ID NO: 3672377 - RNA, 23 nt, Human
ugacccagccccuugagaaaccu

SEQ ID NO: 3672378 - RNA, 12 nt, Human
ugacccaggccg

SEQ ID NO: 3672379 - RNA, 21 nt, Human
ugacccaggccgcagcucuug

SEQ ID NO: 3672380 - RNA, 12 nt, Human
ugacccaggcug

SEQ ID NO: 3672381 - RNA, 15 nt, Human
ugacccaggcugggc

SEQ ID NO: 3672382 - RNA, 16 nt, Human
ugacccagugccccca

SEQ ID NO: 3672383 - RNA, 17 nt, Human
ugacccagugcccccac

SEQ ID NO: 3672384 - RNA, 18 nt, Human
ugacccagugcccccacu

SEQ ID NO: 3672385 - RNA, 18 nt, Human
ugacccaugcugcccugu

SEQ ID NO: 3672386 - RNA, 16 nt, Human
ugacccaugggcagga

SEQ ID NO: 3672387 - RNA, 18 nt, Human
ugacccaugggcaggaga

SEQ ID NO: 3672388 - RNA, 13 nt, Human
ugacccauugcug

SEQ ID NO: 3672389 - RNA, 21 nt, Human
ugaccccaaacaccuuccagc

SEQ ID NO: 3672390 - RNA, 15 nt, Human
ugacuaauuuuacau

SEQ ID NO: 3672391 - RNA, 22 nt, Human
ugacuaauuuuacauguuuaua

SEQ ID NO: 3672392 - RNA, 19 nt, Human
ugacuacuuagcauccuaa

SEQ ID NO: 3672393 - RNA, 22 nt, Human
ugacuacuuagcauccuaagaa

SEQ ID NO: 3672394 - RNA, 15 nt, Human
ugacuacuuugccuu

SEQ ID NO: 3672395 - RNA, 15 nt, Human
ugacuagaaucgaca

SEQ ID NO: 3672396 - RNA, 23 nt, Human
ugacuagaugauggaugccaaua

SEQ ID NO: 3672397 - RNA, 14 nt, Human
ugacuaggaaaaaa

SEQ ID NO: 3672398 - RNA, 17 nt, Human
ugacuagggaaaugauc

SEQ ID NO: 3672399 - RNA, 13 nt, Human
ugacuagggagcc

SEQ ID NO: 3672400 - RNA, 19 nt, Human
ugacuagggauucaggcug

SEQ ID NO: 3672401 - RNA, 21 nt, Human
ugacuagggauucaggcugcu

SEQ ID NO: 3672402 - RNA, 20 nt, Human
ugacuaguacaaauuauaaa

SEQ ID NO: 3672403 - RNA, 13 nt, Human
ugacuagugcuga

SEQ ID NO: 3672404 - RNA, 21 nt, Human
ugacuagugcugaagcuuauu

SEQ ID NO: 3672405 - RNA, 16 nt, Human
ugacuauaaugccucu

SEQ ID NO: 3672406 - RNA, 18 nt, Human
ugacuauauaauuuauuu

SEQ ID NO: 3672407 - RNA, 17 nt, Human
ugacuauauagagaugu

SEQ ID NO: 3672408 - RNA, 14 nt, Human
ugacuaucauaaaa

SEQ ID NO: 3672409 - RNA, 21 nt, Human
ugacuaucccaacagucaugu

SEQ ID NO: 3672410 - RNA, 20 nt, Human
ugacuaugcguggcuggaac

SEQ ID NO: 3672411 - RNA, 12 nt, Human
ugacuauuaugu

SEQ ID NO: 3672412 - RNA, 22 nt, Human
ugacuauucugagaugacuauu

SEQ ID NO: 3672413 - RNA, 20 nt, Human
ugacuauucuguaucuuuca

SEQ ID NO: 3672414 - RNA, 17 nt, Human
ugacuauucuugaugua

SEQ ID NO: 3672415 - RNA, 17 nt, Human
ugacuauuuucguucau

SEQ ID NO: 3672416 - RNA, 19 nt, Human
ugacuauuuuucagaaucu

SEQ ID NO: 3672417 - RNA, 22 nt, Human
ugacucaacauguuacugacca

SEQ ID NO: 3672418 - RNA, 12 nt, Human
ugacucaagaag

SEQ ID NO: 3672419 - RNA, 15 nt, Human
ugacucaagaaguga

SEQ ID NO: 3672420 - RNA, 22 nt, Human
ugacucaagaagugaagaaugc

SEQ ID NO: 3672421 - RNA, 16 nt, Human
ugacucaagauuccca

SEQ ID NO: 3672422 - RNA, 17 nt, Human
ugacucaagauucccag

SEQ ID NO: 3672423 - RNA, 11 nt, Human
ugacucaccca

SEQ ID NO: 3672424 - RNA, 13 nt, Human
ugacucacccaag

SEQ ID NO: 3672425 - RNA, 14 nt, Human
ugacucacccaagc

SEQ ID NO: 3672426 - RNA, 12 nt, Human
ugacucaggagc

SEQ ID NO: 3672427 - RNA, 19 nt, Human
ugacucaggagccugugac

SEQ ID NO: 3672428 - RNA, 18 nt, Human
ugacucagggcuccuggg

SEQ ID NO: 3672429 - RNA, 15 nt, Human
ugacucaucauuugu

SEQ ID NO: 3672430 - RNA, 16 nt, Human
ugacuccaaccauuca

SEQ ID NO: 3672431 - RNA, 20 nt, Human
ugacuccacgauccugccac

SEQ ID NO: 3672432 - RNA, 18 nt, Human
ugacuccaggagaggagc

SEQ ID NO: 3672433 - RNA, 17 nt, Human
ugacuccauagaccuuu

SEQ ID NO: 3672434 - RNA, 18 nt, Human
ugacucccccaguccccu

SEQ ID NO: 3672435 - RNA, 16 nt, Human
ugacuccgcuggaggu

SEQ ID NO: 3672436 - RNA, 18 nt, Human
ugacuccuaccugcccug

SEQ ID NO: 3672437 - RNA, 19 nt, Human
ugacuccuaccugcccugg

SEQ ID NO: 3672438 - RNA, 22 nt, Human
ugacuccuuagagacaucaaaa

SEQ ID NO: 3672439 - RNA, 14 nt, Human
ugacuccuuguggu

SEQ ID NO: 3672440 - RNA, 21 nt, Human
ugacuccuugugguuuauguc

SEQ ID NO: 3672441 - RNA, 18 nt, Human
ugacucgagucacacuca

SEQ ID NO: 3672442 - RNA, 16 nt, Human
ugacucgggcuccugu

SEQ ID NO: 3672443 - RNA, 17 nt, Human
ugacucgggcuccugug

SEQ ID NO: 3672444 - RNA, 19 nt, Human
ugacucgggcuccugugcc

SEQ ID NO: 3672445 - RNA, 20 nt, Human
ugacucgggcuccugugccc

SEQ ID NO: 3672446 - RNA, 16 nt, Human
ugacucgguuucucca

SEQ ID NO: 3672447 - RNA, 19 nt, Human
ugacucuaguacugugaau

SEQ ID NO: 3672448 - RNA, 21 nt, Human
ugacucuauaagcaaauugcu

SEQ ID NO: 3672449 - RNA, 13 nt, Human
ugacucucaaauc

SEQ ID NO: 3672450 - RNA, 13 nt, Human
ugacucuccaggg

SEQ ID NO: 3672451 - RNA, 14 nt, Human
ugacucugcccccu

SEQ ID NO: 3672452 - RNA, 16 nt, Human
ugacucugcucuugca

SEQ ID NO: 3672453 - RNA, 17 nt, Human
ugacucuggcaaagcuu

SEQ ID NO: 3672454 - RNA, 15 nt, Human
ugacucuggguccuu

SEQ ID NO: 3672455 - RNA, 21 nt, Human
ugacucuggguccuuccugaa

SEQ ID NO: 3672456 - RNA, 14 nt, Human
ugacucuuaagaag

SEQ ID NO: 3672457 - RNA, 18 nt, Human
ugacucuuccccaggaag

SEQ ID NO: 3672458 - RNA, 15 nt, Human
ugacucuucccucaa

SEQ ID NO: 3672459 - RNA, 19 nt, Human
ugacucuugaguuguuuuu

SEQ ID NO: 3672460 - RNA, 14 nt, Human
ugacucuuuccaac

SEQ ID NO: 3672461 - RNA, 22 nt, Human
ugacucuuuuuagggccaggca

SEQ ID NO: 3672462 - RNA, 23 nt, Human
ugacucuuuuuagggccaggcag

SEQ ID NO: 3672463 - RNA, 22 nt, Human
ugacugaacgauccuucaaagu

SEQ ID NO: 3672464 - RNA, 19 nt, Human
ugacugaagaugcagcuca

SEQ ID NO: 3672465 - RNA, 15 nt, Human
ugacugaauuucuuu

SEQ ID NO: 3672466 - RNA, 15 nt, Human
ugacugagcuucccu

SEQ ID NO: 3672467 - RNA, 20 nt, Human
ugacugaugcugagauucuu

SEQ ID NO: 3672468 - RNA, 15 nt, Human
ugacugauucuucag

SEQ ID NO: 3672469 - RNA, 22 nt, Human
ugacugcacguggcuucugaug

SEQ ID NO: 3672470 - RNA, 13 nt, Human
ugacugccaagcc

SEQ ID NO: 3672471 - RNA, 16 nt, Human
ugacugccccaacucc

SEQ ID NO: 3672472 - RNA, 20 nt, Human
ugacugcucagaacuugcug

SEQ ID NO: 3672473 - RNA, 22 nt, Human
ugacugcuccccagcccuggcu

SEQ ID NO: 3672474 - RNA, 23 nt, Human
ugacuggaauuuuuauuaugcau

SEQ ID NO: 3672475 - RNA, 23 nt, Human
ugacuggaggguccauuuuucuu

SEQ ID NO: 3672476 - RNA, 11 nt, Human
ugacuggauau

SEQ ID NO: 3672477 - RNA, 14 nt, Human
ugacugggggcaga

SEQ ID NO: 3672478 - RNA, 20 nt, Human
ugacuggggugggaggucuu

SEQ ID NO: 3672479 - RNA, 19 nt, Human
ugacugguuuacaggcccu

SEQ ID NO: 3672480 - RNA, 16 nt, Human
ugacuguacuccuccc

SEQ ID NO: 3672481 - RNA, 22 nt, Human
ugacuguacuccucccaggcgc

SEQ ID NO: 3672482 - RNA, 24 nt, Human
ugacuguccucuccccuccagccu

SEQ ID NO: 3672483 - RNA, 22 nt, Human
ugacugucuggggagcgggucu

SEQ ID NO: 3672484 - RNA, 16 nt, Human
ugacugugcuacuguc

SEQ ID NO: 3672485 - RNA, 11 nt, Human
ugacugugugu

SEQ ID NO: 3672486 - RNA, 17 nt, Human
ugacuguuuuuacccau

SEQ ID NO: 3672487 - RNA, 16 nt, Human
ugacuuaacugcauuu

SEQ ID NO: 3672488 - RNA, 16 nt, Human
ugacuuaaugugauua

SEQ ID NO: 3672489 - RNA, 12 nt, Human
ugacuuacugua

SEQ ID NO: 3672490 - RNA, 20 nt, Human
ugacuuacuguacaugaaaa

SEQ ID NO: 3672491 - RNA, 13 nt, Human
ugacuuagaaucc

SEQ ID NO: 3672492 - RNA, 22 nt, Human
ugacuuagaaucccuguguuaa

SEQ ID NO: 3672493 - RNA, 15 nt, Human
ugacuuauaguacau

SEQ ID NO: 3672494 - RNA, 17 nt, Human
ugacuuauaguacauga

SEQ ID NO: 3672495 - RNA, 14 nt, Human
ugacuuaugggccc

SEQ ID NO: 3672496 - RNA, 17 nt, Human
ugacuucaaugauagua

SEQ ID NO: 3672497 - RNA, 17 nt, Human
ugacuucaggggcugcc

SEQ ID NO: 3672498 - RNA, 18 nt, Human
ugacuucaggggcugccc

SEQ ID NO: 3672499 - RNA, 21 nt, Human
ugacuucaggggcugcccgcu

SEQ ID NO: 3672500 - RNA, 21 nt, Human
ugacuuccccaauaucuugcu

SEQ ID NO: 3672501 - RNA, 20 nt, Human
ugacuucgacugugaccugu

SEQ ID NO: 3672502 - RNA, 20 nt, Human
ugacuucuaauaucauucac

SEQ ID NO: 3672503 - RNA, 15 nt, Human
ugacuucuccagguc

SEQ ID NO: 3672504 - RNA, 13 nt, Human
ugacuucugagau

SEQ ID NO: 3672505 - RNA, 16 nt, Human
ugacuugacuuuaguc

SEQ ID NO: 3672506 - RNA, 21 nt, Human
ugacuuggcuggugugguaca

SEQ ID NO: 3672507 - RNA, 17 nt, Human
ugacuugggcaccccca

SEQ ID NO: 3672508 - RNA, 19 nt, Human
ugacuuguauauuuuaaga

SEQ ID NO: 3672509 - RNA, 19 nt, Human
ugacuugugguugaauuaa

SEQ ID NO: 3672510 - RNA, 16 nt, Human
ugacuuuaauuuaugu

SEQ ID NO: 3672511 - RNA, 20 nt, Human
ugacuuuagaaagcugacau

SEQ ID NO: 3672512 - RNA, 18 nt, Human
ugacuuuagucugcaaaa

SEQ ID NO: 3672513 - RNA, 19 nt, Human
ugacuuuagucugcaaaau

SEQ ID NO: 3672514 - RNA, 22 nt, Human
ugacuuucaaaguggaugcaau

SEQ ID NO: 3672515 - RNA, 21 nt, Human
ugacuuucaggaauugcccau

SEQ ID NO: 3672516 - RNA, 14 nt, Human
ugacuuucaguaaa

SEQ ID NO: 3672517 - RNA, 13 nt, Human
ugacuuucucagc

SEQ ID NO: 3672518 - RNA, 16 nt, Human
ugacuuugcucuuucu

SEQ ID NO: 3672519 - RNA, 15 nt, Human
ugacuuugcuugcuu

SEQ ID NO: 3672520 - RNA, 16 nt, Human
ugacuuugcuugcuuu

SEQ ID NO: 3672521 - RNA, 14 nt, Human
ugacuuuggauaau

SEQ ID NO: 3672522 - RNA, 15 nt, Human
ugacuuuggauaaua

SEQ ID NO: 3672523 - RNA, 23 nt, Human
ugacuuuucaaguauuuaagccu

SEQ ID NO: 3672524 - RNA, 13 nt, Human
ugacuuuucugua

SEQ ID NO: 3672525 - RNA, 13 nt, Human
ugacuuuuuauaa

SEQ ID NO: 3672526 - RNA, 14 nt, Human
ugacuuuuuauaaa

SEQ ID NO: 3672527 - RNA, 14 nt, Human
ugacuuuuugcauu

SEQ ID NO: 3672528 - RNA, 23 nt, Human
ugacuuuuugcauuuaaaacaga

SEQ ID NO: 3672529 - RNA, 15 nt, Human
ugacuuuuuuucacu

SEQ ID NO: 3672530 - RNA, 15 nt, Human
ugacuuuuuuuguau

SEQ ID NO: 3672531 - RNA, 16 nt, Human
ugagaaaaagcuccug

SEQ ID NO: 3672532 - RNA, 21 nt, Human
ugagaaaaauuuacauggcaa

SEQ ID NO: 3672533 - RNA, 14 nt, Human
ugagaaaacaagca

SEQ ID NO: 3672534 - RNA, 23 nt, Human
ugagaaaacaagcaaguucugag

SEQ ID NO: 3672535 - RNA, 23 nt, Human
ggucccagugggaggggcaggcu

SEQ ID NO: 3672536 - RNA, 22 nt, Human
gguccccagcccuuccucugcu

SEQ ID NO: 3672537 - RNA, 21 nt, Human
gguccccaucaucccagcugc

SEQ ID NO: 3672538 - RNA, 21 nt, Human
ggucccccacucuaaagcaaa

SEQ ID NO: 3672539 - RNA, 18 nt, Human
ggucccccuuccauggac

SEQ ID NO: 3672540 - RNA, 12 nt, Human
gguccccuccuu

SEQ ID NO: 3672541 - RNA, 17 nt, Human
ggucccggcucuguggg

SEQ ID NO: 3672542 - RNA, 18 nt, Human
ggucccggcucugugggu

SEQ ID NO: 3672543 - RNA, 19 nt, Human
ggucccggcucugugggug

SEQ ID NO: 3672544 - RNA, 18 nt, Human
ggucccuaauaaagcugu

SEQ ID NO: 3672545 - RNA, 14 nt, Human
ggucccucugugua

SEQ ID NO: 3672546 - RNA, 22 nt, Human
ggucccugauaacaaccuggag

SEQ ID NO: 3672547 - RNA, 14 nt, Human
ggucccugccuuag

SEQ ID NO: 3672548 - RNA, 21 nt, Human
ggucccuucuuacucacacac

SEQ ID NO: 3672549 - RNA, 19 nt, Human
ggucccuuguauccccugc

SEQ ID NO: 3672550 - RNA, 17 nt, Human
gguccggacacuccuag

SEQ ID NO: 3672551 - RNA, 20 nt, Human
gguccggacacuccuagaga

SEQ ID NO: 3672552 - RNA, 21 nt, Human
gguccggacacuccuagagaa

SEQ ID NO: 3672553 - RNA, 16 nt, Human
gguccgguguucuaag

SEQ ID NO: 3672554 - RNA, 21 nt, Human
gguccgguguucuaagaugug

SEQ ID NO: 3672555 - RNA, 16 nt, Human
gguccgugcuaaggac

SEQ ID NO: 3672556 - RNA, 17 nt, Human
gguccuacccauccccg

SEQ ID NO: 3672557 - RNA, 23 nt, Human
gguccuagaaauuccccacccug

SEQ ID NO: 3672558 - RNA, 14 nt, Human
gguccuaggcugga

SEQ ID NO: 3672559 - RNA, 17 nt, Human
gguccuaggcuggaagg

SEQ ID NO: 3672560 - RNA, 23 nt, Human
gguccuccaucccaacagccaug

SEQ ID NO: 3672561 - RNA, 17 nt, Human
gguccuccuccagggac

SEQ ID NO: 3672562 - RNA, 18 nt, Human
gguccuccuccagggaca

SEQ ID NO: 3672563 - RNA, 15 nt, Human
gguccucuggagccc

SEQ ID NO: 3672564 - RNA, 13 nt, Human
gguccucugucag

SEQ ID NO: 3672565 - RNA, 21 nt, Human
gguccucugucagucacagcc

SEQ ID NO: 3672566 - RNA, 19 nt, Human
gguccugagcacugccagg

SEQ ID NO: 3672567 - RNA, 20 nt, Human
gguccugauuucuagaaccc

SEQ ID NO: 3672568 - RNA, 16 nt, Human
gguccugcagccugca

SEQ ID NO: 3672569 - RNA, 20 nt, Human
gguccugcagucuggcugag

SEQ ID NO: 3672570 - RNA, 13 nt, Human
gguccugcugcag

SEQ ID NO: 3672571 - RNA, 21 nt, Human
gguccuggagcagaccacccc

SEQ ID NO: 3672572 - RNA, 21 nt, Human
gguccuggccaucccacaagu

SEQ ID NO: 3672573 - RNA, 15 nt, Human
gguccuggcuccuga

SEQ ID NO: 3672574 - RNA, 16 nt, Human
gguccuggcuccugag

SEQ ID NO: 3672575 - RNA, 15 nt, Human
gguccuggggcucug

SEQ ID NO: 3672576 - RNA, 23 nt, Human
gguccuggggcucugugcaggga

SEQ ID NO: 3672577 - RNA, 15 nt, Human
gguccugggggccug

SEQ ID NO: 3672578 - RNA, 16 nt, Human
gguccugggggccuga

SEQ ID NO: 3672579 - RNA, 18 nt, Human
gguccugguggggcagcu

SEQ ID NO: 3672580 - RNA, 17 nt, Human
gguccuguggcaggcag

SEQ ID NO: 3672581 - RNA, 22 nt, Human
gguccuguggcaggcagcgcca

SEQ ID NO: 3672582 - RNA, 15 nt, Human
gguccuuccaggccc

SEQ ID NO: 3672583 - RNA, 16 nt, Human
gguccuugcaccccuc

SEQ ID NO: 3672584 - RNA, 21 nt, Human
gguccuuugggaaaggagaag

SEQ ID NO: 3672585 - RNA, 15 nt, Human
gguccuuugggguga

SEQ ID NO: 3672586 - RNA, 16 nt, Human
gguccuuuugacacug

SEQ ID NO: 3672587 - RNA, 20 nt, Human
ggucgcccuggacugugugc

SEQ ID NO: 3672588 - RNA, 22 nt, Human
ggucgcuuacuuugagugaucc

SEQ ID NO: 3672589 - RNA, 22 nt, Human
ggucgggcagcacaaguguaau

SEQ ID NO: 3672590 - RNA, 14 nt, Human
ggucgggggggacc

SEQ ID NO: 3672591 - RNA, 20 nt, Human
ggucgguagguucagccaag

SEQ ID NO: 3672592 - RNA, 14 nt, Human
ggucggugccuuca

SEQ ID NO: 3672593 - RNA, 15 nt, Human
ggucguggagagcua

SEQ ID NO: 3672594 - RNA, 19 nt, Human
ggucguggagagcuaggag

SEQ ID NO: 3672595 - RNA, 14 nt, Human
ggucguuuuuuuca

SEQ ID NO: 3672596 - RNA, 13 nt, Human
ggucuaauguuua

SEQ ID NO: 3672597 - RNA, 16 nt, Human
ggucuacacugcaauc

SEQ ID NO: 3672598 - RNA, 21 nt, Human
ggucuacacugcaaucauaug

SEQ ID NO: 3672599 - RNA, 23 nt, Human
ggucuauguaaaugcaucugucc

SEQ ID NO: 3672600 - RNA, 14 nt, Human
ggucuauuccagcu

SEQ ID NO: 3672601 - RNA, 18 nt, Human
ggucuauuccagcucauu

SEQ ID NO: 3672602 - RNA, 19 nt, Human
ggucuauugucuguauuug

SEQ ID NO: 3672603 - RNA, 13 nt, Human
ggucucacccaug

SEQ ID NO: 3672604 - RNA, 15 nt, Human
ggucucacccuggag

SEQ ID NO: 3672605 - RNA, 20 nt, Human
ggucucacccuggaggcacc

SEQ ID NO: 3672606 - RNA, 11 nt, Human
ggucucagccc

SEQ ID NO: 3672607 - RNA, 18 nt, Human
ggucucaugcuccuuaau

SEQ ID NO: 3672608 - RNA, 11 nt, Human
ggucucccugg

SEQ ID NO: 3672609 - RNA, 13 nt, Human
ggucucccuggcu

SEQ ID NO: 3672610 - RNA, 17 nt, Human
ggucucccuggcucccu

SEQ ID NO: 3672611 - RNA, 21 nt, Human
ggucucccuucucuacacucu

SEQ ID NO: 3672612 - RNA, 12 nt, Human
ggucuccucagg

SEQ ID NO: 3672613 - RNA, 20 nt, Human
ggucucgcugaugcugggcu

SEQ ID NO: 3672614 - RNA, 22 nt, Human
ggucucgucuuccgucuccccc

SEQ ID NO: 3672615 - RNA, 15 nt, Human
ggucucuaggcuggg

SEQ ID NO: 3672616 - RNA, 19 nt, Human
ggucucuagugcugugaaa

SEQ ID NO: 3672617 - RNA, 19 nt, Human
ggucucucucucucuacaa

SEQ ID NO: 3672618 - RNA, 20 nt, Human
ggucucuuacuuuccuuucc

SEQ ID NO: 3672619 - RNA, 20 nt, Human
ggucucuucugaauaaagca

SEQ ID NO: 3672620 - RNA, 20 nt, Human
ggucucuuuuguaaauuaaa

SEQ ID NO: 3672621 - RNA, 12 nt, Human
ggucugaaaugg

SEQ ID NO: 3672622 - RNA, 21 nt, Human
ggucugaauguucugacauua

SEQ ID NO: 3672623 - RNA, 22 nt, Human
ggucugaauguucugacauuaa

SEQ ID NO: 3672624 - RNA, 14 nt, Human
ggucugacccacug

SEQ ID NO: 3672625 - RNA, 21 nt, Human
ggucugaguuguuaccccaag

SEQ ID NO: 3672626 - RNA, 14 nt, Human
ggucugcaagucag

SEQ ID NO: 3672627 - RNA, 19 nt, Human
ggucugcaagucagaggau

SEQ ID NO: 3672628 - RNA, 13 nt, Human
ggucugcaggcag

SEQ ID NO: 3672629 - RNA, 12 nt, Human
ggucugccacca

SEQ ID NO: 3672630 - RNA, 18 nt, Human
ugaaauuuaaacauuaaa

SEQ ID NO: 3672631 - RNA, 16 nt, Human
ugaaauuuauacacca

SEQ ID NO: 3672632 - RNA, 23 nt, Human
ugaaauuuauugaggaaaaauau

SEQ ID NO: 3672633 - RNA, 21 nt, Human
ugaaauuuauuuaaugugagu

SEQ ID NO: 3672634 - RNA, 23 nt, Human
ugaaauuuccugggagcuuuugu

SEQ ID NO: 3672635 - RNA, 14 nt, Human
ugaaauuugaauuu

SEQ ID NO: 3672636 - RNA, 13 nt, Human
ugaaauuuuacca

SEQ ID NO: 3672637 - RNA, 16 nt, Human
ugaaauuuuauaugcu

SEQ ID NO: 3672638 - RNA, 18 nt, Human
ugaaauuuuauaugcuua

SEQ ID NO: 3672639 - RNA, 20 nt, Human
ugaaauuuuccaaugucugc

SEQ ID NO: 3672640 - RNA, 20 nt, Human
ugaaauuuucuagacuuucu

SEQ ID NO: 3672641 - RNA, 21 nt, Human
ugaaauuuucuagacuuucug

SEQ ID NO: 3672642 - RNA, 20 nt, Human
ugaaauuuucuugauuugag

SEQ ID NO: 3672643 - RNA, 18 nt, Human
ugaaauuuugcaaauaua

SEQ ID NO: 3672644 - RNA, 22 nt, Human
ugaaauuuuuaaaaauacacuu

SEQ ID NO: 3672645 - RNA, 15 nt, Human
ugaaauuuuucuucu

SEQ ID NO: 3672646 - RNA, 18 nt, Human
ugaacaaaaaauaaaaau

SEQ ID NO: 3672647 - RNA, 15 nt, Human
ugaacaaaaggguca

SEQ ID NO: 3672648 - RNA, 15 nt, Human
ugaacaaaauuauuu

SEQ ID NO: 3672649 - RNA, 23 nt, Human
ugaacaaaguuuaccagaaagca

SEQ ID NO: 3672650 - RNA, 19 nt, Human
ugaacaaauuuacagagac

SEQ ID NO: 3672651 - RNA, 20 nt, Human
ugaacaaauuuacagagaca

SEQ ID NO: 3672652 - RNA, 18 nt, Human
ugaacaagaauuggaagc

SEQ ID NO: 3672653 - RNA, 14 nt, Human
ugaacaagagaagc

SEQ ID NO: 3672654 - RNA, 20 nt, Human
ugaacaaguuguuucauuga

SEQ ID NO: 3672655 - RNA, 16 nt, Human
ugaacaaucaaagcac

SEQ ID NO: 3672656 - RNA, 14 nt, Human
ugaacaaugaaguu

SEQ ID NO: 3672657 - RNA, 15 nt, Human
ugaacaaugaaguug

SEQ ID NO: 3672658 - RNA, 14 nt, Human
ugaacacaaauuau

SEQ ID NO: 3672659 - RNA, 15 nt, Human
ugaacacaggcagcu

SEQ ID NO: 3672660 - RNA, 16 nt, Human
ugaacacaggcagcuu

SEQ ID NO: 3672661 - RNA, 20 nt, Human
ugaacacaggcagcuuucua

SEQ ID NO: 3672662 - RNA, 23 nt, Human
ugaacacaggcagcuuucuagaa

SEQ ID NO: 3672663 - RNA, 12 nt, Human
ugaacacaguau

SEQ ID NO: 3672664 - RNA, 15 nt, Human
ugaacacaguauuuu

SEQ ID NO: 3672665 - RNA, 19 nt, Human
ugaacacaguauuuuccca

SEQ ID NO: 3672666 - RNA, 19 nt, Human
ugaacacaucagcuagcaa

SEQ ID NO: 3672667 - RNA, 20 nt, Human
ugaacacaucagcuagcaaa

SEQ ID NO: 3672668 - RNA, 20 nt, Human
ugaacacaugguuggaaaga

SEQ ID NO: 3672669 - RNA, 17 nt, Human
ugaacaccauugaaggc

SEQ ID NO: 3672670 - RNA, 20 nt, Human
ugaacaccauugaaggcuua

SEQ ID NO: 3672671 - RNA, 21 nt, Human
ugaacagaugaccccugccca

SEQ ID NO: 3672672 - RNA, 18 nt, Human
ugaacagcugguguagcu

SEQ ID NO: 3672673 - RNA, 17 nt, Human
ugaacaggaaacuccug

SEQ ID NO: 3672674 - RNA, 15 nt, Human
ugaacauacaaaugc

SEQ ID NO: 3672675 - RNA, 13 nt, Human
ugaacauguacug

SEQ ID NO: 3672676 - RNA, 13 nt, Human
ugaacauguuuua

SEQ ID NO: 3672677 - RNA, 22 nt, Human
ugaacauuaauccacauguuuc

SEQ ID NO: 3672678 - RNA, 12 nt, Human
ugaacauuccaa

SEQ ID NO: 3672679 - RNA, 17 nt, Human
ggucuuuuuaugcauuu

SEQ ID NO: 3672680 - RNA, 18 nt, Human
ggugaaaauuaggguugg

SEQ ID NO: 3672681 - RNA, 13 nt, Human
ggugaaaauuauu

SEQ ID NO: 3672682 - RNA, 16 nt, Human
ggugaaagaaaucaug

SEQ ID NO: 3672683 - RNA, 19 nt, Human
ggugaaagaaaucauguua

SEQ ID NO: 3672684 - RNA, 13 nt, Human
ggugaaagggagc

SEQ ID NO: 3672685 - RNA, 13 nt, Human
ggugaacagaaca

SEQ ID NO: 3672686 - RNA, 14 nt, Human
ggugaacauugcaa

SEQ ID NO: 3672687 - RNA, 16 nt, Human
ggugaagaaaacuccu

SEQ ID NO: 3672688 - RNA, 21 nt, Human
ggugaagcucacuucugggcu

SEQ ID NO: 3672689 - RNA, 14 nt, Human
ggugaaggaauaua

SEQ ID NO: 3672690 - RNA, 17 nt, Human
ggugaauggcuuuguau

SEQ ID NO: 3672691 - RNA, 17 nt, Human
ggugacaagagccugau

SEQ ID NO: 3672692 - RNA, 14 nt, Human
ggugacacagacuc

SEQ ID NO: 3672693 - RNA, 23 nt, Human
ggugacagucaucaucagggccu

SEQ ID NO: 3672694 - RNA, 12 nt, Human
ggugacaguggc

SEQ ID NO: 3672695 - RNA, 18 nt, Human
ggugacaugugaaaccuu

SEQ ID NO: 3672696 - RNA, 21 nt, Human
ggugaccaaaauccccuucuc

SEQ ID NO: 3672697 - RNA, 14 nt, Human
ggugaccccagggc

SEQ ID NO: 3672698 - RNA, 17 nt, Human
ggugaccccagggcaca

SEQ ID NO: 3672699 - RNA, 22 nt, Human
ggugacccggcacccccugcag

SEQ ID NO: 3672700 - RNA, 18 nt, Human
ggugaccuccggccaggu

SEQ ID NO: 3672701 - RNA, 14 nt, Human
ggugaccucugccu

SEQ ID NO: 3672702 - RNA, 21 nt, Human
ggugaccuuccaagagccuga

SEQ ID NO: 3672703 - RNA, 15 nt, Human
ggugaccuucuggga

SEQ ID NO: 3672704 - RNA, 16 nt, Human
ggugacgguugggagc

SEQ ID NO: 3672705 - RNA, 21 nt, Human
ggugacugucuggggagcggg

SEQ ID NO: 3672706 - RNA, 19 nt, Human
ggugacuucacagugaagu

SEQ ID NO: 3672707 - RNA, 15 nt, Human
ggugagaaauuuaaa

SEQ ID NO: 3672708 - RNA, 21 nt, Human
ggugagaauugggcggcucug

SEQ ID NO: 3672709 - RNA, 14 nt, Human
ggugagaccaccuc

SEQ ID NO: 3672710 - RNA, 15 nt, Human
ggugagaccaccucu

SEQ ID NO: 3672711 - RNA, 21 nt, Human
ggugagagggccgggcagagg

SEQ ID NO: 3672712 - RNA, 16 nt, Human
ggugagaggggaacag

SEQ ID NO: 3672713 - RNA, 14 nt, Human
ggugagaugcugga

SEQ ID NO: 3672714 - RNA, 22 nt, Human
ggugagaugcuggagaagagag

SEQ ID NO: 3672715 - RNA, 18 nt, Human
ggugagcagacugguggg

SEQ ID NO: 3672716 - RNA, 19 nt, Human
ggugagcauuacaggcaag

SEQ ID NO: 3672717 - RNA, 19 nt, Human
ggugagcccauggcccucc

SEQ ID NO: 3672718 - RNA, 13 nt, Human
ggugaggagcaca

SEQ ID NO: 3672719 - RNA, 15 nt, Human
ggugaggcaauaaaa

SEQ ID NO: 3672720 - RNA, 20 nt, Human
ggugaggcagugggucccac

SEQ ID NO: 3672721 - RNA, 16 nt, Human
ggugaggucagcacau

SEQ ID NO: 3672722 - RNA, 20 nt, Human
ggugagucuuggcggcagca

SEQ ID NO: 3672723 - RNA, 23 nt, Human
ggugagucuuggcggcagcagcc

SEQ ID NO: 3672724 - RNA, 15 nt, Human
ggugauaaggacaug

SEQ ID NO: 3672725 - RNA, 18 nt, Human
ggugauccacccaccuca

SEQ ID NO: 3672726 - RNA, 21 nt, Human
ggugauccauguaacugccua

SEQ ID NO: 3672727 - RNA, 19 nt, Human
ggugaucccguuuucccca

SEQ ID NO: 3672728 - RNA, 17 nt, Human
ggugaucugggauuagg

SEQ ID NO: 3672729 - RNA, 17 nt, Human
ggugaugagggcagcag

SEQ ID NO: 3672730 - RNA, 22 nt, Human
ggugauguugacaucacuggca

SEQ ID NO: 3672731 - RNA, 18 nt, Human
ggugauuccgcagugaga

SEQ ID NO: 3672732 - RNA, 18 nt, Human
ggugauuggaccaggcca

SEQ ID NO: 3672733 - RNA, 23 nt, Human
ggugcaacccaaggacugaggga

SEQ ID NO: 3672734 - RNA, 16 nt, Human
ggugcaacccuuaccc

SEQ ID NO: 3672735 - RNA, 12 nt, Human
ggugcaaugacc

SEQ ID NO: 3672736 - RNA, 13 nt, Human
ggugcaaugaccu

SEQ ID NO: 3672737 - RNA, 18 nt, Human
ggugcaaugaccuuucaa

SEQ ID NO: 3672738 - RNA, 13 nt, Human
ggugcacaggagg

SEQ ID NO: 3672739 - RNA, 15 nt, Human
ggugcacaggagggg

SEQ ID NO: 3672740 - RNA, 13 nt, Human
ggugcacugggag

SEQ ID NO: 3672741 - RNA, 15 nt, Human
ggugcacuuuguaaa

SEQ ID NO: 3672742 - RNA, 19 nt, Human
ggugcagacaaucuucugu

SEQ ID NO: 3672743 - RNA, 15 nt, Human
ggugcagacagaagu

SEQ ID NO: 3672744 - RNA, 23 nt, Human
ggugcagacagaagucuccucaa

SEQ ID NO: 3672745 - RNA, 13 nt, Human
ggugcagaggcug

SEQ ID NO: 3672746 - RNA, 11 nt, Human
ggugcagaggu

SEQ ID NO: 3672747 - RNA, 17 nt, Human
ggugcagagugcccaga

SEQ ID NO: 3672748 - RNA, 17 nt, Human
ggugcagccagaggcac

SEQ ID NO: 3672749 - RNA, 21 nt, Human
ggugcauuugaggucuguucu

SEQ ID NO: 3672750 - RNA, 22 nt, Human
ggugccaacaguguuaggccug

SEQ ID NO: 3672751 - RNA, 10 nt, Human
ggugccaccu

SEQ ID NO: 3672752 - RNA, 19 nt, Human
ggugccacuuuacccaccu

SEQ ID NO: 3672753 - RNA, 18 nt, Human
ggugccagcaaagcccca

SEQ ID NO: 3672754 - RNA, 19 nt, Human
ggugccagcaaagccccau

SEQ ID NO: 3672755 - RNA, 15 nt, Human
ggugccagcaacuga

SEQ ID NO: 3672756 - RNA, 13 nt, Human
ggugccagccuga

SEQ ID NO: 3672757 - RNA, 22 nt, Human
ggugccaugucagcgcucuggu

SEQ ID NO: 3672758 - RNA, 14 nt, Human
ggugcccaagccag

SEQ ID NO: 3672759 - RNA, 18 nt, Human
ggugcccaagccagaggc

SEQ ID NO: 3672760 - RNA, 23 nt, Human
ggugcccagaauaaguuauugca

SEQ ID NO: 3672761 - RNA, 22 nt, Human
ggugcccagcuauaccugugcc

SEQ ID NO: 3672762 - RNA, 23 nt, Human
ggugcccccuccucucccauccc

SEQ ID NO: 3672763 - RNA, 13 nt, Human
ggugcccuccacu

SEQ ID NO: 3672764 - RNA, 20 nt, Human
ggugcccuggaugcccagga

SEQ ID NO: 3672765 - RNA, 14 nt, Human
ggugccgccugccc

SEQ ID NO: 3672766 - RNA, 17 nt, Human
ggugccuaguauugaca

SEQ ID NO: 3672767 - RNA, 13 nt, Human
ggugccuccaggu

SEQ ID NO: 3672768 - RNA, 14 nt, Human
ggugccuccaggug

SEQ ID NO: 3672769 - RNA, 17 nt, Human
ggugccuccaggugugc

SEQ ID NO: 3672770 - RNA, 15 nt, Human
ggugccugagaggca

SEQ ID NO: 3672771 - RNA, 18 nt, Human
ggugccugagaggcaggc

SEQ ID NO: 3672772 - RNA, 19 nt, Human
ggugccuggguggggcugc

SEQ ID NO: 3672773 - RNA, 13 nt, Human
ggugccuguccca

SEQ ID NO: 3672774 - RNA, 18 nt, Human
ggugccugugaggcaggg

SEQ ID NO: 3672775 - RNA, 16 nt, Human
ggugccuuuccuguuc

SEQ ID NO: 3672776 - RNA, 18 nt, Human
ggugccuuuccuguucag

SEQ ID NO: 3672777 - RNA, 19 nt, Human
ggugccuuuccuguucagc

SEQ ID NO: 3672778 - RNA, 22 nt, Human
ggugcgaccccaucugcccagg

SEQ ID NO: 3672779 - RNA, 19 nt, Human
ggugcggcggucccagcuc

SEQ ID NO: 3672780 - RNA, 12 nt, Human
ggugcggcugug

SEQ ID NO: 3672781 - RNA, 17 nt, Human
ggugcgggcaccuguag

SEQ ID NO: 3672782 - RNA, 22 nt, Human
ggugcuaaauggucgcccagga

SEQ ID NO: 3672783 - RNA, 20 nt, Human
ggugcuaaugucaaaccacu

SEQ ID NO: 3672784 - RNA, 23 nt, Human
ggugcuacacccuuuuccagcug

SEQ ID NO: 3672785 - RNA, 14 nt, Human
ggugcuaggaagag

SEQ ID NO: 3672786 - RNA, 19 nt, Human
ggugcuauaggcuggagaa

SEQ ID NO: 3672787 - RNA, 16 nt, Human
ggugcuaucuccccca

SEQ ID NO: 3672788 - RNA, 23 nt, Human
ggugcuaucucccccagccccau

SEQ ID NO: 3672789 - RNA, 23 nt, Human
ggugcucagaauaaggcaggcau

SEQ ID NO: 3672790 - RNA, 15 nt, Human
ggugcugacggccag

SEQ ID NO: 3672791 - RNA, 16 nt, Human
ggugcugacggccagg

SEQ ID NO: 3672792 - RNA, 18 nt, Human
ggugcugcaguauguugc

SEQ ID NO: 3672793 - RNA, 15 nt, Human
ggugcugccauccag

SEQ ID NO: 3672794 - RNA, 21 nt, Human
ggugcugccauccagguucag

SEQ ID NO: 3672795 - RNA, 14 nt, Human
ugaagaacauguga

SEQ ID NO: 3672796 - RNA, 13 nt, Human
ugaagaacugagg

SEQ ID NO: 3672797 - RNA, 23 nt, Human
ugaagaacugcaggcccuggccu

SEQ ID NO: 3672798 - RNA, 20 nt, Human
ugaagaagcaccaaucauga

SEQ ID NO: 3672799 - RNA, 14 nt, Human
ugaagaagccugua

SEQ ID NO: 3672800 - RNA, 14 nt, Human
ugaagaauacaguu

SEQ ID NO: 3672801 - RNA, 21 nt, Human
ugaagaauacuucucauuuuu

SEQ ID NO: 3672802 - RNA, 13 nt, Human
ugaagaauguuaa

SEQ ID NO: 3672803 - RNA, 14 nt, Human
ugaagaauuaagau

SEQ ID NO: 3672804 - RNA, 20 nt, Human
ugaagaauuauuuuuuuucu

SEQ ID NO: 3672805 - RNA, 15 nt, Human
ugaagaauuuaaaga

SEQ ID NO: 3672806 - RNA, 17 nt, Human
ugaagacaaaaauacuc

SEQ ID NO: 3672807 - RNA, 11 nt, Human
ugaagacaaug

SEQ ID NO: 3672808 - RNA, 17 nt, Human
ugaagacaaugacuuac

SEQ ID NO: 3672809 - RNA, 22 nt, Human
ugaagacaaugacuuacuguac

SEQ ID NO: 3672810 - RNA, 13 nt, Human
ugaagacaauuug

SEQ ID NO: 3672811 - RNA, 23 nt, Human
ugaagacaauuugauacauaaua

SEQ ID NO: 3672812 - RNA, 14 nt, Human
ugaagacagagcua

SEQ ID NO: 3672813 - RNA, 23 nt, Human
ugaagacagcccgauccuccccu

SEQ ID NO: 3672814 - RNA, 12 nt, Human
ugaagacauaaa

SEQ ID NO: 3672815 - RNA, 20 nt, Human
ugaagaccacauccacacac

SEQ ID NO: 3672816 - RNA, 19 nt, Human
ugaagaccuaaccagggcc

SEQ ID NO: 3672817 - RNA, 21 nt, Human
ugaagaccuuuuucugcacua

SEQ ID NO: 3672818 - RNA, 19 nt, Human
ugaagacucauucuucugu

SEQ ID NO: 3672819 - RNA, 15 nt, Human
ugaagacuccagaaa

SEQ ID NO: 3672820 - RNA, 17 nt, Human
ugaagacuggaagcuaa

SEQ ID NO: 3672821 - RNA, 23 nt, Human
ugaagacuuacagcaaauccuuu

SEQ ID NO: 3672822 - RNA, 23 nt, Human
ugaagagaaccgagcaaagauca

SEQ ID NO: 3672823 - RNA, 20 nt, Human
ugaagagaagggcagggcug

SEQ ID NO: 3672824 - RNA, 19 nt, Human
guaaaguccuuuucuugcu

SEQ ID NO: 3672825 - RNA, 18 nt, Human
guaaagugauaauuucug

SEQ ID NO: 3672826 - RNA, 23 nt, Human
guaaagugauaauuucuggaauu

SEQ ID NO: 3672827 - RNA, 14 nt, Human
guaaagugucagaa

SEQ ID NO: 3672828 - RNA, 15 nt, Human
guaaaguuaaaagaa

SEQ ID NO: 3672829 - RNA, 14 nt, Human
guaaaguuagucua

SEQ ID NO: 3672830 - RNA, 21 nt, Human
guaaaguuuccgugcguggca

SEQ ID NO: 3672831 - RNA, 14 nt, Human
guaaauaaagcccu

SEQ ID NO: 3672832 - RNA, 15 nt, Human
guaaauaaagcccug

SEQ ID NO: 3672833 - RNA, 21 nt, Human
guaaauaaccccauucuuugc

SEQ ID NO: 3672834 - RNA, 21 nt, Human
guaaauaacuggaaaacagaa

SEQ ID NO: 3672835 - RNA, 16 nt, Human
guaaauaauacauuau

SEQ ID NO: 3672836 - RNA, 14 nt, Human
guaaauaauucuuu

SEQ ID NO: 3672837 - RNA, 15 nt, Human
guaaauaauuuauuu

SEQ ID NO: 3672838 - RNA, 13 nt, Human
guaaauacaauuu

SEQ ID NO: 3672839 - RNA, 23 nt, Human
guaaauacaauuuuguuucugua

SEQ ID NO: 3672840 - RNA, 12 nt, Human
guaaauacacca

SEQ ID NO: 3672841 - RNA, 13 nt, Human
guaaauaccagga

SEQ ID NO: 3672842 - RNA, 17 nt, Human
guaaauaggaaucauuc

SEQ ID NO: 3672843 - RNA, 14 nt, Human
guaaauaggaauug

SEQ ID NO: 3672844 - RNA, 13 nt, Human
guaaauagguuuc

SEQ ID NO: 3672845 - RNA, 16 nt, Human
guaaauaguauuugag

SEQ ID NO: 3672846 - RNA, 19 nt, Human
guaaauauaaagacguuuu

SEQ ID NO: 3672847 - RNA, 16 nt, Human
guaaauauauaaauau

SEQ ID NO: 3672848 - RNA, 20 nt, Human
guaaauauauaaauauauau

SEQ ID NO: 3672849 - RNA, 15 nt, Human
guaaauaugaaucug

SEQ ID NO: 3672850 - RNA, 23 nt, Human
guaaauaugaaucugcucacuuu

SEQ ID NO: 3672851 - RNA, 12 nt, Human
guaaauauuaaa

SEQ ID NO: 3672852 - RNA, 13 nt, Human
guaaauauucuau

SEQ ID NO: 3672853 - RNA, 15 nt, Human
guaaauauucuauau

SEQ ID NO: 3672854 - RNA, 22 nt, Human
guaaauauugaggcuuuguguu

SEQ ID NO: 3672855 - RNA, 14 nt, Human
guaaauauuuuaaa

SEQ ID NO: 3672856 - RNA, 22 nt, Human
guaaaucagauguugaauucuu

SEQ ID NO: 3672857 - RNA, 21 nt, Human
guaaaucaguaagagguguua

SEQ ID NO: 3672858 - RNA, 16 nt, Human
guaaaucccauuauuc

SEQ ID NO: 3672859 - RNA, 18 nt, Human
ugacagccucagugaccc

SEQ ID NO: 3672860 - RNA, 20 nt, Human
ugacagcucuuuuugugaag

SEQ ID NO: 3672861 - RNA, 13 nt, Human
ugacagcugcucc

SEQ ID NO: 3672862 - RNA, 22 nt, Human
ugacagcugcuccuagagggag

SEQ ID NO: 3672863 - RNA, 14 nt, Human
ugacagcugucccu

SEQ ID NO: 3672864 - RNA, 15 nt, Human
ugacagcugucccug

SEQ ID NO: 3672865 - RNA, 16 nt, Human
ugacagcugucccugu

SEQ ID NO: 3672866 - RNA, 18 nt, Human
ugacagcugucccuguca

SEQ ID NO: 3672867 - RNA, 16 nt, Human
ugacagcugugcugua

SEQ ID NO: 3672868 - RNA, 16 nt, Human
ugacagcuuugcugcu

SEQ ID NO: 3672869 - RNA, 17 nt, Human
ugacagcuuugcugcug

SEQ ID NO: 3672870 - RNA, 18 nt, Human
ugacagcuuugcugcuga

SEQ ID NO: 3672871 - RNA, 13 nt, Human
ugacaggaaccuu

SEQ ID NO: 3672872 - RNA, 23 nt, Human
ugacaggacgcugaccguggagc

SEQ ID NO: 3672873 - RNA, 19 nt, Human
ugacaggcaaugcuggcug

SEQ ID NO: 3672874 - RNA, 12 nt, Human
ugacagggaagc

SEQ ID NO: 3672875 - RNA, 20 nt, Human
ugacagggaagcuacagguu

SEQ ID NO: 3672876 - RNA, 21 nt, Human
ugacagggcacaccgggcacu

SEQ ID NO: 3672877 - RNA, 13 nt, Human
ugacagggccagu

SEQ ID NO: 3672878 - RNA, 18 nt, Human
ugacagggccaguggggc

SEQ ID NO: 3672879 - RNA, 21 nt, Human
ugacagggccaguggggccug

SEQ ID NO: 3672880 - RNA, 15 nt, Human
ugacagguuugggac

SEQ ID NO: 3672881 - RNA, 21 nt, Human
ugacaguaacuugguuauaca

SEQ ID NO: 3672882 - RNA, 15 nt, Human
ugacaguaauugugu

SEQ ID NO: 3672883 - RNA, 14 nt, Human
ugacaguaguacca

SEQ ID NO: 3672884 - RNA, 22 nt, Human
ugacaguauuauacgcuggcaa

SEQ ID NO: 3672885 - RNA, 17 nt, Human
ugacagucaucaucagg

SEQ ID NO: 3672886 - RNA, 20 nt, Human
ugacagucaucaucagggcc

SEQ ID NO: 3672887 - RNA, 22 nt, Human
ugacaguccgucaaaacagauu

SEQ ID NO: 3672888 - RNA, 23 nt, Human
ugacagucuugugcuuuuccuau

SEQ ID NO: 3672889 - RNA, 20 nt, Human
ugacagugccugggaaugua

SEQ ID NO: 3672890 - RNA, 14 nt, Human
ugacaguguuuuua

SEQ ID NO: 3672891 - RNA, 16 nt, Human
ugacaguucugaagaa

SEQ ID NO: 3672892 - RNA, 17 nt, Human
ugacauaaaaacaacuu

SEQ ID NO: 3672893 - RNA, 16 nt, Human
ugacauaaaguugaua

SEQ ID NO: 3672894 - RNA, 17 nt, Human
ugacauaacagugcagg

SEQ ID NO: 3672895 - RNA, 16 nt, Human
ugacauaauauauucu

SEQ ID NO: 3672896 - RNA, 15 nt, Human
ugacauacccccucc

SEQ ID NO: 3672897 - RNA, 20 nt, Human
ugacauacccccucccccac

SEQ ID NO: 3672898 - RNA, 16 nt, Human
ugacauaccuuuuauu

SEQ ID NO: 3672899 - RNA, 16 nt, Human
ugacauagucuggcug

SEQ ID NO: 3672900 - RNA, 17 nt, Human
ugacauauuuaauguuu

SEQ ID NO: 3672901 - RNA, 18 nt, Human
ugacauauuuaauguuuu

SEQ ID NO: 3672902 - RNA, 21 nt, Human
ugacauauuuaauguuuuaaa

SEQ ID NO: 3672903 - RNA, 18 nt, Human
ugacaucacuggcauggu

SEQ ID NO: 3672904 - RNA, 13 nt, Human
ugacaucacuugu

SEQ ID NO: 3672905 - RNA, 21 nt, Human
ugacaucacuuguacaaaaua

SEQ ID NO: 3672906 - RNA, 18 nt, Human
ugacaucagccagcugcc

SEQ ID NO: 3672907 - RNA, 15 nt, Human
ugacaucucaggggc

SEQ ID NO: 3672908 - RNA, 22 nt, Human
ugacaucucuauuccccacccu

SEQ ID NO: 3672909 - RNA, 17 nt, Human
ugacaucuuaguauuug

SEQ ID NO: 3672910 - RNA, 20 nt, Human
ugacaucuuuuuaaagcuua

SEQ ID NO: 3672911 - RNA, 21 nt, Human
ugacaugaauuuuagcuuuug

SEQ ID NO: 3672912 - RNA, 23 nt, Human
ugacaugaggaaaauaauguaau

SEQ ID NO: 3672913 - RNA, 15 nt, Human
ugacaugauuccuuc

SEQ ID NO: 3672914 - RNA, 18 nt, Human
ugacaugcacucagcucu

SEQ ID NO: 3672915 - RNA, 19 nt, Human
ugacaugcacugacccuuc

SEQ ID NO: 3672916 - RNA, 23 nt, Human
ugacaugcccucccuucucccug

SEQ ID NO: 3672917 - RNA, 17 nt, Human
ugacaugccuauaugag

SEQ ID NO: 3672918 - RNA, 23 nt, Human
ugacaugccuauaugagaagaau

SEQ ID NO: 3672919 - RNA, 16 nt, Human
ugacauggaaaugaag

SEQ ID NO: 3672920 - RNA, 18 nt, Human
ugacaugggacauuugcu

SEQ ID NO: 3672921 - RNA, 15 nt, Human
ugacauggugccuga

SEQ ID NO: 3672922 - RNA, 21 nt, Human
ugacauggugccugagaggca

SEQ ID NO: 3672923 - RNA, 17 nt, Human
ugacauguacagagaac

SEQ ID NO: 3672924 - RNA, 18 nt, Human
ugacauguauuuuuuccu

SEQ ID NO: 3672925 - RNA, 14 nt, Human
ugacauguccuucu

SEQ ID NO: 3672926 - RNA, 13 nt, Human
ugacaugucuuuu

SEQ ID NO: 3672927 - RNA, 21 nt, Human
ugacauguggaaagugaauuu

SEQ ID NO: 3672928 - RNA, 18 nt, Human
ugacauguggggccaggu

SEQ ID NO: 3672929 - RNA, 14 nt, Human
ugacauuaacaaau

SEQ ID NO: 3672930 - RNA, 19 nt, Human
ugacauuaacaaauaaaaa

SEQ ID NO: 3672931 - RNA, 17 nt, Human
ugacauuaacaguuuuc

SEQ ID NO: 3672932 - RNA, 22 nt, Human
ugacauuaacaguuuuccauga

SEQ ID NO: 3672933 - RNA, 19 nt, Human
ugacauuaagaauguuggu

SEQ ID NO: 3672934 - RNA, 15 nt, Human
ugacauucaaggcau

SEQ ID NO: 3672935 - RNA, 21 nt, Human
ugacauuccuaaacuaucuuu

SEQ ID NO: 3672936 - RNA, 15 nt, Human
ugacauuccuugcug

SEQ ID NO: 3672937 - RNA, 22 nt, Human
ugacauucucaggaagccccca

SEQ ID NO: 3672938 - RNA, 16 nt, Human
ugacauugacuauuuu

SEQ ID NO: 3672939 - RNA, 19 nt, Human
ugacauugcuaagaugcuc

SEQ ID NO: 3672940 - RNA, 13 nt, Human
ugacauugcuuua

SEQ ID NO: 3672941 - RNA, 15 nt, Human
ugacauugcuuuacu

SEQ ID NO: 3672942 - RNA, 18 nt, Human
ugacauuguagagcuucu

SEQ ID NO: 3672943 - RNA, 14 nt, Human
ugacauugucuccu

SEQ ID NO: 3672944 - RNA, 20 nt, Human
ugacauuguggcacauucuu

SEQ ID NO: 3672945 - RNA, 16 nt, Human
ugacauuuaauuuagu

SEQ ID NO: 3672946 - RNA, 20 nt, Human
ugacauuuauauauugaauu

SEQ ID NO: 3672947 - RNA, 13 nt, Human
ugacauuucuucu

SEQ ID NO: 3672948 - RNA, 13 nt, Human
ugacauuucuuug

SEQ ID NO: 3672949 - RNA, 14 nt, Human
ugacauuuguaguu

SEQ ID NO: 3672950 - RNA, 16 nt, Human
ugacauuuguaguugg

SEQ ID NO: 3672951 - RNA, 14 nt, Human
ugacauuugucauu

SEQ ID NO: 3672952 - RNA, 18 nt, Human
ugacauuugucauuuuca

SEQ ID NO: 3672953 - RNA, 20 nt, Human
ugacauuugucauuuucauu

SEQ ID NO: 3672954 - RNA, 22 nt, Human
ugacauuuguuugguuauagug

SEQ ID NO: 3672955 - RNA, 12 nt, Human
ugacauuuuaca

SEQ ID NO: 3672956 - RNA, 14 nt, Human
ugacauuuuacauu

SEQ ID NO: 3672957 - RNA, 16 nt, Human
ugacauuuuacauuaa

SEQ ID NO: 3672958 - RNA, 14 nt, Human
ugacauuuugccaa

SEQ ID NO: 3672959 - RNA, 16 nt, Human
ugaccaaaaguuacau

SEQ ID NO: 3672960 - RNA, 20 nt, Human
ugaccaaaauggugaaaccu

SEQ ID NO: 3672961 - RNA, 14 nt, Human
ugaccaaaguccuu

SEQ ID NO: 3672962 - RNA, 23 nt, Human
ugaccaacaggcuguucugcacu

SEQ ID NO: 3672963 - RNA, 17 nt, Human
ugaccaacaguuccuuc

SEQ ID NO: 3672964 - RNA, 17 nt, Human
ugaccaacauggagaaa

SEQ ID NO: 3672965 - RNA, 18 nt, Human
ugaccaacauggagaaac

SEQ ID NO: 3672966 - RNA, 20 nt, Human
ugaccaacuagacauucugu

SEQ ID NO: 3672967 - RNA, 21 nt, Human
ugaccaacuagacauucuguc

SEQ ID NO: 3672968 - RNA, 23 nt, Human
ugaccaacuguguuguauuaaca

SEQ ID NO: 3672969 - RNA, 15 nt, Human
ugacuggcuaaagcu

SEQ ID NO: 3672970 - RNA, 18 nt, Human
ugacugggcccugccucu

SEQ ID NO: 3672971 - RNA, 17 nt, Human
ugacuggggugggaggu

SEQ ID NO: 3672972 - RNA, 21 nt, Human
ugacuggguuucucuguauag

SEQ ID NO: 3672973 - RNA, 23 nt, Human
ugacuggguuucucuguauagua

SEQ ID NO: 3672974 - RNA, 15 nt, Human
ugacuggugcugcag

SEQ ID NO: 3672975 - RNA, 20 nt, Human
ugacugguuaucacaccauc

SEQ ID NO: 3672976 - RNA, 20 nt, Human
ugacugguuuacaggcccug

SEQ ID NO: 3672977 - RNA, 21 nt, Human
ugacugguuuacaggcccugc

SEQ ID NO: 3672978 - RNA, 23 nt, Human
ugacugguuuacaggcccugcuc

SEQ ID NO: 3672979 - RNA, 17 nt, Human
ugacuguacuccuccca

SEQ ID NO: 3672980 - RNA, 18 nt, Human
ugacuguacuccucccag

SEQ ID NO: 3672981 - RNA, 14 nt, Human
ugacuguauauaaa

SEQ ID NO: 3672982 - RNA, 18 nt, Human
ugacuguaucuguguaga

SEQ ID NO: 3672983 - RNA, 13 nt, Human
ugacugucacugu

SEQ ID NO: 3672984 - RNA, 17 nt, Human
ugacugucacuguuccu

SEQ ID NO: 3672985 - RNA, 14 nt, Human
ugacugucugggga

SEQ ID NO: 3672986 - RNA, 18 nt, Human
ugacuguucaagagcaca

SEQ ID NO: 3672987 - RNA, 15 nt, Human
ugacuguuuccauca

SEQ ID NO: 3672988 - RNA, 19 nt, Human
ugacuguuuuucggacagu

SEQ ID NO: 3672989 - RNA, 19 nt, Human
ugacuuaacauagccaaaa

SEQ ID NO: 3672990 - RNA, 22 nt, Human
ugacuuaacauagccaaaaugu

SEQ ID NO: 3672991 - RNA, 15 nt, Human
ugacuuaagaagccu

SEQ ID NO: 3672992 - RNA, 13 nt, Human
ugacuuaauguga

SEQ ID NO: 3672993 - RNA, 13 nt, Human
ugacuuacuguac

SEQ ID NO: 3672994 - RNA, 16 nt, Human
ugacuuacuguacaug

SEQ ID NO: 3672995 - RNA, 21 nt, Human
ugacuuagaaucccuguguua

SEQ ID NO: 3672996 - RNA, 19 nt, Human
ugacuuauaguacaugaua

SEQ ID NO: 3672997 - RNA, 18 nt, Human
ugacuuauuguggauaac

SEQ ID NO: 3672998 - RNA, 20 nt, Human
ugacuuauuuauauaaauuu

SEQ ID NO: 3672999 - RNA, 19 nt, Human
ugacuuauuuucucugugu

SEQ ID NO: 3673000 - RNA, 22 nt, Human
ugacuucaggggcugcccgcuc

SEQ ID NO: 3673001 - RNA, 22 nt, Human
ugacuuccccgcauuccaggcu

SEQ ID NO: 3673002 - RNA, 21 nt, Human
ugacuuccucgccucucccac

SEQ ID NO: 3673003 - RNA, 24 nt, Human
ugacuucuaaguaaaaccacagca

SEQ ID NO: 3673004 - RNA, 16 nt, Human
ugacuucuccaggucu

SEQ ID NO: 3673005 - RNA, 15 nt, Human
ugacuucugccugga

SEQ ID NO: 3673006 - RNA, 16 nt, Human
ugacuucugccuggag

SEQ ID NO: 3673007 - RNA, 18 nt, Human
ugacuucugccuggagac

SEQ ID NO: 3673008 - RNA, 13 nt, Human
ugacuucugugag

SEQ ID NO: 3673009 - RNA, 17 nt, Human
ugacuugacagaacacu

SEQ ID NO: 3673010 - RNA, 17 nt, Human
ugacuugcaugaagaga

SEQ ID NO: 3673011 - RNA, 21 nt, Human
ugacuugggcacccccagccu

SEQ ID NO: 3673012 - RNA, 12 nt, Human
ugacuuggggga

SEQ ID NO: 3673013 - RNA, 12 nt, Human
ugacuuguauau

SEQ ID NO: 3673014 - RNA, 15 nt, Human
ugacuugugucccau

SEQ ID NO: 3673015 - RNA, 18 nt, Human
ugacuuguuugucuucca

SEQ ID NO: 3673016 - RNA, 17 nt, Human
ugacuuuaauuuaugua

SEQ ID NO: 3673017 - RNA, 22 nt, Human
ugacuuuacgcccaucucagga

SEQ ID NO: 3673018 - RNA, 12 nt, Human
ugacuuuauaaa

SEQ ID NO: 3673019 - RNA, 15 nt, Human
ugacuuuauuauuua

SEQ ID NO: 3673020 - RNA, 16 nt, Human
ugacuuuauuauuuau

SEQ ID NO: 3673021 - RNA, 15 nt, Human
ugacuuucaggaauu

SEQ ID NO: 3673022 - RNA, 12 nt, Human
ugacuuucccca

SEQ ID NO: 3673023 - RNA, 22 nt, Human
ugacuuuccccaccagaugcug

SEQ ID NO: 3673024 - RNA, 13 nt, Human
ugacuuucuuuuu

SEQ ID NO: 3673025 - RNA, 14 nt, Human
ugacuuugaaaaua

SEQ ID NO: 3673026 - RNA, 13 nt, Human
ugacuuugcuugc

SEQ ID NO: 3673027 - RNA, 12 nt, Human
ugacuuuggaua

SEQ ID NO: 3673028 - RNA, 20 nt, Human
ugacuuuggauaauaaggaa

SEQ ID NO: 3673029 - RNA, 14 nt, Human
guaauaauaccuca

SEQ ID NO: 3673030 - RNA, 22 nt, Human
guaauaauaccucaauguuuga

SEQ ID NO: 3673031 - RNA, 16 nt, Human
guaauaaugugaauca

SEQ ID NO: 3673032 - RNA, 19 nt, Human
guaauagaaaacugaaaau

SEQ ID NO: 3673033 - RNA, 17 nt, Human
guaauagauuauaguug

SEQ ID NO: 3673034 - RNA, 15 nt, Human
guaauauagaaaaaa

SEQ ID NO: 3673035 - RNA, 22 nt, Human
guaauauauucugaagcaacau

SEQ ID NO: 3673036 - RNA, 13 nt, Human
guaauauauugcu

SEQ ID NO: 3673037 - RNA, 16 nt, Human
guaauaugcacacauu

SEQ ID NO: 3673038 - RNA, 17 nt, Human
guaauaugcacacauuu

SEQ ID NO: 3673039 - RNA, 16 nt, Human
guaauauugacuugua

SEQ ID NO: 3673040 - RNA, 23 nt, Human
guaauauuuacaauguauuaagc

SEQ ID NO: 3673041 - RNA, 17 nt, Human
guaauauuuauuaaauu

SEQ ID NO: 3673042 - RNA, 18 nt, Human
guaauauuuauuaaauuu

SEQ ID NO: 3673043 - RNA, 21 nt, Human
guaauauuuauuaaauuuuuu

SEQ ID NO: 3673044 - RNA, 19 nt, Human
guaauauuuuguauuauug

SEQ ID NO: 3673045 - RNA, 13 nt, Human
guaaucaauaaac

SEQ ID NO: 3673046 - RNA, 17 nt, Human
guaaucaauaaacgauu

SEQ ID NO: 3673047 - RNA, 12 nt, Human
guaaucaaugaa

SEQ ID NO: 3673048 - RNA, 18 nt, Human
guaauccaggcacagcug

SEQ ID NO: 3673049 - RNA, 17 nt, Human
guaauccaucacuagcc

SEQ ID NO: 3673050 - RNA, 12 nt, Human
guaaucccagcu

SEQ ID NO: 3673051 - RNA, 16 nt, Human
guaaucccagcuacuu

SEQ ID NO: 3673052 - RNA, 18 nt, Human
guaaucccgccaccuauc

SEQ ID NO: 3673053 - RNA, 12 nt, Human
guaauccuguag

SEQ ID NO: 3673054 - RNA, 22 nt, Human
guaaucuccacagucaaagaag

SEQ ID NO: 3673055 - RNA, 20 nt, Human
guaaucucguuucaaaaaca

SEQ ID NO: 3673056 - RNA, 18 nt, Human
guaaucucucugcagcug

SEQ ID NO: 3673057 - RNA, 21 nt, Human
guaaucucucugcagcugccg

SEQ ID NO: 3673058 - RNA, 22 nt, Human
guaaucugaauaaaguguaaca

SEQ ID NO: 3673059 - RNA, 24 nt, Human
guaaucugaucguucuuucuagcu

SEQ ID NO: 3673060 - RNA, 22 nt, Human
guaaucuguauaauacuuugua

SEQ ID NO: 3673061 - RNA, 20 nt, Human
guaaucuuuaccuguauaca

SEQ ID NO: 3673062 - RNA, 13 nt, Human
guaaugaaaacca

SEQ ID NO: 3673063 - RNA, 22 nt, Human
guaaugaaacaccuucucugga

SEQ ID NO: 3673064 - RNA, 17 nt, Human
guaaugaaccgcugaau

SEQ ID NO: 3673065 - RNA, 20 nt, Human
guaaugaguuuaaaaaucaa

SEQ ID NO: 3673066 - RNA, 19 nt, Human
guaaugauaacuggaaacu

SEQ ID NO: 3673067 - RNA, 19 nt, Human
guaaugcauacagaaauau

SEQ ID NO: 3673068 - RNA, 20 nt, Human
guaaugcgauuuuauuacug

SEQ ID NO: 3673069 - RNA, 22 nt, Human
guaaugcuacgugugauuuuuc

SEQ ID NO: 3673070 - RNA, 14 nt, Human
guaauggagcauca

SEQ ID NO: 3673071 - RNA, 22 nt, Human
guaauggggcagaaaucugagg

SEQ ID NO: 3673072 - RNA, 23 nt, Human
guaaugguacugacuuugcuugc

SEQ ID NO: 3673073 - RNA, 17 nt, Human
guaaugguguagaacac

SEQ ID NO: 3673074 - RNA, 18 nt, Human
guaauguagcguguuuac

SEQ ID NO: 3673075 - RNA, 21 nt, Human
guaauguagcguguuuacaug

SEQ ID NO: 3673076 - RNA, 19 nt, Human
guaauguaucaaauacauu

SEQ ID NO: 3673077 - RNA, 16 nt, Human
guaaugugaauaaauu

SEQ ID NO: 3673078 - RNA, 22 nt, Human
guaauguuaauauugauuuauu

SEQ ID NO: 3673079 - RNA, 14 nt, Human
guaauguuacugau

SEQ ID NO: 3673080 - RNA, 15 nt, Human
guaauguugugaaua

SEQ ID NO: 3673081 - RNA, 17 nt, Human
guaauguugugaauaau

SEQ ID NO: 3673082 - RNA, 21 nt, Human
guaauguuuucuuugcaaagu

SEQ ID NO: 3673083 - RNA, 16 nt, Human
guaauuaaacuguuaa

SEQ ID NO: 3673084 - RNA, 14 nt, Human
guaauuaaauuaug

SEQ ID NO: 3673085 - RNA, 17 nt, Human
guaauuaaguacuaugu

SEQ ID NO: 3673086 - RNA, 23 nt, Human
guaauuaauaauagauugugaau

SEQ ID NO: 3673087 - RNA, 15 nt, Human
guaauuaguaacaug

SEQ ID NO: 3673088 - RNA, 13 nt, Human
guaauuauggagu

SEQ ID NO: 3673089 - RNA, 23 nt, Human
guaauuauugugauuucccgugg

SEQ ID NO: 3673090 - RNA, 13 nt, Human
guaauuauuugaa

SEQ ID NO: 3673091 - RNA, 14 nt, Human
guaauuauuugaau

SEQ ID NO: 3673092 - RNA, 17 nt, Human
guaauucagguuuuucc

SEQ ID NO: 3673093 - RNA, 21 nt, Human
guaauucaguguauuucaguu

SEQ ID NO: 3673094 - RNA, 15 nt, Human
guaauucuaaaugaa

SEQ ID NO: 3673095 - RNA, 12 nt, Human
guaauugcuuac

SEQ ID NO: 3673096 - RNA, 12 nt, Human
guaauugcuuuu

SEQ ID NO: 3673097 - RNA, 23 nt, Human
guaauuguacuaaagccaaacau

SEQ ID NO: 3673098 - RNA, 15 nt, Human
guaauuguguggauu

SEQ ID NO: 3673099 - RNA, 17 nt, Human
guaauuguguuuacauu

SEQ ID NO: 3673100 - RNA, 20 nt, Human
guaauuguguuuacauuuua

SEQ ID NO: 3673101 - RNA, 19 nt, Human
guaauuguuguuuguaugu

SEQ ID NO: 3673102 - RNA, 19 nt, Human
guaauuuaaaauugugaug

SEQ ID NO: 3673103 - RNA, 21 nt, Human
guaauuuaaacaggcccagca

SEQ ID NO: 3673104 - RNA, 19 nt, Human
guaauuuaaaugaaagaaa

SEQ ID NO: 3673105 - RNA, 12 nt, Human
guaauuuaacuu

SEQ ID NO: 3673106 - RNA, 20 nt, Human
guaauuuaggguacuaaauu

SEQ ID NO: 3673107 - RNA, 14 nt, Human
guaauuuauaaaau

SEQ ID NO: 3673108 - RNA, 15 nt, Human
guaauuuauaaaauu

SEQ ID NO: 3673109 - RNA, 18 nt, Human
guaauuuauaaaauuaga

SEQ ID NO: 3673110 - RNA, 23 nt, Human
guaauuuauaguuuauacaguuu

SEQ ID NO: 3673111 - RNA, 22 nt, Human
guaauuucuuugccuguucagu

SEQ ID NO: 3673112 - RNA, 14 nt, Human
guaauuugaagauu

SEQ ID NO: 3673113 - RNA, 12 nt, Human
ugaggcauuugu

SEQ ID NO: 3673114 - RNA, 19 nt, Human
ugaggcauuuguuugaacu

SEQ ID NO: 3673115 - RNA, 20 nt, Human
ugaggcauuuguuugaacug

SEQ ID NO: 3673116 - RNA, 23 nt, Human
ugaggcauuuguuugaacugaua

SEQ ID NO: 3673117 - RNA, 19 nt, Human
ugaggccaagaauauugca

SEQ ID NO: 3673118 - RNA, 19 nt, Human
ugaggccacacucagcaca

SEQ ID NO: 3673119 - RNA, 22 nt, Human
ugaggccacugaagaggaggag

SEQ ID NO: 3673120 - RNA, 22 nt, Human
ugaggccacugcugcuucucca

SEQ ID NO: 3673121 - RNA, 21 nt, Human
ugaggccacuguguuccuucc

SEQ ID NO: 3673122 - RNA, 12 nt, Human
ugaggccagccu

SEQ ID NO: 3673123 - RNA, 20 nt, Human
ugaggccagccuggccuccu

SEQ ID NO: 3673124 - RNA, 14 nt, Human
ugaggccagggcag

SEQ ID NO: 3673125 - RNA, 15 nt, Human
ugaggccagggcaga

SEQ ID NO: 3673126 - RNA, 21 nt, Human
ugaggcccagagggccugcaa

SEQ ID NO: 3673127 - RNA, 22 nt, Human
ugaggcccagagggccugcaag

SEQ ID NO: 3673128 - RNA, 20 nt, Human
ugaggcccagggagaggcca

SEQ ID NO: 3673129 - RNA, 21 nt, Human
ugaggcccuccacaccugcgg

SEQ ID NO: 3673130 - RNA, 16 nt, Human
ugaggcccuucucucc

SEQ ID NO: 3673131 - RNA, 20 nt, Human
ugaggcccuucucuccagcc

SEQ ID NO: 3673132 - RNA, 23 nt, Human
ugaggcccuucucuccagccccu

SEQ ID NO: 3673133 - RNA, 16 nt, Human
ugaggccgcuagaggc

SEQ ID NO: 3673134 - RNA, 17 nt, Human
ugaggccgcuagaggcc

SEQ ID NO: 3673135 - RNA, 18 nt, Human
ugaggccgcuagaggccu

SEQ ID NO: 3673136 - RNA, 23 nt, Human
ugaggccgcuagaggccugagga

SEQ ID NO: 3673137 - RNA, 19 nt, Human
ugaggccguugcugacuua

SEQ ID NO: 3673138 - RNA, 22 nt, Human
ugaggccguugcugacuuagaa

SEQ ID NO: 3673139 - RNA, 16 nt, Human
ugaggccuagacucug

SEQ ID NO: 3673140 - RNA, 19 nt, Human
ugaggccucaguggacuuu

SEQ ID NO: 3673141 - RNA, 21 nt, Human
ugaggccucuuggaccucugc

SEQ ID NO: 3673142 - RNA, 21 nt, Human
ugaggccugcccucagggauc

SEQ ID NO: 3673143 - RNA, 12 nt, Human
ugaggccuggac

SEQ ID NO: 3673144 - RNA, 19 nt, Human
ugaggccuggacuuuccug

SEQ ID NO: 3673145 - RNA, 20 nt, Human
ugaggccuggacuuuccugc

SEQ ID NO: 3673146 - RNA, 12 nt, Human
ugaggccugggc

SEQ ID NO: 3673147 - RNA, 16 nt, Human
ugaggccugucuguga

SEQ ID NO: 3673148 - RNA, 18 nt, Human
ugaggcuccacuuggucu

SEQ ID NO: 3673149 - RNA, 16 nt, Human
ugaggcuccugugcua

SEQ ID NO: 3673150 - RNA, 21 nt, Human
ugaggcucugacccagugaga

SEQ ID NO: 3673151 - RNA, 13 nt, Human
ugaggcucugccc

SEQ ID NO: 3673152 - RNA, 14 nt, Human
ugaggcucugcccu

SEQ ID NO: 3673153 - RNA, 15 nt, Human
ugaggcucugcccuu

SEQ ID NO: 3673154 - RNA, 18 nt, Human
ugaggcugagacugcggg

SEQ ID NO: 3673155 - RNA, 16 nt, Human
ugaggcugcuuuccaa

SEQ ID NO: 3673156 - RNA, 23 nt, Human
ugaggcugcuuuccaaagccaau

SEQ ID NO: 3673157 - RNA, 16 nt, Human
ugaggcuggacuccag

SEQ ID NO: 3673158 - RNA, 14 nt, Human
ugaggcuggcacag

SEQ ID NO: 3673159 - RNA, 17 nt, Human
ugaggcuggcacaggac

SEQ ID NO: 3673160 - RNA, 21 nt, Human
ugaggcugggcucccuuccca

SEQ ID NO: 3673161 - RNA, 10 nt, Human
ugaggcugua

SEQ ID NO: 3673162 - RNA, 13 nt, Human
ugaggcuguagga

SEQ ID NO: 3673163 - RNA, 14 nt, Human
ugaggcuguccugu

SEQ ID NO: 3673164 - RNA, 18 nt, Human
ugaggcuguccuguacau

SEQ ID NO: 3673165 - RNA, 16 nt, Human
ugaggcuuaacaaugu

SEQ ID NO: 3673166 - RNA, 16 nt, Human
ugaggcuuccagagag

SEQ ID NO: 3673167 - RNA, 15 nt, Human
ugaggcuugcugaga

SEQ ID NO: 3673168 - RNA, 21 nt, Human
ugaggcuugcugagaggggcu

SEQ ID NO: 3673169 - RNA, 14 nt, Human
ugaggcuuuccaug

SEQ ID NO: 3673170 - RNA, 13 nt, Human
ugagggaaauguu

SEQ ID NO: 3673171 - RNA, 21 nt, Human
ugagggaagaauaaagagcug

SEQ ID NO: 3673172 - RNA, 16 nt, Human
ugagggacugccucug

SEQ ID NO: 3673173 - RNA, 19 nt, Human
ugagggacugccucugcca

SEQ ID NO: 3673174 - RNA, 14 nt, Human
ugagggagccuggc

SEQ ID NO: 3673175 - RNA, 14 nt, Human
ugagggagcuuagc

SEQ ID NO: 3673176 - RNA, 23 nt, Human
ugagggaggaccuggggcacagu

SEQ ID NO: 3673177 - RNA, 23 nt, Human
ugagggaggaggccaccucucca

SEQ ID NO: 3673178 - RNA, 16 nt, Human
ugagggauaagcaaaa

SEQ ID NO: 3673179 - RNA, 19 nt, Human
ugagggaugggccuggcau

SEQ ID NO: 3673180 - RNA, 15 nt, Human
ugagggauuaucuuu

SEQ ID NO: 3673181 - RNA, 19 nt, Human
ugagggcaguucgcagcca

SEQ ID NO: 3673182 - RNA, 18 nt, Human
ugagggccaagaaagagu

SEQ ID NO: 3673183 - RNA, 19 nt, Human
ugagggcccagagcaggaa

SEQ ID NO: 3673184 - RNA, 19 nt, Human
ugagggccccucugcccag

SEQ ID NO: 3673185 - RNA, 21 nt, Human
ugagggccugcuggaggccuc

SEQ ID NO: 3673186 - RNA, 13 nt, Human
ugagggcuuguag

SEQ ID NO: 3673187 - RNA, 18 nt, Human
ugaggggaccaggagugg

SEQ ID NO: 3673188 - RNA, 14 nt, Human
ugaggggcuggccu

SEQ ID NO: 3673189 - RNA, 13 nt, Human
ugagggggcucag

SEQ ID NO: 3673190 - RNA, 14 nt, Human
ugagggggcucagu

SEQ ID NO: 3673191 - RNA, 19 nt, Human
ugagggggcucaguucugg

SEQ ID NO: 3673192 - RNA, 20 nt, Human
ugaggggggccgugcccagg

SEQ ID NO: 3673193 - RNA, 20 nt, Human
ugagggggggcucccugggg

SEQ ID NO: 3673194 - RNA, 23 nt, Human
ugaggggucgacuucgggcuggc

SEQ ID NO: 3673195 - RNA, 23 nt, Human
ugaggguaaccccaaaccuccaa

SEQ ID NO: 3673196 - RNA, 21 nt, Human
ugaggguaauaaacuuagaau

SEQ ID NO: 3673197 - RNA, 22 nt, Human
ugagggucagagaggagucaga

SEQ ID NO: 3673198 - RNA, 15 nt, Human
ugaggguccccaccu

SEQ ID NO: 3673199 - RNA, 23 nt, Human
ugaggguccugcagccugcagga

SEQ ID NO: 3673200 - RNA, 23 nt, Human
ugagggucuguagguugcacacu

SEQ ID NO: 3673201 - RNA, 19 nt, Human
ugaggguuucugagcugcu

SEQ ID NO: 3673202 - RNA, 19 nt, Human
ugagguacaaccuguucug

SEQ ID NO: 3673203 - RNA, 17 nt, Human
ugagguacugagaguga

SEQ ID NO: 3673204 - RNA, 22 nt, Human
ugagguacugagagugaacaaa

SEQ ID NO: 3673205 - RNA, 22 nt, Human
ugagguagaccaggauuucuaa

SEQ ID NO: 3673206 - RNA, 13 nt, Human
ugaggucagagcc

SEQ ID NO: 3673207 - RNA, 16 nt, Human
ugaggucagagccugc

SEQ ID NO: 3673208 - RNA, 18 nt, Human
ugaggucagagccugcag

SEQ ID NO: 3673209 - RNA, 15 nt, Human
ugaggucagggagug

SEQ ID NO: 3673210 - RNA, 16 nt, Human
ugaggucagggagugc

SEQ ID NO: 3673211 - RNA, 18 nt, Human
ugagguccugagcacugc

SEQ ID NO: 3673212 - RNA, 19 nt, Human
ugagguccugagcacugcc

SEQ ID NO: 3673213 - RNA, 13 nt, Human
ugagguccugggg

SEQ ID NO: 3673214 - RNA, 15 nt, Human
ugagguccugggggc

SEQ ID NO: 3673215 - RNA, 21 nt, Human
ugagguccugggggccugacc

SEQ ID NO: 3673216 - RNA, 13 nt, Human
ugaggucucagcc

SEQ ID NO: 3673217 - RNA, 15 nt, Human
ugaggucucagcccc

SEQ ID NO: 3673218 - RNA, 14 nt, Human
ugaggucucgcuga

SEQ ID NO: 3673219 - RNA, 17 nt, Human
ugaggucucuugaggga

SEQ ID NO: 3673220 - RNA, 18 nt, Human
ugaggucucuugagggag

SEQ ID NO: 3673221 - RNA, 15 nt, Human
ugaggucugaaaugg

SEQ ID NO: 3673222 - RNA, 15 nt, Human
ugaggucuggcugcu

SEQ ID NO: 3673223 - RNA, 15 nt, Human
ugaggucuguucuuu

SEQ ID NO: 3673224 - RNA, 14 nt, Human
ugaggucuguuuaa

SEQ ID NO: 3673225 - RNA, 17 nt, Human
ugaggucuuuugacaug

SEQ ID NO: 3673226 - RNA, 12 nt, Human
ugaggugcccag

SEQ ID NO: 3673227 - RNA, 18 nt, Human
ugaggugcccaggagaag

SEQ ID NO: 3673228 - RNA, 15 nt, Human
ugaggugcuauguuc

SEQ ID NO: 3673229 - RNA, 15 nt, Human
ugaggugcugggagg

SEQ ID NO: 3673230 - RNA, 15 nt, Human
ugagguggaagcccu

SEQ ID NO: 3673231 - RNA, 21 nt, Human
ugagguggaagcccuccuucc

SEQ ID NO: 3673232 - RNA, 23 nt, Human
ugagguggcacuuuuucauuugc

SEQ ID NO: 3673233 - RNA, 18 nt, Human
ugagguggcaugguccau

SEQ ID NO: 3673234 - RNA, 13 nt, Human
ugaggugggagga

SEQ ID NO: 3673235 - RNA, 11 nt, Human
ugaggugggcc

SEQ ID NO: 3673236 - RNA, 23 nt, Human
ugaggugguaguaaaacacagag

SEQ ID NO: 3673237 - RNA, 15 nt, Human
ugaggugugggggcu

SEQ ID NO: 3673238 - RNA, 23 nt, Human
guauauuauguauuuauauuuug

SEQ ID NO: 3673239 - RNA, 15 nt, Human
guauauuauuucuag

SEQ ID NO: 3673240 - RNA, 15 nt, Human
guauauuauuuggca

SEQ ID NO: 3673241 - RNA, 14 nt, Human
guauauucauuuca

SEQ ID NO: 3673242 - RNA, 17 nt, Human
guauauucuauuuuaca

SEQ ID NO: 3673243 - RNA, 18 nt, Human
guauauucuauuuuacaa

SEQ ID NO: 3673244 - RNA, 12 nt, Human
guauauuggaag

SEQ ID NO: 3673245 - RNA, 17 nt, Human
guauauuuaaaagaaag

SEQ ID NO: 3673246 - RNA, 23 nt, Human
guauauuuauaaauaaaaauauu

SEQ ID NO: 3673247 - RNA, 22 nt, Human
guauauuuauagucacaagagc

SEQ ID NO: 3673248 - RNA, 16 nt, Human
guauauuuccgcacuu

SEQ ID NO: 3673249 - RNA, 17 nt, Human
guauauuugauuuauua

SEQ ID NO: 3673250 - RNA, 19 nt, Human
guauauuugauuuauuaac

SEQ ID NO: 3673251 - RNA, 17 nt, Human
guauauuuguaaagcua

SEQ ID NO: 3673252 - RNA, 15 nt, Human
guauauuuguacaaa

SEQ ID NO: 3673253 - RNA, 17 nt, Human
guauauuuuauuucaau

SEQ ID NO: 3673254 - RNA, 15 nt, Human
guaucaaaauuacau

SEQ ID NO: 3673255 - RNA, 13 nt, Human
guaucaaauacau

SEQ ID NO: 3673256 - RNA, 19 nt, Human
guaucaaauacauuuaaaa

SEQ ID NO: 3673257 - RNA, 20 nt, Human
ugcccagagggcccaggcag

SEQ ID NO: 3673258 - RNA, 21 nt, Human
ugcccagagggcccaggcagg

SEQ ID NO: 3673259 - RNA, 23 nt, Human
ugcccagagggcccaggcaggcc

SEQ ID NO: 3673260 - RNA, 17 nt, Human
ugcccagaucagccaga

SEQ ID NO: 3673261 - RNA, 9 nt, Human
ugcccagcc

SEQ ID NO: 3673262 - RNA, 10 nt, Human
ugcccagccc

SEQ ID NO: 3673263 - RNA, 17 nt, Human
ugcccagccccuucuga

SEQ ID NO: 3673264 - RNA, 18 nt, Human
ugcccagccucuuucccu

SEQ ID NO: 3673265 - RNA, 14 nt, Human
ugcccagccuggau

SEQ ID NO: 3673266 - RNA, 21 nt, Human
ugcccagccuggaugccaucc

SEQ ID NO: 3673267 - RNA, 14 nt, Human
ugcccagcuagcug

SEQ ID NO: 3673268 - RNA, 20 nt, Human
ugcccagcuauaccugugcc

SEQ ID NO: 3673269 - RNA, 22 nt, Human
ugcccagcuauaccugugccuc

SEQ ID NO: 3673270 - RNA, 13 nt, Human
ugcccagcucucg

SEQ ID NO: 3673271 - RNA, 16 nt, Human
ugcccagcuugggccc

SEQ ID NO: 3673272 - RNA, 23 nt, Human
ugcccagcuuuucauugcuguga

SEQ ID NO: 3673273 - RNA, 22 nt, Human
ugcccaggacggggccggccag

SEQ ID NO: 3673274 - RNA, 11 nt, Human
ugcccaggaga

SEQ ID NO: 3673275 - RNA, 12 nt, Human
ugcccaggagaa

SEQ ID NO: 3673276 - RNA, 18 nt, Human
ugcccaggagagccagcc

SEQ ID NO: 3673277 - RNA, 23 nt, Human
ugcccaggagagccagcccuccc

SEQ ID NO: 3673278 - RNA, 12 nt, Human
ugcccaggcacu

SEQ ID NO: 3673279 - RNA, 15 nt, Human
ugcccaggccugccu

SEQ ID NO: 3673280 - RNA, 18 nt, Human
ugcccaggcuggagugca

SEQ ID NO: 3673281 - RNA, 20 nt, Human
ugcccaggcuggagugcagu

SEQ ID NO: 3673282 - RNA, 13 nt, Human
ugcccaggcuggc

SEQ ID NO: 3673283 - RNA, 18 nt, Human
ugcccaggcuggcgugca

SEQ ID NO: 3673284 - RNA, 14 nt, Human
ugcccagggcucag

SEQ ID NO: 3673285 - RNA, 16 nt, Human
ugcccagggcucagcc

SEQ ID NO: 3673286 - RNA, 21 nt, Human
ugcccagggcucagccuggug

SEQ ID NO: 3673287 - RNA, 23 nt, Human
ugcccagggcucagccugguggg

SEQ ID NO: 3673288 - RNA, 11 nt, Human
ugcccaggggu

SEQ ID NO: 3673289 - RNA, 15 nt, Human
ugcccaggggugccc

SEQ ID NO: 3673290 - RNA, 20 nt, Human
ugcccaggggugcccccucc

SEQ ID NO: 3673291 - RNA, 22 nt, Human
ugcccaggggugcccccuccuc

SEQ ID NO: 3673292 - RNA, 20 nt, Human
ugcccagguuucuggucucu

SEQ ID NO: 3673293 - RNA, 20 nt, Human
ugcccagucccccaacccca

SEQ ID NO: 3673294 - RNA, 17 nt, Human
ugcccaguuucagggcu

SEQ ID NO: 3673295 - RNA, 17 nt, Human
ugcccaguuucugccuc

SEQ ID NO: 3673296 - RNA, 13 nt, Human
ugcccaucccugg

SEQ ID NO: 3673297 - RNA, 23 nt, Human
ugcccaucgugaagaagccugua

SEQ ID NO: 3673298 - RNA, 20 nt, Human
ugcccaugcugggagcccac

SEQ ID NO: 3673299 - RNA, 16 nt, Human
ugcccaugggagcugg

SEQ ID NO: 3673300 - RNA, 17 nt, Human
ugcccaugggcacugcu

SEQ ID NO: 3673301 - RNA, 20 nt, Human
ugcccaugggcacugcuggg

SEQ ID NO: 3673302 - RNA, 13 nt, Human
ugcccauguuuca

SEQ ID NO: 3673303 - RNA, 18 nt, Human
ugcccauuccccagccuc

SEQ ID NO: 3673304 - RNA, 17 nt, Human
ugcccauuccucaccuu

SEQ ID NO: 3673305 - RNA, 21 nt, Human
ugcccauucugcccuguggga

SEQ ID NO: 3673306 - RNA, 14 nt, Human
ugcccauuuugaau

SEQ ID NO: 3673307 - RNA, 20 nt, Human
ugccccaaacaaauaugcaa

SEQ ID NO: 3673308 - RNA, 21 nt, Human
ugccccaaaggaagcuuucuc

SEQ ID NO: 3673309 - RNA, 21 nt, Human
ugccccaaauaacuucagucc

SEQ ID NO: 3673310 - RNA, 17 nt, Human
ugccccaacccccagca

SEQ ID NO: 3673311 - RNA, 17 nt, Human
ugccccaacccuucuuc

SEQ ID NO: 3673312 - RNA, 13 nt, Human
ugccccaacuccu

SEQ ID NO: 3673313 - RNA, 15 nt, Human
ugccccaacuccugg

SEQ ID NO: 3673314 - RNA, 16 nt, Human
ugccccaacuccugga

SEQ ID NO: 3673315 - RNA, 19 nt, Human
ugccccaacuccuuccagc

SEQ ID NO: 3673316 - RNA, 20 nt, Human
ugccccaacuccuuccagcu

SEQ ID NO: 3673317 - RNA, 17 nt, Human
ugccccacaccuccucu

SEQ ID NO: 3673318 - RNA, 20 nt, Human
ugccccacaccuccucucac

SEQ ID NO: 3673319 - RNA, 12 nt, Human
ugccccaccugc

SEQ ID NO: 3673320 - RNA, 15 nt, Human
ugccccaccugccac

SEQ ID NO: 3673321 - RNA, 14 nt, Human
ugccccacuugucc

SEQ ID NO: 3673322 - RNA, 13 nt, Human
ugccccagagcug

SEQ ID NO: 3673323 - RNA, 16 nt, Human
ugccccagaggccucu

SEQ ID NO: 3673324 - RNA, 16 nt, Human
ugccccagcccaaguc

SEQ ID NO: 3673325 - RNA, 17 nt, Human
ugccccagcccaagucc

SEQ ID NO: 3673326 - RNA, 13 nt, Human
ugccccagcccag

SEQ ID NO: 3673327 - RNA, 13 nt, Human
ugccccagcucug

SEQ ID NO: 3673328 - RNA, 20 nt, Human
ugccccaggaccagcucagg

SEQ ID NO: 3673329 - RNA, 20 nt, Human
ugccccagucguuagaauau

SEQ ID NO: 3673330 - RNA, 18 nt, Human
ugccccaucagugcuccc

SEQ ID NO: 3673331 - RNA, 20 nt, Human
ugccccaucagugcucccuc

SEQ ID NO: 3673332 - RNA, 17 nt, Human
ugccccauccuccagca

SEQ ID NO: 3673333 - RNA, 18 nt, Human
ugccccauccuccagcag

SEQ ID NO: 3673334 - RNA, 19 nt, Human
ugccccauccuccagcagg

SEQ ID NO: 3673335 - RNA, 12 nt, Human
ugccccaugccu

SEQ ID NO: 3673336 - RNA, 15 nt, Human
ugccccaugccuguc

SEQ ID NO: 3673337 - RNA, 16 nt, Human
ugccccauucaacauc

SEQ ID NO: 3673338 - RNA, 21 nt, Human
ugcccccaccacggccacugg

SEQ ID NO: 3673339 - RNA, 17 nt, Human
ugcccccagcccaaagg

SEQ ID NO: 3673340 - RNA, 16 nt, Human
ugcccccagccccggg

SEQ ID NO: 3673341 - RNA, 13 nt, Human
ugcccccagcugg

SEQ ID NO: 3673342 - RNA, 13 nt, Human
ugcccccaggacu

SEQ ID NO: 3673343 - RNA, 14 nt, Human
ugcccccaggacug

SEQ ID NO: 3673344 - RNA, 15 nt, Human
ugcccccagggcacu

SEQ ID NO: 3673345 - RNA, 18 nt, Human
ugcccccaggguccuggg

SEQ ID NO: 3673346 - RNA, 13 nt, Human
ugccccccacccc

SEQ ID NO: 3673347 - RNA, 20 nt, Human
ugccccccaccccagccuaa

SEQ ID NO: 3673348 - RNA, 17 nt, Human
ugccccccaccccugga

SEQ ID NO: 3673349 - RNA, 19 nt, Human
ugccccccagccucuggca

SEQ ID NO: 3673350 - RNA, 18 nt, Human
ugccccccauccuggccc

SEQ ID NO: 3673351 - RNA, 21 nt, Human
ugccccccauccuggcccauc

SEQ ID NO: 3673352 - RNA, 18 nt, Human
ugccccccuugccagaca

SEQ ID NO: 3673353 - RNA, 23 nt, Human
ugcccccuaauccccuucucccc

SEQ ID NO: 3673354 - RNA, 11 nt, Human
ugcccccuccu

SEQ ID NO: 3673355 - RNA, 16 nt, Human
ugcccccuccucuccc

SEQ ID NO: 3673356 - RNA, 16 nt, Human
ugcccccucugcccug

SEQ ID NO: 3673357 - RNA, 18 nt, Human
ugcccccucugcccugcg

SEQ ID NO: 3673358 - RNA, 13 nt, Human
ugcccccugcaga

SEQ ID NO: 3673359 - RNA, 14 nt, Human
ugcccccugcagaa

SEQ ID NO: 3673360 - RNA, 14 nt, Human
ugcccccugcagga

SEQ ID NO: 3673361 - RNA, 18 nt, Human
ugcccccugcaggaagga

SEQ ID NO: 3673362 - RNA, 21 nt, Human
ugcccccugcaggaaggagcu

SEQ ID NO: 3673363 - RNA, 23 nt, Human
ugcccccugcaggaaggagcugc

SEQ ID NO: 3673364 - RNA, 14 nt, Human
ugcccccugcuggc

SEQ ID NO: 3673365 - RNA, 21 nt, Human
ugcccccugguggacaguccu

SEQ ID NO: 3673366 - RNA, 22 nt, Human
ugcccccugguggacaguccug

SEQ ID NO: 3673367 - RNA, 21 nt, Human
ugcccccuguggaugcugcug

SEQ ID NO: 3673368 - RNA, 12 nt, Human
ugcccccuucuc

SEQ ID NO: 3673369 - RNA, 16 nt, Human
ugcccccuucucccac

SEQ ID NO: 3673370 - RNA, 18 nt, Human
ugcccccuucucccacac

SEQ ID NO: 3673371 - RNA, 16 nt, Human
ugcccccuuucagaug

SEQ ID NO: 3673372 - RNA, 21 nt, Human
ugcccccuuucagaugucuuc

SEQ ID NO: 3673373 - RNA, 22 nt, Human
ugccccgcccccaguccccacc

SEQ ID NO: 3673374 - RNA, 14 nt, Human
ugccccggccaccu

SEQ ID NO: 3673375 - RNA, 17 nt, Human
ugccccggccaccucug

SEQ ID NO: 3673376 - RNA, 21 nt, Human
ugccccggccccggccccagc

SEQ ID NO: 3673377 - RNA, 17 nt, Human
ugccccggccccucccc

SEQ ID NO: 3673378 - RNA, 16 nt, Human
ugccccgucccccucu

SEQ ID NO: 3673379 - RNA, 23 nt, Human
ugccccucaacucuccuccagag

SEQ ID NO: 3673380 - RNA, 14 nt, Human
ugccccucagagac

SEQ ID NO: 3673381 - RNA, 16 nt, Human
ugccccucagagacug

SEQ ID NO: 3673382 - RNA, 21 nt, Human
ugccccucccagaacacacuc

SEQ ID NO: 3673383 - RNA, 13 nt, Human
ugccccucccuuc

SEQ ID NO: 3673384 - RNA, 17 nt, Human
ugccccuccucucugcc

SEQ ID NO: 3673385 - RNA, 18 nt, Human
ugccccuccucucugccc

SEQ ID NO: 3673386 - RNA, 20 nt, Human
ugccccucuccaggcgccgg

SEQ ID NO: 3673387 - RNA, 15 nt, Human
ugccccucuccuucu

SEQ ID NO: 3673388 - RNA, 13 nt, Human
ugccccucucucc

SEQ ID NO: 3673389 - RNA, 15 nt, Human
ugccccucucuccau

SEQ ID NO: 3673390 - RNA, 14 nt, Human
ugccccucucuggg

SEQ ID NO: 3673391 - RNA, 18 nt, Human
ugccccuggcagccccug

SEQ ID NO: 3673392 - RNA, 15 nt, Human
ugccccuggccuugg

SEQ ID NO: 3673393 - RNA, 22 nt, Human
ugccccuucauugauuuccugu

SEQ ID NO: 3673394 - RNA, 18 nt, Human
ugccccuuccgccacugg

SEQ ID NO: 3673395 - RNA, 21 nt, Human
ugccccuuccgccacuggggc

SEQ ID NO: 3673396 - RNA, 16 nt, Human
ugccccuucuacacuc

SEQ ID NO: 3673397 - RNA, 20 nt, Human
ugccccuucuacacucuccu

SEQ ID NO: 3673398 - RNA, 22 nt, Human
ugccccuucuacacucuccugg

SEQ ID NO: 3673399 - RNA, 20 nt, Human
ugccccuuggacacgcucag

SEQ ID NO: 3673400 - RNA, 11 nt, Human
ugccccuuucu

SEQ ID NO: 3673401 - RNA, 18 nt, Human
ugccccuuucucuuuucc

SEQ ID NO: 3673402 - RNA, 14 nt, Human
ugcggcggucccag

SEQ ID NO: 3673403 - RNA, 16 nt, Human
ugcggcguacaggcug

SEQ ID NO: 3673404 - RNA, 22 nt, Human
ugcggcuggccauggagaaagc

SEQ ID NO: 3673405 - RNA, 20 nt, Human
ugcggcugugcagccugucc

SEQ ID NO: 3673406 - RNA, 14 nt, Human
ugcgggacagagua

SEQ ID NO: 3673407 - RNA, 21 nt, Human
ugcgggaccgguacagaaagg

SEQ ID NO: 3673408 - RNA, 19 nt, Human
ugcgggaugguccuggggc

SEQ ID NO: 3673409 - RNA, 13 nt, Human
ugcgggcugggca

SEQ ID NO: 3673410 - RNA, 14 nt, Human
ugcgggcugggcag

SEQ ID NO: 3673411 - RNA, 17 nt, Human
ugcgggcuuuuccccgg

SEQ ID NO: 3673412 - RNA, 14 nt, Human
ugcggggcgggcac

SEQ ID NO: 3673413 - RNA, 23 nt, Human
ugcggguggggcuuggggcucac

SEQ ID NO: 3673414 - RNA, 17 nt, Human
ugcggguuugaggauag

SEQ ID NO: 3673415 - RNA, 18 nt, Human
ugcgguagccagcacaca

SEQ ID NO: 3673416 - RNA, 14 nt, Human
ugcggucaaggcca

SEQ ID NO: 3673417 - RNA, 23 nt, Human
ugcggugcuaucucccccagccc

SEQ ID NO: 3673418 - RNA, 21 nt, Human
ugcgguuaauuuugaagugcu

SEQ ID NO: 3673419 - RNA, 23 nt, Human
ugcgguucaggaaaauugaaugc

SEQ ID NO: 3673420 - RNA, 18 nt, Human
ugcgguuccggcauggac

SEQ ID NO: 3673421 - RNA, 16 nt, Human
ugcguaacuggcugug

SEQ ID NO: 3673422 - RNA, 17 nt, Human
ugcguaacuggcugugu

SEQ ID NO: 3673423 - RNA, 14 nt, Human
ugcguaugucuguu

SEQ ID NO: 3673424 - RNA, 20 nt, Human
ugcgucauuacagggcacag

SEQ ID NO: 3673425 - RNA, 12 nt, Human
ugcgucccaaga

SEQ ID NO: 3673426 - RNA, 23 nt, Human
ugcguccuccucaccucaugccc

SEQ ID NO: 3673427 - RNA, 15 nt, Human
ugcgucuggaggggc

SEQ ID NO: 3673428 - RNA, 20 nt, Human
ugcgucuggaggggccccug

SEQ ID NO: 3673429 - RNA, 23 nt, Human
ugcgucuuagcagugauuuuuau

SEQ ID NO: 3673430 - RNA, 19 nt, Human
ugcgucuuccgccccugcc

SEQ ID NO: 3673431 - RNA, 20 nt, Human
ugcgucuuccgccccugccu

SEQ ID NO: 3673432 - RNA, 21 nt, Human
ugcgucuuccgccccugccug

SEQ ID NO: 3673433 - RNA, 15 nt, Human
ugcgucuugguguaa

SEQ ID NO: 3673434 - RNA, 16 nt, Human
ugcgucuugguguaau

SEQ ID NO: 3673435 - RNA, 15 nt, Human
ugcgugacaauaaaa

SEQ ID NO: 3673436 - RNA, 17 nt, Human
ugcgugacaauaaaaca

SEQ ID NO: 3673437 - RNA, 15 nt, Human
ugcgugacacucucc

SEQ ID NO: 3673438 - RNA, 15 nt, Human
ugcgugcauaccacu

SEQ ID NO: 3673439 - RNA, 14 nt, Human
ugcguggcugaccc

SEQ ID NO: 3673440 - RNA, 17 nt, Human
ugcguggcugacccccc

SEQ ID NO: 3673441 - RNA, 18 nt, Human
ugcgugggagugugugcc

SEQ ID NO: 3673442 - RNA, 21 nt, Human
ugcguggguggggagggaggu

SEQ ID NO: 3673443 - RNA, 21 nt, Human
ugcgugguggucccuggguag

SEQ ID NO: 3673444 - RNA, 19 nt, Human
ugcguguguagaguuaaga

SEQ ID NO: 3673445 - RNA, 24 nt, Human
ugcguguguagaguuaagaagcug

SEQ ID NO: 3673446 - RNA, 15 nt, Human
ugcguguucucagag

SEQ ID NO: 3673447 - RNA, 13 nt, Human
ugcguuacuaauu

SEQ ID NO: 3673448 - RNA, 17 nt, Human
ugcguuccaugaugcug

SEQ ID NO: 3673449 - RNA, 17 nt, Human
ugcguuggucucugcau

SEQ ID NO: 3673450 - RNA, 13 nt, Human
ugcguuuuggaag

SEQ ID NO: 3673451 - RNA, 12 nt, Human
ugcuaaaaaugg

SEQ ID NO: 3673452 - RNA, 13 nt, Human
ugcuaaaaccuga

SEQ ID NO: 3673453 - RNA, 14 nt, Human
ugcuaaaccuuagu

SEQ ID NO: 3673454 - RNA, 15 nt, Human
ugcuaaacguguaug

SEQ ID NO: 3673455 - RNA, 22 nt, Human
ugcuaaauaaaauuuguugcau

SEQ ID NO: 3673456 - RNA, 17 nt, Human
ugcuaaaucuccuauuu

SEQ ID NO: 3673457 - RNA, 18 nt, Human
ugcuaaauguaacagucu

SEQ ID NO: 3673458 - RNA, 19 nt, Human
ugcuaaauguaacagucug

SEQ ID NO: 3673459 - RNA, 16 nt, Human
ugcuaaauugauguug

SEQ ID NO: 3673460 - RNA, 17 nt, Human
ugcuaaauugauguuga

SEQ ID NO: 3673461 - RNA, 12 nt, Human
ugcuaaauuuca

SEQ ID NO: 3673462 - RNA, 22 nt, Human
ugcuaacagcaacacaaagcuu

SEQ ID NO: 3673463 - RNA, 23 nt, Human
ugcuaacagcaacacaaagcuuu

SEQ ID NO: 3673464 - RNA, 16 nt, Human
ugcuaacaucuaaaaa

SEQ ID NO: 3673465 - RNA, 12 nt, Human
ugcuaacugaac

SEQ ID NO: 3673466 - RNA, 22 nt, Human
ugcuaagaagcgagcacugacc

SEQ ID NO: 3673467 - RNA, 17 nt, Human
ugcuaagaauauuugaa

SEQ ID NO: 3673468 - RNA, 20 nt, Human
ugcuaagaauuuuuuauuuu

SEQ ID NO: 3673469 - RNA, 19 nt, Human
ugcuaagcauuccaacuau

SEQ ID NO: 3673470 - RNA, 13 nt, Human
ugcuaagguucua

SEQ ID NO: 3673471 - RNA, 14 nt, Human
ugcuaagguucuaa

SEQ ID NO: 3673472 - RNA, 19 nt, Human
ugcuaagugugaacuggac

SEQ ID NO: 3673473 - RNA, 12 nt, Human
ugcuaauaaaac

SEQ ID NO: 3673474 - RNA, 21 nt, Human
ugcuaauauaaguuucuuugc

SEQ ID NO: 3673475 - RNA, 15 nt, Human
ugcuaauauuaaaag

SEQ ID NO: 3673476 - RNA, 20 nt, Human
ugcuaauauuuuccuccuga

SEQ ID NO: 3673477 - RNA, 19 nt, Human
ugcuaaucagugucucaca

SEQ ID NO: 3673478 - RNA, 17 nt, Human
ugcuaaucuucagggca

SEQ ID NO: 3673479 - RNA, 22 nt, Human
ugcuaaucuucuuaugcaauuu

SEQ ID NO: 3673480 - RNA, 18 nt, Human
ugcuaaucuugugaaaau

SEQ ID NO: 3673481 - RNA, 16 nt, Human
ugcuaaugucaaacca

SEQ ID NO: 3673482 - RNA, 14 nt, Human
ugcuaauucuuugc

SEQ ID NO: 3673483 - RNA, 20 nt, Human
ugcuaauucuuugcaaaaau

SEQ ID NO: 3673484 - RNA, 21 nt, Human
ugcuaauucuuugcaaaaauc

SEQ ID NO: 3673485 - RNA, 17 nt, Human
ugcuaauugcuguugaa

SEQ ID NO: 3673486 - RNA, 23 nt, Human
ugcuaauugcuguugaaagcaaa

SEQ ID NO: 3673487 - RNA, 17 nt, Human
ugcuaauuuaaagagac

SEQ ID NO: 3673488 - RNA, 18 nt, Human
ugcuaauuuugaaaaacu

SEQ ID NO: 3673489 - RNA, 17 nt, Human
ugcuacaaaaacacagc

SEQ ID NO: 3673490 - RNA, 16 nt, Human
ugcuacaaagaagaca

SEQ ID NO: 3673491 - RNA, 19 nt, Human
ugcuacaacuucagcagua

SEQ ID NO: 3673492 - RNA, 14 nt, Human
ugcuacacaguaua

SEQ ID NO: 3673493 - RNA, 19 nt, Human
ugcuacagaggaaacaaua

SEQ ID NO: 3673494 - RNA, 20 nt, Human
ugcuacaggguccaacauag

SEQ ID NO: 3673495 - RNA, 13 nt, Human
ugcuaccaaagca

SEQ ID NO: 3673496 - RNA, 13 nt, Human
ugcuaccaccagc

SEQ ID NO: 3673497 - RNA, 20 nt, Human
ugcuaccaccagcugugucc

SEQ ID NO: 3673498 - RNA, 18 nt, Human
ugcuaccacggccuccuu

SEQ ID NO: 3673499 - RNA, 23 nt, Human
ugcuacccaugacuuuauaugga

SEQ ID NO: 3673500 - RNA, 20 nt, Human
ugcuacccucccugcugucc

SEQ ID NO: 3673501 - RNA, 23 nt, Human
ugcuacccucccugcuguccccu

SEQ ID NO: 3673502 - RNA, 22 nt, Human
ugcuaccuggguccuuuucaga

SEQ ID NO: 3673503 - RNA, 13 nt, Human
ugcuacgccugca

SEQ ID NO: 3673504 - RNA, 19 nt, Human
ugcuacguacaugugaggc

SEQ ID NO: 3673505 - RNA, 16 nt, Human
ugcuacgugugauuuu

SEQ ID NO: 3673506 - RNA, 14 nt, Human
ugcuacugauuguu

SEQ ID NO: 3673507 - RNA, 18 nt, Human
ugcuacugcacuccagcc

SEQ ID NO: 3673508 - RNA, 21 nt, Human
ugcuacugcacuccagccugg

SEQ ID NO: 3673509 - RNA, 14 nt, Human
ugcuacugccaacc

SEQ ID NO: 3673510 - RNA, 13 nt, Human
ugcuacuggggaa

SEQ ID NO: 3673511 - RNA, 19 nt, Human
ugcuacuggggaaacuggc

SEQ ID NO: 3673512 - RNA, 22 nt, Human
ugcuacugucucacugaaacau

SEQ ID NO: 3673513 - RNA, 20 nt, Human
ugcuacuguuguaagaauuc

SEQ ID NO: 3673514 - RNA, 15 nt, Human
ugcuagaaauuuuca

SEQ ID NO: 3673515 - RNA, 18 nt, Human
ugcuagaacucccuuuca

SEQ ID NO: 3673516 - RNA, 13 nt, Human
ugcuagaacuuuu

SEQ ID NO: 3673517 - RNA, 19 nt, Human
ugcuagaacuuuuuuaaau

SEQ ID NO: 3673518 - RNA, 23 nt, Human
ugcuagaacuuuuuuaaauaaac

SEQ ID NO: 3673519 - RNA, 16 nt, Human
ugcuagaauacuuuuu

SEQ ID NO: 3673520 - RNA, 13 nt, Human
ugcuagauaaaag

SEQ ID NO: 3673521 - RNA, 20 nt, Human
ugcuagcaaauggcagaacc

SEQ ID NO: 3673522 - RNA, 18 nt, Human
ugcuagcacuuggagcca

SEQ ID NO: 3673523 - RNA, 17 nt, Human
ugcuagcuaugugaccu

SEQ ID NO: 3673524 - RNA, 16 nt, Human
ugcuaggaacacuccu

SEQ ID NO: 3673525 - RNA, 20 nt, Human
ugcuaggaacacuccuucac

SEQ ID NO: 3673526 - RNA, 21 nt, Human
ugcuaggaacacuccuucaca

SEQ ID NO: 3673527 - RNA, 22 nt, Human
ugcuaggaacacuccuucacag

SEQ ID NO: 3673528 - RNA, 18 nt, Human
ugcuaggaagaggagugg

SEQ ID NO: 3673529 - RNA, 20 nt, Human
ugcuaggaugcggaaauccc

SEQ ID NO: 3673530 - RNA, 14 nt, Human
ugcuaggccagagc

SEQ ID NO: 3673531 - RNA, 17 nt, Human
ugcuaggccagagccca

SEQ ID NO: 3673532 - RNA, 20 nt, Human
ugcuaggcccccggguguga

SEQ ID NO: 3673533 - RNA, 22 nt, Human
ugcuagggaaacuucccguccc

SEQ ID NO: 3673534 - RNA, 20 nt, Human
ugcuagggguuuuaggucuc

SEQ ID NO: 3673535 - RNA, 21 nt, Human
ugcuagggguuuuaggucucu

SEQ ID NO: 3673536 - RNA, 14 nt, Human
ugcuaggugggcca

SEQ ID NO: 3673537 - RNA, 17 nt, Human
ugcuaggugggccagcc

SEQ ID NO: 3673538 - RNA, 19 nt, Human
ugcuaggugggccagcccc

SEQ ID NO: 3673539 - RNA, 20 nt, Human
ugcuaggugggccagccccu

SEQ ID NO: 3673540 - RNA, 13 nt, Human
ugcuagguucuac

SEQ ID NO: 3673541 - RNA, 16 nt, Human
ugcuaguaauuggaaa

SEQ ID NO: 3673542 - RNA, 14 nt, Human
ugcuaguauuugaa

SEQ ID NO: 3673543 - RNA, 16 nt, Human
ugcuaguauuugaauu

SEQ ID NO: 3673544 - RNA, 18 nt, Human
ugcuaguauuugaauuaa

SEQ ID NO: 3673545 - RNA, 20 nt, Human
ugcuaguauuugaauuaaaa

SEQ ID NO: 3673546 - RNA, 18 nt, Human
guccccuucucucaucuc

SEQ ID NO: 3673547 - RNA, 22 nt, Human
guccccuuuguauuccuuaaau

SEQ ID NO: 3673548 - RNA, 23 nt, Human
guccccuuuucuuuucuacccua

SEQ ID NO: 3673549 - RNA, 15 nt, Human
gucccggcucugugg

SEQ ID NO: 3673550 - RNA, 15 nt, Human
gucccggggcuccac

SEQ ID NO: 3673551 - RNA, 21 nt, Human
gucccgggguccuguggcagg

SEQ ID NO: 3673552 - RNA, 19 nt, Human
gucccgucaggacguugag

SEQ ID NO: 3673553 - RNA, 17 nt, Human
gucccuaaagaaaaaaa

SEQ ID NO: 3673554 - RNA, 12 nt, Human
gucccuaauaaa

SEQ ID NO: 3673555 - RNA, 17 nt, Human
gucccuaauaaagcugu

SEQ ID NO: 3673556 - RNA, 23 nt, Human
gucccuaccgagucucuucucca

SEQ ID NO: 3673557 - RNA, 20 nt, Human
gucccuagcagcccacccug

SEQ ID NO: 3673558 - RNA, 19 nt, Human
gucccuccacguucacccc

SEQ ID NO: 3673559 - RNA, 18 nt, Human
gucccucccaccucugug

SEQ ID NO: 3673560 - RNA, 16 nt, Human
gucccucccccuuguc

SEQ ID NO: 3673561 - RNA, 23 nt, Human
gucccuccgggaccuggugcugc

SEQ ID NO: 3673562 - RNA, 13 nt, Human
gucccuccuggga

SEQ ID NO: 3673563 - RNA, 22 nt, Human
gucccucucauuuagccugucc

SEQ ID NO: 3673564 - RNA, 14 nt, Human
gucccucucucugg

SEQ ID NO: 3673565 - RNA, 11 nt, Human
gucccucugug

SEQ ID NO: 3673566 - RNA, 12 nt, Human
gucccucugugu

SEQ ID NO: 3673567 - RNA, 22 nt, Human
gucccucuguguauuugcuuuu

SEQ ID NO: 3673568 - RNA, 20 nt, Human
gucccugacucucugugacc

SEQ ID NO: 3673569 - RNA, 12 nt, Human
gucccugaggau

SEQ ID NO: 3673570 - RNA, 14 nt, Human
gucccugccaaugg

SEQ ID NO: 3673571 - RNA, 14 nt, Human
gucccugcccccuc

SEQ ID NO: 3673572 - RNA, 16 nt, Human
gucccugcccuucuuc

SEQ ID NO: 3673573 - RNA, 15 nt, Human
gucccuggccaucuc

SEQ ID NO: 3673574 - RNA, 19 nt, Human
gucccugggagggacaugc

SEQ ID NO: 3673575 - RNA, 19 nt, Human
gucccugggccagggucug

SEQ ID NO: 3673576 - RNA, 22 nt, Human
gucccuggggcuagggggagcc

SEQ ID NO: 3673577 - RNA, 19 nt, Human
gucccugggggaagcccug

SEQ ID NO: 3673578 - RNA, 20 nt, Human
gucccugggggaagcccugg

SEQ ID NO: 3673579 - RNA, 23 nt, Human
gucccugggggaagcccuggauu

SEQ ID NO: 3673580 - RNA, 20 nt, Human
gucccuggguagcgggggag

SEQ ID NO: 3673581 - RNA, 14 nt, Human
gucccugucaccuc

SEQ ID NO: 3673582 - RNA, 15 nt, Human
gucccugucaccucu

SEQ ID NO: 3673583 - RNA, 15 nt, Human
gucccugugccuaac

SEQ ID NO: 3673584 - RNA, 18 nt, Human
gucccuguuuucugagcc

SEQ ID NO: 3673585 - RNA, 18 nt, Human
gucccuuccacaccccca

SEQ ID NO: 3673586 - RNA, 20 nt, Human
gucccuuccccaugcuuccu

SEQ ID NO: 3673587 - RNA, 20 nt, Human
gucccuuccccucccuggcu

SEQ ID NO: 3673588 - RNA, 19 nt, Human
gucccuucucuuaauuuaa

SEQ ID NO: 3673589 - RNA, 14 nt, Human
gucccuugagaccu

SEQ ID NO: 3673590 - RNA, 17 nt, Human
gucccuugagaccucag

SEQ ID NO: 3673591 - RNA, 18 nt, Human
gucccuugagaccucagc

SEQ ID NO: 3673592 - RNA, 19 nt, Human
gucccuugagaccucagcc

SEQ ID NO: 3673593 - RNA, 18 nt, Human
gucccuugaugcacagag

SEQ ID NO: 3673594 - RNA, 14 nt, Human
gucccuugccucaa

SEQ ID NO: 3673595 - RNA, 20 nt, Human
gucccuugcuugccugcagg

SEQ ID NO: 3673596 - RNA, 22 nt, Human
gucccuugcuugccugcagggc

SEQ ID NO: 3673597 - RNA, 13 nt, Human
guccgagcuuuga

SEQ ID NO: 3673598 - RNA, 15 nt, Human
guccgauaauaucuu

SEQ ID NO: 3673599 - RNA, 12 nt, Human
guccgcccucuu

SEQ ID NO: 3673600 - RNA, 19 nt, Human
guccgcccucuuccccucu

SEQ ID NO: 3673601 - RNA, 20 nt, Human
guccgcccugcuccucccug

SEQ ID NO: 3673602 - RNA, 18 nt, Human
guccggacacuccuagag

SEQ ID NO: 3673603 - RNA, 19 nt, Human
guccgugggacggugccca

SEQ ID NO: 3673604 - RNA, 17 nt, Human
guccguggguugcuaac

SEQ ID NO: 3673605 - RNA, 20 nt, Human
guccguggguugcuaacuga

SEQ ID NO: 3673606 - RNA, 19 nt, Human
guccguucacauguguggu

SEQ ID NO: 3673607 - RNA, 16 nt, Human
guccuaacugguauag

SEQ ID NO: 3673608 - RNA, 18 nt, Human
guccuaaggaaccuuccu

SEQ ID NO: 3673609 - RNA, 21 nt, Human
guccuaauggugaugcagucu

SEQ ID NO: 3673610 - RNA, 16 nt, Human
guccuacagaaaaacc

SEQ ID NO: 3673611 - RNA, 13 nt, Human
guccuacccaccc

SEQ ID NO: 3673612 - RNA, 23 nt, Human
guccuacucugugucaggugggg

SEQ ID NO: 3673613 - RNA, 18 nt, Human
guccuagaauguuucauu

SEQ ID NO: 3673614 - RNA, 15 nt, Human
guccuagcacagaug

SEQ ID NO: 3673615 - RNA, 17 nt, Human
guccuagcacagauggc

SEQ ID NO: 3673616 - RNA, 22 nt, Human
guccuaggccacaccaucuccu

SEQ ID NO: 3673617 - RNA, 16 nt, Human
guccuaggcuggaagg

SEQ ID NO: 3673618 - RNA, 22 nt, Human
guccuaggcuggaaggaggaag

SEQ ID NO: 3673619 - RNA, 18 nt, Human
ugcucacuaccuccucag

SEQ ID NO: 3673620 - RNA, 21 nt, Human
ugcucagaacuugcugcuguc

SEQ ID NO: 3673621 - RNA, 14 nt, Human
ugcucagaagggcu

SEQ ID NO: 3673622 - RNA, 11 nt, Human
ugcucagcccu

SEQ ID NO: 3673623 - RNA, 17 nt, Human
ugcucagcccugacugg

SEQ ID NO: 3673624 - RNA, 13 nt, Human
ugcucagcccugg

SEQ ID NO: 3673625 - RNA, 17 nt, Human
ugcucaggacucagaag

SEQ ID NO: 3673626 - RNA, 19 nt, Human
ugcucaggagcccugggag

SEQ ID NO: 3673627 - RNA, 19 nt, Human
ugcucaggcugcagcugga

SEQ ID NO: 3673628 - RNA, 22 nt, Human
ugcucagggaaaagcagcucuc

SEQ ID NO: 3673629 - RNA, 23 nt, Human
ugcucagggacucaucuuucccu

SEQ ID NO: 3673630 - RNA, 20 nt, Human
ugcucaggggcccuggagca

SEQ ID NO: 3673631 - RNA, 14 nt, Human
ugcucaguugcuaa

SEQ ID NO: 3673632 - RNA, 16 nt, Human
ugcucaguuguagaau

SEQ ID NO: 3673633 - RNA, 19 nt, Human
ugcucaguuguagaaugua

SEQ ID NO: 3673634 - RNA, 14 nt, Human
ugcucauaacggau

SEQ ID NO: 3673635 - RNA, 16 nt, Human
ugcucauaacggauca

SEQ ID NO: 3673636 - RNA, 22 nt, Human
ugcucauauugugauucugccu

SEQ ID NO: 3673637 - RNA, 14 nt, Human
ugcucauauuuccc

SEQ ID NO: 3673638 - RNA, 22 nt, Human
ugcucauauuucccaugauuuc

SEQ ID NO: 3673639 - RNA, 14 nt, Human
ugcucaucugcugg

SEQ ID NO: 3673640 - RNA, 11 nt, Human
ugcucauggaa

SEQ ID NO: 3673641 - RNA, 19 nt, Human
ugcucauucuaaugauggc

SEQ ID NO: 3673642 - RNA, 23 nt, Human
ugcucauucuaaugauggcccau

SEQ ID NO: 3673643 - RNA, 22 nt, Human
ugcucauuuuuuuuuuaucaga

SEQ ID NO: 3673644 - RNA, 22 nt, Human
ugcuccacccuuggccugucuc

SEQ ID NO: 3673645 - RNA, 12 nt, Human
ugcuccagaccu

SEQ ID NO: 3673646 - RNA, 14 nt, Human
ugcuccagaccuga

SEQ ID NO: 3673647 - RNA, 15 nt, Human
ugcuccagcaacaca

SEQ ID NO: 3673648 - RNA, 23 nt, Human
ugcuccagcaacacagccugggc

SEQ ID NO: 3673649 - RNA, 15 nt, Human
ugcuccagccaaccc

SEQ ID NO: 3673650 - RNA, 13 nt, Human
ugcuccagccugg

SEQ ID NO: 3673651 - RNA, 15 nt, Human
ugcuccagccuggcu

SEQ ID NO: 3673652 - RNA, 17 nt, Human
ugcuccagcucuggcau

SEQ ID NO: 3673653 - RNA, 20 nt, Human
ugcuccagcuguucagcugg

SEQ ID NO: 3673654 - RNA, 22 nt, Human
ugcuccaggcaggcuaaggcgu

SEQ ID NO: 3673655 - RNA, 20 nt, Human
ugcuccaggccugcagcagg

SEQ ID NO: 3673656 - RNA, 23 nt, Human
ugcuccagucaacaaacuauuuc

SEQ ID NO: 3673657 - RNA, 18 nt, Human
ugcuccauaguuuggcau

SEQ ID NO: 3673658 - RNA, 18 nt, Human
ugcucccaccuccugaca

SEQ ID NO: 3673659 - RNA, 17 nt, Human
ugcucccagcagcccua

SEQ ID NO: 3673660 - RNA, 18 nt, Human
ugcucccauccugugugu

SEQ ID NO: 3673661 - RNA, 19 nt, Human
ugcuccccacagcgucccu

SEQ ID NO: 3673662 - RNA, 13 nt, Human
ugcucccccaucc

SEQ ID NO: 3673663 - RNA, 14 nt, Human
ugcuccccucccuc

SEQ ID NO: 3673664 - RNA, 21 nt, Human
ugcucccuaagccagccuggu

SEQ ID NO: 3673665 - RNA, 12 nt, Human
ugcucccucaga

SEQ ID NO: 3673666 - RNA, 13 nt, Human
ugcucccuccccu

SEQ ID NO: 3673667 - RNA, 18 nt, Human
ugcucccuccccugcccu

SEQ ID NO: 3673668 - RNA, 21 nt, Human
ugcucccuccgggucuuccua

SEQ ID NO: 3673669 - RNA, 21 nt, Human
ugcucccugaagccagccuuc

SEQ ID NO: 3673670 - RNA, 14 nt, Human
ugcucccugacugg

SEQ ID NO: 3673671 - RNA, 22 nt, Human
ugcucccuguaggguccaacca

SEQ ID NO: 3673672 - RNA, 18 nt, Human
ugcuccgcugcuccuugg

SEQ ID NO: 3673673 - RNA, 20 nt, Human
ugcuccgcugcuccuuggcu

SEQ ID NO: 3673674 - RNA, 14 nt, Human
ugcuccgugccucc

SEQ ID NO: 3673675 - RNA, 15 nt, Human
ugcuccgugccucca

SEQ ID NO: 3673676 - RNA, 19 nt, Human
ugcuccgugccuccaccac

SEQ ID NO: 3673677 - RNA, 20 nt, Human
ugcuccgugccuccaccacc

SEQ ID NO: 3673678 - RNA, 24 nt, Human
ugcuccuagagggaggggccuagg

SEQ ID NO: 3673679 - RNA, 22 nt, Human
ugcuccuccagggccacgugcc

SEQ ID NO: 3673680 - RNA, 12 nt, Human
ugcuccucccug

SEQ ID NO: 3673681 - RNA, 23 nt, Human
ugcuccuccuuggugccuggccu

SEQ ID NO: 3673682 - RNA, 11 nt, Human
ugcuccucucc

SEQ ID NO: 3673683 - RNA, 16 nt, Human
ugcuccucuccaggca

SEQ ID NO: 3673684 - RNA, 19 nt, Human
ugcuccucuuccccagacg

SEQ ID NO: 3673685 - RNA, 15 nt, Human
ugcuccugagccccc

SEQ ID NO: 3673686 - RNA, 13 nt, Human
ugcuccugcagca

SEQ ID NO: 3673687 - RNA, 14 nt, Human
ugcuccuggagccu

SEQ ID NO: 3673688 - RNA, 21 nt, Human
ugcuccuguucacaccagaga

SEQ ID NO: 3673689 - RNA, 18 nt, Human
ugcuccuuagcugccaag

SEQ ID NO: 3673690 - RNA, 21 nt, Human
ugcaguucccacauuaaagaa

SEQ ID NO: 3673691 - RNA, 19 nt, Human
ugcaguucuaguuugcauu

SEQ ID NO: 3673692 - RNA, 20 nt, Human
ugcaguucuaguuugcauuc

SEQ ID NO: 3673693 - RNA, 20 nt, Human
ugcaguucuuuggcugaaag

SEQ ID NO: 3673694 - RNA, 16 nt, Human
ugcaguugacagcagg

SEQ ID NO: 3673695 - RNA, 14 nt, Human
ugcaguugccaguc

SEQ ID NO: 3673696 - RNA, 16 nt, Human
ugcaguugccagucac

SEQ ID NO: 3673697 - RNA, 12 nt, Human
ugcaguugcugu

SEQ ID NO: 3673698 - RNA, 13 nt, Human
ugcaguugucucu

SEQ ID NO: 3673699 - RNA, 17 nt, Human
ugcaguugucucuguuu

SEQ ID NO: 3673700 - RNA, 19 nt, Human
ugcaguuuaagagcagaac

SEQ ID NO: 3673701 - RNA, 10 nt, Human
ugcaguuuau

SEQ ID NO: 3673702 - RNA, 14 nt, Human
ugcaguuugaaauu

SEQ ID NO: 3673703 - RNA, 23 nt, Human
ugcaguuugaaauucugaauuug

SEQ ID NO: 3673704 - RNA, 15 nt, Human
ugcaguuuuucagga

SEQ ID NO: 3673705 - RNA, 18 nt, Human
ugcaguuuuucauuuuaa

SEQ ID NO: 3673706 - RNA, 17 nt, Human
ugcauaaagucagugcc

SEQ ID NO: 3673707 - RNA, 13 nt, Human
ugcauaaauaugc

SEQ ID NO: 3673708 - RNA, 19 nt, Human
ugcauaaauaugcagugau

SEQ ID NO: 3673709 - RNA, 19 nt, Human
ugcauaauaaaugcuucag

SEQ ID NO: 3673710 - RNA, 23 nt, Human
ugcauaauaagcuaaagaggcug

SEQ ID NO: 3673711 - RNA, 11 nt, Human
ugcauaauaau

SEQ ID NO: 3673712 - RNA, 18 nt, Human
ugcauaauguuucuggau

SEQ ID NO: 3673713 - RNA, 23 nt, Human
ugcauaauucugaaguuauauuu

SEQ ID NO: 3673714 - RNA, 12 nt, Human
ugcauacaaaca

SEQ ID NO: 3673715 - RNA, 13 nt, Human
ugcauacaaacaa

SEQ ID NO: 3673716 - RNA, 11 nt, Human
ugcauacacac

SEQ ID NO: 3673717 - RNA, 12 nt, Human
ugcauacacaca

SEQ ID NO: 3673718 - RNA, 22 nt, Human
ugcauacacacacacacacagc

SEQ ID NO: 3673719 - RNA, 23 nt, Human
ugcauacacacacacacacagcc

SEQ ID NO: 3673720 - RNA, 16 nt, Human
ugcauacauacacaua

SEQ ID NO: 3673721 - RNA, 18 nt, Human
ugcauaccaaccugggca

SEQ ID NO: 3673722 - RNA, 19 nt, Human
ugcauacucauuaggaugg

SEQ ID NO: 3673723 - RNA, 17 nt, Human
ugcauacugagccaagu

SEQ ID NO: 3673724 - RNA, 14 nt, Human
ugcauacuggacuc

SEQ ID NO: 3673725 - RNA, 17 nt, Human
ugcauacuucaaaagua

SEQ ID NO: 3673726 - RNA, 19 nt, Human
ugcauacuuuuuaaaugua

SEQ ID NO: 3673727 - RNA, 18 nt, Human
ugcauagaaggaggagag

SEQ ID NO: 3673728 - RNA, 20 nt, Human
ugcauaggugaucucauuua

SEQ ID NO: 3673729 - RNA, 16 nt, Human
ugcauagguuuagcag

SEQ ID NO: 3673730 - RNA, 20 nt, Human
ugcauaguaccaaucauuuu

SEQ ID NO: 3673731 - RNA, 16 nt, Human
ugcauagucccagcua

SEQ ID NO: 3673732 - RNA, 14 nt, Human
ugcauagugcuggg

SEQ ID NO: 3673733 - RNA, 23 nt, Human
ugcauaguuucuuuauuuugugu

SEQ ID NO: 3673734 - RNA, 15 nt, Human
ugcauauaacuuaua

SEQ ID NO: 3673735 - RNA, 16 nt, Human
ugcauauaacuuauau

SEQ ID NO: 3673736 - RNA, 20 nt, Human
ugcauauaacuuauauugua

SEQ ID NO: 3673737 - RNA, 22 nt, Human
ugcauauaacuuauauuguaag

SEQ ID NO: 3673738 - RNA, 21 nt, Human
ugcauauaagggaaguaguua

SEQ ID NO: 3673739 - RNA, 16 nt, Human
ugcauauaaugaauaa

SEQ ID NO: 3673740 - RNA, 13 nt, Human
ugcauauauauau

SEQ ID NO: 3673741 - RNA, 15 nt, Human
ugcauauauauaugu

SEQ ID NO: 3673742 - RNA, 13 nt, Human
ugcauauccugag

SEQ ID NO: 3673743 - RNA, 17 nt, Human
ugcauauccugagccau

SEQ ID NO: 3673744 - RNA, 15 nt, Human
ugcauaugaaauccu

SEQ ID NO: 3673745 - RNA, 12 nt, Human
ugcauauguaug

SEQ ID NO: 3673746 - RNA, 17 nt, Human
ugcauauguugaauacu

SEQ ID NO: 3673747 - RNA, 23 nt, Human
ugcauauuauaaaggauaaagaa

SEQ ID NO: 3673748 - RNA, 23 nt, Human
ugcauauucuuauguaugugaaa

SEQ ID NO: 3673749 - RNA, 23 nt, Human
ugcauauugcauacuauuaaaca

SEQ ID NO: 3673750 - RNA, 15 nt, Human
ugcauauuguacacu

SEQ ID NO: 3673751 - RNA, 16 nt, Human
ugcauauuguacacuu

SEQ ID NO: 3673752 - RNA, 19 nt, Human
ugcauauuguacacuuuuu

SEQ ID NO: 3673753 - RNA, 21 nt, Human
ugcauauuuauaaaaauaaaa

SEQ ID NO: 3673754 - RNA, 22 nt, Human
ugcauauuuauccaaaaugugu

SEQ ID NO: 3673755 - RNA, 14 nt, Human
ugcaucaagaugug

SEQ ID NO: 3673756 - RNA, 13 nt, Human
ugcaucaaggggu

SEQ ID NO: 3673757 - RNA, 19 nt, Human
ugcaucagaaagcuuuauu

SEQ ID NO: 3673758 - RNA, 18 nt, Human
ugcaucagaaagggaggg

SEQ ID NO: 3673759 - RNA, 21 nt, Human
ugcaucagaaaugucuggaga

SEQ ID NO: 3673760 - RNA, 23 nt, Human
ugcaucagaaaugucuggagaau

SEQ ID NO: 3673761 - RNA, 20 nt, Human
ugcaucaguauuaauacuaa

SEQ ID NO: 3673762 - RNA, 16 nt, Human
ugcaucaucuguagau

SEQ ID NO: 3673763 - RNA, 21 nt, Human
ugcauccagccuggggcugag

SEQ ID NO: 3673764 - RNA, 14 nt, Human
ugcauccauuccuc

SEQ ID NO: 3673765 - RNA, 19 nt, Human
ugcauccauuccucaggga

SEQ ID NO: 3673766 - RNA, 18 nt, Human
ugcauccauucuccugag

SEQ ID NO: 3673767 - RNA, 20 nt, Human
ugcaucccagcaccugccuc

SEQ ID NO: 3673768 - RNA, 15 nt, Human
ugcaucccccccacc

SEQ ID NO: 3673769 - RNA, 14 nt, Human
ugcaucccuggcug

SEQ ID NO: 3673770 - RNA, 20 nt, Human
ugcauccguaguucccugaa

SEQ ID NO: 3673771 - RNA, 22 nt, Human
ugcauccuccaagaaucuaucu

SEQ ID NO: 3673772 - RNA, 18 nt, Human
ugcauccuccgccucccg

SEQ ID NO: 3673773 - RNA, 21 nt, Human
ugcauccuccgccucccgggu

SEQ ID NO: 3673774 - RNA, 22 nt, Human
ugcaucgagucaaaacucaaau

SEQ ID NO: 3673775 - RNA, 19 nt, Human
ugcaucuacucccaaguau

SEQ ID NO: 3673776 - RNA, 18 nt, Human
ugcaucuagauuauggag

SEQ ID NO: 3673777 - RNA, 14 nt, Human
ugcaucucaaaauu

SEQ ID NO: 3673778 - RNA, 13 nt, Human
ugcaucuccaccu

SEQ ID NO: 3673779 - RNA, 22 nt, Human
ugcaucugaaauaggaaacaag

SEQ ID NO: 3673780 - RNA, 15 nt, Human
ugcaucugaccagca

SEQ ID NO: 3673781 - RNA, 18 nt, Human
ugcaucugaccagcagcg

SEQ ID NO: 3673782 - RNA, 22 nt, Human
ugcaucugaccagcagcgccuu

SEQ ID NO: 3673783 - RNA, 17 nt, Human
ugcaucuggagagaaca

SEQ ID NO: 3673784 - RNA, 21 nt, Human
ugcaucuggagagaacagguu

SEQ ID NO: 3673785 - RNA, 20 nt, Human
ugcaucugggauucccacca

SEQ ID NO: 3673786 - RNA, 11 nt, Human
ugcaucuguau

SEQ ID NO: 3673787 - RNA, 23 nt, Human
ugcaucuguauaaguaagaaaau

SEQ ID NO: 3673788 - RNA, 12 nt, Human
ugcaucuuugau

SEQ ID NO: 3673789 - RNA, 18 nt, Human
ugcaucuuugauguguug

SEQ ID NO: 3673790 - RNA, 16 nt, Human
ugcaugaagagaagca

SEQ ID NO: 3673791 - RNA, 23 nt, Human
ugcaugaagagaagcaauuuugg

SEQ ID NO: 3673792 - RNA, 21 nt, Human
ugcaugaagguuucugaaaau

SEQ ID NO: 3673793 - RNA, 22 nt, Human
ugcaugagcuacgccugccucc

SEQ ID NO: 3673794 - RNA, 15 nt, Human
ugcaugagcuuuuau

SEQ ID NO: 3673795 - RNA, 21 nt, Human
ugcaugaggcuaguguggugu

SEQ ID NO: 3673796 - RNA, 18 nt, Human
ugcaugauguuugcccaa

SEQ ID NO: 3673797 - RNA, 14 nt, Human
ugcaugcccagaga

SEQ ID NO: 3673798 - RNA, 20 nt, Human
ugcaugcccagagacccagc

SEQ ID NO: 3673799 - RNA, 14 nt, Human
ugcaugccgcugca

SEQ ID NO: 3673800 - RNA, 13 nt, Human
ugcaugcggccca

SEQ ID NO: 3673801 - RNA, 17 nt, Human
ugcaugcucucugcagc

SEQ ID NO: 3673802 - RNA, 17 nt, Human
ugcaugcugcuggacag

SEQ ID NO: 3673803 - RNA, 15 nt, Human
ugcaugcugcuuuaa

SEQ ID NO: 3673804 - RNA, 13 nt, Human
ugcaugcuguccc

SEQ ID NO: 3673805 - RNA, 14 nt, Human
ugcaugcugucccu

SEQ ID NO: 3673806 - RNA, 16 nt, Human
ugcaugcugucccuua

SEQ ID NO: 3673807 - RNA, 19 nt, Human
ugcauggaaaccugaaaaa

SEQ ID NO: 3673808 - RNA, 11 nt, Human
ugcauggaaau

SEQ ID NO: 3673809 - RNA, 15 nt, Human
ugcauggaaaucagc

SEQ ID NO: 3673810 - RNA, 19 nt, Human
ugcauggaauuuguaaguu

SEQ ID NO: 3673811 - RNA, 15 nt, Human
ugcauggaccuaaca

SEQ ID NO: 3673812 - RNA, 17 nt, Human
ugcauggaccuaacauu

SEQ ID NO: 3673813 - RNA, 21 nt, Human
ugcauggaccuaacauucgau

SEQ ID NO: 3673814 - RNA, 18 nt, Human
ugcauggaggcccuccug

SEQ ID NO: 3673815 - RNA, 19 nt, Human
ugcauggcagggggcugcu

SEQ ID NO: 3673816 - RNA, 11 nt, Human
ugcauggcauc

SEQ ID NO: 3673817 - RNA, 17 nt, Human
ugcaugggccagccccu

SEQ ID NO: 3673818 - RNA, 19 nt, Human
ugcaugggcuaaugaagau

SEQ ID NO: 3673819 - RNA, 17 nt, Human
ugcauggggaaagagau

SEQ ID NO: 3673820 - RNA, 23 nt, Human
ugcauggggugggguagggcuga

SEQ ID NO: 3673821 - RNA, 23 nt, Human
ugcauggugcaguugacagcagg

SEQ ID NO: 3673822 - RNA, 22 nt, Human
ugcauggugccccaggaccagc

SEQ ID NO: 3673823 - RNA, 14 nt, Human
ugcaugguggccag

SEQ ID NO: 3673824 - RNA, 14 nt, Human
ugcaugguuucagc

SEQ ID NO: 3673825 - RNA, 12 nt, Human
ugcauguaauca

SEQ ID NO: 3673826 - RNA, 15 nt, Human
ugcauguaugucuug

SEQ ID NO: 3673827 - RNA, 16 nt, Human
ugcauguaugucuugg

SEQ ID NO: 3673828 - RNA, 23 nt, Human
ugcauguccuuugcgccugugac

SEQ ID NO: 3673829 - RNA, 16 nt, Human
ugcaugugaagaaagg

SEQ ID NO: 3673830 - RNA, 14 nt, Human
gucuggcccuuccu

SEQ ID NO: 3673831 - RNA, 16 nt, Human
gucuggcugagcccug

SEQ ID NO: 3673832 - RNA, 15 nt, Human
gucuggcugagcuga

SEQ ID NO: 3673833 - RNA, 21 nt, Human
gucugggagaaauugacagau

SEQ ID NO: 3673834 - RNA, 19 nt, Human
gucugggagaggcagagug

SEQ ID NO: 3673835 - RNA, 21 nt, Human
ugccaaguccagguccuggug

SEQ ID NO: 3673836 - RNA, 19 nt, Human
ugccaaguuguuugagaaa

SEQ ID NO: 3673837 - RNA, 21 nt, Human
ugccaauacuagucaccccaa

SEQ ID NO: 3673838 - RNA, 14 nt, Human
ugccaauauccuaa

SEQ ID NO: 3673839 - RNA, 21 nt, Human
ugccaauauccuaauaaaaag

SEQ ID NO: 3673840 - RNA, 18 nt, Human
ugccaauauuaaaucugc

SEQ ID NO: 3673841 - RNA, 20 nt, Human
ugccaaugaggucugaaaug

SEQ ID NO: 3673842 - RNA, 17 nt, Human
ugccaaugcuacaguaa

SEQ ID NO: 3673843 - RNA, 22 nt, Human
ugccaaugcuacaguaauaaau

SEQ ID NO: 3673844 - RNA, 15 nt, Human
uggaccucugcucug

SEQ ID NO: 3673845 - RNA, 11 nt, Human
uggaccugccc

SEQ ID NO: 3673846 - RNA, 19 nt, Human
uggaccuuaggccuuccuc

SEQ ID NO: 3673847 - RNA, 19 nt, Human
uggaccuuccugccaccag

SEQ ID NO: 3673848 - RNA, 22 nt, Human
uggaccuuuccugaggaagagg

SEQ ID NO: 3673849 - RNA, 24 nt, Human
uggacgacacggucggggcaucug

SEQ ID NO: 3673850 - RNA, 18 nt, Human
uggacgagaaaacaauaa

SEQ ID NO: 3673851 - RNA, 21 nt, Human
uggacggcaggcucacugcca

SEQ ID NO: 3673852 - RNA, 22 nt, Human
uggacggcaggcucacugccag

SEQ ID NO: 3673853 - RNA, 17 nt, Human
uggacggugcuccaggc

SEQ ID NO: 3673854 - RNA, 22 nt, Human
uggacggugcuccaggcaggcu

SEQ ID NO: 3673855 - RNA, 14 nt, Human
uggacuaaaagaua

SEQ ID NO: 3673856 - RNA, 21 nt, Human
uggacuaaaagauauaagugc

SEQ ID NO: 3673857 - RNA, 23 nt, Human
uggacuaaaagauauaagugcug

SEQ ID NO: 3673858 - RNA, 12 nt, Human
uggacucagaaa

SEQ ID NO: 3673859 - RNA, 14 nt, Human
uggacucagggcag

SEQ ID NO: 3673860 - RNA, 15 nt, Human
uggacucagggcagc

SEQ ID NO: 3673861 - RNA, 18 nt, Human
uggacuccagacucucug

SEQ ID NO: 3673862 - RNA, 14 nt, Human
uggacuccagccug

SEQ ID NO: 3673863 - RNA, 22 nt, Human
uggacuccagccugccuggcag

SEQ ID NO: 3673864 - RNA, 15 nt, Human
uggacuccugcacac

SEQ ID NO: 3673865 - RNA, 17 nt, Human
uggacucuaaagaccaa

SEQ ID NO: 3673866 - RNA, 18 nt, Human
uggacucuaaagaccaaa

SEQ ID NO: 3673867 - RNA, 17 nt, Human
uggacucuacacuguga

SEQ ID NO: 3673868 - RNA, 14 nt, Human
uggacucugcacau

SEQ ID NO: 3673869 - RNA, 15 nt, Human
uggacucugcacaug

SEQ ID NO: 3673870 - RNA, 19 nt, Human
uggacucugcacaugucuu

SEQ ID NO: 3673871 - RNA, 14 nt, Human
uggacucugcaucc

SEQ ID NO: 3673872 - RNA, 20 nt, Human
uggacucugcaucccagcac

SEQ ID NO: 3673873 - RNA, 21 nt, Human
uggacucuggugccuccagag

SEQ ID NO: 3673874 - RNA, 13 nt, Human
uggacucuucaaa

SEQ ID NO: 3673875 - RNA, 22 nt, Human
uggacugaaugggaucaugaaa

SEQ ID NO: 3673876 - RNA, 21 nt, Human
uggacugacagcaugugcccu

SEQ ID NO: 3673877 - RNA, 19 nt, Human
uggacugaccugguccaca

SEQ ID NO: 3673878 - RNA, 11 nt, Human
uggacugaggc

SEQ ID NO: 3673879 - RNA, 21 nt, Human
uggacuggaggccccuggagc

SEQ ID NO: 3673880 - RNA, 15 nt, Human
uggacuggccccugg

SEQ ID NO: 3673881 - RNA, 20 nt, Human
uggacuggccccugggucag

SEQ ID NO: 3673882 - RNA, 21 nt, Human
uggacuggguugcguccugac

SEQ ID NO: 3673883 - RNA, 16 nt, Human
uggacugguggccccu

SEQ ID NO: 3673884 - RNA, 21 nt, Human
uggacugucauagaaauuaca

SEQ ID NO: 3673885 - RNA, 21 nt, Human
uggacugugaugccacacaga

SEQ ID NO: 3673886 - RNA, 12 nt, Human
uggacuguggca

SEQ ID NO: 3673887 - RNA, 13 nt, Human
uggacuguggcac

SEQ ID NO: 3673888 - RNA, 18 nt, Human
uggacuguggcacuugcc

SEQ ID NO: 3673889 - RNA, 20 nt, Human
uggacuguggcacuugccug

SEQ ID NO: 3673890 - RNA, 16 nt, Human
uggacuguggugacuu

SEQ ID NO: 3673891 - RNA, 21 nt, Human
uggacuguggugacuuuggau

SEQ ID NO: 3673892 - RNA, 18 nt, Human
uggacuucaaagcaagcu

SEQ ID NO: 3673893 - RNA, 23 nt, Human
uggacuucacauaagcucagaau

SEQ ID NO: 3673894 - RNA, 17 nt, Human
uggacuucuaccugccc

SEQ ID NO: 3673895 - RNA, 20 nt, Human
uggacuucuuuuacucauga

SEQ ID NO: 3673896 - RNA, 18 nt, Human
uggacuugaacuuuccug

SEQ ID NO: 3673897 - RNA, 17 nt, Human
uggacuugagcuuggca

SEQ ID NO: 3673898 - RNA, 18 nt, Human
uggacuuggucaccagcu

SEQ ID NO: 3673899 - RNA, 20 nt, Human
uggacuuggucaccagcucc

SEQ ID NO: 3673900 - RNA, 20 nt, Human
uggacuuguauauuuguaca

SEQ ID NO: 3673901 - RNA, 22 nt, Human
uggacuuguauauuuguacaaa

SEQ ID NO: 3673902 - RNA, 23 nt, Human
uggacuuucaaaauuaaaucugu

SEQ ID NO: 3673903 - RNA, 14 nt, Human
uggacuuuccugca

SEQ ID NO: 3673904 - RNA, 17 nt, Human
uggacuuugcacacuuu

SEQ ID NO: 3673905 - RNA, 18 nt, Human
uggacuuuucguuaacau

SEQ ID NO: 3673906 - RNA, 21 nt, Human
uggacuuuucguuaacauuga

SEQ ID NO: 3673907 - RNA, 22 nt, Human
uggacuuuucguuaacauugac

SEQ ID NO: 3673908 - RNA, 23 nt, Human
uggagaaaaauaucuguaagagu

SEQ ID NO: 3673909 - RNA, 16 nt, Human
uggagaaacccugucu

SEQ ID NO: 3673910 - RNA, 15 nt, Human
uggagaaagcugacu

SEQ ID NO: 3673911 - RNA, 21 nt, Human
uggagaaauaaaaauaccucu

SEQ ID NO: 3673912 - RNA, 15 nt, Human
uggagaaauuauuua

SEQ ID NO: 3673913 - RNA, 19 nt, Human
uggagaacuagaaccugga

SEQ ID NO: 3673914 - RNA, 20 nt, Human
uggagaacuagaaccuggag

SEQ ID NO: 3673915 - RNA, 15 nt, Human
uggagaacucuggcu

SEQ ID NO: 3673916 - RNA, 13 nt, Human
uggagaagaacug

SEQ ID NO: 3673917 - RNA, 12 nt, Human
uggagaagagag

SEQ ID NO: 3673918 - RNA, 13 nt, Human
uggagaagcagug

SEQ ID NO: 3673919 - RNA, 20 nt, Human
uggagaagccacaggccuga

SEQ ID NO: 3673920 - RNA, 21 nt, Human
uggagaagccacaggccugag

SEQ ID NO: 3673921 - RNA, 12 nt, Human
uggagaagccau

SEQ ID NO: 3673922 - RNA, 19 nt, Human
uggagaagccauugucuuc

SEQ ID NO: 3673923 - RNA, 13 nt, Human
uggagaagcggcu

SEQ ID NO: 3673924 - RNA, 13 nt, Human
uggagaaggaagg

SEQ ID NO: 3673925 - RNA, 16 nt, Human
uggagaagucucagcu

SEQ ID NO: 3673926 - RNA, 15 nt, Human
uggagaaucacaggc

SEQ ID NO: 3673927 - RNA, 18 nt, Human
uggagaaucacaggcugg

SEQ ID NO: 3673928 - RNA, 22 nt, Human
uggagaaucacaggcugggcug

SEQ ID NO: 3673929 - RNA, 14 nt, Human
uggagaauuauaua

SEQ ID NO: 3673930 - RNA, 19 nt, Human
uggagaauugcugaagggc

SEQ ID NO: 3673931 - RNA, 18 nt, Human
uggagacaaugcagaugc

SEQ ID NO: 3673932 - RNA, 19 nt, Human
uggagacaaugucugcagc

SEQ ID NO: 3673933 - RNA, 21 nt, Human
uggagacaaugucugcagccc

SEQ ID NO: 3673934 - RNA, 24 nt, Human
uggagacaaugucugcagcccuga

SEQ ID NO: 3673935 - RNA, 17 nt, Human
uggagacacaacuauuu

SEQ ID NO: 3673936 - RNA, 20 nt, Human
uggagacagccccagagcag

SEQ ID NO: 3673937 - RNA, 17 nt, Human
uggagaccaccagggca

SEQ ID NO: 3673938 - RNA, 19 nt, Human
uggagaccagggagccuuu

SEQ ID NO: 3673939 - RNA, 18 nt, Human
uggagaccaugcagagcg

SEQ ID NO: 3673940 - RNA, 20 nt, Human
uggagaccaugcagagcgcc

SEQ ID NO: 3673941 - RNA, 22 nt, Human
uggagacguggaaccucugucu

SEQ ID NO: 3673942 - RNA, 18 nt, Human
uggagacuccuaggcagg

SEQ ID NO: 3673943 - RNA, 22 nt, Human
uggagacuccuaggcaggacau

SEQ ID NO: 3673944 - RNA, 14 nt, Human
uggagacucugugg

SEQ ID NO: 3673945 - RNA, 19 nt, Human
uggagacucuguggggccu

SEQ ID NO: 3673946 - RNA, 23 nt, Human
uggagacugcuccugagccccca

SEQ ID NO: 3673947 - RNA, 12 nt, Human
uggagacugcuu

SEQ ID NO: 3673948 - RNA, 14 nt, Human
uggagacugcuucc

SEQ ID NO: 3673949 - RNA, 17 nt, Human
uggagacugcuucccau

SEQ ID NO: 3673950 - RNA, 20 nt, Human
uggagacugguccugugugc

SEQ ID NO: 3673951 - RNA, 18 nt, Human
uggagacugugugugccc

SEQ ID NO: 3673952 - RNA, 23 nt, Human
uggagacugugugugcccucugg

SEQ ID NO: 3673953 - RNA, 16 nt, Human
uggagacuuagggcac

SEQ ID NO: 3673954 - RNA, 21 nt, Human
uggagacuuagggcaccaggg

SEQ ID NO: 3673955 - RNA, 12 nt, Human
uggagagaaaac

SEQ ID NO: 3673956 - RNA, 21 nt, Human
uggagagaaacaauaaagaga

SEQ ID NO: 3673957 - RNA, 15 nt, Human
uggagagaaggccuc

SEQ ID NO: 3673958 - RNA, 13 nt, Human
uggagagaaguuu

SEQ ID NO: 3673959 - RNA, 12 nt, Human
uggagagagggg

SEQ ID NO: 3673960 - RNA, 13 nt, Human
uggagagagggga

SEQ ID NO: 3673961 - RNA, 14 nt, Human
uggagagauaggaa

SEQ ID NO: 3673962 - RNA, 18 nt, Human
uggagagccagaaccugg

SEQ ID NO: 3673963 - RNA, 20 nt, Human
uggagagccagaaccuggag

SEQ ID NO: 3673964 - RNA, 16 nt, Human
uggagagcccagaguc

SEQ ID NO: 3673965 - RNA, 21 nt, Human
uggagagcccggcgccccugc

SEQ ID NO: 3673966 - RNA, 22 nt, Human
uggagagcuagaaccuggagag

SEQ ID NO: 3673967 - RNA, 21 nt, Human
uggagagcuagaaccuggagg

SEQ ID NO: 3673968 - RNA, 14 nt, Human
uggagagcuaggag

SEQ ID NO: 3673969 - RNA, 23 nt, Human
uggagaggagggaugcugccuga

SEQ ID NO: 3673970 - RNA, 18 nt, Human
uggagaggcccggccucu

SEQ ID NO: 3673971 - RNA, 20 nt, Human
uggagagggacagcccacug

SEQ ID NO: 3673972 - RNA, 23 nt, Human
uggagaguucaauggcugcugaa

SEQ ID NO: 3673973 - RNA, 16 nt, Human
uggagaguuuccugaa

SEQ ID NO: 3673974 - RNA, 21 nt, Human
uggagauccuccugcagacca

SEQ ID NO: 3673975 - RNA, 15 nt, Human
uggagaugaggccag

SEQ ID NO: 3673976 - RNA, 17 nt, Human
uggagaugaggccagac

SEQ ID NO: 3673977 - RNA, 24 nt, Human
uggagaugaggccagaccauggac

SEQ ID NO: 3673978 - RNA, 20 nt, Human
ugccccuccucucugcccua

SEQ ID NO: 3673979 - RNA, 15 nt, Human
ugccccucucaccaa

SEQ ID NO: 3673980 - RNA, 13 nt, Human
ugccccucuuucu

SEQ ID NO: 3673981 - RNA, 14 nt, Human
ugccccucuuucuc

SEQ ID NO: 3673982 - RNA, 11 nt, Human
ugccccugcug

SEQ ID NO: 3673983 - RNA, 12 nt, Human
ugccccugcugc

SEQ ID NO: 3673984 - RNA, 13 nt, Human
ugccccugcugcc

SEQ ID NO: 3673985 - RNA, 19 nt, Human
ugccccugcugcugucacc

SEQ ID NO: 3673986 - RNA, 16 nt, Human
ugccccuggcagcccc

SEQ ID NO: 3673987 - RNA, 14 nt, Human
ugccccuggcucug

SEQ ID NO: 3673988 - RNA, 13 nt, Human
ugccccuggcugg

SEQ ID NO: 3673989 - RNA, 19 nt, Human
ugccccuucccaucucuuc

SEQ ID NO: 3673990 - RNA, 21 nt, Human
ugccccuucccaucucuuccu

SEQ ID NO: 3673991 - RNA, 14 nt, Human
ugccccuuccgcca

SEQ ID NO: 3673992 - RNA, 18 nt, Human
ugccccuucuacacucuc

SEQ ID NO: 3673993 - RNA, 16 nt, Human
ugcccgagggagggga

SEQ ID NO: 3673994 - RNA, 14 nt, Human
ugcccgcacagcag

SEQ ID NO: 3673995 - RNA, 17 nt, Human
ugcccgccugcccaccu

SEQ ID NO: 3673996 - RNA, 15 nt, Human
ugcccgcucccagug

SEQ ID NO: 3673997 - RNA, 20 nt, Human
ugcccggcuaauuuuuguaa

SEQ ID NO: 3673998 - RNA, 20 nt, Human
ugcccgggcgcggccagccc

SEQ ID NO: 3673999 - RNA, 20 nt, Human
ugcccguaaacacgccugca

SEQ ID NO: 3674000 - RNA, 17 nt, Human
ugcccgucucucuccca

SEQ ID NO: 3674001 - RNA, 20 nt, Human
ugcccgucucucucccaugg

SEQ ID NO: 3674002 - RNA, 23 nt, Human
ugcccgucucucucccauggagc

SEQ ID NO: 3674003 - RNA, 17 nt, Human
ugcccgucuucagccua

SEQ ID NO: 3674004 - RNA, 19 nt, Human
ugcccgucuucagccuagc

SEQ ID NO: 3674005 - RNA, 17 nt, Human
ugcccguucuugaaaug

SEQ ID NO: 3674006 - RNA, 13 nt, Human
ugcccuaaacccu

SEQ ID NO: 3674007 - RNA, 15 nt, Human
ugcccuaagcagaaa

SEQ ID NO: 3674008 - RNA, 20 nt, Human
ugcccuaagcagaaagugcc

SEQ ID NO: 3674009 - RNA, 22 nt, Human
ugcccuaagcagaaagugccuu

SEQ ID NO: 3674010 - RNA, 23 nt, Human
ugcccuaaugcgcaggcuggccc

SEQ ID NO: 3674011 - RNA, 16 nt, Human
ugcccuaaugucugua

SEQ ID NO: 3674012 - RNA, 15 nt, Human
ugcccuacucacucu

SEQ ID NO: 3674013 - RNA, 19 nt, Human
ugcccuacucauugggguu

SEQ ID NO: 3674014 - RNA, 18 nt, Human
ugcccuaguuuucuuucc

SEQ ID NO: 3674015 - RNA, 16 nt, Human
ugcccuaugggccugc

SEQ ID NO: 3674016 - RNA, 16 nt, Human
ugcccucaaucccagc

SEQ ID NO: 3674017 - RNA, 16 nt, Human
ugcccucaccacccac

SEQ ID NO: 3674018 - RNA, 12 nt, Human
ugcccucagggg

SEQ ID NO: 3674019 - RNA, 21 nt, Human
ugcccucauggccccucugac

SEQ ID NO: 3674020 - RNA, 18 nt, Human
ugcccucauuacugggcc

SEQ ID NO: 3674021 - RNA, 18 nt, Human
ugcccucauuuuauguca

SEQ ID NO: 3674022 - RNA, 14 nt, Human
ugcccuccacugcc

SEQ ID NO: 3674023 - RNA, 16 nt, Human
ugcccuccacugcccu

SEQ ID NO: 3674024 - RNA, 13 nt, Human
ugcccuccauccc

SEQ ID NO: 3674025 - RNA, 12 nt, Human
ugcccucccauc

SEQ ID NO: 3674026 - RNA, 17 nt, Human
ugcccuccccagagcac

SEQ ID NO: 3674027 - RNA, 20 nt, Human
ugcccuccccagagcacugg

SEQ ID NO: 3674028 - RNA, 14 nt, Human
ugcccuccccucuc

SEQ ID NO: 3674029 - RNA, 17 nt, Human
ugcccuccccucucugc

SEQ ID NO: 3674030 - RNA, 13 nt, Human
ugcccucccuucu

SEQ ID NO: 3674031 - RNA, 14 nt, Human
ugcccucccuucuc

SEQ ID NO: 3674032 - RNA, 20 nt, Human
ugcccucccuucucccugga

SEQ ID NO: 3674033 - RNA, 16 nt, Human
ugcccucguggccagc

SEQ ID NO: 3674034 - RNA, 13 nt, Human
ugcccucucccac

SEQ ID NO: 3674035 - RNA, 16 nt, Human
ugcccucucccacccu

SEQ ID NO: 3674036 - RNA, 12 nt, Human
ugcccucuccug

SEQ ID NO: 3674037 - RNA, 13 nt, Human
ugcccucuccugg

SEQ ID NO: 3674038 - RNA, 17 nt, Human
ugcccucuccuuccuua

SEQ ID NO: 3674039 - RNA, 13 nt, Human
ugcccucugggcu

SEQ ID NO: 3674040 - RNA, 19 nt, Human
ugcccucugggcucugagu

SEQ ID NO: 3674041 - RNA, 11 nt, Human
ugcccucuguu

SEQ ID NO: 3674042 - RNA, 18 nt, Human
ugcccugaccaugcauuu

SEQ ID NO: 3674043 - RNA, 21 nt, Human
ugcccugaccucccagcccua

SEQ ID NO: 3674044 - RNA, 22 nt, Human
ugcccugaccucccagcccuau

SEQ ID NO: 3674045 - RNA, 22 nt, Human
ugcccugaguggaucuccaagg

SEQ ID NO: 3674046 - RNA, 16 nt, Human
ugcccugccaccuguc

SEQ ID NO: 3674047 - RNA, 20 nt, Human
ugcccugccaccugucuguc

SEQ ID NO: 3674048 - RNA, 21 nt, Human
ugcccugccaccugucugucu

SEQ ID NO: 3674049 - RNA, 21 nt, Human
gugcacaaaguggcauaaaaa

SEQ ID NO: 3674050 - RNA, 23 nt, Human
gugcacaaaguggcauaaaaaac

SEQ ID NO: 3674051 - RNA, 23 nt, Human
gugcacaagcuccaagcucccag

SEQ ID NO: 3674052 - RNA, 14 nt, Human
gugcacacaccaga

SEQ ID NO: 3674053 - RNA, 21 nt, Human
gugcacacaccagagcccacc

SEQ ID NO: 3674054 - RNA, 20 nt, Human
gugcacagacgucccuccac

SEQ ID NO: 3674055 - RNA, 14 nt, Human
gugcacagccccua

SEQ ID NO: 3674056 - RNA, 22 nt, Human
gugcacauauccaggcaccagg

SEQ ID NO: 3674057 - RNA, 18 nt, Human
gugcaccaccacacccgg

SEQ ID NO: 3674058 - RNA, 16 nt, Human
gugcaccaucccuuuu

SEQ ID NO: 3674059 - RNA, 23 nt, Human
gugcaccaucccuuuuugaagug

SEQ ID NO: 3674060 - RNA, 15 nt, Human
gugcacccacucugc

SEQ ID NO: 3674061 - RNA, 12 nt, Human
gugcaccugggc

SEQ ID NO: 3674062 - RNA, 18 nt, Human
gugcacgcaguggccuuc

SEQ ID NO: 3674063 - RNA, 23 nt, Human
gugcacguaaaguacuuguaguu

SEQ ID NO: 3674064 - RNA, 18 nt, Human
gugcacguggagagcugg

SEQ ID NO: 3674065 - RNA, 21 nt, Human
gugcacguggagagcuggugc

SEQ ID NO: 3674066 - RNA, 22 nt, Human
gugcacuaauguguaagacaaa

SEQ ID NO: 3674067 - RNA, 18 nt, Human
gugcacuggccccacccu

SEQ ID NO: 3674068 - RNA, 13 nt, Human
gugcacugucacu

SEQ ID NO: 3674069 - RNA, 23 nt, Human
gugcacugucacuuugcucuggg

SEQ ID NO: 3674070 - RNA, 20 nt, Human
gugcacuuggggcacaggga

SEQ ID NO: 3674071 - RNA, 19 nt, Human
gugcacuuucuaauguuuc

SEQ ID NO: 3674072 - RNA, 15 nt, Human
gugcacuuuguaaau

SEQ ID NO: 3674073 - RNA, 14 nt, Human
gugcagaaaacauu

SEQ ID NO: 3674074 - RNA, 16 nt, Human
gugcagaaaacauugu

SEQ ID NO: 3674075 - RNA, 17 nt, Human
gugcagaaaacauuguu

SEQ ID NO: 3674076 - RNA, 22 nt, Human
gugcagaauguaagugggccca

SEQ ID NO: 3674077 - RNA, 18 nt, Human
gugcagacaaucuucugu

SEQ ID NO: 3674078 - RNA, 16 nt, Human
gugcagacagaagucu

SEQ ID NO: 3674079 - RNA, 12 nt, Human
gugcagaggaag

SEQ ID NO: 3674080 - RNA, 13 nt, Human
gugcagaggcugu

SEQ ID NO: 3674081 - RNA, 17 nt, Human
gugcagaggcuguggcu

SEQ ID NO: 3674082 - RNA, 19 nt, Human
gugcagagguacccugggu

SEQ ID NO: 3674083 - RNA, 19 nt, Human
gugcagaugcaauuguuug

SEQ ID NO: 3674084 - RNA, 16 nt, Human
gugcagcaaccagagc

SEQ ID NO: 3674085 - RNA, 15 nt, Human
gugcagcauuucacu

SEQ ID NO: 3674086 - RNA, 12 nt, Human
gugcagccagag

SEQ ID NO: 3674087 - RNA, 14 nt, Human
gugcagccagaggc

SEQ ID NO: 3674088 - RNA, 21 nt, Human
gugcagcccguguggccccuu

SEQ ID NO: 3674089 - RNA, 21 nt, Human
gugcagccuguccugggcugg

SEQ ID NO: 3674090 - RNA, 13 nt, Human
gugcagcugauuu

SEQ ID NO: 3674091 - RNA, 16 nt, Human
gugcagcuucuguccu

SEQ ID NO: 3674092 - RNA, 18 nt, Human
gugcaggcuggccagccg

SEQ ID NO: 3674093 - RNA, 20 nt, Human
gugcaggcuggccagccgcu

SEQ ID NO: 3674094 - RNA, 23 nt, Human
gugcagggaggagguggcagccc

SEQ ID NO: 3674095 - RNA, 14 nt, Human
gugcagggaugugg

SEQ ID NO: 3674096 - RNA, 15 nt, Human
gugcaguaauagcac

SEQ ID NO: 3674097 - RNA, 12 nt, Human
gugcagucuggg

SEQ ID NO: 3674098 - RNA, 24 nt, Human
gugcaguggcgugaucucagcuca

SEQ ID NO: 3674099 - RNA, 20 nt, Human
gugcaguggugcgaucuggg

SEQ ID NO: 3674100 - RNA, 20 nt, Human
gugcaguucuaguuugcauu

SEQ ID NO: 3674101 - RNA, 15 nt, Human
gugcaguugacagca

SEQ ID NO: 3674102 - RNA, 19 nt, Human
gugcaguugacagcaggug

SEQ ID NO: 3674103 - RNA, 14 nt, Human
gugcauaccacuuu

SEQ ID NO: 3674104 - RNA, 19 nt, Human
gugcauagaacuggguaaa

SEQ ID NO: 3674105 - RNA, 20 nt, Human
gugcauaguuguagacaaag

SEQ ID NO: 3674106 - RNA, 15 nt, Human
gugcauaguuucuuu

SEQ ID NO: 3674107 - RNA, 21 nt, Human
gugcauauuccuuucuaucau

SEQ ID NO: 3674108 - RNA, 13 nt, Human
gugcauauuguac

SEQ ID NO: 3674109 - RNA, 12 nt, Human
gugcauccaaag

SEQ ID NO: 3674110 - RNA, 18 nt, Human
gugcauccgggggcagcu

SEQ ID NO: 3674111 - RNA, 13 nt, Human
gugcaugcucucu

SEQ ID NO: 3674112 - RNA, 21 nt, Human
gugcaugcucucugcagccag

SEQ ID NO: 3674113 - RNA, 20 nt, Human
gugcaugggacccacgaaac

SEQ ID NO: 3674114 - RNA, 15 nt, Human
gugcaugguggccag

SEQ ID NO: 3674115 - RNA, 16 nt, Human
gugcauguaugucuug

SEQ ID NO: 3674116 - RNA, 14 nt, Human
gugcauguccuuug

SEQ ID NO: 3674117 - RNA, 14 nt, Human
gugcauguguguau

SEQ ID NO: 3674118 - RNA, 18 nt, Human
gugcaugugugugcucag

SEQ ID NO: 3674119 - RNA, 19 nt, Human
gugcauguguguucaugca

SEQ ID NO: 3674120 - RNA, 23 nt, Human
gugcauuagcacagauuuuaauu

SEQ ID NO: 3674121 - RNA, 19 nt, Human
gugcauucuuuuaaaagac

SEQ ID NO: 3674122 - RNA, 23 nt, Human
gugcauucuuuuaaaagacaaga

SEQ ID NO: 3674123 - RNA, 20 nt, Human
uggccucuuuccucagccuu

SEQ ID NO: 3674124 - RNA, 14 nt, Human
uggccucuuugucu

SEQ ID NO: 3674125 - RNA, 17 nt, Human
uggccugacuuggggga

SEQ ID NO: 3674126 - RNA, 21 nt, Human
uggccugaugaccaauuuuaa

SEQ ID NO: 3674127 - RNA, 19 nt, Human
uggccugcaaacugggaac

SEQ ID NO: 3674128 - RNA, 23 nt, Human
uggccugcaaacugggaaccccu

SEQ ID NO: 3674129 - RNA, 23 nt, Human
uggccugcacggugggccuugcu

SEQ ID NO: 3674130 - RNA, 24 nt, Human
uggccugcacggugggccuugcug

SEQ ID NO: 3674131 - RNA, 14 nt, Human
uggccugcacuaau

SEQ ID NO: 3674132 - RNA, 16 nt, Human
uggccugcacuaauuu

SEQ ID NO: 3674133 - RNA, 21 nt, Human
uggccugcugggcucuccacc

SEQ ID NO: 3674134 - RNA, 12 nt, Human
uggccugcugug

SEQ ID NO: 3674135 - RNA, 12 nt, Human
uggccuggagca

SEQ ID NO: 3674136 - RNA, 18 nt, Human
uggccuggaggugggguu

SEQ ID NO: 3674137 - RNA, 14 nt, Human
uggccuggaucucc

SEQ ID NO: 3674138 - RNA, 12 nt, Human
uggccuggcaca

SEQ ID NO: 3674139 - RNA, 18 nt, Human
uggccuggcacacaucag

SEQ ID NO: 3674140 - RNA, 13 nt, Human
uggccuggccagg

SEQ ID NO: 3674141 - RNA, 17 nt, Human
uggccuggccaggagcu

SEQ ID NO: 3674142 - RNA, 20 nt, Human
uggccuggccagugcccuga

SEQ ID NO: 3674143 - RNA, 13 nt, Human
uggccuggcccug

SEQ ID NO: 3674144 - RNA, 13 nt, Human
uggccuggccggc

SEQ ID NO: 3674145 - RNA, 12 nt, Human
uggccuggcucc

SEQ ID NO: 3674146 - RNA, 21 nt, Human
uggccuguagaauagccugug

SEQ ID NO: 3674147 - RNA, 15 nt, Human
uggccuguagaguug

SEQ ID NO: 3674148 - RNA, 18 nt, Human
uggccuguagaguugcug

SEQ ID NO: 3674149 - RNA, 12 nt, Human
uggccugucuca

SEQ ID NO: 3674150 - RNA, 18 nt, Human
uggccugucucaucccca

SEQ ID NO: 3674151 - RNA, 20 nt, Human
uggccugucucauccccagg

SEQ ID NO: 3674152 - RNA, 21 nt, Human
uggccugugcgaucccacccg

SEQ ID NO: 3674153 - RNA, 19 nt, Human
uggccuguguucuuccugg

SEQ ID NO: 3674154 - RNA, 23 nt, Human
uggccuuccccagcaugcaccac

SEQ ID NO: 3674155 - RNA, 18 nt, Human
uggccuuccccagccucu

SEQ ID NO: 3674156 - RNA, 14 nt, Human
uggccuuccugccc

SEQ ID NO: 3674157 - RNA, 14 nt, Human
uggccuucggccuc

SEQ ID NO: 3674158 - RNA, 20 nt, Human
uggccuucggccuccauccu

SEQ ID NO: 3674159 - RNA, 23 nt, Human
uggccuuguaagacccuuauugc

SEQ ID NO: 3674160 - RNA, 19 nt, Human
uggccuuguucugucacca

SEQ ID NO: 3674161 - RNA, 22 nt, Human
uggccuuuauuaaaaacugagu

SEQ ID NO: 3674162 - RNA, 20 nt, Human
uggccuuucauauuuuagcu

SEQ ID NO: 3674163 - RNA, 16 nt, Human
uggccuuugcgcuccu

SEQ ID NO: 3674164 - RNA, 18 nt, Human
uggccuuuguaagugcag

SEQ ID NO: 3674165 - RNA, 19 nt, Human
uggccuuuuucauuuaucu

SEQ ID NO: 3674166 - RNA, 14 nt, Human
uggcgcacccuccc

SEQ ID NO: 3674167 - RNA, 16 nt, Human
uggcgcacccuccccu

SEQ ID NO: 3674168 - RNA, 12 nt, Human
uggcgcagccaa

SEQ ID NO: 3674169 - RNA, 21 nt, Human
uggcgcaggugggcuggacuu

SEQ ID NO: 3674170 - RNA, 17 nt, Human
uggcgcagugccucugg

SEQ ID NO: 3674171 - RNA, 15 nt, Human
uggcgccgucuccag

SEQ ID NO: 3674172 - RNA, 18 nt, Human
uggcgcuagaggccaugg

SEQ ID NO: 3674173 - RNA, 14 nt, Human
uggcgcugccccug

SEQ ID NO: 3674174 - RNA, 23 nt, Human
uggcgcugccccuggcagccccu

SEQ ID NO: 3674175 - RNA, 14 nt, Human
uggcggcagcagcc

SEQ ID NO: 3674176 - RNA, 21 nt, Human
uggcggccccaacucgggcuc

SEQ ID NO: 3674177 - RNA, 16 nt, Human
uggcggcuacucagca

SEQ ID NO: 3674178 - RNA, 22 nt, Human
uggcggcuacucagcagcccuc

SEQ ID NO: 3674179 - RNA, 17 nt, Human
uggcggggaggaggaaa

SEQ ID NO: 3674180 - RNA, 18 nt, Human
uggcggggggcccauugg

SEQ ID NO: 3674181 - RNA, 12 nt, Human
uggcgggugggg

SEQ ID NO: 3674182 - RNA, 15 nt, Human
uggcgggugggggug

SEQ ID NO: 3674183 - RNA, 13 nt, Human
uggcggugccugg

SEQ ID NO: 3674184 - RNA, 16 nt, Human
uggcguaaguacagag

SEQ ID NO: 3674185 - RNA, 17 nt, Human
uggcguaaguacagaga

SEQ ID NO: 3674186 - RNA, 18 nt, Human
uggcguaaguacagagaa

SEQ ID NO: 3674187 - RNA, 20 nt, Human
uggcguaaguacagagaagc

SEQ ID NO: 3674188 - RNA, 19 nt, Human
uggcguagagggugcugcc

SEQ ID NO: 3674189 - RNA, 18 nt, Human
uggcguaggcuacagaga

SEQ ID NO: 3674190 - RNA, 19 nt, Human
uggcguaggcuacagagaa

SEQ ID NO: 3674191 - RNA, 13 nt, Human
uggcgucugucuu

SEQ ID NO: 3674192 - RNA, 20 nt, Human
uggcgucugucuucaagggc

SEQ ID NO: 3674193 - RNA, 12 nt, Human
uggcgugacccg

SEQ ID NO: 3674194 - RNA, 18 nt, Human
uggcguggauuaaacuua

SEQ ID NO: 3674195 - RNA, 20 nt, Human
uggcuaaaugccuaauaaac

SEQ ID NO: 3674196 - RNA, 14 nt, Human
uggcuaaauucaug

SEQ ID NO: 3674197 - RNA, 17 nt, Human
uggcuaacuuacaaaga

SEQ ID NO: 3674198 - RNA, 12 nt, Human
uggcuaagaccc

SEQ ID NO: 3674199 - RNA, 15 nt, Human
uggcuaagagugucc

SEQ ID NO: 3674200 - RNA, 20 nt, Human
uggcuaagcuuaaaaaaaac

SEQ ID NO: 3674201 - RNA, 14 nt, Human
uggcuaaggcacca

SEQ ID NO: 3674202 - RNA, 19 nt, Human
uggcuacgccucuucuguc

SEQ ID NO: 3674203 - RNA, 22 nt, Human
uggcuacgccucuucugucccu

SEQ ID NO: 3674204 - RNA, 22 nt, Human
uggcuacucugugccagagccu

SEQ ID NO: 3674205 - RNA, 23 nt, Human
uggcuacucugugccagagccug

SEQ ID NO: 3674206 - RNA, 20 nt, Human
uggcuagaauauccuacuuc

SEQ ID NO: 3674207 - RNA, 23 nt, Human
uggcuagauuaaccuucucuguc

SEQ ID NO: 3674208 - RNA, 18 nt, Human
uggcuagucaagcuccuc

SEQ ID NO: 3674209 - RNA, 17 nt, Human
uggcuauagaugucuuu

SEQ ID NO: 3674210 - RNA, 18 nt, Human
uggcuauagaugucuuuu

SEQ ID NO: 3674211 - RNA, 23 nt, Human
uggcuauaggugcuacaaaaaca

SEQ ID NO: 3674212 - RNA, 14 nt, Human
uggcuaugcauuug

SEQ ID NO: 3674213 - RNA, 20 nt, Human
ugccucccugacccugcaga

SEQ ID NO: 3674214 - RNA, 16 nt, Human
ugccucccuucaugca

SEQ ID NO: 3674215 - RNA, 23 nt, Human
ugccuccguccccugcccaugcu

SEQ ID NO: 3674216 - RNA, 19 nt, Human
ugccuccucacccccagcu

SEQ ID NO: 3674217 - RNA, 20 nt, Human
ugccuccugccggcuccuug

SEQ ID NO: 3674218 - RNA, 17 nt, Human
ugccuccuguguacugu

SEQ ID NO: 3674219 - RNA, 18 nt, Human
ugccuccuguguacugug

SEQ ID NO: 3674220 - RNA, 21 nt, Human
ugccuccuguguacuguguca

SEQ ID NO: 3674221 - RNA, 20 nt, Human
ugccuccuuugugaggaagc

SEQ ID NO: 3674222 - RNA, 21 nt, Human
ugccuccuuugugaggaagcc

SEQ ID NO: 3674223 - RNA, 24 nt, Human
ugccucgacacgugggcuccccuc

SEQ ID NO: 3674224 - RNA, 18 nt, Human
ugccucggauccccuucc

SEQ ID NO: 3674225 - RNA, 15 nt, Human
ugccucggcuccugc

SEQ ID NO: 3674226 - RNA, 17 nt, Human
ugccucggcuccugcug

SEQ ID NO: 3674227 - RNA, 19 nt, Human
ugccucggcuccugcugca

SEQ ID NO: 3674228 - RNA, 21 nt, Human
ugccucggcuccugcugcacc

SEQ ID NO: 3674229 - RNA, 16 nt, Human
ugccucggcuggcucc

SEQ ID NO: 3674230 - RNA, 20 nt, Human
ugccucggcuggcuccccug

SEQ ID NO: 3674231 - RNA, 21 nt, Human
ugccucggcuggcuccccugc

SEQ ID NO: 3674232 - RNA, 24 nt, Human
ugccucggcuuuucucagcuggau

SEQ ID NO: 3674233 - RNA, 24 nt, Human
ugccucgggaaccucacucuugcc

SEQ ID NO: 3674234 - RNA, 17 nt, Human
ugccucuaccugacacu

SEQ ID NO: 3674235 - RNA, 19 nt, Human
ugccucuacugggaaggcu

SEQ ID NO: 3674236 - RNA, 14 nt, Human
ugccucucacagcu

SEQ ID NO: 3674237 - RNA, 21 nt, Human
ugccucucacagcugaguugu

SEQ ID NO: 3674238 - RNA, 17 nt, Human
ugccucucccaggcagg

SEQ ID NO: 3674239 - RNA, 12 nt, Human
ugccucucccuc

SEQ ID NO: 3674240 - RNA, 20 nt, Human
ugccucucccugcugcuccu

SEQ ID NO: 3674241 - RNA, 21 nt, Human
ugccucuccgccccugagccc

SEQ ID NO: 3674242 - RNA, 16 nt, Human
ugccucuccuuuguau

SEQ ID NO: 3674243 - RNA, 17 nt, Human
ugccucuccuuuguaua

SEQ ID NO: 3674244 - RNA, 9 nt, Human
ugccucucu

SEQ ID NO: 3674245 - RNA, 12 nt, Human
ugccucucuaca

SEQ ID NO: 3674246 - RNA, 15 nt, Human
ugccucucucaggcc

SEQ ID NO: 3674247 - RNA, 15 nt, Human
ugccucucugcaggu

SEQ ID NO: 3674248 - RNA, 16 nt, Human
ugccucucugcagguc

SEQ ID NO: 3674249 - RNA, 19 nt, Human
ugccucucugcaggucccu

SEQ ID NO: 3674250 - RNA, 20 nt, Human
ugccucucugcaggucccua

SEQ ID NO: 3674251 - RNA, 12 nt, Human
ugccucucuguu

SEQ ID NO: 3674252 - RNA, 20 nt, Human
ugccucugacacacagcucu

SEQ ID NO: 3674253 - RNA, 13 nt, Human
ugccucugaggcc

SEQ ID NO: 3674254 - RNA, 19 nt, Human
ugccucugaggccagccug

SEQ ID NO: 3674255 - RNA, 21 nt, Human
ugccucugauaugggacugag

SEQ ID NO: 3674256 - RNA, 19 nt, Human
ugccucugauguauuuugu

SEQ ID NO: 3674257 - RNA, 22 nt, Human
ugccucugauguauuuugugag

SEQ ID NO: 3674258 - RNA, 21 nt, Human
ugccucugccaaaggauguga

SEQ ID NO: 3674259 - RNA, 12 nt, Human
ugccucugccac

SEQ ID NO: 3674260 - RNA, 16 nt, Human
ugccucugccugcauu

SEQ ID NO: 3674261 - RNA, 13 nt, Human
ugccucugccuua

SEQ ID NO: 3674262 - RNA, 15 nt, Human
ugccucuguccccuu

SEQ ID NO: 3674263 - RNA, 16 nt, Human
ugccucuguccccuuc

SEQ ID NO: 3674264 - RNA, 17 nt, Human
ugccucuguccccuucu

SEQ ID NO: 3674265 - RNA, 20 nt, Human
ugccucuguccccuucucuc

SEQ ID NO: 3674266 - RNA, 13 nt, Human
ugccucugugcug

SEQ ID NO: 3674267 - RNA, 11 nt, Human
uggggcugaac

SEQ ID NO: 3674268 - RNA, 20 nt, Human
uggggcugaagguugaagag

SEQ ID NO: 3674269 - RNA, 22 nt, Human
uggggcugaucucagggaagcc

SEQ ID NO: 3674270 - RNA, 14 nt, Human
uggggcugauugua

SEQ ID NO: 3674271 - RNA, 14 nt, Human
uggggcuggcacaa

SEQ ID NO: 3674272 - RNA, 14 nt, Human
uggggcuggccucc

SEQ ID NO: 3674273 - RNA, 16 nt, Human
uggggcugggcagcua

SEQ ID NO: 3674274 - RNA, 19 nt, Human
uggggcuggggaaggaagc

SEQ ID NO: 3674275 - RNA, 13 nt, Human
uggggcuggggga

SEQ ID NO: 3674276 - RNA, 16 nt, Human
uggggcugggggaugg

SEQ ID NO: 3674277 - RNA, 15 nt, Human
uggggcuucuccuga

SEQ ID NO: 3674278 - RNA, 16 nt, Human
uggggcuucuccugac

SEQ ID NO: 3674279 - RNA, 13 nt, Human
uggggcuucuugg

SEQ ID NO: 3674280 - RNA, 16 nt, Human
uggggcuuggcgugga

SEQ ID NO: 3674281 - RNA, 22 nt, Human
uggggcuuucguccacagcuuc

SEQ ID NO: 3674282 - RNA, 20 nt, Human
ugcugacggccagggagaag

SEQ ID NO: 3674283 - RNA, 18 nt, Human
ugcugacuggcuucagca

SEQ ID NO: 3674284 - RNA, 15 nt, Human
ugcugacuguacucc

SEQ ID NO: 3674285 - RNA, 14 nt, Human
ugcugacuguagcu

SEQ ID NO: 3674286 - RNA, 22 nt, Human
ugcugacuguagcuuuggaagu

SEQ ID NO: 3674287 - RNA, 17 nt, Human
ugcugacuguuuucucu

SEQ ID NO: 3674288 - RNA, 14 nt, Human
ugcugacuuagaau

SEQ ID NO: 3674289 - RNA, 15 nt, Human
ugcugacuuagaauc

SEQ ID NO: 3674290 - RNA, 17 nt, Human
ugcugagaaccuggccu

SEQ ID NO: 3674291 - RNA, 18 nt, Human
ugcugagaaccuggccuu

SEQ ID NO: 3674292 - RNA, 20 nt, Human
ugcugagaaccuggccuuca

SEQ ID NO: 3674293 - RNA, 21 nt, Human
ugcugagaaccuggccuucag

SEQ ID NO: 3674294 - RNA, 17 nt, Human
ugcugagaagcuuuuga

SEQ ID NO: 3674295 - RNA, 17 nt, Human
ugcugagagacccaagg

SEQ ID NO: 3674296 - RNA, 19 nt, Human
ugcugagauacauacagaa

SEQ ID NO: 3674297 - RNA, 20 nt, Human
ugcugagauacauacagaau

SEQ ID NO: 3674298 - RNA, 19 nt, Human
ugcugagccucacagcagu

SEQ ID NO: 3674299 - RNA, 17 nt, Human
ugcugagccucugcucc

SEQ ID NO: 3674300 - RNA, 20 nt, Human
ugcugagccucugcucccca

SEQ ID NO: 3674301 - RNA, 14 nt, Human
ugcugagcucugag

SEQ ID NO: 3674302 - RNA, 17 nt, Human
ugcugaggccuccagcu

SEQ ID NO: 3674303 - RNA, 16 nt, Human
ugcugaggccugggcc

SEQ ID NO: 3674304 - RNA, 16 nt, Human
ugcugaggcucugacc

SEQ ID NO: 3674305 - RNA, 17 nt, Human
ugcugagggaccagcca

SEQ ID NO: 3674306 - RNA, 22 nt, Human
ugcugaggguguuucuuccugc

SEQ ID NO: 3674307 - RNA, 17 nt, Human
ugcugaggguuugaaua

SEQ ID NO: 3674308 - RNA, 22 nt, Human
ugcugagucccaggcugagccu

SEQ ID NO: 3674309 - RNA, 16 nt, Human
ugcugagucucccaag

SEQ ID NO: 3674310 - RNA, 16 nt, Human
ugcugagucuguucug

SEQ ID NO: 3674311 - RNA, 15 nt, Human
ugcugaguuugugcu

SEQ ID NO: 3674312 - RNA, 18 nt, Human
ugcugauauuuaaauuca

SEQ ID NO: 3674313 - RNA, 15 nt, Human
ugcugauauuuucuc

SEQ ID NO: 3674314 - RNA, 23 nt, Human
ugcugaucaucgccagaggugcu

SEQ ID NO: 3674315 - RNA, 16 nt, Human
ugcugaucgccuuccc

SEQ ID NO: 3674316 - RNA, 14 nt, Human
ugcugaugaaucac

SEQ ID NO: 3674317 - RNA, 16 nt, Human
ugcugaugcucauggu

SEQ ID NO: 3674318 - RNA, 16 nt, Human
ugcugauggagccuuc

SEQ ID NO: 3674319 - RNA, 14 nt, Human
ugcugauggucugg

SEQ ID NO: 3674320 - RNA, 19 nt, Human
ugcugauggucuggucuau

SEQ ID NO: 3674321 - RNA, 15 nt, Human
ugcugauggugcaau

SEQ ID NO: 3674322 - RNA, 20 nt, Human
ugcugauggugcaaugaccu

SEQ ID NO: 3674323 - RNA, 17 nt, Human
ugcugauguggcaacug

SEQ ID NO: 3674324 - RNA, 14 nt, Human
ugcugauguucagu

SEQ ID NO: 3674325 - RNA, 16 nt, Human
ugcugauguucagugu

SEQ ID NO: 3674326 - RNA, 21 nt, Human
ugcugauguucaguguaauuu

SEQ ID NO: 3674327 - RNA, 14 nt, Human
ugcugauuuaaaca

SEQ ID NO: 3674328 - RNA, 12 nt, Human
ugcugauuuuaa

SEQ ID NO: 3674329 - RNA, 14 nt, Human
ugcugauuuuaaug

SEQ ID NO: 3674330 - RNA, 16 nt, Human
ugcugauuuuaaugga

SEQ ID NO: 3674331 - RNA, 18 nt, Human
ugcugauuuuauucuuga

SEQ ID NO: 3674332 - RNA, 15 nt, Human
ugcugcaaggccuuu

SEQ ID NO: 3674333 - RNA, 20 nt, Human
ugcugcaaggccuuucugug

SEQ ID NO: 3674334 - RNA, 23 nt, Human
ugcugcaaggccuuucugugugu

SEQ ID NO: 3674335 - RNA, 18 nt, Human
ugcugcaccaacccagcc

SEQ ID NO: 3674336 - RNA, 20 nt, Human
ugcugcaccaacccagccgc

SEQ ID NO: 3674337 - RNA, 22 nt, Human
ugcugcaccaacccagccgcug

SEQ ID NO: 3674338 - RNA, 14 nt, Human
ugcugcacuaauug

SEQ ID NO: 3674339 - RNA, 21 nt, Human
ugcugcagggcuuuaaaauuc

SEQ ID NO: 3674340 - RNA, 17 nt, Human
ugcugcaggggcucugg

SEQ ID NO: 3674341 - RNA, 18 nt, Human
ugcugcaggggcucugga

SEQ ID NO: 3674342 - RNA, 18 nt, Human
ugcugcaugcccucucag

SEQ ID NO: 3674343 - RNA, 14 nt, Human
ugcugcauggcagg

SEQ ID NO: 3674344 - RNA, 21 nt, Human
ugcugcauggcagggggcugc

SEQ ID NO: 3674345 - RNA, 17 nt, Human
ugcugcauuuaaaagau

SEQ ID NO: 3674346 - RNA, 17 nt, Human
ugcugccaaccauaccu

SEQ ID NO: 3674347 - RNA, 16 nt, Human
ugcugccaauauccua

SEQ ID NO: 3674348 - RNA, 22 nt, Human
ugcugccaauauccuaauaaaa

SEQ ID NO: 3674349 - RNA, 20 nt, Human
ugcugccacaaccagccagg

SEQ ID NO: 3674350 - RNA, 22 nt, Human
ugcugccacacuucaggcucuu

SEQ ID NO: 3674351 - RNA, 17 nt, Human
ugcugccaguaccagcc

SEQ ID NO: 3674352 - RNA, 20 nt, Human
ugcugccaguaccagcccca

SEQ ID NO: 3674353 - RNA, 13 nt, Human
ugcugccauccag

SEQ ID NO: 3674354 - RNA, 20 nt, Human
ugcugccauuugauuuuucu

SEQ ID NO: 3674355 - RNA, 16 nt, Human
ugcugcccagccucca

SEQ ID NO: 3674356 - RNA, 17 nt, Human
ugcugcccauguuucaa

SEQ ID NO: 3674357 - RNA, 18 nt, Human
ugcugccccaucagugcu

SEQ ID NO: 3674358 - RNA, 18 nt, Human
ugcugccccaugaagcca

SEQ ID NO: 3674359 - RNA, 20 nt, Human
ugcugccccaugaagccaca

SEQ ID NO: 3674360 - RNA, 17 nt, Human
ugcugcccgcucugcag

SEQ ID NO: 3674361 - RNA, 17 nt, Human
ugcugcccgucuucagc

SEQ ID NO: 3674362 - RNA, 21 nt, Human
ugcugcccgucuucagccuag

SEQ ID NO: 3674363 - RNA, 22 nt, Human
ugcugcccgucuucagccuagc

SEQ ID NO: 3674364 - RNA, 22 nt, Human
ugcugcccugaagaauggcgcc

SEQ ID NO: 3674365 - RNA, 12 nt, Human
ugcugcccugcc

SEQ ID NO: 3674366 - RNA, 13 nt, Human
ugcugcccugccc

SEQ ID NO: 3674367 - RNA, 12 nt, Human
ugcugcccugug

SEQ ID NO: 3674368 - RNA, 15 nt, Human
ugcugcccugugagu

SEQ ID NO: 3674369 - RNA, 19 nt, Human
ugcugccgccccacccaga

SEQ ID NO: 3674370 - RNA, 23 nt, Human
ugcugccgccccacccagauggg

SEQ ID NO: 3674371 - RNA, 17 nt, Human
ugcugccgccucccagc

SEQ ID NO: 3674372 - RNA, 21 nt, Human
ugcugccgccucccagccugg

SEQ ID NO: 3674373 - RNA, 13 nt, Human
ugcugccuaggcu

SEQ ID NO: 3674374 - RNA, 18 nt, Human
ugcugccuaggcugaccu

SEQ ID NO: 3674375 - RNA, 12 nt, Human
ugcugccucccc

SEQ ID NO: 3674376 - RNA, 14 nt, Human
ugcugccuccccaa

SEQ ID NO: 3674377 - RNA, 22 nt, Human
ugcugccucggauccccuuccu

SEQ ID NO: 3674378 - RNA, 13 nt, Human
ugcugccugccug

SEQ ID NO: 3674379 - RNA, 20 nt, Human
ugcugccuucugacggcccu

SEQ ID NO: 3674380 - RNA, 20 nt, Human
ugcugcggagcaagaggagg

SEQ ID NO: 3674381 - RNA, 23 nt, Human
ugcugcgucauuacagggcacag

SEQ ID NO: 3674382 - RNA, 14 nt, Human
ugcugcgucuccca

SEQ ID NO: 3674383 - RNA, 15 nt, Human
ugcugcgucucccau

SEQ ID NO: 3674384 - RNA, 14 nt, Human
ugcugcgugccugu

SEQ ID NO: 3674385 - RNA, 21 nt, Human
ugcugcuaaucuucagggcac

SEQ ID NO: 3674386 - RNA, 21 nt, Human
ugcugcuaauucuuugcaaaa

SEQ ID NO: 3674387 - RNA, 17 nt, Human
ugcugcuacccucccug

SEQ ID NO: 3674388 - RNA, 13 nt, Human
ugcugcuagaacu

SEQ ID NO: 3674389 - RNA, 16 nt, Human
ugcugcuagaacuuuu

SEQ ID NO: 3674390 - RNA, 17 nt, Human
ugcugcuagaacuuuuu

SEQ ID NO: 3674391 - RNA, 20 nt, Human
ugcugcuagaacuuuuuuaa

SEQ ID NO: 3674392 - RNA, 19 nt, Human
ugcugcuauccugccaaaa

SEQ ID NO: 3674393 - RNA, 19 nt, Human
ugcugcuauuuuacugucu

SEQ ID NO: 3674394 - RNA, 22 nt, Human
ugcugcuauuuuacugucuuaa

SEQ ID NO: 3674395 - RNA, 13 nt, Human
ugcugcucccuca

SEQ ID NO: 3674396 - RNA, 18 nt, Human
ugcugcucuuggcuggac

SEQ ID NO: 3674397 - RNA, 19 nt, Human
ugcugcucuuggcuggacc

SEQ ID NO: 3674398 - RNA, 11 nt, Human
ugcugcugaga

SEQ ID NO: 3674399 - RNA, 12 nt, Human
ugcugcugcccc

SEQ ID NO: 3674400 - RNA, 16 nt, Human
ugcugcugccuggcca

SEQ ID NO: 3674401 - RNA, 19 nt, Human
ugcugcugccuggccacug

SEQ ID NO: 3674402 - RNA, 13 nt, Human
ugcugcuggacag

SEQ ID NO: 3674403 - RNA, 12 nt, Human
ugcugcuggcca

SEQ ID NO: 3674404 - RNA, 14 nt, Human
ugcugcuggccaaa

SEQ ID NO: 3674405 - RNA, 13 nt, Human
ugcugcuggcugg

SEQ ID NO: 3674406 - RNA, 14 nt, Human
ugcugcugggcuca

SEQ ID NO: 3674407 - RNA, 16 nt, Human
ugcugcuggugcacag

SEQ ID NO: 3674408 - RNA, 18 nt, Human
ugcugcuggugcacagcc

SEQ ID NO: 3674409 - RNA, 14 nt, Human
ugcugcugugugcu

SEQ ID NO: 3674410 - RNA, 20 nt, Human
ugcugcuuagacauaacaaa

SEQ ID NO: 3674411 - RNA, 15 nt, Human
ugcugcuucucccag

SEQ ID NO: 3674412 - RNA, 22 nt, Human
ugguucugagauggcucccagg

SEQ ID NO: 3674413 - RNA, 15 nt, Human
ugguucugcuucaau

SEQ ID NO: 3674414 - RNA, 22 nt, Human
ugguucuugaggggaccaggag

SEQ ID NO: 3674415 - RNA, 23 nt, Human
ugguucuugaggggaccaggagu

SEQ ID NO: 3674416 - RNA, 12 nt, Human
ugguugaauaug

SEQ ID NO: 3674417 - RNA, 16 nt, Human
ugguugagugggggga

SEQ ID NO: 3674418 - RNA, 22 nt, Human
ugguugaguucagguagcugcc

SEQ ID NO: 3674419 - RNA, 18 nt, Human
ugguugccuuaaagaaag

SEQ ID NO: 3674420 - RNA, 18 nt, Human
ugguuggcugggaaaucg

SEQ ID NO: 3674421 - RNA, 23 nt, Human
ugguugggaaugaggaaaauucu

SEQ ID NO: 3674422 - RNA, 21 nt, Human
ugguugggacccaguggcagg

SEQ ID NO: 3674423 - RNA, 22 nt, Human
ugguugguaacacaaauuuuca

SEQ ID NO: 3674424 - RNA, 12 nt, Human
ugguuguauuag

SEQ ID NO: 3674425 - RNA, 23 nt, Human
ugguugucauuuuugcaguagag

SEQ ID NO: 3674426 - RNA, 20 nt, Human
ugguuguguguccccuugca

SEQ ID NO: 3674427 - RNA, 17 nt, Human
ugguuguuucuguucca

SEQ ID NO: 3674428 - RNA, 15 nt, Human
ugguuguuucuucca

SEQ ID NO: 3674429 - RNA, 20 nt, Human
ugguuuaaaaauacauguuc

SEQ ID NO: 3674430 - RNA, 18 nt, Human
ugguuuaaaagaaaaaau

SEQ ID NO: 3674431 - RNA, 18 nt, Human
ugguuuaacuucugccug

SEQ ID NO: 3674432 - RNA, 15 nt, Human
ugguuuaauuuaaag

SEQ ID NO: 3674433 - RNA, 19 nt, Human
ugguuuacaggcccugcuc

SEQ ID NO: 3674434 - RNA, 20 nt, Human
ugguuuacaggcccugcucc

SEQ ID NO: 3674435 - RNA, 14 nt, Human
ugguuuacuuucaa

SEQ ID NO: 3674436 - RNA, 16 nt, Human
ugguuuacuuucaaau

SEQ ID NO: 3674437 - RNA, 11 nt, Human
ugguuuauaga

SEQ ID NO: 3674438 - RNA, 21 nt, Human
ugguuuauagagggccaagac

SEQ ID NO: 3674439 - RNA, 17 nt, Human
ugguuuauauauuuaaa

SEQ ID NO: 3674440 - RNA, 20 nt, Human
ugguuuauauuuuuucaguu

SEQ ID NO: 3674441 - RNA, 19 nt, Human
ugguuuaucagcaaaaaag

SEQ ID NO: 3674442 - RNA, 11 nt, Human
ugguuuauguc

SEQ ID NO: 3674443 - RNA, 16 nt, Human
ugguuucaaagauuca

SEQ ID NO: 3674444 - RNA, 13 nt, Human
ugguuucagcacu

SEQ ID NO: 3674445 - RNA, 22 nt, Human
ugguuucauaacuuccuguacu

SEQ ID NO: 3674446 - RNA, 23 nt, Human
ugguuuccaaggagcugagaaua

SEQ ID NO: 3674447 - RNA, 20 nt, Human
ugguuuccacgaugaaaaac

SEQ ID NO: 3674448 - RNA, 18 nt, Human
ugguuuccagucaugagc

SEQ ID NO: 3674449 - RNA, 18 nt, Human
ugguuucccaagagcuac

SEQ ID NO: 3674450 - RNA, 17 nt, Human
ugguuucccccuucuac

SEQ ID NO: 3674451 - RNA, 14 nt, Human
ugguuuccugcccu

SEQ ID NO: 3674452 - RNA, 15 nt, Human
ugguuuccugcccug

SEQ ID NO: 3674453 - RNA, 13 nt, Human
ugguuuccuuccu

SEQ ID NO: 3674454 - RNA, 16 nt, Human
ugguuucuagacuugu

SEQ ID NO: 3674455 - RNA, 21 nt, Human
ugguuucucucuacagugcca

SEQ ID NO: 3674456 - RNA, 14 nt, Human
ugguuucucuucuc

SEQ ID NO: 3674457 - RNA, 13 nt, Human
ugguuugagauug

SEQ ID NO: 3674458 - RNA, 20 nt, Human
ugguuuggaauauuaaaaaa

SEQ ID NO: 3674459 - RNA, 22 nt, Human
ugguuuggugcuuuuuauaaaa

SEQ ID NO: 3674460 - RNA, 15 nt, Human
ugguuuguucccugu

SEQ ID NO: 3674461 - RNA, 20 nt, Human
ugguuuuaacaacugugcuu

SEQ ID NO: 3674462 - RNA, 18 nt, Human
ugguuuuaguugcaacuu

SEQ ID NO: 3674463 - RNA, 15 nt, Human
ugguuuuaugaugac

SEQ ID NO: 3674464 - RNA, 19 nt, Human
ugguuuucaaccucuagaa

SEQ ID NO: 3674465 - RNA, 21 nt, Human
ugguuuucaaccucuagaauu

SEQ ID NO: 3674466 - RNA, 14 nt, Human
ugguuuuccccucc

SEQ ID NO: 3674467 - RNA, 21 nt, Human
ugguuuuccccucccuggguu

SEQ ID NO: 3674468 - RNA, 13 nt, Human
ugguuuuccugua

SEQ ID NO: 3674469 - RNA, 20 nt, Human
ugguuuucuccaagagcuac

SEQ ID NO: 3674470 - RNA, 16 nt, Human
ugguuuucuguucuuu

SEQ ID NO: 3674471 - RNA, 15 nt, Human
ugguuuucuugugug

SEQ ID NO: 3674472 - RNA, 19 nt, Human
ugguuuucuuuugccauga

SEQ ID NO: 3674473 - RNA, 22 nt, Human
ugguuuugugccaucuguagcu

SEQ ID NO: 3674474 - RNA, 17 nt, Human
ugguuuuguuccccucc

SEQ ID NO: 3674475 - RNA, 23 nt, Human
ugguuuuuaaaaaacugcugacu

SEQ ID NO: 3674476 - RNA, 20 nt, Human
ugguuuuuaaauuuuguaau

SEQ ID NO: 3674477 - RNA, 18 nt, Human
ugguuuuuacugcucuga

SEQ ID NO: 3674478 - RNA, 21 nt, Human
ugguuuuuacugcucugagaa

SEQ ID NO: 3674479 - RNA, 23 nt, Human
ugguuuuuuuuuuuuuuuuggcu

SEQ ID NO: 3674480 - RNA, 19 nt, Human
uguaaaaaaaaaugccuuu

SEQ ID NO: 3674481 - RNA, 17 nt, Human
uguaaaaaaugugugua

SEQ ID NO: 3674482 - RNA, 20 nt, Human
uguaaaaacagcauugcuuu

SEQ ID NO: 3674483 - RNA, 14 nt, Human
uguaaaaacugugg

SEQ ID NO: 3674484 - RNA, 13 nt, Human
uguaaaaagaaaa

SEQ ID NO: 3674485 - RNA, 22 nt, Human
uguaaaaagagagaaaacuuau

SEQ ID NO: 3674486 - RNA, 20 nt, Human
uguaaaaaggaauaugaaag

SEQ ID NO: 3674487 - RNA, 15 nt, Human
uggaaccuugcuguc

SEQ ID NO: 3674488 - RNA, 23 nt, Human
uggaaccuugcuguccugaucug

SEQ ID NO: 3674489 - RNA, 16 nt, Human
uggaacgcguugaaau

SEQ ID NO: 3674490 - RNA, 20 nt, Human
uggaacggugaaggugacag

SEQ ID NO: 3674491 - RNA, 14 nt, Human
uggaacuaauaaau

SEQ ID NO: 3674492 - RNA, 16 nt, Human
uggaacucuagggaua

SEQ ID NO: 3674493 - RNA, 22 nt, Human
uggaacucuaucugggccuggg

SEQ ID NO: 3674494 - RNA, 23 nt, Human
uggaacucuaucugggccugggc

SEQ ID NO: 3674495 - RNA, 14 nt, Human
uggaacucucgagc

SEQ ID NO: 3674496 - RNA, 11 nt, Human
uggaacucuug

SEQ ID NO: 3674497 - RNA, 20 nt, Human
uggaacugaagggggcggcc

SEQ ID NO: 3674498 - RNA, 20 nt, Human
uggaacugcugccacugagg

SEQ ID NO: 3674499 - RNA, 20 nt, Human
uggaacuggaauccuuucag

SEQ ID NO: 3674500 - RNA, 16 nt, Human
uggaacuggaggcagg

SEQ ID NO: 3674501 - RNA, 17 nt, Human
uggaacuggaggcaggg

SEQ ID NO: 3674502 - RNA, 13 nt, Human
uggaacuguuucc

SEQ ID NO: 3674503 - RNA, 15 nt, Human
uggaacuguuuccuu

SEQ ID NO: 3674504 - RNA, 15 nt, Human
uggaacuucuaauau

SEQ ID NO: 3674505 - RNA, 22 nt, Human
uggaacuugccugccuuuccau

SEQ ID NO: 3674506 - RNA, 22 nt, Human
uggaagaaaaugguuuauuuug

SEQ ID NO: 3674507 - RNA, 16 nt, Human
uggaagaacaggccuc

SEQ ID NO: 3674508 - RNA, 15 nt, Human
uggaagaagagggag

SEQ ID NO: 3674509 - RNA, 15 nt, Human
uggaagaagggagaa

SEQ ID NO: 3674510 - RNA, 17 nt, Human
uggaagaagggagaaga

SEQ ID NO: 3674511 - RNA, 19 nt, Human
uggaagaagggagaagaaa

SEQ ID NO: 3674512 - RNA, 16 nt, Human
uggaagaaggggcagg

SEQ ID NO: 3674513 - RNA, 18 nt, Human
uggaagacaaaauguuuu

SEQ ID NO: 3674514 - RNA, 23 nt, Human
uggaagacagagaccuccugccu

SEQ ID NO: 3674515 - RNA, 17 nt, Human
uggaagaccccacccaa

SEQ ID NO: 3674516 - RNA, 23 nt, Human
uggaagagagaaagcauauugac

SEQ ID NO: 3674517 - RNA, 17 nt, Human
uggaagagcccagucug

SEQ ID NO: 3674518 - RNA, 14 nt, Human
uggaagauagcugu

SEQ ID NO: 3674519 - RNA, 16 nt, Human
uggaagauagcuguga

SEQ ID NO: 3674520 - RNA, 14 nt, Human
uggaagauccugug

SEQ ID NO: 3674521 - RNA, 15 nt, Human
uggaagauccuguga

SEQ ID NO: 3674522 - RNA, 23 nt, Human
uggaagauggggaccagcagccc

SEQ ID NO: 3674523 - RNA, 14 nt, Human
uggaagauucagcu

SEQ ID NO: 3674524 - RNA, 22 nt, Human
uggaagauuugcccauuuacac

SEQ ID NO: 3674525 - RNA, 23 nt, Human
uggaagauuugcccauuuacacu

SEQ ID NO: 3674526 - RNA, 18 nt, Human
uggaagcaacaggaauca

SEQ ID NO: 3674527 - RNA, 22 nt, Human
uggaagcacaccaaucuuacuu

SEQ ID NO: 3674528 - RNA, 16 nt, Human
uggaagcacagcuuca

SEQ ID NO: 3674529 - RNA, 18 nt, Human
uggaagcagugcccaggu

SEQ ID NO: 3674530 - RNA, 19 nt, Human
uggaagcagugcccaggug

SEQ ID NO: 3674531 - RNA, 20 nt, Human
uggaagccccugggcccagu

SEQ ID NO: 3674532 - RNA, 17 nt, Human
uggaagccggagggugu

SEQ ID NO: 3674533 - RNA, 19 nt, Human
uggaagcuagacacaugaa

SEQ ID NO: 3674534 - RNA, 14 nt, Human
uggaagcuagcucc

SEQ ID NO: 3674535 - RNA, 20 nt, Human
uggaagcuagcuccccuccu

SEQ ID NO: 3674536 - RNA, 14 nt, Human
uggaagcucuucuu

SEQ ID NO: 3674537 - RNA, 18 nt, Human
uggaagcugcccugccca

SEQ ID NO: 3674538 - RNA, 15 nt, Human
uggaagcuguguccu

SEQ ID NO: 3674539 - RNA, 16 nt, Human
uggaagcuguguccuu

SEQ ID NO: 3674540 - RNA, 20 nt, Human
uggaagcuguuuggaaaaga

SEQ ID NO: 3674541 - RNA, 19 nt, Human
uggaaggaccacauuuuau

SEQ ID NO: 3674542 - RNA, 22 nt, Human
uggaaggaccacauuuuauauu

SEQ ID NO: 3674543 - RNA, 16 nt, Human
uggaaggagacacaga

SEQ ID NO: 3674544 - RNA, 17 nt, Human
uggaaggagacacagau

SEQ ID NO: 3674545 - RNA, 20 nt, Human
uggaaggagacacagauguu

SEQ ID NO: 3674546 - RNA, 12 nt, Human
uggaaggagcag

SEQ ID NO: 3674547 - RNA, 20 nt, Human
uggaaggcaagauugugucc

SEQ ID NO: 3674548 - RNA, 19 nt, Human
uggaaggcaagccaggcuc

SEQ ID NO: 3674549 - RNA, 13 nt, Human
uggaaggcccagc

SEQ ID NO: 3674550 - RNA, 13 nt, Human
uggaaggugggga

SEQ ID NO: 3674551 - RNA, 17 nt, Human
uggaaguaguggagccc

SEQ ID NO: 3674552 - RNA, 15 nt, Human
uggaagugacuuugg

SEQ ID NO: 3674553 - RNA, 23 nt, Human
uggaagugacuuuggcugcaugc

SEQ ID NO: 3674554 - RNA, 20 nt, Human
uggaagugugggucugugug

SEQ ID NO: 3674555 - RNA, 21 nt, Human
uguaaagaaagagagaaaaua

SEQ ID NO: 3674556 - RNA, 23 nt, Human
uguaaagaaagagagaaaauaaa

SEQ ID NO: 3674557 - RNA, 23 nt, Human
uguaaagagaccuaccucagguu

SEQ ID NO: 3674558 - RNA, 19 nt, Human
uguaaagaucuacaugaau

SEQ ID NO: 3674559 - RNA, 11 nt, Human
uguaaagaugu

SEQ ID NO: 3674560 - RNA, 18 nt, Human
uguaaaggucacuuuuca

SEQ ID NO: 3674561 - RNA, 21 nt, Human
uguaaaggucacuuuucacau

SEQ ID NO: 3674562 - RNA, 19 nt, Human
uguaaaguaggaaaaauaa

SEQ ID NO: 3674563 - RNA, 15 nt, Human
uguaaagugaagaau

SEQ ID NO: 3674564 - RNA, 21 nt, Human
uguaaagugaagaauccuuuu

SEQ ID NO: 3674565 - RNA, 12 nt, Human
uguaaagugugg

SEQ ID NO: 3674566 - RNA, 17 nt, Human
uguaaaguuagucuacu

SEQ ID NO: 3674567 - RNA, 19 nt, Human
uguaaauaaagaacuagca

SEQ ID NO: 3674568 - RNA, 13 nt, Human
uguaaauaaagcc

SEQ ID NO: 3674569 - RNA, 19 nt, Human
uguaaauaaccccauucuu

SEQ ID NO: 3674570 - RNA, 23 nt, Human
uguaaauaaccccauucuuugcu

SEQ ID NO: 3674571 - RNA, 12 nt, Human
uguaaauaagag

SEQ ID NO: 3674572 - RNA, 14 nt, Human
uguaaauaauucuu

SEQ ID NO: 3674573 - RNA, 22 nt, Human
uguaaauaauucuuuuuuauua

SEQ ID NO: 3674574 - RNA, 21 nt, Human
uguaaauacaauuuuguuucu

SEQ ID NO: 3674575 - RNA, 12 nt, Human
uguaaauacacc

SEQ ID NO: 3674576 - RNA, 15 nt, Human
uguaaauaccaggau

SEQ ID NO: 3674577 - RNA, 17 nt, Human
uguaaauaggauuuuua

SEQ ID NO: 3674578 - RNA, 12 nt, Human
uguaaauagguu

SEQ ID NO: 3674579 - RNA, 18 nt, Human
uguaaauagguucuucuu

SEQ ID NO: 3674580 - RNA, 16 nt, Human
uguaaauauaaagacg

SEQ ID NO: 3674581 - RNA, 17 nt, Human
uguaaauauaaagacgu

SEQ ID NO: 3674582 - RNA, 12 nt, Human
uguaaauauaua

SEQ ID NO: 3674583 - RNA, 17 nt, Human
uguaaauauauaaauau

SEQ ID NO: 3674584 - RNA, 13 nt, Human
uguaaauauuaaa

SEQ ID NO: 3674585 - RNA, 16 nt, Human
uguaaaucacauccuu

SEQ ID NO: 3674586 - RNA, 16 nt, Human
uguaaauccugccauu

SEQ ID NO: 3674587 - RNA, 12 nt, Human
uguaaauccuuu

SEQ ID NO: 3674588 - RNA, 19 nt, Human
uguaaauccuuuuucuuua

SEQ ID NO: 3674589 - RNA, 16 nt, Human
uguaaaucuaacauua

SEQ ID NO: 3674590 - RNA, 14 nt, Human
uguaaaucugccac

SEQ ID NO: 3674591 - RNA, 18 nt, Human
uguaaaugguguacauaa

SEQ ID NO: 3674592 - RNA, 14 nt, Human
uguaaauguaaacu

SEQ ID NO: 3674593 - RNA, 15 nt, Human
uguaaauguaaacuc

SEQ ID NO: 3674594 - RNA, 17 nt, Human
uguaaaugucucacuga

SEQ ID NO: 3674595 - RNA, 20 nt, Human
uguaaaugucucacugagca

SEQ ID NO: 3674596 - RNA, 22 nt, Human
uguaaaugucucacugagcacu

SEQ ID NO: 3674597 - RNA, 14 nt, Human
uguaaauguuaguu

SEQ ID NO: 3674598 - RNA, 22 nt, Human
uguaaauguuuguuaaaaauaa

SEQ ID NO: 3674599 - RNA, 13 nt, Human
uguaaauuaacuu

SEQ ID NO: 3674600 - RNA, 21 nt, Human
uguaaauuaccaguaaagugu

SEQ ID NO: 3674601 - RNA, 13 nt, Human
uguaaauuauauu

SEQ ID NO: 3674602 - RNA, 13 nt, Human
uguaaauuaugua

SEQ ID NO: 3674603 - RNA, 20 nt, Human
uguaaauuauguaaugcaaa

SEQ ID NO: 3674604 - RNA, 12 nt, Human
uguaaauuauuu

SEQ ID NO: 3674605 - RNA, 14 nt, Human
uguaaauucugauu

SEQ ID NO: 3674606 - RNA, 18 nt, Human
uguaaauucugauuucuu

SEQ ID NO: 3674607 - RNA, 22 nt, Human
uguaaauucugauuucuuuuca

SEQ ID NO: 3674608 - RNA, 22 nt, Human
uguaaauugaaucaguauaaac

SEQ ID NO: 3674609 - RNA, 12 nt, Human
uguaaauuggca

SEQ ID NO: 3674610 - RNA, 15 nt, Human
uguaaauuuauguga

SEQ ID NO: 3674611 - RNA, 16 nt, Human
uguaaauuuaugugau

SEQ ID NO: 3674612 - RNA, 13 nt, Human
uguaaauuuguac

SEQ ID NO: 3674613 - RNA, 13 nt, Human
uguaacaagaaaa

SEQ ID NO: 3674614 - RNA, 14 nt, Human
uguaacaagaaaau

SEQ ID NO: 3674615 - RNA, 14 nt, Human
uguaacaagccaga

SEQ ID NO: 3674616 - RNA, 18 nt, Human
uguaacaagccagauuuu

SEQ ID NO: 3674617 - RNA, 16 nt, Human
uguaacaauuguguag

SEQ ID NO: 3674618 - RNA, 21 nt, Human
uguaacaauuguguagccuuu

SEQ ID NO: 3674619 - RNA, 22 nt, Human
uguaacaauuguguagccuuuu

SEQ ID NO: 3674620 - RNA, 24 nt, Human
uguaacacaagccacagaagccag

SEQ ID NO: 3674621 - RNA, 11 nt, Human
uguaacacugu

SEQ ID NO: 3674622 - RNA, 16 nt, Human
uguaacacuuuacaau

SEQ ID NO: 3674623 - RNA, 13 nt, Human
uguaacagaaagg

SEQ ID NO: 3674624 - RNA, 15 nt, Human
uguaacagacauugu

SEQ ID NO: 3674625 - RNA, 12 nt, Human
uguaacagcucc

SEQ ID NO: 3674626 - RNA, 13 nt, Human
uguaacagcuccu

SEQ ID NO: 3674627 - RNA, 16 nt, Human
uguaacagcuccuugg

SEQ ID NO: 3674628 - RNA, 18 nt, Human
uguaacagcuccuuggga

SEQ ID NO: 3674629 - RNA, 14 nt, Human
uguaacagcugagg

SEQ ID NO: 3674630 - RNA, 20 nt, Human
uguaacaggucuccucuuaa

SEQ ID NO: 3674631 - RNA, 22 nt, Human
uguaacaggucuccucuuaaaa

SEQ ID NO: 3674632 - RNA, 11 nt, Human
uguaacaugua

SEQ ID NO: 3674633 - RNA, 12 nt, Human
uguaaccauuuu

SEQ ID NO: 3674634 - RNA, 13 nt, Human
uguaaccauuuua

SEQ ID NO: 3674635 - RNA, 22 nt, Human
uguaaccauuuuauaaagugcu

SEQ ID NO: 3674636 - RNA, 22 nt, Human
uguaaccgauucaucucucaga

SEQ ID NO: 3674637 - RNA, 18 nt, Human
uguaaccucagcucuggg

SEQ ID NO: 3674638 - RNA, 19 nt, Human
uguaaccucagcucuggga

SEQ ID NO: 3674639 - RNA, 23 nt, Human
uguaaccucagcucugggagagg

SEQ ID NO: 3674640 - RNA, 19 nt, Human
uguaaccugagauggcccu

SEQ ID NO: 3674641 - RNA, 19 nt, Human
uguaaccuguugcuguguu

SEQ ID NO: 3674642 - RNA, 19 nt, Human
uguaacgcaaguucccagu

SEQ ID NO: 3674643 - RNA, 23 nt, Human
uguaacgcaaguucccaguugga

SEQ ID NO: 3674644 - RNA, 20 nt, Human
uguaacuauagacuggaaaa

SEQ ID NO: 3674645 - RNA, 12 nt, Human
uguaacuauguu

SEQ ID NO: 3674646 - RNA, 13 nt, Human
uguaacuauguuu

SEQ ID NO: 3674647 - RNA, 13 nt, Human
uguaacuccacca

SEQ ID NO: 3674648 - RNA, 16 nt, Human
uguaacucuaaaagau

SEQ ID NO: 3674649 - RNA, 18 nt, Human
uguaacugccaggcucuc

SEQ ID NO: 3674650 - RNA, 11 nt, Human
uguaacugccc

SEQ ID NO: 3674651 - RNA, 12 nt, Human
uguaacuguuac

SEQ ID NO: 3674652 - RNA, 16 nt, Human
uguaacuguuacagua

SEQ ID NO: 3674653 - RNA, 22 nt, Human
guucagagcugcccucuccugg

SEQ ID NO: 3674654 - RNA, 23 nt, Human
guucagaucuuaauauaaauuca

SEQ ID NO: 3674655 - RNA, 14 nt, Human
guucagcacugucc

SEQ ID NO: 3674656 - RNA, 22 nt, Human
guucagcacugucccuugccuc

SEQ ID NO: 3674657 - RNA, 15 nt, Human
guucagcacuugucu

SEQ ID NO: 3674658 - RNA, 20 nt, Human
guucagcacuugucucauuu

SEQ ID NO: 3674659 - RNA, 12 nt, Human
guucagccaagg

SEQ ID NO: 3674660 - RNA, 19 nt, Human
guucagccccuccucugcc

SEQ ID NO: 3674661 - RNA, 20 nt, Human
guucagccccuccucugcca

SEQ ID NO: 3674662 - RNA, 19 nt, Human
guucagcuaagcuaggaau

SEQ ID NO: 3674663 - RNA, 13 nt, Human
guucagcuacucc

SEQ ID NO: 3674664 - RNA, 16 nt, Human
guucagcuccagcuca

SEQ ID NO: 3674665 - RNA, 17 nt, Human
guucagcuguccucccu

SEQ ID NO: 3674666 - RNA, 18 nt, Human
guucagcuguccucccuc

SEQ ID NO: 3674667 - RNA, 19 nt, Human
guucagcuguccucccucc

SEQ ID NO: 3674668 - RNA, 21 nt, Human
guucagcuguccucccuccac

SEQ ID NO: 3674669 - RNA, 15 nt, Human
guucaggagucccaa

SEQ ID NO: 3674670 - RNA, 19 nt, Human
guucaggcccggcagggcg

SEQ ID NO: 3674671 - RNA, 19 nt, Human
guucagggaagauaaguug

SEQ ID NO: 3674672 - RNA, 16 nt, Human
guucagggcuuuucuu

SEQ ID NO: 3674673 - RNA, 22 nt, Human
guucaggguuggccccugcccg

SEQ ID NO: 3674674 - RNA, 17 nt, Human
guucagguaacaggcag

SEQ ID NO: 3674675 - RNA, 18 nt, Human
guucagguaacaggcaga

SEQ ID NO: 3674676 - RNA, 13 nt, Human
guucaguaccugg

SEQ ID NO: 3674677 - RNA, 20 nt, Human
guucaguggcagggcucagg

SEQ ID NO: 3674678 - RNA, 21 nt, Human
guucaguggcagggcucagga

SEQ ID NO: 3674679 - RNA, 16 nt, Human
guucagugucccgggc

SEQ ID NO: 3674680 - RNA, 13 nt, Human
guucaguuacaga

SEQ ID NO: 3674681 - RNA, 22 nt, Human
guucauaacagugccauugucu

SEQ ID NO: 3674682 - RNA, 24 nt, Human
guucauaacagugccauugucuuu

SEQ ID NO: 3674683 - RNA, 22 nt, Human
guucauacacuaaccaaaucuc

SEQ ID NO: 3674684 - RNA, 11 nt, Human
guucauacauu

SEQ ID NO: 3674685 - RNA, 16 nt, Human
guucauaccuaaguac

SEQ ID NO: 3674686 - RNA, 20 nt, Human
guucauaccuaaguacugua

SEQ ID NO: 3674687 - RNA, 13 nt, Human
guucauagcccag

SEQ ID NO: 3674688 - RNA, 17 nt, Human
guucauagggucucuuc

SEQ ID NO: 3674689 - RNA, 22 nt, Human
guucauagggucucuucagguu

SEQ ID NO: 3674690 - RNA, 20 nt, Human
guucauaggucacuggcucu

SEQ ID NO: 3674691 - RNA, 19 nt, Human
guucauauuccauauuuau

SEQ ID NO: 3674692 - RNA, 21 nt, Human
guucaucaguguuaaaaaauu

SEQ ID NO: 3674693 - RNA, 22 nt, Human
guucaucauccagauguggcua

SEQ ID NO: 3674694 - RNA, 21 nt, Human
guucauccaauccucacuggg

SEQ ID NO: 3674695 - RNA, 16 nt, Human
guucaucccagcccca

SEQ ID NO: 3674696 - RNA, 20 nt, Human
guucaucccuucucuuccag

SEQ ID NO: 3674697 - RNA, 20 nt, Human
guucaucugagcaagagcug

SEQ ID NO: 3674698 - RNA, 12 nt, Human
guucaugagaau

SEQ ID NO: 3674699 - RNA, 15 nt, Human
guucaugcagcugug

SEQ ID NO: 3674700 - RNA, 19 nt, Human
uggccaggcugccuggccu

SEQ ID NO: 3674701 - RNA, 13 nt, Human
uggccaggcugcu

SEQ ID NO: 3674702 - RNA, 16 nt, Human
uggccaggcugcucuu

SEQ ID NO: 3674703 - RNA, 17 nt, Human
uggccaggcugcucuug

SEQ ID NO: 3674704 - RNA, 20 nt, Human
uggccaggcugcucuugaac

SEQ ID NO: 3674705 - RNA, 13 nt, Human
uggccaggcuggu

SEQ ID NO: 3674706 - RNA, 15 nt, Human
uggccaggcuggucu

SEQ ID NO: 3674707 - RNA, 20 nt, Human
uggccaggcuggucucgaac

SEQ ID NO: 3674708 - RNA, 14 nt, Human
uguauaaauguaua

SEQ ID NO: 3674709 - RNA, 14 nt, Human
uguauaacagguua

SEQ ID NO: 3674710 - RNA, 13 nt, Human
uguauaacuuuaa

SEQ ID NO: 3674711 - RNA, 22 nt, Human
uguauaagauuagaaugaaaau

SEQ ID NO: 3674712 - RNA, 15 nt, Human
uguauaauacuuugu

SEQ ID NO: 3674713 - RNA, 13 nt, Human
uguauaauauaaa

SEQ ID NO: 3674714 - RNA, 14 nt, Human
uguauaauauugaa

SEQ ID NO: 3674715 - RNA, 21 nt, Human
uguauaauauugaaaauugaa

SEQ ID NO: 3674716 - RNA, 22 nt, Human
uguauaauauugaaaauugaaa

SEQ ID NO: 3674717 - RNA, 12 nt, Human
uguauaauuucg

SEQ ID NO: 3674718 - RNA, 13 nt, Human
uguauacaaauau

SEQ ID NO: 3674719 - RNA, 18 nt, Human
uguauacaaauauauugu

SEQ ID NO: 3674720 - RNA, 13 nt, Human
uguauacuuuaaa

SEQ ID NO: 3674721 - RNA, 12 nt, Human
uguauacuuuag

SEQ ID NO: 3674722 - RNA, 19 nt, Human
uguauacuuuaguaugacg

SEQ ID NO: 3674723 - RNA, 16 nt, Human
uguauagaaccucuuu

SEQ ID NO: 3674724 - RNA, 17 nt, Human
uguauagacaguuugua

SEQ ID NO: 3674725 - RNA, 19 nt, Human
uguauagaugcaagauauu

SEQ ID NO: 3674726 - RNA, 20 nt, Human
uguauagaugcaagauauuu

SEQ ID NO: 3674727 - RNA, 15 nt, Human
uguauagauuagaau

SEQ ID NO: 3674728 - RNA, 23 nt, Human
uguauagauuagauuauauugag

SEQ ID NO: 3674729 - RNA, 13 nt, Human
uguauagcaugaa

SEQ ID NO: 3674730 - RNA, 16 nt, Human
uguauagguagauguu

SEQ ID NO: 3674731 - RNA, 23 nt, Human
uguauaguaaagugauaauuucu

SEQ ID NO: 3674732 - RNA, 15 nt, Human
uguauaguacuggca

SEQ ID NO: 3674733 - RNA, 17 nt, Human
uguauaguauuugaaaa

SEQ ID NO: 3674734 - RNA, 17 nt, Human
uguauaguuaacacacu

SEQ ID NO: 3674735 - RNA, 13 nt, Human
uguauaguugcuu

SEQ ID NO: 3674736 - RNA, 22 nt, Human
uguauaguugcuugccugauau

SEQ ID NO: 3674737 - RNA, 14 nt, Human
uguauaguugcuuu

SEQ ID NO: 3674738 - RNA, 14 nt, Human
uguauauaaauggg

SEQ ID NO: 3674739 - RNA, 20 nt, Human
uguauauaaaugggaacauu

SEQ ID NO: 3674740 - RNA, 13 nt, Human
uguauauacuuuu

SEQ ID NO: 3674741 - RNA, 17 nt, Human
uguauauauacauacac

SEQ ID NO: 3674742 - RNA, 18 nt, Human
uguauauauacauacacu

SEQ ID NO: 3674743 - RNA, 20 nt, Human
uguauauauacauacacuug

SEQ ID NO: 3674744 - RNA, 17 nt, Human
uguauauaucugcuuca

SEQ ID NO: 3674745 - RNA, 12 nt, Human
uguauauaugug

SEQ ID NO: 3674746 - RNA, 14 nt, Human
uguauauaugugua

SEQ ID NO: 3674747 - RNA, 20 nt, Human
uguauauauguguauauaua

SEQ ID NO: 3674748 - RNA, 18 nt, Human
uguauauauguguguuua

SEQ ID NO: 3674749 - RNA, 20 nt, Human
uguauauauguguguuuaaa

SEQ ID NO: 3674750 - RNA, 20 nt, Human
uguauauauuuugugugaaa

SEQ ID NO: 3674751 - RNA, 22 nt, Human
uguauauauuuugugugaaauu

SEQ ID NO: 3674752 - RNA, 18 nt, Human
uguauaucagaaaaggga

SEQ ID NO: 3674753 - RNA, 18 nt, Human
uguauauccuuucuaaca

SEQ ID NO: 3674754 - RNA, 19 nt, Human
uguauaucguuaucacugu

SEQ ID NO: 3674755 - RNA, 15 nt, Human
uguauauuacaauga

SEQ ID NO: 3674756 - RNA, 19 nt, Human
uguauauuacaaugaucac

SEQ ID NO: 3674757 - RNA, 14 nt, Human
uguauauuauuucu

SEQ ID NO: 3674758 - RNA, 15 nt, Human
uguauauuauuucua

SEQ ID NO: 3674759 - RNA, 13 nt, Human
uguauauuauuug

SEQ ID NO: 3674760 - RNA, 18 nt, Human
uguauauuauuuggcagu

SEQ ID NO: 3674761 - RNA, 13 nt, Human
uguauauuccuuu

SEQ ID NO: 3674762 - RNA, 18 nt, Human
uguauauucuauuuuaca

SEQ ID NO: 3674763 - RNA, 13 nt, Human
uguauauugguuu

SEQ ID NO: 3674764 - RNA, 21 nt, Human
uguauauugguuuuaugauga

SEQ ID NO: 3674765 - RNA, 13 nt, Human
uguauauuguaau

SEQ ID NO: 3674766 - RNA, 14 nt, Human
uguauauuguaauu

SEQ ID NO: 3674767 - RNA, 18 nt, Human
uguauauuuaaaagaaag

SEQ ID NO: 3674768 - RNA, 17 nt, Human
uguauauuugauuuauu

SEQ ID NO: 3674769 - RNA, 19 nt, Human
uguauauuugauuuauuaa

SEQ ID NO: 3674770 - RNA, 22 nt, Human
uguauauuuguaaagcuauuua

SEQ ID NO: 3674771 - RNA, 15 nt, Human
uguauauuuguacaa

SEQ ID NO: 3674772 - RNA, 19 nt, Human
uguauauuuguauauuaca

SEQ ID NO: 3674773 - RNA, 17 nt, Human
uguauauuuguaugaua

SEQ ID NO: 3674774 - RNA, 21 nt, Human
uguauauuugugauagcacuu

SEQ ID NO: 3674775 - RNA, 15 nt, Human
uguauauuuuauaua

SEQ ID NO: 3674776 - RNA, 18 nt, Human
uguaucaguguuuaugug

SEQ ID NO: 3674777 - RNA, 19 nt, Human
uguaucauaauuaccaagu

SEQ ID NO: 3674778 - RNA, 16 nt, Human
uguaucauagaaaugu

SEQ ID NO: 3674779 - RNA, 17 nt, Human
uguaucauuugaacaac

SEQ ID NO: 3674780 - RNA, 16 nt, Human
uguauccaugggggca

SEQ ID NO: 3674781 - RNA, 19 nt, Human
uguauccaugggggcaggg

SEQ ID NO: 3674782 - RNA, 13 nt, Human
uguauccauuauc

SEQ ID NO: 3674783 - RNA, 19 nt, Human
uguauccauuaucaugugu

SEQ ID NO: 3674784 - RNA, 22 nt, Human
uguauccauuaucauguguaau

SEQ ID NO: 3674785 - RNA, 19 nt, Human
uguaucccaugagccucag

SEQ ID NO: 3674786 - RNA, 16 nt, Human
uguauccccugcaggc

SEQ ID NO: 3674787 - RNA, 20 nt, Human
uguauccugaggcugagaga

SEQ ID NO: 3674788 - RNA, 12 nt, Human
uguauccugggg

SEQ ID NO: 3674789 - RNA, 14 nt, Human
uguauccuggggcu

SEQ ID NO: 3674790 - RNA, 15 nt, Human
uguauccuggggcuc

SEQ ID NO: 3674791 - RNA, 18 nt, Human
uguauccuggggcucccu

SEQ ID NO: 3674792 - RNA, 15 nt, Human
uguaucggaugcuuu

SEQ ID NO: 3674793 - RNA, 19 nt, Human
uguaucguaaccagccaga

SEQ ID NO: 3674794 - RNA, 12 nt, Human
uguaucuaagaa

SEQ ID NO: 3674795 - RNA, 20 nt, Human
uguaucuaagaauaauaaaa

SEQ ID NO: 3674796 - RNA, 15 nt, Human
uguaucuaccucacu

SEQ ID NO: 3674797 - RNA, 17 nt, Human
uguaucuagugcagcug

SEQ ID NO: 3674798 - RNA, 19 nt, Human
uguaucuagugcagcugau

SEQ ID NO: 3674799 - RNA, 18 nt, Human
uguaucuaugcauuuucu

SEQ ID NO: 3674800 - RNA, 19 nt, Human
uguaucuaugcauuuucug

SEQ ID NO: 3674801 - RNA, 21 nt, Human
uguaucucugaagcauguuuc

SEQ ID NO: 3674802 - RNA, 19 nt, Human
uguaucugcaggcagacac

SEQ ID NO: 3674803 - RNA, 21 nt, Human
uguaucugcaggcagacacgg

SEQ ID NO: 3674804 - RNA, 22 nt, Human
uguaucugcaggcagacacgga

SEQ ID NO: 3674805 - RNA, 12 nt, Human
uguaucugucuu

SEQ ID NO: 3674806 - RNA, 14 nt, Human
uguaucugugcuuu

SEQ ID NO: 3674807 - RNA, 11 nt, Human
uguaucugugu

SEQ ID NO: 3674808 - RNA, 15 nt, Human
uguaucuuaaauuug

SEQ ID NO: 3674809 - RNA, 21 nt, Human
uguaucuuucuaugcugcuuu

SEQ ID NO: 3674810 - RNA, 16 nt, Human
uguaugaaauauaugu

SEQ ID NO: 3674811 - RNA, 18 nt, Human
uguaugaaauauauguga

SEQ ID NO: 3674812 - RNA, 14 nt, Human
uguaugaaggcuuu

SEQ ID NO: 3674813 - RNA, 19 nt, Human
uguaugaauacagcagcaa

SEQ ID NO: 3674814 - RNA, 15 nt, Human
uguaugacuaaagag

SEQ ID NO: 3674815 - RNA, 16 nt, Human
uguaugacuaaagaga

SEQ ID NO: 3674816 - RNA, 23 nt, Human
uguaugacuaaagagagaaugua

SEQ ID NO: 3674817 - RNA, 16 nt, Human
uguaugauauuccaua

SEQ ID NO: 3674818 - RNA, 12 nt, Human
uguaugaucaaa

SEQ ID NO: 3674819 - RNA, 14 nt, Human
uguaugaucaaaug

SEQ ID NO: 3674820 - RNA, 16 nt, Human
uguaugaucaaauguu

SEQ ID NO: 3674821 - RNA, 16 nt, Human
uguaugaucugugccu

SEQ ID NO: 3674822 - RNA, 12 nt, Human
uguaugauuacu

SEQ ID NO: 3674823 - RNA, 13 nt, Human
uguaugauuacug

SEQ ID NO: 3674824 - RNA, 22 nt, Human
uguaugauuacuggccuuuuuc

SEQ ID NO: 3674825 - RNA, 16 nt, Human
uguaugauucccagcc

SEQ ID NO: 3674826 - RNA, 16 nt, Human
uguaugcaagcaguuu

SEQ ID NO: 3674827 - RNA, 16 nt, Human
uguaugcacacacaua

SEQ ID NO: 3674828 - RNA, 19 nt, Human
uguaugcacacacauauau

SEQ ID NO: 3674829 - RNA, 21 nt, Human
uguaugcacacacauauauua

SEQ ID NO: 3674830 - RNA, 21 nt, Human
uguaugcacaugaacuuagau

SEQ ID NO: 3674831 - RNA, 17 nt, Human
uguaugcagcuaucugg

SEQ ID NO: 3674832 - RNA, 12 nt, Human
uguaugccuuua

SEQ ID NO: 3674833 - RNA, 13 nt, Human
uguaugcgugugu

SEQ ID NO: 3674834 - RNA, 14 nt, Human
uguaugcugaucau

SEQ ID NO: 3674835 - RNA, 15 nt, Human
uguaugcugaucauc

SEQ ID NO: 3674836 - RNA, 13 nt, Human
uguaugcuucaua

SEQ ID NO: 3674837 - RNA, 16 nt, Human
uguaugcuucauacag

SEQ ID NO: 3674838 - RNA, 16 nt, Human
uguauggaauacagug

SEQ ID NO: 3674839 - RNA, 17 nt, Human
uguauggaauacagugu

SEQ ID NO: 3674840 - RNA, 19 nt, Human
uguauggaaucccacugua

SEQ ID NO: 3674841 - RNA, 16 nt, Human
uguauggauaguaaaa

SEQ ID NO: 3674842 - RNA, 17 nt, Human
uguauggggaaucuaag

SEQ ID NO: 3674843 - RNA, 22 nt, Human
uguauggguaggguaaaucagu

SEQ ID NO: 3674844 - RNA, 21 nt, Human
uguaugguuuuugagauauua

SEQ ID NO: 3674845 - RNA, 15 nt, Human
uguauguaaauaggu

SEQ ID NO: 3674846 - RNA, 20 nt, Human
ugucaaugcaguugucucug

SEQ ID NO: 3674847 - RNA, 19 nt, Human
ugucaauuuaugaauauaa

SEQ ID NO: 3674848 - RNA, 14 nt, Human
ugucacaauccuaa

SEQ ID NO: 3674849 - RNA, 19 nt, Human
ugucacaauccuaacacau

SEQ ID NO: 3674850 - RNA, 14 nt, Human
ugucacaccagcca

SEQ ID NO: 3674851 - RNA, 15 nt, Human
ugucacaccagccau

SEQ ID NO: 3674852 - RNA, 12 nt, Human
ugucacaggcag

SEQ ID NO: 3674853 - RNA, 21 nt, Human
ugucacaggcagguccagggu

SEQ ID NO: 3674854 - RNA, 12 nt, Human
ugucacagggcc

SEQ ID NO: 3674855 - RNA, 16 nt, Human
ugucacaguaaaaaua

SEQ ID NO: 3674856 - RNA, 23 nt, Human
ugucacaguaaaaauaaaauacu

SEQ ID NO: 3674857 - RNA, 20 nt, Human
ugucacaugaaacauuugca

SEQ ID NO: 3674858 - RNA, 17 nt, Human
ugucacauugcauucua

SEQ ID NO: 3674859 - RNA, 20 nt, Human
ugucacauuuagcugugcuc

SEQ ID NO: 3674860 - RNA, 23 nt, Human
ugucacauuuuucuuguuuuguc

SEQ ID NO: 3674861 - RNA, 14 nt, Human
ugucaccaaggaaa

SEQ ID NO: 3674862 - RNA, 18 nt, Human
ugucaccacccugcucau

SEQ ID NO: 3674863 - RNA, 23 nt, Human
ugucaccaccuucccagcucucc

SEQ ID NO: 3674864 - RNA, 17 nt, Human
ugucaccccagagccac

SEQ ID NO: 3674865 - RNA, 19 nt, Human
ugucaccccagagccacac

SEQ ID NO: 3674866 - RNA, 21 nt, Human
ugucaccccagagccacacau

SEQ ID NO: 3674867 - RNA, 22 nt, Human
ugucaccccagagccacacaug

SEQ ID NO: 3674868 - RNA, 22 nt, Human
ugucacccuuaggccagcacca

SEQ ID NO: 3674869 - RNA, 22 nt, Human
ugucaccgugagcagcuuugga

SEQ ID NO: 3674870 - RNA, 23 nt, Human
ugucaccgugagcagcuuuggaa

SEQ ID NO: 3674871 - RNA, 21 nt, Human
ugucaccguggaccuuccugc

SEQ ID NO: 3674872 - RNA, 16 nt, Human
ugucaccucuuccgac

SEQ ID NO: 3674873 - RNA, 15 nt, Human
ugucacuagaaugga

SEQ ID NO: 3674874 - RNA, 14 nt, Human
ugucacucaaggcg

SEQ ID NO: 3674875 - RNA, 17 nt, Human
ugucacucaaggcggug

SEQ ID NO: 3674876 - RNA, 15 nt, Human
ugucacucaggcugg

SEQ ID NO: 3674877 - RNA, 15 nt, Human
ugucacugcaggcac

SEQ ID NO: 3674878 - RNA, 13 nt, Human
ugucacugcuuuu

SEQ ID NO: 3674879 - RNA, 18 nt, Human
ugucacuggcugccucca

SEQ ID NO: 3674880 - RNA, 18 nt, Human
ugucacugucccuccugg

SEQ ID NO: 3674881 - RNA, 22 nt, Human
ugucacugucccuccugguguc

SEQ ID NO: 3674882 - RNA, 17 nt, Human
ugucacuguuucucugc

SEQ ID NO: 3674883 - RNA, 22 nt, Human
ugucacuucgcgugcccucgcu

SEQ ID NO: 3674884 - RNA, 14 nt, Human
ugucacuugcaugu

SEQ ID NO: 3674885 - RNA, 17 nt, Human
ugucacuugugcuuugc

SEQ ID NO: 3674886 - RNA, 17 nt, Human
ugucacuuugcucuggg

SEQ ID NO: 3674887 - RNA, 12 nt, Human
ugucacuuuuua

SEQ ID NO: 3674888 - RNA, 16 nt, Human
ugucacuuuuuaugcu

SEQ ID NO: 3674889 - RNA, 18 nt, Human
ugucacuuuuugaggcaa

SEQ ID NO: 3674890 - RNA, 21 nt, Human
ugucagaaaccaguuauguga

SEQ ID NO: 3674891 - RNA, 21 nt, Human
ugucagaacuagaauuugauu

SEQ ID NO: 3674892 - RNA, 12 nt, Human
ugucagaagugc

SEQ ID NO: 3674893 - RNA, 17 nt, Human
ugucagaagugcagaau

SEQ ID NO: 3674894 - RNA, 22 nt, Human
ugucagaaugcuauugaaaaug

SEQ ID NO: 3674895 - RNA, 15 nt, Human
ugucagacauaaagc

SEQ ID NO: 3674896 - RNA, 23 nt, Human
ugucagacauccauguuuguaaa

SEQ ID NO: 3674897 - RNA, 16 nt, Human
ugucagacccuggagg

SEQ ID NO: 3674898 - RNA, 17 nt, Human
ugucagacccuggaggc

SEQ ID NO: 3674899 - RNA, 23 nt, Human
ugucagacuuuaaagaauaauau

SEQ ID NO: 3674900 - RNA, 11 nt, Human
ugucagagcug

SEQ ID NO: 3674901 - RNA, 12 nt, Human
ugucagagcugg

SEQ ID NO: 3674902 - RNA, 15 nt, Human
ugucagagcugggag

SEQ ID NO: 3674903 - RNA, 20 nt, Human
ugucagaggcacaaaagggu

SEQ ID NO: 3674904 - RNA, 16 nt, Human
ugucagauacaaugua

SEQ ID NO: 3674905 - RNA, 20 nt, Human
ugucagauccaggagcucca

SEQ ID NO: 3674906 - RNA, 15 nt, Human
ugucagauuccuuuc

SEQ ID NO: 3674907 - RNA, 13 nt, Human
ugucagcaaaaag

SEQ ID NO: 3674908 - RNA, 14 nt, Human
ugucagcaaaaagc

SEQ ID NO: 3674909 - RNA, 19 nt, Human
ugucagcaaaaagcaaaau

SEQ ID NO: 3674910 - RNA, 22 nt, Human
ugucagcaaaaagcaaaaucau

SEQ ID NO: 3674911 - RNA, 14 nt, Human
ugucagcaugaauu

SEQ ID NO: 3674912 - RNA, 17 nt, Human
ugucagccgggcccuga

SEQ ID NO: 3674913 - RNA, 22 nt, Human
ugucagcgcucuggugcugcag

SEQ ID NO: 3674914 - RNA, 18 nt, Human
ugucagcuacuaaugaug

SEQ ID NO: 3674915 - RNA, 23 nt, Human
ugucagcuacugcggaaaaggaa

SEQ ID NO: 3674916 - RNA, 23 nt, Human
ugucagcuccccucggagaagag

SEQ ID NO: 3674917 - RNA, 17 nt, Human
ugucagcucucaucuga

SEQ ID NO: 3674918 - RNA, 13 nt, Human
ugucagcugaggc

SEQ ID NO: 3674919 - RNA, 18 nt, Human
ugucagcuuuugcuucau

SEQ ID NO: 3674920 - RNA, 14 nt, Human
ugucaggaggaacu

SEQ ID NO: 3674921 - RNA, 13 nt, Human
ugucaggauugcg

SEQ ID NO: 3674922 - RNA, 23 nt, Human
ugucaggauugcgagagaugugu

SEQ ID NO: 3674923 - RNA, 14 nt, Human
ugucaggccuucag

SEQ ID NO: 3674924 - RNA, 17 nt, Human
ugucaggcugaaaacaa

SEQ ID NO: 3674925 - RNA, 16 nt, Human
ugucaggcugcuggcg

SEQ ID NO: 3674926 - RNA, 22 nt, Human
ugucaggcugcuggcgccucug

SEQ ID NO: 3674927 - RNA, 23 nt, Human
ugucaggcugcuggcgccucugc

SEQ ID NO: 3674928 - RNA, 19 nt, Human
ugucagggaguguucccua

SEQ ID NO: 3674929 - RNA, 16 nt, Human
ugucagguggggcagc

SEQ ID NO: 3674930 - RNA, 20 nt, Human
ugucaguaccuucaaacuag

SEQ ID NO: 3674931 - RNA, 20 nt, Human
ugucaguaucuguaucucuc

SEQ ID NO: 3674932 - RNA, 19 nt, Human
ugucaguauguggaagugu

SEQ ID NO: 3674933 - RNA, 16 nt, Human
ugucagugcagcccgu

SEQ ID NO: 3674934 - RNA, 16 nt, Human
ugucagugccgccgcc

SEQ ID NO: 3674935 - RNA, 16 nt, Human
ugucagugugacugau

SEQ ID NO: 3674936 - RNA, 19 nt, Human
ugucaguucugauauggaa

SEQ ID NO: 3674937 - RNA, 17 nt, Human
ugucaguuguuauuuau

SEQ ID NO: 3674938 - RNA, 22 nt, Human
ugucaguuguuauuuauugaaa

SEQ ID NO: 3674939 - RNA, 14 nt, Human
ugucaguuuauguu

SEQ ID NO: 3674940 - RNA, 16 nt, Human
ugucaguuuauguuuu

SEQ ID NO: 3674941 - RNA, 14 nt, Human
ugucaguuuucaua

SEQ ID NO: 3674942 - RNA, 21 nt, Human
ugucauaaacagaugaauaaa

SEQ ID NO: 3674943 - RNA, 18 nt, Human
ugucauaaagugagaaaa

SEQ ID NO: 3674944 - RNA, 20 nt, Human
ugucauaaagugagaaaacu

SEQ ID NO: 3674945 - RNA, 16 nt, Human
ugucauaagaaugaau

SEQ ID NO: 3674946 - RNA, 13 nt, Human
ugucauacagaga

SEQ ID NO: 3674947 - RNA, 15 nt, Human
ugucauacagagaag

SEQ ID NO: 3674948 - RNA, 16 nt, Human
ugucauacagagaagu

SEQ ID NO: 3674949 - RNA, 23 nt, Human
ugucauaccaggccgccccagcc

SEQ ID NO: 3674950 - RNA, 20 nt, Human
ugucauacucgagucugagg

SEQ ID NO: 3674951 - RNA, 17 nt, Human
ugucauagaaagugcca

SEQ ID NO: 3674952 - RNA, 22 nt, Human
ugucauagaaagugccagaaag

SEQ ID NO: 3674953 - RNA, 15 nt, Human
ugucauagaaauuac

SEQ ID NO: 3674954 - RNA, 21 nt, Human
ugucauagaauagcauguugu

SEQ ID NO: 3674955 - RNA, 18 nt, Human
ugucauauagcugguuau

SEQ ID NO: 3674956 - RNA, 20 nt, Human
ugucauauguagccuucaca

SEQ ID NO: 3674957 - RNA, 23 nt, Human
ugucaucaauaguguccuaugca

SEQ ID NO: 3674958 - RNA, 16 nt, Human
ugucaucaccauggaa

SEQ ID NO: 3674959 - RNA, 22 nt, Human
ugucaucacucuagguuuuaca

SEQ ID NO: 3674960 - RNA, 17 nt, Human
ugucaucagaagauaac

SEQ ID NO: 3674961 - RNA, 16 nt, Human
ugucauccucaaagaa

SEQ ID NO: 3674962 - RNA, 19 nt, Human
ugucauccucaaagaaagu

SEQ ID NO: 3674963 - RNA, 21 nt, Human
ugucauccucaaagaaagugu

SEQ ID NO: 3674964 - RNA, 22 nt, Human
ugucauccucaaagaaagugua

SEQ ID NO: 3674965 - RNA, 13 nt, Human
ugucaucugugca

SEQ ID NO: 3674966 - RNA, 13 nt, Human
ugucaugcaugaa

SEQ ID NO: 3674967 - RNA, 14 nt, Human
ugucaugccccccu

SEQ ID NO: 3674968 - RNA, 20 nt, Human
ugucaugcugggauuuccaa

SEQ ID NO: 3674969 - RNA, 22 nt, Human
ugucaugcuucaucauucccuc

SEQ ID NO: 3674970 - RNA, 14 nt, Human
ugucaugugcagau

SEQ ID NO: 3674971 - RNA, 15 nt, Human
ugucauguguauaaa

SEQ ID NO: 3674972 - RNA, 17 nt, Human
ugucauguguucccuuu

SEQ ID NO: 3674973 - RNA, 19 nt, Human
ugucauguguucccuuugu

SEQ ID NO: 3674974 - RNA, 23 nt, Human
ugucauuaaauggggcucacaaa

SEQ ID NO: 3674975 - RNA, 17 nt, Human
ugucauuagccugagua

SEQ ID NO: 3674976 - RNA, 16 nt, Human
ugucauugaaaaacua

SEQ ID NO: 3674977 - RNA, 17 nt, Human
ugucauugcuucuucug

SEQ ID NO: 3674978 - RNA, 13 nt, Human
ugucauugcuuua

SEQ ID NO: 3674979 - RNA, 20 nt, Human
ugucauuguuauauaaucau

SEQ ID NO: 3674980 - RNA, 15 nt, Human
ugucauuucagaagu

SEQ ID NO: 3674981 - RNA, 16 nt, Human
ugucauuucagaaguu

SEQ ID NO: 3674982 - RNA, 15 nt, Human
ugucauuucauucca

SEQ ID NO: 3674983 - RNA, 16 nt, Human
ugucauuucauuccau

SEQ ID NO: 3674984 - RNA, 14 nt, Human
ugucauuucauuuc

SEQ ID NO: 3674985 - RNA, 20 nt, Human
ugucauuugagcagggcuca

SEQ ID NO: 3674986 - RNA, 21 nt, Human
ugucauuugagcagggcucag

SEQ ID NO: 3674987 - RNA, 18 nt, Human
ugucauuuguugugaugu

SEQ ID NO: 3674988 - RNA, 12 nt, Human
ugucauuuucau

SEQ ID NO: 3674989 - RNA, 13 nt, Human
ugucauuuucauu

SEQ ID NO: 3674990 - RNA, 15 nt, Human
ugugccuccucaccc

SEQ ID NO: 3674991 - RNA, 16 nt, Human
ugugccuccucacccc

SEQ ID NO: 3674992 - RNA, 12 nt, Human
ugugccucggcu

SEQ ID NO: 3674993 - RNA, 14 nt, Human
ugugccucuagcug

SEQ ID NO: 3674994 - RNA, 18 nt, Human
ugugccucuagcugaauu

SEQ ID NO: 3674995 - RNA, 16 nt, Human
ugugccucugggacug

SEQ ID NO: 3674996 - RNA, 19 nt, Human
ugugccugcaccaggagac

SEQ ID NO: 3674997 - RNA, 12 nt, Human
ugugccugcagc

SEQ ID NO: 3674998 - RNA, 17 nt, Human
ugugccuugucacgcca

SEQ ID NO: 3674999 - RNA, 15 nt, Human
ugugccuuguuuuuu

SEQ ID NO: 3675000 - RNA, 18 nt, Human
ugugccuuuuauagcuau

SEQ ID NO: 3675001 - RNA, 16 nt, Human
ugugccuuuugccauc

SEQ ID NO: 3675002 - RNA, 20 nt, Human
ugugccuuuuuuauaucuug

SEQ ID NO: 3675003 - RNA, 14 nt, Human
ugugcgccuacagg

SEQ ID NO: 3675004 - RNA, 14 nt, Human
ugugcgcuaaacuu

SEQ ID NO: 3675005 - RNA, 23 nt, Human
ugugcgcuaaacuuuucugauag

SEQ ID NO: 3675006 - RNA, 15 nt, Human
ugugcgcucugugga

SEQ ID NO: 3675007 - RNA, 13 nt, Human
ugugcgugaaaca

SEQ ID NO: 3675008 - RNA, 22 nt, Human
ugugcgugaaacacaccaggcu

SEQ ID NO: 3675009 - RNA, 20 nt, Human
ugugcgugcauguguguuca

SEQ ID NO: 3675010 - RNA, 21 nt, Human
ugugcguggggcucccgccuc

SEQ ID NO: 3675011 - RNA, 15 nt, Human
ugugcuaaacgugua

SEQ ID NO: 3675012 - RNA, 22 nt, Human
ugugcuacaauucauuguguua

SEQ ID NO: 3675013 - RNA, 21 nt, Human
ugugcuacugucuuuggaaaa

SEQ ID NO: 3675014 - RNA, 16 nt, Human
ugugcuacuuugccuu

SEQ ID NO: 3675015 - RNA, 17 nt, Human
ugugcuagaaauuuuca

SEQ ID NO: 3675016 - RNA, 14 nt, Human
ugugcuagaauacu

SEQ ID NO: 3675017 - RNA, 15 nt, Human
ugugcuauaaauccu

SEQ ID NO: 3675018 - RNA, 13 nt, Human
ugugcuauacugc

SEQ ID NO: 3675019 - RNA, 21 nt, Human
ugugcuauacugcauacuuuu

SEQ ID NO: 3675020 - RNA, 13 nt, Human
ugugcuauaguau

SEQ ID NO: 3675021 - RNA, 17 nt, Human
ugugcuauaguauuuga

SEQ ID NO: 3675022 - RNA, 16 nt, Human
ugugcucaaaauuuga

SEQ ID NO: 3675023 - RNA, 15 nt, Human
ugugcucagagacac

SEQ ID NO: 3675024 - RNA, 12 nt, Human
ugugcucagccc

SEQ ID NO: 3675025 - RNA, 15 nt, Human
ugugcucaggagccc

SEQ ID NO: 3675026 - RNA, 20 nt, Human
ugugcucaggagcccuggga

SEQ ID NO: 3675027 - RNA, 21 nt, Human
ugugcucaggagcccugggag

SEQ ID NO: 3675028 - RNA, 15 nt, Human
ugugcucauuuaagu

SEQ ID NO: 3675029 - RNA, 21 nt, Human
ugugcucccugguucugauga

SEQ ID NO: 3675030 - RNA, 23 nt, Human
ugugcuccgugccuccaccacca

SEQ ID NO: 3675031 - RNA, 22 nt, Human
ugugcucugaucauccacugug

SEQ ID NO: 3675032 - RNA, 23 nt, Human
ugugcucugaucauccacugugc

SEQ ID NO: 3675033 - RNA, 16 nt, Human
ugugcucuggacaggc

SEQ ID NO: 3675034 - RNA, 19 nt, Human
ugugcucuggacaggcaug

SEQ ID NO: 3675035 - RNA, 14 nt, Human
ugugcugacccucc

SEQ ID NO: 3675036 - RNA, 17 nt, Human
ugugcugacccuccugu

SEQ ID NO: 3675037 - RNA, 21 nt, Human
ugugcugacggaagccaacuu

SEQ ID NO: 3675038 - RNA, 14 nt, Human
ugugcugaggccuu

SEQ ID NO: 3675039 - RNA, 18 nt, Human
ugugcugagucugaaggc

SEQ ID NO: 3675040 - RNA, 19 nt, Human
ugugcugagucugaaggcu

SEQ ID NO: 3675041 - RNA, 16 nt, Human
ugugcugccauuugau

SEQ ID NO: 3675042 - RNA, 12 nt, Human
ugugcugcccug

SEQ ID NO: 3675043 - RNA, 19 nt, Human
ugugcuggauggagcccag

SEQ ID NO: 3675044 - RNA, 20 nt, Human
ugugcuggauggagcccagg

SEQ ID NO: 3675045 - RNA, 21 nt, Human
ugugcuggauggagcccaggc

SEQ ID NO: 3675046 - RNA, 13 nt, Human
ugugcuggccagc

SEQ ID NO: 3675047 - RNA, 12 nt, Human
ugugcugggagc

SEQ ID NO: 3675048 - RNA, 16 nt, Human
ugugcugggggaauga

SEQ ID NO: 3675049 - RNA, 19 nt, Human
ugugcugguguccugacca

SEQ ID NO: 3675050 - RNA, 14 nt, Human
ugugcuguggaagc

SEQ ID NO: 3675051 - RNA, 17 nt, Human
ugugcuguggaagcaac

SEQ ID NO: 3675052 - RNA, 17 nt, Human
ugugcuguggggcuggu

SEQ ID NO: 3675053 - RNA, 12 nt, Human
ugugcuguguaa

SEQ ID NO: 3675054 - RNA, 15 nt, Human
ugugcuuccuccugc

SEQ ID NO: 3675055 - RNA, 15 nt, Human
ugugcuucuccccag

SEQ ID NO: 3675056 - RNA, 20 nt, Human
ugugcuucuccccagaauuc

SEQ ID NO: 3675057 - RNA, 21 nt, Human
ugugcuugaaggcccugcuga

SEQ ID NO: 3675058 - RNA, 19 nt, Human
ugugcuuguuuuauaaaau

SEQ ID NO: 3675059 - RNA, 14 nt, Human
ugugcuuuagcuug

SEQ ID NO: 3675060 - RNA, 13 nt, Human
ugugcuuuaugcu

SEQ ID NO: 3675061 - RNA, 17 nt, Human
ugugcuuuaugcugaaa

SEQ ID NO: 3675062 - RNA, 18 nt, Human
ugugcuuuaugcugaaac

SEQ ID NO: 3675063 - RNA, 20 nt, Human
ugugcuuuaugcugaaacag

SEQ ID NO: 3675064 - RNA, 14 nt, Human
ugugcuuuccagcu

SEQ ID NO: 3675065 - RNA, 16 nt, Human
ugugcuuuccagcuca

SEQ ID NO: 3675066 - RNA, 11 nt, Human
ugugcuuucua

SEQ ID NO: 3675067 - RNA, 16 nt, Human
ugugcuuugcucuugu

SEQ ID NO: 3675068 - RNA, 14 nt, Human
ugugcuuuuccuga

SEQ ID NO: 3675069 - RNA, 15 nt, Human
ugugcuuuucuccaa

SEQ ID NO: 3675070 - RNA, 16 nt, Human
uguggaaaaauauuua

SEQ ID NO: 3675071 - RNA, 19 nt, Human
uguggaaaaaugagagaag

SEQ ID NO: 3675072 - RNA, 20 nt, Human
uguggaaaaaugagagaagg

SEQ ID NO: 3675073 - RNA, 15 nt, Human
uguggaaaagaaaca

SEQ ID NO: 3675074 - RNA, 18 nt, Human
uguggaaaccuccacagg

SEQ ID NO: 3675075 - RNA, 14 nt, Human
uguggaaagccucu

SEQ ID NO: 3675076 - RNA, 17 nt, Human
uguggaaagccucugcu

SEQ ID NO: 3675077 - RNA, 19 nt, Human
uguggaaaguguaaagcau

SEQ ID NO: 3675078 - RNA, 14 nt, Human
uguggaagcaaaaa

SEQ ID NO: 3675079 - RNA, 15 nt, Human
uguggaagggacuag

SEQ ID NO: 3675080 - RNA, 18 nt, Human
uguggaagggacuaggag

SEQ ID NO: 3675081 - RNA, 20 nt, Human
uguggaaguguguguggcag

SEQ ID NO: 3675082 - RNA, 21 nt, Human
ugggagcuccucuccuggagg

SEQ ID NO: 3675083 - RNA, 23 nt, Human
ugggagcuccucuccuggaggau

SEQ ID NO: 3675084 - RNA, 20 nt, Human
ugggagcugaggccacacuc

SEQ ID NO: 3675085 - RNA, 22 nt, Human
ugggagcugaggccacacucag

SEQ ID NO: 3675086 - RNA, 12 nt, Human
ugggagcugccu

SEQ ID NO: 3675087 - RNA, 14 nt, Human
ugggagcugccugu

SEQ ID NO: 3675088 - RNA, 21 nt, Human
ugggagcugccuguucagcuc

SEQ ID NO: 3675089 - RNA, 20 nt, Human
ugggagcugguuagaaaugc

SEQ ID NO: 3675090 - RNA, 20 nt, Human
ugggagcuugauucucagca

SEQ ID NO: 3675091 - RNA, 12 nt, Human
ugggaggaaaag

SEQ ID NO: 3675092 - RNA, 18 nt, Human
ugggaggaagcagaauaa

SEQ ID NO: 3675093 - RNA, 21 nt, Human
ugggaggaagcagaauaaagc

SEQ ID NO: 3675094 - RNA, 24 nt, Human
ugggaggaagcagguugaggggcu

SEQ ID NO: 3675095 - RNA, 17 nt, Human
ugggaggagggcaggca

SEQ ID NO: 3675096 - RNA, 16 nt, Human
ugggaggaucucuuga

SEQ ID NO: 3675097 - RNA, 20 nt, Human
ugggaggaucucuugagccu

SEQ ID NO: 3675098 - RNA, 18 nt, Human
ugggaggauugcuugagc

SEQ ID NO: 3675099 - RNA, 18 nt, Human
ugggaggcauggcccugg

SEQ ID NO: 3675100 - RNA, 16 nt, Human
ugggaggccccacugg

SEQ ID NO: 3675101 - RNA, 20 nt, Human
ugggaggccccuucucuccc

SEQ ID NO: 3675102 - RNA, 17 nt, Human
ugggaggcgggagugga

SEQ ID NO: 3675103 - RNA, 14 nt, Human
ugggaggcuccccu

SEQ ID NO: 3675104 - RNA, 15 nt, Human
ugggaggcuccccuu

SEQ ID NO: 3675105 - RNA, 17 nt, Human
ugggaggcuccuguuag

SEQ ID NO: 3675106 - RNA, 15 nt, Human
ugggaggcugaggcg

SEQ ID NO: 3675107 - RNA, 18 nt, Human
ugggagggaaaagggaag

SEQ ID NO: 3675108 - RNA, 17 nt, Human
ugggagggagcagacag

SEQ ID NO: 3675109 - RNA, 18 nt, Human
ugggagggagcagacagg

SEQ ID NO: 3675110 - RNA, 16 nt, Human
ugggagggaggcucag

SEQ ID NO: 3675111 - RNA, 17 nt, Human
ugggagggaggcucagg

SEQ ID NO: 3675112 - RNA, 14 nt, Human
ugggagggcagcag

SEQ ID NO: 3675113 - RNA, 17 nt, Human
ugggagggcagcagggc

SEQ ID NO: 3675114 - RNA, 12 nt, Human
ugggagggccca

SEQ ID NO: 3675115 - RNA, 16 nt, Human
ugggaggggcaggcug

SEQ ID NO: 3675116 - RNA, 18 nt, Human
ugggaggggcaggcugac

SEQ ID NO: 3675117 - RNA, 23 nt, Human
ugggaggggcgcccaccucccca

SEQ ID NO: 3675118 - RNA, 18 nt, Human
ugggagggggagaaaagg

SEQ ID NO: 3675119 - RNA, 24 nt, Human
ugggaggggguuggggugguugag

SEQ ID NO: 3675120 - RNA, 17 nt, Human
ugggaggucaaggcugc

SEQ ID NO: 3675121 - RNA, 20 nt, Human
ugggaggucaaggcugcagu

SEQ ID NO: 3675122 - RNA, 18 nt, Human
ugggagguggaagaaggg

SEQ ID NO: 3675123 - RNA, 20 nt, Human
ugggagguggagguugcagu

SEQ ID NO: 3675124 - RNA, 15 nt, Human
ugggagguuaaaaag

SEQ ID NO: 3675125 - RNA, 15 nt, Human
ugggagucacacagu

SEQ ID NO: 3675126 - RNA, 19 nt, Human
ugggaguccaggcacagga

SEQ ID NO: 3675127 - RNA, 15 nt, Human
ugggagugagcuggu

SEQ ID NO: 3675128 - RNA, 13 nt, Human
ugggaguguguaa

SEQ ID NO: 3675129 - RNA, 18 nt, Human
ugggaguguugagcaucu

SEQ ID NO: 3675130 - RNA, 14 nt, Human
ugggauaaaugcca

SEQ ID NO: 3675131 - RNA, 15 nt, Human
ugggauacaaccucc

SEQ ID NO: 3675132 - RNA, 20 nt, Human
ugggauacaaccucccucuu

SEQ ID NO: 3675133 - RNA, 16 nt, Human
ugggauacugcagggc

SEQ ID NO: 3675134 - RNA, 19 nt, Human
ugggaucacauguggacuu

SEQ ID NO: 3675135 - RNA, 16 nt, Human
uaaaaggaaaagcaaa

SEQ ID NO: 3675136 - RNA, 19 nt, Human
uaaaaggaagccaaagagu

SEQ ID NO: 3675137 - RNA, 15 nt, Human
uaaaaggauaguauu

SEQ ID NO: 3675138 - RNA, 23 nt, Human
uaaaaggauaguauuuuuaucca

SEQ ID NO: 3675139 - RNA, 15 nt, Human
uaaaaggccaaaccu

SEQ ID NO: 3675140 - RNA, 20 nt, Human
uaaaagggacugagaaauuu

SEQ ID NO: 3675141 - RNA, 20 nt, Human
uaaaagggauuacccaagca

SEQ ID NO: 3675142 - RNA, 17 nt, Human
uaaaagggcaaaucugc

SEQ ID NO: 3675143 - RNA, 19 nt, Human
uaaaaggggguccguggaa

SEQ ID NO: 3675144 - RNA, 21 nt, Human
uaaaagguucagggaaccguu

SEQ ID NO: 3675145 - RNA, 18 nt, Human
uaaaaguaaaaugucuuu

SEQ ID NO: 3675146 - RNA, 13 nt, Human
uaaaaguaaacau

SEQ ID NO: 3675147 - RNA, 18 nt, Human
uaaaagugaaugaaagau

SEQ ID NO: 3675148 - RNA, 17 nt, Human
uaaaagugcacaccuua

SEQ ID NO: 3675149 - RNA, 18 nt, Human
uaaaaguguccauugaaa

SEQ ID NO: 3675150 - RNA, 12 nt, Human
uaaaaguuacuu

SEQ ID NO: 3675151 - RNA, 12 nt, Human
uaaaaguucuuu

SEQ ID NO: 3675152 - RNA, 15 nt, Human
uaaaaguugugauuc

SEQ ID NO: 3675153 - RNA, 18 nt, Human
uaaaaguuucaaugugau

SEQ ID NO: 3675154 - RNA, 18 nt, Human
uaaaaguuugaaaagcaa

SEQ ID NO: 3675155 - RNA, 15 nt, Human
uaaaauaaaaugaaa

SEQ ID NO: 3675156 - RNA, 17 nt, Human
uaaaauaaaaugaaaau

SEQ ID NO: 3675157 - RNA, 19 nt, Human
uaaaauaaaaugaaaauug

SEQ ID NO: 3675158 - RNA, 15 nt, Human
uaaaauaaacaguug

SEQ ID NO: 3675159 - RNA, 13 nt, Human
uaaaauaaacuuu

SEQ ID NO: 3675160 - RNA, 15 nt, Human
uaaaauaaacuuucu

SEQ ID NO: 3675161 - RNA, 16 nt, Human
uaaaauaaacuuucuu

SEQ ID NO: 3675162 - RNA, 22 nt, Human
uaaaauaaaguauauauagaau

SEQ ID NO: 3675163 - RNA, 13 nt, Human
uaaaauaaauggu

SEQ ID NO: 3675164 - RNA, 19 nt, Human
uaaaauaacagauuucuca

SEQ ID NO: 3675165 - RNA, 17 nt, Human
uaaaauaacuaaaaugu

SEQ ID NO: 3675166 - RNA, 19 nt, Human
uaaaauaacuaaaauguau

SEQ ID NO: 3675167 - RNA, 24 nt, Human
uaaaauaacuaguguugcuuggac

SEQ ID NO: 3675168 - RNA, 20 nt, Human
uaaaauaagcacugugcuaa

SEQ ID NO: 3675169 - RNA, 22 nt, Human
uaaaauaaggauuuuucucuua

SEQ ID NO: 3675170 - RNA, 12 nt, Human
uaaaauaauaaa

SEQ ID NO: 3675171 - RNA, 18 nt, Human
uaaaauaauuucucuaca

SEQ ID NO: 3675172 - RNA, 22 nt, Human
uaaaauaauuuuaucucuuucu

SEQ ID NO: 3675173 - RNA, 15 nt, Human
uaaaauaauuuugua

SEQ ID NO: 3675174 - RNA, 18 nt, Human
uaaaauacaagacugcca

SEQ ID NO: 3675175 - RNA, 16 nt, Human
uaaaauacagaauaca

SEQ ID NO: 3675176 - RNA, 15 nt, Human
uaaaauacauuuaaa

SEQ ID NO: 3675177 - RNA, 16 nt, Human
uaaaauacauuuaaaa

SEQ ID NO: 3675178 - RNA, 18 nt, Human
uaaaauacauuuaaaacu

SEQ ID NO: 3675179 - RNA, 22 nt, Human
uaaaauaccagccaguaaaugg

SEQ ID NO: 3675180 - RNA, 12 nt, Human
uaaaauacuauu

SEQ ID NO: 3675181 - RNA, 14 nt, Human
uaaaauacuguaga

SEQ ID NO: 3675182 - RNA, 13 nt, Human
uaaaauacuucuu

SEQ ID NO: 3675183 - RNA, 22 nt, Human
uaaaauacuucuuuuuacaaug

SEQ ID NO: 3675184 - RNA, 19 nt, Human
uaaaauacuuuuacucugc

SEQ ID NO: 3675185 - RNA, 20 nt, Human
uaaaauacuuuuacucugcc

SEQ ID NO: 3675186 - RNA, 17 nt, Human
uaaaauagaaauaagug

SEQ ID NO: 3675187 - RNA, 22 nt, Human
uaaaauagaaauuuuguaagaa

SEQ ID NO: 3675188 - RNA, 21 nt, Human
uaaaauagaguguaguuuaca

SEQ ID NO: 3675189 - RNA, 20 nt, Human
uaaaauagauaaauaaauau

SEQ ID NO: 3675190 - RNA, 16 nt, Human
uaaaauagauauaaau

SEQ ID NO: 3675191 - RNA, 22 nt, Human
uaaaauagcaaaagaagaaguu

SEQ ID NO: 3675192 - RNA, 14 nt, Human
uaaaauagcuugua

SEQ ID NO: 3675193 - RNA, 18 nt, Human
uaaaauagcuuguauagu

SEQ ID NO: 3675194 - RNA, 14 nt, Human
uaaaauauaaacaa

SEQ ID NO: 3675195 - RNA, 16 nt, Human
uaaaauauaauuguuu

SEQ ID NO: 3675196 - RNA, 18 nt, Human
uaaaauaucauucagcaa

SEQ ID NO: 3675197 - RNA, 14 nt, Human
uaaaauaucuacau

SEQ ID NO: 3675198 - RNA, 13 nt, Human
uaaaauaugcacu

SEQ ID NO: 3675199 - RNA, 14 nt, Human
uaaaauauggcuau

SEQ ID NO: 3675200 - RNA, 13 nt, Human
uaaaauauuccug

SEQ ID NO: 3675201 - RNA, 23 nt, Human
uaaaauauuguugaacacuugaa

SEQ ID NO: 3675202 - RNA, 15 nt, Human
uaaaauauuuaucug

SEQ ID NO: 3675203 - RNA, 17 nt, Human
uaaaauauuuaugaaga

SEQ ID NO: 3675204 - RNA, 18 nt, Human
uaaaauauuuaugaagaa

SEQ ID NO: 3675205 - RNA, 18 nt, Human
uaaaauauuuucugugug

SEQ ID NO: 3675206 - RNA, 22 nt, Human
uaaaauauuuucuguguguucc

SEQ ID NO: 3675207 - RNA, 17 nt, Human
uaaaaucaaaacaagug

SEQ ID NO: 3675208 - RNA, 19 nt, Human
uaaaaucaauuuuuaggaa

SEQ ID NO: 3675209 - RNA, 16 nt, Human
uaaaaucacuaacauu

SEQ ID NO: 3675210 - RNA, 19 nt, Human
uaaaaucacuaacauuaua

SEQ ID NO: 3675211 - RNA, 16 nt, Human
uaaaaucauaaguauu

SEQ ID NO: 3675212 - RNA, 15 nt, Human
uaaaauccauacauu

SEQ ID NO: 3675213 - RNA, 19 nt, Human
uaaaauccauacauuugug

SEQ ID NO: 3675214 - RNA, 17 nt, Human
uaaaauccuaagacaca

SEQ ID NO: 3675215 - RNA, 16 nt, Human
uaaaaucuauucugug

SEQ ID NO: 3675216 - RNA, 15 nt, Human
uaaaaucuccuaaau

SEQ ID NO: 3675217 - RNA, 17 nt, Human
uaaaaucugagggaaau

SEQ ID NO: 3675218 - RNA, 23 nt, Human
uaaaaucugauauguauuguuug

SEQ ID NO: 3675219 - RNA, 21 nt, Human
uaaaaucugcuuguauuccaa

SEQ ID NO: 3675220 - RNA, 13 nt, Human
uaaaaucugucac

SEQ ID NO: 3675221 - RNA, 17 nt, Human
uaaaaucuuauaguucu

SEQ ID NO: 3675222 - RNA, 18 nt, Human
uaaaaucuuauaguucua

SEQ ID NO: 3675223 - RNA, 14 nt, Human
uaaaaucuuauuaa

SEQ ID NO: 3675224 - RNA, 17 nt, Human
uaaaaucuuauuaaagu

SEQ ID NO: 3675225 - RNA, 22 nt, Human
uaaaaucuuauuaaaguuucaa

SEQ ID NO: 3675226 - RNA, 23 nt, Human
uaaaaucuuauuaaaguuucaaa

SEQ ID NO: 3675227 - RNA, 11 nt, Human
uaaaaucuugu

SEQ ID NO: 3675228 - RNA, 12 nt, Human
uaaaaucuuguc

SEQ ID NO: 3675229 - RNA, 18 nt, Human
uaaaaucuugucaugugu

SEQ ID NO: 3675230 - RNA, 21 nt, Human
uaaaaucuugucauguguaua

SEQ ID NO: 3675231 - RNA, 20 nt, Human
uaaaaucuuucuuucuuaga

SEQ ID NO: 3675232 - RNA, 21 nt, Human
uaaaaucuuucuuucuuagaa

SEQ ID NO: 3675233 - RNA, 17 nt, Human
uaaaaugacaaucaugu

SEQ ID NO: 3675234 - RNA, 19 nt, Human
uaaaaugacaaucaugugu

SEQ ID NO: 3675235 - RNA, 20 nt, Human
uaaaaugacuacuuagcauc

SEQ ID NO: 3675236 - RNA, 17 nt, Human
uaaaaugaggacauguu

SEQ ID NO: 3675237 - RNA, 15 nt, Human
uaaaaugauugaaaa

SEQ ID NO: 3675238 - RNA, 15 nt, Human
uaaaaugauuguaaa

SEQ ID NO: 3675239 - RNA, 20 nt, Human
uaaaaugauuguaaaauagc

SEQ ID NO: 3675240 - RNA, 17 nt, Human
uaaaaugauuuuaucug

SEQ ID NO: 3675241 - RNA, 17 nt, Human
uaaaaugcaaaaaaucu

SEQ ID NO: 3675242 - RNA, 17 nt, Human
uaaaaugcaacaugugu

SEQ ID NO: 3675243 - RNA, 18 nt, Human
uaaaaugcaacaugugua

SEQ ID NO: 3675244 - RNA, 20 nt, Human
uaaaaugcaacauguguacu

SEQ ID NO: 3675245 - RNA, 16 nt, Human
uaaaaugcaauauuug

SEQ ID NO: 3675246 - RNA, 14 nt, Human
uaaaaugcuagguu

SEQ ID NO: 3675247 - RNA, 18 nt, Human
ugggccauagcuccugcu

SEQ ID NO: 3675248 - RNA, 17 nt, Human
ugggccauguccaaaga

SEQ ID NO: 3675249 - RNA, 24 nt, Human
ugggccauguccaaagaggcugcc

SEQ ID NO: 3675250 - RNA, 18 nt, Human
ugggcccaacccugucug

SEQ ID NO: 3675251 - RNA, 23 nt, Human
ugggcccaagacagaugccccag

SEQ ID NO: 3675252 - RNA, 18 nt, Human
ugggcccacaaaggcaaa

SEQ ID NO: 3675253 - RNA, 19 nt, Human
ugggcccacccaagcagga

SEQ ID NO: 3675254 - RNA, 18 nt, Human
ugggcccagaggcacagc

SEQ ID NO: 3675255 - RNA, 14 nt, Human
ugggcccagaucug

SEQ ID NO: 3675256 - RNA, 13 nt, Human
ugggcccagcugg

SEQ ID NO: 3675257 - RNA, 20 nt, Human
ugggcccagcugggcucugc

SEQ ID NO: 3675258 - RNA, 22 nt, Human
ugggcccagcugggcucugcca

SEQ ID NO: 3675259 - RNA, 20 nt, Human
ugggcccaggaccagcuggg

SEQ ID NO: 3675260 - RNA, 23 nt, Human
ugggcccaggaccagcuggggcg

SEQ ID NO: 3675261 - RNA, 13 nt, Human
ugggcccagggac

SEQ ID NO: 3675262 - RNA, 13 nt, Human
ugggccccagccc

SEQ ID NO: 3675263 - RNA, 12 nt, Human
ugggccccagcu

SEQ ID NO: 3675264 - RNA, 18 nt, Human
ugggccccaguuguauuu

SEQ ID NO: 3675265 - RNA, 19 nt, Human
ugggccccauguuaacccc

SEQ ID NO: 3675266 - RNA, 13 nt, Human
ugggccccucccu

SEQ ID NO: 3675267 - RNA, 16 nt, Human
ugggccccucccuacc

SEQ ID NO: 3675268 - RNA, 14 nt, Human
ugggccccucugac

SEQ ID NO: 3675269 - RNA, 19 nt, Human
ugggccccugccucucugc

SEQ ID NO: 3675270 - RNA, 20 nt, Human
ugggccccugccucucugca

SEQ ID NO: 3675271 - RNA, 21 nt, Human
ugggccccugccucucugcag

SEQ ID NO: 3675272 - RNA, 12 nt, Human
ugggccccuggc

SEQ ID NO: 3675273 - RNA, 16 nt, Human
ugggcccucugguuug

SEQ ID NO: 3675274 - RNA, 11 nt, Human
ugggcccugca

SEQ ID NO: 3675275 - RNA, 16 nt, Human
ugggcccugggcugga

SEQ ID NO: 3675276 - RNA, 14 nt, Human
ugggcccuggggcc

SEQ ID NO: 3675277 - RNA, 22 nt, Human
ugggcccuggggccuguacugc

SEQ ID NO: 3675278 - RNA, 22 nt, Human
ugggccuauggagagcccuggg

SEQ ID NO: 3675279 - RNA, 20 nt, Human
ugggccuccucacaacaugg

SEQ ID NO: 3675280 - RNA, 15 nt, Human
uguuuacaagaaaaa

SEQ ID NO: 3675281 - RNA, 16 nt, Human
uguuuacacucuuugu

SEQ ID NO: 3675282 - RNA, 22 nt, Human
uguuuacagauaauuaccuacu

SEQ ID NO: 3675283 - RNA, 20 nt, Human
uguuuacagggagccuccug

SEQ ID NO: 3675284 - RNA, 21 nt, Human
uguuuacagggagccuccugc

SEQ ID NO: 3675285 - RNA, 12 nt, Human
uguuuacagugu

SEQ ID NO: 3675286 - RNA, 12 nt, Human
uguuuacauauc

SEQ ID NO: 3675287 - RNA, 14 nt, Human
uguuuacaucaguu

SEQ ID NO: 3675288 - RNA, 16 nt, Human
uguuuacaugcuuauu

SEQ ID NO: 3675289 - RNA, 22 nt, Human
uguuuacaugcuuauuccauga

SEQ ID NO: 3675290 - RNA, 22 nt, Human
uguuuacauuugaugcaugucu

SEQ ID NO: 3675291 - RNA, 16 nt, Human
uguuuaccuuucucuc

SEQ ID NO: 3675292 - RNA, 19 nt, Human
uguuuacuagggaucccuc

SEQ ID NO: 3675293 - RNA, 17 nt, Human
uguuuacuuaaagauuu

SEQ ID NO: 3675294 - RNA, 17 nt, Human
uguuuacuuuaaacuug

SEQ ID NO: 3675295 - RNA, 18 nt, Human
uguuuacuuuaaacuugu

SEQ ID NO: 3675296 - RNA, 12 nt, Human
uguuuagaauug

SEQ ID NO: 3675297 - RNA, 15 nt, Human
uguuuagaauugaag

SEQ ID NO: 3675298 - RNA, 13 nt, Human
uguuuagacuuua

SEQ ID NO: 3675299 - RNA, 20 nt, Human
uguuuagaugaaugucaguu

SEQ ID NO: 3675300 - RNA, 15 nt, Human
uguuuagauuuugug

SEQ ID NO: 3675301 - RNA, 20 nt, Human
uguuuagauuuuguguuuau

SEQ ID NO: 3675302 - RNA, 17 nt, Human
uguuuagucuugucuca

SEQ ID NO: 3675303 - RNA, 20 nt, Human
uaaagccugaguuugcuuuc

SEQ ID NO: 3675304 - RNA, 16 nt, Human
uaaagccugcuuuuua

SEQ ID NO: 3675305 - RNA, 21 nt, Human
uaaagccuuuaguaucagugu

SEQ ID NO: 3675306 - RNA, 15 nt, Human
uaaagcuaaaauaaa

SEQ ID NO: 3675307 - RNA, 23 nt, Human
uaaagcuaaaaugauuuuaucug

SEQ ID NO: 3675308 - RNA, 15 nt, Human
uaaagcucaaaugaa

SEQ ID NO: 3675309 - RNA, 18 nt, Human
uaaagcucaaaugaaaug

SEQ ID NO: 3675310 - RNA, 20 nt, Human
uaaagcucaaaugaaaugua

SEQ ID NO: 3675311 - RNA, 18 nt, Human
uaaagcucgaaaacaauu

SEQ ID NO: 3675312 - RNA, 14 nt, Human
uaaagcucugacau

SEQ ID NO: 3675313 - RNA, 17 nt, Human
uaaagcugccuguaguu

SEQ ID NO: 3675314 - RNA, 16 nt, Human
uaaagcuuauccauaa

SEQ ID NO: 3675315 - RNA, 20 nt, Human
uaaagcuuguugacucagcu

SEQ ID NO: 3675316 - RNA, 14 nt, Human
uaaaggaaaagaca

SEQ ID NO: 3675317 - RNA, 17 nt, Human
uaaaggagaaggcauga

SEQ ID NO: 3675318 - RNA, 15 nt, Human
uaaaggaguuuaugu

SEQ ID NO: 3675319 - RNA, 16 nt, Human
uaaaggaugugauugu

SEQ ID NO: 3675320 - RNA, 22 nt, Human
uaaaggaugugauuguggaaug

SEQ ID NO: 3675321 - RNA, 17 nt, Human
uaaaggcuaccuuugua

SEQ ID NO: 3675322 - RNA, 17 nt, Human
uaaaggcucgauuuugu

SEQ ID NO: 3675323 - RNA, 15 nt, Human
uaaaggcuucucucu

SEQ ID NO: 3675324 - RNA, 17 nt, Human
uaaaggcuucucucuca

SEQ ID NO: 3675325 - RNA, 21 nt, Human
uaaagggaaaggauucaugug

SEQ ID NO: 3675326 - RNA, 14 nt, Human
uaaagggaagaaaa

SEQ ID NO: 3675327 - RNA, 17 nt, Human
uaaagggcaaauaauga

SEQ ID NO: 3675328 - RNA, 19 nt, Human
uaaagggcccaaugaauua

SEQ ID NO: 3675329 - RNA, 21 nt, Human
uaaagggcccaaugaauuauu

SEQ ID NO: 3675330 - RNA, 15 nt, Human
uaaagggccugccug

SEQ ID NO: 3675331 - RNA, 16 nt, Human
uaaagggccugccugg

SEQ ID NO: 3675332 - RNA, 13 nt, Human
uaaagguggauuu

SEQ ID NO: 3675333 - RNA, 22 nt, Human
uaaaggugguauguguguguau

SEQ ID NO: 3675334 - RNA, 21 nt, Human
uaaagguggugaggcaauaaa

SEQ ID NO: 3675335 - RNA, 19 nt, Human
uaaaggugucuuccuccca

SEQ ID NO: 3675336 - RNA, 22 nt, Human
uaaagguucaugcaaacuuuau

SEQ ID NO: 3675337 - RNA, 20 nt, Human
uaaagguugacaauaaaugu

SEQ ID NO: 3675338 - RNA, 15 nt, Human
uaaagguuuauuuuu

SEQ ID NO: 3675339 - RNA, 21 nt, Human
uaaagguuuauuuuucuguua

SEQ ID NO: 3675340 - RNA, 13 nt, Human
uaaaguaaagcua

SEQ ID NO: 3675341 - RNA, 13 nt, Human
uaaaguaauuggu

SEQ ID NO: 3675342 - RNA, 21 nt, Human
uaaaguagauuagaucuuuua

SEQ ID NO: 3675343 - RNA, 19 nt, Human
uaaaguaguaaaaauuaaa

SEQ ID NO: 3675344 - RNA, 17 nt, Human
uaaaguaguccugugaa

SEQ ID NO: 3675345 - RNA, 15 nt, Human
uaaaguauaauguuu

SEQ ID NO: 3675346 - RNA, 20 nt, Human
uaaaguauagagagaaguuc

SEQ ID NO: 3675347 - RNA, 14 nt, Human
uaaaguauauauuu

SEQ ID NO: 3675348 - RNA, 19 nt, Human
uaaaguaugguauugaaac

SEQ ID NO: 3675349 - RNA, 22 nt, Human
uaaaguauguaaaguauguaaa

SEQ ID NO: 3675350 - RNA, 14 nt, Human
uaaaguauuccacc

SEQ ID NO: 3675351 - RNA, 18 nt, Human
uaaaguauucuucucuuc

SEQ ID NO: 3675352 - RNA, 12 nt, Human
uaaaguauuuaa

SEQ ID NO: 3675353 - RNA, 19 nt, Human
uaaaguauuuggguuuugu

SEQ ID NO: 3675354 - RNA, 12 nt, Human
uaaaguauuuuu

SEQ ID NO: 3675355 - RNA, 21 nt, Human
uaaaguauuuuuauaaauaua

SEQ ID NO: 3675356 - RNA, 23 nt, Human
uaaaguauuuuuauaaauauaag

SEQ ID NO: 3675357 - RNA, 15 nt, Human
uaaagucagaaguuu

SEQ ID NO: 3675358 - RNA, 17 nt, Human
uaaagucagauggaaaa

SEQ ID NO: 3675359 - RNA, 23 nt, Human
uaaagucauggucauugcaggaa

SEQ ID NO: 3675360 - RNA, 20 nt, Human
uaaagucgagcuuuucuaaa

SEQ ID NO: 3675361 - RNA, 19 nt, Human
uaaagugacuaauggcaug

SEQ ID NO: 3675362 - RNA, 17 nt, Human
uaaagugagaaaacugu

SEQ ID NO: 3675363 - RNA, 19 nt, Human
uaaagugaggccacugaag

SEQ ID NO: 3675364 - RNA, 16 nt, Human
uaaagugauaauuucu

SEQ ID NO: 3675365 - RNA, 16 nt, Human
uaaagugauuaaacgu

SEQ ID NO: 3675366 - RNA, 15 nt, Human
uaaagugccaguauu

SEQ ID NO: 3675367 - RNA, 23 nt, Human
uaaagugccaguauuuuaaaaua

SEQ ID NO: 3675368 - RNA, 16 nt, Human
uaaagugcuaagguuc

SEQ ID NO: 3675369 - RNA, 21 nt, Human
uaaagugcuaagguucuaagg

SEQ ID NO: 3675370 - RNA, 11 nt, Human
uaaagugcuug

SEQ ID NO: 3675371 - RNA, 13 nt, Human
uaaaguguaacau

SEQ ID NO: 3675372 - RNA, 16 nt, Human
uaaaguguaauaauau

SEQ ID NO: 3675373 - RNA, 18 nt, Human
uaaaguguauuauaacag

SEQ ID NO: 3675374 - RNA, 22 nt, Human
uaaaguguccauugacauguac

SEQ ID NO: 3675375 - RNA, 23 nt, Human
uaaaguguccauugacauguaca

SEQ ID NO: 3675376 - RNA, 18 nt, Human
uaaaguguggucccaaca

SEQ ID NO: 3675377 - RNA, 17 nt, Human
uaaaguguguuguugcu

SEQ ID NO: 3675378 - RNA, 18 nt, Human
uaaaguguuucuguuauu

SEQ ID NO: 3675379 - RNA, 16 nt, Human
uaaaguguuuucagag

SEQ ID NO: 3675380 - RNA, 16 nt, Human
uaaaguuagaaucuau

SEQ ID NO: 3675381 - RNA, 20 nt, Human
uaaaguuagaaucuauuuuc

SEQ ID NO: 3675382 - RNA, 20 nt, Human
uaaaguuagucuacucuuaa

SEQ ID NO: 3675383 - RNA, 18 nt, Human
uaaaguucaacauguuau

SEQ ID NO: 3675384 - RNA, 16 nt, Human
uaaaguucuaagauuc

SEQ ID NO: 3675385 - RNA, 19 nt, Human
uaaaguucuaagauucuga

SEQ ID NO: 3675386 - RNA, 14 nt, Human
uaaaguucugugua

SEQ ID NO: 3675387 - RNA, 20 nt, Human
uaaaguugaagcuaagauuu

SEQ ID NO: 3675388 - RNA, 14 nt, Human
uaaaguugaauuua

SEQ ID NO: 3675389 - RNA, 20 nt, Human
uaaaguugauaaagauuuuu

SEQ ID NO: 3675390 - RNA, 18 nt, Human
uaaaguuggaauuuacca

SEQ ID NO: 3675391 - RNA, 13 nt, Human
uaaaguuguacuu

SEQ ID NO: 3675392 - RNA, 22 nt, Human
uaaaguuguacuuuaaaaauuu

SEQ ID NO: 3675393 - RNA, 18 nt, Human
uaaaguuguuugugccuu

SEQ ID NO: 3675394 - RNA, 13 nt, Human
uaaaguuuacagu

SEQ ID NO: 3675395 - RNA, 23 nt, Human
uaaaguuuacaguaaauaaauug

SEQ ID NO: 3675396 - RNA, 20 nt, Human
uaaaguuucaaaaaucugaa

SEQ ID NO: 3675397 - RNA, 14 nt, Human
uaaaguuucucaga

SEQ ID NO: 3675398 - RNA, 21 nt, Human
uaaaguuugcuuguuucuugg

SEQ ID NO: 3675399 - RNA, 14 nt, Human
uaaaguuuuauaua

SEQ ID NO: 3675400 - RNA, 21 nt, Human
uaaauaaaaaauaauaauaca

SEQ ID NO: 3675401 - RNA, 22 nt, Human
uaaauaaaaaauaauaauacaa

SEQ ID NO: 3675402 - RNA, 14 nt, Human
uaaauaaaaacuaa

SEQ ID NO: 3675403 - RNA, 22 nt, Human
uaaauaaaacauuuucacacaa

SEQ ID NO: 3675404 - RNA, 21 nt, Human
uaaauaaaacuuaaaucucac

SEQ ID NO: 3675405 - RNA, 13 nt, Human
uaaauaaaagaaa

SEQ ID NO: 3675406 - RNA, 15 nt, Human
uaaauaaaagcagca

SEQ ID NO: 3675407 - RNA, 17 nt, Human
uaaauaaaagugaucaa

SEQ ID NO: 3675408 - RNA, 13 nt, Human
uaaauaaaaugac

SEQ ID NO: 3675409 - RNA, 20 nt, Human
uaaauaaaaugcuagguucu

SEQ ID NO: 3675410 - RNA, 23 nt, Human
uaaauaaaaugcuagguucuacc

SEQ ID NO: 3675411 - RNA, 20 nt, Human
uaaauaaaauuuguugcaua

SEQ ID NO: 3675412 - RNA, 20 nt, Human
uaaauaaacacauagauuca

SEQ ID NO: 3675413 - RNA, 12 nt, Human
uaaauaaacuuu

SEQ ID NO: 3675414 - RNA, 13 nt, Human
uaaauaaacuuuu

SEQ ID NO: 3675415 - RNA, 18 nt, Human
uaaauaaacuuuuuuuca

SEQ ID NO: 3675416 - RNA, 19 nt, Human
uaaauaaacuuuuuuucaa

SEQ ID NO: 3675417 - RNA, 21 nt, Human
uaaauaaacuuuuuuucaaug

SEQ ID NO: 3675418 - RNA, 14 nt, Human
uaaauaaaguauca

SEQ ID NO: 3675419 - RNA, 15 nt, Human
uaaauaaauauauau

SEQ ID NO: 3675420 - RNA, 16 nt, Human
uaaauaaaugucauua

SEQ ID NO: 3675421 - RNA, 21 nt, Human
uaaauaaauuguauauucacu

SEQ ID NO: 3675422 - RNA, 15 nt, Human
uaaauaaauuguuug

SEQ ID NO: 3675423 - RNA, 13 nt, Human
uaaauaaauuuga

SEQ ID NO: 3675424 - RNA, 20 nt, Human
ugguuugggaauauccaugu

SEQ ID NO: 3675425 - RNA, 22 nt, Human
ugguuuggggcgaggcagagga

SEQ ID NO: 3675426 - RNA, 21 nt, Human
ugguuuguaaauuaacuuuua

SEQ ID NO: 3675427 - RNA, 16 nt, Human
ugguuuuaaaauacug

SEQ ID NO: 3675428 - RNA, 13 nt, Human
ugguuuuagauuu

SEQ ID NO: 3675429 - RNA, 15 nt, Human
ugguuuucaaaauaa

SEQ ID NO: 3675430 - RNA, 20 nt, Human
ugguuuucaaccucuagaau

SEQ ID NO: 3675431 - RNA, 18 nt, Human
ugguuuuccccucccugg

SEQ ID NO: 3675432 - RNA, 20 nt, Human
ugguuuuccccucccugggu

SEQ ID NO: 3675433 - RNA, 13 nt, Human
ugguuuucugcca

SEQ ID NO: 3675434 - RNA, 21 nt, Human
ugguuuucugccaaugaccaa

SEQ ID NO: 3675435 - RNA, 18 nt, Human
ugguuuuguaagaugcug

SEQ ID NO: 3675436 - RNA, 18 nt, Human
ugguuuugugccaucugu

SEQ ID NO: 3675437 - RNA, 21 nt, Human
ugguuuuuaaaaaacugcuga

SEQ ID NO: 3675438 - RNA, 20 nt, Human
ugguuuuuacugcucugaga

SEQ ID NO: 3675439 - RNA, 19 nt, Human
ugguuuuuauuucuccuuu

SEQ ID NO: 3675440 - RNA, 19 nt, Human
ugguuuuucuuuucuugga

SEQ ID NO: 3675441 - RNA, 10 nt, Human
ugguuuuuuu

SEQ ID NO: 3675442 - RNA, 22 nt, Human
ugguuuuuuuuuuuuuuuuggc

SEQ ID NO: 3675443 - RNA, 20 nt, Human
uguaaaaaaaaaaaaguuau

SEQ ID NO: 3675444 - RNA, 22 nt, Human
uguaaaaaaaaaaaaguuauau

SEQ ID NO: 3675445 - RNA, 23 nt, Human
uguaaaaaaaccaccaaaaacaa

SEQ ID NO: 3675446 - RNA, 14 nt, Human
uguaaaaacacuga

SEQ ID NO: 3675447 - RNA, 16 nt, Human
uguaaaaacacugaaa

SEQ ID NO: 3675448 - RNA, 24 nt, Human
uguaaaaacagcauugcuuucuga

SEQ ID NO: 3675449 - RNA, 12 nt, Human
uguaaaaaucuu

SEQ ID NO: 3675450 - RNA, 20 nt, Human
uguaaaaauuggucacccua

SEQ ID NO: 3675451 - RNA, 11 nt, Human
uguaaaacaaa

SEQ ID NO: 3675452 - RNA, 16 nt, Human
uguaaaacgcugucaa

SEQ ID NO: 3675453 - RNA, 16 nt, Human
uguaaaacugaggcac

SEQ ID NO: 3675454 - RNA, 22 nt, Human
uguaaaagcaacaucagcuuga

SEQ ID NO: 3675455 - RNA, 18 nt, Human
uguaaaagcauuuuguaa

SEQ ID NO: 3675456 - RNA, 19 nt, Human
uguaaaagcauuuuguaau

SEQ ID NO: 3675457 - RNA, 14 nt, Human
uguaaaauaaaauu

SEQ ID NO: 3675458 - RNA, 16 nt, Human
uguaaaauaauucuga

SEQ ID NO: 3675459 - RNA, 12 nt, Human
uguaaaauagcu

SEQ ID NO: 3675460 - RNA, 18 nt, Human
uguaaaauauacuuaaau

SEQ ID NO: 3675461 - RNA, 13 nt, Human
uaaauaguauuuc

SEQ ID NO: 3675462 - RNA, 12 nt, Human
uaaauaguguua

SEQ ID NO: 3675463 - RNA, 15 nt, Human
uaaauaguguuauug

SEQ ID NO: 3675464 - RNA, 19 nt, Human
uaaauaguguuauugagag

SEQ ID NO: 3675465 - RNA, 13 nt, Human
uaaauauaaagac

SEQ ID NO: 3675466 - RNA, 14 nt, Human
uaaauauaaagacg

SEQ ID NO: 3675467 - RNA, 18 nt, Human
uaaauauaauucuguaaa

SEQ ID NO: 3675468 - RNA, 17 nt, Human
uaaauauaccacucuuu

SEQ ID NO: 3675469 - RNA, 16 nt, Human
uaaauauaguuccuaa

SEQ ID NO: 3675470 - RNA, 19 nt, Human
uaaauauaguuccuaagaa

SEQ ID NO: 3675471 - RNA, 15 nt, Human
uaaauauauauaaag

SEQ ID NO: 3675472 - RNA, 19 nt, Human
uaaauauauauaaauauau

SEQ ID NO: 3675473 - RNA, 21 nt, Human
uaaauauauauauauauaaaa

SEQ ID NO: 3675474 - RNA, 14 nt, Human
uaaauauaucuacc

SEQ ID NO: 3675475 - RNA, 18 nt, Human
uaaauauaugcuaagucu

SEQ ID NO: 3675476 - RNA, 18 nt, Human
uaaauaucuuuuauguuu

SEQ ID NO: 3675477 - RNA, 22 nt, Human
uaaauaugaacccuuuguuucu

SEQ ID NO: 3675478 - RNA, 22 nt, Human
uaaauaugaaucugcucacuuu

SEQ ID NO: 3675479 - RNA, 13 nt, Human
uaaauaugcagug

SEQ ID NO: 3675480 - RNA, 21 nt, Human
uaaauauggacugcucaggaa

SEQ ID NO: 3675481 - RNA, 14 nt, Human
uaaauauuaagcau

SEQ ID NO: 3675482 - RNA, 18 nt, Human
uaaauauuaguuaaugga

SEQ ID NO: 3675483 - RNA, 12 nt, Human
uaaauauugagg

SEQ ID NO: 3675484 - RNA, 13 nt, Human
uaaauauugucuu

SEQ ID NO: 3675485 - RNA, 15 nt, Human
uaaauauugucuuuu

SEQ ID NO: 3675486 - RNA, 18 nt, Human
uaaauauuuacauaugaa

SEQ ID NO: 3675487 - RNA, 17 nt, Human
uaaauauuuauguagau

SEQ ID NO: 3675488 - RNA, 14 nt, Human
uaaauauuucaaga

SEQ ID NO: 3675489 - RNA, 19 nt, Human
uaaauauuuggucucuauu

SEQ ID NO: 3675490 - RNA, 14 nt, Human
uaaauauuuuaaag

SEQ ID NO: 3675491 - RNA, 15 nt, Human
uaaauauuuuaaaga

SEQ ID NO: 3675492 - RNA, 13 nt, Human
uaaauauuuucua

SEQ ID NO: 3675493 - RNA, 14 nt, Human
uaaauauuuucuau

SEQ ID NO: 3675494 - RNA, 18 nt, Human
uaaauauuuugacuuguu

SEQ ID NO: 3675495 - RNA, 19 nt, Human
uaaauauuuugacuuguug

SEQ ID NO: 3675496 - RNA, 13 nt, Human
uaaaucaauaaag

SEQ ID NO: 3675497 - RNA, 20 nt, Human
uaaaucauauauaauaaauu

SEQ ID NO: 3675498 - RNA, 14 nt, Human
uaaaucauuaauac

SEQ ID NO: 3675499 - RNA, 17 nt, Human
uaaaucauucuuacuaa

SEQ ID NO: 3675500 - RNA, 17 nt, Human
uaaaucauuuuaggaaa

SEQ ID NO: 3675501 - RNA, 20 nt, Human
uaaaucauuuuaggaaagga

SEQ ID NO: 3675502 - RNA, 21 nt, Human
uaaaucauuuuaggaaaggau

SEQ ID NO: 3675503 - RNA, 19 nt, Human
uaaaucauuuuaugucaag

SEQ ID NO: 3675504 - RNA, 14 nt, Human
uaaauccaguucua

SEQ ID NO: 3675505 - RNA, 21 nt, Human
uaaauccaucacuauaauaaa

SEQ ID NO: 3675506 - RNA, 17 nt, Human
uaaaucccauuauucaa

SEQ ID NO: 3675507 - RNA, 15 nt, Human
uaaaucccauucaua

SEQ ID NO: 3675508 - RNA, 17 nt, Human
uaaauccuuuacuguua

SEQ ID NO: 3675509 - RNA, 19 nt, Human
uaaaucuaaaucuauuuau

SEQ ID NO: 3675510 - RNA, 13 nt, Human
uaaaucuaacauu

SEQ ID NO: 3675511 - RNA, 18 nt, Human
uaaaucuaguauacauug

SEQ ID NO: 3675512 - RNA, 19 nt, Human
uaaaucuaugaaguauaua

SEQ ID NO: 3675513 - RNA, 21 nt, Human
uaaaucuaugaaguauauaau

SEQ ID NO: 3675514 - RNA, 18 nt, Human
uaaaucuauuuauuaaua

SEQ ID NO: 3675515 - RNA, 19 nt, Human
uaaaucuauuuauuaauau

SEQ ID NO: 3675516 - RNA, 18 nt, Human
uaaaucuccaaaauaaaa

SEQ ID NO: 3675517 - RNA, 20 nt, Human
uaaaucuccaaaauaaaacu

SEQ ID NO: 3675518 - RNA, 22 nt, Human
uaaaucuccaaaauaaaacuuu

SEQ ID NO: 3675519 - RNA, 18 nt, Human
uaaaucucuaauauggca

SEQ ID NO: 3675520 - RNA, 18 nt, Human
uaaaucucuucuguguuu

SEQ ID NO: 3675521 - RNA, 14 nt, Human
uaaaucugacccag

SEQ ID NO: 3675522 - RNA, 17 nt, Human
uaaaucugacccagugc

SEQ ID NO: 3675523 - RNA, 12 nt, Human
uaaaucugccac

SEQ ID NO: 3675524 - RNA, 20 nt, Human
uaaaucugcuggaguuucau

SEQ ID NO: 3675525 - RNA, 16 nt, Human
uaaaucuguaagcucu

SEQ ID NO: 3675526 - RNA, 16 nt, Human
uaaaucugugaacuug

SEQ ID NO: 3675527 - RNA, 18 nt, Human
uaaaucugugaacuugaa

SEQ ID NO: 3675528 - RNA, 12 nt, Human
uaaaucugugau

SEQ ID NO: 3675529 - RNA, 21 nt, Human
uaaaucuguucugggcucuuu

SEQ ID NO: 3675530 - RNA, 19 nt, Human
uaaaucuuaaaaaguuguu

SEQ ID NO: 3675531 - RNA, 19 nt, Human
uaaaucuuuuauaggauuu

SEQ ID NO: 3675532 - RNA, 18 nt, Human
uaaaugaaaaucgugaca

SEQ ID NO: 3675533 - RNA, 14 nt, Human
uaaaugaaauugua

SEQ ID NO: 3675534 - RNA, 16 nt, Human
uaaaugaaauuguaaa

SEQ ID NO: 3675535 - RNA, 16 nt, Human
uaaaugaacaagagaa

SEQ ID NO: 3675536 - RNA, 23 nt, Human
uaaaugaacaagagaagcauucu

SEQ ID NO: 3675537 - RNA, 22 nt, Human
uaaaugaagcagcuuuaaacaa

SEQ ID NO: 3675538 - RNA, 16 nt, Human
uaaaugaauauuuuga

SEQ ID NO: 3675539 - RNA, 12 nt, Human
uaaaugaauguu

SEQ ID NO: 3675540 - RNA, 22 nt, Human
uaaaugagcaaauaucauacug

SEQ ID NO: 3675541 - RNA, 21 nt, Human
uaaaugauguggugccugagg

SEQ ID NO: 3675542 - RNA, 20 nt, Human
uaaaugauuuaaauuuaagu

SEQ ID NO: 3675543 - RNA, 16 nt, Human
uaaaugcaaaguucug

SEQ ID NO: 3675544 - RNA, 19 nt, Human
uaaaugcaaaguucugugu

SEQ ID NO: 3675545 - RNA, 15 nt, Human
uaaaugcaauaugua

SEQ ID NO: 3675546 - RNA, 23 nt, Human
uaaaugcaccuggaauauauaac

SEQ ID NO: 3675547 - RNA, 14 nt, Human
uaaaugcagcccau

SEQ ID NO: 3675548 - RNA, 16 nt, Human
uaaaugcaguuacaaa

SEQ ID NO: 3675549 - RNA, 10 nt, Human
uaaaugcaua

SEQ ID NO: 3675550 - RNA, 11 nt, Human
uaaaugccaca

SEQ ID NO: 3675551 - RNA, 15 nt, Human
uaaaugccacacacc

SEQ ID NO: 3675552 - RNA, 15 nt, Human
uaaaugcccagcccc

SEQ ID NO: 3675553 - RNA, 12 nt, Human
uaaaugcccugc

SEQ ID NO: 3675554 - RNA, 14 nt, Human
uaaaugccuaauaa

SEQ ID NO: 3675555 - RNA, 13 nt, Human
uaaauggcuguaa

SEQ ID NO: 3675556 - RNA, 18 nt, Human
uaaaugggggugcauuug

SEQ ID NO: 3675557 - RNA, 19 nt, Human
uaaaugguaauaagcacug

SEQ ID NO: 3675558 - RNA, 17 nt, Human
uaaauggucgcccagga

SEQ ID NO: 3675559 - RNA, 20 nt, Human
uaaaugguuuggugcuuuuu

SEQ ID NO: 3675560 - RNA, 21 nt, Human
uaaaugguuuggugcuuuuua

SEQ ID NO: 3675561 - RNA, 22 nt, Human
uaaaugguuuggugcuuuuuau

SEQ ID NO: 3675562 - RNA, 16 nt, Human
uaaauguaaacucagc

SEQ ID NO: 3675563 - RNA, 13 nt, Human
uaaauguaaagau

SEQ ID NO: 3675564 - RNA, 16 nt, Human
uaaauguaaagauauu

SEQ ID NO: 3675565 - RNA, 17 nt, Human
uaaauguaaagauauuu

SEQ ID NO: 3675566 - RNA, 13 nt, Human
uaaauguaacagu

SEQ ID NO: 3675567 - RNA, 17 nt, Human
uaaauguaccugaugua

SEQ ID NO: 3675568 - RNA, 18 nt, Human
uaaauguagaguuuuuaa

SEQ ID NO: 3675569 - RNA, 22 nt, Human
uuaacucaggacuccagcccau

SEQ ID NO: 3675570 - RNA, 15 nt, Human
uuaacuccacugcuu

SEQ ID NO: 3675571 - RNA, 20 nt, Human
uuaacuccacugcuuaccua

SEQ ID NO: 3675572 - RNA, 20 nt, Human
uuaacucuuugccuuugcca

SEQ ID NO: 3675573 - RNA, 21 nt, Human
uuaacugaacaauggcccugu

SEQ ID NO: 3675574 - RNA, 17 nt, Human
uuaacugcucaguguuu

SEQ ID NO: 3675575 - RNA, 21 nt, Human
uuaacuggugcacuuuguaaa

SEQ ID NO: 3675576 - RNA, 22 nt, Human
uuaacuggugcacuuuguaaau

SEQ ID NO: 3675577 - RNA, 13 nt, Human
uuaacuuaaauag

SEQ ID NO: 3675578 - RNA, 18 nt, Human
uuaacuuaacauucugua

SEQ ID NO: 3675579 - RNA, 17 nt, Human
uuaacuuaguuuugcau

SEQ ID NO: 3675580 - RNA, 14 nt, Human
uuaacuucucugga

SEQ ID NO: 3675581 - RNA, 12 nt, Human
uuaacuucugcc

SEQ ID NO: 3675582 - RNA, 14 nt, Human
uuaacuucuugcuu

SEQ ID NO: 3675583 - RNA, 21 nt, Human
uuaacuucuugcuucuuucua

SEQ ID NO: 3675584 - RNA, 17 nt, Human
uuaacuugagcuuuaaa

SEQ ID NO: 3675585 - RNA, 22 nt, Human
uuaacuugucaaaaaacaaaaa

SEQ ID NO: 3675586 - RNA, 16 nt, Human
uuaacuuuaaguuuca

SEQ ID NO: 3675587 - RNA, 14 nt, Human
uuaacuuuaauguu

SEQ ID NO: 3675588 - RNA, 13 nt, Human
uuaacuuuaccau

SEQ ID NO: 3675589 - RNA, 14 nt, Human
uuaacuuuuauaaa

SEQ ID NO: 3675590 - RNA, 17 nt, Human
uuaagaaaaaaauaauu

SEQ ID NO: 3675591 - RNA, 20 nt, Human
uuaagaaaaaggaugcacag

SEQ ID NO: 3675592 - RNA, 21 nt, Human
uuaagaaaaaggaugcacaga

SEQ ID NO: 3675593 - RNA, 17 nt, Human
uuaagaaaauacaauaa

SEQ ID NO: 3675594 - RNA, 20 nt, Human
uuaagaaagaaauacuguau

SEQ ID NO: 3675595 - RNA, 15 nt, Human
uuaagaaauagaauu

SEQ ID NO: 3675596 - RNA, 22 nt, Human
uuaagaaaucuguuuuuguuua

SEQ ID NO: 3675597 - RNA, 20 nt, Human
uuaagaacuaaaauguucua

SEQ ID NO: 3675598 - RNA, 13 nt, Human
uuaagaagaaacu

SEQ ID NO: 3675599 - RNA, 11 nt, Human
uuaagaagcug

SEQ ID NO: 3675600 - RNA, 13 nt, Human
uuaagaagcuguu

SEQ ID NO: 3675601 - RNA, 18 nt, Human
uuaagaagcuguuguaca

SEQ ID NO: 3675602 - RNA, 22 nt, Human
uuaagaagcuguuguacauuua

SEQ ID NO: 3675603 - RNA, 14 nt, Human
uuaagaaggcaaaa

SEQ ID NO: 3675604 - RNA, 10 nt, Human
uuaagaauau

SEQ ID NO: 3675605 - RNA, 18 nt, Human
uuaagaaugaguuucuua

SEQ ID NO: 3675606 - RNA, 22 nt, Human
uuaagaaugaguuucuuagacu

SEQ ID NO: 3675607 - RNA, 15 nt, Human
uuaagaaugaucuga

SEQ ID NO: 3675608 - RNA, 23 nt, Human
uuaagacauuuuuggaaggggac

SEQ ID NO: 3675609 - RNA, 14 nt, Human
uuaagaccagccug

SEQ ID NO: 3675610 - RNA, 17 nt, Human
uuaagacguguuugugu

SEQ ID NO: 3675611 - RNA, 13 nt, Human
uuaagacuugaca

SEQ ID NO: 3675612 - RNA, 17 nt, Human
uuaagacuugacagugg

SEQ ID NO: 3675613 - RNA, 19 nt, Human
uuaagagaaacuuuauaca

SEQ ID NO: 3675614 - RNA, 23 nt, Human
uuaagagaaacuuuauacauuag

SEQ ID NO: 3675615 - RNA, 13 nt, Human
uuaagagaaaugg

SEQ ID NO: 3675616 - RNA, 15 nt, Human
uuaagagaaauggca

SEQ ID NO: 3675617 - RNA, 23 nt, Human
uuaagagcagaacagaucuuuua

SEQ ID NO: 3675618 - RNA, 16 nt, Human
uuaagagcaguccauu

SEQ ID NO: 3675619 - RNA, 15 nt, Human
uuaagaggcaggguc

SEQ ID NO: 3675620 - RNA, 13 nt, Human
uuaagaguccaag

SEQ ID NO: 3675621 - RNA, 14 nt, Human
uuaagaguccaaga

SEQ ID NO: 3675622 - RNA, 19 nt, Human
uuaagaguccaagaaucca

SEQ ID NO: 3675623 - RNA, 19 nt, Human
uuaagauaauaauauaugu

SEQ ID NO: 3675624 - RNA, 16 nt, Human
uuaagauaauuauaau

SEQ ID NO: 3675625 - RNA, 14 nt, Human
uuaagauaugaugu

SEQ ID NO: 3675626 - RNA, 12 nt, Human
uuaagauucuug

SEQ ID NO: 3675627 - RNA, 15 nt, Human
uuaagauuuaauuug

SEQ ID NO: 3675628 - RNA, 16 nt, Human
uuaagauuuuacaaaa

SEQ ID NO: 3675629 - RNA, 21 nt, Human
uuaagauuuuucucaaaguuu

SEQ ID NO: 3675630 - RNA, 22 nt, Human
uuaagauuuuucucaaaguuuu

SEQ ID NO: 3675631 - RNA, 14 nt, Human
uuaagcaacaucuu

SEQ ID NO: 3675632 - RNA, 22 nt, Human
uuaagcacuacauaaacugacu

SEQ ID NO: 3675633 - RNA, 15 nt, Human
uuaagcacucuuaaa

SEQ ID NO: 3675634 - RNA, 15 nt, Human
uuaagcagaagcauu

SEQ ID NO: 3675635 - RNA, 22 nt, Human
uuaagcagcuaaauuuucugaa

SEQ ID NO: 3675636 - RNA, 19 nt, Human
uuaagcauauauuuuuaua

SEQ ID NO: 3675637 - RNA, 15 nt, Human
uuaagcaugacagaa

SEQ ID NO: 3675638 - RNA, 19 nt, Human
uuaagcauuacucuuguaa

SEQ ID NO: 3675639 - RNA, 22 nt, Human
uuaagcauuacucuuguaagau

SEQ ID NO: 3675640 - RNA, 12 nt, Human
uuaagcauuguu

SEQ ID NO: 3675641 - RNA, 22 nt, Human
uuaagcauuguuugcuuauugu

SEQ ID NO: 3675642 - RNA, 16 nt, Human
uuaagccaaaacaaug

SEQ ID NO: 3675643 - RNA, 13 nt, Human
uuaagccacugcc

SEQ ID NO: 3675644 - RNA, 19 nt, Human
uuaagccacugccucuccc

SEQ ID NO: 3675645 - RNA, 19 nt, Human
uuaagcccacaguauauuu

SEQ ID NO: 3675646 - RNA, 20 nt, Human
uuaagcccagugcacugaaa

SEQ ID NO: 3675647 - RNA, 16 nt, Human
uuaagccuucaaaacu

SEQ ID NO: 3675648 - RNA, 18 nt, Human
uuaagccuuuguugaacu

SEQ ID NO: 3675649 - RNA, 14 nt, Human
uuaagcucugagcu

SEQ ID NO: 3675650 - RNA, 23 nt, Human
uuaagcugcagagauuucucauu

SEQ ID NO: 3675651 - RNA, 17 nt, Human
uuaagcuguggucaagg

SEQ ID NO: 3675652 - RNA, 22 nt, Human
uuaagcuuuggacccaaggaaa

SEQ ID NO: 3675653 - RNA, 14 nt, Human
uuaaggaaacucuu

SEQ ID NO: 3675654 - RNA, 13 nt, Human
uuaaggaagaaaa

SEQ ID NO: 3675655 - RNA, 21 nt, Human
uuaaggaagacaaugugaaaa

SEQ ID NO: 3675656 - RNA, 22 nt, Human
uuaaggacaaagugccaaagaa

SEQ ID NO: 3675657 - RNA, 17 nt, Human
uuaaggagaaucauguu

SEQ ID NO: 3675658 - RNA, 20 nt, Human
uuaaggagaaucauguuucu

SEQ ID NO: 3675659 - RNA, 23 nt, Human
uuaaggauaaaucauaaagucag

SEQ ID NO: 3675660 - RNA, 18 nt, Human
uuaaggaugcuuguacau

SEQ ID NO: 3675661 - RNA, 19 nt, Human
uuaaggaugcuuguacaua

SEQ ID NO: 3675662 - RNA, 23 nt, Human
uuaaggaugggguuaugaacccu

SEQ ID NO: 3675663 - RNA, 20 nt, Human
uuaaggauugugauauuuuu

SEQ ID NO: 3675664 - RNA, 15 nt, Human
uuaaggccacaucca

SEQ ID NO: 3675665 - RNA, 11 nt, Human
uuaaggccuga

SEQ ID NO: 3675666 - RNA, 16 nt, Human
uuaaggcuaaaaagua

SEQ ID NO: 3675667 - RNA, 23 nt, Human
uuaaggcugaggaaaggccagcu

SEQ ID NO: 3675668 - RNA, 14 nt, Human
uaacucagaauuau

SEQ ID NO: 3675669 - RNA, 21 nt, Human
uaacucagaucacuacugcag

SEQ ID NO: 3675670 - RNA, 15 nt, Human
uaacucaucauaaaa

SEQ ID NO: 3675671 - RNA, 16 nt, Human
uaacucaucauaaaau

SEQ ID NO: 3675672 - RNA, 15 nt, Human
uaacucaucugucac

SEQ ID NO: 3675673 - RNA, 20 nt, Human
uaacucauuuguuaaaauua

SEQ ID NO: 3675674 - RNA, 11 nt, Human
uaacuccacca

SEQ ID NO: 3675675 - RNA, 16 nt, Human
uaacuccaccaaccca

SEQ ID NO: 3675676 - RNA, 14 nt, Human
uaacuccacugcuu

SEQ ID NO: 3675677 - RNA, 21 nt, Human
uaacuccuaguagggguacca

SEQ ID NO: 3675678 - RNA, 17 nt, Human
uaacuccucaauuccaa

SEQ ID NO: 3675679 - RNA, 21 nt, Human
uaacuccucccaggguuuuaa

SEQ ID NO: 3675680 - RNA, 19 nt, Human
uaacuccugagaaauguua

SEQ ID NO: 3675681 - RNA, 17 nt, Human
uaacucuaaaagauccu

SEQ ID NO: 3675682 - RNA, 14 nt, Human
uaacucucuuuaug

SEQ ID NO: 3675683 - RNA, 15 nt, Human
uaacucugauguaaa

SEQ ID NO: 3675684 - RNA, 19 nt, Human
uaacucugauguaaaugaa

SEQ ID NO: 3675685 - RNA, 21 nt, Human
uaacucugcacuacuccucug

SEQ ID NO: 3675686 - RNA, 20 nt, Human
uaacugaaaaugugcuauac

SEQ ID NO: 3675687 - RNA, 14 nt, Human
uaacugaagagaca

SEQ ID NO: 3675688 - RNA, 19 nt, Human
uaacugaagauguugagaa

SEQ ID NO: 3675689 - RNA, 14 nt, Human
uaacugaaggagaa

SEQ ID NO: 3675690 - RNA, 16 nt, Human
uaacugaaggagaagg

SEQ ID NO: 3675691 - RNA, 16 nt, Human
uaacugaauaccacuc

SEQ ID NO: 3675692 - RNA, 21 nt, Human
uaacugaauaccacucuguaa

SEQ ID NO: 3675693 - RNA, 12 nt, Human
uaacugacaaau

SEQ ID NO: 3675694 - RNA, 15 nt, Human
uaacugacaaaucaa

SEQ ID NO: 3675695 - RNA, 17 nt, Human
uaacugacaaaucaagu

SEQ ID NO: 3675696 - RNA, 22 nt, Human
uaacugacuauucuugauguaa

SEQ ID NO: 3675697 - RNA, 18 nt, Human
uaacugacuuaguucuuc

SEQ ID NO: 3675698 - RNA, 11 nt, Human
uaacugccagg

SEQ ID NO: 3675699 - RNA, 17 nt, Human
uaacugcccaaagcagc

SEQ ID NO: 3675700 - RNA, 16 nt, Human
uaacugccuagaaaca

SEQ ID NO: 3675701 - RNA, 23 nt, Human
uaacugcucuugggcaauauucu

SEQ ID NO: 3675702 - RNA, 20 nt, Human
uaacuggaaaacagaacacu

SEQ ID NO: 3675703 - RNA, 15 nt, Human
uaacuggaaacuuca

SEQ ID NO: 3675704 - RNA, 10 nt, Human
uaacuggaac

SEQ ID NO: 3675705 - RNA, 24 nt, Human
uaacuggcaguuuuccauugguuu

SEQ ID NO: 3675706 - RNA, 19 nt, Human
uaacuggguaaugaaacaa

SEQ ID NO: 3675707 - RNA, 17 nt, Human
uaacuggugauauaucu

SEQ ID NO: 3675708 - RNA, 17 nt, Human
uaacuggugcacuuugu

SEQ ID NO: 3675709 - RNA, 22 nt, Human
uaacuggugcacuuuguaaauu

SEQ ID NO: 3675710 - RNA, 12 nt, Human
uaacuguaaauc

SEQ ID NO: 3675711 - RNA, 13 nt, Human
uaacuguacauuu

SEQ ID NO: 3675712 - RNA, 14 nt, Human
uaacuguacauuuc

SEQ ID NO: 3675713 - RNA, 12 nt, Human
uaacuguaucuu

SEQ ID NO: 3675714 - RNA, 13 nt, Human
uaagacuccucgg

SEQ ID NO: 3675715 - RNA, 23 nt, Human
uaagacuccucggccuggcuccu

SEQ ID NO: 3675716 - RNA, 15 nt, Human
uaagacuuaaugaga

SEQ ID NO: 3675717 - RNA, 17 nt, Human
uaagacuuacucuaaga

SEQ ID NO: 3675718 - RNA, 21 nt, Human
uaagacuuaguacuaucugug

SEQ ID NO: 3675719 - RNA, 14 nt, Human
uaagagaaacuuua

SEQ ID NO: 3675720 - RNA, 22 nt, Human
uaagagaaacuuuauacauuag

SEQ ID NO: 3675721 - RNA, 23 nt, Human
uaagagaaacuuuauacauuagu

SEQ ID NO: 3675722 - RNA, 18 nt, Human
uaagagaaagaaaaugaa

SEQ ID NO: 3675723 - RNA, 14 nt, Human
uaagagaauguuau

SEQ ID NO: 3675724 - RNA, 21 nt, Human
uaagagacagucaccccagga

SEQ ID NO: 3675725 - RNA, 18 nt, Human
uaagagacucagccugca

SEQ ID NO: 3675726 - RNA, 12 nt, Human
uaagagagaaau

SEQ ID NO: 3675727 - RNA, 13 nt, Human
uaagagauucuga

SEQ ID NO: 3675728 - RNA, 14 nt, Human
uaagagauucugau

SEQ ID NO: 3675729 - RNA, 15 nt, Human
uaagagauucugauu

SEQ ID NO: 3675730 - RNA, 22 nt, Human
uaagagauuggaucaaguauua

SEQ ID NO: 3675731 - RNA, 22 nt, Human
uaagagcaaaagaauggcagaa

SEQ ID NO: 3675732 - RNA, 15 nt, Human
uaagaggaaaguaca

SEQ ID NO: 3675733 - RNA, 19 nt, Human
uaagaggaaaguacauuuu

SEQ ID NO: 3675734 - RNA, 21 nt, Human
uaagaggacauaauggggucc

SEQ ID NO: 3675735 - RNA, 16 nt, Human
uaagaggaucuccugu

SEQ ID NO: 3675736 - RNA, 15 nt, Human
uaagaggaugaagug

SEQ ID NO: 3675737 - RNA, 12 nt, Human
uaagaggcaggg

SEQ ID NO: 3675738 - RNA, 22 nt, Human
uaagaggcagggucucacucug

SEQ ID NO: 3675739 - RNA, 17 nt, Human
uaagagggcacacacug

SEQ ID NO: 3675740 - RNA, 18 nt, Human
uaagagguguuauuugga

SEQ ID NO: 3675741 - RNA, 18 nt, Human
uaagagugaaaauugucu

SEQ ID NO: 3675742 - RNA, 19 nt, Human
uaagagugggggagagcag

SEQ ID NO: 3675743 - RNA, 16 nt, Human
uaagauaaaaaagcug

SEQ ID NO: 3675744 - RNA, 14 nt, Human
uaagauaaaugugc

SEQ ID NO: 3675745 - RNA, 14 nt, Human
uaagauaauaauau

SEQ ID NO: 3675746 - RNA, 15 nt, Human
uaagauaauaauaua

SEQ ID NO: 3675747 - RNA, 23 nt, Human
uaagauaauaguuuacauguagu

SEQ ID NO: 3675748 - RNA, 16 nt, Human
uaagauauacuuguuu

SEQ ID NO: 3675749 - RNA, 15 nt, Human
uaagauauuugcagu

SEQ ID NO: 3675750 - RNA, 22 nt, Human
uaagauauuugcaguuuuucau

SEQ ID NO: 3675751 - RNA, 17 nt, Human
uaagauauuuuucauga

SEQ ID NO: 3675752 - RNA, 18 nt, Human
uaagauauuuuucaugau

SEQ ID NO: 3675753 - RNA, 16 nt, Human
uaagaucacugccaga

SEQ ID NO: 3675754 - RNA, 12 nt, Human
uaagaucacugu

SEQ ID NO: 3675755 - RNA, 17 nt, Human
uaagaucacuguuuaga

SEQ ID NO: 3675756 - RNA, 19 nt, Human
uaagaucgguuaacaaaua

SEQ ID NO: 3675757 - RNA, 18 nt, Human
uaagaucguucucugccu

SEQ ID NO: 3675758 - RNA, 14 nt, Human
uaagaucuuagauu

SEQ ID NO: 3675759 - RNA, 17 nt, Human
uaagaucuuagauucuc

SEQ ID NO: 3675760 - RNA, 16 nt, Human
uaagaugacauugcua

SEQ ID NO: 3675761 - RNA, 23 nt, Human
uaagaugcuaccuugugacccag

SEQ ID NO: 3675762 - RNA, 21 nt, Human
uaagauggauucucagauauu

SEQ ID NO: 3675763 - RNA, 12 nt, Human
uaagaugucugu

SEQ ID NO: 3675764 - RNA, 14 nt, Human
uaagaugugauauu

SEQ ID NO: 3675765 - RNA, 20 nt, Human
uaagaugugauauucuaaga

SEQ ID NO: 3675766 - RNA, 21 nt, Human
uaagaugugcagcauuucacu

SEQ ID NO: 3675767 - RNA, 15 nt, Human
uaagauguguucuua

SEQ ID NO: 3675768 - RNA, 21 nt, Human
uaagauguuauauuuuucuua

SEQ ID NO: 3675769 - RNA, 22 nt, Human
uaagauuacaaaucagaaguca

SEQ ID NO: 3675770 - RNA, 14 nt, Human
uaagauuccagaga

SEQ ID NO: 3675771 - RNA, 14 nt, Human
uaagauucuaaagg

SEQ ID NO: 3675772 - RNA, 17 nt, Human
uaagauucuaaaggucc

SEQ ID NO: 3675773 - RNA, 17 nt, Human
uaagauucuaacggucu

SEQ ID NO: 3675774 - RNA, 14 nt, Human
uaagauucuagauc

SEQ ID NO: 3675775 - RNA, 14 nt, Human
uaagauucuuggua

SEQ ID NO: 3675776 - RNA, 15 nt, Human
uaagauucuuuuaaa

SEQ ID NO: 3675777 - RNA, 23 nt, Human
uaagauucuuuuaaauuagaaaa

SEQ ID NO: 3675778 - RNA, 21 nt, Human
uaagauugauaucuauaaaau

SEQ ID NO: 3675779 - RNA, 22 nt, Human
uaagauugauaucuauaaaaua

SEQ ID NO: 3675780 - RNA, 12 nt, Human
uaagauuuaccc

SEQ ID NO: 3675781 - RNA, 13 nt, Human
uaagauuuaccca

SEQ ID NO: 3675782 - RNA, 22 nt, Human
uaagauuuacccagaaugucag

SEQ ID NO: 3675783 - RNA, 16 nt, Human
uaagauuuccuucuuu

SEQ ID NO: 3675784 - RNA, 16 nt, Human
uaagauuuuacaaaag

SEQ ID NO: 3675785 - RNA, 17 nt, Human
uaagauuuugaaaacua

SEQ ID NO: 3675786 - RNA, 16 nt, Human
uaagauuuuucucaaa

SEQ ID NO: 3675787 - RNA, 23 nt, Human
uaagcaaaaacaaaaagaaaaga

SEQ ID NO: 3675788 - RNA, 14 nt, Human
uaagcaaaauguga

SEQ ID NO: 3675789 - RNA, 17 nt, Human
uaagcaaaggggacagc

SEQ ID NO: 3675790 - RNA, 16 nt, Human
uaagcaaauacuuagc

SEQ ID NO: 3675791 - RNA, 18 nt, Human
uaagcaaauguuaaaagu

SEQ ID NO: 3675792 - RNA, 19 nt, Human
uaagcaaauguuaaaaguu

SEQ ID NO: 3675793 - RNA, 13 nt, Human
uaagcaaauuuca

SEQ ID NO: 3675794 - RNA, 18 nt, Human
uaagcaaauuucaaaaga

SEQ ID NO: 3675795 - RNA, 13 nt, Human
uaagcaacaauuu

SEQ ID NO: 3675796 - RNA, 17 nt, Human
uaagcaacauggcuuug

SEQ ID NO: 3675797 - RNA, 18 nt, Human
uaagcacacuugacauca

SEQ ID NO: 3675798 - RNA, 13 nt, Human
uaagcacuacaua

SEQ ID NO: 3675799 - RNA, 22 nt, Human
uaagcacuacauaaacugacuu

SEQ ID NO: 3675800 - RNA, 20 nt, Human
uaagcacugaaaaacaacaa

SEQ ID NO: 3675801 - RNA, 17 nt, Human
uaagcacugugcuaaua

SEQ ID NO: 3675802 - RNA, 16 nt, Human
uaagcacuguuuuucc

SEQ ID NO: 3675803 - RNA, 17 nt, Human
uaagcacuguuuuucca

SEQ ID NO: 3675804 - RNA, 15 nt, Human
uaagcacuuuuuaaa

SEQ ID NO: 3675805 - RNA, 21 nt, Human
uaagcacuuuuuaaaaaacuu

SEQ ID NO: 3675806 - RNA, 15 nt, Human
uaagcagaaagugcc

SEQ ID NO: 3675807 - RNA, 15 nt, Human
uaagcagaaauccug

SEQ ID NO: 3675808 - RNA, 24 nt, Human
uaagcagagaagggcauaaaacag

SEQ ID NO: 3675809 - RNA, 13 nt, Human
uaagcagaggagg

SEQ ID NO: 3675810 - RNA, 17 nt, Human
uaagcagaggaggggcc

SEQ ID NO: 3675811 - RNA, 21 nt, Human
uaagcagauuuaacaauucca

SEQ ID NO: 3675812 - RNA, 18 nt, Human
uaagcagcauuucugaag

SEQ ID NO: 3675813 - RNA, 19 nt, Human
uaagcagcauuucugaagu

SEQ ID NO: 3675814 - RNA, 21 nt, Human
uaagcagcauuucugaagugg

SEQ ID NO: 3675815 - RNA, 23 nt, Human
uaagcagcauuucugaaguggac

SEQ ID NO: 3675816 - RNA, 17 nt, Human
uaagcagcuaaauuuuc

SEQ ID NO: 3675817 - RNA, 21 nt, Human
uaagcaggagagaaauuucuc

SEQ ID NO: 3675818 - RNA, 15 nt, Human
uaagcaggaggaggu

SEQ ID NO: 3675819 - RNA, 18 nt, Human
uaagcaggaggaggugcc

SEQ ID NO: 3675820 - RNA, 16 nt, Human
uaagcaggcgcaaggg

SEQ ID NO: 3675821 - RNA, 12 nt, Human
uaagcaguauau

SEQ ID NO: 3675822 - RNA, 23 nt, Human
uaagcauaaaagaugaaagagca

SEQ ID NO: 3675823 - RNA, 13 nt, Human
uaagcauauauuu

SEQ ID NO: 3675824 - RNA, 16 nt, Human
uaagcauauauuuuua

SEQ ID NO: 3675825 - RNA, 23 nt, Human
uaagcauauauuuuuauauuuac

SEQ ID NO: 3675826 - RNA, 14 nt, Human
uaagcaucauuauu

SEQ ID NO: 3675827 - RNA, 23 nt, Human
uaagcaucuaaggacaagguaag

SEQ ID NO: 3675828 - RNA, 15 nt, Human
uaagcaucuacuuca

SEQ ID NO: 3675829 - RNA, 17 nt, Human
uaagcaucuacuucagg

SEQ ID NO: 3675830 - RNA, 18 nt, Human
uaagcaucuggcucuaau

SEQ ID NO: 3675831 - RNA, 19 nt, Human
uaagcauuacucuuguaag

SEQ ID NO: 3675832 - RNA, 21 nt, Human
uaagcauuacucuuguaagau

SEQ ID NO: 3675833 - RNA, 16 nt, Human
uaagcauuccaacuau

SEQ ID NO: 3675834 - RNA, 14 nt, Human
uguauuuuguguga

SEQ ID NO: 3675835 - RNA, 15 nt, Human
uguauuuugugugac

SEQ ID NO: 3675836 - RNA, 17 nt, Human
uguauuuuuaguagaga

SEQ ID NO: 3675837 - RNA, 19 nt, Human
uguauuuuucuacauuauu

SEQ ID NO: 3675838 - RNA, 16 nt, Human
uguauuuuugucaauu

SEQ ID NO: 3675839 - RNA, 20 nt, Human
uguauuuuugucaauuacca

SEQ ID NO: 3675840 - RNA, 19 nt, Human
uguauuuuuucuugcauug

SEQ ID NO: 3675841 - RNA, 21 nt, Human
uguauuuuuucuugcauugac

SEQ ID NO: 3675842 - RNA, 14 nt, Human
uguauuuuuuuacu

SEQ ID NO: 3675843 - RNA, 16 nt, Human
uguauuuuuuuacuaa

SEQ ID NO: 3675844 - RNA, 13 nt, Human
ugucaaaacacug

SEQ ID NO: 3675845 - RNA, 12 nt, Human
ugucaaaaguag

SEQ ID NO: 3675846 - RNA, 21 nt, Human
ugucaaaaguagaacuuugua

SEQ ID NO: 3675847 - RNA, 16 nt, Human
ugucaaaaguuggacu

SEQ ID NO: 3675848 - RNA, 20 nt, Human
ugucaaaaguuggacuaaau

SEQ ID NO: 3675849 - RNA, 21 nt, Human
ugucaaaaguuggacuaaaug

SEQ ID NO: 3675850 - RNA, 22 nt, Human
ugucaaaaguuggacuaaaugc

SEQ ID NO: 3675851 - RNA, 22 nt, Human
ugucaaacaaagccagaagcug

SEQ ID NO: 3675852 - RNA, 13 nt, Human
ugucaaacaaaua

SEQ ID NO: 3675853 - RNA, 12 nt, Human
ugucaaagaagg

SEQ ID NO: 3675854 - RNA, 14 nt, Human
ugucaaagaagguu

SEQ ID NO: 3675855 - RNA, 12 nt, Human
ugucaaagcagg

SEQ ID NO: 3675856 - RNA, 16 nt, Human
ugucaaaguggugaga

SEQ ID NO: 3675857 - RNA, 17 nt, Human
ugucaaauaaacacugu

SEQ ID NO: 3675858 - RNA, 17 nt, Human
ugucaacaugaaacacc

SEQ ID NO: 3675859 - RNA, 13 nt, Human
uaaucaauuuaaa

SEQ ID NO: 3675860 - RNA, 21 nt, Human
uaaucaccagggccaaaagcu

SEQ ID NO: 3675861 - RNA, 17 nt, Human
uaaucacgcuuuccuga

SEQ ID NO: 3675862 - RNA, 18 nt, Human
uaaucacgcuuuccugaa

SEQ ID NO: 3675863 - RNA, 16 nt, Human
uaaucacucagagcag

SEQ ID NO: 3675864 - RNA, 19 nt, Human
uaaucacuuaacauuccua

SEQ ID NO: 3675865 - RNA, 16 nt, Human
uaaucacuuuuuucca

SEQ ID NO: 3675866 - RNA, 17 nt, Human
uaaucacuuuuuuccac

SEQ ID NO: 3675867 - RNA, 19 nt, Human
uaaucacuuuuuuccacau

SEQ ID NO: 3675868 - RNA, 13 nt, Human
uaaucagaaauuu

SEQ ID NO: 3675869 - RNA, 12 nt, Human
uaaucagccucu

SEQ ID NO: 3675870 - RNA, 19 nt, Human
uaaucagggaggucauuuu

SEQ ID NO: 3675871 - RNA, 23 nt, Human
uaaucaguucauuagaaauauuu

SEQ ID NO: 3675872 - RNA, 22 nt, Human
uaaucauauaauaaauguacau

SEQ ID NO: 3675873 - RNA, 22 nt, Human
uaaucaucaagagaauuugggg

SEQ ID NO: 3675874 - RNA, 17 nt, Human
uaaucauccaaugcuca

SEQ ID NO: 3675875 - RNA, 14 nt, Human
uaaucaucuaaguc

SEQ ID NO: 3675876 - RNA, 15 nt, Human
uaaucaugaaccaau

SEQ ID NO: 3675877 - RNA, 13 nt, Human
uaaucaugaauau

SEQ ID NO: 3675878 - RNA, 20 nt, Human
uaaucauucuuauuucauga

SEQ ID NO: 3675879 - RNA, 14 nt, Human
uaaucauugccugg

SEQ ID NO: 3675880 - RNA, 16 nt, Human
uaaucauuuccccaua

SEQ ID NO: 3675881 - RNA, 14 nt, Human
uaaucauuuucauu

SEQ ID NO: 3675882 - RNA, 18 nt, Human
uaauccaggcacagcuga

SEQ ID NO: 3675883 - RNA, 19 nt, Human
uaauccaggcagauccagg

SEQ ID NO: 3675884 - RNA, 22 nt, Human
uaauccaggcagauccaggacu

SEQ ID NO: 3675885 - RNA, 12 nt, Human
uaauccaguaaa

SEQ ID NO: 3675886 - RNA, 19 nt, Human
uaauccaguuauaagaaga

SEQ ID NO: 3675887 - RNA, 23 nt, Human
uaauccaguuauaagaagaaguu

SEQ ID NO: 3675888 - RNA, 21 nt, Human
uaaucccagcauuuugggaag

SEQ ID NO: 3675889 - RNA, 16 nt, Human
ugucuuccucccaagu

SEQ ID NO: 3675890 - RNA, 14 nt, Human
ugucuuccuuggag

SEQ ID NO: 3675891 - RNA, 20 nt, Human
ugucuucggaaaccuuggug

SEQ ID NO: 3675892 - RNA, 13 nt, Human
ugucuucucccug

SEQ ID NO: 3675893 - RNA, 20 nt, Human
ugucuucucuaacaccuugu

SEQ ID NO: 3675894 - RNA, 17 nt, Human
ugucuucugccuguuau

SEQ ID NO: 3675895 - RNA, 11 nt, Human
ugucuucugcu

SEQ ID NO: 3675896 - RNA, 14 nt, Human
ugucuucugcuuug

SEQ ID NO: 3675897 - RNA, 23 nt, Human
ugucuucuggacaggcucugcuu

SEQ ID NO: 3675898 - RNA, 15 nt, Human
ugucuugcaauggca

SEQ ID NO: 3675899 - RNA, 18 nt, Human
ugucuugcaauggcagcc

SEQ ID NO: 3675900 - RNA, 17 nt, Human
ugucuugccuuuuucau

SEQ ID NO: 3675901 - RNA, 13 nt, Human
ugucuuggaacau

SEQ ID NO: 3675902 - RNA, 13 nt, Human
ugucuuggacacu

SEQ ID NO: 3675903 - RNA, 12 nt, Human
ugucuugggcag

SEQ ID NO: 3675904 - RNA, 17 nt, Human
ugucuuguacaugugua

SEQ ID NO: 3675905 - RNA, 15 nt, Human
ugucuuguuaauauu

SEQ ID NO: 3675906 - RNA, 18 nt, Human
ugucuuguuaauauucuu

SEQ ID NO: 3675907 - RNA, 13 nt, Human
ugucuuguucugu

SEQ ID NO: 3675908 - RNA, 15 nt, Human
ugucuuguucuguca

SEQ ID NO: 3675909 - RNA, 14 nt, Human
ugucuuuaaaaacu

SEQ ID NO: 3675910 - RNA, 14 nt, Human
ugucuuuaaaagua

SEQ ID NO: 3675911 - RNA, 14 nt, Human
ugucuuuaaggaaa

SEQ ID NO: 3675912 - RNA, 15 nt, Human
ugucuuuaaggaaaa

SEQ ID NO: 3675913 - RNA, 22 nt, Human
ugucuuuaauuucugucagaau

SEQ ID NO: 3675914 - RNA, 15 nt, Human
ugucuuuacuccuca

SEQ ID NO: 3675915 - RNA, 13 nt, Human
ugucuuucaaacu

SEQ ID NO: 3675916 - RNA, 18 nt, Human
ugucuuuccacuccuccu

SEQ ID NO: 3675917 - RNA, 13 nt, Human
ugucuuucugggg

SEQ ID NO: 3675918 - RNA, 19 nt, Human
ugucuuuggacccugaggc

SEQ ID NO: 3675919 - RNA, 23 nt, Human
ugucuuuggacccugaggcccag

SEQ ID NO: 3675920 - RNA, 16 nt, Human
ugucuuuggaggugcu

SEQ ID NO: 3675921 - RNA, 12 nt, Human
ugucuuuguaag

SEQ ID NO: 3675922 - RNA, 17 nt, Human
ugucuuuguaagucagu

SEQ ID NO: 3675923 - RNA, 16 nt, Human
ugucuuuuauauuugu

SEQ ID NO: 3675924 - RNA, 14 nt, Human
ugucuuuucuuggc

SEQ ID NO: 3675925 - RNA, 23 nt, Human
ugucuuuucuuggcaaaagccuu

SEQ ID NO: 3675926 - RNA, 19 nt, Human
ugucuuuucuuugccaucu

SEQ ID NO: 3675927 - RNA, 12 nt, Human
ugucuuuugcau

SEQ ID NO: 3675928 - RNA, 15 nt, Human
ugucuuuuuguugua

SEQ ID NO: 3675929 - RNA, 14 nt, Human
ugucuuuuuucuaa

SEQ ID NO: 3675930 - RNA, 16 nt, Human
ugucuuuuuuuguaua

SEQ ID NO: 3675931 - RNA, 23 nt, Human
ugucuuuuuuuguauaguuaaca

SEQ ID NO: 3675932 - RNA, 17 nt, Human
ugugaaaaaaaaaaugc

SEQ ID NO: 3675933 - RNA, 17 nt, Human
ugugaaaaaauuuacuu

SEQ ID NO: 3675934 - RNA, 15 nt, Human
ugugaaaagaaaaau

SEQ ID NO: 3675935 - RNA, 23 nt, Human
ugugaaaagaaaaaugagccugg

SEQ ID NO: 3675936 - RNA, 14 nt, Human
ugugaaaauggguu

SEQ ID NO: 3675937 - RNA, 18 nt, Human
ugugaaaaugguccagga

SEQ ID NO: 3675938 - RNA, 17 nt, Human
ugugaaaaugugugugu

SEQ ID NO: 3675939 - RNA, 14 nt, Human
ugugaaaauguguu

SEQ ID NO: 3675940 - RNA, 16 nt, Human
ugugaaacacagcugu

SEQ ID NO: 3675941 - RNA, 19 nt, Human
ugugaaacacuuugccucc

SEQ ID NO: 3675942 - RNA, 21 nt, Human
ugugaaaggaaagagggaggu

SEQ ID NO: 3675943 - RNA, 20 nt, Human
ugugaaaggaagcuccacug

SEQ ID NO: 3675944 - RNA, 12 nt, Human
ugugaaauuauu

SEQ ID NO: 3675945 - RNA, 13 nt, Human
ugugaaauugcau

SEQ ID NO: 3675946 - RNA, 19 nt, Human
ugugaaauuuuucauauuu

SEQ ID NO: 3675947 - RNA, 20 nt, Human
ugugaaauuuuucauauuuu

SEQ ID NO: 3675948 - RNA, 14 nt, Human
ugugaaccaaugca

SEQ ID NO: 3675949 - RNA, 15 nt, Human
ugugaaccaccacac

SEQ ID NO: 3675950 - RNA, 20 nt, Human
ugugaacccuggggccugac

SEQ ID NO: 3675951 - RNA, 14 nt, Human
ugugaacucagcca

SEQ ID NO: 3675952 - RNA, 21 nt, Human
ugugaacucagccaagcacag

SEQ ID NO: 3675953 - RNA, 18 nt, Human
ugugaacuggacccuguu

SEQ ID NO: 3675954 - RNA, 22 nt, Human
ugugaacuggacccuguugcua

SEQ ID NO: 3675955 - RNA, 15 nt, Human
ugugaacuugaaauu

SEQ ID NO: 3675956 - RNA, 20 nt, Human
ugugaacuuggggaacaagg

SEQ ID NO: 3675957 - RNA, 21 nt, Human
ugugaacuuguagcuguaaaa

SEQ ID NO: 3675958 - RNA, 18 nt, Human
ugugaacuuuauuaaaua

SEQ ID NO: 3675959 - RNA, 16 nt, Human
ugugaagacuugccuu

SEQ ID NO: 3675960 - RNA, 14 nt, Human
ugugaagagaacca

SEQ ID NO: 3675961 - RNA, 20 nt, Human
ugugaagcaaacucuaaaau

SEQ ID NO: 3675962 - RNA, 12 nt, Human
ugugaagcauuc

SEQ ID NO: 3675963 - RNA, 10 nt, Human
ugugaagcca

SEQ ID NO: 3675964 - RNA, 13 nt, Human
ugugaagccuucc

SEQ ID NO: 3675965 - RNA, 13 nt, Human
ugugaaggacccu

SEQ ID NO: 3675966 - RNA, 13 nt, Human
ugugaaggaccuu

SEQ ID NO: 3675967 - RNA, 16 nt, Human
ugugaaggaccuucac

SEQ ID NO: 3675968 - RNA, 23 nt, Human
ugugaaggauuauggaaaaauaa

SEQ ID NO: 3675969 - RNA, 23 nt, Human
ugugaaggcaggggaauguaugu

SEQ ID NO: 3675970 - RNA, 23 nt, Human
ugugaaguccuucaccucacuga

SEQ ID NO: 3675971 - RNA, 18 nt, Human
ugugaagugaaugaaaca

SEQ ID NO: 3675972 - RNA, 14 nt, Human
ugugaaguuagaau

SEQ ID NO: 3675973 - RNA, 21 nt, Human
ugugaaguuagguucuuaaaa

SEQ ID NO: 3675974 - RNA, 12 nt, Human
ugugaauaaauu

SEQ ID NO: 3675975 - RNA, 18 nt, Human
ugugaauacugcuugaau

SEQ ID NO: 3675976 - RNA, 22 nt, Human
ugugaauagaacucugaaauga

SEQ ID NO: 3675977 - RNA, 17 nt, Human
ugugaauauaaaugugu

SEQ ID NO: 3675978 - RNA, 20 nt, Human
ugugaauauaaaugugugua

SEQ ID NO: 3675979 - RNA, 21 nt, Human
ugugaaucaagggucaggccu

SEQ ID NO: 3675980 - RNA, 18 nt, Human
ugugaaucagacccuacc

SEQ ID NO: 3675981 - RNA, 22 nt, Human
ugugaaugauucauguuauauu

SEQ ID NO: 3675982 - RNA, 17 nt, Human
ugugaaugcuucucacu

SEQ ID NO: 3675983 - RNA, 16 nt, Human
ugugaauggauuggau

SEQ ID NO: 3675984 - RNA, 19 nt, Human
ugugaauggauuggauuau

SEQ ID NO: 3675985 - RNA, 18 nt, Human
ugugaaugugggcacugg

SEQ ID NO: 3675986 - RNA, 21 nt, Human
ugugaauguugugauguauuc

SEQ ID NO: 3675987 - RNA, 16 nt, Human
ugugaauuauugacac

SEQ ID NO: 3675988 - RNA, 17 nt, Human
ugugaauuauugacacu

SEQ ID NO: 3675989 - RNA, 20 nt, Human
ugugaauuauugacacugaa

SEQ ID NO: 3675990 - RNA, 21 nt, Human
ugugaauuauugacacugaac

SEQ ID NO: 3675991 - RNA, 18 nt, Human
ugugaauugcaugacuug

SEQ ID NO: 3675992 - RNA, 22 nt, Human
ugugaauugccugcagagagaa

SEQ ID NO: 3675993 - RNA, 23 nt, Human
ugugaauuucuucacuguugaaa

SEQ ID NO: 3675994 - RNA, 17 nt, Human
ugugaauuuuuaagcug

SEQ ID NO: 3675995 - RNA, 19 nt, Human
ugugaauuuuuaagcugca

SEQ ID NO: 3675996 - RNA, 16 nt, Human
ugugaauuuuuauugu

SEQ ID NO: 3675997 - RNA, 12 nt, Human
ugugacaaaauu

SEQ ID NO: 3675998 - RNA, 21 nt, Human
ugugacaacugucuaacuuua

SEQ ID NO: 3675999 - RNA, 21 nt, Human
ugugacaaggauugcuacugu

SEQ ID NO: 3676000 - RNA, 20 nt, Human
ugugacaauaauauuguugu

SEQ ID NO: 3676001 - RNA, 16 nt, Human
ugugacacacuacacc

SEQ ID NO: 3676002 - RNA, 22 nt, Human
ugugacacacuacaccacacac

SEQ ID NO: 3676003 - RNA, 17 nt, Human
ugugacacauaugcacc

SEQ ID NO: 3676004 - RNA, 16 nt, Human
uaaugcuguugccuca

SEQ ID NO: 3676005 - RNA, 14 nt, Human
uaaugcuuuuauau

SEQ ID NO: 3676006 - RNA, 13 nt, Human
uaauggaagagaa

SEQ ID NO: 3676007 - RNA, 14 nt, Human
uaauggaagagaaa

SEQ ID NO: 3676008 - RNA, 19 nt, Human
uaauggaaguguauuuauu

SEQ ID NO: 3676009 - RNA, 23 nt, Human
uaauggaaguguauuuauuuuac

SEQ ID NO: 3676010 - RNA, 19 nt, Human
uaauggacaugagauaaug

SEQ ID NO: 3676011 - RNA, 17 nt, Human
uaauggagcaucaagcc

SEQ ID NO: 3676012 - RNA, 12 nt, Human
uaauggauccuu

SEQ ID NO: 3676013 - RNA, 16 nt, Human
uaauggauuguuaauu

SEQ ID NO: 3676014 - RNA, 20 nt, Human
uaauggauuguuaauuucag

SEQ ID NO: 3676015 - RNA, 17 nt, Human
uaauggcacuuaucauu

SEQ ID NO: 3676016 - RNA, 20 nt, Human
uaauggcagcagaaaacuug

SEQ ID NO: 3676017 - RNA, 15 nt, Human
uaauggcaguuauau

SEQ ID NO: 3676018 - RNA, 15 nt, Human
uaauggcaugagaaa

SEQ ID NO: 3676019 - RNA, 17 nt, Human
uaauggcaugagaaaua

SEQ ID NO: 3676020 - RNA, 17 nt, Human
uaauggccggcuggaaa

SEQ ID NO: 3676021 - RNA, 23 nt, Human
uaauggccggcuggaaaugcugg

SEQ ID NO: 3676022 - RNA, 18 nt, Human
uaauggggguagcagcug

SEQ ID NO: 3676023 - RNA, 17 nt, Human
uaaugggguccuggcca

SEQ ID NO: 3676024 - RNA, 22 nt, Human
uaaugggguccuggccauccca

SEQ ID NO: 3676025 - RNA, 18 nt, Human
uaauggguuucauauuuc

SEQ ID NO: 3676026 - RNA, 14 nt, Human
uaaugguaccagau

SEQ ID NO: 3676027 - RNA, 16 nt, Human
uaaugguaccagauaa

SEQ ID NO: 3676028 - RNA, 19 nt, Human
uaaugguacugacuuugcu

SEQ ID NO: 3676029 - RNA, 16 nt, Human
uaaugguaguuuuaca

SEQ ID NO: 3676030 - RNA, 15 nt, Human
uaauggucccaucca

SEQ ID NO: 3676031 - RNA, 20 nt, Human
uaauggucccauccaggcag

SEQ ID NO: 3676032 - RNA, 22 nt, Human
uaauggugaugcagucuuagau

SEQ ID NO: 3676033 - RNA, 12 nt, Human
uaauguaaagau

SEQ ID NO: 3676034 - RNA, 17 nt, Human
uaauguaauaacuguga

SEQ ID NO: 3676035 - RNA, 18 nt, Human
uaauguaauaacugugaa

SEQ ID NO: 3676036 - RNA, 19 nt, Human
uaauguacauagugcuaac

SEQ ID NO: 3676037 - RNA, 15 nt, Human
uaauguauucauauu

SEQ ID NO: 3676038 - RNA, 19 nt, Human
uaauguauucauauuugua

SEQ ID NO: 3676039 - RNA, 20 nt, Human
uaauguauuuguucauguuu

SEQ ID NO: 3676040 - RNA, 12 nt, Human
uaauguauuuua

SEQ ID NO: 3676041 - RNA, 22 nt, Human
uaaugucuguaucacucugugu

SEQ ID NO: 3676042 - RNA, 14 nt, Human
uaaugucuucauaa

SEQ ID NO: 3676043 - RNA, 17 nt, Human
uaaugucuucauuucau

SEQ ID NO: 3676044 - RNA, 19 nt, Human
uaaugucuucauuucauug

SEQ ID NO: 3676045 - RNA, 15 nt, Human
uaaugucuuguuaau

SEQ ID NO: 3676046 - RNA, 22 nt, Human
uaaugugaaacuggauuaaacu

SEQ ID NO: 3676047 - RNA, 18 nt, Human
uaaugugaacuuguagcu

SEQ ID NO: 3676048 - RNA, 13 nt, Human
uaaugugaagugu

SEQ ID NO: 3676049 - RNA, 22 nt, Human
uaaugugaccuagcaauaggca

SEQ ID NO: 3676050 - RNA, 12 nt, Human
uaaugugcugug

SEQ ID NO: 3676051 - RNA, 13 nt, Human
uaaugugcugugu

SEQ ID NO: 3676052 - RNA, 14 nt, Human
uaaugugcugugua

SEQ ID NO: 3676053 - RNA, 19 nt, Human
uaaugugcuguguaaaguu

SEQ ID NO: 3676054 - RNA, 20 nt, Human
uaaugugcuguguaaaguua

SEQ ID NO: 3676055 - RNA, 15 nt, Human
uaauguggaagaaaa

SEQ ID NO: 3676056 - RNA, 17 nt, Human
uuauaaacuuuuaaaga

SEQ ID NO: 3676057 - RNA, 13 nt, Human
uuauaaagcaugu

SEQ ID NO: 3676058 - RNA, 12 nt, Human
uuauaaaggaau

SEQ ID NO: 3676059 - RNA, 17 nt, Human
uuauaaagugcuugugu

SEQ ID NO: 3676060 - RNA, 21 nt, Human
uuauaaagugcuuguguaauu

SEQ ID NO: 3676061 - RNA, 19 nt, Human
uuauaaaguggaaguaugu

SEQ ID NO: 3676062 - RNA, 19 nt, Human
uuauaaauacugcaaauca

SEQ ID NO: 3676063 - RNA, 18 nt, Human
uuauaaauauaagccuuu

SEQ ID NO: 3676064 - RNA, 16 nt, Human
uuauaaauauauauaa

SEQ ID NO: 3676065 - RNA, 17 nt, Human
uuauaaauauauauaaa

SEQ ID NO: 3676066 - RNA, 19 nt, Human
uuauaaauauauauaaaga

SEQ ID NO: 3676067 - RNA, 12 nt, Human
uuauaaaucaua

SEQ ID NO: 3676068 - RNA, 17 nt, Human
uuauaaaucauauugau

SEQ ID NO: 3676069 - RNA, 19 nt, Human
uuauaaaucauauugauga

SEQ ID NO: 3676070 - RNA, 17 nt, Human
uuauaaaucgcuuuuga

SEQ ID NO: 3676071 - RNA, 14 nt, Human
uuauaaaugcuauu

SEQ ID NO: 3676072 - RNA, 12 nt, Human
uuauaaauuaaa

SEQ ID NO: 3676073 - RNA, 21 nt, Human
uuauaaauuauguuuauauaa

SEQ ID NO: 3676074 - RNA, 21 nt, Human
uuauaaauuggugaugcuugu

SEQ ID NO: 3676075 - RNA, 19 nt, Human
uuauaaccuuaauuuauua

SEQ ID NO: 3676076 - RNA, 15 nt, Human
uuauaacuaacaugu

SEQ ID NO: 3676077 - RNA, 17 nt, Human
uuauaacucaucauaaa

SEQ ID NO: 3676078 - RNA, 16 nt, Human
uuauaacuggaaagaa

SEQ ID NO: 3676079 - RNA, 17 nt, Human
uuauaacuggaaagaag

SEQ ID NO: 3676080 - RNA, 14 nt, Human
uuauaagaaaaacu

SEQ ID NO: 3676081 - RNA, 16 nt, Human
uuauaagaaaaacuuu

SEQ ID NO: 3676082 - RNA, 18 nt, Human
uuauaagaagaaguucau

SEQ ID NO: 3676083 - RNA, 14 nt, Human
uuauaagacucuca

SEQ ID NO: 3676084 - RNA, 16 nt, Human
uuauaagcagauuuaa

SEQ ID NO: 3676085 - RNA, 19 nt, Human
uuauaagcaucauuauuua

SEQ ID NO: 3676086 - RNA, 17 nt, Human
uuauaagcauugaaauu

SEQ ID NO: 3676087 - RNA, 13 nt, Human
uuauaaggacugc

SEQ ID NO: 3676088 - RNA, 16 nt, Human
uuauaaggacugcaug

SEQ ID NO: 3676089 - RNA, 18 nt, Human
uuauaauaaaggacugua

SEQ ID NO: 3676090 - RNA, 14 nt, Human
uuauaauacucugu

SEQ ID NO: 3676091 - RNA, 11 nt, Human
uuauaauagca

SEQ ID NO: 3676092 - RNA, 16 nt, Human
uuauaaucagaaugga

SEQ ID NO: 3676093 - RNA, 23 nt, Human
uuauaaucagaauggaagagaga

SEQ ID NO: 3676094 - RNA, 18 nt, Human
uuauaaucuuauaauugu

SEQ ID NO: 3676095 - RNA, 13 nt, Human
uuauaauggguaa

SEQ ID NO: 3676096 - RNA, 12 nt, Human
uuauaauguauu

SEQ ID NO: 3676097 - RNA, 13 nt, Human
uuauaauguauuc

SEQ ID NO: 3676098 - RNA, 22 nt, Human
uuauaauguauucauauuugua

SEQ ID NO: 3676099 - RNA, 17 nt, Human
uuauaauucucauuaaa

SEQ ID NO: 3676100 - RNA, 15 nt, Human
uuauaauuguugcau

SEQ ID NO: 3676101 - RNA, 12 nt, Human
uuauaauuuaaa

SEQ ID NO: 3676102 - RNA, 16 nt, Human
uuauaauuuuuuucaa

SEQ ID NO: 3676103 - RNA, 20 nt, Human
uuauaauuuuuuuuaaaaua

SEQ ID NO: 3676104 - RNA, 19 nt, Human
uuauacaaauuaaaaagau

SEQ ID NO: 3676105 - RNA, 16 nt, Human
uuauacaaccuucauu

SEQ ID NO: 3676106 - RNA, 18 nt, Human
uuauacacauaauuaaag

SEQ ID NO: 3676107 - RNA, 13 nt, Human
uuauacacugugu

SEQ ID NO: 3676108 - RNA, 20 nt, Human
uuauacacuguguaaauacc

SEQ ID NO: 3676109 - RNA, 13 nt, Human
uuauacagcugua

SEQ ID NO: 3676110 - RNA, 21 nt, Human
uuauacagcuguauugucuga

SEQ ID NO: 3676111 - RNA, 21 nt, Human
uuauacaggggaauauuuuau

SEQ ID NO: 3676112 - RNA, 14 nt, Human
uuauacaggucaua

SEQ ID NO: 3676113 - RNA, 12 nt, Human
uuauacaguaca

SEQ ID NO: 3676114 - RNA, 21 nt, Human
uuauacaguuuuaaagaauca

SEQ ID NO: 3676115 - RNA, 14 nt, Human
uuauacauuaguaa

SEQ ID NO: 3676116 - RNA, 16 nt, Human
uuauaccaaaauguug

SEQ ID NO: 3676117 - RNA, 22 nt, Human
uuauaccaaaauguugcugaaa

SEQ ID NO: 3676118 - RNA, 19 nt, Human
uuauacccagaaaguuauu

SEQ ID NO: 3676119 - RNA, 23 nt, Human
uuauacccagaaaguuauugaua

SEQ ID NO: 3676120 - RNA, 18 nt, Human
uuauaccccaauaaucaa

SEQ ID NO: 3676121 - RNA, 18 nt, Human
uuauacccccugcaaagc

SEQ ID NO: 3676122 - RNA, 14 nt, Human
uuauaccucaauuu

SEQ ID NO: 3676123 - RNA, 21 nt, Human
uuauaccucaauuuucacugu

SEQ ID NO: 3676124 - RNA, 22 nt, Human
uuauaccucaauuuucacugug

SEQ ID NO: 3676125 - RNA, 16 nt, Human
uuauaccugcuaucag

SEQ ID NO: 3676126 - RNA, 14 nt, Human
uuauaccuguugcu

SEQ ID NO: 3676127 - RNA, 12 nt, Human
uuauaccuguuu

SEQ ID NO: 3676128 - RNA, 16 nt, Human
uuauacgaaauaauug

SEQ ID NO: 3676129 - RNA, 17 nt, Human
uuauacgaaauaauugu

SEQ ID NO: 3676130 - RNA, 14 nt, Human
uuauacgcuuuucu

SEQ ID NO: 3676131 - RNA, 18 nt, Human
uuauacguguagcuauau

SEQ ID NO: 3676132 - RNA, 16 nt, Human
uuauacguuauagagu

SEQ ID NO: 3676133 - RNA, 18 nt, Human
uuauacuaacuuauuuau

SEQ ID NO: 3676134 - RNA, 12 nt, Human
uuauacuaagaa

SEQ ID NO: 3676135 - RNA, 16 nt, Human
uuauacuaagaaaaga

SEQ ID NO: 3676136 - RNA, 23 nt, Human
uuauacuacuuuguuaggauuuu

SEQ ID NO: 3676137 - RNA, 14 nt, Human
uuauacuguacaau

SEQ ID NO: 3676138 - RNA, 14 nt, Human
uuauacuguauuaa

SEQ ID NO: 3676139 - RNA, 15 nt, Human
uuauacuuguaauua

SEQ ID NO: 3676140 - RNA, 19 nt, Human
uuauacuuguaauuaugga

SEQ ID NO: 3676141 - RNA, 14 nt, Human
uuauagaaaguuca

SEQ ID NO: 3676142 - RNA, 15 nt, Human
uuauagaagaaugca

SEQ ID NO: 3676143 - RNA, 22 nt, Human
uuauagaagaaugcaugcuuuc

SEQ ID NO: 3676144 - RNA, 15 nt, Human
uuauagaauauuuau

SEQ ID NO: 3676145 - RNA, 17 nt, Human
uuauagacacccuggca

SEQ ID NO: 3676146 - RNA, 21 nt, Human
uuauagagaaugaugauaaca

SEQ ID NO: 3676147 - RNA, 15 nt, Human
uuauagagcagaaau

SEQ ID NO: 3676148 - RNA, 22 nt, Human
uuauagagcagaaauucuguuu

SEQ ID NO: 3676149 - RNA, 15 nt, Human
uuauagaugucuagg

SEQ ID NO: 3676150 - RNA, 20 nt, Human
uguuaugacuauguaaacua

SEQ ID NO: 3676151 - RNA, 13 nt, Human
uguuaugacucca

SEQ ID NO: 3676152 - RNA, 21 nt, Human
uguuaugauaaaaaauuuugu

SEQ ID NO: 3676153 - RNA, 12 nt, Human
uguuaugaugug

SEQ ID NO: 3676154 - RNA, 22 nt, Human
uguuaugaugugcuuaacaggg

SEQ ID NO: 3676155 - RNA, 17 nt, Human
uguuaugcaaaagcaag

SEQ ID NO: 3676156 - RNA, 20 nt, Human
uguuauguacuaguguucug

SEQ ID NO: 3676157 - RNA, 13 nt, Human
uguuauguacugu

SEQ ID NO: 3676158 - RNA, 14 nt, Human
uguuauguauuucc

SEQ ID NO: 3676159 - RNA, 20 nt, Human
uguuauguuuucgaaaauca

SEQ ID NO: 3676160 - RNA, 14 nt, Human
uguuauuaaaugua

SEQ ID NO: 3676161 - RNA, 14 nt, Human
uguuauuacauccu

SEQ ID NO: 3676162 - RNA, 20 nt, Human
uguuauuauagagcagaaau

SEQ ID NO: 3676163 - RNA, 16 nt, Human
uguuauuaucugggcu

SEQ ID NO: 3676164 - RNA, 22 nt, Human
uguuauuauuacuuauuuuuga

SEQ ID NO: 3676165 - RNA, 13 nt, Human
uguuauucuuugc

SEQ ID NO: 3676166 - RNA, 13 nt, Human
uguuauugaaaaa

SEQ ID NO: 3676167 - RNA, 23 nt, Human
uguuauugaaaaaaauuggcauu

SEQ ID NO: 3676168 - RNA, 22 nt, Human
uguuauugggcaagugauugaa

SEQ ID NO: 3676169 - RNA, 15 nt, Human
uguuauugugaauga

SEQ ID NO: 3676170 - RNA, 22 nt, Human
uguuauuguuuuguuaauuaca

SEQ ID NO: 3676171 - RNA, 17 nt, Human
uguuauuuagacucauc

SEQ ID NO: 3676172 - RNA, 18 nt, Human
uguuauuuauaaucacuu

SEQ ID NO: 3676173 - RNA, 21 nt, Human
uguuauuuauaaucacuuuuu

SEQ ID NO: 3676174 - RNA, 21 nt, Human
uguuauuucuauuuuuguaga

SEQ ID NO: 3676175 - RNA, 13 nt, Human
uguuauuucucag

SEQ ID NO: 3676176 - RNA, 18 nt, Human
uguuauuucuuacaggca

SEQ ID NO: 3676177 - RNA, 14 nt, Human
uguuauuuucagua

SEQ ID NO: 3676178 - RNA, 15 nt, Human
uguuauuuucaguga

SEQ ID NO: 3676179 - RNA, 20 nt, Human
uguuauuuuuauaagaaaac

SEQ ID NO: 3676180 - RNA, 18 nt, Human
uguuauuuuuuaauuauu

SEQ ID NO: 3676181 - RNA, 19 nt, Human
uguucaaaaaaacacuagu

SEQ ID NO: 3676182 - RNA, 19 nt, Human
uguucaaacaauaucauau

SEQ ID NO: 3676183 - RNA, 20 nt, Human
uguucaaacaauaucauauc

SEQ ID NO: 3676184 - RNA, 20 nt, Human
uguucaaagccacauuauuu

SEQ ID NO: 3676185 - RNA, 21 nt, Human
uguucaaagccagcguccucc

SEQ ID NO: 3676186 - RNA, 22 nt, Human
uguucaaaggagcaagaacuuu

SEQ ID NO: 3676187 - RNA, 19 nt, Human
uguucaacuaggaucagaa

SEQ ID NO: 3676188 - RNA, 15 nt, Human
uguucaacuauuuua

SEQ ID NO: 3676189 - RNA, 23 nt, Human
uguucaagaccagccugaccaac

SEQ ID NO: 3676190 - RNA, 18 nt, Human
uguucaauuauuuccccc

SEQ ID NO: 3676191 - RNA, 22 nt, Human
uguucacacucucacauguuua

SEQ ID NO: 3676192 - RNA, 18 nt, Human
uguucacgcaacuugaaa

SEQ ID NO: 3676193 - RNA, 15 nt, Human
uguucacugaagacg

SEQ ID NO: 3676194 - RNA, 18 nt, Human
uguucacugaaggugauu

SEQ ID NO: 3676195 - RNA, 12 nt, Human
uguucagaaaaa

SEQ ID NO: 3676196 - RNA, 22 nt, Human
uguucagaagaaauucugucau

SEQ ID NO: 3676197 - RNA, 22 nt, Human
uguucagaagguugcucuagau

SEQ ID NO: 3676198 - RNA, 17 nt, Human
uguucagauugcuuuga

SEQ ID NO: 3676199 - RNA, 14 nt, Human
uguucagcacuguc

SEQ ID NO: 3676200 - RNA, 15 nt, Human
uguucagcacugucc

SEQ ID NO: 3676201 - RNA, 18 nt, Human
uguucagccacugaggga

SEQ ID NO: 3676202 - RNA, 19 nt, Human
uguucagccacugagggac

SEQ ID NO: 3676203 - RNA, 18 nt, Human
uguucagcuccagcucac

SEQ ID NO: 3676204 - RNA, 21 nt, Human
uguucagcuccagcucaccag

SEQ ID NO: 3676205 - RNA, 15 nt, Human
uguucaguguaaaua

SEQ ID NO: 3676206 - RNA, 13 nt, Human
uguucaguguaau

SEQ ID NO: 3676207 - RNA, 21 nt, Human
uguucaguguaauuucuuugc

SEQ ID NO: 3676208 - RNA, 12 nt, Human
uguucaguguua

SEQ ID NO: 3676209 - RNA, 15 nt, Human
uguucaguuacagaa

SEQ ID NO: 3676210 - RNA, 18 nt, Human
uguucaguugcacuucua

SEQ ID NO: 3676211 - RNA, 13 nt, Human
uguucauaaauaa

SEQ ID NO: 3676212 - RNA, 17 nt, Human
uguucauaaauaaaguu

SEQ ID NO: 3676213 - RNA, 12 nt, Human
uguucauacaua

SEQ ID NO: 3676214 - RNA, 18 nt, Human
uguucauauuaagaauga

SEQ ID NO: 3676215 - RNA, 23 nt, Human
uguucauauuaagaaugaucuga

SEQ ID NO: 3676216 - RNA, 13 nt, Human
uguucaugaaaga

SEQ ID NO: 3676217 - RNA, 16 nt, Human
uguucauuguaauguu

SEQ ID NO: 3676218 - RNA, 18 nt, Human
uguucauuguaauguuac

SEQ ID NO: 3676219 - RNA, 21 nt, Human
uguucauuguaauguuacuga

SEQ ID NO: 3676220 - RNA, 13 nt, Human
uguucauuuccuc

SEQ ID NO: 3676221 - RNA, 19 nt, Human
uguucauuuguuauucuua

SEQ ID NO: 3676222 - RNA, 17 nt, Human
uguucauuuugagcuga

SEQ ID NO: 3676223 - RNA, 20 nt, Human
uguucauuuugagcugaaau

SEQ ID NO: 3676224 - RNA, 20 nt, Human
uguuccaaauucaguuucau

SEQ ID NO: 3676225 - RNA, 16 nt, Human
uguuccaaggccaggg

SEQ ID NO: 3676226 - RNA, 17 nt, Human
uguuccaaguuuccaaa

SEQ ID NO: 3676227 - RNA, 20 nt, Human
uguuccaaugccacauacuu

SEQ ID NO: 3676228 - RNA, 12 nt, Human
uguuccagacau

SEQ ID NO: 3676229 - RNA, 17 nt, Human
uguuccagccugcccuc

SEQ ID NO: 3676230 - RNA, 18 nt, Human
uguuccaguaaucuaaua

SEQ ID NO: 3676231 - RNA, 23 nt, Human
uguucccaagagcaucaugccuc

SEQ ID NO: 3676232 - RNA, 17 nt, Human
uguucccaccugcugga

SEQ ID NO: 3676233 - RNA, 18 nt, Human
uguucccauccucuucuu

SEQ ID NO: 3676234 - RNA, 16 nt, Human
uguucccauuucagcu

SEQ ID NO: 3676235 - RNA, 13 nt, Human
uguuccccacugg

SEQ ID NO: 3676236 - RNA, 14 nt, Human
uguuccccacugga

SEQ ID NO: 3676237 - RNA, 13 nt, Human
uguuccccagaga

SEQ ID NO: 3676238 - RNA, 18 nt, Human
uguuccccauggccacuu

SEQ ID NO: 3676239 - RNA, 15 nt, Human
uguucccccugugca

SEQ ID NO: 3676240 - RNA, 16 nt, Human
uguucccccugugcag

SEQ ID NO: 3676241 - RNA, 15 nt, Human
uguuccccucacugg

SEQ ID NO: 3676242 - RNA, 15 nt, Human
uguuccccuccucca

SEQ ID NO: 3676243 - RNA, 13 nt, Human
uguuccccucucc

SEQ ID NO: 3676244 - RNA, 12 nt, Human
uguuccccucuu

SEQ ID NO: 3676245 - RNA, 21 nt, Human
uguuccccucuugucuccccu

SEQ ID NO: 3676246 - RNA, 23 nt, Human
uguuccccucuugucuccccugu

SEQ ID NO: 3676247 - RNA, 21 nt, Human
uguucccuauuuuucucuccu

SEQ ID NO: 3676248 - RNA, 23 nt, Human
uguucccuauuuuucucuccugu

SEQ ID NO: 3676249 - RNA, 18 nt, Human
uguucccucucccuguug

SEQ ID NO: 3676250 - RNA, 18 nt, Human
uguucccuuugucuuuca

SEQ ID NO: 3676251 - RNA, 21 nt, Human
uguuccgugguuaaacucgcu

SEQ ID NO: 3676252 - RNA, 15 nt, Human
uguuccuaaguucuu

SEQ ID NO: 3676253 - RNA, 15 nt, Human
uguuccuacagcccc

SEQ ID NO: 3676254 - RNA, 19 nt, Human
uguuccuacagccccuuuu

SEQ ID NO: 3676255 - RNA, 14 nt, Human
uguuccuagaguag

SEQ ID NO: 3676256 - RNA, 16 nt, Human
uguuccuagaguagag

SEQ ID NO: 3676257 - RNA, 22 nt, Human
uguuccugaauucuauuugcug

SEQ ID NO: 3676258 - RNA, 15 nt, Human
uguuccuggcaguuu

SEQ ID NO: 3676259 - RNA, 19 nt, Human
uguuccuggcaguuuaaaa

SEQ ID NO: 3676260 - RNA, 19 nt, Human
uguuccuuaagucagaaca

SEQ ID NO: 3676261 - RNA, 19 nt, Human
uguuccuuagaccuuccau

SEQ ID NO: 3676262 - RNA, 17 nt, Human
uguuccuucccugugcc

SEQ ID NO: 3676263 - RNA, 14 nt, Human
uguucgcuuggcuc

SEQ ID NO: 3676264 - RNA, 16 nt, Human
uuauuuuaguuucugu

SEQ ID NO: 3676265 - RNA, 23 nt, Human
uuauuuuaugagaaauguaaugc

SEQ ID NO: 3676266 - RNA, 20 nt, Human
uuauuuuauguugcauagaa

SEQ ID NO: 3676267 - RNA, 18 nt, Human
uuauuuuauguuuagaua

SEQ ID NO: 3676268 - RNA, 18 nt, Human
uuauuuuauuuuagcagu

SEQ ID NO: 3676269 - RNA, 18 nt, Human
uuauuuucaagaaacuga

SEQ ID NO: 3676270 - RNA, 16 nt, Human
uuauuuucaaguagcu

SEQ ID NO: 3676271 - RNA, 14 nt, Human
uuauuuucagugau

SEQ ID NO: 3676272 - RNA, 14 nt, Human
uuauuuuccucccc

SEQ ID NO: 3676273 - RNA, 16 nt, Human
uuauuuuccuccccag

SEQ ID NO: 3676274 - RNA, 18 nt, Human
uuauuuucuacguuucuu

SEQ ID NO: 3676275 - RNA, 21 nt, Human
uuauuuucugguagauagaaa

SEQ ID NO: 3676276 - RNA, 13 nt, Human
uuauuuucuguca

SEQ ID NO: 3676277 - RNA, 17 nt, Human
uuauuuucuuugaaauu

SEQ ID NO: 3676278 - RNA, 21 nt, Human
uuauuuugaaaagcuucuuaa

SEQ ID NO: 3676279 - RNA, 11 nt, Human
uuauuuugaug

SEQ ID NO: 3676280 - RNA, 21 nt, Human
uuauuuuggagagauaggaag

SEQ ID NO: 3676281 - RNA, 15 nt, Human
uuauuuuguaauuau

SEQ ID NO: 3676282 - RNA, 18 nt, Human
uuauuuuguaauuauugu

SEQ ID NO: 3676283 - RNA, 22 nt, Human
uuauuuugugaugcaaauaaau

SEQ ID NO: 3676284 - RNA, 18 nt, Human
uuauuuuuagacagaguc

SEQ ID NO: 3676285 - RNA, 14 nt, Human
uuauuuuuauacag

SEQ ID NO: 3676286 - RNA, 14 nt, Human
uuauuuuucacucu

SEQ ID NO: 3676287 - RNA, 14 nt, Human
uuauuuuucuaaaa

SEQ ID NO: 3676288 - RNA, 14 nt, Human
uuauuuuucuguua

SEQ ID NO: 3676289 - RNA, 14 nt, Human
uuauuuuucuuguc

SEQ ID NO: 3676290 - RNA, 12 nt, Human
uuauuuuugcuu

SEQ ID NO: 3676291 - RNA, 14 nt, Human
uuauuuuuguacau

SEQ ID NO: 3676292 - RNA, 16 nt, Human
uuauuuuuguacaugu

SEQ ID NO: 3676293 - RNA, 17 nt, Human
uuauuuuuguacauguu

SEQ ID NO: 3676294 - RNA, 18 nt, Human
uuauuuuuuaaguauuua

SEQ ID NO: 3676295 - RNA, 13 nt, Human
uucaauaaaucuu

SEQ ID NO: 3676296 - RNA, 19 nt, Human
uucaauaaaugucuguuga

SEQ ID NO: 3676297 - RNA, 16 nt, Human
uucaauaacuggaaca

SEQ ID NO: 3676298 - RNA, 14 nt, Human
uucaauacagauau

SEQ ID NO: 3676299 - RNA, 18 nt, Human
uucaauacagauauauuu

SEQ ID NO: 3676300 - RNA, 17 nt, Human
uucaauagcacauaugg

SEQ ID NO: 3676301 - RNA, 14 nt, Human
uucaauagccacua

SEQ ID NO: 3676302 - RNA, 23 nt, Human
uucaauagccacuaaccuugccu

SEQ ID NO: 3676303 - RNA, 15 nt, Human
uucaauauauugaac

SEQ ID NO: 3676304 - RNA, 17 nt, Human
uucaauauauugaacuu

SEQ ID NO: 3676305 - RNA, 16 nt, Human
uucaauauauuuguau

SEQ ID NO: 3676306 - RNA, 16 nt, Human
uucaaucccaggaugu

SEQ ID NO: 3676307 - RNA, 18 nt, Human
uucaaucucaauugcuuu

SEQ ID NO: 3676308 - RNA, 23 nt, Human
uucaaucugaagauacaugucuu

SEQ ID NO: 3676309 - RNA, 14 nt, Human
uucaaucuguaaac

SEQ ID NO: 3676310 - RNA, 18 nt, Human
uucaaucuguaaacugug

SEQ ID NO: 3676311 - RNA, 20 nt, Human
uucaaucuguaaacugugua

SEQ ID NO: 3676312 - RNA, 16 nt, Human
uucaaugauaguaaga

SEQ ID NO: 3676313 - RNA, 16 nt, Human
uucaaugguucugaaa

SEQ ID NO: 3676314 - RNA, 22 nt, Human
uucaaugguuugcaaggaagcc

SEQ ID NO: 3676315 - RNA, 21 nt, Human
uucaaugugauucuaaugucu

SEQ ID NO: 3676316 - RNA, 12 nt, Human
uucaauuaaacg

SEQ ID NO: 3676317 - RNA, 15 nt, Human
uucaauuaaacggau

SEQ ID NO: 3676318 - RNA, 16 nt, Human
uucaauuaaacggauu

SEQ ID NO: 3676319 - RNA, 16 nt, Human
uucaauuaaagaaaua

SEQ ID NO: 3676320 - RNA, 17 nt, Human
uucaauuauuuccccca

SEQ ID NO: 3676321 - RNA, 16 nt, Human
uucaauucaaaaaugu

SEQ ID NO: 3676322 - RNA, 20 nt, Human
uucaauucaaaaauguacaa

SEQ ID NO: 3676323 - RNA, 15 nt, Human
uucaauucaaagcug

SEQ ID NO: 3676324 - RNA, 12 nt, Human
uucaauuccucu

SEQ ID NO: 3676325 - RNA, 13 nt, Human
uucaauucucaaa

SEQ ID NO: 3676326 - RNA, 17 nt, Human
uucaauugcaucuccca

SEQ ID NO: 3676327 - RNA, 14 nt, Human
uucaauuguaaauu

SEQ ID NO: 3676328 - RNA, 15 nt, Human
uucaauuuauaccuc

SEQ ID NO: 3676329 - RNA, 16 nt, Human
uucaauuuauaccuca

SEQ ID NO: 3676330 - RNA, 16 nt, Human
uucaauuuauucaaga

SEQ ID NO: 3676331 - RNA, 17 nt, Human
uucaauuuauucaagaa

SEQ ID NO: 3676332 - RNA, 15 nt, Human
uucaauuugaugugg

SEQ ID NO: 3676333 - RNA, 16 nt, Human
uucacaaaguaauuug

SEQ ID NO: 3676334 - RNA, 12 nt, Human
uucacaaauauu

SEQ ID NO: 3676335 - RNA, 14 nt, Human
uucacaacccaucu

SEQ ID NO: 3676336 - RNA, 21 nt, Human
uucacaaccuucuguggcuca

SEQ ID NO: 3676337 - RNA, 14 nt, Human
uucacaagcugccu

SEQ ID NO: 3676338 - RNA, 13 nt, Human
uucacaauaaaag

SEQ ID NO: 3676339 - RNA, 15 nt, Human
uucacaauaaaagcu

SEQ ID NO: 3676340 - RNA, 22 nt, Human
uucacaauggugcucauuucau

SEQ ID NO: 3676341 - RNA, 13 nt, Human
uucacaauguuaa

SEQ ID NO: 3676342 - RNA, 16 nt, Human
uucacaccccaccugc

SEQ ID NO: 3676343 - RNA, 12 nt, Human
uucacacccugc

SEQ ID NO: 3676344 - RNA, 13 nt, Human
uucacacccugca

SEQ ID NO: 3676345 - RNA, 14 nt, Human
uucacacccugcaa

SEQ ID NO: 3676346 - RNA, 15 nt, Human
uucacacccugcaag

SEQ ID NO: 3676347 - RNA, 14 nt, Human
uucacaccugcaga

SEQ ID NO: 3676348 - RNA, 18 nt, Human
uucacacuuccaccagcc

SEQ ID NO: 3676349 - RNA, 19 nt, Human
uucacacuuccaccagccu

SEQ ID NO: 3676350 - RNA, 12 nt, Human
uucacagagugu

SEQ ID NO: 3676351 - RNA, 16 nt, Human
uucacagcuuuuauca

SEQ ID NO: 3676352 - RNA, 19 nt, Human
uucacaggcagccagugcc

SEQ ID NO: 3676353 - RNA, 18 nt, Human
uucacaggugugguguaa

SEQ ID NO: 3676354 - RNA, 20 nt, Human
uucacaggugugguguaauu

SEQ ID NO: 3676355 - RNA, 12 nt, Human
uucacaguguuu

SEQ ID NO: 3676356 - RNA, 21 nt, Human
uucacaguucuuugggccaga

SEQ ID NO: 3676357 - RNA, 23 nt, Human
uucacaguuggcuggaugaaauu

SEQ ID NO: 3676358 - RNA, 16 nt, Human
uucacaguuugaaaua

SEQ ID NO: 3676359 - RNA, 23 nt, Human
uucacaguuugaaauaagcuauu

SEQ ID NO: 3676360 - RNA, 13 nt, Human
uucacaguuuuuc

SEQ ID NO: 3676361 - RNA, 19 nt, Human
uucacauaaaauagauuuu

SEQ ID NO: 3676362 - RNA, 15 nt, Human
uucacauacccuccc

SEQ ID NO: 3676363 - RNA, 18 nt, Human
uucacauagcugucuaga

SEQ ID NO: 3676364 - RNA, 18 nt, Human
uucacauccuguguuucu

SEQ ID NO: 3676365 - RNA, 19 nt, Human
uucacauccuguguuucua

SEQ ID NO: 3676366 - RNA, 18 nt, Human
uucacaugcaucaaguua

SEQ ID NO: 3676367 - RNA, 13 nt, Human
uucacauucuuau

SEQ ID NO: 3676368 - RNA, 16 nt, Human
uucacauucuuggcuu

SEQ ID NO: 3676369 - RNA, 14 nt, Human
uucacauuggaaac

SEQ ID NO: 3676370 - RNA, 21 nt, Human
uucacauuguuaagaaaaaua

SEQ ID NO: 3676371 - RNA, 14 nt, Human
uucacauuuagaaa

SEQ ID NO: 3676372 - RNA, 14 nt, Human
uucaccacagacuu

SEQ ID NO: 3676373 - RNA, 19 nt, Human
uucaccagaggaaucacuc

SEQ ID NO: 3676374 - RNA, 23 nt, Human
uucaccauguaaaacaaaaaaca

SEQ ID NO: 3676375 - RNA, 24 nt, Human
uucaccauuuggcaaugccaucau

SEQ ID NO: 3676376 - RNA, 16 nt, Human
uucacccaucuuauca

SEQ ID NO: 3676377 - RNA, 17 nt, Human
uucaccccaaucccagc

SEQ ID NO: 3676378 - RNA, 22 nt, Human
uucaccccggcaggcccugcag

SEQ ID NO: 3676379 - RNA, 20 nt, Human
uucaccccucccuuucuccc

SEQ ID NO: 3676380 - RNA, 22 nt, Human
uucacccuguccaaacugccua

SEQ ID NO: 3676381 - RNA, 19 nt, Human
uucaccuaagagauucuga

SEQ ID NO: 3676382 - RNA, 21 nt, Human
uucaccuaagucucugugaau

SEQ ID NO: 3676383 - RNA, 19 nt, Human
uucaccucacugaaaacau

SEQ ID NO: 3676384 - RNA, 15 nt, Human
uucaccuccuucaau

SEQ ID NO: 3676385 - RNA, 16 nt, Human
uucaccuccuucaauu

SEQ ID NO: 3676386 - RNA, 14 nt, Human
uucaccuguaaaac

SEQ ID NO: 3676387 - RNA, 16 nt, Human
uucaccuguaaaccug

SEQ ID NO: 3676388 - RNA, 19 nt, Human
uucaccuguuuuuaagcug

SEQ ID NO: 3676389 - RNA, 23 nt, Human
uucaccuguuuuuaagcuguuuc

SEQ ID NO: 3676390 - RNA, 14 nt, Human
uucaccuugaagaa

SEQ ID NO: 3676391 - RNA, 16 nt, Human
uucaccuugggaugau

SEQ ID NO: 3676392 - RNA, 13 nt, Human
uucaccuuuguag

SEQ ID NO: 3676393 - RNA, 22 nt, Human
uucaccuuuguccccaccgcag

SEQ ID NO: 3676394 - RNA, 20 nt, Human
uucacgaaguguugcaugga

SEQ ID NO: 3676395 - RNA, 17 nt, Human
uucacggaagagccuug

SEQ ID NO: 3676396 - RNA, 19 nt, Human
uucacgucauaggaaguua

SEQ ID NO: 3676397 - RNA, 13 nt, Human
uucacuaaagcag

SEQ ID NO: 3676398 - RNA, 14 nt, Human
uucacuaaagcagu

SEQ ID NO: 3676399 - RNA, 14 nt, Human
uucacuacucagca

SEQ ID NO: 3676400 - RNA, 15 nt, Human
uucacuacucagcau

SEQ ID NO: 3676401 - RNA, 13 nt, Human
uucacuagcuuug

SEQ ID NO: 3676402 - RNA, 16 nt, Human
uucacucuaagauguu

SEQ ID NO: 3676403 - RNA, 18 nt, Human
uucacucuaagucaugua

SEQ ID NO: 3676404 - RNA, 13 nt, Human
uucacucuuaggc

SEQ ID NO: 3676405 - RNA, 20 nt, Human
uucacucuucaaaugccuga

SEQ ID NO: 3676406 - RNA, 14 nt, Human
uucacucuuggagc

SEQ ID NO: 3676407 - RNA, 19 nt, Human
uucacucuuggagccugca

SEQ ID NO: 3676408 - RNA, 20 nt, Human
uucacugcauggcucccaca

SEQ ID NO: 3676409 - RNA, 13 nt, Human
uucacugcugcaa

SEQ ID NO: 3676410 - RNA, 19 nt, Human
uucacugcugcaaggccuu

SEQ ID NO: 3676411 - RNA, 23 nt, Human
uucacugcugcaaggccuuucug

SEQ ID NO: 3676412 - RNA, 13 nt, Human
uucacugcuggcu

SEQ ID NO: 3676413 - RNA, 15 nt, Human
uucacugcuguuaua

SEQ ID NO: 3676414 - RNA, 23 nt, Human
uucacugcuguuauauuucauca

SEQ ID NO: 3676415 - RNA, 17 nt, Human
uucacuguagcucuaaa

SEQ ID NO: 3676416 - RNA, 15 nt, Human
uucacuguauaaaua

SEQ ID NO: 3676417 - RNA, 16 nt, Human
uucacuguauaaauag

SEQ ID NO: 3676418 - RNA, 23 nt, Human
uucacugucaccacccugcucau

SEQ ID NO: 3676419 - RNA, 15 nt, Human
uucacuuaacaaaca

SEQ ID NO: 3676420 - RNA, 12 nt, Human
uucacuucacug

SEQ ID NO: 3676421 - RNA, 14 nt, Human
uucacuucacugug

SEQ ID NO: 3676422 - RNA, 16 nt, Human
uucacuucacugugcu

SEQ ID NO: 3676423 - RNA, 19 nt, Human
uucacuucauaauccagua

SEQ ID NO: 3676424 - RNA, 16 nt, Human
uucacuucaucuucuc

SEQ ID NO: 3676425 - RNA, 20 nt, Human
uucacuucgggcuguguaaa

SEQ ID NO: 3676426 - RNA, 21 nt, Human
uucacuugaugauacaaugaa

SEQ ID NO: 3676427 - RNA, 16 nt, Human
uucacuuuagaugcug

SEQ ID NO: 3676428 - RNA, 14 nt, Human
uucacuuugacacu

SEQ ID NO: 3676429 - RNA, 20 nt, Human
uucacuuuuagggagaguca

SEQ ID NO: 3676430 - RNA, 20 nt, Human
uucacuuuugacaaaggcaa

SEQ ID NO: 3676431 - RNA, 21 nt, Human
uguuggacaccuuuagguucu

SEQ ID NO: 3676432 - RNA, 18 nt, Human
uguuggacccgcucugga

SEQ ID NO: 3676433 - RNA, 14 nt, Human
uguuggagaagaac

SEQ ID NO: 3676434 - RNA, 19 nt, Human
uguuggagaagaacugaaa

SEQ ID NO: 3676435 - RNA, 14 nt, Human
uguuggagccugca

SEQ ID NO: 3676436 - RNA, 19 nt, Human
uguuggauaaaucaguggu

SEQ ID NO: 3676437 - RNA, 11 nt, Human
uguuggauaag

SEQ ID NO: 3676438 - RNA, 21 nt, Human
uguuggauaaggaauuauaga

SEQ ID NO: 3676439 - RNA, 17 nt, Human
uguuggauuccaugcua

SEQ ID NO: 3676440 - RNA, 18 nt, Human
uguuggcacauccuaugc

SEQ ID NO: 3676441 - RNA, 12 nt, Human
uuaaaauuuauu

SEQ ID NO: 3676442 - RNA, 15 nt, Human
uuaaaauuugaaaca

SEQ ID NO: 3676443 - RNA, 17 nt, Human
uuaaaauuugaaacauu

SEQ ID NO: 3676444 - RNA, 18 nt, Human
uuaaaauuugaaacauug

SEQ ID NO: 3676445 - RNA, 19 nt, Human
uuaaaauuuguucuuguau

SEQ ID NO: 3676446 - RNA, 21 nt, Human
uuaaaauuuuaagcuaggaaa

SEQ ID NO: 3676447 - RNA, 20 nt, Human
uuaaacaaacauuguguuga

SEQ ID NO: 3676448 - RNA, 12 nt, Human
uuaaacaaacca

SEQ ID NO: 3676449 - RNA, 14 nt, Human
uuaaacaaagguug

SEQ ID NO: 3676450 - RNA, 14 nt, Human
uuaaacaaaguuuc

SEQ ID NO: 3676451 - RNA, 22 nt, Human
uuaaacaaauguaugauuacau

SEQ ID NO: 3676452 - RNA, 18 nt, Human
uuaaacaauuuauuuuau

SEQ ID NO: 3676453 - RNA, 14 nt, Human
uuaaacacauuguc

SEQ ID NO: 3676454 - RNA, 16 nt, Human
uuaaacaccuccucau

SEQ ID NO: 3676455 - RNA, 12 nt, Human
uuaaacagauga

SEQ ID NO: 3676456 - RNA, 16 nt, Human
uuaaacagauguccau

SEQ ID NO: 3676457 - RNA, 15 nt, Human
uuaaacaggcccagc

SEQ ID NO: 3676458 - RNA, 16 nt, Human
uuaaacaguauuucau

SEQ ID NO: 3676459 - RNA, 22 nt, Human
uuaaacaugcuguacauacuuu

SEQ ID NO: 3676460 - RNA, 23 nt, Human
uuaaacauuaauagcagccuuuc

SEQ ID NO: 3676461 - RNA, 13 nt, Human
uuaaacauugaag

SEQ ID NO: 3676462 - RNA, 15 nt, Human
uuaaacauugaagua

SEQ ID NO: 3676463 - RNA, 18 nt, Human
uuaaacauugguucuugu

SEQ ID NO: 3676464 - RNA, 22 nt, Human
uuaaaccaucucccuggugcuu

SEQ ID NO: 3676465 - RNA, 23 nt, Human
uuaaaccaucucccuggugcuua

SEQ ID NO: 3676466 - RNA, 23 nt, Human
uuaaaccaugggauaaaugccau

SEQ ID NO: 3676467 - RNA, 13 nt, Human
uuaaacccauuuu

SEQ ID NO: 3676468 - RNA, 19 nt, Human
uuaaaccgcuaaaagaaac

SEQ ID NO: 3676469 - RNA, 17 nt, Human
uuaaaccuauacucacu

SEQ ID NO: 3676470 - RNA, 15 nt, Human
uuaaaccugucucca

SEQ ID NO: 3676471 - RNA, 19 nt, Human
uuaaaccugucuccacugu

SEQ ID NO: 3676472 - RNA, 20 nt, Human
uuaaaccugucuccacugug

SEQ ID NO: 3676473 - RNA, 21 nt, Human
uuaaaccuguuuuuuuuucau

SEQ ID NO: 3676474 - RNA, 22 nt, Human
uuaaacgauuuuuaaaauguac

SEQ ID NO: 3676475 - RNA, 15 nt, Human
uuaaacggauuauuu

SEQ ID NO: 3676476 - RNA, 20 nt, Human
uuaaacguaugcaugugaag

SEQ ID NO: 3676477 - RNA, 17 nt, Human
uuaaacuagcauaucug

SEQ ID NO: 3676478 - RNA, 23 nt, Human
uuaaacuagcauaucugccuuua

SEQ ID NO: 3676479 - RNA, 16 nt, Human
uuaaacucagggacag

SEQ ID NO: 3676480 - RNA, 20 nt, Human
uuaaacucugaauuuaucuu

SEQ ID NO: 3676481 - RNA, 22 nt, Human
uuaaacucugaauuuaucuuug

SEQ ID NO: 3676482 - RNA, 21 nt, Human
uuaaacucugagugcaaacuu

SEQ ID NO: 3676483 - RNA, 22 nt, Human
uuaaacugguauuuuaucuuug

SEQ ID NO: 3676484 - RNA, 12 nt, Human
uuaaacuguaca

SEQ ID NO: 3676485 - RNA, 14 nt, Human
uuaaacuguacagu

SEQ ID NO: 3676486 - RNA, 16 nt, Human
uuaaacuguuagcacu

SEQ ID NO: 3676487 - RNA, 19 nt, Human
uuaaacuguuagcacuguu

SEQ ID NO: 3676488 - RNA, 22 nt, Human
uuaaacuguuagcacuguugau

SEQ ID NO: 3676489 - RNA, 23 nt, Human
uaccugaagcuaucguaaaauua

SEQ ID NO: 3676490 - RNA, 14 nt, Human
uaccugaaugcucu

SEQ ID NO: 3676491 - RNA, 19 nt, Human
uaccugaccucuugcuguc

SEQ ID NO: 3676492 - RNA, 13 nt, Human
uaccugaggggcc

SEQ ID NO: 3676493 - RNA, 17 nt, Human
uaccugaguugaagagg

SEQ ID NO: 3676494 - RNA, 18 nt, Human
uaccugauuuuuuuuccu

SEQ ID NO: 3676495 - RNA, 16 nt, Human
uaccugccacucacac

SEQ ID NO: 3676496 - RNA, 15 nt, Human
uaccugcccuggaac

SEQ ID NO: 3676497 - RNA, 16 nt, Human
uaccugcgcuuguuuu

SEQ ID NO: 3676498 - RNA, 10 nt, Human
uaccugcugc

SEQ ID NO: 3676499 - RNA, 15 nt, Human
uaccuggaaucaaau

SEQ ID NO: 3676500 - RNA, 19 nt, Human
uaccuggguccccagcccu

SEQ ID NO: 3676501 - RNA, 18 nt, Human
uaccugggugauuacaua

SEQ ID NO: 3676502 - RNA, 19 nt, Human
uaccuguacacugacuuga

SEQ ID NO: 3676503 - RNA, 20 nt, Human
uaccuguauacguuucaaaa

SEQ ID NO: 3676504 - RNA, 18 nt, Human
uaccugucacauugcauu

SEQ ID NO: 3676505 - RNA, 17 nt, Human
uaccugucccccugaca

SEQ ID NO: 3676506 - RNA, 13 nt, Human
uaccugugaaaua

SEQ ID NO: 3676507 - RNA, 12 nt, Human
uaccuguggaua

SEQ ID NO: 3676508 - RNA, 20 nt, Human
uaccuguucagugucccggg

SEQ ID NO: 3676509 - RNA, 21 nt, Human
uaccuguucagugucccgggc

SEQ ID NO: 3676510 - RNA, 13 nt, Human
uaccuguuccuua

SEQ ID NO: 3676511 - RNA, 14 nt, Human
uaccuguugagcau

SEQ ID NO: 3676512 - RNA, 21 nt, Human
uaccuguugagcaucacagaa

SEQ ID NO: 3676513 - RNA, 14 nt, Human
uaccuguuuaaauu

SEQ ID NO: 3676514 - RNA, 22 nt, Human
uaccuguuuuguggucagcugu

SEQ ID NO: 3676515 - RNA, 15 nt, Human
uaccuuaaaauuuga

SEQ ID NO: 3676516 - RNA, 16 nt, Human
uaccuuaaaauuugaa

SEQ ID NO: 3676517 - RNA, 20 nt, Human
uaccuuaaaauuugaaacau

SEQ ID NO: 3676518 - RNA, 20 nt, Human
uaccuuacagugagggcuau

SEQ ID NO: 3676519 - RNA, 16 nt, Human
uaccuuagauuagcuc

SEQ ID NO: 3676520 - RNA, 20 nt, Human
uaccuuagauuagcucugga

SEQ ID NO: 3676521 - RNA, 21 nt, Human
uaccuuagauuagcucuggac

SEQ ID NO: 3676522 - RNA, 22 nt, Human
uaccuuagauuagcucuggacc

SEQ ID NO: 3676523 - RNA, 18 nt, Human
uaccuuagugcaguuauu

SEQ ID NO: 3676524 - RNA, 20 nt, Human
uaccuuagugcaguuauuug

SEQ ID NO: 3676525 - RNA, 22 nt, Human
uaccuuagugcaguuauuugcu

SEQ ID NO: 3676526 - RNA, 15 nt, Human
uaccuucaaacuuua

SEQ ID NO: 3676527 - RNA, 14 nt, Human
uaccuucaaagcug

SEQ ID NO: 3676528 - RNA, 20 nt, Human
uaccuucaauaaaguaucua

SEQ ID NO: 3676529 - RNA, 15 nt, Human
uaccuucagauccua

SEQ ID NO: 3676530 - RNA, 13 nt, Human
uaccuucauuuca

SEQ ID NO: 3676531 - RNA, 12 nt, Human
uaccuuccaguc

SEQ ID NO: 3676532 - RNA, 14 nt, Human
uaccuuccuucccu

SEQ ID NO: 3676533 - RNA, 15 nt, Human
uaccuuccuucccug

SEQ ID NO: 3676534 - RNA, 19 nt, Human
uaccuucuccccagcuccc

SEQ ID NO: 3676535 - RNA, 22 nt, Human
uaccuucuccccagcucccagg

SEQ ID NO: 3676536 - RNA, 12 nt, Human
uaccuugcccca

SEQ ID NO: 3676537 - RNA, 15 nt, Human
uaccuugccccaacc

SEQ ID NO: 3676538 - RNA, 21 nt, Human
uaccuugccccaacccuucuu

SEQ ID NO: 3676539 - RNA, 13 nt, Human
uaccuugguuccc

SEQ ID NO: 3676540 - RNA, 20 nt, Human
uaccuuguauacuguaggca

SEQ ID NO: 3676541 - RNA, 18 nt, Human
uaccuuucucucucuaag

SEQ ID NO: 3676542 - RNA, 18 nt, Human
uaccuuuucagggcuggc

SEQ ID NO: 3676543 - RNA, 15 nt, Human
uaccuuuucucuuca

SEQ ID NO: 3676544 - RNA, 20 nt, Human
uaccuuuuuauuugcaugug

SEQ ID NO: 3676545 - RNA, 16 nt, Human
uaccuuuuuuuuuucu

SEQ ID NO: 3676546 - RNA, 18 nt, Human
uaccuuuuuuuuuucuug

SEQ ID NO: 3676547 - RNA, 18 nt, Human
uacgaaaagaggggaaga

SEQ ID NO: 3676548 - RNA, 21 nt, Human
uacgaaaagaggggaagagac

SEQ ID NO: 3676549 - RNA, 16 nt, Human
uacgaaauaauuguug

SEQ ID NO: 3676550 - RNA, 22 nt, Human
uacgaaauaauuguuguucugu

SEQ ID NO: 3676551 - RNA, 22 nt, Human
uacgaagaguauuuuugacaga

SEQ ID NO: 3676552 - RNA, 15 nt, Human
uacgaauauuuucag

SEQ ID NO: 3676553 - RNA, 15 nt, Human
uacgacaacuugcac

SEQ ID NO: 3676554 - RNA, 21 nt, Human
uacgacacggguggggaaagg

SEQ ID NO: 3676555 - RNA, 14 nt, Human
uacgacuuuauuuu

SEQ ID NO: 3676556 - RNA, 20 nt, Human
uacgagcaccuccagccuga

SEQ ID NO: 3676557 - RNA, 20 nt, Human
uacgaguaauugcauuugcu

SEQ ID NO: 3676558 - RNA, 15 nt, Human
uacgauaaggaagaa

SEQ ID NO: 3676559 - RNA, 21 nt, Human
uacgauaaggaagaaacagaa

SEQ ID NO: 3676560 - RNA, 17 nt, Human
uacgcacagacagguuu

SEQ ID NO: 3676561 - RNA, 21 nt, Human
uacgcacagacagguuuucac

SEQ ID NO: 3676562 - RNA, 23 nt, Human
uacgcacuacaugugguuuauag

SEQ ID NO: 3676563 - RNA, 22 nt, Human
uacgccaggggaaaaucagccu

SEQ ID NO: 3676564 - RNA, 19 nt, Human
uacgcccaacccuucccca

SEQ ID NO: 3676565 - RNA, 17 nt, Human
uacgcccaucucaggac

SEQ ID NO: 3676566 - RNA, 18 nt, Human
uacgccucuucugucccu

SEQ ID NO: 3676567 - RNA, 24 nt, Human
uacgcuccaucgcugucaucucag

SEQ ID NO: 3676568 - RNA, 22 nt, Human
uacgcugaagauggcauccugu

SEQ ID NO: 3676569 - RNA, 12 nt, Human
uacgcuuuguca

SEQ ID NO: 3676570 - RNA, 12 nt, Human
uacgcuuuucuu

SEQ ID NO: 3676571 - RNA, 17 nt, Human
uacggacagagaccaag

SEQ ID NO: 3676572 - RNA, 19 nt, Human
uacggaccagguauagaga

SEQ ID NO: 3676573 - RNA, 22 nt, Human
uacggauccugcacugacucug

SEQ ID NO: 3676574 - RNA, 18 nt, Human
uacgggaggguaaggcug

SEQ ID NO: 3676575 - RNA, 22 nt, Human
uacguaaaaaucucucauuugu

SEQ ID NO: 3676576 - RNA, 16 nt, Human
uacguacaugugaggc

SEQ ID NO: 3676577 - RNA, 21 nt, Human
uacguagccuaaggcuccugu

SEQ ID NO: 3676578 - RNA, 21 nt, Human
uacguaugucugguucucaau

SEQ ID NO: 3676579 - RNA, 16 nt, Human
uacguauuuaauagca

SEQ ID NO: 3676580 - RNA, 14 nt, Human
uacgucugacaggc

SEQ ID NO: 3676581 - RNA, 13 nt, Human
uacgucugggaga

SEQ ID NO: 3676582 - RNA, 14 nt, Human
uacgucugggagaa

SEQ ID NO: 3676583 - RNA, 22 nt, Human
uacgugacccucugcugaagac

SEQ ID NO: 3676584 - RNA, 16 nt, Human
uacgugucaaugugug

SEQ ID NO: 3676585 - RNA, 19 nt, Human
uuaacucucuuuaugucug

SEQ ID NO: 3676586 - RNA, 12 nt, Human
uuaacucugucu

SEQ ID NO: 3676587 - RNA, 11 nt, Human
uuaacucuuug

SEQ ID NO: 3676588 - RNA, 12 nt, Human
uuaacucuuugc

SEQ ID NO: 3676589 - RNA, 19 nt, Human
uuaacugaagauguugaga

SEQ ID NO: 3676590 - RNA, 21 nt, Human
uuaacugaauaccacucugua

SEQ ID NO: 3676591 - RNA, 17 nt, Human
uuaacuggguaaugaaa

SEQ ID NO: 3676592 - RNA, 21 nt, Human
uuaacuggguaaugaaacaaa

SEQ ID NO: 3676593 - RNA, 22 nt, Human
uuaacuguccguaagcaguaua

SEQ ID NO: 3676594 - RNA, 12 nt, Human
uuaacuguggau

SEQ ID NO: 3676595 - RNA, 13 nt, Human
uuaacuguggaua

SEQ ID NO: 3676596 - RNA, 15 nt, Human
uuaacuguggauauu

SEQ ID NO: 3676597 - RNA, 19 nt, Human
uuaacuguguauguacaua

SEQ ID NO: 3676598 - RNA, 15 nt, Human
uuaacuuaaauagua

SEQ ID NO: 3676599 - RNA, 22 nt, Human
uuaacuuaaauuuuaauuuauu

SEQ ID NO: 3676600 - RNA, 14 nt, Human
uuaacuuaauaauc

SEQ ID NO: 3676601 - RNA, 18 nt, Human
uuaacuuaguuuugcaua

SEQ ID NO: 3676602 - RNA, 16 nt, Human
uuaacuucacauauug

SEQ ID NO: 3676603 - RNA, 17 nt, Human
uuaacuucuguuuuacc

SEQ ID NO: 3676604 - RNA, 15 nt, Human
uuaacuugaguuuua

SEQ ID NO: 3676605 - RNA, 16 nt, Human
uuaacuugucaaaaaa

SEQ ID NO: 3676606 - RNA, 16 nt, Human
uuaacuuuaagacuga

SEQ ID NO: 3676607 - RNA, 18 nt, Human
uuaacuuuaucacauuau

SEQ ID NO: 3676608 - RNA, 12 nt, Human
uuaacuuuuaua

SEQ ID NO: 3676609 - RNA, 13 nt, Human
uuaacuuuuauaa

SEQ ID NO: 3676610 - RNA, 18 nt, Human
uuaacuuuuauaaacuuu

SEQ ID NO: 3676611 - RNA, 23 nt, Human
uuaacuuuuauaaacuuuaccuu

SEQ ID NO: 3676612 - RNA, 18 nt, Human
uuaacuuuuuuucuucua

SEQ ID NO: 3676613 - RNA, 14 nt, Human
uuaagaaaaaaaua

SEQ ID NO: 3676614 - RNA, 23 nt, Human
uuaagaaaaaaauaauuuuauga

SEQ ID NO: 3676615 - RNA, 20 nt, Human
uuaagaaaaaauaacacaca

SEQ ID NO: 3676616 - RNA, 21 nt, Human
uuaagaaaaaauaacacacau

SEQ ID NO: 3676617 - RNA, 19 nt, Human
uuaagaaaaaggaugcaca

SEQ ID NO: 3676618 - RNA, 21 nt, Human
uuaagaaaaguauuuugaagu

SEQ ID NO: 3676619 - RNA, 23 nt, Human
uuaagaaaaguauuuugaaguuu

SEQ ID NO: 3676620 - RNA, 18 nt, Human
uuaagaaaauacaauaaa

SEQ ID NO: 3676621 - RNA, 14 nt, Human
uuaagaaaaucaua

SEQ ID NO: 3676622 - RNA, 22 nt, Human
uuaagaaagacuaucuaaaugu

SEQ ID NO: 3676623 - RNA, 22 nt, Human
uuaagaaauagacagcaugaga

SEQ ID NO: 3676624 - RNA, 15 nt, Human
uuaagaaauguaguu

SEQ ID NO: 3676625 - RNA, 21 nt, Human
uuaagaaauguaguugaugua

SEQ ID NO: 3676626 - RNA, 19 nt, Human
uuaagaaauguauaaacuu

SEQ ID NO: 3676627 - RNA, 22 nt, Human
uuaagaagacugcauuauauuu

SEQ ID NO: 3676628 - RNA, 14 nt, Human
uuaagaagcuguug

SEQ ID NO: 3676629 - RNA, 12 nt, Human
uuaagaaggcaa

SEQ ID NO: 3676630 - RNA, 18 nt, Human
uuaagaaggcaaaaaugu

SEQ ID NO: 3676631 - RNA, 20 nt, Human
uuaagaauaucuguaauggu

SEQ ID NO: 3676632 - RNA, 16 nt, Human
uuaagaauauguuucc

SEQ ID NO: 3676633 - RNA, 19 nt, Human
uuaagaauauguuuccuug

SEQ ID NO: 3676634 - RNA, 20 nt, Human
uuaagaaugaaauacuguuu

SEQ ID NO: 3676635 - RNA, 20 nt, Human
uuaagaaugaguuucuuaga

SEQ ID NO: 3676636 - RNA, 19 nt, Human
uuaagaaugaucugauuga

SEQ ID NO: 3676637 - RNA, 22 nt, Human
uuaagaauguugguuuacuuuc

SEQ ID NO: 3676638 - RNA, 14 nt, Human
uuaagaauugacca

SEQ ID NO: 3676639 - RNA, 10 nt, Human
uuaagacaag

SEQ ID NO: 3676640 - RNA, 15 nt, Human
uuaagaccagccugg

SEQ ID NO: 3676641 - RNA, 18 nt, Human
uuaagaccuacuguucua

SEQ ID NO: 3676642 - RNA, 20 nt, Human
uuaagaccuacuguucuaaa

SEQ ID NO: 3676643 - RNA, 19 nt, Human
uuaagacgaaacauuuguu

SEQ ID NO: 3676644 - RNA, 13 nt, Human
uuaagacguguuu

SEQ ID NO: 3676645 - RNA, 16 nt, Human
uuaagacguguuugug

SEQ ID NO: 3676646 - RNA, 21 nt, Human
uuaagacugagcaccugcuuc

SEQ ID NO: 3676647 - RNA, 18 nt, Human
uuaagacugauuuuaaua

SEQ ID NO: 3676648 - RNA, 16 nt, Human
uuaagacuuaaugaga

SEQ ID NO: 3676649 - RNA, 13 nt, Human
uuaagagaaacuu

SEQ ID NO: 3676650 - RNA, 21 nt, Human
uuaagagaaacuuuauacauu

SEQ ID NO: 3676651 - RNA, 14 nt, Human
uuaagagagaaauc

SEQ ID NO: 3676652 - RNA, 16 nt, Human
uuaagaggcagggucu

SEQ ID NO: 3676653 - RNA, 14 nt, Human
uuaagauaauuaua

SEQ ID NO: 3676654 - RNA, 14 nt, Human
uuccgucacauccc

SEQ ID NO: 3676655 - RNA, 15 nt, Human
uuccgucagaaagug

SEQ ID NO: 3676656 - RNA, 14 nt, Human
uuccgugcguggca

SEQ ID NO: 3676657 - RNA, 15 nt, Human
uuccgugucuggcca

SEQ ID NO: 3676658 - RNA, 15 nt, Human
uuccguuugcuuuug

SEQ ID NO: 3676659 - RNA, 13 nt, Human
uuccuaaagaaaa

SEQ ID NO: 3676660 - RNA, 20 nt, Human
uuccuaaauuuuccuguccu

SEQ ID NO: 3676661 - RNA, 14 nt, Human
uuccuaacacagca

SEQ ID NO: 3676662 - RNA, 19 nt, Human
uuccuaacaggauuagaca

SEQ ID NO: 3676663 - RNA, 22 nt, Human
uuccuaacuuuucaaugacauu

SEQ ID NO: 3676664 - RNA, 13 nt, Human
uuccuaagccacu

SEQ ID NO: 3676665 - RNA, 18 nt, Human
uuccuaaguucuuagaua

SEQ ID NO: 3676666 - RNA, 16 nt, Human
uuccuaauaaaguucu

SEQ ID NO: 3676667 - RNA, 22 nt, Human
uuccuaauaaaguucuguacuc

SEQ ID NO: 3676668 - RNA, 13 nt, Human
uuccuaauuuuag

SEQ ID NO: 3676669 - RNA, 15 nt, Human
uuccuacacaggaca

SEQ ID NO: 3676670 - RNA, 18 nt, Human
uuccuacacccuuggacu

SEQ ID NO: 3676671 - RNA, 21 nt, Human
uuccuacacccuuggacuuga

SEQ ID NO: 3676672 - RNA, 14 nt, Human
uuccuacagcacua

SEQ ID NO: 3676673 - RNA, 17 nt, Human
uuccuacagcacuacug

SEQ ID NO: 3676674 - RNA, 23 nt, Human
uuccuacagcacuacuggguguc

SEQ ID NO: 3676675 - RNA, 14 nt, Human
uuccuacagccccu

SEQ ID NO: 3676676 - RNA, 18 nt, Human
uuccuacagccccuuuuu

SEQ ID NO: 3676677 - RNA, 13 nt, Human
uuccuacaggcag

SEQ ID NO: 3676678 - RNA, 20 nt, Human
uuccuacccacaccucugcc

SEQ ID NO: 3676679 - RNA, 13 nt, Human
uuccuaccucccu

SEQ ID NO: 3676680 - RNA, 12 nt, Human
uuccuacucuuc

SEQ ID NO: 3676681 - RNA, 15 nt, Human
uuccuacucuucucu

SEQ ID NO: 3676682 - RNA, 20 nt, Human
uuccuacucuucucucugcu

SEQ ID NO: 3676683 - RNA, 18 nt, Human
uuccuacuuuuccuuccc

SEQ ID NO: 3676684 - RNA, 19 nt, Human
uuccuagaaguuacugaau

SEQ ID NO: 3676685 - RNA, 14 nt, Human
uuccuagagaacug

SEQ ID NO: 3676686 - RNA, 16 nt, Human
uuccuagccuguuucu

SEQ ID NO: 3676687 - RNA, 18 nt, Human
uuccuaggggaaugaggg

SEQ ID NO: 3676688 - RNA, 14 nt, Human
uuccuagggguuug

SEQ ID NO: 3676689 - RNA, 20 nt, Human
uuccuagguauaauucacau

SEQ ID NO: 3676690 - RNA, 12 nt, Human
uuccuagugaaa

SEQ ID NO: 3676691 - RNA, 18 nt, Human
uuccuaguucaucccuuc

SEQ ID NO: 3676692 - RNA, 18 nt, Human
uuccuaguuuucuccucc

SEQ ID NO: 3676693 - RNA, 17 nt, Human
uuccuauaacuugaugc

SEQ ID NO: 3676694 - RNA, 11 nt, Human
uuccuauaagg

SEQ ID NO: 3676695 - RNA, 15 nt, Human
uuccuaucauguuaa

SEQ ID NO: 3676696 - RNA, 14 nt, Human
uuccuaucccaucc

SEQ ID NO: 3676697 - RNA, 18 nt, Human
uuccuaucccaucccauc

SEQ ID NO: 3676698 - RNA, 18 nt, Human
uuccuaugauguauacug

SEQ ID NO: 3676699 - RNA, 18 nt, Human
uuccuaugcuauugacaa

SEQ ID NO: 3676700 - RNA, 16 nt, Human
uuccuaugcuuugaaa

SEQ ID NO: 3676701 - RNA, 19 nt, Human
uuccuauuccaagcuucca

SEQ ID NO: 3676702 - RNA, 13 nt, Human
uuccuauugucau

SEQ ID NO: 3676703 - RNA, 15 nt, Human
uuccuauuucuuaua

SEQ ID NO: 3676704 - RNA, 23 nt, Human
uuccuauuugccaugggcuucac

SEQ ID NO: 3676705 - RNA, 21 nt, Human
uuccucaaaauaaagaaguau

SEQ ID NO: 3676706 - RNA, 13 nt, Human
uuccucacuucca

SEQ ID NO: 3676707 - RNA, 18 nt, Human
uuccucagacucuaagaa

SEQ ID NO: 3676708 - RNA, 11 nt, Human
uuccucagcca

SEQ ID NO: 3676709 - RNA, 19 nt, Human
uuccucagccagccucgcc

SEQ ID NO: 3676710 - RNA, 12 nt, Human
uuccucagcuua

SEQ ID NO: 3676711 - RNA, 17 nt, Human
uuccucaguuacacaaa

SEQ ID NO: 3676712 - RNA, 23 nt, Human
uuccucaguucauccauucuauu

SEQ ID NO: 3676713 - RNA, 18 nt, Human
uuccucauccaccccauc

SEQ ID NO: 3676714 - RNA, 22 nt, Human
uuccucauccucagaugcucaa

SEQ ID NO: 3676715 - RNA, 16 nt, Human
uuccucaugaauguaa

SEQ ID NO: 3676716 - RNA, 18 nt, Human
uuccucaugaauguaaau

SEQ ID NO: 3676717 - RNA, 13 nt, Human
uuccucauuagca

SEQ ID NO: 3676718 - RNA, 22 nt, Human
uuccuccagcugcaccagagca

SEQ ID NO: 3676719 - RNA, 24 nt, Human
uuccuccauccuccuccuuccuag

SEQ ID NO: 3676720 - RNA, 17 nt, Human
uuccuccauuugagaaa

SEQ ID NO: 3676721 - RNA, 18 nt, Human
uuccucccauucaagauu

SEQ ID NO: 3676722 - RNA, 13 nt, Human
uuccuccccagca

SEQ ID NO: 3676723 - RNA, 11 nt, Human
uuccucccuuc

SEQ ID NO: 3676724 - RNA, 12 nt, Human
uuccucccuucu

SEQ ID NO: 3676725 - RNA, 14 nt, Human
uuccuccuccacca

SEQ ID NO: 3676726 - RNA, 18 nt, Human
uuccuccuccaccaccgc

SEQ ID NO: 3676727 - RNA, 16 nt, Human
uuccuccuccccacuu

SEQ ID NO: 3676728 - RNA, 17 nt, Human
uuccuccucccuccugc

SEQ ID NO: 3676729 - RNA, 20 nt, Human
uuccuccucugacuugggga

SEQ ID NO: 3676730 - RNA, 13 nt, Human
uuccuccugcuca

SEQ ID NO: 3676731 - RNA, 23 nt, Human
uacuugccuuauuagagugucuu

SEQ ID NO: 3676732 - RNA, 17 nt, Human
uacuugcucagguacuu

SEQ ID NO: 3676733 - RNA, 12 nt, Human
uacuugcucugg

SEQ ID NO: 3676734 - RNA, 13 nt, Human
uacuugcucuuga

SEQ ID NO: 3676735 - RNA, 18 nt, Human
uacuugcucuugaugccu

SEQ ID NO: 3676736 - RNA, 20 nt, Human
uacuugcucuugaugccugg

SEQ ID NO: 3676737 - RNA, 21 nt, Human
uacuugcucuugaugccuggc

SEQ ID NO: 3676738 - RNA, 19 nt, Human
uacuugcuuuaccuuuuca

SEQ ID NO: 3676739 - RNA, 14 nt, Human
uacuugcuuugugu

SEQ ID NO: 3676740 - RNA, 17 nt, Human
uacuugggaagcugagg

SEQ ID NO: 3676741 - RNA, 21 nt, Human
uacuugggagaccuguaauca

SEQ ID NO: 3676742 - RNA, 18 nt, Human
uacuuggucacagccagg

SEQ ID NO: 3676743 - RNA, 15 nt, Human
uacuuguaauuaugg

SEQ ID NO: 3676744 - RNA, 18 nt, Human
uacuugucaaagaagguu

SEQ ID NO: 3676745 - RNA, 13 nt, Human
uacuugucaauau

SEQ ID NO: 3676746 - RNA, 19 nt, Human
uacuugugaaacacagcug

SEQ ID NO: 3676747 - RNA, 16 nt, Human
uacuugugauuucgau

SEQ ID NO: 3676748 - RNA, 15 nt, Human
uacuuguggacuaaa

SEQ ID NO: 3676749 - RNA, 23 nt, Human
uacuuguggacuaaaagauauaa

SEQ ID NO: 3676750 - RNA, 14 nt, Human
uacuuguuauaaac

SEQ ID NO: 3676751 - RNA, 20 nt, Human
uacuuguuucucuguuguaa

SEQ ID NO: 3676752 - RNA, 19 nt, Human
uacuuguuuuuguaaagaa

SEQ ID NO: 3676753 - RNA, 15 nt, Human
uacuuuaaaggaaaa

SEQ ID NO: 3676754 - RNA, 20 nt, Human
uacuuuaaaggaaaaaaugu

SEQ ID NO: 3676755 - RNA, 22 nt, Human
uacuuuaacuuaguuuugcaua

SEQ ID NO: 3676756 - RNA, 13 nt, Human
uacuuuaauaaau

SEQ ID NO: 3676757 - RNA, 15 nt, Human
uacuuuaccaccccc

SEQ ID NO: 3676758 - RNA, 19 nt, Human
uacuuuaccacccccacac

SEQ ID NO: 3676759 - RNA, 18 nt, Human
uacuuuauagaagaaugc

SEQ ID NO: 3676760 - RNA, 19 nt, Human
uacuuuauagaagaaugca

SEQ ID NO: 3676761 - RNA, 20 nt, Human
uacuuuaucacuuuuugaac

SEQ ID NO: 3676762 - RNA, 20 nt, Human
uacuuuauguuacuacaugc

SEQ ID NO: 3676763 - RNA, 17 nt, Human
uacuuuccaauucuccu

SEQ ID NO: 3676764 - RNA, 19 nt, Human
uacuuuccaauucuccuuu

SEQ ID NO: 3676765 - RNA, 15 nt, Human
uacuuucccuacccu

SEQ ID NO: 3676766 - RNA, 18 nt, Human
uacuuucccuacccucua

SEQ ID NO: 3676767 - RNA, 12 nt, Human
uacuuucccuug

SEQ ID NO: 3676768 - RNA, 23 nt, Human
uacuuucccuugcuuuucccucu

SEQ ID NO: 3676769 - RNA, 15 nt, Human
uacuuucuguuaaaa

SEQ ID NO: 3676770 - RNA, 17 nt, Human
uacuuucuguuaaaaug

SEQ ID NO: 3676771 - RNA, 18 nt, Human
uacuuucuuaaugugacc

SEQ ID NO: 3676772 - RNA, 15 nt, Human
uacuuucuucaaaau

SEQ ID NO: 3676773 - RNA, 19 nt, Human
uacuuugaaaccagaaaau

SEQ ID NO: 3676774 - RNA, 13 nt, Human
uacuuugaaugug

SEQ ID NO: 3676775 - RNA, 18 nt, Human
uacuuugaauguguuuca

SEQ ID NO: 3676776 - RNA, 12 nt, Human
uacuuugauuca

SEQ ID NO: 3676777 - RNA, 16 nt, Human
uacuuugcauugucug

SEQ ID NO: 3676778 - RNA, 19 nt, Human
uacuuugccuuuugcaaac

SEQ ID NO: 3676779 - RNA, 22 nt, Human
uacuuugccuuuugcaaacuuu

SEQ ID NO: 3676780 - RNA, 17 nt, Human
uacuuuggaauucuuag

SEQ ID NO: 3676781 - RNA, 20 nt, Human
uacuuuggggcuaauuuaac

SEQ ID NO: 3676782 - RNA, 20 nt, Human
uacuuugguagcugggaaag

SEQ ID NO: 3676783 - RNA, 23 nt, Human
uacuuugguagcugggaaagcau

SEQ ID NO: 3676784 - RNA, 19 nt, Human
uacuuugguuucugucugu

SEQ ID NO: 3676785 - RNA, 18 nt, Human
uacuuuguaaauucugau

SEQ ID NO: 3676786 - RNA, 19 nt, Human
uacuuuguaaauucugauu

SEQ ID NO: 3676787 - RNA, 22 nt, Human
uacuuuguaaauucugauuucu

SEQ ID NO: 3676788 - RNA, 22 nt, Human
uacuuuguacaaagaccacaca

SEQ ID NO: 3676789 - RNA, 12 nt, Human
uacuuuguauug

SEQ ID NO: 3676790 - RNA, 14 nt, Human
uacuuuguauuguc

SEQ ID NO: 3676791 - RNA, 21 nt, Human
uacuuugucuaagaaacauug

SEQ ID NO: 3676792 - RNA, 16 nt, Human
uacuuugucugaaaaa

SEQ ID NO: 3676793 - RNA, 21 nt, Human
uacuuuuaaacagugagccug

SEQ ID NO: 3676794 - RNA, 20 nt, Human
uacuuuuaaagaauuucuuu

SEQ ID NO: 3676795 - RNA, 16 nt, Human
uacuuuuauaauaaaa

SEQ ID NO: 3676796 - RNA, 23 nt, Human
uacuuuuauuuuacacagaaaca

SEQ ID NO: 3676797 - RNA, 20 nt, Human
uacuuuucauauuugcacua

SEQ ID NO: 3676798 - RNA, 16 nt, Human
uacuuuucauucucuu

SEQ ID NO: 3676799 - RNA, 19 nt, Human
uacuuuucccauuuguaau

SEQ ID NO: 3676800 - RNA, 21 nt, Human
uacuuuuccuugcauacaaac

SEQ ID NO: 3676801 - RNA, 13 nt, Human
uacuuuugagugu

SEQ ID NO: 3676802 - RNA, 11 nt, Human
uacuuuuggaa

SEQ ID NO: 3676803 - RNA, 20 nt, Human
uacuuuuggaaucuagaaga

SEQ ID NO: 3676804 - RNA, 14 nt, Human
uacuuuuuauauau

SEQ ID NO: 3676805 - RNA, 13 nt, Human
uacuuuuucuaau

SEQ ID NO: 3676806 - RNA, 14 nt, Human
uacuuuuucuaaug

SEQ ID NO: 3676807 - RNA, 16 nt, Human
uacuuuuucuaaugag

SEQ ID NO: 3676808 - RNA, 18 nt, Human
uacuuuuucuuuuguaag

SEQ ID NO: 3676809 - RNA, 20 nt, Human
uacuuuuuggcauaacauaa

SEQ ID NO: 3676810 - RNA, 15 nt, Human
uacuuuuugugaaga

SEQ ID NO: 3676811 - RNA, 14 nt, Human
uacuuuuuugaaau

SEQ ID NO: 3676812 - RNA, 16 nt, Human
uagaaaaacaggcacu

SEQ ID NO: 3676813 - RNA, 16 nt, Human
uagaaaaacccugccc

SEQ ID NO: 3676814 - RNA, 20 nt, Human
uagaaaaagaacaugcaguu

SEQ ID NO: 3676815 - RNA, 13 nt, Human
uagaaaaaggguc

SEQ ID NO: 3676816 - RNA, 14 nt, Human
uagaaaaaggguca

SEQ ID NO: 3676817 - RNA, 18 nt, Human
uagaaaaauagcaacuug

SEQ ID NO: 3676818 - RNA, 13 nt, Human
uagaaaaauuuca

SEQ ID NO: 3676819 - RNA, 17 nt, Human
uagaaaaauuucacgau

SEQ ID NO: 3676820 - RNA, 22 nt, Human
uagaaaacaggaaaaaaacuuu

SEQ ID NO: 3676821 - RNA, 16 nt, Human
uagaaaacauaaucuu

SEQ ID NO: 3676822 - RNA, 13 nt, Human
uagaaaacugaaa

SEQ ID NO: 3676823 - RNA, 15 nt, Human
uagaaaacuuuaaag

SEQ ID NO: 3676824 - RNA, 13 nt, Human
uagaaaacuuugu

SEQ ID NO: 3676825 - RNA, 21 nt, Human
uagaaaagaaaaaaaaaauau

SEQ ID NO: 3676826 - RNA, 16 nt, Human
uagaaaagaacuggaa

SEQ ID NO: 3676827 - RNA, 11 nt, Human
uagaaaaggca

SEQ ID NO: 3676828 - RNA, 14 nt, Human
uagaaaagugaauu

SEQ ID NO: 3676829 - RNA, 13 nt, Human
uagaaaauauucu

SEQ ID NO: 3676830 - RNA, 16 nt, Human
uagaaaauauucucua

SEQ ID NO: 3676831 - RNA, 14 nt, Human
uagaaaaucuucau

SEQ ID NO: 3676832 - RNA, 12 nt, Human
uagaaaaugguc

SEQ ID NO: 3676833 - RNA, 18 nt, Human
uagaaaaugugacccucc

SEQ ID NO: 3676834 - RNA, 21 nt, Human
uagaaaaugugacccuccaaa

SEQ ID NO: 3676835 - RNA, 17 nt, Human
uagaaaauuuaaaacau

SEQ ID NO: 3676836 - RNA, 20 nt, Human
uagaaacaacacuguaguaa

SEQ ID NO: 3676837 - RNA, 18 nt, Human
uagaaacauaaauaaaau

SEQ ID NO: 3676838 - RNA, 17 nt, Human
uagaaacauguaauccu

SEQ ID NO: 3676839 - RNA, 20 nt, Human
uagaaacccaagcuccuccu

SEQ ID NO: 3676840 - RNA, 19 nt, Human
uagaaacuaauugacuuua

SEQ ID NO: 3676841 - RNA, 15 nt, Human
uagaaagaagaugaa

SEQ ID NO: 3676842 - RNA, 21 nt, Human
uagaaagaagcccaauauuau

SEQ ID NO: 3676843 - RNA, 14 nt, Human
uagaaagcaggggc

SEQ ID NO: 3676844 - RNA, 15 nt, Human
uagaaagcauuacau

SEQ ID NO: 3676845 - RNA, 23 nt, Human
uagaaagcugcugugaucccagu

SEQ ID NO: 3676846 - RNA, 20 nt, Human
uagaaaguucaaaaagucua

SEQ ID NO: 3676847 - RNA, 15 nt, Human
uagaaauaaaccuua

SEQ ID NO: 3676848 - RNA, 16 nt, Human
uagaaauaaagcaucu

SEQ ID NO: 3676849 - RNA, 13 nt, Human
uagaaauaacaga

SEQ ID NO: 3676850 - RNA, 11 nt, Human
uagaaauaagu

SEQ ID NO: 3676851 - RNA, 16 nt, Human
uagaaauaagugguua

SEQ ID NO: 3676852 - RNA, 11 nt, Human
uagaaaucaua

SEQ ID NO: 3676853 - RNA, 12 nt, Human
uagaaaucauuu

SEQ ID NO: 3676854 - RNA, 16 nt, Human
uagaaaucauuuugca

SEQ ID NO: 3676855 - RNA, 17 nt, Human
uagaaaucauuuugcaa

SEQ ID NO: 3676856 - RNA, 22 nt, Human
uagaaaucccccuuucucuaau

SEQ ID NO: 3676857 - RNA, 16 nt, Human
uagaaauggaaauuuu

SEQ ID NO: 3676858 - RNA, 15 nt, Human
uagaaaugguuguau

SEQ ID NO: 3676859 - RNA, 17 nt, Human
uagaaaugguuguauua

SEQ ID NO: 3676860 - RNA, 16 nt, Human
uagaaauguaaacugc

SEQ ID NO: 3676861 - RNA, 14 nt, Human
uuacuugcuucucu

SEQ ID NO: 3676862 - RNA, 18 nt, Human
uuacuuuaaaaggagcca

SEQ ID NO: 3676863 - RNA, 15 nt, Human
uuacuuuaccacccc

SEQ ID NO: 3676864 - RNA, 15 nt, Human
uuacuuuaucacuuu

SEQ ID NO: 3676865 - RNA, 16 nt, Human
uuacuuuaucacuuuu

SEQ ID NO: 3676866 - RNA, 15 nt, Human
uuacuuuauguuugu

SEQ ID NO: 3676867 - RNA, 11 nt, Human
uuacuuucugu

SEQ ID NO: 3676868 - RNA, 18 nt, Human
uuacuuucuguugccaca

SEQ ID NO: 3676869 - RNA, 15 nt, Human
uuacuuucuuaaugu

SEQ ID NO: 3676870 - RNA, 11 nt, Human
uuacuuuguaa

SEQ ID NO: 3676871 - RNA, 18 nt, Human
uuacuuuguaaauucuga

SEQ ID NO: 3676872 - RNA, 13 nt, Human
uuacuuuguauga

SEQ ID NO: 3676873 - RNA, 13 nt, Human
uuacuuugugaau

SEQ ID NO: 3676874 - RNA, 14 nt, Human
uuacuuuguguuca

SEQ ID NO: 3676875 - RNA, 17 nt, Human
uuacuuuuaaacaguga

SEQ ID NO: 3676876 - RNA, 16 nt, Human
uuacuuuuaaacugug

SEQ ID NO: 3676877 - RNA, 22 nt, Human
uuagauuucauaguucagaauu

SEQ ID NO: 3676878 - RNA, 23 nt, Human
uuagauuugccauagaguacacu

SEQ ID NO: 3676879 - RNA, 13 nt, Human
uuagauuugugug

SEQ ID NO: 3676880 - RNA, 14 nt, Human
uuagauuuuacaug

SEQ ID NO: 3676881 - RNA, 20 nt, Human
uuagauuuuacaugaaguau

SEQ ID NO: 3676882 - RNA, 21 nt, Human
uuagauuuuauuuuacuauug

SEQ ID NO: 3676883 - RNA, 16 nt, Human
uuagauuuuguguuua

SEQ ID NO: 3676884 - RNA, 18 nt, Human
uuagauuuuguguuuauu

SEQ ID NO: 3676885 - RNA, 14 nt, Human
uuagcaaacuuugu

SEQ ID NO: 3676886 - RNA, 15 nt, Human
uuagcaaauacauau

SEQ ID NO: 3676887 - RNA, 23 nt, Human
uuagcacagauuuuaauugucau

SEQ ID NO: 3676888 - RNA, 11 nt, Human
uuagcacagcg

SEQ ID NO: 3676889 - RNA, 18 nt, Human
uuagcacguuuaaaguuc

SEQ ID NO: 3676890 - RNA, 18 nt, Human
uuagcacuguugauguau

SEQ ID NO: 3676891 - RNA, 17 nt, Human
uuagcagaagaaaggaa

SEQ ID NO: 3676892 - RNA, 15 nt, Human
uuagcagaaucaaaa

SEQ ID NO: 3676893 - RNA, 21 nt, Human
uuagcagcagccuuuaaugca

SEQ ID NO: 3676894 - RNA, 21 nt, Human
uuagcagcugacuuucaaagu

SEQ ID NO: 3676895 - RNA, 16 nt, Human
uuagcaguucugcaaa

SEQ ID NO: 3676896 - RNA, 18 nt, Human
uuagcauccuaagaaaua

SEQ ID NO: 3676897 - RNA, 24 nt, Human
uuagcaugacaagccccaggcagg

SEQ ID NO: 3676898 - RNA, 16 nt, Human
uuagcauguuugcuga

SEQ ID NO: 3676899 - RNA, 15 nt, Human
uuagccaggaucaug

SEQ ID NO: 3676900 - RNA, 19 nt, Human
uuagccagguaaugugaau

SEQ ID NO: 3676901 - RNA, 16 nt, Human
uuagccccugaaagcc

SEQ ID NO: 3676902 - RNA, 21 nt, Human
uuagcccucacauuagaucua

SEQ ID NO: 3676903 - RNA, 14 nt, Human
uuagccggagaucc

SEQ ID NO: 3676904 - RNA, 13 nt, Human
uuagccgggcgug

SEQ ID NO: 3676905 - RNA, 17 nt, Human
uuagccugaguagaaag

SEQ ID NO: 3676906 - RNA, 22 nt, Human
uuagccuggaccucugacagca

SEQ ID NO: 3676907 - RNA, 12 nt, Human
uuagccuucucu

SEQ ID NO: 3676908 - RNA, 15 nt, Human
uuagccuucucuguu

SEQ ID NO: 3676909 - RNA, 17 nt, Human
uuagccuucucuguuca

SEQ ID NO: 3676910 - RNA, 23 nt, Human
uuagccuuuuuuccccagacuug

SEQ ID NO: 3676911 - RNA, 14 nt, Human
uuagcggagacgga

SEQ ID NO: 3676912 - RNA, 21 nt, Human
uuagcuaaacggauuccaaag

SEQ ID NO: 3676913 - RNA, 12 nt, Human
uuagcuaaagga

SEQ ID NO: 3676914 - RNA, 23 nt, Human
uuagcuaauaaaaagcuuuuguc

SEQ ID NO: 3676915 - RNA, 18 nt, Human
uuagcuacguuuacucac

SEQ ID NO: 3676916 - RNA, 14 nt, Human
uuagcuaggauuug

SEQ ID NO: 3676917 - RNA, 18 nt, Human
uuagcuaggauuugaaca

SEQ ID NO: 3676918 - RNA, 18 nt, Human
uuagcucaaugagcaugu

SEQ ID NO: 3676919 - RNA, 13 nt, Human
uuagcuccccucc

SEQ ID NO: 3676920 - RNA, 16 nt, Human
uuagcucccucccgca

SEQ ID NO: 3676921 - RNA, 12 nt, Human
uuagcucuuaau

SEQ ID NO: 3676922 - RNA, 16 nt, Human
uuagcugaagaauuga

SEQ ID NO: 3676923 - RNA, 15 nt, Human
uuagcugccaagccc

SEQ ID NO: 3676924 - RNA, 17 nt, Human
uuagcugccaagcccca

SEQ ID NO: 3676925 - RNA, 12 nt, Human
uuagcuggaaaa

SEQ ID NO: 3676926 - RNA, 16 nt, Human
uuagcuggcauuacag

SEQ ID NO: 3676927 - RNA, 15 nt, Human
uuagcugucugcuca

SEQ ID NO: 3676928 - RNA, 14 nt, Human
uuagcuguguuauu

SEQ ID NO: 3676929 - RNA, 21 nt, Human
uuagcuguuauuucuauuuuu

SEQ ID NO: 3676930 - RNA, 17 nt, Human
uuagcuuagaccucagc

SEQ ID NO: 3676931 - RNA, 18 nt, Human
uuagcuuagaccucagcc

SEQ ID NO: 3676932 - RNA, 13 nt, Human
uuagcuucaggaa

SEQ ID NO: 3676933 - RNA, 14 nt, Human
uuagcuucaggaac

SEQ ID NO: 3676934 - RNA, 16 nt, Human
uuagcuucaggaaccu

SEQ ID NO: 3676935 - RNA, 21 nt, Human
uuagcuugaaggaucuguuuu

SEQ ID NO: 3676936 - RNA, 15 nt, Human
uuagcuuggggccag

SEQ ID NO: 3676937 - RNA, 13 nt, Human
uuagcuuuaacuu

SEQ ID NO: 3676938 - RNA, 18 nt, Human
uuagcuuuuuaauuguug

SEQ ID NO: 3676939 - RNA, 18 nt, Human
uuagcuuuuucauccccu

SEQ ID NO: 3676940 - RNA, 18 nt, Human
uuaggaaagaaaaaaagu

SEQ ID NO: 3676941 - RNA, 15 nt, Human
uuaggaaauaaaacc

SEQ ID NO: 3676942 - RNA, 17 nt, Human
uuaggaaauaaaaccuu

SEQ ID NO: 3676943 - RNA, 19 nt, Human
uuaggaaauaaaaccuuuc

SEQ ID NO: 3676944 - RNA, 15 nt, Human
uuaggaaaugaaugu

SEQ ID NO: 3676945 - RNA, 11 nt, Human
uuaggaagagc

SEQ ID NO: 3676946 - RNA, 22 nt, Human
uuaggaagagccuuccacccag

SEQ ID NO: 3676947 - RNA, 20 nt, Human
uuaggaaguguaacagcuga

SEQ ID NO: 3676948 - RNA, 20 nt, Human
uuaggaaguguuuauguugu

SEQ ID NO: 3676949 - RNA, 15 nt, Human
uuaggaaugagaagu

SEQ ID NO: 3676950 - RNA, 12 nt, Human
uuaggacaaauc

SEQ ID NO: 3676951 - RNA, 21 nt, Human
uuaggacaaucaguccccucc

SEQ ID NO: 3676952 - RNA, 16 nt, Human
uuaggagaagccagga

SEQ ID NO: 3676953 - RNA, 17 nt, Human
uuaggagaagccaggaa

SEQ ID NO: 3676954 - RNA, 20 nt, Human
uuaggagaagucuucuauuu

SEQ ID NO: 3676955 - RNA, 13 nt, Human
uuaggagcaugag

SEQ ID NO: 3676956 - RNA, 16 nt, Human
uuaggagcuaaggcuc

SEQ ID NO: 3676957 - RNA, 17 nt, Human
uuaggagcuaaggcucu

SEQ ID NO: 3676958 - RNA, 18 nt, Human
uuaggaggcucaacaaua

SEQ ID NO: 3676959 - RNA, 22 nt, Human
uuaggagugggugacaagagcc

SEQ ID NO: 3676960 - RNA, 15 nt, Human
uuaggaguuuugaga

SEQ ID NO: 3676961 - RNA, 16 nt, Human
uuaggaugugugcaug

SEQ ID NO: 3676962 - RNA, 22 nt, Human
uuaggauuuaacagucauuuaa

SEQ ID NO: 3676963 - RNA, 16 nt, Human
uuaggauuuucacauu

SEQ ID NO: 3676964 - RNA, 15 nt, Human
uuaggcagauugaaa

SEQ ID NO: 3676965 - RNA, 13 nt, Human
uuaggcagcagcu

SEQ ID NO: 3676966 - RNA, 12 nt, Human
uuaggcagggau

SEQ ID NO: 3676967 - RNA, 10 nt, Human
uuaggccagc

SEQ ID NO: 3676968 - RNA, 14 nt, Human
uuaggccuggcaca

SEQ ID NO: 3676969 - RNA, 15 nt, Human
uuaggccuggcacag

SEQ ID NO: 3676970 - RNA, 17 nt, Human
uuaggccuggcacagug

SEQ ID NO: 3676971 - RNA, 23 nt, Human
uuaggcuauuuguaaaucugcca

SEQ ID NO: 3676972 - RNA, 14 nt, Human
uuaggcuguaacua

SEQ ID NO: 3676973 - RNA, 14 nt, Human
uuaggcuuucagcu

SEQ ID NO: 3676974 - RNA, 14 nt, Human
uuagggaaaacauu

SEQ ID NO: 3676975 - RNA, 16 nt, Human
uuagggaacaauuugg

SEQ ID NO: 3676976 - RNA, 13 nt, Human
uuagggaagagaa

SEQ ID NO: 3676977 - RNA, 18 nt, Human
uuagggaagagaaacagg

SEQ ID NO: 3676978 - RNA, 20 nt, Human
uuagggaaggauacaaaagc

SEQ ID NO: 3676979 - RNA, 14 nt, Human
uuagggaagggccu

SEQ ID NO: 3676980 - RNA, 23 nt, Human
uuagggacuacccauagacauga

SEQ ID NO: 3676981 - RNA, 17 nt, Human
uuagggagaaaauucaa

SEQ ID NO: 3676982 - RNA, 23 nt, Human
uuagggagagucauauuuugauu

SEQ ID NO: 3676983 - RNA, 14 nt, Human
uuagggaguauucu

SEQ ID NO: 3676984 - RNA, 18 nt, Human
uuagggaguauucuaaua

SEQ ID NO: 3676985 - RNA, 15 nt, Human
uuagggcacugggcu

SEQ ID NO: 3676986 - RNA, 15 nt, Human
uuaggggaacugggu

SEQ ID NO: 3676987 - RNA, 16 nt, Human
uuaggguuaugauuaa

SEQ ID NO: 3676988 - RNA, 16 nt, Human
uuaggguucugccucu

SEQ ID NO: 3676989 - RNA, 15 nt, Human
uuaggguuucugauu

SEQ ID NO: 3676990 - RNA, 15 nt, Human
uuagguagaaaaaca

SEQ ID NO: 3676991 - RNA, 13 nt, Human
uuaggucaagaag

SEQ ID NO: 3676992 - RNA, 18 nt, Human
uuaggugcaauuucaagg

SEQ ID NO: 3676993 - RNA, 12 nt, Human
uuagguuaacau

SEQ ID NO: 3676994 - RNA, 13 nt, Human
uuagguuaacuau

SEQ ID NO: 3676995 - RNA, 12 nt, Human
uuagguucuaaa

SEQ ID NO: 3676996 - RNA, 13 nt, Human
uuagguucuaaag

SEQ ID NO: 3676997 - RNA, 18 nt, Human
uuagguucuaaaguucua

SEQ ID NO: 3676998 - RNA, 22 nt, Human
uuagguucuaaaguucuaagau

SEQ ID NO: 3676999 - RNA, 14 nt, Human
uuagguucuuaaaa

SEQ ID NO: 3677000 - RNA, 14 nt, Human
uuagguugaaacau

SEQ ID NO: 3677001 - RNA, 16 nt, Human
uuagguugaaacauau

SEQ ID NO: 3677002 - RNA, 13 nt, Human
uuagguugugaau

SEQ ID NO: 3677003 - RNA, 14 nt, Human
uuagguuuaacaua

SEQ ID NO: 3677004 - RNA, 14 nt, Human
uuagguuuuguaca

SEQ ID NO: 3677005 - RNA, 19 nt, Human
uuagguuuuuuuguauagu

SEQ ID NO: 3677006 - RNA, 14 nt, Human
uuaguaaagaaaug

SEQ ID NO: 3677007 - RNA, 15 nt, Human
uuaguaaagaaauga

SEQ ID NO: 3677008 - RNA, 13 nt, Human
uuaguaaaugucu

SEQ ID NO: 3677009 - RNA, 20 nt, Human
uuaguaaaugucuuuguaag

SEQ ID NO: 3677010 - RNA, 13 nt, Human
uuaguaaauguua

SEQ ID NO: 3677011 - RNA, 17 nt, Human
uuaguaauaccucuaau

SEQ ID NO: 3677012 - RNA, 14 nt, Human
uuaguaaucauauu

SEQ ID NO: 3677013 - RNA, 14 nt, Human
uuaguaaucuguau

SEQ ID NO: 3677014 - RNA, 20 nt, Human
uuaguaaugcuacgugugau

SEQ ID NO: 3677015 - RNA, 21 nt, Human
uuaguaaugcuacgugugauu

SEQ ID NO: 3677016 - RNA, 17 nt, Human
uuaguacaaaguuucaa

SEQ ID NO: 3677017 - RNA, 14 nt, Human
uuaguacccaccug

SEQ ID NO: 3677018 - RNA, 13 nt, Human
uuaguacuuuaua

SEQ ID NO: 3677019 - RNA, 19 nt, Human
uuaguaggauaugccugcu

SEQ ID NO: 3677020 - RNA, 18 nt, Human
uuaguaucuaacauguau

SEQ ID NO: 3677021 - RNA, 23 nt, Human
uuaguaucuaacauguaucccaa

SEQ ID NO: 3677022 - RNA, 18 nt, Human
uuaguaugaggcauuugu

SEQ ID NO: 3677023 - RNA, 15 nt, Human
uuaguauucauucug

SEQ ID NO: 3677024 - RNA, 12 nt, Human
uuauucauaauu

SEQ ID NO: 3677025 - RNA, 14 nt, Human
uuauucauaugcau

SEQ ID NO: 3677026 - RNA, 15 nt, Human
uuauucauaugcaua

SEQ ID NO: 3677027 - RNA, 17 nt, Human
uuauucauuagcuguga

SEQ ID NO: 3677028 - RNA, 12 nt, Human
uuauucauuauu

SEQ ID NO: 3677029 - RNA, 15 nt, Human
uuauucauuauuugu

SEQ ID NO: 3677030 - RNA, 19 nt, Human
uuauucauuauuugucaaa

SEQ ID NO: 3677031 - RNA, 17 nt, Human
uuauucauuuaaaauga

SEQ ID NO: 3677032 - RNA, 18 nt, Human
uuauucauuuaaaaugau

SEQ ID NO: 3677033 - RNA, 20 nt, Human
uuauucauuuaaaaugauua

SEQ ID NO: 3677034 - RNA, 22 nt, Human
uuauuccagaaugcuguacauc

SEQ ID NO: 3677035 - RNA, 20 nt, Human
uuauuccauauuagaaaacu

SEQ ID NO: 3677036 - RNA, 20 nt, Human
uuauuccccauucuuccuag

SEQ ID NO: 3677037 - RNA, 16 nt, Human
uuauucccuguacaau

SEQ ID NO: 3677038 - RNA, 13 nt, Human
uuauucccuuccu

SEQ ID NO: 3677039 - RNA, 23 nt, Human
uuauucccuuccugccagccccu

SEQ ID NO: 3677040 - RNA, 13 nt, Human
uuauuccuguaug

SEQ ID NO: 3677041 - RNA, 19 nt, Human
uuauucuaaacagacucau

SEQ ID NO: 3677042 - RNA, 12 nt, Human
uuauucuaauua

SEQ ID NO: 3677043 - RNA, 13 nt, Human
uuauucuucuaga

SEQ ID NO: 3677044 - RNA, 13 nt, Human
uuauucuugauca

SEQ ID NO: 3677045 - RNA, 13 nt, Human
uuauugaagcaga

SEQ ID NO: 3677046 - RNA, 22 nt, Human
uuauugaaggaagccaaauuua

SEQ ID NO: 3677047 - RNA, 18 nt, Human
uuauugaaucuauuuaag

SEQ ID NO: 3677048 - RNA, 22 nt, Human
uuauugacaauaauuucagguu

SEQ ID NO: 3677049 - RNA, 23 nt, Human
uuauugacacagaaaauguugag

SEQ ID NO: 3677050 - RNA, 13 nt, Human
uuauugacacuga

SEQ ID NO: 3677051 - RNA, 22 nt, Human
uuauugaccauuuuuuaauuua

SEQ ID NO: 3677052 - RNA, 18 nt, Human
uuauugagaaagagcacu

SEQ ID NO: 3677053 - RNA, 20 nt, Human
uuauugagagagauguguaa

SEQ ID NO: 3677054 - RNA, 22 nt, Human
uuauugagagagauguguaauu

SEQ ID NO: 3677055 - RNA, 22 nt, Human
uuauugaggaaaaauaugugaa

SEQ ID NO: 3677056 - RNA, 17 nt, Human
uuauugauauucuaaga

SEQ ID NO: 3677057 - RNA, 19 nt, Human
uuauugauauucuaagaaa

SEQ ID NO: 3677058 - RNA, 17 nt, Human
uuauugcaauaaaguau

SEQ ID NO: 3677059 - RNA, 14 nt, Human
uuauugcaguuuau

SEQ ID NO: 3677060 - RNA, 16 nt, Human
uuauugcaguuuauca

SEQ ID NO: 3677061 - RNA, 21 nt, Human
uuauugcaguuuaucauucaa

SEQ ID NO: 3677062 - RNA, 15 nt, Human
uuauugcccacgcug

SEQ ID NO: 3677063 - RNA, 22 nt, Human
uuauugccuucucaccagcugc

SEQ ID NO: 3677064 - RNA, 23 nt, Human
uuauugccuucucaccagcugca

SEQ ID NO: 3677065 - RNA, 17 nt, Human
uuauugcuaguauuuga

SEQ ID NO: 3677066 - RNA, 20 nt, Human
uuauugcuaguauuugaauu

SEQ ID NO: 3677067 - RNA, 13 nt, Human
uuauugcugauuu

SEQ ID NO: 3677068 - RNA, 18 nt, Human
uuauugcugauuuuaaug

SEQ ID NO: 3677069 - RNA, 15 nt, Human
uuauugcuuaguaaa

SEQ ID NO: 3677070 - RNA, 16 nt, Human
uuauuggaauuaaccu

SEQ ID NO: 3677071 - RNA, 22 nt, Human
uuauuggaauuaaccuggugcu

SEQ ID NO: 3677072 - RNA, 12 nt, Human
uuauuggcuuuu

SEQ ID NO: 3677073 - RNA, 17 nt, Human
uuauuguaccucucuua

SEQ ID NO: 3677074 - RNA, 21 nt, Human
uuauuguacguuuaaagugua

SEQ ID NO: 3677075 - RNA, 15 nt, Human
uuauugucuagugaa

SEQ ID NO: 3677076 - RNA, 14 nt, Human
uuauugucuguaaa

SEQ ID NO: 3677077 - RNA, 14 nt, Human
uuauuguggauaac

SEQ ID NO: 3677078 - RNA, 23 nt, Human
uuauuguggauaacaaagauauc

SEQ ID NO: 3677079 - RNA, 18 nt, Human
uuauuguguuugucauua

SEQ ID NO: 3677080 - RNA, 20 nt, Human
uuauuguguuugucauuagc

SEQ ID NO: 3677081 - RNA, 22 nt, Human
uuauuguguuugucauuagccu

SEQ ID NO: 3677082 - RNA, 14 nt, Human
uuauuguuaauaca

SEQ ID NO: 3677083 - RNA, 20 nt, Human
uugaguuaagucuaucuggu

SEQ ID NO: 3677084 - RNA, 20 nt, Human
uugaguugguuacuucauau

SEQ ID NO: 3677085 - RNA, 17 nt, Human
uugaguuguuuuuguau

SEQ ID NO: 3677086 - RNA, 19 nt, Human
uugaguuguuuuuguauau

SEQ ID NO: 3677087 - RNA, 19 nt, Human
uugaguuuccucaggcugc

SEQ ID NO: 3677088 - RNA, 13 nt, Human
uugaguuuguagg

SEQ ID NO: 3677089 - RNA, 11 nt, Human
uugaguuuguc

SEQ ID NO: 3677090 - RNA, 19 nt, Human
uugaguuuucaguggggca

SEQ ID NO: 3677091 - RNA, 17 nt, Human
uugaguuuugacugcuu

SEQ ID NO: 3677092 - RNA, 22 nt, Human
uugauaaagauuuuuuaauaau

SEQ ID NO: 3677093 - RNA, 12 nt, Human
uugauaaaguaa

SEQ ID NO: 3677094 - RNA, 14 nt, Human
uugauaaaguuucu

SEQ ID NO: 3677095 - RNA, 17 nt, Human
uugauaaaguuucucag

SEQ ID NO: 3677096 - RNA, 15 nt, Human
uugauaaauaguguu

SEQ ID NO: 3677097 - RNA, 11 nt, Human
uugauaacagc

SEQ ID NO: 3677098 - RNA, 15 nt, Human
uugauaacagcacug

SEQ ID NO: 3677099 - RNA, 13 nt, Human
uugauaacuuugc

SEQ ID NO: 3677100 - RNA, 21 nt, Human
uugauaagggacugauguuug

SEQ ID NO: 3677101 - RNA, 19 nt, Human
uugauaaucaacugggcug

SEQ ID NO: 3677102 - RNA, 23 nt, Human
uugauaaugcuuucacaacauuu

SEQ ID NO: 3677103 - RNA, 22 nt, Human
uugauaauguuaaauuuguaag

SEQ ID NO: 3677104 - RNA, 14 nt, Human
uugauaauuuuccu

SEQ ID NO: 3677105 - RNA, 18 nt, Human
uugauaauuuuccuuuaa

SEQ ID NO: 3677106 - RNA, 17 nt, Human
uugauacauaauaaaaa

SEQ ID NO: 3677107 - RNA, 13 nt, Human
uugauaccccccu

SEQ ID NO: 3677108 - RNA, 13 nt, Human
uugauaccccugg

SEQ ID NO: 3677109 - RNA, 23 nt, Human
uugauaccccuggggaacauuuc

SEQ ID NO: 3677110 - RNA, 13 nt, Human
uugauacuguugc

SEQ ID NO: 3677111 - RNA, 15 nt, Human
uugauacuguugcac

SEQ ID NO: 3677112 - RNA, 17 nt, Human
uugauacuguugcacgu

SEQ ID NO: 3677113 - RNA, 18 nt, Human
uugauacuguugcacgug

SEQ ID NO: 3677114 - RNA, 13 nt, Human
uugauagaaccau

SEQ ID NO: 3677115 - RNA, 23 nt, Human
uugauagcacagacccugcccug

SEQ ID NO: 3677116 - RNA, 14 nt, Human
uugauagcuuuauu

SEQ ID NO: 3677117 - RNA, 19 nt, Human
uugauagcuuuauuuuuua

SEQ ID NO: 3677118 - RNA, 16 nt, Human
uugauagggaacuggg

SEQ ID NO: 3677119 - RNA, 17 nt, Human
uugauauagaacagugc

SEQ ID NO: 3677120 - RNA, 19 nt, Human
uugauaucacagucuaauu

SEQ ID NO: 3677121 - RNA, 17 nt, Human
uugauaucuauaaaaua

SEQ ID NO: 3677122 - RNA, 15 nt, Human
uugauaugacuguuu

SEQ ID NO: 3677123 - RNA, 22 nt, Human
uugauauuuguauuuauucuuu

SEQ ID NO: 3677124 - RNA, 15 nt, Human
uugauauuuucuaua

SEQ ID NO: 3677125 - RNA, 17 nt, Human
uugaucaacaucuuuuc

SEQ ID NO: 3677126 - RNA, 15 nt, Human
uugaucauguacuuu

SEQ ID NO: 3677127 - RNA, 16 nt, Human
uugaucauguacuuuu

SEQ ID NO: 3677128 - RNA, 18 nt, Human
uugaucauuuucccccca

SEQ ID NO: 3677129 - RNA, 21 nt, Human
uugauccauccagcuugccag

SEQ ID NO: 3677130 - RNA, 15 nt, Human
uugauccauuucuaa

SEQ ID NO: 3677131 - RNA, 18 nt, Human
uugauccauuucuaauua

SEQ ID NO: 3677132 - RNA, 16 nt, Human
uugaucuucaacaaau

SEQ ID NO: 3677133 - RNA, 15 nt, Human
uugaugaaaagcuuu

SEQ ID NO: 3677134 - RNA, 18 nt, Human
uugaugaagcaaggaaga

SEQ ID NO: 3677135 - RNA, 23 nt, Human
uugaugaagcaaggaagauauac

SEQ ID NO: 3677136 - RNA, 18 nt, Human
uugaugaguguaacaaga

SEQ ID NO: 3677137 - RNA, 21 nt, Human
uugaugaguguaacaagaaag

SEQ ID NO: 3677138 - RNA, 22 nt, Human
uugaugaguguaacaagaaagg

SEQ ID NO: 3677139 - RNA, 16 nt, Human
uugaugaucuuugcag

SEQ ID NO: 3677140 - RNA, 17 nt, Human
uugaugcaauccuuaca

SEQ ID NO: 3677141 - RNA, 20 nt, Human
uugaugcaauccuuacaaau

SEQ ID NO: 3677142 - RNA, 16 nt, Human
uugaugcaugcuauuc

SEQ ID NO: 3677143 - RNA, 12 nt, Human
uugaugccuggc

SEQ ID NO: 3677144 - RNA, 14 nt, Human
uugauggagauauu

SEQ ID NO: 3677145 - RNA, 22 nt, Human
uugaugggaugauugaagaaac

SEQ ID NO: 3677146 - RNA, 17 nt, Human
uugaugggauucuggac

SEQ ID NO: 3677147 - RNA, 21 nt, Human
uugaugguaaccauaauggaa

SEQ ID NO: 3677148 - RNA, 13 nt, Human
uugauguaaaauc

SEQ ID NO: 3677149 - RNA, 14 nt, Human
uugauguaaagaug

SEQ ID NO: 3677150 - RNA, 20 nt, Human
uugauguaaggaugggcaug

SEQ ID NO: 3677151 - RNA, 20 nt, Human
uugauguacagucugucaug

SEQ ID NO: 3677152 - RNA, 20 nt, Human
uugauguacugauugagaag

SEQ ID NO: 3677153 - RNA, 20 nt, Human
uugauguaucugaguugcca

SEQ ID NO: 3677154 - RNA, 15 nt, Human
uugaugugacaauaa

SEQ ID NO: 3677155 - RNA, 18 nt, Human
uugaugugcaaaaauuuu

SEQ ID NO: 3677156 - RNA, 19 nt, Human
uugauguggcccuggcugc

SEQ ID NO: 3677157 - RNA, 12 nt, Human
uugauguguugu

SEQ ID NO: 3677158 - RNA, 14 nt, Human
uugauguguuguuc

SEQ ID NO: 3677159 - RNA, 20 nt, Human
uugauguguuuauuuauaga

SEQ ID NO: 3677160 - RNA, 14 nt, Human
uugauguuacagau

SEQ ID NO: 3677161 - RNA, 15 nt, Human
uugauguuacagauu

SEQ ID NO: 3677162 - RNA, 19 nt, Human
uugauguuccuuccagugu

SEQ ID NO: 3677163 - RNA, 14 nt, Human
uugauguugaugca

SEQ ID NO: 3677164 - RNA, 16 nt, Human
uugauguuggcuggga

SEQ ID NO: 3677165 - RNA, 13 nt, Human
uugauguuuccuu

SEQ ID NO: 3677166 - RNA, 16 nt, Human
uugauguuuguggccu

SEQ ID NO: 3677167 - RNA, 18 nt, Human
uugauguuuguggccuca

SEQ ID NO: 3677168 - RNA, 13 nt, Human
uugauuaaagaug

SEQ ID NO: 3677169 - RNA, 15 nt, Human
uugcagguugcuuug

SEQ ID NO: 3677170 - RNA, 20 nt, Human
uugcaguagagucaucucca

SEQ ID NO: 3677171 - RNA, 16 nt, Human
uugcagucacucuagu

SEQ ID NO: 3677172 - RNA, 14 nt, Human
uugcagucauagaa

SEQ ID NO: 3677173 - RNA, 21 nt, Human
uugcagucccaagcggugucu

SEQ ID NO: 3677174 - RNA, 23 nt, Human
uugcagucccaagcggugucucu

SEQ ID NO: 3677175 - RNA, 16 nt, Human
uugcaguucagcacca

SEQ ID NO: 3677176 - RNA, 13 nt, Human
uugcaguuuauca

SEQ ID NO: 3677177 - RNA, 23 nt, Human
uugcaguuuaucauucaagugua

SEQ ID NO: 3677178 - RNA, 13 nt, Human
uugcauaaaauug

SEQ ID NO: 3677179 - RNA, 16 nt, Human
uugcauaacguauaaa

SEQ ID NO: 3677180 - RNA, 13 nt, Human
uugcauaagagcu

SEQ ID NO: 3677181 - RNA, 13 nt, Human
uugcauaagguuu

SEQ ID NO: 3677182 - RNA, 15 nt, Human
uugcauaauaagcua

SEQ ID NO: 3677183 - RNA, 20 nt, Human
uugcauacaaacaagcauau

SEQ ID NO: 3677184 - RNA, 18 nt, Human
uugcauacuauuaaacau

SEQ ID NO: 3677185 - RNA, 22 nt, Human
uugcauaguaccaaucauuuua

SEQ ID NO: 3677186 - RNA, 23 nt, Human
uugcauaguaccaaucauuuuaa

SEQ ID NO: 3677187 - RNA, 23 nt, Human
uugcauauaacuuauauuguaag

SEQ ID NO: 3677188 - RNA, 13 nt, Human
uugcauauucauu

SEQ ID NO: 3677189 - RNA, 20 nt, Human
uugcaucaaggggucacuua

SEQ ID NO: 3677190 - RNA, 13 nt, Human
uugcaucaauuuu

SEQ ID NO: 3677191 - RNA, 20 nt, Human
uugcaucacuguaucauuuu

SEQ ID NO: 3677192 - RNA, 13 nt, Human
uugcaucagaaau

SEQ ID NO: 3677193 - RNA, 15 nt, Human
uugcaucagaaaugu

SEQ ID NO: 3677194 - RNA, 17 nt, Human
uugcaucucaaaauuau

SEQ ID NO: 3677195 - RNA, 18 nt, Human
uugcaucuggguagcugu

SEQ ID NO: 3677196 - RNA, 19 nt, Human
uugcaucuguauaaguaag

SEQ ID NO: 3677197 - RNA, 21 nt, Human
uugcaugaagagaagcaauuu

SEQ ID NO: 3677198 - RNA, 14 nt, Human
uugcaugaggcuag

SEQ ID NO: 3677199 - RNA, 14 nt, Human
uugcaugauguauu

SEQ ID NO: 3677200 - RNA, 11 nt, Human
uugcaugcaug

SEQ ID NO: 3677201 - RNA, 15 nt, Human
uugcaugcaugcaaa

SEQ ID NO: 3677202 - RNA, 21 nt, Human
uugcaugcugcuuuaauugug

SEQ ID NO: 3677203 - RNA, 22 nt, Human
uugcaugggcuaaugaagauca

SEQ ID NO: 3677204 - RNA, 17 nt, Human
uugcauggguuuuguag

SEQ ID NO: 3677205 - RNA, 20 nt, Human
uugcauggguuuuguaggua

SEQ ID NO: 3677206 - RNA, 21 nt, Human
uugcauguuauguuuaauaag

SEQ ID NO: 3677207 - RNA, 17 nt, Human
uugcauguuccacuaac

SEQ ID NO: 3677208 - RNA, 13 nt, Human
uugcauuaaauua

SEQ ID NO: 3677209 - RNA, 20 nt, Human
uugcauuaaauucacaaacu

SEQ ID NO: 3677210 - RNA, 21 nt, Human
uugcauuaaauucacaaacuu

SEQ ID NO: 3677211 - RNA, 11 nt, Human
uugcauucaaa

SEQ ID NO: 3677212 - RNA, 22 nt, Human
uugcauucuauugccuucuuug

SEQ ID NO: 3677213 - RNA, 15 nt, Human
uugcauugaacacaa

SEQ ID NO: 3677214 - RNA, 18 nt, Human
uugcauugaacacaaacu

SEQ ID NO: 3677215 - RNA, 14 nt, Human
uugcauugaauaua

SEQ ID NO: 3677216 - RNA, 17 nt, Human
uugcauugaauauauua

SEQ ID NO: 3677217 - RNA, 15 nt, Human
uugcauugacauuau

SEQ ID NO: 3677218 - RNA, 13 nt, Human
uugcauugacuuu

SEQ ID NO: 3677219 - RNA, 16 nt, Human
uugcauugagcugaga

SEQ ID NO: 3677220 - RNA, 21 nt, Human
uugcauuuaaaacagacacug

SEQ ID NO: 3677221 - RNA, 15 nt, Human
uugcauuuaugguca

SEQ ID NO: 3677222 - RNA, 14 nt, Human
uugcauuucagaaa

SEQ ID NO: 3677223 - RNA, 14 nt, Human
uugcauuugcuuuu

SEQ ID NO: 3677224 - RNA, 15 nt, Human
uugcauuuggucaag

SEQ ID NO: 3677225 - RNA, 14 nt, Human
uugcauuuguuuau

SEQ ID NO: 3677226 - RNA, 20 nt, Human
uugcauuuguuuauguaauu

SEQ ID NO: 3677227 - RNA, 12 nt, Human
uugcauuuuugc

SEQ ID NO: 3677228 - RNA, 18 nt, Human
uugcauuuuuuaaaacaa

SEQ ID NO: 3677229 - RNA, 15 nt, Human
uugccaaaaaggaua

SEQ ID NO: 3677230 - RNA, 23 nt, Human
uugccaaaaagugaaauaaugug

SEQ ID NO: 3677231 - RNA, 17 nt, Human
uugccaaaacccagcug

SEQ ID NO: 3677232 - RNA, 22 nt, Human
uugccaaaacccagcugcaccc

SEQ ID NO: 3677233 - RNA, 23 nt, Human
uugccaaaauaaugucuuguuaa

SEQ ID NO: 3677234 - RNA, 13 nt, Human
uugccaaaauggu

SEQ ID NO: 3677235 - RNA, 13 nt, Human
uugccaaaauuca

SEQ ID NO: 3677236 - RNA, 16 nt, Human
uugccaaaguacagaa

SEQ ID NO: 3677237 - RNA, 15 nt, Human
uugccaaaucuggcu

SEQ ID NO: 3677238 - RNA, 22 nt, Human
uugccaaccuguaauaaauaug

SEQ ID NO: 3677239 - RNA, 23 nt, Human
uugccaaccuguaauaaauauga

SEQ ID NO: 3677240 - RNA, 22 nt, Human
uugccaaccuuauagggaugag

SEQ ID NO: 3677241 - RNA, 12 nt, Human
uugccaagacaa

SEQ ID NO: 3677242 - RNA, 24 nt, Human
uugccaagacaaaucaacagaagc

SEQ ID NO: 3677243 - RNA, 14 nt, Human
uugccaagaccuuu

SEQ ID NO: 3677244 - RNA, 15 nt, Human
uugccaagaccuuuc

SEQ ID NO: 3677245 - RNA, 15 nt, Human
uugccaagcucagga

SEQ ID NO: 3677246 - RNA, 22 nt, Human
uugccaagcuccaagccccauc

SEQ ID NO: 3677247 - RNA, 21 nt, Human
uugccaagggcauaaauuauu

SEQ ID NO: 3677248 - RNA, 12 nt, Human
uugccacagcuu

SEQ ID NO: 3677249 - RNA, 20 nt, Human
uugccacaguagaacugucu

SEQ ID NO: 3677250 - RNA, 16 nt, Human
uucaaauccuuccaaa

SEQ ID NO: 3677251 - RNA, 17 nt, Human
uucaaauccuuccaaaa

SEQ ID NO: 3677252 - RNA, 18 nt, Human
uucaaaugcuguaacuuu

SEQ ID NO: 3677253 - RNA, 19 nt, Human
uucaaauuagaagacauuu

SEQ ID NO: 3677254 - RNA, 17 nt, Human
uucaaauuuuaucugcc

SEQ ID NO: 3677255 - RNA, 22 nt, Human
uucaacaaagaaacaaagaugu

SEQ ID NO: 3677256 - RNA, 19 nt, Human
uucaacaaauaucuugugu

SEQ ID NO: 3677257 - RNA, 14 nt, Human
uucaacaauucuaa

SEQ ID NO: 3677258 - RNA, 18 nt, Human
uucaacaauucuaaaaug

SEQ ID NO: 3677259 - RNA, 21 nt, Human
uucaacagguuuuccugaaga

SEQ ID NO: 3677260 - RNA, 17 nt, Human
uucaacaguuucaaaau

SEQ ID NO: 3677261 - RNA, 16 nt, Human
uucaacaucaauguuc

SEQ ID NO: 3677262 - RNA, 19 nt, Human
uucaacaucaauguucauu

SEQ ID NO: 3677263 - RNA, 21 nt, Human
uucaacaucaauguucauugu

SEQ ID NO: 3677264 - RNA, 22 nt, Human
uucaacaucaauguucauugua

SEQ ID NO: 3677265 - RNA, 21 nt, Human
uucaacauccugccagcccca

SEQ ID NO: 3677266 - RNA, 21 nt, Human
uucaacauguuauuuguaaua

SEQ ID NO: 3677267 - RNA, 22 nt, Human
uucaaccagggauuguuucugu

SEQ ID NO: 3677268 - RNA, 21 nt, Human
uucaaccauggacuuuauaag

SEQ ID NO: 3677269 - RNA, 14 nt, Human
uucaaccccacccu

SEQ ID NO: 3677270 - RNA, 13 nt, Human
uucaacgcagccc

SEQ ID NO: 3677271 - RNA, 14 nt, Human
uucaacgcagcccu

SEQ ID NO: 3677272 - RNA, 15 nt, Human
uucaacgcagcccug

SEQ ID NO: 3677273 - RNA, 17 nt, Human
uucaacuauuuuauuau

SEQ ID NO: 3677274 - RNA, 16 nt, Human
uucaacucagacuagu

SEQ ID NO: 3677275 - RNA, 21 nt, Human
uucaacuccucgacaucacug

SEQ ID NO: 3677276 - RNA, 15 nt, Human
uucaacugucuuccu

SEQ ID NO: 3677277 - RNA, 19 nt, Human
uucaacugucuuccucaaa

SEQ ID NO: 3677278 - RNA, 16 nt, Human
uucaacuuugaauaaa

SEQ ID NO: 3677279 - RNA, 12 nt, Human
uucaacuuuucc

SEQ ID NO: 3677280 - RNA, 12 nt, Human
uucaagaaacug

SEQ ID NO: 3677281 - RNA, 23 nt, Human
uucaagaaacugaggaauuuucu

SEQ ID NO: 3677282 - RNA, 21 nt, Human
uucaagaaagccagucuuaac

SEQ ID NO: 3677283 - RNA, 22 nt, Human
uucaagaaagccagucuuaaca

SEQ ID NO: 3677284 - RNA, 14 nt, Human
uucaagaacuuguu

SEQ ID NO: 3677285 - RNA, 15 nt, Human
uucaagaacuuguuu

SEQ ID NO: 3677286 - RNA, 11 nt, Human
uucaagaauga

SEQ ID NO: 3677287 - RNA, 18 nt, Human
uucaagacauuaaaucua

SEQ ID NO: 3677288 - RNA, 18 nt, Human
uucaagacugaauuccaa

SEQ ID NO: 3677289 - RNA, 23 nt, Human
uucaagaggagcccccacccugu

SEQ ID NO: 3677290 - RNA, 23 nt, Human
uucaagcaucuccugaggaucag

SEQ ID NO: 3677291 - RNA, 17 nt, Human
uucaagcauucuucaac

SEQ ID NO: 3677292 - RNA, 14 nt, Human
uucaagccauucca

SEQ ID NO: 3677293 - RNA, 18 nt, Human
uucaagcgauucuccugc

SEQ ID NO: 3677294 - RNA, 23 nt, Human
uucaagcgauucucuugccucag

SEQ ID NO: 3677295 - RNA, 12 nt, Human
uucaagcucuga

SEQ ID NO: 3677296 - RNA, 14 nt, Human
uucaagcucugagg

SEQ ID NO: 3677297 - RNA, 14 nt, Human
uucaagcuuauuuu

SEQ ID NO: 3677298 - RNA, 17 nt, Human
uucaaggaauuucuuaa

SEQ ID NO: 3677299 - RNA, 19 nt, Human
uucaaggaauuucuuaacu

SEQ ID NO: 3677300 - RNA, 21 nt, Human
uucaaggauccugagccagau

SEQ ID NO: 3677301 - RNA, 19 nt, Human
uucaaggcacucuagauuc

SEQ ID NO: 3677302 - RNA, 16 nt, Human
uucaaggccauccuuc

SEQ ID NO: 3677303 - RNA, 17 nt, Human
uucaaggccauccuucc

SEQ ID NO: 3677304 - RNA, 12 nt, Human
uucaaggcuuca

SEQ ID NO: 3677305 - RNA, 22 nt, Human
uucaagggcuuuccugugccag

SEQ ID NO: 3677306 - RNA, 18 nt, Human
uucaagguaaaauucuaa

SEQ ID NO: 3677307 - RNA, 17 nt, Human
uucaagguggccaaauu

SEQ ID NO: 3677308 - RNA, 14 nt, Human
uucaagguucuaac

SEQ ID NO: 3677309 - RNA, 15 nt, Human
uucaagguucuaacc

SEQ ID NO: 3677310 - RNA, 16 nt, Human
uucaaguaauugugaa

SEQ ID NO: 3677311 - RNA, 15 nt, Human
uucaaguacacugaa

SEQ ID NO: 3677312 - RNA, 16 nt, Human
uucaaguagcugggau

SEQ ID NO: 3677313 - RNA, 16 nt, Human
uucaagucaccuccuu

SEQ ID NO: 3677314 - RNA, 21 nt, Human
uaguuuuauuuuauguuuaga

SEQ ID NO: 3677315 - RNA, 17 nt, Human
uaguuuucaguuuguau

SEQ ID NO: 3677316 - RNA, 22 nt, Human
uaguuuucauccauaacugaac

SEQ ID NO: 3677317 - RNA, 15 nt, Human
uaguuuugucaaacu

SEQ ID NO: 3677318 - RNA, 15 nt, Human
uaguuuuuauauguu

SEQ ID NO: 3677319 - RNA, 17 nt, Human
uaguuuuucuucaacau

SEQ ID NO: 3677320 - RNA, 17 nt, Human
uaguuuuuguaauuuau

SEQ ID NO: 3677321 - RNA, 15 nt, Human
uaguuuuuguucuua

SEQ ID NO: 3677322 - RNA, 23 nt, Human
uauaaaaaaaauaguugagccag

SEQ ID NO: 3677323 - RNA, 16 nt, Human
uauaaaaaauauguau

SEQ ID NO: 3677324 - RNA, 17 nt, Human
uauaaaaaauggugccu

SEQ ID NO: 3677325 - RNA, 19 nt, Human
uauaaaaaauggugccuga

SEQ ID NO: 3677326 - RNA, 14 nt, Human
uauaaaaaaugguu

SEQ ID NO: 3677327 - RNA, 15 nt, Human
uauaaaaaaugguuc

SEQ ID NO: 3677328 - RNA, 21 nt, Human
uauaaaaaaugguucagaauu

SEQ ID NO: 3677329 - RNA, 19 nt, Human
uauaaaaagaaaagauaaa

SEQ ID NO: 3677330 - RNA, 21 nt, Human
uauaaaaauaaaaaacacugg

SEQ ID NO: 3677331 - RNA, 16 nt, Human
uauaaaaauauauaua

SEQ ID NO: 3677332 - RNA, 21 nt, Human
uauaaaacagaguaaucuugu

SEQ ID NO: 3677333 - RNA, 19 nt, Human
uauaaaacuguacuucacu

SEQ ID NO: 3677334 - RNA, 15 nt, Human
uauaaaacuuuccuc

SEQ ID NO: 3677335 - RNA, 20 nt, Human
uauaaaagauggggucugua

SEQ ID NO: 3677336 - RNA, 22 nt, Human
uauaaaagauggggucuguaaa

SEQ ID NO: 3677337 - RNA, 23 nt, Human
uauaaaagauggggucuguaaaa

SEQ ID NO: 3677338 - RNA, 22 nt, Human
uauaaaagggacugagaaauuu

SEQ ID NO: 3677339 - RNA, 13 nt, Human
uauaaaauaaaua

SEQ ID NO: 3677340 - RNA, 19 nt, Human
uauaaaauaacuaaaaugu

SEQ ID NO: 3677341 - RNA, 21 nt, Human
uauaaaauaauuuuuauauuu

SEQ ID NO: 3677342 - RNA, 14 nt, Human
uauaaaaucagcca

SEQ ID NO: 3677343 - RNA, 16 nt, Human
uauaaaaucagccaau

SEQ ID NO: 3677344 - RNA, 22 nt, Human
uauaaaauggcaacaaacugca

SEQ ID NO: 3677345 - RNA, 22 nt, Human
uauaaaaugguguuuucaugua

SEQ ID NO: 3677346 - RNA, 15 nt, Human
uauaaaauuuacugu

SEQ ID NO: 3677347 - RNA, 19 nt, Human
uauaaacaagaaaaauaaa

SEQ ID NO: 3677348 - RNA, 16 nt, Human
uauaaacagaaaugga

SEQ ID NO: 3677349 - RNA, 18 nt, Human
uauaaacagaaauggaaa

SEQ ID NO: 3677350 - RNA, 17 nt, Human
uauaaacaucacacaca

SEQ ID NO: 3677351 - RNA, 18 nt, Human
uauaaaccuaaaaaagau

SEQ ID NO: 3677352 - RNA, 16 nt, Human
uauaaacuuuaccuuu

SEQ ID NO: 3677353 - RNA, 18 nt, Human
uauaaacuuuaccuuuuu

SEQ ID NO: 3677354 - RNA, 15 nt, Human
uauaaacuuuagagu

SEQ ID NO: 3677355 - RNA, 15 nt, Human
uauaaagaacaaggu

SEQ ID NO: 3677356 - RNA, 23 nt, Human
uauaaagaagguuggugaauuuc

SEQ ID NO: 3677357 - RNA, 14 nt, Human
uauaaagaauugug

SEQ ID NO: 3677358 - RNA, 21 nt, Human
uauaaagacguuuuauaagca

SEQ ID NO: 3677359 - RNA, 17 nt, Human
uauaaagauggcugacu

SEQ ID NO: 3677360 - RNA, 16 nt, Human
uauaaagguugacaau

SEQ ID NO: 3677361 - RNA, 19 nt, Human
uauaaaguacccaucuagu

SEQ ID NO: 3677362 - RNA, 17 nt, Human
uauaaagugcuugugua

SEQ ID NO: 3677363 - RNA, 12 nt, Human
uauaaauaaaua

SEQ ID NO: 3677364 - RNA, 15 nt, Human
uauaaauaaauauau

SEQ ID NO: 3677365 - RNA, 17 nt, Human
uauaaauaaauauauau

SEQ ID NO: 3677366 - RNA, 12 nt, Human
uauaaauauaua

SEQ ID NO: 3677367 - RNA, 20 nt, Human
uauaaauauauauaaagaau

SEQ ID NO: 3677368 - RNA, 21 nt, Human
uauaaauauauauaaauauau

SEQ ID NO: 3677369 - RNA, 22 nt, Human
uauaaauauauauaaauauaua

SEQ ID NO: 3677370 - RNA, 19 nt, Human
uauaaauauauauucuauu

SEQ ID NO: 3677371 - RNA, 19 nt, Human
uauaaauauauuauuacuu

SEQ ID NO: 3677372 - RNA, 15 nt, Human
uauaaauaucauugu

SEQ ID NO: 3677373 - RNA, 16 nt, Human
uauaaaucaaugucac

SEQ ID NO: 3677374 - RNA, 20 nt, Human
uauaaaucaaugucacuuaa

SEQ ID NO: 3677375 - RNA, 14 nt, Human
uauaaaucauauug

SEQ ID NO: 3677376 - RNA, 21 nt, Human
uauaaaucauauugaugaaaa

SEQ ID NO: 3677377 - RNA, 22 nt, Human
uauaaaucauauugaugaaaag

SEQ ID NO: 3677378 - RNA, 19 nt, Human
uauaaaucgcuuuugauaa

SEQ ID NO: 3677379 - RNA, 20 nt, Human
uauaaaucgcuuuugauaau

SEQ ID NO: 3677380 - RNA, 20 nt, Human
uauaaaugaaguuuauacag

SEQ ID NO: 3677381 - RNA, 24 nt, Human
uauaaaugaaguuuauacaguaca

SEQ ID NO: 3677382 - RNA, 15 nt, Human
uauaaaugcaaauaa

SEQ ID NO: 3677383 - RNA, 16 nt, Human
uauaaaugcaaauaac

SEQ ID NO: 3677384 - RNA, 16 nt, Human
uauaaaugcuauuuuu

SEQ ID NO: 3677385 - RNA, 12 nt, Human
uauaaauguaua

SEQ ID NO: 3677386 - RNA, 14 nt, Human
uauaaauguauaaa

SEQ ID NO: 3677387 - RNA, 18 nt, Human
uauaaauguauauacaca

SEQ ID NO: 3677388 - RNA, 23 nt, Human
uauaaauguauauacacauauac

SEQ ID NO: 3677389 - RNA, 17 nt, Human
uauaaaugucuuuaaug

SEQ ID NO: 3677390 - RNA, 13 nt, Human
uauaaaugugugu

SEQ ID NO: 3677391 - RNA, 16 nt, Human
uauaaauguguguaug

SEQ ID NO: 3677392 - RNA, 14 nt, Human
uauaaauuaaauau

SEQ ID NO: 3677393 - RNA, 14 nt, Human
uauaaauuccucuu

SEQ ID NO: 3677394 - RNA, 11 nt, Human
uauaaauucug

SEQ ID NO: 3677395 - RNA, 17 nt, Human
uauaaauugucuuaaug

SEQ ID NO: 3677396 - RNA, 22 nt, Human
uauaaauuuauuuacugcuagu

SEQ ID NO: 3677397 - RNA, 15 nt, Human
uauaaauuuguguaa

SEQ ID NO: 3677398 - RNA, 22 nt, Human
uauaaauuuuuaagagaaagaa

SEQ ID NO: 3677399 - RNA, 22 nt, Human
uauaacaaaggauacuuauuua

SEQ ID NO: 3677400 - RNA, 14 nt, Human
uauaacacauuuuu

SEQ ID NO: 3677401 - RNA, 14 nt, Human
uauaacagauacau

SEQ ID NO: 3677402 - RNA, 16 nt, Human
uauaacagauacauuu

SEQ ID NO: 3677403 - RNA, 19 nt, Human
uauaacauauauggaagag

SEQ ID NO: 3677404 - RNA, 17 nt, Human
uauaacauauguacaua

SEQ ID NO: 3677405 - RNA, 11 nt, Human
uauaacaugaa

SEQ ID NO: 3677406 - RNA, 14 nt, Human
uauaacaugaaaug

SEQ ID NO: 3677407 - RNA, 21 nt, Human
uauaaccaauguuuaaaaaag

SEQ ID NO: 3677408 - RNA, 17 nt, Human
uauaaccagcugaaguu

SEQ ID NO: 3677409 - RNA, 22 nt, Human
uauaaccaguguuguggauuua

SEQ ID NO: 3677410 - RNA, 15 nt, Human
uauaaccccagcucc

SEQ ID NO: 3677411 - RNA, 14 nt, Human
uauaacguguucaa

SEQ ID NO: 3677412 - RNA, 15 nt, Human
uauaacuaacagcau

SEQ ID NO: 3677413 - RNA, 13 nt, Human
uauaacuacauau

SEQ ID NO: 3677414 - RNA, 18 nt, Human
uauaacuacauauugaau

SEQ ID NO: 3677415 - RNA, 22 nt, Human
uauaacucaaggauaccuucuu

SEQ ID NO: 3677416 - RNA, 19 nt, Human
uauaacucaucauaaaaua

SEQ ID NO: 3677417 - RNA, 20 nt, Human
uauaacucaucauaaaauaa

SEQ ID NO: 3677418 - RNA, 14 nt, Human
uauaacugcccagc

SEQ ID NO: 3677419 - RNA, 23 nt, Human
uauaacuguauuugaaauaagaa

SEQ ID NO: 3677420 - RNA, 20 nt, Human
uauaacuuaaaaauguaaau

SEQ ID NO: 3677421 - RNA, 18 nt, Human
uauaacuuaaugaaaaca

SEQ ID NO: 3677422 - RNA, 19 nt, Human
uauaacuuaaugaaaacaa

SEQ ID NO: 3677423 - RNA, 16 nt, Human
uauaacuucaaauuuu

SEQ ID NO: 3677424 - RNA, 12 nt, Human
uauaacuugaug

SEQ ID NO: 3677425 - RNA, 17 nt, Human
uauaacuugaugcaugu

SEQ ID NO: 3677426 - RNA, 16 nt, Human
uauaacuuuaacuucu

SEQ ID NO: 3677427 - RNA, 13 nt, Human
uauaacuuuagaa

SEQ ID NO: 3677428 - RNA, 17 nt, Human
uauaacuuuuuauauuc

SEQ ID NO: 3677429 - RNA, 13 nt, Human
uauaagaaaaacu

SEQ ID NO: 3677430 - RNA, 15 nt, Human
uauaagaaaaacuuu

SEQ ID NO: 3677431 - RNA, 21 nt, Human
uauaagaaagacaucuuucuc

SEQ ID NO: 3677432 - RNA, 22 nt, Human
uauaagaaagacaucuuucucu

SEQ ID NO: 3677433 - RNA, 12 nt, Human
uauaagaaagcc

SEQ ID NO: 3677434 - RNA, 14 nt, Human
uauaagaaagccug

SEQ ID NO: 3677435 - RNA, 20 nt, Human
uauaagaagcuuucaguauu

SEQ ID NO: 3677436 - RNA, 16 nt, Human
uauaagagcaugaaau

SEQ ID NO: 3677437 - RNA, 15 nt, Human
uauaagcacugaaaa

SEQ ID NO: 3677438 - RNA, 15 nt, Human
uauaagcaucauuau

SEQ ID NO: 3677439 - RNA, 20 nt, Human
uauaagccaguguugccuaa

SEQ ID NO: 3677440 - RNA, 21 nt, Human
uauaagccaguguugccuaag

SEQ ID NO: 3677441 - RNA, 16 nt, Human
uauaaggaaagcaaua

SEQ ID NO: 3677442 - RNA, 10 nt, Human
uauaaggacu

SEQ ID NO: 3677443 - RNA, 12 nt, Human
uauaaggacugc

SEQ ID NO: 3677444 - RNA, 21 nt, Human
uauaaggacugcaugguaauu

SEQ ID NO: 3677445 - RNA, 16 nt, Human
uauaaggacuuccuga

SEQ ID NO: 3677446 - RNA, 21 nt, Human
uauaagggaaguaguuaucau

SEQ ID NO: 3677447 - RNA, 21 nt, Human
uauaagguguuuucuguguaa

SEQ ID NO: 3677448 - RNA, 23 nt, Human
uauaaguaaagugauuaaagugc

SEQ ID NO: 3677449 - RNA, 22 nt, Human
uauaaguaacuuuauucuugaa

SEQ ID NO: 3677450 - RNA, 14 nt, Human
uauaaguaagaaaa

SEQ ID NO: 3677451 - RNA, 16 nt, Human
uauaaguaagaaaaua

SEQ ID NO: 3677452 - RNA, 14 nt, Human
uauaagucacaaag

SEQ ID NO: 3677453 - RNA, 18 nt, Human
uauaagucauuguauguu

SEQ ID NO: 3677454 - RNA, 17 nt, Human
uauaagugcacacagaa

SEQ ID NO: 3677455 - RNA, 18 nt, Human
uauaaguguacauaugug

SEQ ID NO: 3677456 - RNA, 12 nt, Human
uauaauaaaaau

SEQ ID NO: 3677457 - RNA, 13 nt, Human
uauaauaaaaaua

SEQ ID NO: 3677458 - RNA, 14 nt, Human
uauaauaaaaauau

SEQ ID NO: 3677459 - RNA, 18 nt, Human
uuguggaaagccucugcu

SEQ ID NO: 3677460 - RNA, 13 nt, Human
uuguggaauguug

SEQ ID NO: 3677461 - RNA, 18 nt, Human
uuguggaauguuggauaa

SEQ ID NO: 3677462 - RNA, 15 nt, Human
uuguggacauuuaag

SEQ ID NO: 3677463 - RNA, 16 nt, Human
uuguggacauuuaaga

SEQ ID NO: 3677464 - RNA, 18 nt, Human
uuguggacuaaaagauau

SEQ ID NO: 3677465 - RNA, 18 nt, Human
uuguggauaacaaagaua

SEQ ID NO: 3677466 - RNA, 18 nt, Human
uuguggauguuuuaauuc

SEQ ID NO: 3677467 - RNA, 15 nt, Human
uuguggauuucaguu

SEQ ID NO: 3677468 - RNA, 19 nt, Human
uuguggauuucaguuuuaa

SEQ ID NO: 3677469 - RNA, 22 nt, Human
uuguggcaagugaauuugccug

SEQ ID NO: 3677470 - RNA, 17 nt, Human
uuguggcuauuaaaacu

SEQ ID NO: 3677471 - RNA, 19 nt, Human
uuguggcuccuaucugugu

SEQ ID NO: 3677472 - RNA, 15 nt, Human
uuguggcugucagca

SEQ ID NO: 3677473 - RNA, 16 nt, Human
uugugggaauuuaaga

SEQ ID NO: 3677474 - RNA, 14 nt, Human
uugugggccugggc

SEQ ID NO: 3677475 - RNA, 22 nt, Human
uauaauaaaaggaaaagcaaau

SEQ ID NO: 3677476 - RNA, 14 nt, Human
uauaauaaaaugug

SEQ ID NO: 3677477 - RNA, 12 nt, Human
uauaauaaauau

SEQ ID NO: 3677478 - RNA, 16 nt, Human
uauaauaaauguacau

SEQ ID NO: 3677479 - RNA, 15 nt, Human
uauaauacacaaaau

SEQ ID NO: 3677480 - RNA, 14 nt, Human
uauaauacucuguu

SEQ ID NO: 3677481 - RNA, 15 nt, Human
uauaauacuguauuu

SEQ ID NO: 3677482 - RNA, 17 nt, Human
uauaauauacuauauuu

SEQ ID NO: 3677483 - RNA, 14 nt, Human
uauaauauauauau

SEQ ID NO: 3677484 - RNA, 16 nt, Human
uauaauauauuugugu

SEQ ID NO: 3677485 - RNA, 20 nt, Human
uauaauaucuaaaguuauau

SEQ ID NO: 3677486 - RNA, 16 nt, Human
uauaaucaucaaguaa

SEQ ID NO: 3677487 - RNA, 17 nt, Human
uauaaucaucaaguaau

SEQ ID NO: 3677488 - RNA, 23 nt, Human
uauaaucauuauuacuuuugcug

SEQ ID NO: 3677489 - RNA, 18 nt, Human
uauaaucccagcacuuug

SEQ ID NO: 3677490 - RNA, 19 nt, Human
uauaauccuuaaaucuuaa

SEQ ID NO: 3677491 - RNA, 22 nt, Human
uauaauccuuaaaucuuaaugu

SEQ ID NO: 3677492 - RNA, 14 nt, Human
uauaaucugucaaa

SEQ ID NO: 3677493 - RNA, 20 nt, Human
uauaaucugucaaaacacug

SEQ ID NO: 3677494 - RNA, 21 nt, Human
uauaaucugucaaaacacugu

SEQ ID NO: 3677495 - RNA, 16 nt, Human
uauaaucuuauaauug

SEQ ID NO: 3677496 - RNA, 20 nt, Human
uauaaucuuccauacuucuu

SEQ ID NO: 3677497 - RNA, 16 nt, Human
uauaaugaacaaaauu

SEQ ID NO: 3677498 - RNA, 13 nt, Human
uauaaugaauaaa

SEQ ID NO: 3677499 - RNA, 16 nt, Human
uauaaugaauaaauca

SEQ ID NO: 3677500 - RNA, 18 nt, Human
uauaaugggauuggguuu

SEQ ID NO: 3677501 - RNA, 15 nt, Human
uauaaugguugacug

SEQ ID NO: 3677502 - RNA, 14 nt, Human
uauaauguaagcuc

SEQ ID NO: 3677503 - RNA, 15 nt, Human
uauaauguauucaua

SEQ ID NO: 3677504 - RNA, 12 nt, Human
uauaaugugugu

SEQ ID NO: 3677505 - RNA, 14 nt, Human
uauaauguguguau

SEQ ID NO: 3677506 - RNA, 17 nt, Human
uauaauguguguaugug

SEQ ID NO: 3677507 - RNA, 16 nt, Human
uauaauguugcccagu

SEQ ID NO: 3677508 - RNA, 17 nt, Human
uauaauguuuuuaauau

SEQ ID NO: 3677509 - RNA, 12 nt, Human
uauaauuaacau

SEQ ID NO: 3677510 - RNA, 14 nt, Human
uauaauuaacaugu

SEQ ID NO: 3677511 - RNA, 15 nt, Human
uauaauucaccuucu

SEQ ID NO: 3677512 - RNA, 23 nt, Human
uauaauucacucaagcacugaua

SEQ ID NO: 3677513 - RNA, 16 nt, Human
uauaauucucauuaaa

SEQ ID NO: 3677514 - RNA, 17 nt, Human
uauaauugccaaaaagu

SEQ ID NO: 3677515 - RNA, 18 nt, Human
uauaauuggauuuccuaa

SEQ ID NO: 3677516 - RNA, 23 nt, Human
uauaauuguacaaaauuaagcaa

SEQ ID NO: 3677517 - RNA, 12 nt, Human
uauaauuguauc

SEQ ID NO: 3677518 - RNA, 15 nt, Human
uauaauuguuuuuua

SEQ ID NO: 3677519 - RNA, 22 nt, Human
uauaauuuaacuucagagggaa

SEQ ID NO: 3677520 - RNA, 16 nt, Human
uauaauuuaaugcaug

SEQ ID NO: 3677521 - RNA, 14 nt, Human
uauaauuuaccuaa

SEQ ID NO: 3677522 - RNA, 22 nt, Human
uauaauuuccauuuacuuaaga

SEQ ID NO: 3677523 - RNA, 16 nt, Human
uauaauuuucugaaag

SEQ ID NO: 3677524 - RNA, 19 nt, Human
uauaauuuuuuagagagcu

SEQ ID NO: 3677525 - RNA, 21 nt, Human
uauaauuuuuuucaauauuua

SEQ ID NO: 3677526 - RNA, 13 nt, Human
uauacaaaacuuu

SEQ ID NO: 3677527 - RNA, 15 nt, Human
uauacaaaacuuuau

SEQ ID NO: 3677528 - RNA, 17 nt, Human
uauacaaaacuuuauca

SEQ ID NO: 3677529 - RNA, 14 nt, Human
uauacaaaauaaga

SEQ ID NO: 3677530 - RNA, 14 nt, Human
uauacaaauauauu

SEQ ID NO: 3677531 - RNA, 23 nt, Human
uauacaaauuaaaaagauucuuu

SEQ ID NO: 3677532 - RNA, 13 nt, Human
uauacaacaccaa

SEQ ID NO: 3677533 - RNA, 21 nt, Human
uauacaacccuggcauuaugu

SEQ ID NO: 3677534 - RNA, 23 nt, Human
uauacaaguacugguaagauugu

SEQ ID NO: 3677535 - RNA, 20 nt, Human
uauacaauaauggaaaaaaa

SEQ ID NO: 3677536 - RNA, 13 nt, Human
uauacaauauaua

SEQ ID NO: 3677537 - RNA, 15 nt, Human
uauacacacacacac

SEQ ID NO: 3677538 - RNA, 15 nt, Human
uauacacauauaccu

SEQ ID NO: 3677539 - RNA, 21 nt, Human
uauacaccauauacuguucuu

SEQ ID NO: 3677540 - RNA, 19 nt, Human
uauacacgaauagacauca

SEQ ID NO: 3677541 - RNA, 13 nt, Human
uauacagaggaaa

SEQ ID NO: 3677542 - RNA, 18 nt, Human
uauacagaugaaaauuug

SEQ ID NO: 3677543 - RNA, 20 nt, Human
uauacagcuguauugucuga

SEQ ID NO: 3677544 - RNA, 15 nt, Human
uauacaggggaauau

SEQ ID NO: 3677545 - RNA, 16 nt, Human
uauacaggggaauauu

SEQ ID NO: 3677546 - RNA, 15 nt, Human
uauacaggucauauu

SEQ ID NO: 3677547 - RNA, 16 nt, Human
uauacaguaacuuuau

SEQ ID NO: 3677548 - RNA, 21 nt, Human
uauacaguaacuuuaugugua

SEQ ID NO: 3677549 - RNA, 16 nt, Human
uauacaguacaguggu

SEQ ID NO: 3677550 - RNA, 23 nt, Human
uauacaguagugagaagaauauu

SEQ ID NO: 3677551 - RNA, 17 nt, Human
uauacagugcagagccu

SEQ ID NO: 3677552 - RNA, 19 nt, Human
uauacaguuauaaaauuaa

SEQ ID NO: 3677553 - RNA, 16 nt, Human
uauacaguuuuaaaga

SEQ ID NO: 3677554 - RNA, 22 nt, Human
uauacaguuuuccuaaauguau

SEQ ID NO: 3677555 - RNA, 13 nt, Human
uauacauaaacaa

SEQ ID NO: 3677556 - RNA, 21 nt, Human
uauacauacuaugaaauaugu

SEQ ID NO: 3677557 - RNA, 15 nt, Human
uauacauaucuuuau

SEQ ID NO: 3677558 - RNA, 15 nt, Human
uauacauccugggua

SEQ ID NO: 3677559 - RNA, 22 nt, Human
uauacaugaagaauagaaacaa

SEQ ID NO: 3677560 - RNA, 22 nt, Human
uauacaugacacugaaaugccu

SEQ ID NO: 3677561 - RNA, 18 nt, Human
uauacaugugauacauuu

SEQ ID NO: 3677562 - RNA, 20 nt, Human
uauacaugugauacauuuuu

SEQ ID NO: 3677563 - RNA, 14 nt, Human
uauacaugugugua

SEQ ID NO: 3677564 - RNA, 17 nt, Human
uauacauguguguauau

SEQ ID NO: 3677565 - RNA, 19 nt, Human
uauacauguuuauguaaac

SEQ ID NO: 3677566 - RNA, 19 nt, Human
uauacauuaguaaaugucu

SEQ ID NO: 3677567 - RNA, 14 nt, Human
uauacauuugauaa

SEQ ID NO: 3677568 - RNA, 17 nt, Human
uauaccaaagcacauuu

SEQ ID NO: 3677569 - RNA, 22 nt, Human
uauaccaaagcacauuuuaaaa

SEQ ID NO: 3677570 - RNA, 16 nt, Human
uauaccaaauuaaaaa

SEQ ID NO: 3677571 - RNA, 12 nt, Human
uauaccaauaaa

SEQ ID NO: 3677572 - RNA, 13 nt, Human
uauaccaauaaag

SEQ ID NO: 3677573 - RNA, 13 nt, Human
uauaccauuuccg

SEQ ID NO: 3677574 - RNA, 17 nt, Human
uauaccauuuccguaau

SEQ ID NO: 3677575 - RNA, 14 nt, Human
uauaccauuuccuc

SEQ ID NO: 3677576 - RNA, 15 nt, Human
uauacccacccagaa

SEQ ID NO: 3677577 - RNA, 22 nt, Human
uauacccacccagaaugagaca

SEQ ID NO: 3677578 - RNA, 17 nt, Human
uauacccccugcaaagc

SEQ ID NO: 3677579 - RNA, 20 nt, Human
uauaccccgugaagcaucca

SEQ ID NO: 3677580 - RNA, 22 nt, Human
uauaccccgugaagcauccagg

SEQ ID NO: 3677581 - RNA, 19 nt, Human
uauacccguacaacguguc

SEQ ID NO: 3677582 - RNA, 15 nt, Human
uauaccucaaacuau

SEQ ID NO: 3677583 - RNA, 12 nt, Human
uauaccugauuu

SEQ ID NO: 3677584 - RNA, 15 nt, Human
uauaccugugccucg

SEQ ID NO: 3677585 - RNA, 15 nt, Human
uauacgaacaaaaca

SEQ ID NO: 3677586 - RNA, 16 nt, Human
uauacgagaacaggca

SEQ ID NO: 3677587 - RNA, 18 nt, Human
uauacgauaaauaacuuu

SEQ ID NO: 3677588 - RNA, 20 nt, Human
uauacgcagcgugcuuuaaa

SEQ ID NO: 3677589 - RNA, 14 nt, Human
uauacguguagcua

SEQ ID NO: 3677590 - RNA, 21 nt, Human
uauacuacuuuguuaggauuu

SEQ ID NO: 3677591 - RNA, 20 nt, Human
uauacuagggagccauuuga

SEQ ID NO: 3677592 - RNA, 17 nt, Human
uauacuauaguaccagu

SEQ ID NO: 3677593 - RNA, 15 nt, Human
uauacucauuagaau

SEQ ID NO: 3677594 - RNA, 18 nt, Human
uauacuccaguguacaua

SEQ ID NO: 3677595 - RNA, 21 nt, Human
uauacucucaccauuuggauc

SEQ ID NO: 3677596 - RNA, 23 nt, Human
uauacugaucuucauuaccaaua

SEQ ID NO: 3677597 - RNA, 17 nt, Human
uauacugauuaugucuu

SEQ ID NO: 3677598 - RNA, 22 nt, Human
uauacugcaaacuauuuaaaga

SEQ ID NO: 3677599 - RNA, 16 nt, Human
uauacuggagaagucu

SEQ ID NO: 3677600 - RNA, 10 nt, Human
uauacuguaa

SEQ ID NO: 3677601 - RNA, 13 nt, Human
uauacuguaaaga

SEQ ID NO: 3677602 - RNA, 15 nt, Human
uauacuguaauuuag

SEQ ID NO: 3677603 - RNA, 13 nt, Human
uauacuguacaau

SEQ ID NO: 3677604 - RNA, 22 nt, Human
uauacuguacaauaaaaacauu

SEQ ID NO: 3677605 - RNA, 21 nt, Human
uuuaauggcagcagaaaacuu

SEQ ID NO: 3677606 - RNA, 14 nt, Human
uuuaauguaaagau

SEQ ID NO: 3677607 - RNA, 15 nt, Human
uuuaauguaaagauu

SEQ ID NO: 3677608 - RNA, 21 nt, Human
uuuaauguaauagggaaaauu

SEQ ID NO: 3677609 - RNA, 18 nt, Human
uuuaauguacuaauauuu

SEQ ID NO: 3677610 - RNA, 19 nt, Human
uuuaaugugaacuuguagc

SEQ ID NO: 3677611 - RNA, 23 nt, Human
uuuaauguugaacaaaauaaauu

SEQ ID NO: 3677612 - RNA, 21 nt, Human
uuuaauguuuaaaacaucauu

SEQ ID NO: 3677613 - RNA, 18 nt, Human
uuuaauguuuuaaaugua

SEQ ID NO: 3677614 - RNA, 18 nt, Human
uuuaauuaaaaacuagua

SEQ ID NO: 3677615 - RNA, 13 nt, Human
uuuaauuaaauaa

SEQ ID NO: 3677616 - RNA, 14 nt, Human
uuuaauuaagcaaa

SEQ ID NO: 3677617 - RNA, 22 nt, Human
uuuaauuaaugaaauaucugua

SEQ ID NO: 3677618 - RNA, 19 nt, Human
uuuaauuagguuaacuaug

SEQ ID NO: 3677619 - RNA, 15 nt, Human
uuuaauuagugcuaa

SEQ ID NO: 3677620 - RNA, 11 nt, Human
uuuaauuauua

SEQ ID NO: 3677621 - RNA, 19 nt, Human
uuuaauuauuaacuacauu

SEQ ID NO: 3677622 - RNA, 21 nt, Human
uuuaauuccaauaugaugacu

SEQ ID NO: 3677623 - RNA, 22 nt, Human
uuuaauuccaugaaucgcuucu

SEQ ID NO: 3677624 - RNA, 17 nt, Human
uuuaauugaaagaaugu

SEQ ID NO: 3677625 - RNA, 21 nt, Human
uuuaauuguaaaguaaaagcu

SEQ ID NO: 3677626 - RNA, 12 nt, Human
uuuaauugucau

SEQ ID NO: 3677627 - RNA, 15 nt, Human
uuuaauuguuuaaaa

SEQ ID NO: 3677628 - RNA, 22 nt, Human
uuuaauuuaguaaaccaauccu

SEQ ID NO: 3677629 - RNA, 19 nt, Human
uuuaauuuauuuauuaaga

SEQ ID NO: 3677630 - RNA, 20 nt, Human
uuuaauuucaagcuuauuuu

SEQ ID NO: 3677631 - RNA, 13 nt, Human
uuuaauuucuuca

SEQ ID NO: 3677632 - RNA, 16 nt, Human
uuuaauuugaaauaug

SEQ ID NO: 3677633 - RNA, 19 nt, Human
uuuaauuugaugaaagcug

SEQ ID NO: 3677634 - RNA, 14 nt, Human
uuuaauuuucacuu

SEQ ID NO: 3677635 - RNA, 15 nt, Human
uuuaauuuugacacu

SEQ ID NO: 3677636 - RNA, 14 nt, Human
uuuaauuuuggaau

SEQ ID NO: 3677637 - RNA, 16 nt, Human
uuuaauuuuguauuuu

SEQ ID NO: 3677638 - RNA, 18 nt, Human
uuuaauuuuuuuuaguau

SEQ ID NO: 3677639 - RNA, 15 nt, Human
uuuacaaaaauauaa

SEQ ID NO: 3677640 - RNA, 18 nt, Human
uuuacaaaacaaacucau

SEQ ID NO: 3677641 - RNA, 19 nt, Human
uuuacaaaacuacaugaga

SEQ ID NO: 3677642 - RNA, 21 nt, Human
uuuacaaaagaaauaccuuga

SEQ ID NO: 3677643 - RNA, 15 nt, Human
uuuacaaacugaaga

SEQ ID NO: 3677644 - RNA, 23 nt, Human
uuuacaaaggcuguauucagcaa

SEQ ID NO: 3677645 - RNA, 18 nt, Human
uuuacaaaguguguauua

SEQ ID NO: 3677646 - RNA, 20 nt, Human
uuuacaaauguuaaaaugug

SEQ ID NO: 3677647 - RNA, 11 nt, Human
uuuacaacuca

SEQ ID NO: 3677648 - RNA, 22 nt, Human
uuuacaacucauuccagauccc

SEQ ID NO: 3677649 - RNA, 20 nt, Human
uuuacaagacaacauuguaa

SEQ ID NO: 3677650 - RNA, 21 nt, Human
uuuacaaucagccacauucua

SEQ ID NO: 3677651 - RNA, 16 nt, Human
uuuacaauguaauuau

SEQ ID NO: 3677652 - RNA, 15 nt, Human
uuuacaaugucauau

SEQ ID NO: 3677653 - RNA, 18 nt, Human
uuuacacacuguacacau

SEQ ID NO: 3677654 - RNA, 15 nt, Human
uuuacacagaaacac

SEQ ID NO: 3677655 - RNA, 19 nt, Human
uuuacacagaaacacugcc

SEQ ID NO: 3677656 - RNA, 16 nt, Human
uuuacacgcuuuugug

SEQ ID NO: 3677657 - RNA, 14 nt, Human
uuuacacucaggcu

SEQ ID NO: 3677658 - RNA, 17 nt, Human
uuuacagaaaaaucuug

SEQ ID NO: 3677659 - RNA, 13 nt, Human
uuuacagagacag

SEQ ID NO: 3677660 - RNA, 17 nt, Human
uuuacagaugaauguau

SEQ ID NO: 3677661 - RNA, 23 nt, Human
uuuacagauuuauuccuuuguua

SEQ ID NO: 3677662 - RNA, 15 nt, Human
uuuacagcacuacuc

SEQ ID NO: 3677663 - RNA, 18 nt, Human
uuuacagcacuacucugu

SEQ ID NO: 3677664 - RNA, 21 nt, Human
uuuacagcucauuaaacuuuu

SEQ ID NO: 3677665 - RNA, 20 nt, Human
uuuacagcucugacuuuaca

SEQ ID NO: 3677666 - RNA, 18 nt, Human
uuuacagcuuuacacaca

SEQ ID NO: 3677667 - RNA, 18 nt, Human
uuuacaggaacuucauca

SEQ ID NO: 3677668 - RNA, 13 nt, Human
uuuacaggcccug

SEQ ID NO: 3677669 - RNA, 22 nt, Human
uuuacaggcccugcuccugcag

SEQ ID NO: 3677670 - RNA, 15 nt, Human
uuuacaguccuucaa

SEQ ID NO: 3677671 - RNA, 19 nt, Human
uuuacaguuacuuuuccuu

SEQ ID NO: 3677672 - RNA, 15 nt, Human
uuuacauaacugccu

SEQ ID NO: 3677673 - RNA, 14 nt, Human
uuuacaugaaguau

SEQ ID NO: 3677674 - RNA, 15 nt, Human
uuuacaugaaguauu

SEQ ID NO: 3677675 - RNA, 21 nt, Human
uuuacaugaaguauuuuuuca

SEQ ID NO: 3677676 - RNA, 18 nt, Human
uuuacaugaauugcauuu

SEQ ID NO: 3677677 - RNA, 12 nt, Human
uuuacaugcuua

SEQ ID NO: 3677678 - RNA, 18 nt, Human
uuuacaugggguuuucaa

SEQ ID NO: 3677679 - RNA, 19 nt, Human
uuuacaugggguuuucaau

SEQ ID NO: 3677680 - RNA, 19 nt, Human
uuuacauguguagccuaug

SEQ ID NO: 3677681 - RNA, 20 nt, Human
uuuacauuguaaauaguauu

SEQ ID NO: 3677682 - RNA, 10 nt, Human
uuuacauuua

SEQ ID NO: 3677683 - RNA, 20 nt, Human
uuuaccaaguuauauaaaga

SEQ ID NO: 3677684 - RNA, 22 nt, Human
uuuaccacugcugugaacaagu

SEQ ID NO: 3677685 - RNA, 16 nt, Human
uuuaccacuugcugca

SEQ ID NO: 3677686 - RNA, 13 nt, Human
uucuauaauuuaa

SEQ ID NO: 3677687 - RNA, 20 nt, Human
uucuauagcaucacuuaaaa

SEQ ID NO: 3677688 - RNA, 14 nt, Human
uucuauagccaaaa

SEQ ID NO: 3677689 - RNA, 23 nt, Human
uucuauagccaaaaauagcuaaa

SEQ ID NO: 3677690 - RNA, 20 nt, Human
uucuauaggaacauaugaaa

SEQ ID NO: 3677691 - RNA, 16 nt, Human
uucuauaguuauuaag

SEQ ID NO: 3677692 - RNA, 21 nt, Human
uucuauauaauuccuguuuuu

SEQ ID NO: 3677693 - RNA, 12 nt, Human
uucuauaugaau

SEQ ID NO: 3677694 - RNA, 20 nt, Human
uucuauaugcgaguuagcca

SEQ ID NO: 3677695 - RNA, 15 nt, Human
uucuauauuuucauu

SEQ ID NO: 3677696 - RNA, 18 nt, Human
uucuauauuuucauucuc

SEQ ID NO: 3677697 - RNA, 17 nt, Human
uucuaucacauauuuga

SEQ ID NO: 3677698 - RNA, 17 nt, Human
uucuauccaaacaugua

SEQ ID NO: 3677699 - RNA, 23 nt, Human
uucuaucccaaacuaagcuaugu

SEQ ID NO: 3677700 - RNA, 15 nt, Human
uucuauccucaucuu

SEQ ID NO: 3677701 - RNA, 14 nt, Human
uucuauccucugua

SEQ ID NO: 3677702 - RNA, 21 nt, Human
uucuaugaaauauuauguuaa

SEQ ID NO: 3677703 - RNA, 16 nt, Human
uucuaugacacaugca

SEQ ID NO: 3677704 - RNA, 14 nt, Human
uucuaugcaguggc

SEQ ID NO: 3677705 - RNA, 23 nt, Human
uucuaugcugcuuuuauaucugu

SEQ ID NO: 3677706 - RNA, 18 nt, Human
uucuauggguguuaucac

SEQ ID NO: 3677707 - RNA, 16 nt, Human
uucuaugguuaugaaa

SEQ ID NO: 3677708 - RNA, 23 nt, Human
uucuaugguuaugaaagaauaua

SEQ ID NO: 3677709 - RNA, 14 nt, Human
uucuauuaaaagac

SEQ ID NO: 3677710 - RNA, 22 nt, Human
uucuauuaaaagacucauccgu

SEQ ID NO: 3677711 - RNA, 12 nt, Human
uucuauuaaagu

SEQ ID NO: 3677712 - RNA, 20 nt, Human
uucuauuacauuuucaguga

SEQ ID NO: 3677713 - RNA, 19 nt, Human
uucuauuauuuuuauaauu

SEQ ID NO: 3677714 - RNA, 18 nt, Human
uucuauuccuucuggccu

SEQ ID NO: 3677715 - RNA, 12 nt, Human
uucuauugccuu

SEQ ID NO: 3677716 - RNA, 14 nt, Human
uucuauuguuucuu

SEQ ID NO: 3677717 - RNA, 13 nt, Human
uucuauuuaaugg

SEQ ID NO: 3677718 - RNA, 14 nt, Human
uucuauuuaaugga

SEQ ID NO: 3677719 - RNA, 18 nt, Human
uucuauuuauauguacau

SEQ ID NO: 3677720 - RNA, 21 nt, Human
uucuauuuauuuauuuauuca

SEQ ID NO: 3677721 - RNA, 14 nt, Human
uucuauuuauuugu

SEQ ID NO: 3677722 - RNA, 15 nt, Human
uucuauuucacugga

SEQ ID NO: 3677723 - RNA, 13 nt, Human
uucuauuuuacaa

SEQ ID NO: 3677724 - RNA, 18 nt, Human
uucuauuuuauuaugaag

SEQ ID NO: 3677725 - RNA, 16 nt, Human
uucuauuuuguaaacu

SEQ ID NO: 3677726 - RNA, 15 nt, Human
uucuauuuuuguaga

SEQ ID NO: 3677727 - RNA, 23 nt, Human
uucuauuuuuuguuuuguuuccu

SEQ ID NO: 3677728 - RNA, 16 nt, Human
uucucaaaagcauuua

SEQ ID NO: 3677729 - RNA, 23 nt, Human
uucucaaacacaguuacacuugu

SEQ ID NO: 3677730 - RNA, 22 nt, Human
uucucaaaccuguuuaaauauu

SEQ ID NO: 3677731 - RNA, 22 nt, Human
uucucaaaguuuugaaaagcua

SEQ ID NO: 3677732 - RNA, 12 nt, Human
uucucaaaucuu

SEQ ID NO: 3677733 - RNA, 21 nt, Human
uucucaacaaagcacaguguu

SEQ ID NO: 3677734 - RNA, 22 nt, Human
uucucaacaaagcacaguguua

SEQ ID NO: 3677735 - RNA, 14 nt, Human
uucucaaccuacca

SEQ ID NO: 3677736 - RNA, 22 nt, Human
uucucaagauacugcuacugua

SEQ ID NO: 3677737 - RNA, 23 nt, Human
uucucaagccgcaucccagacuu

SEQ ID NO: 3677738 - RNA, 15 nt, Human
uucucaagugccuua

SEQ ID NO: 3677739 - RNA, 18 nt, Human
uucucaaguucuaagauu

SEQ ID NO: 3677740 - RNA, 14 nt, Human
uucucaaugaaaaa

SEQ ID NO: 3677741 - RNA, 14 nt, Human
uucucaauuccaac

SEQ ID NO: 3677742 - RNA, 17 nt, Human
uucucaauuccaacagu

SEQ ID NO: 3677743 - RNA, 23 nt, Human
uucucacaauagccgauaucaga

SEQ ID NO: 3677744 - RNA, 15 nt, Human
uucucacacccaccg

SEQ ID NO: 3677745 - RNA, 21 nt, Human
uucucacacucuaacuguaua

SEQ ID NO: 3677746 - RNA, 13 nt, Human
uucucacagaaga

SEQ ID NO: 3677747 - RNA, 20 nt, Human
uucucacauggaaugagggu

SEQ ID NO: 3677748 - RNA, 16 nt, Human
uucucacuccaccacc

SEQ ID NO: 3677749 - RNA, 18 nt, Human
uucucuguguuuguuccu

SEQ ID NO: 3677750 - RNA, 22 nt, Human
uucucuuagaaaaggugauaaa

SEQ ID NO: 3677751 - RNA, 13 nt, Human
uucucuucacuca

SEQ ID NO: 3677752 - RNA, 15 nt, Human
uucucuuccaggcag

SEQ ID NO: 3677753 - RNA, 16 nt, Human
uucucuuccaggcagc

SEQ ID NO: 3677754 - RNA, 13 nt, Human
uucucuuccugua

SEQ ID NO: 3677755 - RNA, 20 nt, Human
uucucuuccuuuuaucagua

SEQ ID NO: 3677756 - RNA, 19 nt, Human
uucucuucuccccuuccau

SEQ ID NO: 3677757 - RNA, 17 nt, Human
uucucuugagcuggccu

SEQ ID NO: 3677758 - RNA, 18 nt, Human
uucucuugagcuggccuc

SEQ ID NO: 3677759 - RNA, 14 nt, Human
uucucuugccucag

SEQ ID NO: 3677760 - RNA, 14 nt, Human
uucucuugcuuucu

SEQ ID NO: 3677761 - RNA, 16 nt, Human
uucucuuggcuggcuu

SEQ ID NO: 3677762 - RNA, 22 nt, Human
uucucuugggaacugaacucac

SEQ ID NO: 3677763 - RNA, 23 nt, Human
uucucuuguauaagauccuagau

SEQ ID NO: 3677764 - RNA, 17 nt, Human
uucucuuuaacucagga

SEQ ID NO: 3677765 - RNA, 21 nt, Human
uucucuuuaacucaggacucc

SEQ ID NO: 3677766 - RNA, 21 nt, Human
uucucuuucccuggucccuug

SEQ ID NO: 3677767 - RNA, 13 nt, Human
uucucuuuccuug

SEQ ID NO: 3677768 - RNA, 13 nt, Human
uucucuuucucuc

SEQ ID NO: 3677769 - RNA, 17 nt, Human
uucucuuucucucuucc

SEQ ID NO: 3677770 - RNA, 22 nt, Human
uucucuuuguggggcuuggcgu

SEQ ID NO: 3677771 - RNA, 15 nt, Human
uucucuuuuccuuug

SEQ ID NO: 3677772 - RNA, 22 nt, Human
uucucuuuucuaguuugcucau

SEQ ID NO: 3677773 - RNA, 13 nt, Human
uucugaaaagaaa

SEQ ID NO: 3677774 - RNA, 12 nt, Human
uucugaaagagu

SEQ ID NO: 3677775 - RNA, 13 nt, Human
uucugaacagcug

SEQ ID NO: 3677776 - RNA, 22 nt, Human
uucugaacagcugguguagcua

SEQ ID NO: 3677777 - RNA, 16 nt, Human
uucugaaccugucuuu

SEQ ID NO: 3677778 - RNA, 22 nt, Human
uucugaacucaaacugaggaau

SEQ ID NO: 3677779 - RNA, 23 nt, Human
uucugaacuuggcgcugccccug

SEQ ID NO: 3677780 - RNA, 13 nt, Human
uucugaagaagau

SEQ ID NO: 3677781 - RNA, 18 nt, Human
uucugaagcuuuaccagc

SEQ ID NO: 3677782 - RNA, 19 nt, Human
uucugaagguagcauucuu

SEQ ID NO: 3677783 - RNA, 13 nt, Human
uucugaaguuaua

SEQ ID NO: 3677784 - RNA, 18 nt, Human
uucugaaguuauauuucc

SEQ ID NO: 3677785 - RNA, 20 nt, Human
uucugaaguuauauuuccua

SEQ ID NO: 3677786 - RNA, 17 nt, Human
uucugaauaaagcaauu

SEQ ID NO: 3677787 - RNA, 17 nt, Human
uucugaauaacauuugu

SEQ ID NO: 3677788 - RNA, 15 nt, Human
uucugaauaugcugc

SEQ ID NO: 3677789 - RNA, 16 nt, Human
uucugaaucuucugaa

SEQ ID NO: 3677790 - RNA, 16 nt, Human
uucugaaugcugcuac

SEQ ID NO: 3677791 - RNA, 15 nt, Human
uucugaaugcuucua

SEQ ID NO: 3677792 - RNA, 19 nt, Human
uucugaaugugcugaucau

SEQ ID NO: 3677793 - RNA, 15 nt, Human
uucugaauuugcaaa

SEQ ID NO: 3677794 - RNA, 18 nt, Human
uucugaauuugcaaagua

SEQ ID NO: 3677795 - RNA, 19 nt, Human
uucugaauuugcaaaguac

SEQ ID NO: 3677796 - RNA, 20 nt, Human
uucugaauuugcaaaguacu

SEQ ID NO: 3677797 - RNA, 17 nt, Human
uucugaccacagcauca

SEQ ID NO: 3677798 - RNA, 14 nt, Human
uucugacccaugcu

SEQ ID NO: 3677799 - RNA, 20 nt, Human
uucugacccaugcugcccug

SEQ ID NO: 3677800 - RNA, 21 nt, Human
uucugacccaugcugcccugu

SEQ ID NO: 3677801 - RNA, 15 nt, Human
uucugacggcccugc

SEQ ID NO: 3677802 - RNA, 17 nt, Human
uucugacggcccugcaa

SEQ ID NO: 3677803 - RNA, 18 nt, Human
uucugagaagguccuuaa

SEQ ID NO: 3677804 - RNA, 20 nt, Human
uucugagacaugugucaaca

SEQ ID NO: 3677805 - RNA, 13 nt, Human
uucugagaccaaa

SEQ ID NO: 3677806 - RNA, 22 nt, Human
uucugagacgucaugaggagau

SEQ ID NO: 3677807 - RNA, 13 nt, Human
uucugagagcugu

SEQ ID NO: 3677808 - RNA, 19 nt, Human
uucugagagcugugcauca

SEQ ID NO: 3677809 - RNA, 20 nt, Human
uucugagcaccgaauauuga

SEQ ID NO: 3677810 - RNA, 21 nt, Human
uucugagcaccgaauauugag

SEQ ID NO: 3677811 - RNA, 19 nt, Human
uucugagcccgggcugccu

SEQ ID NO: 3677812 - RNA, 22 nt, Human
uucugagcccgguaagagcaaa

SEQ ID NO: 3677813 - RNA, 16 nt, Human
uucugagcuauuucau

SEQ ID NO: 3677814 - RNA, 19 nt, Human
uucugagcuccuguccccu

SEQ ID NO: 3677815 - RNA, 14 nt, Human
uucugagcuggccu

SEQ ID NO: 3677816 - RNA, 19 nt, Human
uucugaggacauuccaaga

SEQ ID NO: 3677817 - RNA, 16 nt, Human
uucugaggcuuuauga

SEQ ID NO: 3677818 - RNA, 13 nt, Human
uucugaguacaga

SEQ ID NO: 3677819 - RNA, 16 nt, Human
uucugaguuucauucu

SEQ ID NO: 3677820 - RNA, 19 nt, Human
uucugaguuucauucuccu

SEQ ID NO: 3677821 - RNA, 16 nt, Human
uucugaguuuuaccaa

SEQ ID NO: 3677822 - RNA, 16 nt, Human
uucugaguuuuguguu

SEQ ID NO: 3677823 - RNA, 18 nt, Human
uucugauaaaagauggcc

SEQ ID NO: 3677824 - RNA, 23 nt, Human
uucugauaacuagauggugcuga

SEQ ID NO: 3677825 - RNA, 18 nt, Human
uucugauauagaauugca

SEQ ID NO: 3677826 - RNA, 22 nt, Human
uucugaucaaggccuuauugga

SEQ ID NO: 3677827 - RNA, 13 nt, Human
uucugaugaaucu

SEQ ID NO: 3677828 - RNA, 13 nt, Human
uucugaugagcaa

SEQ ID NO: 3677829 - RNA, 18 nt, Human
uucugaugaugugccugg

SEQ ID NO: 3677830 - RNA, 16 nt, Human
uucugaugucucuaaa

SEQ ID NO: 3677831 - RNA, 15 nt, Human
uucugauguugccuu

SEQ ID NO: 3677832 - RNA, 15 nt, Human
uucugauuagaaaug

SEQ ID NO: 3677833 - RNA, 23 nt, Human
uucugauucuggcuuuaagccuu

SEQ ID NO: 3677834 - RNA, 15 nt, Human
uucugauucuucaaa

SEQ ID NO: 3677835 - RNA, 23 nt, Human
uucugauuguaacguugcugugg

SEQ ID NO: 3677836 - RNA, 21 nt, Human
uucugauuugccacugauauu

SEQ ID NO: 3677837 - RNA, 14 nt, Human
uucugauuuuaugu

SEQ ID NO: 3677838 - RNA, 16 nt, Human
uucugauuuuauguaa

SEQ ID NO: 3677839 - RNA, 23 nt, Human
uucugauuuuauguaaaauuuug

SEQ ID NO: 3677840 - RNA, 13 nt, Human
uucugcaaaauag

SEQ ID NO: 3677841 - RNA, 23 nt, Human
uucugcaaauagaaaacaggaaa

SEQ ID NO: 3677842 - RNA, 21 nt, Human
uucugcaagcacaucugcauu

SEQ ID NO: 3677843 - RNA, 22 nt, Human
uucugcaagcacaucugcauuu

SEQ ID NO: 3677844 - RNA, 17 nt, Human
uucugcacccuccaccc

SEQ ID NO: 3677845 - RNA, 12 nt, Human
uucugcacugaa

SEQ ID NO: 3677846 - RNA, 15 nt, Human
uucugcacugaaaag

SEQ ID NO: 3677847 - RNA, 22 nt, Human
uucugcacuugcgguuccggca

SEQ ID NO: 3677848 - RNA, 21 nt, Human
uucugcagcaugaccugugac

SEQ ID NO: 3677849 - RNA, 19 nt, Human
uucugcagccacuauuguu

SEQ ID NO: 3677850 - RNA, 12 nt, Human
uucugcagcugu

SEQ ID NO: 3677851 - RNA, 17 nt, Human
uuuaguuuuauuuucua

SEQ ID NO: 3677852 - RNA, 15 nt, Human
uuuaguuuuucauua

SEQ ID NO: 3677853 - RNA, 16 nt, Human
uuuaguuuuuguucuu

SEQ ID NO: 3677854 - RNA, 17 nt, Human
uuuauaaaaaaaaugaa

SEQ ID NO: 3677855 - RNA, 18 nt, Human
uuuauaaaaaaaaugaaa

SEQ ID NO: 3677856 - RNA, 21 nt, Human
uuuauaaaaauaaaaaacacu

SEQ ID NO: 3677857 - RNA, 23 nt, Human
uuuauaaaagaauaaaauugcac

SEQ ID NO: 3677858 - RNA, 17 nt, Human
uuuauaaaauuaaagaa

SEQ ID NO: 3677859 - RNA, 12 nt, Human
uuuauaaaauug

SEQ ID NO: 3677860 - RNA, 17 nt, Human
uuuauaaaauuuugcuu

SEQ ID NO: 3677861 - RNA, 15 nt, Human
uuuauaaacagaaau

SEQ ID NO: 3677862 - RNA, 14 nt, Human
uuuauaaacuuuac

SEQ ID NO: 3677863 - RNA, 16 nt, Human
uuuauaaacuuuaccu

SEQ ID NO: 3677864 - RNA, 20 nt, Human
uuuauaaauaaacuguugcu

SEQ ID NO: 3677865 - RNA, 22 nt, Human
uuuauaaauauaagccuuuuau

SEQ ID NO: 3677866 - RNA, 18 nt, Human
uuuauaaaucgcuuuuga

SEQ ID NO: 3677867 - RNA, 19 nt, Human
uuuauaaaucgcuuuugau

SEQ ID NO: 3677868 - RNA, 22 nt, Human
uuuauaaaucgcuuuugauaau

SEQ ID NO: 3677869 - RNA, 12 nt, Human
uuuauaaaugcu

SEQ ID NO: 3677870 - RNA, 16 nt, Human
uuuauaaauuaaauau

SEQ ID NO: 3677871 - RNA, 17 nt, Human
uuuauaacaucuuuauu

SEQ ID NO: 3677872 - RNA, 14 nt, Human
uuuauaacuaacau

SEQ ID NO: 3677873 - RNA, 21 nt, Human
uuuauaacuauucaguugugu

SEQ ID NO: 3677874 - RNA, 18 nt, Human
uuuauaacucaucauaaa

SEQ ID NO: 3677875 - RNA, 20 nt, Human
uuuauaacucaucauaaaau

SEQ ID NO: 3677876 - RNA, 13 nt, Human
uuuauaacuuuuu

SEQ ID NO: 3677877 - RNA, 12 nt, Human
uuuauaagcauc

SEQ ID NO: 3677878 - RNA, 13 nt, Human
uuuauaagcauca

SEQ ID NO: 3677879 - RNA, 16 nt, Human
uuuauaagcaucauua

SEQ ID NO: 3677880 - RNA, 13 nt, Human
uuuauaagguuuu

SEQ ID NO: 3677881 - RNA, 19 nt, Human
uuuauaagucauuguaugu

SEQ ID NO: 3677882 - RNA, 14 nt, Human
uuuauaauaaaaau

SEQ ID NO: 3677883 - RNA, 17 nt, Human
uuuauaauucucauuaa

SEQ ID NO: 3677884 - RNA, 15 nt, Human
uuuauaauuguacaa

SEQ ID NO: 3677885 - RNA, 17 nt, Human
uuuauaauuguacaaaa

SEQ ID NO: 3677886 - RNA, 20 nt, Human
uuuauaauuguacaaaauua

SEQ ID NO: 3677887 - RNA, 13 nt, Human
uuuauacaaaaua

SEQ ID NO: 3677888 - RNA, 13 nt, Human
uuuauacaaauua

SEQ ID NO: 3677889 - RNA, 19 nt, Human
uuuauacaaauuagaaaau

SEQ ID NO: 3677890 - RNA, 15 nt, Human
uuuauacaacagugc

SEQ ID NO: 3677891 - RNA, 18 nt, Human
uuuauacaacagugcuaa

SEQ ID NO: 3677892 - RNA, 16 nt, Human
uuuauacaauaucauc

SEQ ID NO: 3677893 - RNA, 15 nt, Human
uuuauacacauaauu

SEQ ID NO: 3677894 - RNA, 17 nt, Human
uugaauacuugaaccau

SEQ ID NO: 3677895 - RNA, 20 nt, Human
uugaauacuuugaauguguu

SEQ ID NO: 3677896 - RNA, 23 nt, Human
uugaauagggcuaggaauauaga

SEQ ID NO: 3677897 - RNA, 13 nt, Human
uugaauauaaaaa

SEQ ID NO: 3677898 - RNA, 17 nt, Human
uugaauauaaaaaauca

SEQ ID NO: 3677899 - RNA, 20 nt, Human
uugaauauaauauauuugug

SEQ ID NO: 3677900 - RNA, 21 nt, Human
uugaauauaauauauuugugu

SEQ ID NO: 3677901 - RNA, 22 nt, Human
uugaauauaauauauuugugua

SEQ ID NO: 3677902 - RNA, 13 nt, Human
uugaauauauuau

SEQ ID NO: 3677903 - RNA, 13 nt, Human
uugaauauugugu

SEQ ID NO: 3677904 - RNA, 10 nt, Human
uugaaucaau

SEQ ID NO: 3677905 - RNA, 21 nt, Human
uugaaucaguuuccaauuauu

SEQ ID NO: 3677906 - RNA, 19 nt, Human
uauuaaaacuaaauuucac

SEQ ID NO: 3677907 - RNA, 16 nt, Human
uauuaaaacucagccu

SEQ ID NO: 3677908 - RNA, 12 nt, Human
uauuaaaagacu

SEQ ID NO: 3677909 - RNA, 15 nt, Human
uauuaaaagacucau

SEQ ID NO: 3677910 - RNA, 16 nt, Human
uauuaaaagacucauc

SEQ ID NO: 3677911 - RNA, 13 nt, Human
uauuaaaaucuua

SEQ ID NO: 3677912 - RNA, 17 nt, Human
uauuaaaaugauuguaa

SEQ ID NO: 3677913 - RNA, 19 nt, Human
uauuaaaaugauuguaaaa

SEQ ID NO: 3677914 - RNA, 20 nt, Human
uauuaaaaugauuguaaaau

SEQ ID NO: 3677915 - RNA, 15 nt, Human
uauuaaaauuccaaa

SEQ ID NO: 3677916 - RNA, 11 nt, Human
uauuaaaauug

SEQ ID NO: 3677917 - RNA, 15 nt, Human
uauuaaaauuguugu

SEQ ID NO: 3677918 - RNA, 18 nt, Human
uauuaaaauuguuguccg

SEQ ID NO: 3677919 - RNA, 12 nt, Human
uauuaaacaaag

SEQ ID NO: 3677920 - RNA, 23 nt, Human
uauuaaacagauuuuuacaaaug

SEQ ID NO: 3677921 - RNA, 12 nt, Human
uauuaaagacag

SEQ ID NO: 3677922 - RNA, 12 nt, Human
uauuaaagccau

SEQ ID NO: 3677923 - RNA, 17 nt, Human
uauuaaagccauguuua

SEQ ID NO: 3677924 - RNA, 18 nt, Human
uauuaaagccauguuuau

SEQ ID NO: 3677925 - RNA, 23 nt, Human
uauuaaaggaagcacucuguaua

SEQ ID NO: 3677926 - RNA, 13 nt, Human
uauuaaagggggg

SEQ ID NO: 3677927 - RNA, 16 nt, Human
uauuaaaguggagaag

SEQ ID NO: 3677928 - RNA, 14 nt, Human
uauuaaaguuucaa

SEQ ID NO: 3677929 - RNA, 18 nt, Human
uauuaaaguuucaaaaau

SEQ ID NO: 3677930 - RNA, 12 nt, Human
uauuaaauacag

SEQ ID NO: 3677931 - RNA, 13 nt, Human
uauuaaauacaga

SEQ ID NO: 3677932 - RNA, 15 nt, Human
uauuaaauagaaggu

SEQ ID NO: 3677933 - RNA, 12 nt, Human
uauuaaauaguu

SEQ ID NO: 3677934 - RNA, 17 nt, Human
uauuaaauaguuaauau

SEQ ID NO: 3677935 - RNA, 20 nt, Human
uauuaaauggaaacugaaac

SEQ ID NO: 3677936 - RNA, 21 nt, Human
uauuaaauuaaauuuuguguc

SEQ ID NO: 3677937 - RNA, 20 nt, Human
uauuaaauuacauuuguaau

SEQ ID NO: 3677938 - RNA, 22 nt, Human
uauuaaauuuguugacaaaauu

SEQ ID NO: 3677939 - RNA, 19 nt, Human
uauuaaauuuuuuguugac

SEQ ID NO: 3677940 - RNA, 23 nt, Human
uauuaaauuuuuuguugacauua

SEQ ID NO: 3677941 - RNA, 23 nt, Human
uauuaaauuuuuuuguaugaaaa

SEQ ID NO: 3677942 - RNA, 13 nt, Human
uauuaacaaaaca

SEQ ID NO: 3677943 - RNA, 23 nt, Human
uauuaacaacaauaacacugucu

SEQ ID NO: 3677944 - RNA, 17 nt, Human
uauuaacacuacucaaa

SEQ ID NO: 3677945 - RNA, 13 nt, Human
uauuaacauaccu

SEQ ID NO: 3677946 - RNA, 15 nt, Human
uauuaacuuaauaau

SEQ ID NO: 3677947 - RNA, 16 nt, Human
uauuaacuuaauaauc

SEQ ID NO: 3677948 - RNA, 18 nt, Human
uauuaacuuuaauguuuu

SEQ ID NO: 3677949 - RNA, 13 nt, Human
uauuaagaaagga

SEQ ID NO: 3677950 - RNA, 14 nt, Human
uauuaagaaaggaa

SEQ ID NO: 3677951 - RNA, 20 nt, Human
uauuaagaaaggaagcauug

SEQ ID NO: 3677952 - RNA, 21 nt, Human
uauuaagaaaggaagcauugu

SEQ ID NO: 3677953 - RNA, 18 nt, Human
uauuaagacaauagcacu

SEQ ID NO: 3677954 - RNA, 21 nt, Human
uauuaagacaauagcacuuaa

SEQ ID NO: 3677955 - RNA, 22 nt, Human
uauuaagaggcagaaaauugca

SEQ ID NO: 3677956 - RNA, 15 nt, Human
uauuaagauggauuc

SEQ ID NO: 3677957 - RNA, 17 nt, Human
uauuaagauuauaauug

SEQ ID NO: 3677958 - RNA, 15 nt, Human
uauuaaguuguuaau

SEQ ID NO: 3677959 - RNA, 20 nt, Human
uauuaauaguaauuuguaaa

SEQ ID NO: 3677960 - RNA, 22 nt, Human
uauuaauauauauuaucuuuuc

SEQ ID NO: 3677961 - RNA, 12 nt, Human
uauuaauauauu

SEQ ID NO: 3677962 - RNA, 22 nt, Human
uauuaauauucaggguaaauag

SEQ ID NO: 3677963 - RNA, 20 nt, Human
uauuaauauucauuguauaa

SEQ ID NO: 3677964 - RNA, 15 nt, Human
uauuaauauuuuaau

SEQ ID NO: 3677965 - RNA, 14 nt, Human
uauuaaucacugug

SEQ ID NO: 3677966 - RNA, 15 nt, Human
uauuaaucacugugu

SEQ ID NO: 3677967 - RNA, 18 nt, Human
uauuaaucuuaguguaug

SEQ ID NO: 3677968 - RNA, 20 nt, Human
uauuaaugcacuuucuaucc

SEQ ID NO: 3677969 - RNA, 13 nt, Human
uauuaaugccuuu

SEQ ID NO: 3677970 - RNA, 14 nt, Human
uauuaaugccuuua

SEQ ID NO: 3677971 - RNA, 12 nt, Human
uauuaaugcuaa

SEQ ID NO: 3677972 - RNA, 15 nt, Human
uauuaaugcuaaggg

SEQ ID NO: 3677973 - RNA, 13 nt, Human
uauuaauugcuuu

SEQ ID NO: 3677974 - RNA, 14 nt, Human
uauuaauugcuuug

SEQ ID NO: 3677975 - RNA, 12 nt, Human
uauuacaauauu

SEQ ID NO: 3677976 - RNA, 15 nt, Human
uauuacaauauuugu

SEQ ID NO: 3677977 - RNA, 19 nt, Human
uauuacaauauuugugugc

SEQ ID NO: 3677978 - RNA, 21 nt, Human
uauuacacuguauuuguaucu

SEQ ID NO: 3677979 - RNA, 13 nt, Human
uauuacaguauaa

SEQ ID NO: 3677980 - RNA, 20 nt, Human
uauuacaguauaauuaacau

SEQ ID NO: 3677981 - RNA, 23 nt, Human
uauuacauccuuguggcacauuu

SEQ ID NO: 3677982 - RNA, 13 nt, Human
uauuaccagcaag

SEQ ID NO: 3677983 - RNA, 16 nt, Human
uauuaccagcaagaau

SEQ ID NO: 3677984 - RNA, 22 nt, Human
uauuaccaguggcguuguugca

SEQ ID NO: 3677985 - RNA, 15 nt, Human
uauuaccaugagaag

SEQ ID NO: 3677986 - RNA, 21 nt, Human
uauuacccccuccuucagaca

SEQ ID NO: 3677987 - RNA, 15 nt, Human
uauuaccccuuuucg

SEQ ID NO: 3677988 - RNA, 17 nt, Human
uauuaccuaaugaaagu

SEQ ID NO: 3677989 - RNA, 13 nt, Human
uauuaccucugau

SEQ ID NO: 3677990 - RNA, 17 nt, Human
uauuacuccuauuuuug

SEQ ID NO: 3677991 - RNA, 19 nt, Human
uauuacuggcguggauuaa

SEQ ID NO: 3677992 - RNA, 18 nt, Human
uauuacugucugguuuua

SEQ ID NO: 3677993 - RNA, 23 nt, Human
uauuacugucugguuuuaacaau

SEQ ID NO: 3677994 - RNA, 18 nt, Human
uauuacuguuuauuucug

SEQ ID NO: 3677995 - RNA, 14 nt, Human
uauuacuuauuugg

SEQ ID NO: 3677996 - RNA, 13 nt, Human
uauuacuucugcu

SEQ ID NO: 3677997 - RNA, 14 nt, Human
uauuacuucugcua

SEQ ID NO: 3677998 - RNA, 19 nt, Human
uauuagaaaacuuuguuag

SEQ ID NO: 3677999 - RNA, 17 nt, Human
uauuagaaucaaacauu

SEQ ID NO: 3678000 - RNA, 21 nt, Human
uauuagaaucaaacauuuuga

SEQ ID NO: 3678001 - RNA, 17 nt, Human
uauuagacuucuguuuu

SEQ ID NO: 3678002 - RNA, 20 nt, Human
uauuagacuucuguuuucaa

SEQ ID NO: 3678003 - RNA, 23 nt, Human
uauuagacuucuguuuucaaucu

SEQ ID NO: 3678004 - RNA, 11 nt, Human
uauuagaugaa

SEQ ID NO: 3678005 - RNA, 15 nt, Human
uauuagaugcacuua

SEQ ID NO: 3678006 - RNA, 13 nt, Human
uauuagaugugau

SEQ ID NO: 3678007 - RNA, 23 nt, Human
uauuagaugugauuuaauagugu

SEQ ID NO: 3678008 - RNA, 14 nt, Human
uauuagauguucuc

SEQ ID NO: 3678009 - RNA, 15 nt, Human
uauuagauguucucu

SEQ ID NO: 3678010 - RNA, 17 nt, Human
uauuagauguucucuau

SEQ ID NO: 3678011 - RNA, 22 nt, Human
uauuagauguucucuaucauuu

SEQ ID NO: 3678012 - RNA, 16 nt, Human
uauuagcccugcauuu

SEQ ID NO: 3678013 - RNA, 20 nt, Human
uauuagcccugcauuuucau

SEQ ID NO: 3678014 - RNA, 22 nt, Human
uauuagcccugcauuuucauag

SEQ ID NO: 3678015 - RNA, 18 nt, Human
uauuagcgacaacagauu

SEQ ID NO: 3678016 - RNA, 16 nt, Human
uauuagcuuuacuguu

SEQ ID NO: 3678017 - RNA, 21 nt, Human
uauuagggagaaaauucaauu

SEQ ID NO: 3678018 - RNA, 17 nt, Human
uauuagggguaauauau

SEQ ID NO: 3678019 - RNA, 21 nt, Human
uauuaggugcaauuucaaggu

SEQ ID NO: 3678020 - RNA, 21 nt, Human
uauuaguacugcucuuguuuc

SEQ ID NO: 3678021 - RNA, 16 nt, Human
uauuaguauuguuguc

SEQ ID NO: 3678022 - RNA, 19 nt, Human
uauuaguauuguuguccuu

SEQ ID NO: 3678023 - RNA, 16 nt, Human
uauuagucuuggggca

SEQ ID NO: 3678024 - RNA, 19 nt, Human
uauuagugauauuucucua

SEQ ID NO: 3678025 - RNA, 21 nt, Human
uauuagugauauuucucuagu

SEQ ID NO: 3678026 - RNA, 22 nt, Human
uauuagugguuuaucagcaaaa

SEQ ID NO: 3678027 - RNA, 13 nt, Human
uauuaguguuaua

SEQ ID NO: 3678028 - RNA, 14 nt, Human
uauuaguguuauau

SEQ ID NO: 3678029 - RNA, 17 nt, Human
uauuaguguuauaugaa

SEQ ID NO: 3678030 - RNA, 13 nt, Human
uauuaguugcuuu

SEQ ID NO: 3678031 - RNA, 13 nt, Human
uauuauaaauaua

SEQ ID NO: 3678032 - RNA, 22 nt, Human
uauuauaaauauauauaaagaa

SEQ ID NO: 3678033 - RNA, 18 nt, Human
uauuauaaauuauguuua

SEQ ID NO: 3678034 - RNA, 20 nt, Human
uauuauaagcauugaaauua

SEQ ID NO: 3678035 - RNA, 14 nt, Human
uauuauaaucuuau

SEQ ID NO: 3678036 - RNA, 12 nt, Human
uauuauaauuua

SEQ ID NO: 3678037 - RNA, 15 nt, Human
uauuauaauuuaaug

SEQ ID NO: 3678038 - RNA, 19 nt, Human
uauuauacaugugauacau

SEQ ID NO: 3678039 - RNA, 14 nt, Human
uuucuguguguucc

SEQ ID NO: 3678040 - RNA, 15 nt, Human
uuucuguguguuccu

SEQ ID NO: 3678041 - RNA, 14 nt, Human
uuucuguuccaaau

SEQ ID NO: 3678042 - RNA, 14 nt, Human
uuucuguugccaca

SEQ ID NO: 3678043 - RNA, 15 nt, Human
uuucuguuggauucc

SEQ ID NO: 3678044 - RNA, 15 nt, Human
uuucuguugguguau

SEQ ID NO: 3678045 - RNA, 15 nt, Human
uuucuguuguaacuu

SEQ ID NO: 3678046 - RNA, 16 nt, Human
uuucuguuguaacuua

SEQ ID NO: 3678047 - RNA, 17 nt, Human
uuucuguugucauugcu

SEQ ID NO: 3678048 - RNA, 23 nt, Human
uuucuguugucauugcuguuguc

SEQ ID NO: 3678049 - RNA, 18 nt, Human
uuucuguuuccuuuuuua

SEQ ID NO: 3678050 - RNA, 20 nt, Human
uuucuguuucuaauuugcug

SEQ ID NO: 3678051 - RNA, 16 nt, Human
uuucuuaaaccuucag

SEQ ID NO: 3678052 - RNA, 18 nt, Human
uuucuuaaaccuucaguu

SEQ ID NO: 3678053 - RNA, 12 nt, Human
uuucuuaaauaa

SEQ ID NO: 3678054 - RNA, 13 nt, Human
uuucuuaaauaag

SEQ ID NO: 3678055 - RNA, 15 nt, Human
uuucuuaaaugggcu

SEQ ID NO: 3678056 - RNA, 21 nt, Human
uuucuuaaccaguuguggugu

SEQ ID NO: 3678057 - RNA, 23 nt, Human
uuucuuaaggugaggccugucug

SEQ ID NO: 3678058 - RNA, 23 nt, Human
uuucuuaauuauuauaaaaauau

SEQ ID NO: 3678059 - RNA, 15 nt, Human
uuucuuaauuuggaa

SEQ ID NO: 3678060 - RNA, 17 nt, Human
uuucuuacuccuccucu

SEQ ID NO: 3678061 - RNA, 22 nt, Human
uuucuuacugucuuuuuucuaa

SEQ ID NO: 3678062 - RNA, 13 nt, Human
uuucuuagacuuu

SEQ ID NO: 3678063 - RNA, 13 nt, Human
uuucuuagcuuuu

SEQ ID NO: 3678064 - RNA, 16 nt, Human
uuucuuagcuuuuuaa

SEQ ID NO: 3678065 - RNA, 18 nt, Human
uuucuuagggaaggauac

SEQ ID NO: 3678066 - RNA, 23 nt, Human
uuucuuagggaaggauacaaaag

SEQ ID NO: 3678067 - RNA, 16 nt, Human
uuucuuagugccugug

SEQ ID NO: 3678068 - RNA, 23 nt, Human
uuucuuaucacaaaaaagaaaau

SEQ ID NO: 3678069 - RNA, 15 nt, Human
uuucuuaugugacau

SEQ ID NO: 3678070 - RNA, 16 nt, Human
uuucuuaugugacauu

SEQ ID NO: 3678071 - RNA, 13 nt, Human
uuucuuauugcgc

SEQ ID NO: 3678072 - RNA, 14 nt, Human
uauuaugcuucuug

SEQ ID NO: 3678073 - RNA, 21 nt, Human
uauuauguccugugagaugug

SEQ ID NO: 3678074 - RNA, 22 nt, Human
uauuauguccugugagaugugu

SEQ ID NO: 3678075 - RNA, 13 nt, Human
uauuauuagaaau

SEQ ID NO: 3678076 - RNA, 19 nt, Human
uauuauuaguuuugauuua

SEQ ID NO: 3678077 - RNA, 20 nt, Human
uauuauugugguaggccuuu

SEQ ID NO: 3678078 - RNA, 20 nt, Human
uauuauuucuaggaagaauu

SEQ ID NO: 3678079 - RNA, 21 nt, Human
uauuauuugcagugcaguaua

SEQ ID NO: 3678080 - RNA, 15 nt, Human
uauuauuuucaccug

SEQ ID NO: 3678081 - RNA, 23 nt, Human
uauucaaaaauuaucuauagcua

SEQ ID NO: 3678082 - RNA, 14 nt, Human
uauucaaacugaaa

SEQ ID NO: 3678083 - RNA, 13 nt, Human
uauucaaaguugc

SEQ ID NO: 3678084 - RNA, 16 nt, Human
uauucaaaguugccua

SEQ ID NO: 3678085 - RNA, 19 nt, Human
uauucaacucauaagacuu

SEQ ID NO: 3678086 - RNA, 23 nt, Human
uauucaagaaagccagucuuaac

SEQ ID NO: 3678087 - RNA, 21 nt, Human
uauucaagguaaaauucuaaa

SEQ ID NO: 3678088 - RNA, 16 nt, Human
uauucaaguuauugua

SEQ ID NO: 3678089 - RNA, 20 nt, Human
uauucaaguuauuguacagc

SEQ ID NO: 3678090 - RNA, 22 nt, Human
uauucaauaaaaaaaagaaaug

SEQ ID NO: 3678091 - RNA, 23 nt, Human
uauucaauaaaaaaaagaaauga

SEQ ID NO: 3678092 - RNA, 12 nt, Human
uauucaauaaag

SEQ ID NO: 3678093 - RNA, 15 nt, Human
uauucacaaaauauc

SEQ ID NO: 3678094 - RNA, 21 nt, Human
uauucacaucgcuucugugua

SEQ ID NO: 3678095 - RNA, 20 nt, Human
uauucaccauguaaaacaaa

SEQ ID NO: 3678096 - RNA, 22 nt, Human
uauucacugauuugacauaguc

SEQ ID NO: 3678097 - RNA, 14 nt, Human
uauucacuggcccc

SEQ ID NO: 3678098 - RNA, 12 nt, Human
uauucacugggc

SEQ ID NO: 3678099 - RNA, 18 nt, Human
uauucagaaucuuuguua

SEQ ID NO: 3678100 - RNA, 16 nt, Human
uauucagacaaaaugg

SEQ ID NO: 3678101 - RNA, 17 nt, Human
uauucagacaaaaugga

SEQ ID NO: 3678102 - RNA, 15 nt, Human
uauucagauguaugu

SEQ ID NO: 3678103 - RNA, 14 nt, Human
uauucagcuucauu

SEQ ID NO: 3678104 - RNA, 21 nt, Human
uauucagcuucauuuguguca

SEQ ID NO: 3678105 - RNA, 19 nt, Human
uauucagcuuuaguagaua

SEQ ID NO: 3678106 - RNA, 15 nt, Human
uauucaggguaaaua

SEQ ID NO: 3678107 - RNA, 16 nt, Human
uauucaggguaaauag

SEQ ID NO: 3678108 - RNA, 14 nt, Human
uauucaguaaaaaa

SEQ ID NO: 3678109 - RNA, 20 nt, Human
uauucaguaauaacucuacc

SEQ ID NO: 3678110 - RNA, 18 nt, Human
uauucagugcuguggccu

SEQ ID NO: 3678111 - RNA, 21 nt, Human
uauucagugcuguggccuggg

SEQ ID NO: 3678112 - RNA, 17 nt, Human
uauucaguuaagaaaaa

SEQ ID NO: 3678113 - RNA, 14 nt, Human
uauucaguucccag

SEQ ID NO: 3678114 - RNA, 21 nt, Human
uauucaguucccagaaucaaa

SEQ ID NO: 3678115 - RNA, 23 nt, Human
uauucauagcagcuuauucacaa

SEQ ID NO: 3678116 - RNA, 17 nt, Human
uauucauaguagaacuu

SEQ ID NO: 3678117 - RNA, 14 nt, Human
uauucauaugcaua

SEQ ID NO: 3678118 - RNA, 17 nt, Human
uauucauauuuguacuu

SEQ ID NO: 3678119 - RNA, 23 nt, Human
uauucauuauuugucaaauuguc

SEQ ID NO: 3678120 - RNA, 18 nt, Human
uauucauucuuuuugaaa

SEQ ID NO: 3678121 - RNA, 21 nt, Human
uauucauugugguuauuuuua

SEQ ID NO: 3678122 - RNA, 15 nt, Human
uauucauuuaaaaug

SEQ ID NO: 3678123 - RNA, 16 nt, Human
uauucauuuaaaauga

SEQ ID NO: 3678124 - RNA, 14 nt, Human
uauucauuuucucu

SEQ ID NO: 3678125 - RNA, 15 nt, Human
uauucauuuucucua

SEQ ID NO: 3678126 - RNA, 16 nt, Human
uauucauuuuuguuau

SEQ ID NO: 3678127 - RNA, 17 nt, Human
uauuccaaaccaaauuu

SEQ ID NO: 3678128 - RNA, 14 nt, Human
uauuccaaaugucu

SEQ ID NO: 3678129 - RNA, 13 nt, Human
uauuccacaucua

SEQ ID NO: 3678130 - RNA, 14 nt, Human
uauuccaccuuaaa

SEQ ID NO: 3678131 - RNA, 17 nt, Human
uauuccagaaugcugua

SEQ ID NO: 3678132 - RNA, 12 nt, Human
uauuccagagcu

SEQ ID NO: 3678133 - RNA, 17 nt, Human
uauuccagagcugccag

SEQ ID NO: 3678134 - RNA, 23 nt, Human
uauuccagcucauucauuuuaua

SEQ ID NO: 3678135 - RNA, 17 nt, Human
uauuccagcuguccccc

SEQ ID NO: 3678136 - RNA, 18 nt, Human
uauuccauaguauauuaa

SEQ ID NO: 3678137 - RNA, 17 nt, Human
uauuccauauuuauuca

SEQ ID NO: 3678138 - RNA, 18 nt, Human
uauuccauccauauacuu

SEQ ID NO: 3678139 - RNA, 19 nt, Human
uauuccauccauauacuuu

SEQ ID NO: 3678140 - RNA, 12 nt, Human
uauuccaugacu

SEQ ID NO: 3678141 - RNA, 23 nt, Human
uauuccaugacugcuugcccuaa

SEQ ID NO: 3678142 - RNA, 23 nt, Human
uauuccccagcagggucuuuuca

SEQ ID NO: 3678143 - RNA, 22 nt, Human
uauuccccuaucucuagaauuu

SEQ ID NO: 3678144 - RNA, 21 nt, Human
uauucccuagaaacuuccaaa

SEQ ID NO: 3678145 - RNA, 14 nt, Human
uauuccuaguuggu

SEQ ID NO: 3678146 - RNA, 23 nt, Human
uauuccuaguuggugagaaaccu

SEQ ID NO: 3678147 - RNA, 22 nt, Human
uauuccuauauaguuuauugac

SEQ ID NO: 3678148 - RNA, 14 nt, Human
uauuccuauugugc

SEQ ID NO: 3678149 - RNA, 16 nt, Human
uauuccucaaaaaauu

SEQ ID NO: 3678150 - RNA, 20 nt, Human
uauuccucuugcauuucacu

SEQ ID NO: 3678151 - RNA, 14 nt, Human
uauuccugaaugaa

SEQ ID NO: 3678152 - RNA, 20 nt, Human
uauuccugaaugaaauauca

SEQ ID NO: 3678153 - RNA, 21 nt, Human
uauuccugcauuugugaaaug

SEQ ID NO: 3678154 - RNA, 19 nt, Human
uauuccugcccugcuguuu

SEQ ID NO: 3678155 - RNA, 16 nt, Human
uauuccuucuggccuu

SEQ ID NO: 3678156 - RNA, 19 nt, Human
uauuccuucuggccuuucc

SEQ ID NO: 3678157 - RNA, 16 nt, Human
uauuccuugaucauuu

SEQ ID NO: 3678158 - RNA, 16 nt, Human
uauuccuuucuaucau

SEQ ID NO: 3678159 - RNA, 22 nt, Human
uauuccuuuguuacuucucuaa

SEQ ID NO: 3678160 - RNA, 19 nt, Human
uauuccuuuuguguacagu

SEQ ID NO: 3678161 - RNA, 21 nt, Human
uauuccuuuuguguacagugu

SEQ ID NO: 3678162 - RNA, 17 nt, Human
uauucgaaugaaaagac

SEQ ID NO: 3678163 - RNA, 14 nt, Human
uauucgcuugagaa

SEQ ID NO: 3678164 - RNA, 15 nt, Human
uauucuaaaaccauu

SEQ ID NO: 3678165 - RNA, 14 nt, Human
uauucuaaauuuua

SEQ ID NO: 3678166 - RNA, 19 nt, Human
uauucuaaauuuuauaucu

SEQ ID NO: 3678167 - RNA, 12 nt, Human
uauucuaagacu

SEQ ID NO: 3678168 - RNA, 13 nt, Human
uauucuaagacuu

SEQ ID NO: 3678169 - RNA, 13 nt, Human
uauucuaauaagc

SEQ ID NO: 3678170 - RNA, 17 nt, Human
uauucuaauaagcuagu

SEQ ID NO: 3678171 - RNA, 14 nt, Human
uauucuacauuuca

SEQ ID NO: 3678172 - RNA, 13 nt, Human
uauucuacuauac

SEQ ID NO: 3678173 - RNA, 15 nt, Human
uauucuauaugaauu

SEQ ID NO: 3678174 - RNA, 17 nt, Human
uauucuauaugaauuua

SEQ ID NO: 3678175 - RNA, 19 nt, Human
uauucuauuaacuuuaauu

SEQ ID NO: 3678176 - RNA, 12 nt, Human
uauucuauugca

SEQ ID NO: 3678177 - RNA, 16 nt, Human
uauucucaaagcagga

SEQ ID NO: 3678178 - RNA, 16 nt, Human
uauucucacuccacca

SEQ ID NO: 3678179 - RNA, 19 nt, Human
uauucucacuccaccaccc

SEQ ID NO: 3678180 - RNA, 16 nt, Human
uauucucuccucagac

SEQ ID NO: 3678181 - RNA, 19 nt, Human
uauucucugagcugugcag

SEQ ID NO: 3678182 - RNA, 15 nt, Human
uauucucuguacaua

SEQ ID NO: 3678183 - RNA, 18 nt, Human
uauucucuguacauauua

SEQ ID NO: 3678184 - RNA, 15 nt, Human
uauuugcuuuuugcu

SEQ ID NO: 3678185 - RNA, 17 nt, Human
uauuuggaaauaaaguc

SEQ ID NO: 3678186 - RNA, 21 nt, Human
uauuuggaagaaaaaaaucuu

SEQ ID NO: 3678187 - RNA, 11 nt, Human
uauuuggaauu

SEQ ID NO: 3678188 - RNA, 15 nt, Human
uauuuggaauuagaa

SEQ ID NO: 3678189 - RNA, 20 nt, Human
uauuuggaauuuauauacaa

SEQ ID NO: 3678190 - RNA, 21 nt, Human
uauuuggaauuuauauacaac

SEQ ID NO: 3678191 - RNA, 16 nt, Human
uauuuggaugcagagu

SEQ ID NO: 3678192 - RNA, 19 nt, Human
uauuuggaugcagaguuca

SEQ ID NO: 3678193 - RNA, 20 nt, Human
uauuuggaugcagaguucag

SEQ ID NO: 3678194 - RNA, 14 nt, Human
uauuuggcuuaaau

SEQ ID NO: 3678195 - RNA, 19 nt, Human
uauuuggcuuaaauauagu

SEQ ID NO: 3678196 - RNA, 23 nt, Human
uauuugggagggaaaagggaagu

SEQ ID NO: 3678197 - RNA, 21 nt, Human
uauuugguuuggccaucucug

SEQ ID NO: 3678198 - RNA, 14 nt, Human
uauuuguaaaauga

SEQ ID NO: 3678199 - RNA, 15 nt, Human
uauuuguaaaaugac

SEQ ID NO: 3678200 - RNA, 23 nt, Human
uauuuguaaaaugacaaucaugu

SEQ ID NO: 3678201 - RNA, 17 nt, Human
uauuuguaaauuuaugu

SEQ ID NO: 3678202 - RNA, 22 nt, Human
uauuuguaaauuuaugugaugg

SEQ ID NO: 3678203 - RNA, 23 nt, Human
uauuuguaaggcuuguuccaaug

SEQ ID NO: 3678204 - RNA, 15 nt, Human
uauuuguaauagaug

SEQ ID NO: 3678205 - RNA, 23 nt, Human
uauuuguacuguuuaauguucug

SEQ ID NO: 3678206 - RNA, 15 nt, Human
uauuuguacuuucug

SEQ ID NO: 3678207 - RNA, 20 nt, Human
uauuuguacuuucuguuaaa

SEQ ID NO: 3678208 - RNA, 15 nt, Human
uauuuguaggagaaa

SEQ ID NO: 3678209 - RNA, 23 nt, Human
uauuuguauaguugcuugccuga

SEQ ID NO: 3678210 - RNA, 17 nt, Human
uauuuguauuuauucuu

SEQ ID NO: 3678211 - RNA, 12 nt, Human
uauuugucaaau

SEQ ID NO: 3678212 - RNA, 20 nt, Human
uauuugucaguguagaucaa

SEQ ID NO: 3678213 - RNA, 14 nt, Human
uauuugugacuaau

SEQ ID NO: 3678214 - RNA, 17 nt, Human
uauuugugacuaauugu

SEQ ID NO: 3678215 - RNA, 18 nt, Human
uauuugugauagcacuuu

SEQ ID NO: 3678216 - RNA, 17 nt, Human
uauuugugcauuuucua

SEQ ID NO: 3678217 - RNA, 14 nt, Human
uauuuguggaauaa

SEQ ID NO: 3678218 - RNA, 14 nt, Human
uauuuguguaauag

SEQ ID NO: 3678219 - RNA, 17 nt, Human
uauuuguguauuuaaca

SEQ ID NO: 3678220 - RNA, 21 nt, Human
uauuuguguuuuaauuuaaac

SEQ ID NO: 3678221 - RNA, 20 nt, Human
uauuuguuaaugguuugaau

SEQ ID NO: 3678222 - RNA, 14 nt, Human
uauuuguuauuuuc

SEQ ID NO: 3678223 - RNA, 21 nt, Human
uauuuguuuaugguaaaaaau

SEQ ID NO: 3678224 - RNA, 17 nt, Human
uauuuguuuuucauuca

SEQ ID NO: 3678225 - RNA, 23 nt, Human
uauuuuaaaagccacauagagug

SEQ ID NO: 3678226 - RNA, 13 nt, Human
uauuuuaaaauga

SEQ ID NO: 3678227 - RNA, 14 nt, Human
uauuuuaaaauuug

SEQ ID NO: 3678228 - RNA, 17 nt, Human
uauuuuaaaauuuguuc

SEQ ID NO: 3678229 - RNA, 19 nt, Human
uauuuuaaacaaaauagaa

SEQ ID NO: 3678230 - RNA, 12 nt, Human
uauuuuaaagaa

SEQ ID NO: 3678231 - RNA, 13 nt, Human
uauuuuaaagaau

SEQ ID NO: 3678232 - RNA, 16 nt, Human
uauuuuaaagaauugu

SEQ ID NO: 3678233 - RNA, 18 nt, Human
uauuuuaaauuauaagga

SEQ ID NO: 3678234 - RNA, 21 nt, Human
uauuuuaaauuauaaggacug

SEQ ID NO: 3678235 - RNA, 23 nt, Human
uauuuuaagacugauuuuaauag

SEQ ID NO: 3678236 - RNA, 12 nt, Human
uauuuuaagcau

SEQ ID NO: 3678237 - RNA, 14 nt, Human
uauuuuaauaaaca

SEQ ID NO: 3678238 - RNA, 19 nt, Human
uauuuuaauuuaugaguuu

SEQ ID NO: 3678239 - RNA, 14 nt, Human
uauuuuaauuucaa

SEQ ID NO: 3678240 - RNA, 15 nt, Human
uauuuuaauuucaag

SEQ ID NO: 3678241 - RNA, 14 nt, Human
uauuuuacacagaa

SEQ ID NO: 3678242 - RNA, 19 nt, Human
uauuuuacacagaaacacu

SEQ ID NO: 3678243 - RNA, 24 nt, Human
uauuuuacacagaaacacugccuu

SEQ ID NO: 3678244 - RNA, 12 nt, Human
uauuuuacuuuu

SEQ ID NO: 3678245 - RNA, 14 nt, Human
uauuuuacuuuuau

SEQ ID NO: 3678246 - RNA, 14 nt, Human
uauuuuacuuuuug

SEQ ID NO: 3678247 - RNA, 15 nt, Human
uauuuuacuuuuugg

SEQ ID NO: 3678248 - RNA, 16 nt, Human
uauuuuagaauaaauu

SEQ ID NO: 3678249 - RNA, 21 nt, Human
uauuuuaggcagggauuugag

SEQ ID NO: 3678250 - RNA, 22 nt, Human
uauuuuaguggacccugaaaug

SEQ ID NO: 3678251 - RNA, 18 nt, Human
uauuuuaguuucuguucu

SEQ ID NO: 3678252 - RNA, 17 nt, Human
uauuuuauauuguuaua

SEQ ID NO: 3678253 - RNA, 15 nt, Human
uauuuuauccucugg

SEQ ID NO: 3678254 - RNA, 23 nt, Human
uauuuuaucuuugauucuccuuc

SEQ ID NO: 3678255 - RNA, 18 nt, Human
uauuuuaugagaaaugua

SEQ ID NO: 3678256 - RNA, 14 nt, Human
uauuuuaugcaaau

SEQ ID NO: 3678257 - RNA, 19 nt, Human
uauuuuaugguuauguuuu

SEQ ID NO: 3678258 - RNA, 21 nt, Human
uauuuuauguuauauauaaau

SEQ ID NO: 3678259 - RNA, 13 nt, Human
uauuuuauuaaua

SEQ ID NO: 3678260 - RNA, 13 nt, Human
uauuuuauuacug

SEQ ID NO: 3678261 - RNA, 23 nt, Human
uauuuuauuaugaaacuugugua

SEQ ID NO: 3678262 - RNA, 15 nt, Human
uauuuuauuucaaug

SEQ ID NO: 3678263 - RNA, 16 nt, Human
uauuuuauuucaaugu

SEQ ID NO: 3678264 - RNA, 20 nt, Human
uauuuuauuuccaucauguc

SEQ ID NO: 3678265 - RNA, 21 nt, Human
uauuuucaauucaaaaaugua

SEQ ID NO: 3678266 - RNA, 11 nt, Human
uauuuucacaa

SEQ ID NO: 3678267 - RNA, 16 nt, Human
uauuuucacaauguca

SEQ ID NO: 3678268 - RNA, 13 nt, Human
uauuuucagaauc

SEQ ID NO: 3678269 - RNA, 20 nt, Human
uauuuucagaaucugaaugu

SEQ ID NO: 3678270 - RNA, 14 nt, Human
uauuuucagaugug

SEQ ID NO: 3678271 - RNA, 19 nt, Human
uauuuucauccuugucuua

SEQ ID NO: 3678272 - RNA, 14 nt, Human
uauuuuccaagugu

SEQ ID NO: 3678273 - RNA, 19 nt, Human
uauuuuccaagugugcaua

SEQ ID NO: 3678274 - RNA, 22 nt, Human
uauuuuccaagugugcauauug

SEQ ID NO: 3678275 - RNA, 18 nt, Human
uauuuucccaauagcacu

SEQ ID NO: 3678276 - RNA, 15 nt, Human
uauuuuccuccccag

SEQ ID NO: 3678277 - RNA, 16 nt, Human
uugcuguugaaagcaa

SEQ ID NO: 3678278 - RNA, 20 nt, Human
uugcuguugacauauuuaau

SEQ ID NO: 3678279 - RNA, 15 nt, Human
uugcuguugcuugaa

SEQ ID NO: 3678280 - RNA, 14 nt, Human
uugcuguuguccaa

SEQ ID NO: 3678281 - RNA, 19 nt, Human
uugcuguuguccaacuauu

SEQ ID NO: 3678282 - RNA, 18 nt, Human
uugcuguuuuccucccuu

SEQ ID NO: 3678283 - RNA, 16 nt, Human
uugcuguuuuguucug

SEQ ID NO: 3678284 - RNA, 14 nt, Human
uugcuuaaauguga

SEQ ID NO: 3678285 - RNA, 20 nt, Human
uugcuuaaaugugaauuacu

SEQ ID NO: 3678286 - RNA, 13 nt, Human
uugcuuacaauuu

SEQ ID NO: 3678287 - RNA, 22 nt, Human
uugcuuacaauuuuuuuaauuu

SEQ ID NO: 3678288 - RNA, 18 nt, Human
uugcuuacauuuuuacaa

SEQ ID NO: 3678289 - RNA, 17 nt, Human
uugcuuaccuugacugu

SEQ ID NO: 3678290 - RNA, 23 nt, Human
uugcuuacuuuggaauacauuuc

SEQ ID NO: 3678291 - RNA, 13 nt, Human
uugcuuaugacau

SEQ ID NO: 3678292 - RNA, 20 nt, Human
uugcuuauuguuccaagaca

SEQ ID NO: 3678293 - RNA, 22 nt, Human
uugcuuauuguuccaagacauu

SEQ ID NO: 3678294 - RNA, 17 nt, Human
uugcuucaccauggccu

SEQ ID NO: 3678295 - RNA, 12 nt, Human
uugcuucacuca

SEQ ID NO: 3678296 - RNA, 17 nt, Human
uugcuucauaaaugaag

SEQ ID NO: 3678297 - RNA, 12 nt, Human
uugcuucuguag

SEQ ID NO: 3678298 - RNA, 21 nt, Human
uugcuucuguaguacuccuua

SEQ ID NO: 3678299 - RNA, 20 nt, Human
uugcuucuuucuagaaagag

SEQ ID NO: 3678300 - RNA, 13 nt, Human
uugcuugaaacca

SEQ ID NO: 3678301 - RNA, 12 nt, Human
uugcuugaaaga

SEQ ID NO: 3678302 - RNA, 14 nt, Human
uugcuugaaagaaa

SEQ ID NO: 3678303 - RNA, 16 nt, Human
uugcuugaacacagua

SEQ ID NO: 3678304 - RNA, 21 nt, Human
uugcuugaacacaguauuuuc

SEQ ID NO: 3678305 - RNA, 17 nt, Human
uugcuugacuucaguua

SEQ ID NO: 3678306 - RNA, 16 nt, Human
uugcuugccugcaggg

SEQ ID NO: 3678307 - RNA, 16 nt, Human
uugcuuggacuauuau

SEQ ID NO: 3678308 - RNA, 15 nt, Human
uugcuuggcugcuug

SEQ ID NO: 3678309 - RNA, 19 nt, Human
uugcuuggcugcuuggccu

SEQ ID NO: 3678310 - RNA, 12 nt, Human
uugcuuuacugg

SEQ ID NO: 3678311 - RNA, 16 nt, Human
uugcuuuauaaauaaa

SEQ ID NO: 3678312 - RNA, 20 nt, Human
uugcuuuaugccuucuuauu

SEQ ID NO: 3678313 - RNA, 14 nt, Human
uugcuuugaaaaag

SEQ ID NO: 3678314 - RNA, 14 nt, Human
uugcuuugaagcag

SEQ ID NO: 3678315 - RNA, 14 nt, Human
uugcuuugcccagc

SEQ ID NO: 3678316 - RNA, 13 nt, Human
uugcuuugcccuu

SEQ ID NO: 3678317 - RNA, 15 nt, Human
uugcuuuguguucuu

SEQ ID NO: 3678318 - RNA, 17 nt, Human
uugcuuuuaaaacuacu

SEQ ID NO: 3678319 - RNA, 21 nt, Human
uugcuuuuaaaacuacuuagc

SEQ ID NO: 3678320 - RNA, 14 nt, Human
uugcuuuuagaaaa

SEQ ID NO: 3678321 - RNA, 17 nt, Human
uugcuuuuauuuugaaa

SEQ ID NO: 3678322 - RNA, 15 nt, Human
uugcuuuucacaaau

SEQ ID NO: 3678323 - RNA, 17 nt, Human
uugcuuuucaugcaaac

SEQ ID NO: 3678324 - RNA, 23 nt, Human
uugcuuuugaaggaauacaauau

SEQ ID NO: 3678325 - RNA, 15 nt, Human
uugcuuuugagagaa

SEQ ID NO: 3678326 - RNA, 20 nt, Human
uugcuuuuggcaaaacucua

SEQ ID NO: 3678327 - RNA, 15 nt, Human
uugcuuuuucuaaug

SEQ ID NO: 3678328 - RNA, 22 nt, Human
uugcuuuuucuaaugugguuau

SEQ ID NO: 3678329 - RNA, 17 nt, Human
uuggcaaaagccuugug

SEQ ID NO: 3678330 - RNA, 16 nt, Human
uuggcaaacucuccac

SEQ ID NO: 3678331 - RNA, 16 nt, Human
uuggcaaauuccuagu

SEQ ID NO: 3678332 - RNA, 14 nt, Human
uuggcaacagaagc

SEQ ID NO: 3678333 - RNA, 22 nt, Human
uuggcaauaaauuuugaaaagu

SEQ ID NO: 3678334 - RNA, 16 nt, Human
uuggcaauauuccuua

SEQ ID NO: 3678335 - RNA, 17 nt, Human
uuggcaaugccaucauc

SEQ ID NO: 3678336 - RNA, 23 nt, Human
uuggcacagaaacacaauauuuu

SEQ ID NO: 3678337 - RNA, 12 nt, Human
uuggcaccaaag

SEQ ID NO: 3678338 - RNA, 18 nt, Human
uuggcaccaaagaugcag

SEQ ID NO: 3678339 - RNA, 18 nt, Human
uuggcaccgaagcccaga

SEQ ID NO: 3678340 - RNA, 21 nt, Human
uuggcaccuaauccaggcaga

SEQ ID NO: 3678341 - RNA, 23 nt, Human
uuggcacucacagaccuggagcc

SEQ ID NO: 3678342 - RNA, 22 nt, Human
uuggcacugagauauuuauugu

SEQ ID NO: 3678343 - RNA, 18 nt, Human
uuggcacuuauugaauau

SEQ ID NO: 3678344 - RNA, 19 nt, Human
uuggcacuugccauuccaa

SEQ ID NO: 3678345 - RNA, 12 nt, Human
uuggcagcagau

SEQ ID NO: 3678346 - RNA, 22 nt, Human
uuggcagcaggugcugcuaccc

SEQ ID NO: 3678347 - RNA, 16 nt, Human
uuggcagcucuacucu

SEQ ID NO: 3678348 - RNA, 12 nt, Human
uuggcaggcugg

SEQ ID NO: 3678349 - RNA, 13 nt, Human
uuggcaggcuggc

SEQ ID NO: 3678350 - RNA, 14 nt, Human
uuggcaggcuggcc

SEQ ID NO: 3678351 - RNA, 19 nt, Human
uuggcagguaggaauauua

SEQ ID NO: 3678352 - RNA, 20 nt, Human
uuggcagugagugagccugg

SEQ ID NO: 3678353 - RNA, 19 nt, Human
uuggcaguggacucagaaa

SEQ ID NO: 3678354 - RNA, 18 nt, Human
uuggcauaacauaaaucu

SEQ ID NO: 3678355 - RNA, 17 nt, Human
uuggcaucucuguccca

SEQ ID NO: 3678356 - RNA, 21 nt, Human
uuggcauggaaauuuaaagca

SEQ ID NO: 3678357 - RNA, 13 nt, Human
uuggcauuccgca

SEQ ID NO: 3678358 - RNA, 15 nt, Human
uuggccaagcaggga

SEQ ID NO: 3678359 - RNA, 17 nt, Human
uuggccaaggaaaggca

SEQ ID NO: 3678360 - RNA, 20 nt, Human
uuggccagaagucaaggcuu

SEQ ID NO: 3678361 - RNA, 21 nt, Human
uuggccauauuuaccucagcc

SEQ ID NO: 3678362 - RNA, 14 nt, Human
uuggccaugggagg

SEQ ID NO: 3678363 - RNA, 16 nt, Human
uuggcccaagcucuug

SEQ ID NO: 3678364 - RNA, 13 nt, Human
uuggcccaggagu

SEQ ID NO: 3678365 - RNA, 23 nt, Human
uuggcccccaaagauagacaggu

SEQ ID NO: 3678366 - RNA, 19 nt, Human
uuggcccccuuucccgggc

SEQ ID NO: 3678367 - RNA, 19 nt, Human
uuggcccuuuccuuccaga

SEQ ID NO: 3678368 - RNA, 19 nt, Human
uuggccgcuguaugucuua

SEQ ID NO: 3678369 - RNA, 22 nt, Human
uuggccgggugcgguggcucac

SEQ ID NO: 3678370 - RNA, 16 nt, Human
uuggccucucucuagg

SEQ ID NO: 3678371 - RNA, 22 nt, Human
uuggccucugcaaaggaaauac

SEQ ID NO: 3678372 - RNA, 17 nt, Human
uuggccugaucagacca

SEQ ID NO: 3678373 - RNA, 13 nt, Human
uuggccugcugug

SEQ ID NO: 3678374 - RNA, 14 nt, Human
uuggccuggagcac

SEQ ID NO: 3678375 - RNA, 16 nt, Human
uuggccuggagcacaa

SEQ ID NO: 3678376 - RNA, 12 nt, Human
uuggccuggagg

SEQ ID NO: 3678377 - RNA, 22 nt, Human
uuggccugucucauccccaggg

SEQ ID NO: 3678378 - RNA, 21 nt, Human
uuggccuuggcuuuucuagcc

SEQ ID NO: 3678379 - RNA, 16 nt, Human
uuggcgcuauuacaaa

SEQ ID NO: 3678380 - RNA, 18 nt, Human
uuggcgcuauuacaaaua

SEQ ID NO: 3678381 - RNA, 14 nt, Human
uuggcgggccaagg

SEQ ID NO: 3678382 - RNA, 19 nt, Human
uuggcguaggcuacagaga

SEQ ID NO: 3678383 - RNA, 23 nt, Human
uuggcguaggcuacagagaagcc

SEQ ID NO: 3678384 - RNA, 13 nt, Human
uuggcguggagca

SEQ ID NO: 3678385 - RNA, 14 nt, Human
uuggcguggagcag

SEQ ID NO: 3678386 - RNA, 20 nt, Human
uuggcuaacuauauuugcuu

SEQ ID NO: 3678387 - RNA, 23 nt, Human
uuggcuauuagagaucaaccccu

SEQ ID NO: 3678388 - RNA, 13 nt, Human
uuggcucaauccu

SEQ ID NO: 3678389 - RNA, 14 nt, Human
uuggcucaauccuc

SEQ ID NO: 3678390 - RNA, 16 nt, Human
uuggcucacacugaga

SEQ ID NO: 3678391 - RNA, 17 nt, Human
uuggcucacacugagaa

SEQ ID NO: 3678392 - RNA, 12 nt, Human
uuggcucaccca

SEQ ID NO: 3678393 - RNA, 22 nt, Human
uuggcucacccaagcaaggcca

SEQ ID NO: 3678394 - RNA, 13 nt, Human
uuggcucagacau

SEQ ID NO: 3678395 - RNA, 17 nt, Human
uuggcucccaucuuuug

SEQ ID NO: 3678396 - RNA, 20 nt, Human
uuggcucgaaucucugugcc

SEQ ID NO: 3678397 - RNA, 12 nt, Human
uuggcucugcca

SEQ ID NO: 3678398 - RNA, 17 nt, Human
uuggcucuggagacagc

SEQ ID NO: 3678399 - RNA, 20 nt, Human
uuggcucuggagacagcccc

SEQ ID NO: 3678400 - RNA, 23 nt, Human
uuggcucuggagacagccccaga

SEQ ID NO: 3678401 - RNA, 22 nt, Human
uuggcugaaauucuccuggagg

SEQ ID NO: 3678402 - RNA, 13 nt, Human
uuggcugcaggga

SEQ ID NO: 3678403 - RNA, 14 nt, Human
uuggcugcagggag

SEQ ID NO: 3678404 - RNA, 15 nt, Human
uuggcugcugaaggc

SEQ ID NO: 3678405 - RNA, 16 nt, Human
uuggcugcuuggccuu

SEQ ID NO: 3678406 - RNA, 13 nt, Human
uuggcugggccca

SEQ ID NO: 3678407 - RNA, 18 nt, Human
uuggcugggcccagaagg

SEQ ID NO: 3678408 - RNA, 18 nt, Human
uuggcugggggccucagu

SEQ ID NO: 3678409 - RNA, 21 nt, Human
uuggcuggugugguacagaga

SEQ ID NO: 3678410 - RNA, 21 nt, Human
uuggcuguagaaggagacaga

SEQ ID NO: 3678411 - RNA, 17 nt, Human
uuggcugugaggccccu

SEQ ID NO: 3678412 - RNA, 14 nt, Human
uuggcugugucuaa

SEQ ID NO: 3678413 - RNA, 15 nt, Human
uuggcugugucuaaa

SEQ ID NO: 3678414 - RNA, 17 nt, Human
uuggcugugucuaaacu

SEQ ID NO: 3678415 - RNA, 20 nt, Human
uuggcugugucuaaacugca

SEQ ID NO: 3678416 - RNA, 21 nt, Human
uuggcugugucuaaacugcau

SEQ ID NO: 3678417 - RNA, 14 nt, Human
uuggcuuaccuggc

SEQ ID NO: 3678418 - RNA, 17 nt, Human
uuggcuuauaauucuuu

SEQ ID NO: 3678419 - RNA, 22 nt, Human
uuggcuuccuuucuugguucau

SEQ ID NO: 3678420 - RNA, 18 nt, Human
uuggcuucuguuucuagu

SEQ ID NO: 3678421 - RNA, 19 nt, Human
uuggcuucuucuuuaggau

SEQ ID NO: 3678422 - RNA, 13 nt, Human
uuggcuuggcccu

SEQ ID NO: 3678423 - RNA, 17 nt, Human
uuggcuugugaucuggg

SEQ ID NO: 3678424 - RNA, 16 nt, Human
uugggaaacuuggcuc

SEQ ID NO: 3678425 - RNA, 18 nt, Human
uugggaacugaacucacu

SEQ ID NO: 3678426 - RNA, 21 nt, Human
uugggaaggggacccccgccc

SEQ ID NO: 3678427 - RNA, 15 nt, Human
uugggaauaaauaug

SEQ ID NO: 3678428 - RNA, 15 nt, Human
uugggaauauuugaa

SEQ ID NO: 3678429 - RNA, 19 nt, Human
uugggaauauuugaaucuu

SEQ ID NO: 3678430 - RNA, 16 nt, Human
uugggaaugaggcuug

SEQ ID NO: 3678431 - RNA, 15 nt, Human
uugggacccaguggc

SEQ ID NO: 3678432 - RNA, 15 nt, Human
uugggaccccuggug

SEQ ID NO: 3678433 - RNA, 20 nt, Human
uugggaccccuggugguuca

SEQ ID NO: 3678434 - RNA, 22 nt, Human
uugggacccugcuuuagagcua

SEQ ID NO: 3678435 - RNA, 16 nt, Human
uugggaccgccagaug

SEQ ID NO: 3678436 - RNA, 23 nt, Human
uugggacuggguuuggaccccag

SEQ ID NO: 3678437 - RNA, 23 nt, Human
uugggagagacuuguuuuggaug

SEQ ID NO: 3678438 - RNA, 16 nt, Human
uugggagagccccugg

SEQ ID NO: 3678439 - RNA, 16 nt, Human
uugggagagggcgcag

SEQ ID NO: 3678440 - RNA, 22 nt, Human
uugggagcacuggagugcaggg

SEQ ID NO: 3678441 - RNA, 19 nt, Human
uugggagcuugggaaugga

SEQ ID NO: 3678442 - RNA, 15 nt, Human
uugggaggaagcaga

SEQ ID NO: 3678443 - RNA, 20 nt, Human
uuuuaaaagaugcaauguag

SEQ ID NO: 3678444 - RNA, 21 nt, Human
uuuuaaaagguauuuugaaua

SEQ ID NO: 3678445 - RNA, 16 nt, Human
uuuuaaaaguuauuaa

SEQ ID NO: 3678446 - RNA, 18 nt, Human
uuuuaaaaguuucaaugu

SEQ ID NO: 3678447 - RNA, 19 nt, Human
uuuuaaaaguuucaaugug

SEQ ID NO: 3678448 - RNA, 21 nt, Human
uuuuaaaauagaaauuuugua

SEQ ID NO: 3678449 - RNA, 20 nt, Human
uuuuaaaaucacuaacauua

SEQ ID NO: 3678450 - RNA, 14 nt, Human
uuuuaaaauccacu

SEQ ID NO: 3678451 - RNA, 23 nt, Human
uuuuaaaaucugagggaaauguu

SEQ ID NO: 3678452 - RNA, 12 nt, Human
uuuuaaaaucuu

SEQ ID NO: 3678453 - RNA, 13 nt, Human
uuuuaaaaucuua

SEQ ID NO: 3678454 - RNA, 15 nt, Human
uuuuaaaaucuuauu

SEQ ID NO: 3678455 - RNA, 22 nt, Human
uuuuaaaaucuuauuaaaguuu

SEQ ID NO: 3678456 - RNA, 21 nt, Human
uuuuaaaauggugcuuaaguu

SEQ ID NO: 3678457 - RNA, 14 nt, Human
uuuuaaaauguaca

SEQ ID NO: 3678458 - RNA, 14 nt, Human
uuuuaaacaaaaua

SEQ ID NO: 3678459 - RNA, 20 nt, Human
uuuuaaacuagaugaccuca

SEQ ID NO: 3678460 - RNA, 15 nt, Human
uuuuaaacuguacag

SEQ ID NO: 3678461 - RNA, 16 nt, Human
uuuuaaacuguacagu

SEQ ID NO: 3678462 - RNA, 20 nt, Human
uuuuaaacuguacagugucu

SEQ ID NO: 3678463 - RNA, 13 nt, Human
uuuuaaacugugu

SEQ ID NO: 3678464 - RNA, 23 nt, Human
uuuuaaacuguguacauaacuga

SEQ ID NO: 3678465 - RNA, 14 nt, Human
uuuuaaagaaaagu

SEQ ID NO: 3678466 - RNA, 12 nt, Human
uuuuaaagaauu

SEQ ID NO: 3678467 - RNA, 18 nt, Human
uuuuaaagaccccuaacc

SEQ ID NO: 3678468 - RNA, 20 nt, Human
uuuuaaagaucuguaaguaa

SEQ ID NO: 3678469 - RNA, 16 nt, Human
uuuuaaagguggauuu

SEQ ID NO: 3678470 - RNA, 21 nt, Human
uuuuaaaguaacccuacaaaa

SEQ ID NO: 3678471 - RNA, 16 nt, Human
uuuuaaaguauauauu

SEQ ID NO: 3678472 - RNA, 22 nt, Human
uuuuaaaguauguuauugcaua

SEQ ID NO: 3678473 - RNA, 12 nt, Human
uuuuguuugucu

SEQ ID NO: 3678474 - RNA, 20 nt, Human
uuuuguuugucucuccuuuu

SEQ ID NO: 3678475 - RNA, 16 nt, Human
uuuuguuuguuucuuu

SEQ ID NO: 3678476 - RNA, 18 nt, Human
uuuuguuuguuuguuuau

SEQ ID NO: 3678477 - RNA, 16 nt, Human
uuuuguuuuaaaacug

SEQ ID NO: 3678478 - RNA, 16 nt, Human
uuuuguuuuaaaauua

SEQ ID NO: 3678479 - RNA, 15 nt, Human
uuuuguuuuggcuga

SEQ ID NO: 3678480 - RNA, 15 nt, Human
uuuuguuuuguugca

SEQ ID NO: 3678481 - RNA, 17 nt, Human
uuuuguuuuucauucag

SEQ ID NO: 3678482 - RNA, 18 nt, Human
uuuuguuuuuucaaaaua

SEQ ID NO: 3678483 - RNA, 19 nt, Human
uuuuguuuuuucaaaauag

SEQ ID NO: 3678484 - RNA, 15 nt, Human
uuuuuaaaaaaagaa

SEQ ID NO: 3678485 - RNA, 18 nt, Human
uuuuuaaaaacuaaaaaa

SEQ ID NO: 3678486 - RNA, 17 nt, Human
uuuuuaaaauaucuuuu

SEQ ID NO: 3678487 - RNA, 16 nt, Human
uuuuuaaaauauuuau

SEQ ID NO: 3678488 - RNA, 12 nt, Human
uuuuuaaaaucu

SEQ ID NO: 3678489 - RNA, 19 nt, Human
uuuuuaaaaucuuauuaaa

SEQ ID NO: 3678490 - RNA, 19 nt, Human
uuuuuaaacaaacauugug

SEQ ID NO: 3678491 - RNA, 17 nt, Human
uuuuuaaacuguacagu

SEQ ID NO: 3678492 - RNA, 21 nt, Human
uuuuuaaacuguacagugucu

SEQ ID NO: 3678493 - RNA, 12 nt, Human
uuuuuaaagaaa

SEQ ID NO: 3678494 - RNA, 20 nt, Human
uuuuuaaagaaaaguuuugu

SEQ ID NO: 3678495 - RNA, 13 nt, Human
uuuuuaaagacuu

SEQ ID NO: 3678496 - RNA, 15 nt, Human
uuuuuaaagcuacaa

SEQ ID NO: 3678497 - RNA, 12 nt, Human
uuuuuaaagcuu

SEQ ID NO: 3678498 - RNA, 18 nt, Human
uuuuuaaaguuacuuugu

SEQ ID NO: 3678499 - RNA, 20 nt, Human
uuuuuaaauuuucuucaguu

SEQ ID NO: 3678500 - RNA, 12 nt, Human
uuuuuaagaaaa

SEQ ID NO: 3678501 - RNA, 13 nt, Human
uuuuuaagauuuu

SEQ ID NO: 3678502 - RNA, 14 nt, Human
uuuuuaagcucuga

SEQ ID NO: 3678503 - RNA, 20 nt, Human
uuuuuaagcugcaaaucuga

SEQ ID NO: 3678504 - RNA, 17 nt, Human
uuuuuaagguuauuuau

SEQ ID NO: 3678505 - RNA, 20 nt, Human
uuuuuaagugaaaauauagc

SEQ ID NO: 3678506 - RNA, 15 nt, Human
uuuuuaagugaaauu

SEQ ID NO: 3678507 - RNA, 17 nt, Human
uuguguacucuggccuc

SEQ ID NO: 3678508 - RNA, 13 nt, Human
uuguguagccuuu

SEQ ID NO: 3678509 - RNA, 16 nt, Human
uuguguauagaacugg

SEQ ID NO: 3678510 - RNA, 14 nt, Human
uuguguauauuugu

SEQ ID NO: 3678511 - RNA, 22 nt, Human
uuguguauccauuaucaugugu

SEQ ID NO: 3678512 - RNA, 13 nt, Human
uuguguauuuaac

SEQ ID NO: 3678513 - RNA, 21 nt, Human
uuguguauuuaacagggaggg

SEQ ID NO: 3678514 - RNA, 20 nt, Human
uuguguauuuacgcuuugau

SEQ ID NO: 3678515 - RNA, 18 nt, Human
uugugucccaugaucccu

SEQ ID NO: 3678516 - RNA, 16 nt, Human
uugugucccuaaugug

SEQ ID NO: 3678517 - RNA, 19 nt, Human
uuguguccuccaggagcuu

SEQ ID NO: 3678518 - RNA, 15 nt, Human
uugugucucuuaugg

SEQ ID NO: 3678519 - RNA, 19 nt, Human
uugugucuggcaguuuaua

SEQ ID NO: 3678520 - RNA, 12 nt, Human
uugugugaaauu

SEQ ID NO: 3678521 - RNA, 16 nt, Human
uugugugaaauugcau

SEQ ID NO: 3678522 - RNA, 11 nt, Human
uugugugaccc

SEQ ID NO: 3678523 - RNA, 14 nt, Human
uugugugauuuaag

SEQ ID NO: 3678524 - RNA, 20 nt, Human
uugugugccucuagcugaau

SEQ ID NO: 3678525 - RNA, 13 nt, Human
uugugugcucucc

SEQ ID NO: 3678526 - RNA, 13 nt, Human
uuguguggauucu

SEQ ID NO: 3678527 - RNA, 22 nt, Human
uuguguguaugcacaugaacuu

SEQ ID NO: 3678528 - RNA, 14 nt, Human
uuguguguauuugc

SEQ ID NO: 3678529 - RNA, 16 nt, Human
uuguguguauuugcua

SEQ ID NO: 3678530 - RNA, 19 nt, Human
uugugugugggcugugagu

SEQ ID NO: 3678531 - RNA, 12 nt, Human
uugugugugugc

SEQ ID NO: 3678532 - RNA, 20 nt, Human
uugugugugugucagcugag

SEQ ID NO: 3678533 - RNA, 15 nt, Human
uuguguguuccaagu

SEQ ID NO: 3678534 - RNA, 22 nt, Human
uuguguguuccaaguuuccaaa

SEQ ID NO: 3678535 - RNA, 15 nt, Human
uuguguguugucucu

SEQ ID NO: 3678536 - RNA, 15 nt, Human
uuguguuacuaaguu

SEQ ID NO: 3678537 - RNA, 16 nt, Human
uuguguuccuuuuuau

SEQ ID NO: 3678538 - RNA, 13 nt, Human
uuguguucuuugu

SEQ ID NO: 3678539 - RNA, 12 nt, Human
uuguguugaaga

SEQ ID NO: 3678540 - RNA, 21 nt, Human
uuguguuguaauucuucaguu

SEQ ID NO: 3678541 - RNA, 13 nt, Human
uuguguuguccuu

SEQ ID NO: 3678542 - RNA, 13 nt, Human
uuguguuguuuga

SEQ ID NO: 3678543 - RNA, 21 nt, Human
uuguguuguuugaaaauauua

SEQ ID NO: 3678544 - RNA, 18 nt, Human
uuguguuuacauuuuaug

SEQ ID NO: 3678545 - RNA, 21 nt, Human
uuguguuuauucuugaugaaa

SEQ ID NO: 3678546 - RNA, 17 nt, Human
uuguguuugguuuacau

SEQ ID NO: 3678547 - RNA, 18 nt, Human
uuguguuugguuuacauu

SEQ ID NO: 3678548 - RNA, 14 nt, Human
uuguguuugucauu

SEQ ID NO: 3678549 - RNA, 15 nt, Human
uuguguuugucauua

SEQ ID NO: 3678550 - RNA, 16 nt, Human
uuguguuuuuuaagau

SEQ ID NO: 3678551 - RNA, 21 nt, Human
uuguuaaaaauaaaucccaug

SEQ ID NO: 3678552 - RNA, 20 nt, Human
uuguuaaaacuggcaucuga

SEQ ID NO: 3678553 - RNA, 16 nt, Human
uuguuaaaauaacuag

SEQ ID NO: 3678554 - RNA, 22 nt, Human
uuguuaaaauuaugaaucugau

SEQ ID NO: 3678555 - RNA, 14 nt, Human
uuguuaaauauuua

SEQ ID NO: 3678556 - RNA, 11 nt, Human
uuguuaaauga

SEQ ID NO: 3678557 - RNA, 11 nt, Human
uuguuaacuuu

SEQ ID NO: 3678558 - RNA, 14 nt, Human
uuguuaacuuuggg

SEQ ID NO: 3678559 - RNA, 17 nt, Human
uuguuaaguccuuggcu

SEQ ID NO: 3678560 - RNA, 22 nt, Human
uuguuaagucuaaauauuuccu

SEQ ID NO: 3678561 - RNA, 14 nt, Human
uuguuaauaaaagu

SEQ ID NO: 3678562 - RNA, 16 nt, Human
uuguuaauaguuccug

SEQ ID NO: 3678563 - RNA, 20 nt, Human
uuguuaauaucacucauuaa

SEQ ID NO: 3678564 - RNA, 13 nt, Human
uuguuaauauucu

SEQ ID NO: 3678565 - RNA, 20 nt, Human
uuguuaaucucuguuaugua

SEQ ID NO: 3678566 - RNA, 18 nt, Human
uuguuaaucuucaauagu

SEQ ID NO: 3678567 - RNA, 11 nt, Human
uuguuacuguu

SEQ ID NO: 3678568 - RNA, 20 nt, Human
uuguuacuguucuugcugcu

SEQ ID NO: 3678569 - RNA, 16 nt, Human
uuguuagaaaaaugga

SEQ ID NO: 3678570 - RNA, 19 nt, Human
uuguuagagaaaaaugcuu

SEQ ID NO: 3678571 - RNA, 17 nt, Human
uuguuagaucuaguuca

SEQ ID NO: 3678572 - RNA, 12 nt, Human
uuguuagauguu

SEQ ID NO: 3678573 - RNA, 20 nt, Human
uuguuaggccaaagacaaau

SEQ ID NO: 3678574 - RNA, 22 nt, Human
uuguuaguuucugaguuuuacc

SEQ ID NO: 3678575 - RNA, 16 nt, Human
uuguuauauaaucauu

SEQ ID NO: 3678576 - RNA, 16 nt, Human
uuguuaucaaaauagu

SEQ ID NO: 3678577 - RNA, 13 nt, Human
uuguuaucaguaa

SEQ ID NO: 3678578 - RNA, 16 nt, Human
uuguuaucagucaaua

SEQ ID NO: 3678579 - RNA, 22 nt, Human
uuguuaucagucaauauuuuua

SEQ ID NO: 3678580 - RNA, 14 nt, Human
uuguuaugcuauua

SEQ ID NO: 3678581 - RNA, 22 nt, Human
uuguuauuacauccuuguggca

SEQ ID NO: 3678582 - RNA, 15 nt, Human
uuguuauuuauugaa

SEQ ID NO: 3678583 - RNA, 23 nt, Human
uuguuauuugaaaacauguuuau

SEQ ID NO: 3678584 - RNA, 15 nt, Human
uuguuauuuugcaac

SEQ ID NO: 3678585 - RNA, 15 nt, Human
uuguuauuuuggaaa

SEQ ID NO: 3678586 - RNA, 17 nt, Human
uuguucaaacaauauca

SEQ ID NO: 3678587 - RNA, 13 nt, Human
uuguucaaacauu

SEQ ID NO: 3678588 - RNA, 13 nt, Human
uuguucaacuauu

SEQ ID NO: 3678589 - RNA, 13 nt, Human
uuguucaaguuuu

SEQ ID NO: 3678590 - RNA, 19 nt, Human
uuguucaccauuauaauga

SEQ ID NO: 3678591 - RNA, 21 nt, Human
uuguuccaagacauugucaau

SEQ ID NO: 3678592 - RNA, 16 nt, Human
uuguuccaaugccaca

SEQ ID NO: 3678593 - RNA, 15 nt, Human
uuguuccccuccucc

SEQ ID NO: 3678594 - RNA, 23 nt, Human
uuguuccuuggagaaaugaaaac

SEQ ID NO: 3678595 - RNA, 16 nt, Human
uuguucucagaauccc

SEQ ID NO: 3678596 - RNA, 17 nt, Human
uuguucucucuauggua

SEQ ID NO: 3678597 - RNA, 18 nt, Human
uuguucucucuaugguaa

SEQ ID NO: 3678598 - RNA, 12 nt, Human
uuguucucuggg

SEQ ID NO: 3678599 - RNA, 23 nt, Human
uuguucugaaaugucaguucuga

SEQ ID NO: 3678600 - RNA, 16 nt, Human
uuguucuguuaacuga

SEQ ID NO: 3678601 - RNA, 18 nt, Human
uuguucuguuaacugaau

SEQ ID NO: 3678602 - RNA, 17 nt, Human
uuguucuuaauugcacu

SEQ ID NO: 3678603 - RNA, 15 nt, Human
uuguucuuacacaua

SEQ ID NO: 3678604 - RNA, 18 nt, Human
uuguucuuauucuggcau

SEQ ID NO: 3678605 - RNA, 14 nt, Human
uuguucuucuuaaa

SEQ ID NO: 3678606 - RNA, 19 nt, Human
uuguucuugguuuguaaau

SEQ ID NO: 3678607 - RNA, 15 nt, Human
uuguucuuguuuuua

SEQ ID NO: 3678608 - RNA, 16 nt, Human
uuguugaaaaaguuug

SEQ ID NO: 3678609 - RNA, 22 nt, Human
uuguugaaaaaguuuguuuuug

SEQ ID NO: 3678610 - RNA, 18 nt, Human
uuguugaaauuuugcaaa

SEQ ID NO: 3678611 - RNA, 17 nt, Human
uuguugaacagguguuu

SEQ ID NO: 3678612 - RNA, 22 nt, Human
uuguugaacuguuagaauguaa

SEQ ID NO: 3678613 - RNA, 12 nt, Human
uuguugacauua

SEQ ID NO: 3678614 - RNA, 15 nt, Human
uuguugacauucuga

SEQ ID NO: 3678615 - RNA, 17 nt, Human
uuguugacauucugaau

SEQ ID NO: 3678616 - RNA, 21 nt, Human
uuguugagguggucugaaugu

SEQ ID NO: 3678617 - RNA, 17 nt, Human
uuguugauucucuccau

SEQ ID NO: 3678618 - RNA, 22 nt, Human
uuguugcucccugugacaaaau

SEQ ID NO: 3678619 - RNA, 12 nt, Human
ucacauguuuuc

SEQ ID NO: 3678620 - RNA, 18 nt, Human
ucacauguuuucaaaugg

SEQ ID NO: 3678621 - RNA, 22 nt, Human
ucacauuaaaaaaugaaauauu

SEQ ID NO: 3678622 - RNA, 19 nt, Human
ucacauuaauggucuaaaa

SEQ ID NO: 3678623 - RNA, 15 nt, Human
ucacauuauuugcau

SEQ ID NO: 3678624 - RNA, 21 nt, Human
ucacauuccccuggggaccca

SEQ ID NO: 3678625 - RNA, 15 nt, Human
ucacauucuuauaaa

SEQ ID NO: 3678626 - RNA, 18 nt, Human
ucacauucuuauaaauau

SEQ ID NO: 3678627 - RNA, 20 nt, Human
ucacauucuuauaaauauga

SEQ ID NO: 3678628 - RNA, 21 nt, Human
ucacauucuuauaaauaugaa

SEQ ID NO: 3678629 - RNA, 21 nt, Human
ucacauucuuggcuuaaucau

SEQ ID NO: 3678630 - RNA, 21 nt, Human
ucacauugagcugauauaaau

SEQ ID NO: 3678631 - RNA, 12 nt, Human
ucacauugcauu

SEQ ID NO: 3678632 - RNA, 15 nt, Human
ucacauugcauucua

SEQ ID NO: 3678633 - RNA, 16 nt, Human
ucacauugcauucuau

SEQ ID NO: 3678634 - RNA, 22 nt, Human
ucacauugcauucuauugccuu

SEQ ID NO: 3678635 - RNA, 18 nt, Human
ucacauuguuaagaaaaa

SEQ ID NO: 3678636 - RNA, 11 nt, Human
ucacauuguuu

SEQ ID NO: 3678637 - RNA, 18 nt, Human
ucacauuguuugcugcua

SEQ ID NO: 3678638 - RNA, 16 nt, Human
ucacauuuuccuuuuc

SEQ ID NO: 3678639 - RNA, 22 nt, Human
ucacauuuuuauaccuguuuaa

SEQ ID NO: 3678640 - RNA, 17 nt, Human
ucacauuuuuuaugggc

SEQ ID NO: 3678641 - RNA, 15 nt, Human
ucaccaaaagacacu

SEQ ID NO: 3678642 - RNA, 18 nt, Human
ucaccaaaagacacugca

SEQ ID NO: 3678643 - RNA, 17 nt, Human
ucaccaaaguauuuuuu

SEQ ID NO: 3678644 - RNA, 17 nt, Human
ucaccaaauagugugaa

SEQ ID NO: 3678645 - RNA, 19 nt, Human
ucaccaaaucagcugcuac

SEQ ID NO: 3678646 - RNA, 16 nt, Human
ucaccaagcucacagu

SEQ ID NO: 3678647 - RNA, 12 nt, Human
ucaccaaggaaa

SEQ ID NO: 3678648 - RNA, 15 nt, Human
ucaccaauguaccca

SEQ ID NO: 3678649 - RNA, 23 nt, Human
ucaccaauguacccaccgggcca

SEQ ID NO: 3678650 - RNA, 19 nt, Human
ucaccacaguaaguuccua

SEQ ID NO: 3678651 - RNA, 20 nt, Human
ucaccacaugcggagaacaa

SEQ ID NO: 3678652 - RNA, 16 nt, Human
ucaccacaugugcaca

SEQ ID NO: 3678653 - RNA, 22 nt, Human
ucaccacucaaaggccagaccu

SEQ ID NO: 3678654 - RNA, 23 nt, Human
ucaccacucaaaggccagaccug

SEQ ID NO: 3678655 - RNA, 15 nt, Human
ucaccacuccauucc

SEQ ID NO: 3678656 - RNA, 21 nt, Human
ucaccacuucaauagaucaaa

SEQ ID NO: 3678657 - RNA, 18 nt, Human
ucaccagaauugugcaaa

SEQ ID NO: 3678658 - RNA, 15 nt, Human
ucaccagacggggcu

SEQ ID NO: 3678659 - RNA, 19 nt, Human
ucaccagaggaaucacucu

SEQ ID NO: 3678660 - RNA, 15 nt, Human
ucaccagauuugcua

SEQ ID NO: 3678661 - RNA, 21 nt, Human
ucaccagauuugcuaauuuau

SEQ ID NO: 3678662 - RNA, 19 nt, Human
ucaccagccccacugccag

SEQ ID NO: 3678663 - RNA, 16 nt, Human
ucaccagccccagugc

SEQ ID NO: 3678664 - RNA, 17 nt, Human
ucaccagccccagugcc

SEQ ID NO: 3678665 - RNA, 16 nt, Human
ucaccagcugcaaagu

SEQ ID NO: 3678666 - RNA, 21 nt, Human
ucaccagcugcaaaguguuuu

SEQ ID NO: 3678667 - RNA, 20 nt, Human
ucaccagcugccucuucugu

SEQ ID NO: 3678668 - RNA, 18 nt, Human
ucaccagcugcugcucug

SEQ ID NO: 3678669 - RNA, 22 nt, Human
ucaccaggaauguuaaagucag

SEQ ID NO: 3678670 - RNA, 19 nt, Human
ucaccaguacauucucagu

SEQ ID NO: 3678671 - RNA, 17 nt, Human
ucaccaguguccccucc

SEQ ID NO: 3678672 - RNA, 20 nt, Human
ucaccaguguccccuccacu

SEQ ID NO: 3678673 - RNA, 17 nt, Human
uuuuuaagugcugcauu

SEQ ID NO: 3678674 - RNA, 22 nt, Human
uuuuuaagugcugcauuuaaaa

SEQ ID NO: 3678675 - RNA, 18 nt, Human
uuuuuaaguuaauagauu

SEQ ID NO: 3678676 - RNA, 12 nt, Human
uuuuuaauagaa

SEQ ID NO: 3678677 - RNA, 13 nt, Human
uuuuuaauagaac

SEQ ID NO: 3678678 - RNA, 23 nt, Human
uuuuuaauagucauuccaaauau

SEQ ID NO: 3678679 - RNA, 14 nt, Human
uuuuuaauaugcuu

SEQ ID NO: 3678680 - RNA, 16 nt, Human
uuuuuaaucuagacaa

SEQ ID NO: 3678681 - RNA, 13 nt, Human
uuuuuaaucucca

SEQ ID NO: 3678682 - RNA, 13 nt, Human
uuuuuaaucuuua

SEQ ID NO: 3678683 - RNA, 13 nt, Human
uuuuuaaugcuau

SEQ ID NO: 3678684 - RNA, 10 nt, Human
uuuuuaaugg

SEQ ID NO: 3678685 - RNA, 19 nt, Human
uuuuuaaugugcuguguaa

SEQ ID NO: 3678686 - RNA, 20 nt, Human
uuuuuaauuguuguuucuuu

SEQ ID NO: 3678687 - RNA, 23 nt, Human
uuuuuaauuuacaaaaauauaaa

SEQ ID NO: 3678688 - RNA, 22 nt, Human
uuuuuaauuugaugaaagcuga

SEQ ID NO: 3678689 - RNA, 18 nt, Human
uuuuuaauuuuguauuuu

SEQ ID NO: 3678690 - RNA, 22 nt, Human
uuuuuacccauauccccucucc

SEQ ID NO: 3678691 - RNA, 15 nt, Human
uuuuuaccugucaca

SEQ ID NO: 3678692 - RNA, 21 nt, Human
uuuuuaccugucacauugcau

SEQ ID NO: 3678693 - RNA, 11 nt, Human
uuuuuacuaau

SEQ ID NO: 3678694 - RNA, 14 nt, Human
uuuuuacugaacaa

SEQ ID NO: 3678695 - RNA, 22 nt, Human
uuuuuagaauaagaauuugcau

SEQ ID NO: 3678696 - RNA, 15 nt, Human
uuuuuagaucaaaua

SEQ ID NO: 3678697 - RNA, 21 nt, Human
uuuuuagaucaaauacuuuaa

SEQ ID NO: 3678698 - RNA, 17 nt, Human
uuuuuagaugguuacac

SEQ ID NO: 3678699 - RNA, 20 nt, Human
uuuuuagaugguuacacugu

SEQ ID NO: 3678700 - RNA, 19 nt, Human
uuuuuagauugagaaaugu

SEQ ID NO: 3678701 - RNA, 20 nt, Human
uuuuuagauugagaaaugug

SEQ ID NO: 3678702 - RNA, 13 nt, Human
uuuuuaggaaaug

SEQ ID NO: 3678703 - RNA, 13 nt, Human
uuuuuaguaaucu

SEQ ID NO: 3678704 - RNA, 15 nt, Human
uuuuuaguaaucugu

SEQ ID NO: 3678705 - RNA, 12 nt, Human
uuuuuauaaaaa

SEQ ID NO: 3678706 - RNA, 20 nt, Human
uuuuuauacaaaccuaccaa

SEQ ID NO: 3678707 - RNA, 18 nt, Human
uuuuuauauagcuugaaa

SEQ ID NO: 3678708 - RNA, 21 nt, Human
uuuuuauaucaugcaaaauau

SEQ ID NO: 3678709 - RNA, 21 nt, Human
uuuuuauauucucagcagagu

SEQ ID NO: 3678710 - RNA, 22 nt, Human
uuuuuauauucucagcagagug

SEQ ID NO: 3678711 - RNA, 23 nt, Human
uuuuuaucuccccuucacaugca

SEQ ID NO: 3678712 - RNA, 13 nt, Human
uuuuuaucuuuuc

SEQ ID NO: 3678713 - RNA, 21 nt, Human
uuuuuaucuuuucuacagcaa

SEQ ID NO: 3678714 - RNA, 12 nt, Human
uuuuuaugugau

SEQ ID NO: 3678715 - RNA, 16 nt, Human
uuuuuaugugaucaau

SEQ ID NO: 3678716 - RNA, 23 nt, Human
uuuuuauuaaaauauuucagguu

SEQ ID NO: 3678717 - RNA, 21 nt, Human
uuuuuauuaaucacuguguau

SEQ ID NO: 3678718 - RNA, 14 nt, Human
uuuuuauuaauuua

SEQ ID NO: 3678719 - RNA, 23 nt, Human
uuuuuauuaauuuuaguuuuuca

SEQ ID NO: 3678720 - RNA, 14 nt, Human
uuuuuauucuugug

SEQ ID NO: 3678721 - RNA, 13 nt, Human
uuuuuauuuaaaa

SEQ ID NO: 3678722 - RNA, 14 nt, Human
uuuuuauuuaugaa

SEQ ID NO: 3678723 - RNA, 19 nt, Human
uuuuuauuuccuaugaugu

SEQ ID NO: 3678724 - RNA, 14 nt, Human
uuuuuauuucuccu

SEQ ID NO: 3678725 - RNA, 15 nt, Human
uuuuuauuucuuccu

SEQ ID NO: 3678726 - RNA, 19 nt, Human
uuuuuauuuguuugugcau

SEQ ID NO: 3678727 - RNA, 15 nt, Human
uuuuucaaaauagaa

SEQ ID NO: 3678728 - RNA, 21 nt, Human
uuuuucaaaauccaaaaagaa

SEQ ID NO: 3678729 - RNA, 9 nt, Human
uuuuucaac

SEQ ID NO: 3678730 - RNA, 20 nt, Human
uuuuucaauauauugaacuu

SEQ ID NO: 3678731 - RNA, 21 nt, Human
uuuuucaauuaaacggauuau

SEQ ID NO: 3678732 - RNA, 19 nt, Human
uuuuucacggaaguuuuca

SEQ ID NO: 3678733 - RNA, 18 nt, Human
uuuuucaguauuauaugu

SEQ ID NO: 3678734 - RNA, 14 nt, Human
uuuuucaguucaaa

SEQ ID NO: 3678735 - RNA, 18 nt, Human
uuuuucauaaacaaguuc

SEQ ID NO: 3678736 - RNA, 12 nt, Human
uuuuucaucccc

SEQ ID NO: 3678737 - RNA, 11 nt, Human
uuuuucaugau

SEQ ID NO: 3678738 - RNA, 20 nt, Human
uuuuucauguuuuaacaaaa

SEQ ID NO: 3678739 - RNA, 23 nt, Human
uuuuucauucaucccauuaauca

SEQ ID NO: 3678740 - RNA, 18 nt, Human
uuuuucauuuuaaaaagu

SEQ ID NO: 3678741 - RNA, 14 nt, Human
uuuuucauuuucca

SEQ ID NO: 3678742 - RNA, 16 nt, Human
uuuuucauuuuccaau

SEQ ID NO: 3678743 - RNA, 13 nt, Human
uuuuuccaaaaaa

SEQ ID NO: 3678744 - RNA, 19 nt, Human
uuuuuccaaaaaaauacug

SEQ ID NO: 3678745 - RNA, 14 nt, Human
uuuuuccaacugug

SEQ ID NO: 3678746 - RNA, 14 nt, Human
uuuuuccacuuugu

SEQ ID NO: 3678747 - RNA, 23 nt, Human
uuuuuccuaacaaaagaugaaag

SEQ ID NO: 3678748 - RNA, 14 nt, Human
uuuuuccuguccuu

SEQ ID NO: 3678749 - RNA, 15 nt, Human
uuuuuccuuacauaa

SEQ ID NO: 3678750 - RNA, 19 nt, Human
uuuuuccuucagugccuua

SEQ ID NO: 3678751 - RNA, 11 nt, Human
uuuuuccuuua

SEQ ID NO: 3678752 - RNA, 17 nt, Human
uuuuuccuuuuucugau

SEQ ID NO: 3678753 - RNA, 18 nt, Human
uuuuucuaaaacuaaaua

SEQ ID NO: 3678754 - RNA, 15 nt, Human
uuuuucuaagagaag

SEQ ID NO: 3678755 - RNA, 16 nt, Human
uuuuucuaagagaagu

SEQ ID NO: 3678756 - RNA, 15 nt, Human
uuuuucuauauuauu

SEQ ID NO: 3678757 - RNA, 19 nt, Human
uuuuucucaugaaucugca

SEQ ID NO: 3678758 - RNA, 18 nt, Human
uuuuucucucaacaccau

SEQ ID NO: 3678759 - RNA, 16 nt, Human
uuuuucugauuagcuu

SEQ ID NO: 3678760 - RNA, 22 nt, Human
uuuuucugcacuauaugcaaac

SEQ ID NO: 3678761 - RNA, 13 nt, Human
uuuuucugcagaa

SEQ ID NO: 3678762 - RNA, 12 nt, Human
uuuuucugccuc

SEQ ID NO: 3678763 - RNA, 13 nt, Human
uuuuucugccucc

SEQ ID NO: 3678764 - RNA, 15 nt, Human
agaaguuaagcaaca

SEQ ID NO: 3678765 - RNA, 14 nt, Human
agaaguuacugaau

SEQ ID NO: 3678766 - RNA, 15 nt, Human
agaaguucuaguguu

SEQ ID NO: 3678767 - RNA, 17 nt, Human
agaaguucuaguguuuu

SEQ ID NO: 3678768 - RNA, 20 nt, Human
agaaguucuuugauucugua

SEQ ID NO: 3678769 - RNA, 21 nt, Human
agaaguuguaaaguauguauu

SEQ ID NO: 3678770 - RNA, 12 nt, Human
agaaguuuaaau

SEQ ID NO: 3678771 - RNA, 16 nt, Human
agaaguuuagauuuua

SEQ ID NO: 3678772 - RNA, 18 nt, Human
agaaguuuagauuuuaau

SEQ ID NO: 3678773 - RNA, 21 nt, Human
agaaguuucaucauuuuuuac

SEQ ID NO: 3678774 - RNA, 14 nt, Human
agaaguuucccuuc

SEQ ID NO: 3678775 - RNA, 23 nt, Human
agaaguuucugccgcagcccugc

SEQ ID NO: 3678776 - RNA, 20 nt, Human
agaaguuugauauuaaagga

SEQ ID NO: 3678777 - RNA, 21 nt, Human
agaaguuugcacuaucuuuca

SEQ ID NO: 3678778 - RNA, 23 nt, Human
agaaguuugcacuaucuuucagc

SEQ ID NO: 3678779 - RNA, 15 nt, Human
agaaguuuguccauu

SEQ ID NO: 3678780 - RNA, 16 nt, Human
agaaguuuuaaauuuu

SEQ ID NO: 3678781 - RNA, 11 nt, Human
agaaguuuuug

SEQ ID NO: 3678782 - RNA, 12 nt, Human
agaaguuuuugu

SEQ ID NO: 3678783 - RNA, 20 nt, Human
agaaguuuuuguacuguaaa

SEQ ID NO: 3678784 - RNA, 12 nt, Human
agaauaaaauug

SEQ ID NO: 3678785 - RNA, 14 nt, Human
agaauaaaauuuuu

SEQ ID NO: 3678786 - RNA, 16 nt, Human
agaauaaaccaagaau

SEQ ID NO: 3678787 - RNA, 20 nt, Human
agaauaaacuuacauauuua

SEQ ID NO: 3678788 - RNA, 13 nt, Human
agaauaaagcaau

SEQ ID NO: 3678789 - RNA, 18 nt, Human
agaauaaagcaauuuucc

SEQ ID NO: 3678790 - RNA, 19 nt, Human
agaauaaagcaauuuuccu

SEQ ID NO: 3678791 - RNA, 20 nt, Human
agaauaaagcaauuuuccuu

SEQ ID NO: 3678792 - RNA, 22 nt, Human
agaauaaagcaauuuuccuuga

SEQ ID NO: 3678793 - RNA, 23 nt, Human
agaauaaagccuugugaucacuu

SEQ ID NO: 3678794 - RNA, 14 nt, Human
agaauaaaggcagu

SEQ ID NO: 3678795 - RNA, 18 nt, Human
agaauaaaggcaguuuuc

SEQ ID NO: 3678796 - RNA, 21 nt, Human
agaauaaaggcaguuuucuaa

SEQ ID NO: 3678797 - RNA, 17 nt, Human
agaauaaaguucugagu

SEQ ID NO: 3678798 - RNA, 16 nt, Human
agaauaagaauuugca

SEQ ID NO: 3678799 - RNA, 17 nt, Human
agaauaagaauuugcau

SEQ ID NO: 3678800 - RNA, 16 nt, Human
agaauaagagaaagaa

SEQ ID NO: 3678801 - RNA, 21 nt, Human
agaauaagagaaagaaaauga

SEQ ID NO: 3678802 - RNA, 13 nt, Human
agaauaaguuauu

SEQ ID NO: 3678803 - RNA, 14 nt, Human
agaauaaguuauug

SEQ ID NO: 3678804 - RNA, 16 nt, Human
agaauaaguuauugca

SEQ ID NO: 3678805 - RNA, 19 nt, Human
agaauaaguuauugcaguu

SEQ ID NO: 3678806 - RNA, 21 nt, Human
agaauaaguuauugcaguuua

SEQ ID NO: 3678807 - RNA, 23 nt, Human
agaauaauaugcugccaaauuuu

SEQ ID NO: 3678808 - RNA, 13 nt, Human
agaauaaucuuug

SEQ ID NO: 3678809 - RNA, 21 nt, Human
agaauaaugugggaagaaaca

SEQ ID NO: 3678810 - RNA, 17 nt, Human
agaauaauuuauaguaa

SEQ ID NO: 3678811 - RNA, 22 nt, Human
agaauaauuuauaguaaugagu

SEQ ID NO: 3678812 - RNA, 15 nt, Human
agaauaauuugguau

SEQ ID NO: 3678813 - RNA, 15 nt, Human
agaauacaaacauau

SEQ ID NO: 3678814 - RNA, 18 nt, Human
agaauacagaaagaugga

SEQ ID NO: 3678815 - RNA, 21 nt, Human
agaauacagaaagauggaugu

SEQ ID NO: 3678816 - RNA, 16 nt, Human
agaauacagcuuucug

SEQ ID NO: 3678817 - RNA, 18 nt, Human
agaauacaguaagcugcu

SEQ ID NO: 3678818 - RNA, 11 nt, Human
agaauacugau

SEQ ID NO: 3678819 - RNA, 19 nt, Human
agaauacuguuaaaggaaa

SEQ ID NO: 3678820 - RNA, 20 nt, Human
agaauacuguuaaaggaaaa

SEQ ID NO: 3678821 - RNA, 19 nt, Human
agaauacuucucauuuuuu

SEQ ID NO: 3678822 - RNA, 12 nt, Human
agaauacuugaa

SEQ ID NO: 3678823 - RNA, 16 nt, Human
agaauacuugaacuug

SEQ ID NO: 3678824 - RNA, 14 nt, Human
agaauacuuuuuaa

SEQ ID NO: 3678825 - RNA, 13 nt, Human
agaauagaaagaa

SEQ ID NO: 3678826 - RNA, 19 nt, Human
agaauagaacaacauauac

SEQ ID NO: 3678827 - RNA, 21 nt, Human
agaauagaacaacauauacaa

SEQ ID NO: 3678828 - RNA, 14 nt, Human
agaauagaagcuaa

SEQ ID NO: 3678829 - RNA, 17 nt, Human
agaauagccacauuugg

SEQ ID NO: 3678830 - RNA, 20 nt, Human
agaauagccacauuuggaau

SEQ ID NO: 3678831 - RNA, 17 nt, Human
agaauaggacuuguuuu

SEQ ID NO: 3678832 - RNA, 18 nt, Human
agaauaggcacuuuaaaa

SEQ ID NO: 3678833 - RNA, 14 nt, Human
agaauauaacauga

SEQ ID NO: 3678834 - RNA, 21 nt, Human
agaauauaacaugaaaugaua

SEQ ID NO: 3678835 - RNA, 23 nt, Human
agaauauaauuaucggaagcagu

SEQ ID NO: 3678836 - RNA, 11 nt, Human
agaauauauau

SEQ ID NO: 3678837 - RNA, 18 nt, Human
agaauauauuuauuuaaa

SEQ ID NO: 3678838 - RNA, 21 nt, Human
agaauauauuuauuuaaagca

SEQ ID NO: 3678839 - RNA, 17 nt, Human
agaauauccaugaccua

SEQ ID NO: 3678840 - RNA, 21 nt, Human
agaauauccuuuaaaauuuaa

SEQ ID NO: 3678841 - RNA, 16 nt, Human
agaauaugacuuuuua

SEQ ID NO: 3678842 - RNA, 14 nt, Human
agaauaugucagug

SEQ ID NO: 3678843 - RNA, 18 nt, Human
agaauauguuucaaacuu

SEQ ID NO: 3678844 - RNA, 19 nt, Human
agaauauguuucaaacuuu

SEQ ID NO: 3678845 - RNA, 21 nt, Human
agaauauguuucaaacuuugg

SEQ ID NO: 3678846 - RNA, 13 nt, Human
agaauauucagga

SEQ ID NO: 3678847 - RNA, 15 nt, Human
agaauauucaggacu

SEQ ID NO: 3678848 - RNA, 22 nt, Human
agaauauugaaguacuugccag

SEQ ID NO: 3678849 - RNA, 19 nt, Human
agaauauugcaaaauacau

SEQ ID NO: 3678850 - RNA, 13 nt, Human
agaauauuguauu

SEQ ID NO: 3678851 - RNA, 15 nt, Human
agaauauuguauugu

SEQ ID NO: 3678852 - RNA, 12 nt, Human
agaauauugucc

SEQ ID NO: 3678853 - RNA, 14 nt, Human
agaauauuguuccu

SEQ ID NO: 3678854 - RNA, 20 nt, Human
agaauauuguuccuaaguuc

SEQ ID NO: 3678855 - RNA, 22 nt, Human
agaauauuguuccuaaguucuu

SEQ ID NO: 3678856 - RNA, 22 nt, Human
agaauauuuauuaccucugaua

SEQ ID NO: 3678857 - RNA, 13 nt, Human
agaauauuucuau

SEQ ID NO: 3678858 - RNA, 19 nt, Human
agaauauuugguuuuccug

SEQ ID NO: 3678859 - RNA, 19 nt, Human
agaauauuuuaaguauugc

SEQ ID NO: 3678860 - RNA, 14 nt, Human
agaaucaaaacucu

SEQ ID NO: 3678861 - RNA, 13 nt, Human
agaaucaaagcaa

SEQ ID NO: 3678862 - RNA, 19 nt, Human
agaaucaaagcaaugcauu

SEQ ID NO: 3678863 - RNA, 14 nt, Human
agaaucacuugaac

SEQ ID NO: 3678864 - RNA, 17 nt, Human
agaaucacuugaacccg

SEQ ID NO: 3678865 - RNA, 16 nt, Human
agaaucagaagauagu

SEQ ID NO: 3678866 - RNA, 13 nt, Human
agaaucagccuag

SEQ ID NO: 3678867 - RNA, 22 nt, Human
agaaucagucuauccacagaga

SEQ ID NO: 3678868 - RNA, 21 nt, Human
agaaucaugugaacccgggac

SEQ ID NO: 3678869 - RNA, 18 nt, Human
agaaucauguuucuuuga

SEQ ID NO: 3678870 - RNA, 21 nt, Human
agaaucauguuucuuugauca

SEQ ID NO: 3678871 - RNA, 12 nt, Human
agaauccaaacu

SEQ ID NO: 3678872 - RNA, 16 nt, Human
agaauccaaacuugga

SEQ ID NO: 3678873 - RNA, 21 nt, Human
agaauccaaacuuggauuuuu

SEQ ID NO: 3678874 - RNA, 16 nt, Human
agaauccacauuucua

SEQ ID NO: 3678875 - RNA, 17 nt, Human
agaauccacauuucuaa

SEQ ID NO: 3678876 - RNA, 19 nt, Human
agaauccacauuucuaaaa

SEQ ID NO: 3678877 - RNA, 20 nt, Human
agaauccacauuucuaaaau

SEQ ID NO: 3678878 - RNA, 20 nt, Human
agaauccagcaccggcccca

SEQ ID NO: 3678879 - RNA, 19 nt, Human
agaaucccaaauuugauug

SEQ ID NO: 3678880 - RNA, 18 nt, Human
agaaucccacuuucuaua

SEQ ID NO: 3678881 - RNA, 21 nt, Human
agaaucccagcccccugacca

SEQ ID NO: 3678882 - RNA, 16 nt, Human
agaaucccuagacuuu

SEQ ID NO: 3678883 - RNA, 18 nt, Human
agaaucccuggcaaaggg

SEQ ID NO: 3678884 - RNA, 17 nt, Human
agaaucccuguguuaau

SEQ ID NO: 3678885 - RNA, 21 nt, Human
agaaucccuguguuaauuuaa

SEQ ID NO: 3678886 - RNA, 16 nt, Human
agaauccuuuuguaga

SEQ ID NO: 3678887 - RNA, 17 nt, Human
agaaucgaggugcuguu

SEQ ID NO: 3678888 - RNA, 17 nt, Human
agaaucuacccaaagga

SEQ ID NO: 3678889 - RNA, 19 nt, Human
agaaucuacccaaaggaua

SEQ ID NO: 3678890 - RNA, 13 nt, Human
agaaucuauuuuc

SEQ ID NO: 3678891 - RNA, 21 nt, Human
agaaucuauuuucuauguacu

SEQ ID NO: 3678892 - RNA, 22 nt, Human
agaaucuauuuucuauguacua

SEQ ID NO: 3678893 - RNA, 17 nt, Human
agaaucucaaauaacua

SEQ ID NO: 3678894 - RNA, 18 nt, Human
agaaucucaacaugucuc

SEQ ID NO: 3678895 - RNA, 16 nt, Human
agaaucuggagagcua

SEQ ID NO: 3678896 - RNA, 22 nt, Human
agaaucuuguuuugaaaauaac

SEQ ID NO: 3678897 - RNA, 16 nt, Human
agaaucuuuauugaga

SEQ ID NO: 3678898 - RNA, 19 nt, Human
agaaucuuuauugagaaag

SEQ ID NO: 3678899 - RNA, 15 nt, Human
agaaugaaaaaugaa

SEQ ID NO: 3678900 - RNA, 21 nt, Human
agaaugaaagaguaaaggaaa

SEQ ID NO: 3678901 - RNA, 15 nt, Human
agaaugaaagcuccu

SEQ ID NO: 3678902 - RNA, 16 nt, Human
agaaugaaauguaugu

SEQ ID NO: 3678903 - RNA, 13 nt, Human
agaaugaacaaag

SEQ ID NO: 3678904 - RNA, 18 nt, Human
agaaugaagguuuuugua

SEQ ID NO: 3678905 - RNA, 20 nt, Human
agaaugaagguuuuuguaaa

SEQ ID NO: 3678906 - RNA, 15 nt, Human
agaaugaccuuguaa

SEQ ID NO: 3678907 - RNA, 17 nt, Human
agaaugaccuuguaaug

SEQ ID NO: 3678908 - RNA, 23 nt, Human
agaaugaccuuguaauguaacug

SEQ ID NO: 3678909 - RNA, 16 nt, Human
agaccugagcucccca

SEQ ID NO: 3678910 - RNA, 16 nt, Human
agaccugauccuggag

SEQ ID NO: 3678911 - RNA, 21 nt, Human
agaccugauccuggaggccca

SEQ ID NO: 3678912 - RNA, 19 nt, Human
agaccugcagacgcccaga

SEQ ID NO: 3678913 - RNA, 22 nt, Human
agaccugccccuccucucugcc

SEQ ID NO: 3678914 - RNA, 23 nt, Human
agaccugccccuccucucugccc

SEQ ID NO: 3678915 - RNA, 22 nt, Human
agaccugcccucaagagcaaag

SEQ ID NO: 3678916 - RNA, 23 nt, Human
agaccugcuuuuugaaaugaaau

SEQ ID NO: 3678917 - RNA, 16 nt, Human
agaccuggacacaggc

SEQ ID NO: 3678918 - RNA, 18 nt, Human
agaccuggacacaggccu

SEQ ID NO: 3678919 - RNA, 16 nt, Human
agaccuggcagcucug

SEQ ID NO: 3678920 - RNA, 17 nt, Human
agaccuggcagcucugg

SEQ ID NO: 3678921 - RNA, 23 nt, Human
agaccuggcagcucuggacagcc

SEQ ID NO: 3678922 - RNA, 20 nt, Human
agaccuggggcugcugugaa

SEQ ID NO: 3678923 - RNA, 13 nt, Human
agaccuguaauca

SEQ ID NO: 3678924 - RNA, 18 nt, Human
agaccuguuagcagacag

SEQ ID NO: 3678925 - RNA, 11 nt, Human
agaccuuaccc

SEQ ID NO: 3678926 - RNA, 23 nt, Human
agaccuuccauaaugcuacuguc

SEQ ID NO: 3678927 - RNA, 11 nt, Human
agaccuucucc

SEQ ID NO: 3678928 - RNA, 18 nt, Human
agaccuucuccuucaccu

SEQ ID NO: 3678929 - RNA, 16 nt, Human
agaccuuguucacacu

SEQ ID NO: 3678930 - RNA, 19 nt, Human
agaccuuucaaagccauuu

SEQ ID NO: 3678931 - RNA, 19 nt, Human
agaccuuuuaacuccucaa

SEQ ID NO: 3678932 - RNA, 22 nt, Human
agaccuuuuggcccaaucucug

SEQ ID NO: 3678933 - RNA, 16 nt, Human
agaccuuuuuuaggaa

SEQ ID NO: 3678934 - RNA, 20 nt, Human
agaccuuuuuuuuuuuucca

SEQ ID NO: 3678935 - RNA, 14 nt, Human
agacgaacauguag

SEQ ID NO: 3678936 - RNA, 20 nt, Human
agacgaggcccucgggccca

SEQ ID NO: 3678937 - RNA, 20 nt, Human
agacgauaguuaucuguucu

SEQ ID NO: 3678938 - RNA, 17 nt, Human
agacgaugucuucauac

SEQ ID NO: 3678939 - RNA, 19 nt, Human
agacgaugucuucauaccu

SEQ ID NO: 3678940 - RNA, 17 nt, Human
agacgauuugucaguua

SEQ ID NO: 3678941 - RNA, 23 nt, Human
agacgcacuuuggcuuauaauuc

SEQ ID NO: 3678942 - RNA, 22 nt, Human
agacgccggggacagaggccug

SEQ ID NO: 3678943 - RNA, 15 nt, Human
agacgccugagcuca

SEQ ID NO: 3678944 - RNA, 17 nt, Human
agacgcugugcugcccu

SEQ ID NO: 3678945 - RNA, 18 nt, Human
agacgcugugcugcccug

SEQ ID NO: 3678946 - RNA, 19 nt, Human
agacgcugugcugcccugc

SEQ ID NO: 3678947 - RNA, 21 nt, Human
agacgcugugcugcccugccc

SEQ ID NO: 3678948 - RNA, 18 nt, Human
agacggaaggguaaacaa

SEQ ID NO: 3678949 - RNA, 21 nt, Human
agacggaggccuacucuucca

SEQ ID NO: 3678950 - RNA, 18 nt, Human
agacggagucccaccuug

SEQ ID NO: 3678951 - RNA, 18 nt, Human
agacgggaggccuggccu

SEQ ID NO: 3678952 - RNA, 18 nt, Human
agacgggggcagagaggg

SEQ ID NO: 3678953 - RNA, 21 nt, Human
agacggugucuuguucuguca

SEQ ID NO: 3678954 - RNA, 16 nt, Human
agacgguguuuugcca

SEQ ID NO: 3678955 - RNA, 20 nt, Human
agacguacguaucagcggcc

SEQ ID NO: 3678956 - RNA, 21 nt, Human
agagagaaaacuuauuugagu

SEQ ID NO: 3678957 - RNA, 14 nt, Human
agagagaaaauaaa

SEQ ID NO: 3678958 - RNA, 16 nt, Human
agagagaaagccaggc

SEQ ID NO: 3678959 - RNA, 21 nt, Human
agagagaaccuaacuguaucu

SEQ ID NO: 3678960 - RNA, 15 nt, Human
agagagaagugcccc

SEQ ID NO: 3678961 - RNA, 19 nt, Human
agagagaagugccccugcu

SEQ ID NO: 3678962 - RNA, 20 nt, Human
agagagacacagcugcagag

SEQ ID NO: 3678963 - RNA, 12 nt, Human
agagagagaaaa

SEQ ID NO: 3678964 - RNA, 10 nt, Human
agagagagag

SEQ ID NO: 3678965 - RNA, 15 nt, Human
agagagagagagaaa

SEQ ID NO: 3678966 - RNA, 15 nt, Human
agagagagagagaga

SEQ ID NO: 3678967 - RNA, 14 nt, Human
agagagauguguaa

SEQ ID NO: 3678968 - RNA, 19 nt, Human
agagagcaagacgcugugc

SEQ ID NO: 3678969 - RNA, 18 nt, Human
agagagcaccccucucug

SEQ ID NO: 3678970 - RNA, 13 nt, Human
agagagccauuuu

SEQ ID NO: 3678971 - RNA, 15 nt, Human
agagagccauuuugu

SEQ ID NO: 3678972 - RNA, 17 nt, Human
agagagccauuuuguga

SEQ ID NO: 3678973 - RNA, 23 nt, Human
agagagccuugguucaucagugu

SEQ ID NO: 3678974 - RNA, 22 nt, Human
agagagcgcagccgccuucaca

SEQ ID NO: 3678975 - RNA, 16 nt, Human
agagagcggucucagg

SEQ ID NO: 3678976 - RNA, 11 nt, Human
agagagcuggu

SEQ ID NO: 3678977 - RNA, 17 nt, Human
agagagcuguucccaaa

SEQ ID NO: 3678978 - RNA, 18 nt, Human
agagagcuuaaugauaau

SEQ ID NO: 3678979 - RNA, 14 nt, Human
agagaggaaucaga

SEQ ID NO: 3678980 - RNA, 13 nt, Human
agagaggacagcu

SEQ ID NO: 3678981 - RNA, 18 nt, Human
agagaggacgugggcggc

SEQ ID NO: 3678982 - RNA, 13 nt, Human
agagaggagagga

SEQ ID NO: 3678983 - RNA, 14 nt, Human
agagaggagccaga

SEQ ID NO: 3678984 - RNA, 13 nt, Human
agagaggagucag

SEQ ID NO: 3678985 - RNA, 14 nt, Human
agagaggaguucaa

SEQ ID NO: 3678986 - RNA, 15 nt, Human
agagaggaguucaau

SEQ ID NO: 3678987 - RNA, 13 nt, Human
agagaggcagaga

SEQ ID NO: 3678988 - RNA, 15 nt, Human
agagaggcagagagc

SEQ ID NO: 3678989 - RNA, 20 nt, Human
agagaggccuuuuggaaugu

SEQ ID NO: 3678990 - RNA, 19 nt, Human
agagaggcuaaaauguuuu

SEQ ID NO: 3678991 - RNA, 18 nt, Human
agagagggaauucucuug

SEQ ID NO: 3678992 - RNA, 15 nt, Human
agagagggagaagaa

SEQ ID NO: 3678993 - RNA, 15 nt, Human
agagagggcagaggg

SEQ ID NO: 3678994 - RNA, 15 nt, Human
agagagggcuuuaau

SEQ ID NO: 3678995 - RNA, 19 nt, Human
agagagggguacauuuccc

SEQ ID NO: 3678996 - RNA, 23 nt, Human
agagagggugaguccuccagaac

SEQ ID NO: 3678997 - RNA, 20 nt, Human
agagaggguggugaccucug

SEQ ID NO: 3678998 - RNA, 22 nt, Human
agagagguuugcagucccaagc

SEQ ID NO: 3678999 - RNA, 22 nt, Human
agagaguaauggguuucauauu

SEQ ID NO: 3679000 - RNA, 13 nt, Human
agagaguggcugg

SEQ ID NO: 3679001 - RNA, 14 nt, Human
agagauacucuggg

SEQ ID NO: 3679002 - RNA, 16 nt, Human
agagauagccuguggc

SEQ ID NO: 3679003 - RNA, 23 nt, Human
agagauaggaaggucauuuccau

SEQ ID NO: 3679004 - RNA, 14 nt, Human
agagauauaucuga

SEQ ID NO: 3679005 - RNA, 20 nt, Human
agagauauguagaaggcaca

SEQ ID NO: 3679006 - RNA, 20 nt, Human
agagauauuuuaaaaugaga

SEQ ID NO: 3679007 - RNA, 15 nt, Human
agagauauuuugggc

SEQ ID NO: 3679008 - RNA, 23 nt, Human
agagauauuuugggcaugugggc

SEQ ID NO: 3679009 - RNA, 14 nt, Human
agagauauuuugua

SEQ ID NO: 3679010 - RNA, 15 nt, Human
agagaucaaauggaa

SEQ ID NO: 3679011 - RNA, 19 nt, Human
agagaucaaauggaaagga

SEQ ID NO: 3679012 - RNA, 19 nt, Human
agagaucaggaagagaagg

SEQ ID NO: 3679013 - RNA, 20 nt, Human
agagaucaggaagagaagga

SEQ ID NO: 3679014 - RNA, 18 nt, Human
agagauccaaaagaagcc

SEQ ID NO: 3679015 - RNA, 13 nt, Human
agagauccaaaga

SEQ ID NO: 3679016 - RNA, 12 nt, Human
agagaugaauua

SEQ ID NO: 3679017 - RNA, 17 nt, Human
agagaugacugaguccu

SEQ ID NO: 3679018 - RNA, 17 nt, Human
agagaugccuccaccgc

SEQ ID NO: 3679019 - RNA, 13 nt, Human
agagaugccuccc

SEQ ID NO: 3679020 - RNA, 18 nt, Human
agagaugccucccugagc

SEQ ID NO: 3679021 - RNA, 15 nt, Human
agagauggaggagga

SEQ ID NO: 3679022 - RNA, 21 nt, Human
agagaugggagcuccucuccu

SEQ ID NO: 3679023 - RNA, 13 nt, Human
agagauguguaau

SEQ ID NO: 3679024 - RNA, 14 nt, Human
agagauguguguug

SEQ ID NO: 3679025 - RNA, 21 nt, Human
agagauguguguugauacugu

SEQ ID NO: 3679026 - RNA, 22 nt, Human
agagauguuuuuaaaaguuuca

SEQ ID NO: 3679027 - RNA, 14 nt, Human
agagauugcuaauu

SEQ ID NO: 3679028 - RNA, 15 nt, Human
agagauugcuucuca

SEQ ID NO: 3679029 - RNA, 22 nt, Human
agagauuggaaugggcagcuca

SEQ ID NO: 3679030 - RNA, 20 nt, Human
agagauuggaucaaguauua

SEQ ID NO: 3679031 - RNA, 23 nt, Human
agagauuggguuuuuggacuucu

SEQ ID NO: 3679032 - RNA, 12 nt, Human
agagauuucuca

SEQ ID NO: 3679033 - RNA, 17 nt, Human
agagauuugucuaauug

SEQ ID NO: 3679034 - RNA, 22 nt, Human
agagauuuuuuuguuguuuguu

SEQ ID NO: 3679035 - RNA, 17 nt, Human
agagauuuuuuuuuaaa

SEQ ID NO: 3679036 - RNA, 18 nt, Human
agagcaaaauaauuuuaa

SEQ ID NO: 3679037 - RNA, 15 nt, Human
agagcaaagggccag

SEQ ID NO: 3679038 - RNA, 22 nt, Human
agagcaaccccuggaccccagc

SEQ ID NO: 3679039 - RNA, 15 nt, Human
agagcaagacucugu

SEQ ID NO: 3679040 - RNA, 20 nt, Human
agagcaagagagcagcaagg

SEQ ID NO: 3679041 - RNA, 17 nt, Human
agagcaaggaagguaaa

SEQ ID NO: 3679042 - RNA, 14 nt, Human
agagcacagcccuc

SEQ ID NO: 3679043 - RNA, 14 nt, Human
agagcacugccacc

SEQ ID NO: 3679044 - RNA, 15 nt, Human
agagcacuuaagaga

SEQ ID NO: 3679045 - RNA, 19 nt, Human
agagcacuuaagagaauau

SEQ ID NO: 3679046 - RNA, 20 nt, Human
agagcacuuaagagaauauu

SEQ ID NO: 3679047 - RNA, 14 nt, Human
agagcagagaauau

SEQ ID NO: 3679048 - RNA, 15 nt, Human
agagcagaugcagag

SEQ ID NO: 3679049 - RNA, 16 nt, Human
agagcagcaccuccuc

SEQ ID NO: 3679050 - RNA, 23 nt, Human
agagcagcagugaaaacaagugc

SEQ ID NO: 3679051 - RNA, 17 nt, Human
agagcagccuguggcau

SEQ ID NO: 3679052 - RNA, 21 nt, Human
agagcagcuuuaaacucaggg

SEQ ID NO: 3679053 - RNA, 13 nt, Human
agagcaggaccuc

SEQ ID NO: 3679054 - RNA, 23 nt, Human
agagcaggaggccccuggcccag

SEQ ID NO: 3679055 - RNA, 15 nt, Human
agagcaggccaggcg

SEQ ID NO: 3679056 - RNA, 22 nt, Human
agagcagggauuaaccucugca

SEQ ID NO: 3679057 - RNA, 13 nt, Human
agagcagggcaag

SEQ ID NO: 3679058 - RNA, 19 nt, Human
agagcaguaccagcgcucu

SEQ ID NO: 3679059 - RNA, 20 nt, Human
agagcagugaagacuagaaa

SEQ ID NO: 3679060 - RNA, 13 nt, Human
agagcagugcuuu

SEQ ID NO: 3679061 - RNA, 22 nt, Human
agagcaguuucuguccugcugg

SEQ ID NO: 3679062 - RNA, 23 nt, Human
agagcaguuugguuucuagcaug

SEQ ID NO: 3679063 - RNA, 14 nt, Human
agagcauaauuuaa

SEQ ID NO: 3679064 - RNA, 18 nt, Human
agagcauaauuuaaaaau

SEQ ID NO: 3679065 - RNA, 21 nt, Human
agagcauaauuuaaaaauaua

SEQ ID NO: 3679066 - RNA, 13 nt, Human
agagcauaggguc

SEQ ID NO: 3679067 - RNA, 14 nt, Human
agagcaucaugccu

SEQ ID NO: 3679068 - RNA, 17 nt, Human
agagcaucaugccucug

SEQ ID NO: 3679069 - RNA, 19 nt, Human
agagcaucaugccucugag

SEQ ID NO: 3679070 - RNA, 19 nt, Human
agagcauuacgugagccag

SEQ ID NO: 3679071 - RNA, 20 nt, Human
agagcauuacgugagccagg

SEQ ID NO: 3679072 - RNA, 16 nt, Human
agagcauuccagucag

SEQ ID NO: 3679073 - RNA, 17 nt, Human
agagcauuccagucagg

SEQ ID NO: 3679074 - RNA, 15 nt, Human
agagcauugccauuc

SEQ ID NO: 3679075 - RNA, 18 nt, Human
agagcauugccauucccu

SEQ ID NO: 3679076 - RNA, 21 nt, Human
agagccacaaaagaaaagacu

SEQ ID NO: 3679077 - RNA, 20 nt, Human
agagccacaggucuuuaugu

SEQ ID NO: 3679078 - RNA, 15 nt, Human
agagccaccaagagg

SEQ ID NO: 3679079 - RNA, 19 nt, Human
agagccaccaagagggacg

SEQ ID NO: 3679080 - RNA, 15 nt, Human
agagccacugccauu

SEQ ID NO: 3679081 - RNA, 22 nt, Human
agagccagaaccuggagggcua

SEQ ID NO: 3679082 - RNA, 13 nt, Human
agagccagaccaa

SEQ ID NO: 3679083 - RNA, 15 nt, Human
agagccagagaagug

SEQ ID NO: 3679084 - RNA, 17 nt, Human
agagccagagaagugac

SEQ ID NO: 3679085 - RNA, 20 nt, Human
agagccagagaagugacagg

SEQ ID NO: 3679086 - RNA, 13 nt, Human
agagccagcaacu

SEQ ID NO: 3679087 - RNA, 12 nt, Human
agagccagcccu

SEQ ID NO: 3679088 - RNA, 13 nt, Human
agagccagcccuc

SEQ ID NO: 3679089 - RNA, 21 nt, Human
agagccagcccucccuguccu

SEQ ID NO: 3679090 - RNA, 22 nt, Human
agagccagcccucccuguccuc

SEQ ID NO: 3679091 - RNA, 11 nt, Human
agagccagcuu

SEQ ID NO: 3679092 - RNA, 15 nt, Human
agagccaggagaagc

SEQ ID NO: 3679093 - RNA, 16 nt, Human
agagccaggagaagcu

SEQ ID NO: 3679094 - RNA, 13 nt, Human
agagccaggcaca

SEQ ID NO: 3679095 - RNA, 19 nt, Human
agagccaggcacacacugu

SEQ ID NO: 3679096 - RNA, 20 nt, Human
agagccaggcacacacugug

SEQ ID NO: 3679097 - RNA, 22 nt, Human
agagccaggggggugaggagcu

SEQ ID NO: 3679098 - RNA, 13 nt, Human
agagccagggucu

SEQ ID NO: 3679099 - RNA, 13 nt, Human
agagccauacaua

SEQ ID NO: 3679100 - RNA, 21 nt, Human
agagccauacauaaaagaaau

SEQ ID NO: 3679101 - RNA, 22 nt, Human
agagccauauaaguuugaagga

SEQ ID NO: 3679102 - RNA, 22 nt, Human
agagccaugucuucucccugga

SEQ ID NO: 3679103 - RNA, 17 nt, Human
agagccauuuugugaau

SEQ ID NO: 3679104 - RNA, 13 nt, Human
agagcccaccuug

SEQ ID NO: 3679105 - RNA, 16 nt, Human
agagcccacgccccca

SEQ ID NO: 3679106 - RNA, 18 nt, Human
agagcccacgcccccacu

SEQ ID NO: 3679107 - RNA, 23 nt, Human
agauguaauguuuucuuugcaaa

SEQ ID NO: 3679108 - RNA, 14 nt, Human
agauguaauuuugu

SEQ ID NO: 3679109 - RNA, 15 nt, Human
agauguaauuuugug

SEQ ID NO: 3679110 - RNA, 18 nt, Human
agauguacgacuugcaua

SEQ ID NO: 3679111 - RNA, 20 nt, Human
agauguagacaguuggguuu

SEQ ID NO: 3679112 - RNA, 16 nt, Human
agauguagaggagaaa

SEQ ID NO: 3679113 - RNA, 15 nt, Human
agauguagauuuauu

SEQ ID NO: 3679114 - RNA, 21 nt, Human
agauguagcaaaacgcaugga

SEQ ID NO: 3679115 - RNA, 21 nt, Human
agauguagcaaacccugucaa

SEQ ID NO: 3679116 - RNA, 22 nt, Human
agauguagcaaacccugucaaa

SEQ ID NO: 3679117 - RNA, 23 nt, Human
agauguagcaaacccugucaaac

SEQ ID NO: 3679118 - RNA, 13 nt, Human
agauguaggaggg

SEQ ID NO: 3679119 - RNA, 17 nt, Human
agauguauccuuccaau

SEQ ID NO: 3679120 - RNA, 15 nt, Human
agauguaugaaggcu

SEQ ID NO: 3679121 - RNA, 14 nt, Human
agauguaugcacac

SEQ ID NO: 3679122 - RNA, 23 nt, Human
agauguaugcacacacauauauu

SEQ ID NO: 3679123 - RNA, 20 nt, Human
agaugucagccgagccgggc

SEQ ID NO: 3679124 - RNA, 16 nt, Human
agaugucaucccauug

SEQ ID NO: 3679125 - RNA, 23 nt, Human
agaugucauuuaguucagcaucc

SEQ ID NO: 3679126 - RNA, 21 nt, Human
agauguccaucagaugacaag

SEQ ID NO: 3679127 - RNA, 21 nt, Human
agauguccauuuuuacaaguu

SEQ ID NO: 3679128 - RNA, 16 nt, Human
agaugucccuugaugc

SEQ ID NO: 3679129 - RNA, 23 nt, Human
agaugucccuugaugcacagaga

SEQ ID NO: 3679130 - RNA, 17 nt, Human
agauguccuaaugguga

SEQ ID NO: 3679131 - RNA, 14 nt, Human
agaugucuauauug

SEQ ID NO: 3679132 - RNA, 14 nt, Human
agaugucucuaaaa

SEQ ID NO: 3679133 - RNA, 13 nt, Human
agaugucuuccua

SEQ ID NO: 3679134 - RNA, 18 nt, Human
agaugucuucguacaguu

SEQ ID NO: 3679135 - RNA, 13 nt, Human
agaugucuuggaa

SEQ ID NO: 3679136 - RNA, 13 nt, Human
agaugucuuuuau

SEQ ID NO: 3679137 - RNA, 17 nt, Human
agaugucuuuuauagug

SEQ ID NO: 3679138 - RNA, 18 nt, Human
agaugucuuuucccauuu

SEQ ID NO: 3679139 - RNA, 15 nt, Human
agaugugaaaauuac

SEQ ID NO: 3679140 - RNA, 20 nt, Human
agaugugaauuauugacacu

SEQ ID NO: 3679141 - RNA, 21 nt, Human
agaugugaauuauugacacug

SEQ ID NO: 3679142 - RNA, 15 nt, Human
agaugugauauucua

SEQ ID NO: 3679143 - RNA, 20 nt, Human
agaugugauuuaauaguguu

SEQ ID NO: 3679144 - RNA, 18 nt, Human
agaugugcagcagauugg

SEQ ID NO: 3679145 - RNA, 23 nt, Human
agaugugcagcagauuggaagga

SEQ ID NO: 3679146 - RNA, 22 nt, Human
agauguggaaaagccaagaggc

SEQ ID NO: 3679147 - RNA, 12 nt, Human
agauguggagcc

SEQ ID NO: 3679148 - RNA, 14 nt, Human
agauguggagccag

SEQ ID NO: 3679149 - RNA, 15 nt, Human
agauguggagccagg

SEQ ID NO: 3679150 - RNA, 16 nt, Human
agauguggauuuggca

SEQ ID NO: 3679151 - RNA, 16 nt, Human
agauguggcuacugac

SEQ ID NO: 3679152 - RNA, 22 nt, Human
agaugugguugcauaagguuuu

SEQ ID NO: 3679153 - RNA, 21 nt, Human
agauguguaauuuuucuguau

SEQ ID NO: 3679154 - RNA, 13 nt, Human
agauguguguuga

SEQ ID NO: 3679155 - RNA, 15 nt, Human
agauguguguugaua

SEQ ID NO: 3679156 - RNA, 18 nt, Human
agauguguguugauacug

SEQ ID NO: 3679157 - RNA, 22 nt, Human
agauguguguugauacuguugc

SEQ ID NO: 3679158 - RNA, 23 nt, Human
agauguguguugauacuguugca

SEQ ID NO: 3679159 - RNA, 15 nt, Human
agauguguucuuauu

SEQ ID NO: 3679160 - RNA, 19 nt, Human
agauguguugcuauccuga

SEQ ID NO: 3679161 - RNA, 14 nt, Human
agauguuaaaauaa

SEQ ID NO: 3679162 - RNA, 17 nt, Human
agauguuagaucagggg

SEQ ID NO: 3679163 - RNA, 21 nt, Human
agauguuauauuuuucuuaaa

SEQ ID NO: 3679164 - RNA, 21 nt, Human
agauguucagauugcuuugau

SEQ ID NO: 3679165 - RNA, 14 nt, Human
agauguucccccau

SEQ ID NO: 3679166 - RNA, 22 nt, Human
agauguucuaagucuuuccauu

SEQ ID NO: 3679167 - RNA, 14 nt, Human
agauguucuacuuu

SEQ ID NO: 3679168 - RNA, 22 nt, Human
agauguucuacuuuguucugcu

SEQ ID NO: 3679169 - RNA, 20 nt, Human
agauguucucuaucauuuaa

SEQ ID NO: 3679170 - RNA, 22 nt, Human
agauguugagaaaccugggcuc

SEQ ID NO: 3679171 - RNA, 22 nt, Human
agauguugauuuuuacuguguu

SEQ ID NO: 3679172 - RNA, 18 nt, Human
agauguugccauguguuu

SEQ ID NO: 3679173 - RNA, 15 nt, Human
agauguuuaaaacac

SEQ ID NO: 3679174 - RNA, 19 nt, Human
agauguuuauucuucuaga

SEQ ID NO: 3679175 - RNA, 20 nt, Human
agauguuuauucuucuagag

SEQ ID NO: 3679176 - RNA, 22 nt, Human
agauguuuauucuucuagaguu

SEQ ID NO: 3679177 - RNA, 15 nt, Human
agauguuuauuucag

SEQ ID NO: 3679178 - RNA, 21 nt, Human
agauguuuccagacuuccuug

SEQ ID NO: 3679179 - RNA, 17 nt, Human
agauguuugucagauau

SEQ ID NO: 3679180 - RNA, 17 nt, Human
agauguuuuacgucugg

SEQ ID NO: 3679181 - RNA, 11 nt, Human
agauguuuuag

SEQ ID NO: 3679182 - RNA, 13 nt, Human
agauguuuuuaaa

SEQ ID NO: 3679183 - RNA, 16 nt, Human
agauguuuuuaaaagu

SEQ ID NO: 3679184 - RNA, 21 nt, Human
agauuaaaaauuauaggaaua

SEQ ID NO: 3679185 - RNA, 13 nt, Human
agauuaaauauag

SEQ ID NO: 3679186 - RNA, 18 nt, Human
agauuaauagcauucgaa

SEQ ID NO: 3679187 - RNA, 20 nt, Human
agauuaauauuguucucugu

SEQ ID NO: 3679188 - RNA, 14 nt, Human
agauuaauggcacu

SEQ ID NO: 3679189 - RNA, 21 nt, Human
agauuagaaugaaaauuguau

SEQ ID NO: 3679190 - RNA, 21 nt, Human
agauuagcaaggucauuucuu

SEQ ID NO: 3679191 - RNA, 14 nt, Human
agauuauaacuugu

SEQ ID NO: 3679192 - RNA, 13 nt, Human
agauuauaauugu

SEQ ID NO: 3679193 - RNA, 18 nt, Human
agauuauaauuguugcau

SEQ ID NO: 3679194 - RNA, 14 nt, Human
agauuauacagaau

SEQ ID NO: 3679195 - RNA, 15 nt, Human
agauuauagauucua

SEQ ID NO: 3679196 - RNA, 21 nt, Human
agauuauagauucuaaagauu

SEQ ID NO: 3679197 - RNA, 16 nt, Human
agauuaucguuuucuu

SEQ ID NO: 3679198 - RNA, 17 nt, Human
agauuaucguuuucuua

SEQ ID NO: 3679199 - RNA, 19 nt, Human
agauuaucguuuucuuaaa

SEQ ID NO: 3679200 - RNA, 13 nt, Human
agauuauuuugga

SEQ ID NO: 3679201 - RNA, 14 nt, Human
agauuauuuuggaa

SEQ ID NO: 3679202 - RNA, 17 nt, Human
agauucaaagguucuag

SEQ ID NO: 3679203 - RNA, 18 nt, Human
agauucaaagguucuagg

SEQ ID NO: 3679204 - RNA, 16 nt, Human
agauucaaucccagga

SEQ ID NO: 3679205 - RNA, 11 nt, Human
agauucaauuu

SEQ ID NO: 3679206 - RNA, 17 nt, Human
agauucacacugucugg

SEQ ID NO: 3679207 - RNA, 16 nt, Human
agauucaccuaagaga

SEQ ID NO: 3679208 - RNA, 17 nt, Human
agauucaccuaagagau

SEQ ID NO: 3679209 - RNA, 18 nt, Human
agauucaccuaagagauu

SEQ ID NO: 3679210 - RNA, 14 nt, Human
agauucaccuguaa

SEQ ID NO: 3679211 - RNA, 19 nt, Human
agauucaccuguaaaacuu

SEQ ID NO: 3679212 - RNA, 21 nt, Human
agauucaccuguaaaacuuua

SEQ ID NO: 3679213 - RNA, 23 nt, Human
agauucacuuugacacuuuucau

SEQ ID NO: 3679214 - RNA, 13 nt, Human
agauucagcuagu

SEQ ID NO: 3679215 - RNA, 18 nt, Human
agauucagguaauacaaa

SEQ ID NO: 3679216 - RNA, 18 nt, Human
agauucagguauguugcc

SEQ ID NO: 3679217 - RNA, 13 nt, Human
agauucagucuug

SEQ ID NO: 3679218 - RNA, 17 nt, Human
agauucagucuugccuu

SEQ ID NO: 3679219 - RNA, 13 nt, Human
agauucauauuua

SEQ ID NO: 3679220 - RNA, 16 nt, Human
agauucauauuuacuu

SEQ ID NO: 3679221 - RNA, 19 nt, Human
agauucauauuuacuucuu

SEQ ID NO: 3679222 - RNA, 17 nt, Human
agauucauuuucuagau

SEQ ID NO: 3679223 - RNA, 12 nt, Human
agauucauuuuu

SEQ ID NO: 3679224 - RNA, 17 nt, Human
agauucauuuuuaauca

SEQ ID NO: 3679225 - RNA, 17 nt, Human
agauucauuuuucuuuc

SEQ ID NO: 3679226 - RNA, 19 nt, Human
agauuccagagaguggcuc

SEQ ID NO: 3679227 - RNA, 21 nt, Human
agauuccagagaguggcuccu

SEQ ID NO: 3679228 - RNA, 22 nt, Human
agauuccagagaguggcuccuc

SEQ ID NO: 3679229 - RNA, 16 nt, Human
agauucccaggaguuc

SEQ ID NO: 3679230 - RNA, 16 nt, Human
agauuccccuguguca

SEQ ID NO: 3679231 - RNA, 15 nt, Human
agauucccugagcag

SEQ ID NO: 3679232 - RNA, 23 nt, Human
agauuccggauccuaagcaucua

SEQ ID NO: 3679233 - RNA, 15 nt, Human
agauuccucuguauu

SEQ ID NO: 3679234 - RNA, 13 nt, Human
agauuccuuccca

SEQ ID NO: 3679235 - RNA, 20 nt, Human
agauuccuuucccuuuagca

SEQ ID NO: 3679236 - RNA, 14 nt, Human
agauuccuuuucuu

SEQ ID NO: 3679237 - RNA, 12 nt, Human
agauucuaaaga

SEQ ID NO: 3679238 - RNA, 13 nt, Human
agauucuaaaggu

SEQ ID NO: 3679239 - RNA, 23 nt, Human
agauucuaaagguccacaggucu

SEQ ID NO: 3679240 - RNA, 12 nt, Human
agauucuaacgg

SEQ ID NO: 3679241 - RNA, 13 nt, Human
agauucuaaugau

SEQ ID NO: 3679242 - RNA, 20 nt, Human
agauucuauaguucuagaca

SEQ ID NO: 3679243 - RNA, 17 nt, Human
agauucuauccucaucu

SEQ ID NO: 3679244 - RNA, 14 nt, Human
agauucucuaugua

SEQ ID NO: 3679245 - RNA, 21 nt, Human
agauucucuggcuguaaggcu

SEQ ID NO: 3679246 - RNA, 13 nt, Human
agauucugccuuu

SEQ ID NO: 3679247 - RNA, 22 nt, Human
agauucugugaucuuuuaaagu

SEQ ID NO: 3679248 - RNA, 17 nt, Human
agcaaaggggacagcug

SEQ ID NO: 3679249 - RNA, 22 nt, Human
agcaaaguaguacuucuucugu

SEQ ID NO: 3679250 - RNA, 15 nt, Human
agcaaagucuaaagu

SEQ ID NO: 3679251 - RNA, 23 nt, Human
agcaaagucuaaaguuuacagua

SEQ ID NO: 3679252 - RNA, 22 nt, Human
agcaaagugguagguacuuuuu

SEQ ID NO: 3679253 - RNA, 18 nt, Human
agcaaaucaccacaaacu

SEQ ID NO: 3679254 - RNA, 21 nt, Human
agcaaaucaccacaaacugua

SEQ ID NO: 3679255 - RNA, 22 nt, Human
agcaaaucaccacaaacuguaa

SEQ ID NO: 3679256 - RNA, 20 nt, Human
agcaaaucagaaacuuguga

SEQ ID NO: 3679257 - RNA, 22 nt, Human
agcaaaucauuuguuuaaaaag

SEQ ID NO: 3679258 - RNA, 20 nt, Human
agcaaauccuuugugaaaaa

SEQ ID NO: 3679259 - RNA, 15 nt, Human
agcaaaucgaaugaa

SEQ ID NO: 3679260 - RNA, 22 nt, Human
agcaaaucgaaugaaauuaacu

SEQ ID NO: 3679261 - RNA, 13 nt, Human
agcaaaugcaaaa

SEQ ID NO: 3679262 - RNA, 14 nt, Human
agcaaaugcaaaaa

SEQ ID NO: 3679263 - RNA, 19 nt, Human
agcaaaugucaugcugccu

SEQ ID NO: 3679264 - RNA, 21 nt, Human
agcaaaugucaugcugccuua

SEQ ID NO: 3679265 - RNA, 19 nt, Human
agcauccccaaaacaaagu

SEQ ID NO: 3679266 - RNA, 16 nt, Human
agcaucccccaaaguu

SEQ ID NO: 3679267 - RNA, 18 nt, Human
agcauccccuugaacucu

SEQ ID NO: 3679268 - RNA, 14 nt, Human
agcaucccggagga

SEQ ID NO: 3679269 - RNA, 19 nt, Human
agcaucccggaggaaaucu

SEQ ID NO: 3679270 - RNA, 22 nt, Human
agcaucccuugaccaggccugg

SEQ ID NO: 3679271 - RNA, 16 nt, Human
agcauccgcaggugcu

SEQ ID NO: 3679272 - RNA, 21 nt, Human
agcauccgcaggugcuggucc

SEQ ID NO: 3679273 - RNA, 23 nt, Human
agcauccuaagaaauaugugaga

SEQ ID NO: 3679274 - RNA, 15 nt, Human
agcauccucaguucc

SEQ ID NO: 3679275 - RNA, 13 nt, Human
agcauccugagcc

SEQ ID NO: 3679276 - RNA, 19 nt, Human
agcauccugagccccgccc

SEQ ID NO: 3679277 - RNA, 14 nt, Human
agcaucgcacucug

SEQ ID NO: 3679278 - RNA, 23 nt, Human
agcaucggacaagacccccagca

SEQ ID NO: 3679279 - RNA, 13 nt, Human
agcaucggaggga

SEQ ID NO: 3679280 - RNA, 12 nt, Human
agcaucuaaguu

SEQ ID NO: 3679281 - RNA, 20 nt, Human
agcaucucagccuaccauga

SEQ ID NO: 3679282 - RNA, 16 nt, Human
agcaucuccaagcagc

SEQ ID NO: 3679283 - RNA, 19 nt, Human
agcaucucuaccuucuccc

SEQ ID NO: 3679284 - RNA, 19 nt, Human
agcaucucuugaggccagg

SEQ ID NO: 3679285 - RNA, 22 nt, Human
agcaucucuugaggccaggagu

SEQ ID NO: 3679286 - RNA, 19 nt, Human
agcaucugcauugcccagu

SEQ ID NO: 3679287 - RNA, 24 nt, Human
agcaucugcauugcccagucuuuc

SEQ ID NO: 3679288 - RNA, 23 nt, Human
agcaucuggaagaucauuuugaa

SEQ ID NO: 3679289 - RNA, 13 nt, Human
agcaucugggccu

SEQ ID NO: 3679290 - RNA, 19 nt, Human
agcaucugggccuuggccu

SEQ ID NO: 3679291 - RNA, 13 nt, Human
agcaucuguacaa

SEQ ID NO: 3679292 - RNA, 17 nt, Human
agcaucuguacaaaggg

SEQ ID NO: 3679293 - RNA, 23 nt, Human
agcaucuucacuucuaaaugcau

SEQ ID NO: 3679294 - RNA, 17 nt, Human
agcaucuuccagaagug

SEQ ID NO: 3679295 - RNA, 19 nt, Human
agcaucuucucacucccuu

SEQ ID NO: 3679296 - RNA, 21 nt, Human
agcaucuuggggggguggccg

SEQ ID NO: 3679297 - RNA, 21 nt, Human
agcaucuuugaauacaaagaa

SEQ ID NO: 3679298 - RNA, 19 nt, Human
agcaugaaauaaaauauau

SEQ ID NO: 3679299 - RNA, 14 nt, Human
agcaugaaauguga

SEQ ID NO: 3679300 - RNA, 15 nt, Human
agcaugaagacagag

SEQ ID NO: 3679301 - RNA, 17 nt, Human
agcaugacaagccccag

SEQ ID NO: 3679302 - RNA, 19 nt, Human
agcaugacaagccccaggc

SEQ ID NO: 3679303 - RNA, 21 nt, Human
agcaugacaagccccaggcag

SEQ ID NO: 3679304 - RNA, 14 nt, Human
agcaugacagccug

SEQ ID NO: 3679305 - RNA, 15 nt, Human
agcaugacauuucuu

SEQ ID NO: 3679306 - RNA, 22 nt, Human
agcaugagacuauguaaaaaua

SEQ ID NO: 3679307 - RNA, 19 nt, Human
agcaugagagaauuguauc

SEQ ID NO: 3679308 - RNA, 17 nt, Human
agcaugagaggaggcag

SEQ ID NO: 3679309 - RNA, 17 nt, Human
agcaugccaacaagaau

SEQ ID NO: 3679310 - RNA, 12 nt, Human
agcaugccugga

SEQ ID NO: 3679311 - RNA, 21 nt, Human
agcaugcugugauugugccua

SEQ ID NO: 3679312 - RNA, 13 nt, Human
agcaugcuuucug

SEQ ID NO: 3679313 - RNA, 16 nt, Human
agcauggagaacagug

SEQ ID NO: 3679314 - RNA, 13 nt, Human
agcauggagcugg

SEQ ID NO: 3679315 - RNA, 16 nt, Human
agcauggagcuggccg

SEQ ID NO: 3679316 - RNA, 16 nt, Human
agcauggcacucccuc

SEQ ID NO: 3679317 - RNA, 21 nt, Human
agcauggcacucccuccagca

SEQ ID NO: 3679318 - RNA, 18 nt, Human
agcauggcuauuuuauau

SEQ ID NO: 3679319 - RNA, 18 nt, Human
agcauggcucaaagugca

SEQ ID NO: 3679320 - RNA, 13 nt, Human
agcauggcugcca

SEQ ID NO: 3679321 - RNA, 19 nt, Human
agcauggcugccaauggga

SEQ ID NO: 3679322 - RNA, 14 nt, Human
agcaugggccuggc

SEQ ID NO: 3679323 - RNA, 16 nt, Human
agcauggguucauccu

SEQ ID NO: 3679324 - RNA, 21 nt, Human
agcaugguacuuggccuuugg

SEQ ID NO: 3679325 - RNA, 21 nt, Human
agcauggucccacaucccugg

SEQ ID NO: 3679326 - RNA, 16 nt, Human
agcauggucccugccu

SEQ ID NO: 3679327 - RNA, 19 nt, Human
agcauguaacuuauauuaa

SEQ ID NO: 3679328 - RNA, 16 nt, Human
agcauguacaguguuc

SEQ ID NO: 3679329 - RNA, 19 nt, Human
agcagugccuuccauaauu

SEQ ID NO: 3679330 - RNA, 14 nt, Human
agcagugcuucuca

SEQ ID NO: 3679331 - RNA, 19 nt, Human
agcaguggacaccaggagu

SEQ ID NO: 3679332 - RNA, 16 nt, Human
agcaguggagcccagg

SEQ ID NO: 3679333 - RNA, 18 nt, Human
agcaguggagcccaggag

SEQ ID NO: 3679334 - RNA, 23 nt, Human
agcaguggccuacaaaucaguaa

SEQ ID NO: 3679335 - RNA, 11 nt, Human
agcaguggcug

SEQ ID NO: 3679336 - RNA, 18 nt, Human
agcaguggcugguccagg

SEQ ID NO: 3679337 - RNA, 21 nt, Human
agcaguggcugguccagggcu

SEQ ID NO: 3679338 - RNA, 19 nt, Human
agcagugucaucagaagau

SEQ ID NO: 3679339 - RNA, 20 nt, Human
agcagugucuuccauaaugu

SEQ ID NO: 3679340 - RNA, 21 nt, Human
agcagugugaggccagggcag

SEQ ID NO: 3679341 - RNA, 16 nt, Human
agcagugugucuccug

SEQ ID NO: 3679342 - RNA, 13 nt, Human
agcaguguuagcu

SEQ ID NO: 3679343 - RNA, 22 nt, Human
agcaguucaccuauuucaaaaa

SEQ ID NO: 3679344 - RNA, 20 nt, Human
agcaguucagagcugcccuc

SEQ ID NO: 3679345 - RNA, 14 nt, Human
agcaguuccggauu

SEQ ID NO: 3679346 - RNA, 16 nt, Human
agcaguucugcaaaua

SEQ ID NO: 3679347 - RNA, 21 nt, Human
agcaguucuguuauauccccu

SEQ ID NO: 3679348 - RNA, 21 nt, Human
agcaguucuuaacccaguguc

SEQ ID NO: 3679349 - RNA, 16 nt, Human
agcaguugaaaagacu

SEQ ID NO: 3679350 - RNA, 12 nt, Human
agcaguuucaau

SEQ ID NO: 3679351 - RNA, 13 nt, Human
agcaguuucaaua

SEQ ID NO: 3679352 - RNA, 20 nt, Human
agcaguuucaauaaaguuug

SEQ ID NO: 3679353 - RNA, 18 nt, Human
agcaguuucuguccugcu

SEQ ID NO: 3679354 - RNA, 19 nt, Human
agcaguuucuguccugcug

SEQ ID NO: 3679355 - RNA, 14 nt, Human
agcaguuugcuuug

SEQ ID NO: 3679356 - RNA, 21 nt, Human
agcaguuuucaagucaaauua

SEQ ID NO: 3679357 - RNA, 20 nt, Human
agcaguuuucuuuuaauuuu

SEQ ID NO: 3679358 - RNA, 15 nt, Human
agcauaaaagaugaa

SEQ ID NO: 3679359 - RNA, 18 nt, Human
agcauaaagcucaaauga

SEQ ID NO: 3679360 - RNA, 22 nt, Human
agcauacaugcaaaaagaaaug

SEQ ID NO: 3679361 - RNA, 13 nt, Human
agcauaccaacac

SEQ ID NO: 3679362 - RNA, 16 nt, Human
agcauaccuuuauugu

SEQ ID NO: 3679363 - RNA, 16 nt, Human
agcauacguacacauu

SEQ ID NO: 3679364 - RNA, 21 nt, Human
agcauacguacacauuuuauu

SEQ ID NO: 3679365 - RNA, 17 nt, Human
agcauacuuuguaaaua

SEQ ID NO: 3679366 - RNA, 22 nt, Human
agcauacuuuguaaauaggauu

SEQ ID NO: 3679367 - RNA, 14 nt, Human
agcauagauguuuu

SEQ ID NO: 3679368 - RNA, 16 nt, Human
agcauagcucuguaca

SEQ ID NO: 3679369 - RNA, 19 nt, Human
agcauauaaaauggcaaca

SEQ ID NO: 3679370 - RNA, 14 nt, Human
agcauauagagaug

SEQ ID NO: 3679371 - RNA, 15 nt, Human
agcauauagauuguc

SEQ ID NO: 3679372 - RNA, 16 nt, Human
agcauaucugauuguu

SEQ ID NO: 3679373 - RNA, 23 nt, Human
agcauaucugccuuuauuguguu

SEQ ID NO: 3679374 - RNA, 17 nt, Human
agcauaugacaaauguu

SEQ ID NO: 3679375 - RNA, 18 nt, Human
agcauaugacaaauguuu

SEQ ID NO: 3679376 - RNA, 23 nt, Human
agcauaugaggaugcagagucag

SEQ ID NO: 3679377 - RNA, 16 nt, Human
agcauauguguuggcu

SEQ ID NO: 3679378 - RNA, 22 nt, Human
agcauauuuguauaguugcuug

SEQ ID NO: 3679379 - RNA, 20 nt, Human
agcaucacaugaacuuguaa

SEQ ID NO: 3679380 - RNA, 15 nt, Human
agcaucaccucaggc

SEQ ID NO: 3679381 - RNA, 20 nt, Human
agcaucaccucaggccaggu

SEQ ID NO: 3679382 - RNA, 22 nt, Human
agcaucacuccccaaggaagag

SEQ ID NO: 3679383 - RNA, 17 nt, Human
agcaucacuuaaaacac

SEQ ID NO: 3679384 - RNA, 22 nt, Human
agcaucacuuaaaacacguuuu

SEQ ID NO: 3679385 - RNA, 17 nt, Human
agcaucaggccaggccc

SEQ ID NO: 3679386 - RNA, 20 nt, Human
agcaucaggccaggcccucu

SEQ ID NO: 3679387 - RNA, 23 nt, Human
agcaucaggccaggcccucugcc

SEQ ID NO: 3679388 - RNA, 18 nt, Human
agcaucagggggaagaag

SEQ ID NO: 3679389 - RNA, 20 nt, Human
agcaucagggggaagaagca

SEQ ID NO: 3679390 - RNA, 14 nt, Human
agcaucauccugca

SEQ ID NO: 3679391 - RNA, 18 nt, Human
agcaucaugccucugagg

SEQ ID NO: 3679392 - RNA, 21 nt, Human
agcaucauuauuugcagagac

SEQ ID NO: 3679393 - RNA, 20 nt, Human
agcaucauuuugcauucaaa

SEQ ID NO: 3679394 - RNA, 22 nt, Human
agcaucauuuugcauucaaauu

SEQ ID NO: 3679395 - RNA, 17 nt, Human
agcauccaccuccuucu

SEQ ID NO: 3679396 - RNA, 20 nt, Human
agcauccaccuccuucucug

SEQ ID NO: 3679397 - RNA, 24 nt, Human
agcauccauguguggacucaaguc

SEQ ID NO: 3679398 - RNA, 13 nt, Human
agcucagcugcau

SEQ ID NO: 3679399 - RNA, 22 nt, Human
agcucaggaaccgaggcaggga

SEQ ID NO: 3679400 - RNA, 17 nt, Human
agcucaggacagaugcc

SEQ ID NO: 3679401 - RNA, 18 nt, Human
agcucaggaccaggcaau

SEQ ID NO: 3679402 - RNA, 18 nt, Human
agcucaggaccugggacc

SEQ ID NO: 3679403 - RNA, 15 nt, Human
agcucaggaggcgcc

SEQ ID NO: 3679404 - RNA, 17 nt, Human
agcucaggaggcgcccu

SEQ ID NO: 3679405 - RNA, 18 nt, Human
agcucaggaugagggaaa

SEQ ID NO: 3679406 - RNA, 12 nt, Human
agcucagggccu

SEQ ID NO: 3679407 - RNA, 13 nt, Human
agcucagggccug

SEQ ID NO: 3679408 - RNA, 15 nt, Human
agcucagggccuggc

SEQ ID NO: 3679409 - RNA, 19 nt, Human
agcucagggccuggcucag

SEQ ID NO: 3679410 - RNA, 14 nt, Human
agcucagggcuuca

SEQ ID NO: 3679411 - RNA, 15 nt, Human
agcucagggcuucau

SEQ ID NO: 3679412 - RNA, 14 nt, Human
agcucaggggcagc

SEQ ID NO: 3679413 - RNA, 23 nt, Human
agcucagucuucccuagggcugg

SEQ ID NO: 3679414 - RNA, 18 nt, Human
agcucauaagagccacag

SEQ ID NO: 3679415 - RNA, 20 nt, Human
agcucauagaguccccccuc

SEQ ID NO: 3679416 - RNA, 18 nt, Human
agcucauauuuuguauau

SEQ ID NO: 3679417 - RNA, 21 nt, Human
agcucauccaugccucagaag

SEQ ID NO: 3679418 - RNA, 22 nt, Human
agcucauucauuuuauauugaa

SEQ ID NO: 3679419 - RNA, 15 nt, Human
agcucauuucacuuu

SEQ ID NO: 3679420 - RNA, 15 nt, Human
agcuccaaccugcaa

SEQ ID NO: 3679421 - RNA, 16 nt, Human
agcuccaaccugcaaa

SEQ ID NO: 3679422 - RNA, 18 nt, Human
agcuccaaccugcaaaga

SEQ ID NO: 3679423 - RNA, 15 nt, Human
agcuccaagaauuuc

SEQ ID NO: 3679424 - RNA, 17 nt, Human
agcuccaagcucccagg

SEQ ID NO: 3679425 - RNA, 18 nt, Human
agcuccaagcucccaggc

SEQ ID NO: 3679426 - RNA, 22 nt, Human
agcuccacacccucucccagga

SEQ ID NO: 3679427 - RNA, 15 nt, Human
agcuccacccuggcc

SEQ ID NO: 3679428 - RNA, 17 nt, Human
agcuccacccuggccga

SEQ ID NO: 3679429 - RNA, 21 nt, Human
agcuccacugucacccuccac

SEQ ID NO: 3679430 - RNA, 11 nt, Human
agcuccagccc

SEQ ID NO: 3679431 - RNA, 19 nt, Human
agcuccagccccuuuccaa

SEQ ID NO: 3679432 - RNA, 17 nt, Human
agcuccagcucaccagc

SEQ ID NO: 3679433 - RNA, 19 nt, Human
agcuccagcucaccagccc

SEQ ID NO: 3679434 - RNA, 21 nt, Human
agcuccagcucaccagcccca

SEQ ID NO: 3679435 - RNA, 14 nt, Human
agcuccagcuuucu

SEQ ID NO: 3679436 - RNA, 15 nt, Human
agcuccagggccaga

SEQ ID NO: 3679437 - RNA, 14 nt, Human
agcuccaguccugc

SEQ ID NO: 3679438 - RNA, 20 nt, Human
agcuccaguggaagaagaaa

SEQ ID NO: 3679439 - RNA, 14 nt, Human
agcuccaguguccu

SEQ ID NO: 3679440 - RNA, 18 nt, Human
agcuccauacacacgcug

SEQ ID NO: 3679441 - RNA, 19 nt, Human
agcuccauacacacgcugc

SEQ ID NO: 3679442 - RNA, 22 nt, Human
agcuccaucaaugagguaucuu

SEQ ID NO: 3679443 - RNA, 13 nt, Human
agcuccaucucca

SEQ ID NO: 3679444 - RNA, 15 nt, Human
agcuccaucuccacu

SEQ ID NO: 3679445 - RNA, 14 nt, Human
agcuccauuuaaac

SEQ ID NO: 3679446 - RNA, 15 nt, Human
agcuccauuuaaaca

SEQ ID NO: 3679447 - RNA, 18 nt, Human
agcuccauuuaaacagau

SEQ ID NO: 3679448 - RNA, 22 nt, Human
agcucuuuuuuguuuguuucuu

SEQ ID NO: 3679449 - RNA, 23 nt, Human
agcucuuuuuuguuuguuucuuu

SEQ ID NO: 3679450 - RNA, 21 nt, Human
agcugaaaaaucacauccugg

SEQ ID NO: 3679451 - RNA, 14 nt, Human
agcugaaaguuggg

SEQ ID NO: 3679452 - RNA, 12 nt, Human
agcugaaauuga

SEQ ID NO: 3679453 - RNA, 13 nt, Human
agcugaaauugaa

SEQ ID NO: 3679454 - RNA, 16 nt, Human
agcugaaauugaaaag

SEQ ID NO: 3679455 - RNA, 23 nt, Human
agcugaacaauaggcuguuccca

SEQ ID NO: 3679456 - RNA, 22 nt, Human
agcugaacagccaaaugcaugg

SEQ ID NO: 3679457 - RNA, 24 nt, Human
agcugaacaguguuggcuuucaug

SEQ ID NO: 3679458 - RNA, 20 nt, Human
agcugaagaguugccccguc

SEQ ID NO: 3679459 - RNA, 15 nt, Human
agcugaauguuuuuc

SEQ ID NO: 3679460 - RNA, 20 nt, Human
agcugaauguuuuucuaaag

SEQ ID NO: 3679461 - RNA, 15 nt, Human
agcugaauugagccu

SEQ ID NO: 3679462 - RNA, 21 nt, Human
agcugaauugagccuaaaaau

SEQ ID NO: 3679463 - RNA, 21 nt, Human
agcugacaaaauacuugucug

SEQ ID NO: 3679464 - RNA, 14 nt, Human
agcugacacaaacc

SEQ ID NO: 3679465 - RNA, 21 nt, Human
agcugacacaaaccugccugg

SEQ ID NO: 3679466 - RNA, 18 nt, Human
agcugacauugccaaaaa

SEQ ID NO: 3679467 - RNA, 19 nt, Human
agcugaccagccgugagca

SEQ ID NO: 3679468 - RNA, 23 nt, Human
agcugacccagccccuugagaaa

SEQ ID NO: 3679469 - RNA, 22 nt, Human
agcugaccucuguuguccuccc

SEQ ID NO: 3679470 - RNA, 19 nt, Human
agcugacgaggcugggcca

SEQ ID NO: 3679471 - RNA, 13 nt, Human
agcugacucacac

SEQ ID NO: 3679472 - RNA, 16 nt, Human
agcugacuuggcuggu

SEQ ID NO: 3679473 - RNA, 13 nt, Human
agcugagaagacu

SEQ ID NO: 3679474 - RNA, 15 nt, Human
agcugagagacuuuu

SEQ ID NO: 3679475 - RNA, 20 nt, Human
agcugagaucgugccacugc

SEQ ID NO: 3679476 - RNA, 15 nt, Human
agcugagcaccaggg

SEQ ID NO: 3679477 - RNA, 15 nt, Human
agcugagcagggccg

SEQ ID NO: 3679478 - RNA, 14 nt, Human
agcugagccucuca

SEQ ID NO: 3679479 - RNA, 14 nt, Human
agcugagccugcag

SEQ ID NO: 3679480 - RNA, 16 nt, Human
agcugagccugcaggg

SEQ ID NO: 3679481 - RNA, 17 nt, Human
agcugagccugcaggga

SEQ ID NO: 3679482 - RNA, 12 nt, Human
agcugagcgcca

SEQ ID NO: 3679483 - RNA, 17 nt, Human
agcugagcgccaggaug

SEQ ID NO: 3679484 - RNA, 17 nt, Human
agcugagcucacaaggc

SEQ ID NO: 3679485 - RNA, 18 nt, Human
agcugagcucacaaggca

SEQ ID NO: 3679486 - RNA, 16 nt, Human
agcugaggcagcagug

SEQ ID NO: 3679487 - RNA, 17 nt, Human
agcugaggcagcagugu

SEQ ID NO: 3679488 - RNA, 22 nt, Human
agcugaggccacacucagcaca

SEQ ID NO: 3679489 - RNA, 21 nt, Human
agcugaggucucuugagggag

SEQ ID NO: 3679490 - RNA, 18 nt, Human
agcugaggugcccaggag

SEQ ID NO: 3679491 - RNA, 16 nt, Human
agcugagguuucaccc

SEQ ID NO: 3679492 - RNA, 18 nt, Human
agcugagguuucacccuu

SEQ ID NO: 3679493 - RNA, 21 nt, Human
agcugaguuuccuaugggaac

SEQ ID NO: 3679494 - RNA, 21 nt, Human
agcugauacaaauugcagacu

SEQ ID NO: 3679495 - RNA, 20 nt, Human
agcugauacuuugacagugu

SEQ ID NO: 3679496 - RNA, 17 nt, Human
agcugauauaaauucug

SEQ ID NO: 3679497 - RNA, 22 nt, Human
agcugaucugcggaucucagcu

SEQ ID NO: 3679498 - RNA, 11 nt, Human
agcugaugaaa

SEQ ID NO: 3679499 - RNA, 13 nt, Human
agcugaugaaacu

SEQ ID NO: 3679500 - RNA, 14 nt, Human
agcugauggagaag

SEQ ID NO: 3679501 - RNA, 16 nt, Human
agcugauggagaagga

SEQ ID NO: 3679502 - RNA, 20 nt, Human
agcugauguuggaagagaaa

SEQ ID NO: 3679503 - RNA, 16 nt, Human
agcugauuacugucaa

SEQ ID NO: 3679504 - RNA, 18 nt, Human
agcugauuacugucaaua

SEQ ID NO: 3679505 - RNA, 20 nt, Human
agcugauuuuaacaauaacu

SEQ ID NO: 3679506 - RNA, 13 nt, Human
agcugcaaagugu

SEQ ID NO: 3679507 - RNA, 15 nt, Human
agcugcaaaguguuu

SEQ ID NO: 3679508 - RNA, 15 nt, Human
agcugcaagugacau

SEQ ID NO: 3679509 - RNA, 17 nt, Human
agcugcaauucccugga

SEQ ID NO: 3679510 - RNA, 19 nt, Human
agcugcacagggcagcugg

SEQ ID NO: 3679511 - RNA, 16 nt, Human
agcugcaccagagcaa

SEQ ID NO: 3679512 - RNA, 13 nt, Human
agcugcaccccuu

SEQ ID NO: 3679513 - RNA, 21 nt, Human
agcugcaccccuuccugggca

SEQ ID NO: 3679514 - RNA, 17 nt, Human
agcugcacccucaggca

SEQ ID NO: 3679515 - RNA, 16 nt, Human
agcugcaccugccagc

SEQ ID NO: 3679516 - RNA, 21 nt, Human
agcugcaccugccagccuggc

SEQ ID NO: 3679517 - RNA, 11 nt, Human
agcugcacuga

SEQ ID NO: 3679518 - RNA, 11 nt, Human
agcugcagaac

SEQ ID NO: 3679519 - RNA, 15 nt, Human
agcugcagagacaga

SEQ ID NO: 3679520 - RNA, 13 nt, Human
agcugcagagcca

SEQ ID NO: 3679521 - RNA, 15 nt, Human
agcugcagcuuccug

SEQ ID NO: 3679522 - RNA, 16 nt, Human
agcugcagcuuccugu

SEQ ID NO: 3679523 - RNA, 14 nt, Human
agcugcagcuuggg

SEQ ID NO: 3679524 - RNA, 16 nt, Human
agcugcaggaaucaaa

SEQ ID NO: 3679525 - RNA, 13 nt, Human
agcugcagugagc

SEQ ID NO: 3679526 - RNA, 17 nt, Human
agcugcauaucuucauc

SEQ ID NO: 3679527 - RNA, 18 nt, Human
agcugcauccuccaagaa

SEQ ID NO: 3679528 - RNA, 21 nt, Human
agcugcauccuccaagaaucu

SEQ ID NO: 3679529 - RNA, 15 nt, Human
agcugcauuccgcag

SEQ ID NO: 3679530 - RNA, 18 nt, Human
agcugcauuccgcagccc

SEQ ID NO: 3679531 - RNA, 22 nt, Human
agcugccaaguaaauagcaaca

SEQ ID NO: 3679532 - RNA, 23 nt, Human
agcugccaccucuccauccugcu

SEQ ID NO: 3679533 - RNA, 20 nt, Human
agcugccagccgagauagcc

SEQ ID NO: 3679534 - RNA, 11 nt, Human
agcugccagug

SEQ ID NO: 3679535 - RNA, 24 nt, Human
agcugccaguguccugagccccag

SEQ ID NO: 3679536 - RNA, 19 nt, Human
agcugccaucgcugugaug

SEQ ID NO: 3679537 - RNA, 15 nt, Human
agcugccauggcuag

SEQ ID NO: 3679538 - RNA, 17 nt, Human
agcugcccacagcaggc

SEQ ID NO: 3679539 - RNA, 18 nt, Human
agcugcccagaguugcug

SEQ ID NO: 3679540 - RNA, 16 nt, Human
agcugccccagccaga

SEQ ID NO: 3679541 - RNA, 14 nt, Human
agcugcccccagag

SEQ ID NO: 3679542 - RNA, 16 nt, Human
agcugcccccagagcc

SEQ ID NO: 3679543 - RNA, 19 nt, Human
agcugcccccagagccaca

SEQ ID NO: 3679544 - RNA, 20 nt, Human
agcugccccggggaggggcg

SEQ ID NO: 3679545 - RNA, 17 nt, Human
agcugccccucccugcc

SEQ ID NO: 3679546 - RNA, 16 nt, Human
agcugccccucucugg

SEQ ID NO: 3679547 - RNA, 18 nt, Human
agcugccccucucugggc

SEQ ID NO: 3679548 - RNA, 13 nt, Human
agcugcccucucc

SEQ ID NO: 3679549 - RNA, 15 nt, Human
agcugcccucuccug

SEQ ID NO: 3679550 - RNA, 21 nt, Human
agcugcccucuccugggcagc

SEQ ID NO: 3679551 - RNA, 22 nt, Human
agcugcccucuccugggcagcu

SEQ ID NO: 3679552 - RNA, 13 nt, Human
agcugccgaccag

SEQ ID NO: 3679553 - RNA, 14 nt, Human
agcugccuaagagg

SEQ ID NO: 3679554 - RNA, 19 nt, Human
agcugccuccccuccucug

SEQ ID NO: 3679555 - RNA, 21 nt, Human
agcugccuccccuccucugcu

SEQ ID NO: 3679556 - RNA, 23 nt, Human
agcugccuccccuccucugcuug

SEQ ID NO: 3679557 - RNA, 20 nt, Human
agcugccuccccucuccuuc

SEQ ID NO: 3679558 - RNA, 23 nt, Human
agcugccuccccucuccuuccug

SEQ ID NO: 3679559 - RNA, 15 nt, Human
agcugccucuucccu

SEQ ID NO: 3679560 - RNA, 16 nt, Human
agcugccucuucugug

SEQ ID NO: 3679561 - RNA, 19 nt, Human
agcugccugaaaaucaaga

SEQ ID NO: 3679562 - RNA, 21 nt, Human
agcugccuggaagagcagccc

SEQ ID NO: 3679563 - RNA, 15 nt, Human
agcugguuggagagc

SEQ ID NO: 3679564 - RNA, 15 nt, Human
agcugguuuccucau

SEQ ID NO: 3679565 - RNA, 12 nt, Human
agcuguaaaacg

SEQ ID NO: 3679566 - RNA, 14 nt, Human
agcuguaaaacgcu

SEQ ID NO: 3679567 - RNA, 19 nt, Human
agcuguaaaacgcugucaa

SEQ ID NO: 3679568 - RNA, 15 nt, Human
agcuguaacaguucu

SEQ ID NO: 3679569 - RNA, 18 nt, Human
agcuguaagaagagacug

SEQ ID NO: 3679570 - RNA, 18 nt, Human
agcuguaaggcaugaagg

SEQ ID NO: 3679571 - RNA, 13 nt, Human
agcuguacaaaua

SEQ ID NO: 3679572 - RNA, 21 nt, Human
agcuguauagcugcuuccagu

SEQ ID NO: 3679573 - RNA, 19 nt, Human
agcuguauugaaucaugua

SEQ ID NO: 3679574 - RNA, 17 nt, Human
agcugucaccaaggaaa

SEQ ID NO: 3679575 - RNA, 15 nt, Human
agcugucccugucac

SEQ ID NO: 3679576 - RNA, 22 nt, Human
agcugucccugucaccaagcuc

SEQ ID NO: 3679577 - RNA, 16 nt, Human
agcuguccuuuuuccu

SEQ ID NO: 3679578 - RNA, 17 nt, Human
agcuguccuuuuuccuc

SEQ ID NO: 3679579 - RNA, 17 nt, Human
agcugucugcucagaca

SEQ ID NO: 3679580 - RNA, 20 nt, Human
agcugucuuguccuugcugg

SEQ ID NO: 3679581 - RNA, 17 nt, Human
agcugucuuuuggagga

SEQ ID NO: 3679582 - RNA, 19 nt, Human
agcugucuuuuggaggacg

SEQ ID NO: 3679583 - RNA, 17 nt, Human
agcugugaacauggacu

SEQ ID NO: 3679584 - RNA, 17 nt, Human
agcaauucuccugccuc

SEQ ID NO: 3679585 - RNA, 18 nt, Human
agcaauucuccugccuca

SEQ ID NO: 3679586 - RNA, 16 nt, Human
agcaauucuuucaagu

SEQ ID NO: 3679587 - RNA, 18 nt, Human
agcaauugcugcaucuua

SEQ ID NO: 3679588 - RNA, 23 nt, Human
agcaauuguguggucaguggcuc

SEQ ID NO: 3679589 - RNA, 20 nt, Human
agcaauuuauacaauaucau

SEQ ID NO: 3679590 - RNA, 24 nt, Human
agcaauuucccccuaaaccaacug

SEQ ID NO: 3679591 - RNA, 21 nt, Human
agcaauuucuugcucuaucuc

SEQ ID NO: 3679592 - RNA, 15 nt, Human
agcaauuuuccuuga

SEQ ID NO: 3679593 - RNA, 16 nt, Human
agcaauuuuccuugaa

SEQ ID NO: 3679594 - RNA, 19 nt, Human
agcaauuuuccuugaagcc

SEQ ID NO: 3679595 - RNA, 20 nt, Human
agcaauuuuccuugaagccg

SEQ ID NO: 3679596 - RNA, 14 nt, Human
agcaauuuucgaac

SEQ ID NO: 3679597 - RNA, 16 nt, Human
agcacaaaagccucuc

SEQ ID NO: 3679598 - RNA, 15 nt, Human
agcacaaaauucaaa

SEQ ID NO: 3679599 - RNA, 14 nt, Human
agcacaaacacaag

SEQ ID NO: 3679600 - RNA, 17 nt, Human
agcacaaacacaagguc

SEQ ID NO: 3679601 - RNA, 15 nt, Human
agcacaaacuuuagg

SEQ ID NO: 3679602 - RNA, 18 nt, Human
agcacaaagacccuggcu

SEQ ID NO: 3679603 - RNA, 22 nt, Human
agcacaacccccagcucccgcu

SEQ ID NO: 3679604 - RNA, 20 nt, Human
agcacaaccuucaagcugcu

SEQ ID NO: 3679605 - RNA, 22 nt, Human
agcacaaccuucaagcugcuuu

SEQ ID NO: 3679606 - RNA, 23 nt, Human
agcacaagcagagugcacagcug

SEQ ID NO: 3679607 - RNA, 21 nt, Human
agcacaaguuauuuaaaucug

SEQ ID NO: 3679608 - RNA, 14 nt, Human
agcacacagggcag

SEQ ID NO: 3679609 - RNA, 19 nt, Human
agcacaccaaucuuacuuu

SEQ ID NO: 3679610 - RNA, 14 nt, Human
agcuuccuucagag

SEQ ID NO: 3679611 - RNA, 17 nt, Human
agcuuccuucagagagc

SEQ ID NO: 3679612 - RNA, 20 nt, Human
agcuuccuucagagagcagu

SEQ ID NO: 3679613 - RNA, 21 nt, Human
agcuuccuucagagagcagug

SEQ ID NO: 3679614 - RNA, 14 nt, Human
agcuucgcgugaga

SEQ ID NO: 3679615 - RNA, 20 nt, Human
agcuucguuuauuuucaaga

SEQ ID NO: 3679616 - RNA, 23 nt, Human
agcuucuaauaaauuauacaaau

SEQ ID NO: 3679617 - RNA, 23 nt, Human
agcuucuagugauuucuggggcc

SEQ ID NO: 3679618 - RNA, 12 nt, Human
agcuucuccaac

SEQ ID NO: 3679619 - RNA, 14 nt, Human
agcuucuccaggcu

SEQ ID NO: 3679620 - RNA, 16 nt, Human
agcuucuccuguguga

SEQ ID NO: 3679621 - RNA, 15 nt, Human
agcuucugaccucag

SEQ ID NO: 3679622 - RNA, 13 nt, Human
agcuucugcuggg

SEQ ID NO: 3679623 - RNA, 23 nt, Human
agcuucugcuuuucugcccuggc

SEQ ID NO: 3679624 - RNA, 21 nt, Human
agcuucuggaauuuguucaag

SEQ ID NO: 3679625 - RNA, 19 nt, Human
agcuucugggagauuuuuu

SEQ ID NO: 3679626 - RNA, 19 nt, Human
agcuucugggguccccagg

SEQ ID NO: 3679627 - RNA, 22 nt, Human
agcuucugggguccccagggcu

SEQ ID NO: 3679628 - RNA, 15 nt, Human
agcuucugguacucu

SEQ ID NO: 3679629 - RNA, 21 nt, Human
agcuucuggugaccuuccaag

SEQ ID NO: 3679630 - RNA, 22 nt, Human
agcuucuggugaccuuccaaga

SEQ ID NO: 3679631 - RNA, 17 nt, Human
agcuucugucuccagcu

SEQ ID NO: 3679632 - RNA, 22 nt, Human
agcuucuguugcugccucaugc

SEQ ID NO: 3679633 - RNA, 23 nt, Human
agcuucuguugcugccucaugcu

SEQ ID NO: 3679634 - RNA, 18 nt, Human
agcuucuuaaaugagaag

SEQ ID NO: 3679635 - RNA, 21 nt, Human
agcuucuuaauauaacugccu

SEQ ID NO: 3679636 - RNA, 14 nt, Human
agcuucuuguuucc

SEQ ID NO: 3679637 - RNA, 16 nt, Human
agcuucuuguuuccuu

SEQ ID NO: 3679638 - RNA, 17 nt, Human
agcuugaaaguuuucag

SEQ ID NO: 3679639 - RNA, 15 nt, Human
agcuugagccugaaa

SEQ ID NO: 3679640 - RNA, 18 nt, Human
agcuugaggguugggcug

SEQ ID NO: 3679641 - RNA, 16 nt, Human
agcuugcccuggugcc

SEQ ID NO: 3679642 - RNA, 21 nt, Human
agcuugcgcauucucauggag

SEQ ID NO: 3679643 - RNA, 23 nt, Human
agcuugcgcauucucauggagaa

SEQ ID NO: 3679644 - RNA, 17 nt, Human
agcuugcucacaucuug

SEQ ID NO: 3679645 - RNA, 15 nt, Human
agcuugcucccugug

SEQ ID NO: 3679646 - RNA, 20 nt, Human
agcuugcuucauugggcugu

SEQ ID NO: 3679647 - RNA, 21 nt, Human
agcuugcuugcuuucuuuuuu

SEQ ID NO: 3679648 - RNA, 23 nt, Human
agcuugcuugcuuucuuuuuuaa

SEQ ID NO: 3679649 - RNA, 18 nt, Human
agcuugcuuugauuuaca

SEQ ID NO: 3679650 - RNA, 22 nt, Human
agcuugcuuugauuuacagcaa

SEQ ID NO: 3679651 - RNA, 17 nt, Human
agcuuggaaaggaccag

SEQ ID NO: 3679652 - RNA, 18 nt, Human
agcuuggaagagccugca

SEQ ID NO: 3679653 - RNA, 17 nt, Human
agcuuggauuaaauaca

SEQ ID NO: 3679654 - RNA, 18 nt, Human
agcuuggauuaaauacau

SEQ ID NO: 3679655 - RNA, 21 nt, Human
agcuuggcagccgagcucgug

SEQ ID NO: 3679656 - RNA, 17 nt, Human
agcuuggcccuuuccuu

SEQ ID NO: 3679657 - RNA, 23 nt, Human
agcuuggcuguagaaggagacag

SEQ ID NO: 3679658 - RNA, 20 nt, Human
agcuugggaaaggugguguu

SEQ ID NO: 3679659 - RNA, 23 nt, Human
agcuugggcagaucucccacaug

SEQ ID NO: 3679660 - RNA, 12 nt, Human
agcuugggccca

SEQ ID NO: 3679661 - RNA, 17 nt, Human
agcuugggcccagcugg

SEQ ID NO: 3679662 - RNA, 23 nt, Human
agcuugggcccagcugggcucug

SEQ ID NO: 3679663 - RNA, 21 nt, Human
agcuuggggccaccaaagcug

SEQ ID NO: 3679664 - RNA, 18 nt, Human
agcuuggguuuuuguuac

SEQ ID NO: 3679665 - RNA, 21 nt, Human
agcuuguaaauagcucaggug

SEQ ID NO: 3679666 - RNA, 20 nt, Human
agcuuguauaguguaaaaua

SEQ ID NO: 3679667 - RNA, 17 nt, Human
agcuuguaugcaaugga

SEQ ID NO: 3679668 - RNA, 18 nt, Human
ugcacaagcuccaagcuc

SEQ ID NO: 3679669 - RNA, 20 nt, Human
ugcacaagcuccaagcuccc

SEQ ID NO: 3679670 - RNA, 14 nt, Human
ugcacaagcugcac

SEQ ID NO: 3679671 - RNA, 18 nt, Human
ugcacaagcugcacccuc

SEQ ID NO: 3679672 - RNA, 21 nt, Human
ugcacaagcugcacccucagg

SEQ ID NO: 3679673 - RNA, 17 nt, Human
ugcacaaggauugaaaa

SEQ ID NO: 3679674 - RNA, 15 nt, Human
ugcacaauaaaaaug

SEQ ID NO: 3679675 - RNA, 17 nt, Human
ugcacaauauugaacuu

SEQ ID NO: 3679676 - RNA, 13 nt, Human
ugcacaaugucuu

SEQ ID NO: 3679677 - RNA, 13 nt, Human
ugcacaauuccau

SEQ ID NO: 3679678 - RNA, 17 nt, Human
ugcacaauuuugauaaa

SEQ ID NO: 3679679 - RNA, 18 nt, Human
ugcacacaaauauuauuu

SEQ ID NO: 3679680 - RNA, 17 nt, Human
ugcacacaauuagauuu

SEQ ID NO: 3679681 - RNA, 22 nt, Human
ugcacacaccagagcccaccuu

SEQ ID NO: 3679682 - RNA, 22 nt, Human
ugcacacagaaauauauauaca

SEQ ID NO: 3679683 - RNA, 14 nt, Human
ugcacacagugcuu

SEQ ID NO: 3679684 - RNA, 16 nt, Human
ugcacaccccacuccc

SEQ ID NO: 3679685 - RNA, 20 nt, Human
ugcacacccuccagagacaa

SEQ ID NO: 3679686 - RNA, 21 nt, Human
ugcacacuagccucuccagga

SEQ ID NO: 3679687 - RNA, 21 nt, Human
ugcacacuccccugcacugga

SEQ ID NO: 3679688 - RNA, 21 nt, Human
ugcacacuugugugugggcug

SEQ ID NO: 3679689 - RNA, 22 nt, Human
ugcacacuuugccauauuuuca

SEQ ID NO: 3679690 - RNA, 18 nt, Human
ugcacacuuuggcccagg

SEQ ID NO: 3679691 - RNA, 17 nt, Human
ugcacacuuugguacca

SEQ ID NO: 3679692 - RNA, 14 nt, Human
ugcacagaaguccu

SEQ ID NO: 3679693 - RNA, 15 nt, Human
ugcacagagaagcug

SEQ ID NO: 3679694 - RNA, 19 nt, Human
ugcacagagaagcugggga

SEQ ID NO: 3679695 - RNA, 13 nt, Human
ugcacagagcucu

SEQ ID NO: 3679696 - RNA, 17 nt, Human
ugcacagaguuguuaca

SEQ ID NO: 3679697 - RNA, 19 nt, Human
ugcacagaguuguuacauu

SEQ ID NO: 3679698 - RNA, 20 nt, Human
ugcacagaguuguuacauuu

SEQ ID NO: 3679699 - RNA, 21 nt, Human
ugcacagaguuguuacauuuu

SEQ ID NO: 3679700 - RNA, 16 nt, Human
ugcacagauauacuuu

SEQ ID NO: 3679701 - RNA, 22 nt, Human
ugcacagcacaaauuaguuaua

SEQ ID NO: 3679702 - RNA, 23 nt, Human
ugcacagcacaaauuaguuauau

SEQ ID NO: 3679703 - RNA, 21 nt, Human
ugcacagcaggcugccagugc

SEQ ID NO: 3679704 - RNA, 20 nt, Human
ugcacagccacuccccggca

SEQ ID NO: 3679705 - RNA, 16 nt, Human
ugcacagcggccccug

SEQ ID NO: 3679706 - RNA, 18 nt, Human
ugcacagcggccccugca

SEQ ID NO: 3679707 - RNA, 14 nt, Human
ugcacagcugucca

SEQ ID NO: 3679708 - RNA, 12 nt, Human
ugcacaggaggg

SEQ ID NO: 3679709 - RNA, 17 nt, Human
ugcacagggcagcuggg

SEQ ID NO: 3679710 - RNA, 17 nt, Human
ugcacaguauuuguaau

SEQ ID NO: 3679711 - RNA, 18 nt, Human
ugcacaguauuuguaauu

SEQ ID NO: 3679712 - RNA, 20 nt, Human
ugcacaguauuuguaauuaa

SEQ ID NO: 3679713 - RNA, 20 nt, Human
ugcacagugcaucucagccc

SEQ ID NO: 3679714 - RNA, 22 nt, Human
ugcacaguuagcaaacuuugua

SEQ ID NO: 3679715 - RNA, 18 nt, Human
ugcacauaaacucuuuua

SEQ ID NO: 3679716 - RNA, 14 nt, Human
ugcacauauggacu

SEQ ID NO: 3679717 - RNA, 15 nt, Human
ugcacaucaaaauau

SEQ ID NO: 3679718 - RNA, 16 nt, Human
ugcacauccauuccca

SEQ ID NO: 3679719 - RNA, 12 nt, Human
ugcacaucccug

SEQ ID NO: 3679720 - RNA, 21 nt, Human
ugcacauccgcgugugccugu

SEQ ID NO: 3679721 - RNA, 14 nt, Human
ugcacaucucugcu

SEQ ID NO: 3679722 - RNA, 22 nt, Human
ugcacaucuguaaaucuacaca

SEQ ID NO: 3679723 - RNA, 19 nt, Human
ugcacaucugugucuuguu

SEQ ID NO: 3679724 - RNA, 14 nt, Human
ugcacaugaacugu

SEQ ID NO: 3679725 - RNA, 21 nt, Human
ugcacaugacucggggguggg

SEQ ID NO: 3679726 - RNA, 14 nt, Human
ugcacaugauuuca

SEQ ID NO: 3679727 - RNA, 16 nt, Human
ugcacaugauuucaca

SEQ ID NO: 3679728 - RNA, 17 nt, Human
ugcacaugauuucacaa

SEQ ID NO: 3679729 - RNA, 19 nt, Human
ugcacaugauuucacaaau

SEQ ID NO: 3679730 - RNA, 15 nt, Human
ugcacaugucuuaau

SEQ ID NO: 3679731 - RNA, 15 nt, Human
ugcacaugucuugua

SEQ ID NO: 3679732 - RNA, 19 nt, Human
ugcacaugugugcgugugc

SEQ ID NO: 3679733 - RNA, 14 nt, Human
ugcacauguuuccu

SEQ ID NO: 3679734 - RNA, 18 nt, Human
ugcacauguuuccucuag

SEQ ID NO: 3679735 - RNA, 13 nt, Human
ugcacauuaaaug

SEQ ID NO: 3679736 - RNA, 20 nt, Human
ugcaccaacccagccgcugc

SEQ ID NO: 3679737 - RNA, 14 nt, Human
ugcaccaagcagga

SEQ ID NO: 3679738 - RNA, 16 nt, Human
ugcaccaccaagccaa

SEQ ID NO: 3679739 - RNA, 12 nt, Human
ugcaccagagca

SEQ ID NO: 3679740 - RNA, 13 nt, Human
ugcaccagcccuu

SEQ ID NO: 3679741 - RNA, 14 nt, Human
ugcaccaggagaca

SEQ ID NO: 3679742 - RNA, 23 nt, Human
ugcaccaggguugaccccagagg

SEQ ID NO: 3679743 - RNA, 16 nt, Human
ugcaccaucccuuuuu

SEQ ID NO: 3679744 - RNA, 22 nt, Human
ugcaccaucccuuuuugaagug

SEQ ID NO: 3679745 - RNA, 19 nt, Human
ugcaccaugcugcugggga

SEQ ID NO: 3679746 - RNA, 23 nt, Human
ugcaccaugcugcuggggaagac

SEQ ID NO: 3679747 - RNA, 15 nt, Human
ugcaccauugcugcu

SEQ ID NO: 3679748 - RNA, 15 nt, Human
ugcacccacugaaag

SEQ ID NO: 3679749 - RNA, 13 nt, Human
ugcacccagaaca

SEQ ID NO: 3679750 - RNA, 16 nt, Human
ugcacccagcccagau

SEQ ID NO: 3679751 - RNA, 13 nt, Human
ugcacccagcccu

SEQ ID NO: 3679752 - RNA, 14 nt, Human
ugcacccagcccug

SEQ ID NO: 3679753 - RNA, 15 nt, Human
ugcacccagcccugg

SEQ ID NO: 3679754 - RNA, 17 nt, Human
ugcacccagcccugguc

SEQ ID NO: 3679755 - RNA, 21 nt, Human
ugcacccaugggcucugacag

SEQ ID NO: 3679756 - RNA, 16 nt, Human
ugcacccaugguacca

SEQ ID NO: 3679757 - RNA, 20 nt, Human
ugcaccccaaagcuuuccug

SEQ ID NO: 3679758 - RNA, 23 nt, Human
ugcaccccaaagcuuuccugccc

SEQ ID NO: 3679759 - RNA, 14 nt, Human
ugcaccccaagucc

SEQ ID NO: 3679760 - RNA, 12 nt, Human
ugcacccccucc

SEQ ID NO: 3679761 - RNA, 12 nt, Human
ugcaccccuccc

SEQ ID NO: 3679762 - RNA, 19 nt, Human
ugcaccccuucucuccucc

SEQ ID NO: 3679763 - RNA, 16 nt, Human
ugcacccgccucuccc

SEQ ID NO: 3679764 - RNA, 14 nt, Human
ugcacccuccgccu

SEQ ID NO: 3679765 - RNA, 14 nt, Human
ugcacccucuaucc

SEQ ID NO: 3679766 - RNA, 15 nt, Human
ugcacccuggggccu

SEQ ID NO: 3679767 - RNA, 16 nt, Human
ugcacccuucuuuucu

SEQ ID NO: 3679768 - RNA, 17 nt, Human
ugcacccuucuuuucuc

SEQ ID NO: 3679769 - RNA, 18 nt, Human
ugcacccuucuuuucuca

SEQ ID NO: 3679770 - RNA, 20 nt, Human
ugcaccgccggccagcuggg

SEQ ID NO: 3679771 - RNA, 19 nt, Human
ugcaccggcuggccuggcc

SEQ ID NO: 3679772 - RNA, 20 nt, Human
ugcaccggcuggccuggccc

SEQ ID NO: 3679773 - RNA, 21 nt, Human
ugcaccggcuggccuggcccc

SEQ ID NO: 3679774 - RNA, 23 nt, Human
ugcaccggcuggccuggccccuc

SEQ ID NO: 3679775 - RNA, 12 nt, Human
ugcaccggggcc

SEQ ID NO: 3679776 - RNA, 16 nt, Human
ugcaccggggccuggg

SEQ ID NO: 3679777 - RNA, 22 nt, Human
ugcaccggggccugggcaggag

SEQ ID NO: 3679778 - RNA, 19 nt, Human
ugcaccuaaagaaaaacaa

SEQ ID NO: 3679779 - RNA, 14 nt, Human
ugcaccucccccca

SEQ ID NO: 3679780 - RNA, 18 nt, Human
ugcaccuccccccacugc

SEQ ID NO: 3679781 - RNA, 20 nt, Human
ugcaccuccccccacugcag

SEQ ID NO: 3679782 - RNA, 16 nt, Human
ugcaccugccagccug

SEQ ID NO: 3679783 - RNA, 18 nt, Human
ugcaccugccagccuggc

SEQ ID NO: 3679784 - RNA, 20 nt, Human
ugcaccugccagccuggcuu

SEQ ID NO: 3679785 - RNA, 17 nt, Human
ugcaccuggaauauaua

SEQ ID NO: 3679786 - RNA, 20 nt, Human
ugcaccuggaauauauaacc

SEQ ID NO: 3679787 - RNA, 13 nt, Human
ugcaccugucccc

SEQ ID NO: 3679788 - RNA, 12 nt, Human
ugcaccugugca

SEQ ID NO: 3679789 - RNA, 22 nt, Human
ugcaccuuaucuuaaagcacuu

SEQ ID NO: 3679790 - RNA, 14 nt, Human
ugcaccuuucuagu

SEQ ID NO: 3679791 - RNA, 19 nt, Human
ugcacgcccaugugugagu

SEQ ID NO: 3679792 - RNA, 20 nt, Human
ugcacgcgcccuuucuacca

SEQ ID NO: 3679793 - RNA, 14 nt, Human
ugcacggugaaugg

SEQ ID NO: 3679794 - RNA, 19 nt, Human
ugcacggugaauggcuuug

SEQ ID NO: 3679795 - RNA, 15 nt, Human
ugcacgucaugggag

SEQ ID NO: 3679796 - RNA, 16 nt, Human
ugcacguggcaugugg

SEQ ID NO: 3679797 - RNA, 16 nt, Human
ugcacguggccucuug

SEQ ID NO: 3679798 - RNA, 22 nt, Human
ugcacguggccucuugagcagu

SEQ ID NO: 3679799 - RNA, 11 nt, Human
ugcacgugugu

SEQ ID NO: 3679800 - RNA, 13 nt, Human
ugcacguguguuu

SEQ ID NO: 3679801 - RNA, 15 nt, Human
ugcacguguguuuuu

SEQ ID NO: 3679802 - RNA, 18 nt, Human
ugcacguguguuuuucua

SEQ ID NO: 3679803 - RNA, 20 nt, Human
ugcacguuaugguguuucuc

SEQ ID NO: 3679804 - RNA, 16 nt, Human
ugcacguuuucaucuc

SEQ ID NO: 3679805 - RNA, 17 nt, Human
ugcacuaacagaguggc

SEQ ID NO: 3679806 - RNA, 15 nt, Human
ugcacuaaggggccc

SEQ ID NO: 3679807 - RNA, 17 nt, Human
ugcacuaaggggcccgg

SEQ ID NO: 3679808 - RNA, 22 nt, Human
ugcacuaaggggcccggccagc

SEQ ID NO: 3679809 - RNA, 16 nt, Human
ugcacuaagucucuuu

SEQ ID NO: 3679810 - RNA, 16 nt, Human
ugcacuacuccucugc

SEQ ID NO: 3679811 - RNA, 19 nt, Human
ugcacuacuccucugcagu

SEQ ID NO: 3679812 - RNA, 16 nt, Human
ugcacuauaugcaaac

SEQ ID NO: 3679813 - RNA, 18 nt, Human
ugcacuauaugcaaacag

SEQ ID NO: 3679814 - RNA, 15 nt, Human
ugcacuaugaggaau

SEQ ID NO: 3679815 - RNA, 14 nt, Human
ugcacucaaaucuu

SEQ ID NO: 3679816 - RNA, 16 nt, Human
ugcacucaaaucuuaa

SEQ ID NO: 3679817 - RNA, 20 nt, Human
ugcacucaaaucuuaagaaa

SEQ ID NO: 3679818 - RNA, 17 nt, Human
ugcagcccccacugccu

SEQ ID NO: 3679819 - RNA, 21 nt, Human
ugcagccccgccuccaggcca

SEQ ID NO: 3679820 - RNA, 23 nt, Human
ugcagccccgccuccaggccaca

SEQ ID NO: 3679821 - RNA, 21 nt, Human
ugcagccccgcgccuccuucc

SEQ ID NO: 3679822 - RNA, 23 nt, Human
ugcagcccguguggccccuucac

SEQ ID NO: 3679823 - RNA, 19 nt, Human
ugcagcccugagaaagccc

SEQ ID NO: 3679824 - RNA, 14 nt, Human
ugcagcccugcugc

SEQ ID NO: 3679825 - RNA, 15 nt, Human
ugcagccgccuuccu

SEQ ID NO: 3679826 - RNA, 17 nt, Human
ugcagccgccuuccuug

SEQ ID NO: 3679827 - RNA, 17 nt, Human
ugcagccggcacagggu

SEQ ID NO: 3679828 - RNA, 19 nt, Human
ugcagccggcacagggucu

SEQ ID NO: 3679829 - RNA, 15 nt, Human
ugcagccucacaguc

SEQ ID NO: 3679830 - RNA, 12 nt, Human
ugcagccucaga

SEQ ID NO: 3679831 - RNA, 13 nt, Human
ugcagccucagga

SEQ ID NO: 3679832 - RNA, 17 nt, Human
ugcagccucaggacugg

SEQ ID NO: 3679833 - RNA, 21 nt, Human
ugcagccucaggacugggagc

SEQ ID NO: 3679834 - RNA, 19 nt, Human
ugcagccuccgcuucccug

SEQ ID NO: 3679835 - RNA, 20 nt, Human
ugcagccuccgcuucccugg

SEQ ID NO: 3679836 - RNA, 23 nt, Human
ugcagccuccgcuucccugguuc

SEQ ID NO: 3679837 - RNA, 16 nt, Human
ugcagccuccuccuga

SEQ ID NO: 3679838 - RNA, 18 nt, Human
ugcagccugcaggaccuc

SEQ ID NO: 3679839 - RNA, 19 nt, Human
ugcagcgaaccaauauuug

SEQ ID NO: 3679840 - RNA, 21 nt, Human
ugcagcuaguccuagugaacc

SEQ ID NO: 3679841 - RNA, 20 nt, Human
ugcagcucaagagaucccaa

SEQ ID NO: 3679842 - RNA, 16 nt, Human
ugcagcucacuacccu

SEQ ID NO: 3679843 - RNA, 19 nt, Human
ugcagcucagaaccacagc

SEQ ID NO: 3679844 - RNA, 14 nt, Human
ugcagcucccuggc

SEQ ID NO: 3679845 - RNA, 18 nt, Human
ugcagcucccuggcuucu

SEQ ID NO: 3679846 - RNA, 16 nt, Human
ugcagcucuuccugga

SEQ ID NO: 3679847 - RNA, 18 nt, Human
ugcagcucuuccuggaca

SEQ ID NO: 3679848 - RNA, 15 nt, Human
ugcagcugaaauuga

SEQ ID NO: 3679849 - RNA, 19 nt, Human
ugcagcugagagaaaauaa

SEQ ID NO: 3679850 - RNA, 15 nt, Human
ugcagcugauuuuaa

SEQ ID NO: 3679851 - RNA, 18 nt, Human
ugcagcugauuuuaacaa

SEQ ID NO: 3679852 - RNA, 19 nt, Human
ugcagcugauuuuaacaau

SEQ ID NO: 3679853 - RNA, 15 nt, Human
ugcagcuggacagag

SEQ ID NO: 3679854 - RNA, 23 nt, Human
ugcagcuguuuuguugacauucu

SEQ ID NO: 3679855 - RNA, 22 nt, Human
ugcagcuuccuuuugagggaca

SEQ ID NO: 3679856 - RNA, 16 nt, Human
ugcagcuucuguccug

SEQ ID NO: 3679857 - RNA, 19 nt, Human
ugcagcuuguagccagccg

SEQ ID NO: 3679858 - RNA, 23 nt, Human
ugcagcuugugugcaaaagcagu

SEQ ID NO: 3679859 - RNA, 13 nt, Human
ugcagcuuuaaaa

SEQ ID NO: 3679860 - RNA, 16 nt, Human
ugcaggaaggagcugc

SEQ ID NO: 3679861 - RNA, 22 nt, Human
ugcaggaaggagcugccuggac

SEQ ID NO: 3679862 - RNA, 16 nt, Human
ugcaggaauaaggccu

SEQ ID NO: 3679863 - RNA, 19 nt, Human
ugcaggaaucaaaaauuga

SEQ ID NO: 3679864 - RNA, 15 nt, Human
ugcaggaccugccug

SEQ ID NO: 3679865 - RNA, 19 nt, Human
ugcaggaccugccuguagc

SEQ ID NO: 3679866 - RNA, 20 nt, Human
ugcaggaucucaccaggcag

SEQ ID NO: 3679867 - RNA, 22 nt, Human
ugcaggaucucaccaggcagcc

SEQ ID NO: 3679868 - RNA, 19 nt, Human
ugcaggaugauuguacaga

SEQ ID NO: 3679869 - RNA, 14 nt, Human
ugcaggaugguguc

SEQ ID NO: 3679870 - RNA, 18 nt, Human
ugcaggauggugucucuu

SEQ ID NO: 3679871 - RNA, 17 nt, Human
ugcaggauucucaccag

SEQ ID NO: 3679872 - RNA, 21 nt, Human
ugcaggauucucaccagcugu

SEQ ID NO: 3679873 - RNA, 16 nt, Human
ugcaggcaccuuagug

SEQ ID NO: 3679874 - RNA, 19 nt, Human
ugcaggcaccuuaguggcu

SEQ ID NO: 3679875 - RNA, 12 nt, Human
ugcaggcagaca

SEQ ID NO: 3679876 - RNA, 13 nt, Human
ugcaggcagccag

SEQ ID NO: 3679877 - RNA, 15 nt, Human
ugcaggcagccaggc

SEQ ID NO: 3679878 - RNA, 16 nt, Human
ugcaggcagccaggcc

SEQ ID NO: 3679879 - RNA, 18 nt, Human
ugcaggcagccaggccac

SEQ ID NO: 3679880 - RNA, 10 nt, Human
ugcaggcagg

SEQ ID NO: 3679881 - RNA, 14 nt, Human
ugcaggcaggaaca

SEQ ID NO: 3679882 - RNA, 13 nt, Human
ugcaggcaggcug

SEQ ID NO: 3679883 - RNA, 12 nt, Human
ugcaggcccacc

SEQ ID NO: 3679884 - RNA, 16 nt, Human
ugcaggcccuggccuc

SEQ ID NO: 3679885 - RNA, 19 nt, Human
ugcaggcccuggccucccc

SEQ ID NO: 3679886 - RNA, 13 nt, Human
ugcaggcuggcca

SEQ ID NO: 3679887 - RNA, 16 nt, Human
ugcaggcuuaauaaaa

SEQ ID NO: 3679888 - RNA, 20 nt, Human
ugcagggaaaauuauuugca

SEQ ID NO: 3679889 - RNA, 21 nt, Human
ugcagggaaaauuauuugcau

SEQ ID NO: 3679890 - RNA, 24 nt, Human
ugcagggaggagguggcagcccug

SEQ ID NO: 3679891 - RNA, 20 nt, Human
ugcagggagggcaguuuucu

SEQ ID NO: 3679892 - RNA, 13 nt, Human
ugcagggaguccg

SEQ ID NO: 3679893 - RNA, 14 nt, Human
ugcagggauguggg

SEQ ID NO: 3679894 - RNA, 23 nt, Human
ugcagggauguggguuccacaga

SEQ ID NO: 3679895 - RNA, 10 nt, Human
ugcagggcca

SEQ ID NO: 3679896 - RNA, 13 nt, Human
ugcagggccucca

SEQ ID NO: 3679897 - RNA, 22 nt, Human
ugcagggggugugucugcucag

SEQ ID NO: 3679898 - RNA, 19 nt, Human
ugcaggguccucuucuggg

SEQ ID NO: 3679899 - RNA, 19 nt, Human
ugcaggguggugcugggac

SEQ ID NO: 3679900 - RNA, 15 nt, Human
ugcagguagaccugu

SEQ ID NO: 3679901 - RNA, 21 nt, Human
ugcaggucaaguugucagguu

SEQ ID NO: 3679902 - RNA, 11 nt, Human
ugcaggucccu

SEQ ID NO: 3679903 - RNA, 14 nt, Human
ugcaggucccuaau

SEQ ID NO: 3679904 - RNA, 20 nt, Human
ugcaggucccuaauaaagcu

SEQ ID NO: 3679905 - RNA, 21 nt, Human
ugcaggucuuuaaaucauuuu

SEQ ID NO: 3679906 - RNA, 19 nt, Human
ugcaggugagcccauggcc

SEQ ID NO: 3679907 - RNA, 21 nt, Human
ugcaggugcuauuguuacucu

SEQ ID NO: 3679908 - RNA, 14 nt, Human
ugcaggugcugcug

SEQ ID NO: 3679909 - RNA, 20 nt, Human
ugcagguggccaaguuccuc

SEQ ID NO: 3679910 - RNA, 23 nt, Human
ugcagguggggguugcuguauaa

SEQ ID NO: 3679911 - RNA, 19 nt, Human
ugcagguggugucgggccc

SEQ ID NO: 3679912 - RNA, 15 nt, Human
ugcagguucauggau

SEQ ID NO: 3679913 - RNA, 20 nt, Human
ugcagguucuucuuccugaa

SEQ ID NO: 3679914 - RNA, 13 nt, Human
ugcaguaaaucuu

SEQ ID NO: 3679915 - RNA, 18 nt, Human
ugcaguaaaucuuuuaca

SEQ ID NO: 3679916 - RNA, 14 nt, Human
ugcaguagauuuuc

SEQ ID NO: 3679917 - RNA, 19 nt, Human
ugcaguagauuuucuuuaa

SEQ ID NO: 3679918 - RNA, 18 nt, Human
ugcaguaggggaggagca

SEQ ID NO: 3679919 - RNA, 21 nt, Human
ugcaguagucucugugcuuug

SEQ ID NO: 3679920 - RNA, 14 nt, Human
ugcaguauagaaua

SEQ ID NO: 3679921 - RNA, 20 nt, Human
ugcaguaucggcacuguaca

SEQ ID NO: 3679922 - RNA, 16 nt, Human
ugcaguaugaaaauaa

SEQ ID NO: 3679923 - RNA, 16 nt, Human
ugcaguaugguacauu

SEQ ID NO: 3679924 - RNA, 22 nt, Human
ugcaguaugguacauuuuucaa

SEQ ID NO: 3679925 - RNA, 17 nt, Human
ugcagucacuggagguu

SEQ ID NO: 3679926 - RNA, 11 nt, Human
ugcagucccaa

SEQ ID NO: 3679927 - RNA, 14 nt, Human
ugcaguccugggau

SEQ ID NO: 3679928 - RNA, 13 nt, Human
ugcagucuccucu

SEQ ID NO: 3679929 - RNA, 21 nt, Human
ugcagucucuauaccaauaaa

SEQ ID NO: 3679930 - RNA, 15 nt, Human
ugcagucugcuucug

SEQ ID NO: 3679931 - RNA, 19 nt, Human
ugcagucuggcugagcccu

SEQ ID NO: 3679932 - RNA, 19 nt, Human
ugcagucuguccaggcucg

SEQ ID NO: 3679933 - RNA, 14 nt, Human
ugcagugagccgag

SEQ ID NO: 3679934 - RNA, 20 nt, Human
ugcagugauauggcagaaga

SEQ ID NO: 3679935 - RNA, 21 nt, Human
ugcagugauauggcagaagac

SEQ ID NO: 3679936 - RNA, 22 nt, Human
ugcagugauauggcagaagaca

SEQ ID NO: 3679937 - RNA, 22 nt, Human
ugcagugauuaaggucucucuu

SEQ ID NO: 3679938 - RNA, 16 nt, Human
ugcagugcaguauaga

SEQ ID NO: 3679939 - RNA, 17 nt, Human
ugcagugcaguauagaa

SEQ ID NO: 3679940 - RNA, 16 nt, Human
ugcagugccccuagcu

SEQ ID NO: 3679941 - RNA, 17 nt, Human
ugcagugccccuagcuu

SEQ ID NO: 3679942 - RNA, 12 nt, Human
ugcagugccuug

SEQ ID NO: 3679943 - RNA, 16 nt, Human
ugcagugcugcuuugc

SEQ ID NO: 3679944 - RNA, 22 nt, Human
ugcaguggcaucaucucagcuc

SEQ ID NO: 3679945 - RNA, 22 nt, Human
ugcaguggcgaaaucccugcuc

SEQ ID NO: 3679946 - RNA, 13 nt, Human
ugcagugggguuu

SEQ ID NO: 3679947 - RNA, 21 nt, Human
ugcaguggugcgaucuggguu

SEQ ID NO: 3679948 - RNA, 18 nt, Human
ugcaguguucgcuuggcu

SEQ ID NO: 3679949 - RNA, 18 nt, Human
ugcaguuacaaauuauaa

SEQ ID NO: 3679950 - RNA, 21 nt, Human
ugcaguuacaaauuauaaugu

SEQ ID NO: 3679951 - RNA, 19 nt, Human
ugcaguucagcaccacccu

SEQ ID NO: 3679952 - RNA, 23 nt, Human
ugcaguuccccuggaagcagugc

SEQ ID NO: 3679953 - RNA, 17 nt, Human
ugcaguucuacucaggc

SEQ ID NO: 3679954 - RNA, 17 nt, Human
ugcaguucuaguuugca

SEQ ID NO: 3679955 - RNA, 12 nt, Human
ugcaguucugaa

SEQ ID NO: 3679956 - RNA, 15 nt, Human
ugcaguucugaagaa

SEQ ID NO: 3679957 - RNA, 17 nt, Human
ugcaguucugaagaaga

SEQ ID NO: 3679958 - RNA, 18 nt, Human
ugcaguucugaagaagau

SEQ ID NO: 3679959 - RNA, 14 nt, Human
ugcaguucugcagc

SEQ ID NO: 3679960 - RNA, 13 nt, Human
ugcaguucuugag

SEQ ID NO: 3679961 - RNA, 17 nt, Human
ugcaguucuugaguugc

SEQ ID NO: 3679962 - RNA, 17 nt, Human
ugcaguugacagcaggu

SEQ ID NO: 3679963 - RNA, 14 nt, Human
ugcaguugucucug

SEQ ID NO: 3679964 - RNA, 15 nt, Human
ugcaguugucucugu

SEQ ID NO: 3679965 - RNA, 13 nt, Human
ugcaguuugaaau

SEQ ID NO: 3679966 - RNA, 16 nt, Human
ugcaguuugaaauucu

SEQ ID NO: 3679967 - RNA, 17 nt, Human
ugcaguuugaaauucug

SEQ ID NO: 3679968 - RNA, 18 nt, Human
ugcaguuugaaauucuga

SEQ ID NO: 3679969 - RNA, 20 nt, Human
ugcaguuugaaauucugaau

SEQ ID NO: 3679970 - RNA, 23 nt, Human
ugcaguuugagacaggagaccug

SEQ ID NO: 3679971 - RNA, 21 nt, Human
ugcaguuugguguguccuccg

SEQ ID NO: 3679972 - RNA, 18 nt, Human
ugcaguuuugguguguaa

SEQ ID NO: 3679973 - RNA, 15 nt, Human
ugcaguuuuucagag

SEQ ID NO: 3679974 - RNA, 14 nt, Human
ugcaguuuuucagg

SEQ ID NO: 3679975 - RNA, 15 nt, Human
ugcaguuuuucauuu

SEQ ID NO: 3679976 - RNA, 11 nt, Human
ugcauaaaaug

SEQ ID NO: 3679977 - RNA, 13 nt, Human
ugcauaaaauguu

SEQ ID NO: 3679978 - RNA, 14 nt, Human
ugcauaaauaugca

SEQ ID NO: 3679979 - RNA, 17 nt, Human
ugcauaacaauuccucu

SEQ ID NO: 3679980 - RNA, 23 nt, Human
ugcauaacguauaaaagccuguu

SEQ ID NO: 3679981 - RNA, 18 nt, Human
ugcauaagugaaaaucuu

SEQ ID NO: 3679982 - RNA, 19 nt, Human
ugcauaauaagcuaaagag

SEQ ID NO: 3679983 - RNA, 22 nt, Human
ugcauaauaagcuaaagaggcu

SEQ ID NO: 3679984 - RNA, 23 nt, Human
ugcauaauaauccugcaaaguac

SEQ ID NO: 3679985 - RNA, 19 nt, Human
ugcauaauucugaaguuau

SEQ ID NO: 3679986 - RNA, 13 nt, Human
ugcauaauuucag

SEQ ID NO: 3679987 - RNA, 20 nt, Human
ugcauacaaacaagcauaua

SEQ ID NO: 3679988 - RNA, 9 nt, Human
ugcauacac

SEQ ID NO: 3679989 - RNA, 10 nt, Human
ugcauacaca

SEQ ID NO: 3679990 - RNA, 13 nt, Human
ugcauacacacac

SEQ ID NO: 3679991 - RNA, 15 nt, Human
ugcauacagaaauau

SEQ ID NO: 3679992 - RNA, 12 nt, Human
ugcauaccaacc

SEQ ID NO: 3679993 - RNA, 12 nt, Human
ugcauaccacuu

SEQ ID NO: 3679994 - RNA, 16 nt, Human
ugcauaccacuuuugu

SEQ ID NO: 3679995 - RNA, 20 nt, Human
ugcauaccacuuuuguucuu

SEQ ID NO: 3679996 - RNA, 12 nt, Human
ugcauacuauua

SEQ ID NO: 3679997 - RNA, 17 nt, Human
ugcauacuauuaaacau

SEQ ID NO: 3679998 - RNA, 18 nt, Human
ugcauacuauuaaacaug

SEQ ID NO: 3679999 - RNA, 19 nt, Human
ugcauacuggacucuucaa

SEQ ID NO: 3680000 - RNA, 20 nt, Human
ugcauacuggacucuucaaa

SEQ ID NO: 3680001 - RNA, 20 nt, Human
ugcauacuuaccuagugaaa

SEQ ID NO: 3680002 - RNA, 15 nt, Human
ugcauacuucaaaag

SEQ ID NO: 3680003 - RNA, 21 nt, Human
ugcauacuucaaaaguauuuu

SEQ ID NO: 3680004 - RNA, 22 nt, Human
ugcauacuuuguauuuugauua

SEQ ID NO: 3680005 - RNA, 16 nt, Human
ugcauagaacugggua

SEQ ID NO: 3680006 - RNA, 13 nt, Human
ugcauagaaggag

SEQ ID NO: 3680007 - RNA, 20 nt, Human
ugcauagauucccugagcag

SEQ ID NO: 3680008 - RNA, 14 nt, Human
ugcauaguauucca

SEQ ID NO: 3680009 - RNA, 15 nt, Human
ugcauagucccagcu

SEQ ID NO: 3680010 - RNA, 16 nt, Human
ugcauagugcugggau

SEQ ID NO: 3680011 - RNA, 18 nt, Human
ugcauaguuucuuuauuu

SEQ ID NO: 3680012 - RNA, 14 nt, Human
ugcauaucuucauc

SEQ ID NO: 3680013 - RNA, 21 nt, Human
ugcauaugucacuagaaugga

SEQ ID NO: 3680014 - RNA, 15 nt, Human
ugcauauguugaaua

SEQ ID NO: 3680015 - RNA, 13 nt, Human
ugcauauguuucg

SEQ ID NO: 3680016 - RNA, 20 nt, Human
ugcauauuauaaaggauaaa

SEQ ID NO: 3680017 - RNA, 15 nt, Human
ugcauauugcauacu

SEQ ID NO: 3680018 - RNA, 17 nt, Human
ugcauauuguacacuuu

SEQ ID NO: 3680019 - RNA, 20 nt, Human
ugcauauuuauaaaaauaaa

SEQ ID NO: 3680020 - RNA, 15 nt, Human
ugcauauuuauccaa

SEQ ID NO: 3680021 - RNA, 14 nt, Human
ugcaucaauccugu

SEQ ID NO: 3680022 - RNA, 22 nt, Human
ugcaucaauuuuucuuauuuca

SEQ ID NO: 3680023 - RNA, 22 nt, Human
ugcaucagaaagggagggcucu

SEQ ID NO: 3680024 - RNA, 13 nt, Human
ugcaucagguccu

SEQ ID NO: 3680025 - RNA, 16 nt, Human
ugcaucauccuugcag

SEQ ID NO: 3680026 - RNA, 16 nt, Human
ugcauccaaaggugcu

SEQ ID NO: 3680027 - RNA, 16 nt, Human
ugcauccaacuccagg

SEQ ID NO: 3680028 - RNA, 17 nt, Human
ugcauccaacuccagga

SEQ ID NO: 3680029 - RNA, 20 nt, Human
ugcauccagagauucauuuu

SEQ ID NO: 3680030 - RNA, 20 nt, Human
ugcauccauuccucagggac

SEQ ID NO: 3680031 - RNA, 21 nt, Human
ugcauccauuccucagggaca

SEQ ID NO: 3680032 - RNA, 19 nt, Human
ugcauccauucuccugagg

SEQ ID NO: 3680033 - RNA, 12 nt, Human
ugcaucccagca

SEQ ID NO: 3680034 - RNA, 16 nt, Human
ugcauccccuuggcug

SEQ ID NO: 3680035 - RNA, 14 nt, Human
ugcauccuccaaga

SEQ ID NO: 3680036 - RNA, 14 nt, Human
ugcauccuccgccu

SEQ ID NO: 3680037 - RNA, 15 nt, Human
ugcauccuccgccuc

SEQ ID NO: 3680038 - RNA, 19 nt, Human
ugcauccucuggagccagc

SEQ ID NO: 3680039 - RNA, 15 nt, Human
ugcaucguuucaucu

SEQ ID NO: 3680040 - RNA, 17 nt, Human
ugcaucguuucaucuuc

SEQ ID NO: 3680041 - RNA, 17 nt, Human
ugcaucuaagcccaugg

SEQ ID NO: 3680042 - RNA, 16 nt, Human
ugcaucuacucaggcc

SEQ ID NO: 3680043 - RNA, 19 nt, Human
ugcaucucaaaauuauucu

SEQ ID NO: 3680044 - RNA, 14 nt, Human
ugcaucucagccca

SEQ ID NO: 3680045 - RNA, 21 nt, Human
ugcaucugaccagcagcgccu

SEQ ID NO: 3680046 - RNA, 19 nt, Human
ugcaucugggauucccacc

SEQ ID NO: 3680047 - RNA, 21 nt, Human
ugcaucuggguagcuguaagg

SEQ ID NO: 3680048 - RNA, 21 nt, Human
ugcaucuguauaaguaagaaa

SEQ ID NO: 3680049 - RNA, 22 nt, Human
ugcaucuguauaaguaagaaaa

SEQ ID NO: 3680050 - RNA, 14 nt, Human
ugcaucuguccuca

SEQ ID NO: 3680051 - RNA, 17 nt, Human
ugcaucuuacugaaggu

SEQ ID NO: 3680052 - RNA, 21 nt, Human
ugcaucuuauagcacuuugaa

SEQ ID NO: 3680053 - RNA, 16 nt, Human
ugcaucuuugaugugu

SEQ ID NO: 3680054 - RNA, 20 nt, Human
ugcaugaagagaagcaauuu

SEQ ID NO: 3680055 - RNA, 22 nt, Human
ugcaugaagagaagcaauuuug

SEQ ID NO: 3680056 - RNA, 19 nt, Human
ugcaugaagguuucugaaa

SEQ ID NO: 3680057 - RNA, 20 nt, Human
ugcaugaaguaauaugcaca

SEQ ID NO: 3680058 - RNA, 19 nt, Human
ugcaugaauaaaauuauuc

SEQ ID NO: 3680059 - RNA, 19 nt, Human
ugcaugaauaucauacaaa

SEQ ID NO: 3680060 - RNA, 14 nt, Human
ugcaugauguuugc

SEQ ID NO: 3680061 - RNA, 15 nt, Human
ugcaugauguuugcc

SEQ ID NO: 3680062 - RNA, 17 nt, Human
ugcaugauguuugccca

SEQ ID NO: 3680063 - RNA, 15 nt, Human
ugcaugauugcagaa

SEQ ID NO: 3680064 - RNA, 15 nt, Human
ugcaugcaaaugagc

SEQ ID NO: 3680065 - RNA, 18 nt, Human
ugcaugcagccacugugc

SEQ ID NO: 3680066 - RNA, 18 nt, Human
ugcaugcaugcaaaugag

SEQ ID NO: 3680067 - RNA, 14 nt, Human
ugcaugcccucuca

SEQ ID NO: 3680068 - RNA, 15 nt, Human
ugcaugcccucucag

SEQ ID NO: 3680069 - RNA, 16 nt, Human
ugcaugcccucucagg

SEQ ID NO: 3680070 - RNA, 15 nt, Human
ugcaugcggcccagc

SEQ ID NO: 3680071 - RNA, 16 nt, Human
ugcaugcggcccagcc

SEQ ID NO: 3680072 - RNA, 18 nt, Human
ugcaugcggcccagcccg

SEQ ID NO: 3680073 - RNA, 19 nt, Human
ugcaugcucucugcagcca

SEQ ID NO: 3680074 - RNA, 13 nt, Human
ugcaugcugcuuu

SEQ ID NO: 3680075 - RNA, 17 nt, Human
ugcaugcugcuuuaauu

SEQ ID NO: 3680076 - RNA, 20 nt, Human
ugcaugcugcuuuaauugug

SEQ ID NO: 3680077 - RNA, 23 nt, Human
ugcaugcugcuuuaauugugaau

SEQ ID NO: 3680078 - RNA, 15 nt, Human
ugcaugcugucccuu

SEQ ID NO: 3680079 - RNA, 18 nt, Human
ugcaugcugucccuuacg

SEQ ID NO: 3680080 - RNA, 14 nt, Human
ugcaugcuuuccau

SEQ ID NO: 3680081 - RNA, 15 nt, Human
ugcauggaaaccuga

SEQ ID NO: 3680082 - RNA, 23 nt, Human
ugcauggaaauucccuucaucug

SEQ ID NO: 3680083 - RNA, 18 nt, Human
ugcauggaccuaacauuc

SEQ ID NO: 3680084 - RNA, 13 nt, Human
ugcauggacugug

SEQ ID NO: 3680085 - RNA, 16 nt, Human
ugcauggauuucuuug

SEQ ID NO: 3680086 - RNA, 19 nt, Human
ugcauggcacuugcaucug

SEQ ID NO: 3680087 - RNA, 22 nt, Human
ugcauggcagcaggccuguugc

SEQ ID NO: 3680088 - RNA, 22 nt, Human
ugcauggcagggggcugcugcu

SEQ ID NO: 3680089 - RNA, 19 nt, Human
ugcauggcuccagaaaugu

SEQ ID NO: 3680090 - RNA, 16 nt, Human
ugcaugggccagcccc

SEQ ID NO: 3680091 - RNA, 17 nt, Human
ugcaugggugaagggag

SEQ ID NO: 3680092 - RNA, 17 nt, Human
ugcauggguuuuguagg

SEQ ID NO: 3680093 - RNA, 17 nt, Human
ugcauggugccccagga

SEQ ID NO: 3680094 - RNA, 15 nt, Human
ugcaugguggccaga

SEQ ID NO: 3680095 - RNA, 17 nt, Human
ugcaugguuucagcacu

SEQ ID NO: 3680096 - RNA, 18 nt, Human
ugcaugguuucagcacua

SEQ ID NO: 3680097 - RNA, 20 nt, Human
ugcauguaaacacgccugca

SEQ ID NO: 3680098 - RNA, 23 nt, Human
ugcauguaacgcaaguucccagu

SEQ ID NO: 3680099 - RNA, 21 nt, Human
ugcauguaaucaacauggcua

SEQ ID NO: 3680100 - RNA, 16 nt, Human
ugcauguacuaucuua

SEQ ID NO: 3680101 - RNA, 17 nt, Human
ugcauguacuguauauu

SEQ ID NO: 3680102 - RNA, 18 nt, Human
ugcauguagaggcuuguu

SEQ ID NO: 3680103 - RNA, 21 nt, Human
ugcaugucgugaccaacuaga

SEQ ID NO: 3680104 - RNA, 20 nt, Human
ugcaugugacucugaagcug

SEQ ID NO: 3680105 - RNA, 24 nt, Human
ugcaugugguuugguuccucucug

SEQ ID NO: 3680106 - RNA, 12 nt, Human
ugcaugugugcg

SEQ ID NO: 3680107 - RNA, 19 nt, Human
ugcauguguguauaagugc

SEQ ID NO: 3680108 - RNA, 14 nt, Human
ugcaugugugugcu

SEQ ID NO: 3680109 - RNA, 22 nt, Human
ugcauguuauguuuaauaagcu

SEQ ID NO: 3680110 - RNA, 14 nt, Human
ugcauguuccacua

SEQ ID NO: 3680111 - RNA, 18 nt, Human
ugcauguugaccaugucu

SEQ ID NO: 3680112 - RNA, 19 nt, Human
ugcauguugucuaagaaau

SEQ ID NO: 3680113 - RNA, 20 nt, Human
ugcauguugucuaagaaauu

SEQ ID NO: 3680114 - RNA, 19 nt, Human
ugcauguuuuccagcuccu

SEQ ID NO: 3680115 - RNA, 21 nt, Human
ugcauguuuuccagcuccuca

SEQ ID NO: 3680116 - RNA, 14 nt, Human
ugcauuaaaagaaa

SEQ ID NO: 3680117 - RNA, 15 nt, Human
ugcauuaaaagaaaa

SEQ ID NO: 3680118 - RNA, 15 nt, Human
ugccauauucuguug

SEQ ID NO: 3680119 - RNA, 21 nt, Human
ugccauauucuguuggccagu

SEQ ID NO: 3680120 - RNA, 16 nt, Human
ugccauauugcacaug

SEQ ID NO: 3680121 - RNA, 19 nt, Human
ugccauauugcacaugucu

SEQ ID NO: 3680122 - RNA, 13 nt, Human
ugccauauuuuca

SEQ ID NO: 3680123 - RNA, 14 nt, Human
ugccauauuuucac

SEQ ID NO: 3680124 - RNA, 17 nt, Human
ugccauauuuucaccau

SEQ ID NO: 3680125 - RNA, 15 nt, Human
ugccaucaaacugua

SEQ ID NO: 3680126 - RNA, 17 nt, Human
ugccaucaaacuguaaa

SEQ ID NO: 3680127 - RNA, 13 nt, Human
ugccaucaaauga

SEQ ID NO: 3680128 - RNA, 22 nt, Human
ugccaucaauaaaaaauuauga

SEQ ID NO: 3680129 - RNA, 16 nt, Human
ugccaucaucuccugc

SEQ ID NO: 3680130 - RNA, 23 nt, Human
ugccaucaucuccugccuuccuc

SEQ ID NO: 3680131 - RNA, 13 nt, Human
ugccaucauguuu

SEQ ID NO: 3680132 - RNA, 22 nt, Human
ugccaucauguuuacagaggac

SEQ ID NO: 3680133 - RNA, 18 nt, Human
ugccaucauugcugucug

SEQ ID NO: 3680134 - RNA, 21 nt, Human
ugccaucauugcugucugcag

SEQ ID NO: 3680135 - RNA, 21 nt, Human
ugccauccagguucagcuugu

SEQ ID NO: 3680136 - RNA, 15 nt, Human
ugccaucccucccuc

SEQ ID NO: 3680137 - RNA, 20 nt, Human
ugccaucccucccuccaccu

SEQ ID NO: 3680138 - RNA, 21 nt, Human
ugccaucccucccuccaccuc

SEQ ID NO: 3680139 - RNA, 13 nt, Human
ugccauccucuuu

SEQ ID NO: 3680140 - RNA, 16 nt, Human
ugccauccuggcccag

SEQ ID NO: 3680141 - RNA, 21 nt, Human
ugccauccuggcccagggcau

SEQ ID NO: 3680142 - RNA, 21 nt, Human
ugccaucucaccuccugcugg

SEQ ID NO: 3680143 - RNA, 16 nt, Human
ugccaucugugggcac

SEQ ID NO: 3680144 - RNA, 13 nt, Human
ugccaucuuccca

SEQ ID NO: 3680145 - RNA, 20 nt, Human
ugccaugacaacuucuaauu

SEQ ID NO: 3680146 - RNA, 20 nt, Human
ugccaugagccgcccaaggc

SEQ ID NO: 3680147 - RNA, 16 nt, Human
ugccaugaugccucug

SEQ ID NO: 3680148 - RNA, 16 nt, Human
ugccauggaagaggcu

SEQ ID NO: 3680149 - RNA, 23 nt, Human
ugccauggaagaggcuacagggc

SEQ ID NO: 3680150 - RNA, 17 nt, Human
ugccauggaggcacaca

SEQ ID NO: 3680151 - RNA, 23 nt, Human
ugccauggaggcacacagcugca

SEQ ID NO: 3680152 - RNA, 19 nt, Human
ugccaugggcuucacugua

SEQ ID NO: 3680153 - RNA, 23 nt, Human
ugccaugggcuucacuguauaaa

SEQ ID NO: 3680154 - RNA, 19 nt, Human
ugccauguaccuccccugc

SEQ ID NO: 3680155 - RNA, 22 nt, Human
ugccauguaccuccccugccuu

SEQ ID NO: 3680156 - RNA, 15 nt, Human
ugccaugugcaccuu

SEQ ID NO: 3680157 - RNA, 16 nt, Human
ugccauuaucccugaa

SEQ ID NO: 3680158 - RNA, 21 nt, Human
ugccauuauuuucugucagau

SEQ ID NO: 3680159 - RNA, 15 nt, Human
ugccauugcacucca

SEQ ID NO: 3680160 - RNA, 20 nt, Human
ugccauuguagcgucuuucu

SEQ ID NO: 3680161 - RNA, 17 nt, Human
ugccauugucuuuauau

SEQ ID NO: 3680162 - RNA, 17 nt, Human
ugccauuugauaccccu

SEQ ID NO: 3680163 - RNA, 21 nt, Human
ugccauuugcacccuccgccu

SEQ ID NO: 3680164 - RNA, 16 nt, Human
ugccauuuuaaggaaa

SEQ ID NO: 3680165 - RNA, 20 nt, Human
ugccauuuuaaggaaaacua

SEQ ID NO: 3680166 - RNA, 19 nt, Human
ugcccaaaaauaugguuga

SEQ ID NO: 3680167 - RNA, 16 nt, Human
ugcccaaagagcacaa

SEQ ID NO: 3680168 - RNA, 23 nt, Human
ugcccaaagcagcacuuauaaau

SEQ ID NO: 3680169 - RNA, 20 nt, Human
ugcccaaauccuuagaucug

SEQ ID NO: 3680170 - RNA, 18 nt, Human
ugcccaacaccagccccu

SEQ ID NO: 3680171 - RNA, 23 nt, Human
ugcccaacaccagccccugcccc

SEQ ID NO: 3680172 - RNA, 17 nt, Human
ugcccaaccucagcaac

SEQ ID NO: 3680173 - RNA, 22 nt, Human
ugcccaacuacuaucucagaga

SEQ ID NO: 3680174 - RNA, 13 nt, Human
ugcccaagccaga

SEQ ID NO: 3680175 - RNA, 18 nt, Human
ugcccaagccagaggcug

SEQ ID NO: 3680176 - RNA, 16 nt, Human
ugcccaauuggaggaa

SEQ ID NO: 3680177 - RNA, 16 nt, Human
ugcccacaccuccugg

SEQ ID NO: 3680178 - RNA, 20 nt, Human
ugcccacaggaucagucuga

SEQ ID NO: 3680179 - RNA, 14 nt, Human
ugcccacaggccgc

SEQ ID NO: 3680180 - RNA, 16 nt, Human
ugcccacaucccaggc

SEQ ID NO: 3680181 - RNA, 23 nt, Human
ugcccacaucccaggcuucaccc

SEQ ID NO: 3680182 - RNA, 23 nt, Human
ugcccacauguguccaucccagc

SEQ ID NO: 3680183 - RNA, 17 nt, Human
ugcccaccaacauccca

SEQ ID NO: 3680184 - RNA, 12 nt, Human
ugcccaccccac

SEQ ID NO: 3680185 - RNA, 13 nt, Human
ugcccaccccacc

SEQ ID NO: 3680186 - RNA, 16 nt, Human
ugcccaccccaccccc

SEQ ID NO: 3680187 - RNA, 14 nt, Human
ugcccacccccuca

SEQ ID NO: 3680188 - RNA, 18 nt, Human
ugcccacccccucaagcc

SEQ ID NO: 3680189 - RNA, 13 nt, Human
ugcccacccccug

SEQ ID NO: 3680190 - RNA, 15 nt, Human
ugcccacccccugcc

SEQ ID NO: 3680191 - RNA, 22 nt, Human
ugcccacccucuggagaaggug

SEQ ID NO: 3680192 - RNA, 13 nt, Human
ugcccaccugccu

SEQ ID NO: 3680193 - RNA, 16 nt, Human
ugcccaccugccuggc

SEQ ID NO: 3680194 - RNA, 21 nt, Human
ugcccaccugccuggccggcc

SEQ ID NO: 3680195 - RNA, 22 nt, Human
ugcccaccugccuggccggcca

SEQ ID NO: 3680196 - RNA, 18 nt, Human
ugcccaccuggccucugc

SEQ ID NO: 3680197 - RNA, 21 nt, Human
ugcccacucccugcaaccuga

SEQ ID NO: 3680198 - RNA, 20 nt, Human
ugcccacuccugcucugcuc

SEQ ID NO: 3680199 - RNA, 22 nt, Human
ugcccacugcugcaguagggga

SEQ ID NO: 3680200 - RNA, 17 nt, Human
ugcccacugucucuccu

SEQ ID NO: 3680201 - RNA, 19 nt, Human
ugcccagaauaaguuauug

SEQ ID NO: 3680202 - RNA, 16 nt, Human
ugcccagaauacugau

SEQ ID NO: 3680203 - RNA, 16 nt, Human
ugcccagaauucccag

SEQ ID NO: 3680204 - RNA, 22 nt, Human
ugcccagaauucccagcugucu

SEQ ID NO: 3680205 - RNA, 23 nt, Human
ugcccagaauucccagcugucug

SEQ ID NO: 3680206 - RNA, 19 nt, Human
ugcccagaccccucuggcc

SEQ ID NO: 3680207 - RNA, 16 nt, Human
ugcccagagacccagc

SEQ ID NO: 3680208 - RNA, 12 nt, Human
ugcccagagaug

SEQ ID NO: 3680209 - RNA, 17 nt, Human
ugcccagagaugccucc

SEQ ID NO: 3680210 - RNA, 12 nt, Human
ugcccagagcug

SEQ ID NO: 3680211 - RNA, 13 nt, Human
ugcccagagcugg

SEQ ID NO: 3680212 - RNA, 21 nt, Human
ugcccagaggacucccaaccc

SEQ ID NO: 3680213 - RNA, 18 nt, Human
ugcccagagggcccaggc

SEQ ID NO: 3680214 - RNA, 15 nt, Human
ugcccagaguugcug

SEQ ID NO: 3680215 - RNA, 11 nt, Human
ugcccagcccc

SEQ ID NO: 3680216 - RNA, 13 nt, Human
ugcccagccccuu

SEQ ID NO: 3680217 - RNA, 16 nt, Human
ugcccagccccuucug

SEQ ID NO: 3680218 - RNA, 21 nt, Human
ugcccagccccuucugaccca

SEQ ID NO: 3680219 - RNA, 20 nt, Human
ugcccagcccggaccuuggc

SEQ ID NO: 3680220 - RNA, 19 nt, Human
ugcccagcccuaaacauca

SEQ ID NO: 3680221 - RNA, 23 nt, Human
ugcccagccucuuucccuuccag

SEQ ID NO: 3680222 - RNA, 19 nt, Human
ugcccagcggacaguggca

SEQ ID NO: 3680223 - RNA, 20 nt, Human
ugcccagcggacaguggcag

SEQ ID NO: 3680224 - RNA, 22 nt, Human
ugcccagcggacaguggcagga

SEQ ID NO: 3680225 - RNA, 20 nt, Human
ugcccagcuagcugcagagc

SEQ ID NO: 3680226 - RNA, 18 nt, Human
ugcccagcuauaccugug

SEQ ID NO: 3680227 - RNA, 12 nt, Human
ugcccagcucag

SEQ ID NO: 3680228 - RNA, 17 nt, Human
ugcccagcucagagggu

SEQ ID NO: 3680229 - RNA, 15 nt, Human
ugcccagcucagucu

SEQ ID NO: 3680230 - RNA, 13 nt, Human
ugcccagcuuggg

SEQ ID NO: 3680231 - RNA, 21 nt, Human
ugcccagcuugggcccagcug

SEQ ID NO: 3680232 - RNA, 19 nt, Human
ugcccagcuuuucauugcu

SEQ ID NO: 3680233 - RNA, 20 nt, Human
ugcccagcuuuucauugcug

SEQ ID NO: 3680234 - RNA, 17 nt, Human
ugcccaggagagccagc

SEQ ID NO: 3680235 - RNA, 21 nt, Human
ugcccaggagagccagcccuc

SEQ ID NO: 3680236 - RNA, 15 nt, Human
ugcccaggcacugca

SEQ ID NO: 3680237 - RNA, 12 nt, Human
ugcccaggcagg

SEQ ID NO: 3680238 - RNA, 14 nt, Human
ugcccaggcagguc

SEQ ID NO: 3680239 - RNA, 15 nt, Human
ugcccaggcaggucu

SEQ ID NO: 3680240 - RNA, 22 nt, Human
ugcccaggccccugccacccug

SEQ ID NO: 3680241 - RNA, 17 nt, Human
ugcccaggccugccugu

SEQ ID NO: 3680242 - RNA, 15 nt, Human
ugcccaggcuggucu

SEQ ID NO: 3680243 - RNA, 17 nt, Human
ugcccaggcuggucuca

SEQ ID NO: 3680244 - RNA, 22 nt, Human
ugcccagggccacucugccucu

SEQ ID NO: 3680245 - RNA, 11 nt, Human
ugcccagggcu

SEQ ID NO: 3680246 - RNA, 18 nt, Human
ugcccagggcucagccug

SEQ ID NO: 3680247 - RNA, 20 nt, Human
ugcccagggcucagccuggu

SEQ ID NO: 3680248 - RNA, 15 nt, Human
ugcccaggggagccc

SEQ ID NO: 3680249 - RNA, 16 nt, Human
ugcccaggggagcccu

SEQ ID NO: 3680250 - RNA, 17 nt, Human
ugcccaggggagcccuc

SEQ ID NO: 3680251 - RNA, 18 nt, Human
ugcccaggggugcccccu

SEQ ID NO: 3680252 - RNA, 21 nt, Human
ugcccaggggugcccccuccu

SEQ ID NO: 3680253 - RNA, 19 nt, Human
ugcccagguggcuguggaa

SEQ ID NO: 3680254 - RNA, 15 nt, Human
ugcccaguacauuua

SEQ ID NO: 3680255 - RNA, 16 nt, Human
ugcccagucccccaac

SEQ ID NO: 3680256 - RNA, 18 nt, Human
ugcccagucccccaaccc

SEQ ID NO: 3680257 - RNA, 12 nt, Human
ugcccaguguug

SEQ ID NO: 3680258 - RNA, 18 nt, Human
ugcccaguguuguuugua

SEQ ID NO: 3680259 - RNA, 21 nt, Human
ugcccaguguuguuuguaaau

SEQ ID NO: 3680260 - RNA, 20 nt, Human
ugcccaguuaaucuugcuuu

SEQ ID NO: 3680261 - RNA, 22 nt, Human
ugcccaguuaaucuugcuuucu

SEQ ID NO: 3680262 - RNA, 18 nt, Human
ugcccaguuucugccucu

SEQ ID NO: 3680263 - RNA, 21 nt, Human
ugcccaucauguggccccacc

SEQ ID NO: 3680264 - RNA, 15 nt, Human
ugcccauccugacug

SEQ ID NO: 3680265 - RNA, 20 nt, Human
ugcccaucgugaagaagccu

SEQ ID NO: 3680266 - RNA, 19 nt, Human
ugcccaucugggaaaauac

SEQ ID NO: 3680267 - RNA, 22 nt, Human
ugcccaugauggucacuuaaaa

SEQ ID NO: 3680268 - RNA, 14 nt, Human
ugcccaugcugggc

SEQ ID NO: 3680269 - RNA, 23 nt, Human
ugcccaugggcacugcugggugg

SEQ ID NO: 3680270 - RNA, 15 nt, Human
ugcccauguuucaaa

SEQ ID NO: 3680271 - RNA, 16 nt, Human
ugcccauuccccagcc

SEQ ID NO: 3680272 - RNA, 15 nt, Human
ugcccauuccucacc

SEQ ID NO: 3680273 - RNA, 22 nt, Human
ugcccauuucauauucuuucaa

SEQ ID NO: 3680274 - RNA, 22 nt, Human
ugccccaaaggaagcuuucucu

SEQ ID NO: 3680275 - RNA, 23 nt, Human
ugccccaaauggauuccuguuuc

SEQ ID NO: 3680276 - RNA, 16 nt, Human
ugccccaacccccagc

SEQ ID NO: 3680277 - RNA, 20 nt, Human
ugccccaacccuucuucaug

SEQ ID NO: 3680278 - RNA, 14 nt, Human
ugccccacagucuc

SEQ ID NO: 3680279 - RNA, 20 nt, Human
ugccccaccccuccccauua

SEQ ID NO: 3680280 - RNA, 13 nt, Human
ugccccaccugcc

SEQ ID NO: 3680281 - RNA, 16 nt, Human
ugccccaccugccacu

SEQ ID NO: 3680282 - RNA, 17 nt, Human
ugccccaccugccacua

SEQ ID NO: 3680283 - RNA, 21 nt, Human
ugccccaccugccacuaggcu

SEQ ID NO: 3680284 - RNA, 19 nt, Human
ugccccaccuuuauuaaaa

SEQ ID NO: 3680285 - RNA, 14 nt, Human
ugccccagagcugu

SEQ ID NO: 3680286 - RNA, 23 nt, Human
ugccccagagcuguuuauggccu

SEQ ID NO: 3680287 - RNA, 16 nt, Human
ugccccagcucuggcu

SEQ ID NO: 3680288 - RNA, 13 nt, Human
ugccccaggacca

SEQ ID NO: 3680289 - RNA, 19 nt, Human
ugccccaggaccagcucag

SEQ ID NO: 3680290 - RNA, 14 nt, Human
ugccccaggccuga

SEQ ID NO: 3680291 - RNA, 15 nt, Human
ugccccagggcuccc

SEQ ID NO: 3680292 - RNA, 16 nt, Human
ugccccaucagugcuc

SEQ ID NO: 3680293 - RNA, 21 nt, Human
ugccccauccuccagcaggga

SEQ ID NO: 3680294 - RNA, 21 nt, Human
ugccccaugaagccacagccc

SEQ ID NO: 3680295 - RNA, 18 nt, Human
ugccccauucuuuuguaa

SEQ ID NO: 3680296 - RNA, 16 nt, Human
ugcccccaaccauuuc

SEQ ID NO: 3680297 - RNA, 17 nt, Human
ugcccccacaccuggcc

SEQ ID NO: 3680298 - RNA, 18 nt, Human
ugcccccacaccuggccc

SEQ ID NO: 3680299 - RNA, 17 nt, Human
ugcccccaccccauucc

SEQ ID NO: 3680300 - RNA, 19 nt, Human
ugcccccaccccauucccg

SEQ ID NO: 3680301 - RNA, 14 nt, Human
ugcccccagccccg

SEQ ID NO: 3680302 - RNA, 20 nt, Human
ugcccccagccccgggguga

SEQ ID NO: 3680303 - RNA, 14 nt, Human
ugcccccagcuggc

SEQ ID NO: 3680304 - RNA, 11 nt, Human
ugcccccagga

SEQ ID NO: 3680305 - RNA, 17 nt, Human
ugcccccaggacugggc

SEQ ID NO: 3680306 - RNA, 19 nt, Human
ugcccccaggacugggcca

SEQ ID NO: 3680307 - RNA, 15 nt, Human
ugcccccauuucuga

SEQ ID NO: 3680308 - RNA, 12 nt, Human
ugccccccaccc

SEQ ID NO: 3680309 - RNA, 14 nt, Human
ugccccccacccca

SEQ ID NO: 3680310 - RNA, 17 nt, Human
ugccccccaccccagcc

SEQ ID NO: 3680311 - RNA, 15 nt, Human
ugccccccagccucu

SEQ ID NO: 3680312 - RNA, 17 nt, Human
ugccccccauccuggcc

SEQ ID NO: 3680313 - RNA, 19 nt, Human
ugccccccauccuggccca

SEQ ID NO: 3680314 - RNA, 20 nt, Human
ugccccccauccuggcccau

SEQ ID NO: 3680315 - RNA, 20 nt, Human
ugccccccucaaaccuccuc

SEQ ID NO: 3680316 - RNA, 22 nt, Human
ugcccccgcucaugggccccuc

SEQ ID NO: 3680317 - RNA, 17 nt, Human
ugcccccggcccccugg

SEQ ID NO: 3680318 - RNA, 21 nt, Human
ugcccccggcccccuggucuc

SEQ ID NO: 3680319 - RNA, 21 nt, Human
ugcccccuaauccccuucucc

SEQ ID NO: 3680320 - RNA, 14 nt, Human
ugcccccuccucuc

SEQ ID NO: 3680321 - RNA, 13 nt, Human
ugcccccucgugc

SEQ ID NO: 3680322 - RNA, 13 nt, Human
ugcccccugcagg

SEQ ID NO: 3680323 - RNA, 22 nt, Human
ugcccccugcaggaaggagcug

SEQ ID NO: 3680324 - RNA, 13 nt, Human
ugcccccugcugg

SEQ ID NO: 3680325 - RNA, 12 nt, Human
ugcccccuggug

SEQ ID NO: 3680326 - RNA, 13 nt, Human
ugcccccugugga

SEQ ID NO: 3680327 - RNA, 13 nt, Human
ugcccccuucucc

SEQ ID NO: 3680328 - RNA, 19 nt, Human
ugcccccuucucccacacu

SEQ ID NO: 3680329 - RNA, 22 nt, Human
ugcccccuucucccacacugcu

SEQ ID NO: 3680330 - RNA, 22 nt, Human
ugcccccuuucagaugucuucu

SEQ ID NO: 3680331 - RNA, 23 nt, Human
ugcccccuuucagaugucuucug

SEQ ID NO: 3680332 - RNA, 23 nt, Human
ugccccgaacauguuuuucuucu

SEQ ID NO: 3680333 - RNA, 13 nt, Human
ugccccgcccagc

SEQ ID NO: 3680334 - RNA, 15 nt, Human
ugccccgccuccccg

SEQ ID NO: 3680335 - RNA, 22 nt, Human
ugccccggccccggccccagcc

SEQ ID NO: 3680336 - RNA, 17 nt, Human
ugccccgucaccaucuc

SEQ ID NO: 3680337 - RNA, 19 nt, Human
ugccccgucaccaucucag

SEQ ID NO: 3680338 - RNA, 20 nt, Human
ugccccgucaccaucucagg

SEQ ID NO: 3680339 - RNA, 22 nt, Human
ugccccguccacggcucuaggu

SEQ ID NO: 3680340 - RNA, 18 nt, Human
ugccccgucccccucugg

SEQ ID NO: 3680341 - RNA, 19 nt, Human
ugccccgucuacagcuccc

SEQ ID NO: 3680342 - RNA, 16 nt, Human
ugccccgugcagacug

SEQ ID NO: 3680343 - RNA, 18 nt, Human
ugccccgugcagacugga

SEQ ID NO: 3680344 - RNA, 21 nt, Human
ugccccgugcagacuggaggg

SEQ ID NO: 3680345 - RNA, 20 nt, Human
ugccccuaaucucuguagga

SEQ ID NO: 3680346 - RNA, 16 nt, Human
ugccccuagcuuagag

SEQ ID NO: 3680347 - RNA, 12 nt, Human
ugccccucccag

SEQ ID NO: 3680348 - RNA, 17 nt, Human
ugccccucccccaaccc

SEQ ID NO: 3680349 - RNA, 16 nt, Human
ugccccucccccagcc

SEQ ID NO: 3680350 - RNA, 15 nt, Human
ugccccucccuucaa

SEQ ID NO: 3680351 - RNA, 12 nt, Human
ugccccucucac

SEQ ID NO: 3680352 - RNA, 20 nt, Human
ugccccucuccuucuuagcu

SEQ ID NO: 3680353 - RNA, 16 nt, Human
ugccccucucugggcc

SEQ ID NO: 3680354 - RNA, 15 nt, Human
ugccccucuuucucu

SEQ ID NO: 3680355 - RNA, 16 nt, Human
ugccccucuuucucuu

SEQ ID NO: 3680356 - RNA, 21 nt, Human
ugccccucuuucucuuucuuc

SEQ ID NO: 3680357 - RNA, 16 nt, Human
ugccccugcugccucc

SEQ ID NO: 3680358 - RNA, 17 nt, Human
ugccccugcugccuccc

SEQ ID NO: 3680359 - RNA, 17 nt, Human
ugccccuggcagccccu

SEQ ID NO: 3680360 - RNA, 17 nt, Human
ugccccuuccgccacug

SEQ ID NO: 3680361 - RNA, 19 nt, Human
ugccccuuccgccacuggg

SEQ ID NO: 3680362 - RNA, 23 nt, Human
ugccccuuccgccacuggggcuc

SEQ ID NO: 3680363 - RNA, 15 nt, Human
ugccccuucuacacu

SEQ ID NO: 3680364 - RNA, 23 nt, Human
ugccccuucuacacucuccuggg

SEQ ID NO: 3680365 - RNA, 21 nt, Human
ugccccuugacaacuggcagg

SEQ ID NO: 3680366 - RNA, 19 nt, Human
ugccccuuuauaaauccaa

SEQ ID NO: 3680367 - RNA, 13 nt, Human
ugcccgagcuggu

SEQ ID NO: 3680368 - RNA, 14 nt, Human
ugcccgagcuggug

SEQ ID NO: 3680369 - RNA, 19 nt, Human
ugcccgagcuggugcauua

SEQ ID NO: 3680370 - RNA, 19 nt, Human
ugcccgcacagcagccugc

SEQ ID NO: 3680371 - RNA, 17 nt, Human
ugcccgcagaccucugg

SEQ ID NO: 3680372 - RNA, 18 nt, Human
ugcccgcagaccucugga

SEQ ID NO: 3680373 - RNA, 18 nt, Human
ugcccgccugcccaccug

SEQ ID NO: 3680374 - RNA, 19 nt, Human
ugcccgccugcccaccugc

SEQ ID NO: 3680375 - RNA, 20 nt, Human
ugcccgccugggucuccuaa

SEQ ID NO: 3680376 - RNA, 21 nt, Human
ugcccggagauuggacggccu

SEQ ID NO: 3680377 - RNA, 16 nt, Human
ugcccggauucuggga

SEQ ID NO: 3680378 - RNA, 17 nt, Human
ugcccggauucugggag

SEQ ID NO: 3680379 - RNA, 18 nt, Human
ugcccggauucugggagg

SEQ ID NO: 3680380 - RNA, 22 nt, Human
ugcccggcacagaugcuccagg

SEQ ID NO: 3680381 - RNA, 21 nt, Human
ugcccggcgcccucuguccug

SEQ ID NO: 3680382 - RNA, 22 nt, Human
ugcccggcgcccucuguccuga

SEQ ID NO: 3680383 - RNA, 18 nt, Human
ugcccgggagcucaggaa

SEQ ID NO: 3680384 - RNA, 23 nt, Human
ugcccggggcagcagcagcccug

SEQ ID NO: 3680385 - RNA, 18 nt, Human
ugcccggggcagcugcca

SEQ ID NO: 3680386 - RNA, 20 nt, Human
ugcccggggcagcugccaga

SEQ ID NO: 3680387 - RNA, 14 nt, Human
ugcccggucccacc

SEQ ID NO: 3680388 - RNA, 23 nt, Human
ugcccguaaacacgccugcaaac

SEQ ID NO: 3680389 - RNA, 21 nt, Human
ugcccgucucucucccaugga

SEQ ID NO: 3680390 - RNA, 14 nt, Human
ugcccguucuugaa

SEQ ID NO: 3680391 - RNA, 17 nt, Human
ugcccuaaaguguauuu

SEQ ID NO: 3680392 - RNA, 19 nt, Human
ugcccuaaaguguauuuuu

SEQ ID NO: 3680393 - RNA, 22 nt, Human
ugcccuaaccucugagucacca

SEQ ID NO: 3680394 - RNA, 13 nt, Human
ugcccuagcucca

SEQ ID NO: 3680395 - RNA, 22 nt, Human
ugcccuaguuuucuuuccuccu

SEQ ID NO: 3680396 - RNA, 23 nt, Human
ugcccuaguuuucuuuccuccuu

SEQ ID NO: 3680397 - RNA, 12 nt, Human
ugcccucaggga

SEQ ID NO: 3680398 - RNA, 23 nt, Human
ugcccucauuacugggccuuagu

SEQ ID NO: 3680399 - RNA, 22 nt, Human
ugcccuccaagaccuucuccuu

SEQ ID NO: 3680400 - RNA, 18 nt, Human
ugcccuccacagccgcag

SEQ ID NO: 3680401 - RNA, 15 nt, Human
ugcccuccacugccc

SEQ ID NO: 3680402 - RNA, 21 nt, Human
ugcccuccagcucuuuccucc

SEQ ID NO: 3680403 - RNA, 17 nt, Human
ugcccuccaucccgaca

SEQ ID NO: 3680404 - RNA, 15 nt, Human
ugcccuccccagagc

SEQ ID NO: 3680405 - RNA, 16 nt, Human
ugcccuccccagagca

SEQ ID NO: 3680406 - RNA, 19 nt, Human
ugcccuccccagagcacug

SEQ ID NO: 3680407 - RNA, 15 nt, Human
ugcccucccuccuuc

SEQ ID NO: 3680408 - RNA, 19 nt, Human
ugcccucccuucucccugg

SEQ ID NO: 3680409 - RNA, 23 nt, Human
ugcccuccugugcucagcccuga

SEQ ID NO: 3680410 - RNA, 19 nt, Human
ugcccuccuuguccaccca

SEQ ID NO: 3680411 - RNA, 19 nt, Human
ugcccucgggcgagucacu

SEQ ID NO: 3680412 - RNA, 22 nt, Human
ugcccucgggcgagucacugcc

SEQ ID NO: 3680413 - RNA, 17 nt, Human
ugcccucguggccagcc

SEQ ID NO: 3680414 - RNA, 18 nt, Human
ugcccucguggccagccc

SEQ ID NO: 3680415 - RNA, 23 nt, Human
ugccuccaccaccacuggccacc

SEQ ID NO: 3680416 - RNA, 18 nt, Human
ugccuccaccccccagaa

SEQ ID NO: 3680417 - RNA, 11 nt, Human
ugccuccaccg

SEQ ID NO: 3680418 - RNA, 13 nt, Human
ugccuccacuccc

SEQ ID NO: 3680419 - RNA, 16 nt, Human
ugccuccacucccacu

SEQ ID NO: 3680420 - RNA, 12 nt, Human
ugccuccagggc

SEQ ID NO: 3680421 - RNA, 14 nt, Human
ugccuccagggcug

SEQ ID NO: 3680422 - RNA, 16 nt, Human
ugccuccagggcugga

SEQ ID NO: 3680423 - RNA, 18 nt, Human
ugccuccagggcuggacu

SEQ ID NO: 3680424 - RNA, 11 nt, Human
ugccuccaggu

SEQ ID NO: 3680425 - RNA, 17 nt, Human
ugccuccaggugcagag

SEQ ID NO: 3680426 - RNA, 16 nt, Human
ugccuccauggugccu

SEQ ID NO: 3680427 - RNA, 18 nt, Human
ugccuccauggugccucu

SEQ ID NO: 3680428 - RNA, 14 nt, Human
ugccucccaucacc

SEQ ID NO: 3680429 - RNA, 18 nt, Human
ugccuccccaacccugcc

SEQ ID NO: 3680430 - RNA, 20 nt, Human
ugccuccccaacccugcccc

SEQ ID NO: 3680431 - RNA, 21 nt, Human
ugccuccccauuucccaucug

SEQ ID NO: 3680432 - RNA, 13 nt, Human
ugccuccccuccu

SEQ ID NO: 3680433 - RNA, 14 nt, Human
ugccuccccuccuc

SEQ ID NO: 3680434 - RNA, 16 nt, Human
ugccuccccuccucug

SEQ ID NO: 3680435 - RNA, 18 nt, Human
ugccuccccuccucugcu

SEQ ID NO: 3680436 - RNA, 23 nt, Human
ugccuccccuccucugcuugcca

SEQ ID NO: 3680437 - RNA, 16 nt, Human
ugccucccucacccug

SEQ ID NO: 3680438 - RNA, 22 nt, Human
ugccucccucucguaagauuuc

SEQ ID NO: 3680439 - RNA, 13 nt, Human
ugccucccugagc

SEQ ID NO: 3680440 - RNA, 14 nt, Human
ugccucccugagcu

SEQ ID NO: 3680441 - RNA, 14 nt, Human
ugccucccugguga

SEQ ID NO: 3680442 - RNA, 15 nt, Human
ugccucccuguccac

SEQ ID NO: 3680443 - RNA, 16 nt, Human
ugccucccuguccacc

SEQ ID NO: 3680444 - RNA, 19 nt, Human
ugccucccuuguggcagca

SEQ ID NO: 3680445 - RNA, 12 nt, Human
ugccuccucacc

SEQ ID NO: 3680446 - RNA, 16 nt, Human
ugccuccucaggagcc

SEQ ID NO: 3680447 - RNA, 15 nt, Human
ugccuccucccuccc

SEQ ID NO: 3680448 - RNA, 19 nt, Human
ugccuccucccucccucuc

SEQ ID NO: 3680449 - RNA, 20 nt, Human
ugccuccucguuccuuucuc

SEQ ID NO: 3680450 - RNA, 14 nt, Human
ugccuccucuucaa

SEQ ID NO: 3680451 - RNA, 16 nt, Human
ugccuccucuucaacu

SEQ ID NO: 3680452 - RNA, 21 nt, Human
ugccuccugccggcuccuugg

SEQ ID NO: 3680453 - RNA, 16 nt, Human
ugccuccuuugugagg

SEQ ID NO: 3680454 - RNA, 17 nt, Human
ugccuccuuugugagga

SEQ ID NO: 3680455 - RNA, 19 nt, Human
ugccuccuuugugaggaag

SEQ ID NO: 3680456 - RNA, 22 nt, Human
ugccuccuuugugaggaagccg

SEQ ID NO: 3680457 - RNA, 17 nt, Human
ugccucgaaacacagaa

SEQ ID NO: 3680458 - RNA, 16 nt, Human
ugccucggauccccuu

SEQ ID NO: 3680459 - RNA, 16 nt, Human
ugccucggcuccugcu

SEQ ID NO: 3680460 - RNA, 20 nt, Human
ugccucggcuccugcugcac

SEQ ID NO: 3680461 - RNA, 15 nt, Human
ugccucuaccugaca

SEQ ID NO: 3680462 - RNA, 23 nt, Human
ugccucuaccugacacucccuug

SEQ ID NO: 3680463 - RNA, 12 nt, Human
ugccucuagcug

SEQ ID NO: 3680464 - RNA, 13 nt, Human
ugccucuagcuga

SEQ ID NO: 3680465 - RNA, 12 nt, Human
ugccucucacac

SEQ ID NO: 3680466 - RNA, 17 nt, Human
ugccucucacagcugag

SEQ ID NO: 3680467 - RNA, 18 nt, Human
ugccucucacagcugagu

SEQ ID NO: 3680468 - RNA, 14 nt, Human
ugccucuccaggca

SEQ ID NO: 3680469 - RNA, 16 nt, Human
ugccucucccaggcag

SEQ ID NO: 3680470 - RNA, 13 nt, Human
ugccucucccucu

SEQ ID NO: 3680471 - RNA, 14 nt, Human
ugccucucccucug

SEQ ID NO: 3680472 - RNA, 17 nt, Human
ugccucucccugcugcu

SEQ ID NO: 3680473 - RNA, 20 nt, Human
ugccucuccgccccugagcc

SEQ ID NO: 3680474 - RNA, 22 nt, Human
ugccucuccgccccugagccca

SEQ ID NO: 3680475 - RNA, 20 nt, Human
ugccucucgcuccucaaccc

SEQ ID NO: 3680476 - RNA, 12 nt, Human
ugccucucuagg

SEQ ID NO: 3680477 - RNA, 13 nt, Human
ugccucucucagg

SEQ ID NO: 3680478 - RNA, 11 nt, Human
ugccucucugc

SEQ ID NO: 3680479 - RNA, 23 nt, Human
ugccucucugcaggucccuaaua

SEQ ID NO: 3680480 - RNA, 13 nt, Human
ugccucucuguuu

SEQ ID NO: 3680481 - RNA, 16 nt, Human
ugccucugacacacag

SEQ ID NO: 3680482 - RNA, 22 nt, Human
ugccucugacacacagcucugu

SEQ ID NO: 3680483 - RNA, 11 nt, Human
ugccucugagg

SEQ ID NO: 3680484 - RNA, 12 nt, Human
ugccucugaggc

SEQ ID NO: 3680485 - RNA, 16 nt, Human
ugccucugaggccagc

SEQ ID NO: 3680486 - RNA, 18 nt, Human
ugccucugauaugggacu

SEQ ID NO: 3680487 - RNA, 17 nt, Human
ugccucugauguauuuu

SEQ ID NO: 3680488 - RNA, 12 nt, Human
ugccucugccuc

SEQ ID NO: 3680489 - RNA, 18 nt, Human
ugccucugccugucuccc

SEQ ID NO: 3680490 - RNA, 22 nt, Human
ugccucugccuuagaggagccc

SEQ ID NO: 3680491 - RNA, 20 nt, Human
ugccucuggaggccucuggg

SEQ ID NO: 3680492 - RNA, 21 nt, Human
ugccucuggcucuacacauau

SEQ ID NO: 3680493 - RNA, 13 nt, Human
ugccucugucccc

SEQ ID NO: 3680494 - RNA, 21 nt, Human
ugccucugucuagcaugccaa

SEQ ID NO: 3680495 - RNA, 18 nt, Human
ugccucugucuucuggac

SEQ ID NO: 3680496 - RNA, 16 nt, Human
ugccucuguuugacaa

SEQ ID NO: 3680497 - RNA, 23 nt, Human
ugccucuguuugacaaaccucua

SEQ ID NO: 3680498 - RNA, 23 nt, Human
ugccucuucccccugcuuccacc

SEQ ID NO: 3680499 - RNA, 17 nt, Human
ugccucuuccuugaaga

SEQ ID NO: 3680500 - RNA, 21 nt, Human
ugccucuucucuacucuaggg

SEQ ID NO: 3680501 - RNA, 15 nt, Human
ugccucuucugggag

SEQ ID NO: 3680502 - RNA, 16 nt, Human
ugccucuucugggagg

SEQ ID NO: 3680503 - RNA, 19 nt, Human
ugccucuucugggagggca

SEQ ID NO: 3680504 - RNA, 11 nt, Human
ugccucuuucc

SEQ ID NO: 3680505 - RNA, 18 nt, Human
ugccucuuuuaccugcug

SEQ ID NO: 3680506 - RNA, 20 nt, Human
ugccucuuuuaccugcugcu

SEQ ID NO: 3680507 - RNA, 13 nt, Human
ugccugaacaucc

SEQ ID NO: 3680508 - RNA, 20 nt, Human
ugccugaacauccuuccuuc

SEQ ID NO: 3680509 - RNA, 21 nt, Human
ugccugaacauccuuccuucc

SEQ ID NO: 3680510 - RNA, 18 nt, Human
ugccugaagucacacagu

SEQ ID NO: 3680511 - RNA, 22 nt, Human
ugccugaagucacacagugagu

SEQ ID NO: 3680512 - RNA, 12 nt, Human
ugccugaauaaa

SEQ ID NO: 3680513 - RNA, 13 nt, Human
ugccugaauaaag

SEQ ID NO: 3680514 - RNA, 16 nt, Human
ugccugacacacuaac

SEQ ID NO: 3680515 - RNA, 15 nt, Human
ugccugagaggcagg

SEQ ID NO: 3680516 - RNA, 19 nt, Human
ugccugagaggcaggcaua

SEQ ID NO: 3680517 - RNA, 18 nt, Human
ugccugagcaccucccag

SEQ ID NO: 3680518 - RNA, 19 nt, Human
ugccugagggcgaggggag

SEQ ID NO: 3680519 - RNA, 15 nt, Human
ugccugaggggcagc

SEQ ID NO: 3680520 - RNA, 14 nt, Human
ugccugagggugga

SEQ ID NO: 3680521 - RNA, 15 nt, Human
ugccugaggucugua

SEQ ID NO: 3680522 - RNA, 18 nt, Human
ugccugauccagccucuc

SEQ ID NO: 3680523 - RNA, 15 nt, Human
ugccugauggaccug

SEQ ID NO: 3680524 - RNA, 18 nt, Human
ugccugauucggcugucu

SEQ ID NO: 3680525 - RNA, 17 nt, Human
ugccugcacaaacucac

SEQ ID NO: 3680526 - RNA, 19 nt, Human
ugccugcaccaggagacag

SEQ ID NO: 3680527 - RNA, 15 nt, Human
ugccugcaccccugc

SEQ ID NO: 3680528 - RNA, 18 nt, Human
ugccugcagagagaagcc

SEQ ID NO: 3680529 - RNA, 19 nt, Human
ugccugcagaggucugugc

SEQ ID NO: 3680530 - RNA, 22 nt, Human
ugccugcagccccgcgccuccu

SEQ ID NO: 3680531 - RNA, 12 nt, Human
ugccugcagggc

SEQ ID NO: 3680532 - RNA, 22 nt, Human
ugccugcagggccauggcucag

SEQ ID NO: 3680533 - RNA, 16 nt, Human
ugccugccagcugcac

SEQ ID NO: 3680534 - RNA, 19 nt, Human
ugccugccagcugcacuga

SEQ ID NO: 3680535 - RNA, 13 nt, Human
ugccugcccaccc

SEQ ID NO: 3680536 - RNA, 16 nt, Human
ugccugcccaggcccc

SEQ ID NO: 3680537 - RNA, 18 nt, Human
ugccugcccaggccccug

SEQ ID NO: 3680538 - RNA, 19 nt, Human
ugccugcccaggccccugc

SEQ ID NO: 3680539 - RNA, 18 nt, Human
ugccugccccccucaucu

SEQ ID NO: 3680540 - RNA, 17 nt, Human
ugccugccccgccccca

SEQ ID NO: 3680541 - RNA, 21 nt, Human
ugccugccccuacccuggacu

SEQ ID NO: 3680542 - RNA, 22 nt, Human
ugccugccccuacccuggacuu

SEQ ID NO: 3680543 - RNA, 18 nt, Human
ugccugcccgcacagcag

SEQ ID NO: 3680544 - RNA, 22 nt, Human
ugccugcccgcacagcagccug

SEQ ID NO: 3680545 - RNA, 10 nt, Human
ugccugcccu

SEQ ID NO: 3680546 - RNA, 13 nt, Human
ugccugcccuuug

SEQ ID NO: 3680547 - RNA, 20 nt, Human
ugccugccugucugucucuc

SEQ ID NO: 3680548 - RNA, 20 nt, Human
ugccugcgcccaccccgcuc

SEQ ID NO: 3680549 - RNA, 21 nt, Human
ugccugcgcccaccccgcucu

SEQ ID NO: 3680550 - RNA, 18 nt, Human
ugccugcgucuuccgccc

SEQ ID NO: 3680551 - RNA, 17 nt, Human
ugccugcuauuugaagu

SEQ ID NO: 3680552 - RNA, 21 nt, Human
ugccugcucgcucccugcaga

SEQ ID NO: 3680553 - RNA, 11 nt, Human
ugccugcucuu

SEQ ID NO: 3680554 - RNA, 23 nt, Human
ugccugcugaaugauuuccaaag

SEQ ID NO: 3680555 - RNA, 22 nt, Human
ugccugcuuggggggugaugag

SEQ ID NO: 3680556 - RNA, 13 nt, Human
ugccugcuuugaa

SEQ ID NO: 3680557 - RNA, 20 nt, Human
ugccugcuuuuuauggccug

SEQ ID NO: 3680558 - RNA, 21 nt, Human
ugccugcuuuuuauggccugu

SEQ ID NO: 3680559 - RNA, 21 nt, Human
ugccugcuuuuuggaaaguca

SEQ ID NO: 3680560 - RNA, 18 nt, Human
ugccuggagacguggaac

SEQ ID NO: 3680561 - RNA, 22 nt, Human
ugccuggagacguggaaccucu

SEQ ID NO: 3680562 - RNA, 14 nt, Human
ugccuggagcccca

SEQ ID NO: 3680563 - RNA, 20 nt, Human
ugccuggagccccacugccc

SEQ ID NO: 3680564 - RNA, 17 nt, Human
ugccuggagcuccuggg

SEQ ID NO: 3680565 - RNA, 18 nt, Human
ugccuggaggaccugagc

SEQ ID NO: 3680566 - RNA, 23 nt, Human
ugccuggaguguaugacugcaca

SEQ ID NO: 3680567 - RNA, 14 nt, Human
ugccuggauggggc

SEQ ID NO: 3680568 - RNA, 21 nt, Human
ugccuggauggggcugcaccg

SEQ ID NO: 3680569 - RNA, 15 nt, Human
ugccuggccacgccc

SEQ ID NO: 3680570 - RNA, 15 nt, Human
ugccuggccacugcu

SEQ ID NO: 3680571 - RNA, 12 nt, Human
ugccuggccccc

SEQ ID NO: 3680572 - RNA, 16 nt, Human
ugccuggcccccagcu

SEQ ID NO: 3680573 - RNA, 21 nt, Human
ugccuggccccucgccugugg

SEQ ID NO: 3680574 - RNA, 13 nt, Human
ugccuggccggcc

SEQ ID NO: 3680575 - RNA, 14 nt, Human
ugccuggccggcca

SEQ ID NO: 3680576 - RNA, 16 nt, Human
ugccuggccggccagc

SEQ ID NO: 3680577 - RNA, 16 nt, Human
ugccuggccuggcaca

SEQ ID NO: 3680578 - RNA, 11 nt, Human
ugccuggcuca

SEQ ID NO: 3680579 - RNA, 22 nt, Human
ugccuggcuucgcaaaauguuu

SEQ ID NO: 3680580 - RNA, 21 nt, Human
ugccugggaaccuuccugucu

SEQ ID NO: 3680581 - RNA, 12 nt, Human
ugccugggcugu

SEQ ID NO: 3680582 - RNA, 19 nt, Human
ugccuggguggggcugcuc

SEQ ID NO: 3680583 - RNA, 23 nt, Human
ugccuggguggggcugcuccucc

SEQ ID NO: 3680584 - RNA, 15 nt, Human
ugccugguacaguau

SEQ ID NO: 3680585 - RNA, 20 nt, Human
ugccugguauauccaaaagc

SEQ ID NO: 3680586 - RNA, 22 nt, Human
ugccuggucacagggcaugccc

SEQ ID NO: 3680587 - RNA, 17 nt, Human
ugccuggugaauggccu

SEQ ID NO: 3680588 - RNA, 20 nt, Human
ugccuggugcuuccaaauau

SEQ ID NO: 3680589 - RNA, 11 nt, Human
ugccuguaauc

SEQ ID NO: 3680590 - RNA, 18 nt, Human
ugccuguaaucacagcua

SEQ ID NO: 3680591 - RNA, 18 nt, Human
ugccuguaauucagugua

SEQ ID NO: 3680592 - RNA, 23 nt, Human
ugccuguagcccacucugcucgc

SEQ ID NO: 3680593 - RNA, 20 nt, Human
ugccuguagccccagugaca

SEQ ID NO: 3680594 - RNA, 21 nt, Human
ugccuguagccccagugacag

SEQ ID NO: 3680595 - RNA, 16 nt, Human
ugccuguaguuaggaa

SEQ ID NO: 3680596 - RNA, 17 nt, Human
ugccuguaguuaggaaa

SEQ ID NO: 3680597 - RNA, 18 nt, Human
ugccuguccagccugggc

SEQ ID NO: 3680598 - RNA, 17 nt, Human
ugccuguccccaugcuu

SEQ ID NO: 3680599 - RNA, 11 nt, Human
ugccugucccu

SEQ ID NO: 3680600 - RNA, 14 nt, Human
ugccugucccucuc

SEQ ID NO: 3680601 - RNA, 18 nt, Human
ugccugucuguuacacug

SEQ ID NO: 3680602 - RNA, 17 nt, Human
ugccugugaacugaacu

SEQ ID NO: 3680603 - RNA, 14 nt, Human
ugccugugaggcag

SEQ ID NO: 3680604 - RNA, 16 nt, Human
ugccugugaggcaggg

SEQ ID NO: 3680605 - RNA, 12 nt, Human
ugccugugccag

SEQ ID NO: 3680606 - RNA, 16 nt, Human
ugccugugccagguga

SEQ ID NO: 3680607 - RNA, 19 nt, Human
ugccuguggaaucuggagu

SEQ ID NO: 3680608 - RNA, 14 nt, Human
ugccuguggccaug

SEQ ID NO: 3680609 - RNA, 15 nt, Human
ugccuguguauggaa

SEQ ID NO: 3680610 - RNA, 19 nt, Human
ugccuguguccaugcgcuc

SEQ ID NO: 3680611 - RNA, 15 nt, Human
ugccuguucagcucc

SEQ ID NO: 3680612 - RNA, 17 nt, Human
ugccuguucaguuacag

SEQ ID NO: 3680613 - RNA, 20 nt, Human
ugccuguucaguuacagaaa

SEQ ID NO: 3680614 - RNA, 19 nt, Human
ugccuguugggccaggagc

SEQ ID NO: 3680615 - RNA, 20 nt, Human
ugccuguugggccaggagcc

SEQ ID NO: 3680616 - RNA, 16 nt, Human
ugccuguuucugauuu

SEQ ID NO: 3680617 - RNA, 20 nt, Human
ugccuuaaaaccaaagaggg

SEQ ID NO: 3680618 - RNA, 22 nt, Human
ugccuuaaaaccaaagagggcu

SEQ ID NO: 3680619 - RNA, 14 nt, Human
ugccuuaaaaugga

SEQ ID NO: 3680620 - RNA, 22 nt, Human
ugccuuaaacacucaccuucua

SEQ ID NO: 3680621 - RNA, 15 nt, Human
ugccuuaaagaaagu

SEQ ID NO: 3680622 - RNA, 24 nt, Human
ugccuuaaagacaagacagcauuu

SEQ ID NO: 3680623 - RNA, 16 nt, Human
ugccuuaacuggagcc

SEQ ID NO: 3680624 - RNA, 23 nt, Human
ugccuuaauaagaaugguugccu

SEQ ID NO: 3680625 - RNA, 20 nt, Human
ugccuuacccucauguucuu

SEQ ID NO: 3680626 - RNA, 16 nt, Human
ugccuuaccuccugcc

SEQ ID NO: 3680627 - RNA, 17 nt, Human
ugccuuaccuccugccc

SEQ ID NO: 3680628 - RNA, 23 nt, Human
ugccuuaccuccugcccaggaga

SEQ ID NO: 3680629 - RNA, 18 nt, Human
ugccuuacuuuguaugau

SEQ ID NO: 3680630 - RNA, 14 nt, Human
ugccuuagaaccuu

SEQ ID NO: 3680631 - RNA, 15 nt, Human
ugccuuagagccagg

SEQ ID NO: 3680632 - RNA, 17 nt, Human
ugccuuagagccaggca

SEQ ID NO: 3680633 - RNA, 13 nt, Human
ugccuuagcuuca

SEQ ID NO: 3680634 - RNA, 16 nt, Human
ugccuuaggccuaccu

SEQ ID NO: 3680635 - RNA, 16 nt, Human
ugccuuagucucaguu

SEQ ID NO: 3680636 - RNA, 14 nt, Human
ugccuuaucuugca

SEQ ID NO: 3680637 - RNA, 18 nt, Human
ugccuuauggaacacucu

SEQ ID NO: 3680638 - RNA, 22 nt, Human
ugccuuauggaacacucugaga

SEQ ID NO: 3680639 - RNA, 21 nt, Human
ugccuuauuagagugucuuuc

SEQ ID NO: 3680640 - RNA, 23 nt, Human
ugccuuauuagagugucuuucca

SEQ ID NO: 3680641 - RNA, 13 nt, Human
ugccuucagcucu

SEQ ID NO: 3680642 - RNA, 18 nt, Human
ugccuucagcucuacagc

SEQ ID NO: 3680643 - RNA, 19 nt, Human
ugccuuccacgcugucucc

SEQ ID NO: 3680644 - RNA, 21 nt, Human
ugccuuccacgcugucuccag

SEQ ID NO: 3680645 - RNA, 15 nt, Human
ugccuuccagauccu

SEQ ID NO: 3680646 - RNA, 13 nt, Human
ugccuuccauaau

SEQ ID NO: 3680647 - RNA, 14 nt, Human
ugccuucccuagcu

SEQ ID NO: 3680648 - RNA, 14 nt, Human
ugccuuccuaagcc

SEQ ID NO: 3680649 - RNA, 23 nt, Human
ugccuuccuaagccuguggcugu

SEQ ID NO: 3680650 - RNA, 14 nt, Human
ugccuuccuccugg

SEQ ID NO: 3680651 - RNA, 15 nt, Human
ugccuuccuccuggg

SEQ ID NO: 3680652 - RNA, 15 nt, Human
ugccuuccuguuuuu

SEQ ID NO: 3680653 - RNA, 12 nt, Human
ugccuuccuugc

SEQ ID NO: 3680654 - RNA, 16 nt, Human
ugccuuccuuucucca

SEQ ID NO: 3680655 - RNA, 19 nt, Human
ugccuuccuuucuccagga

SEQ ID NO: 3680656 - RNA, 23 nt, Human
ugccuuccuuucuccaggaccaa

SEQ ID NO: 3680657 - RNA, 21 nt, Human
ugccuucgauacaccgggccu

SEQ ID NO: 3680658 - RNA, 13 nt, Human
ugccuucgcuucu

SEQ ID NO: 3680659 - RNA, 16 nt, Human
ugccuucuaaaggugu

SEQ ID NO: 3680660 - RNA, 16 nt, Human
ugccuucuacuuuuaa

SEQ ID NO: 3680661 - RNA, 17 nt, Human
ugccuucucaacuccaa

SEQ ID NO: 3680662 - RNA, 17 nt, Human
ugccuucucaccagcug

SEQ ID NO: 3680663 - RNA, 17 nt, Human
ugccuucugacggcccu

SEQ ID NO: 3680664 - RNA, 20 nt, Human
ugccuucugacggcccugca

SEQ ID NO: 3680665 - RNA, 17 nt, Human
ugccuucuguccuggug

SEQ ID NO: 3680666 - RNA, 14 nt, Human
ugccuucugugggg

SEQ ID NO: 3680667 - RNA, 16 nt, Human
ugccuucuucacccag

SEQ ID NO: 3680668 - RNA, 14 nt, Human
ugccuucuucaggg

SEQ ID NO: 3680669 - RNA, 18 nt, Human
ugccuucuucagggccug

SEQ ID NO: 3680670 - RNA, 19 nt, Human
ugccuucuucuuuuugcug

SEQ ID NO: 3680671 - RNA, 22 nt, Human
ugccuucuucuuuuugcuguug

SEQ ID NO: 3680672 - RNA, 13 nt, Human
ugccuucuuugaa

SEQ ID NO: 3680673 - RNA, 17 nt, Human
ugccuucuuugaagaag

SEQ ID NO: 3680674 - RNA, 20 nt, Human
ugccuucuuugaagaaggug

SEQ ID NO: 3680675 - RNA, 15 nt, Human
ugccuugaaccacuu

SEQ ID NO: 3680676 - RNA, 21 nt, Human
ugccuugaaccacuucccuca

SEQ ID NO: 3680677 - RNA, 18 nt, Human
ugccuugaaccugugagu

SEQ ID NO: 3680678 - RNA, 21 nt, Human
ugccuugacaaacuucuuuca

SEQ ID NO: 3680679 - RNA, 15 nt, Human
ugccuugaugauuua

SEQ ID NO: 3680680 - RNA, 23 nt, Human
ugccuugcccacuccugcucugc

SEQ ID NO: 3680681 - RNA, 22 nt, Human
ugccuugcuguuggucaugugg

SEQ ID NO: 3680682 - RNA, 13 nt, Human
ugccuugcuguuu

SEQ ID NO: 3680683 - RNA, 21 nt, Human
ugccuuggagggucccaagcu

SEQ ID NO: 3680684 - RNA, 17 nt, Human
ugccuuggcucagacau

SEQ ID NO: 3680685 - RNA, 13 nt, Human
ugccuuggcuuca

SEQ ID NO: 3680686 - RNA, 16 nt, Human
ugccuuggggacaaga

SEQ ID NO: 3680687 - RNA, 23 nt, Human
ugccuuggggaggacaaaacuuc

SEQ ID NO: 3680688 - RNA, 23 nt, Human
ugccuugguuuuuacugcucuga

SEQ ID NO: 3680689 - RNA, 15 nt, Human
ugccuugugcuguua

SEQ ID NO: 3680690 - RNA, 16 nt, Human
ugccuuuaaaguauga

SEQ ID NO: 3680691 - RNA, 16 nt, Human
ugccuuuagaaaauau

SEQ ID NO: 3680692 - RNA, 23 nt, Human
ugccuuuagaaaauauaaguaaa

SEQ ID NO: 3680693 - RNA, 17 nt, Human
ugccuuucaaauuuaga

SEQ ID NO: 3680694 - RNA, 16 nt, Human
ugccuuucaggaucua

SEQ ID NO: 3680695 - RNA, 19 nt, Human
ugccuuucaggaucuauuu

SEQ ID NO: 3680696 - RNA, 21 nt, Human
ugccuuuccauccauggccag

SEQ ID NO: 3680697 - RNA, 10 nt, Human
ugccuuuccu

SEQ ID NO: 3680698 - RNA, 12 nt, Human
ugccuuuccugu

SEQ ID NO: 3680699 - RNA, 16 nt, Human
ugccuuuccuguucag

SEQ ID NO: 3680700 - RNA, 20 nt, Human
ugccuuuccuguucagcauu

SEQ ID NO: 3680701 - RNA, 11 nt, Human
ugccuuucugu

SEQ ID NO: 3680702 - RNA, 16 nt, Human
ugccuuucuguguuua

SEQ ID NO: 3680703 - RNA, 13 nt, Human
ugccuuugaagag

SEQ ID NO: 3680704 - RNA, 13 nt, Human
ugccuuugaccug

SEQ ID NO: 3680705 - RNA, 17 nt, Human
ugccuuugaccugccuc

SEQ ID NO: 3680706 - RNA, 21 nt, Human
ugccuuugagacaguuucuua

SEQ ID NO: 3680707 - RNA, 19 nt, Human
ugccuuugaguuuccucag

SEQ ID NO: 3680708 - RNA, 14 nt, Human
ugccuuugcagaaa

SEQ ID NO: 3680709 - RNA, 15 nt, Human
ugccuuugcagaaac

SEQ ID NO: 3680710 - RNA, 17 nt, Human
ugccuuugcagaaacag

SEQ ID NO: 3680711 - RNA, 16 nt, Human
ugccuuugccagguga

SEQ ID NO: 3680712 - RNA, 17 nt, Human
ugccuuugccaggugac

SEQ ID NO: 3680713 - RNA, 16 nt, Human
ugccuuugccuccaga

SEQ ID NO: 3680714 - RNA, 17 nt, Human
ugccuuugcucuggucu

SEQ ID NO: 3680715 - RNA, 15 nt, Human
ugccuuugggagcag

SEQ ID NO: 3680716 - RNA, 13 nt, Human
ugaugcaugucuu

SEQ ID NO: 3680717 - RNA, 21 nt, Human
ugaugccaaaaaaaaauacau

SEQ ID NO: 3680718 - RNA, 15 nt, Human
ugaugccaaccucug

SEQ ID NO: 3680719 - RNA, 15 nt, Human
ugaugccaaguuguu

SEQ ID NO: 3680720 - RNA, 21 nt, Human
ugaugccaaguuguuugagaa

SEQ ID NO: 3680721 - RNA, 18 nt, Human
ugaugccacacagagugg

SEQ ID NO: 3680722 - RNA, 19 nt, Human
ugaugccagguucuauuug

SEQ ID NO: 3680723 - RNA, 20 nt, Human
ugaugcccugcuccagggag

SEQ ID NO: 3680724 - RNA, 11 nt, Human
ugaugccuggc

SEQ ID NO: 3680725 - RNA, 15 nt, Human
ugaugccugugaacu

SEQ ID NO: 3680726 - RNA, 20 nt, Human
ugaugcuaaaaccugaaauu

SEQ ID NO: 3680727 - RNA, 20 nt, Human
ugaugcuacaggauuugaaa

SEQ ID NO: 3680728 - RNA, 15 nt, Human
ugaugcucaggcuug

SEQ ID NO: 3680729 - RNA, 15 nt, Human
ugaugcucccucccc

SEQ ID NO: 3680730 - RNA, 17 nt, Human
ugaugcucccuccccug

SEQ ID NO: 3680731 - RNA, 22 nt, Human
ugaugcucccuccccugcccug

SEQ ID NO: 3680732 - RNA, 23 nt, Human
ugaugcucccuccccugcccugg

SEQ ID NO: 3680733 - RNA, 15 nt, Human
ugaugcugccccuca

SEQ ID NO: 3680734 - RNA, 15 nt, Human
ugaugcuggaugcuc

SEQ ID NO: 3680735 - RNA, 20 nt, Human
ugaugcuggaugcuccuucc

SEQ ID NO: 3680736 - RNA, 20 nt, Human
ugaugcugggcugggugcga

SEQ ID NO: 3680737 - RNA, 16 nt, Human
ugaugcuucuucagag

SEQ ID NO: 3680738 - RNA, 17 nt, Human
ugaugcuucuucagaga

SEQ ID NO: 3680739 - RNA, 19 nt, Human
ugaugcuucuucagagacu

SEQ ID NO: 3680740 - RNA, 20 nt, Human
ugauggacccaaugcacaca

SEQ ID NO: 3680741 - RNA, 21 nt, Human
ugauggagguuucauacucua

SEQ ID NO: 3680742 - RNA, 17 nt, Human
ugauggcaauuuuguaa

SEQ ID NO: 3680743 - RNA, 22 nt, Human
ugauggcaccacugcacuccag

SEQ ID NO: 3680744 - RNA, 20 nt, Human
ugauggcagccauagugcau

SEQ ID NO: 3680745 - RNA, 20 nt, Human
ugauggccuuaauuuccuuu

SEQ ID NO: 3680746 - RNA, 19 nt, Human
ugauggcuaacuuacaaag

SEQ ID NO: 3680747 - RNA, 13 nt, Human
ugauggcuucucc

SEQ ID NO: 3680748 - RNA, 15 nt, Human
ugauggcuucuccag

SEQ ID NO: 3680749 - RNA, 19 nt, Human
ugaugggaugauugaagaa

SEQ ID NO: 3680750 - RNA, 16 nt, Human
ugaugggcacuugaga

SEQ ID NO: 3680751 - RNA, 15 nt, Human
ugauggggcccugcc

SEQ ID NO: 3680752 - RNA, 15 nt, Human
ugaugggucaguugu

SEQ ID NO: 3680753 - RNA, 15 nt, Human
ugauggucagagggc

SEQ ID NO: 3680754 - RNA, 21 nt, Human
ugauggucagcucccuucucu

SEQ ID NO: 3680755 - RNA, 15 nt, Human
ugauggugaugaaau

SEQ ID NO: 3680756 - RNA, 13 nt, Human
ugauggugcaaug

SEQ ID NO: 3680757 - RNA, 16 nt, Human
ugauggugcaaugacc

SEQ ID NO: 3680758 - RNA, 17 nt, Human
ugauggugcaaugaccu

SEQ ID NO: 3680759 - RNA, 15 nt, Human
ugauggugcugaccu

SEQ ID NO: 3680760 - RNA, 14 nt, Human
ugaugguuccccug

SEQ ID NO: 3680761 - RNA, 17 nt, Human
ugaugguucguucuguu

SEQ ID NO: 3680762 - RNA, 18 nt, Human
ugaugguuuauguugacc

SEQ ID NO: 3680763 - RNA, 21 nt, Human
ugauguaaggaugggcauggu

SEQ ID NO: 3680764 - RNA, 19 nt, Human
ugauguaaguuuaccuaug

SEQ ID NO: 3680765 - RNA, 22 nt, Human
ugauguaaucucucugcagcug

SEQ ID NO: 3680766 - RNA, 19 nt, Human
ugauguacagucugucaug

SEQ ID NO: 3680767 - RNA, 20 nt, Human
ugauguaccaugaaacaaag

SEQ ID NO: 3680768 - RNA, 12 nt, Human
ugauguacugua

SEQ ID NO: 3680769 - RNA, 13 nt, Human
ugauguauucuag

SEQ ID NO: 3680770 - RNA, 14 nt, Human
ugauguauucuagc

SEQ ID NO: 3680771 - RNA, 18 nt, Human
ugaugucaauaacaguau

SEQ ID NO: 3680772 - RNA, 17 nt, Human
ugaugucaauuucugug

SEQ ID NO: 3680773 - RNA, 23 nt, Human
ugaugucagcaguugcugguaaa

SEQ ID NO: 3680774 - RNA, 13 nt, Human
ugaugucaugugu

SEQ ID NO: 3680775 - RNA, 14 nt, Human
ugaugucauguguu

SEQ ID NO: 3680776 - RNA, 17 nt, Human
ugaugucauuaaugugu

SEQ ID NO: 3680777 - RNA, 16 nt, Human
ugaugucccuauggaa

SEQ ID NO: 3680778 - RNA, 20 nt, Human
ugaugucuccuaagcaccug

SEQ ID NO: 3680779 - RNA, 23 nt, Human
ugaugucuuuguuaagacugcug

SEQ ID NO: 3680780 - RNA, 22 nt, Human
ugaugugaagccaauucagaca

SEQ ID NO: 3680781 - RNA, 16 nt, Human
ugaugugacaauaaua

SEQ ID NO: 3680782 - RNA, 18 nt, Human
ugaugugacaauaauauu

SEQ ID NO: 3680783 - RNA, 12 nt, Human
ugaugugacauu

SEQ ID NO: 3680784 - RNA, 13 nt, Human
ugaugugacauuu

SEQ ID NO: 3680785 - RNA, 15 nt, Human
ugaugugacauuugu

SEQ ID NO: 3680786 - RNA, 18 nt, Human
ugaugugacauuugucau

SEQ ID NO: 3680787 - RNA, 16 nt, Human
ugaugugcaaaaauuu

SEQ ID NO: 3680788 - RNA, 19 nt, Human
ugaugugcacguaaaguac

SEQ ID NO: 3680789 - RNA, 16 nt, Human
ugaugugccugcuuca

SEQ ID NO: 3680790 - RNA, 19 nt, Human
ugaugugcucaucagaaac

SEQ ID NO: 3680791 - RNA, 16 nt, Human
ugauguggugaaaagc

SEQ ID NO: 3680792 - RNA, 13 nt, Human
ugauguguacauc

SEQ ID NO: 3680793 - RNA, 22 nt, Human
ugauguguuguucuuggcaaua

SEQ ID NO: 3680794 - RNA, 13 nt, Human
ugauguuaaaaaa

SEQ ID NO: 3680795 - RNA, 23 nt, Human
ugauguuaaaaaaauaagaagaa

SEQ ID NO: 3680796 - RNA, 14 nt, Human
ugauguuaaaauuc

SEQ ID NO: 3680797 - RNA, 10 nt, Human
ugauguuaac

SEQ ID NO: 3680798 - RNA, 11 nt, Human
ugauguuaaca

SEQ ID NO: 3680799 - RNA, 15 nt, Human
ugauguuaacacauu

SEQ ID NO: 3680800 - RNA, 20 nt, Human
ugauguuaacacauuuugua

SEQ ID NO: 3680801 - RNA, 15 nt, Human
ugauguucaguguaa

SEQ ID NO: 3680802 - RNA, 21 nt, Human
ugauguucaguguaauuucuu

SEQ ID NO: 3680803 - RNA, 17 nt, Human
ugauguucuaaggcucu

SEQ ID NO: 3680804 - RNA, 18 nt, Human
ugauguucuaaggcucug

SEQ ID NO: 3680805 - RNA, 20 nt, Human
ugauguucuaaggcucugag

SEQ ID NO: 3680806 - RNA, 22 nt, Human
ugauguucuaaggcucugagag

SEQ ID NO: 3680807 - RNA, 22 nt, Human
ugauguuuagaaacacaacuau

SEQ ID NO: 3680808 - RNA, 13 nt, Human
ugauguuucauuu

SEQ ID NO: 3680809 - RNA, 11 nt, Human
ugauguuugug

SEQ ID NO: 3680810 - RNA, 19 nt, Human
ugauguuuguggccucaga

SEQ ID NO: 3680811 - RNA, 20 nt, Human
ugauguuuguggccucagaa

SEQ ID NO: 3680812 - RNA, 21 nt, Human
ugauguuuuaaggaugcuugu

SEQ ID NO: 3680813 - RNA, 17 nt, Human
ugauguuuuuaaaaucu

SEQ ID NO: 3680814 - RNA, 15 nt, Human
ugauguuuuuaugau

SEQ ID NO: 3680815 - RNA, 15 nt, Human
ugauuaaaaauauca

SEQ ID NO: 3680816 - RNA, 19 nt, Human
ugauuaaaaauaucaaauu

SEQ ID NO: 3680817 - RNA, 22 nt, Human
ugauuaaaaauaucaaauuaau

SEQ ID NO: 3680818 - RNA, 23 nt, Human
ugauuaaaaugcuuccucccagc

SEQ ID NO: 3680819 - RNA, 15 nt, Human
ugauuaaagaugagc

SEQ ID NO: 3680820 - RNA, 22 nt, Human
ugauuaaagaugagcuuugucu

SEQ ID NO: 3680821 - RNA, 19 nt, Human
ugauuaaauaagauucuaa

SEQ ID NO: 3680822 - RNA, 20 nt, Human
ugauuaaauaagauucuaac

SEQ ID NO: 3680823 - RNA, 17 nt, Human
ugauuaacaaauaugcu

SEQ ID NO: 3680824 - RNA, 19 nt, Human
ugauuaaccacuucagcug

SEQ ID NO: 3680825 - RNA, 20 nt, Human
ugauuaaggucucucuuugg

SEQ ID NO: 3680826 - RNA, 23 nt, Human
ugauuaaguaaugauaacuggaa

SEQ ID NO: 3680827 - RNA, 16 nt, Human
ugauuaauccagaaua

SEQ ID NO: 3680828 - RNA, 17 nt, Human
ugauuaauccagaauaa

SEQ ID NO: 3680829 - RNA, 14 nt, Human
ugauuacucuuuga

SEQ ID NO: 3680830 - RNA, 16 nt, Human
ugauuacugucaauaa

SEQ ID NO: 3680831 - RNA, 13 nt, Human
ugauuagacagaa

SEQ ID NO: 3680832 - RNA, 15 nt, Human
ugauuagacagaaca

SEQ ID NO: 3680833 - RNA, 17 nt, Human
ugauuagacagaacacc

SEQ ID NO: 3680834 - RNA, 13 nt, Human
ugauuagcaaguu

SEQ ID NO: 3680835 - RNA, 19 nt, Human
ugauuagcuuugucacugu

SEQ ID NO: 3680836 - RNA, 14 nt, Human
ugauuagcuuugug

SEQ ID NO: 3680837 - RNA, 16 nt, Human
ugauuagcuuuguguu

SEQ ID NO: 3680838 - RNA, 16 nt, Human
ugauuaguaaagaaau

SEQ ID NO: 3680839 - RNA, 17 nt, Human
ugauuaguaaagaaaug

SEQ ID NO: 3680840 - RNA, 19 nt, Human
ugauuaguuuucuuguugc

SEQ ID NO: 3680841 - RNA, 22 nt, Human
ugauuauuuaagacuaaaaguu

SEQ ID NO: 3680842 - RNA, 15 nt, Human
ugauuauuucacuuu

SEQ ID NO: 3680843 - RNA, 16 nt, Human
ugauuauuucacuuua

SEQ ID NO: 3680844 - RNA, 23 nt, Human
ugauuauuucacuuuagaugcug

SEQ ID NO: 3680845 - RNA, 14 nt, Human
ugauuauuugcaug

SEQ ID NO: 3680846 - RNA, 15 nt, Human
ugauuauuugcaugu

SEQ ID NO: 3680847 - RNA, 19 nt, Human
ugauuauuuucuucaucca

SEQ ID NO: 3680848 - RNA, 21 nt, Human
ugauucaaucuguaaacugug

SEQ ID NO: 3680849 - RNA, 22 nt, Human
ugauucaaucuguaaacugugu

SEQ ID NO: 3680850 - RNA, 19 nt, Human
ugauucaauuugauguggu

SEQ ID NO: 3680851 - RNA, 12 nt, Human
ugauucacagug

SEQ ID NO: 3680852 - RNA, 16 nt, Human
ugauucacaucucauu

SEQ ID NO: 3680853 - RNA, 13 nt, Human
ugauucacauguu

SEQ ID NO: 3680854 - RNA, 14 nt, Human
ugauucacauguuu

SEQ ID NO: 3680855 - RNA, 15 nt, Human
ugauucacauguuuu

SEQ ID NO: 3680856 - RNA, 17 nt, Human
ugauucacauguuuuca

SEQ ID NO: 3680857 - RNA, 21 nt, Human
ugauucacauguuuucaaaug

SEQ ID NO: 3680858 - RNA, 12 nt, Human
ugauucacugca

SEQ ID NO: 3680859 - RNA, 17 nt, Human
ugauucacugcauggcu

SEQ ID NO: 3680860 - RNA, 20 nt, Human
ugauucagacagcugccugg

SEQ ID NO: 3680861 - RNA, 13 nt, Human
ugauucagcucug

SEQ ID NO: 3680862 - RNA, 14 nt, Human
ugauucagucacau

SEQ ID NO: 3680863 - RNA, 15 nt, Human
ugauucagucacaug

SEQ ID NO: 3680864 - RNA, 21 nt, Human
ugauucaguguuaaaugugau

SEQ ID NO: 3680865 - RNA, 17 nt, Human
ugauucauaauaaauau

SEQ ID NO: 3680866 - RNA, 16 nt, Human
ugauucauaaugacuu

SEQ ID NO: 3680867 - RNA, 21 nt, Human
ugauucauaaugacuuaagca

SEQ ID NO: 3680868 - RNA, 20 nt, Human
ugauuccacuacaccuggcu

SEQ ID NO: 3680869 - RNA, 22 nt, Human
ugauuccacuacaccuggcuga

SEQ ID NO: 3680870 - RNA, 13 nt, Human
ugauuccaucucc

SEQ ID NO: 3680871 - RNA, 15 nt, Human
ugauucccaagcucu

SEQ ID NO: 3680872 - RNA, 19 nt, Human
ugauucccaagcucugcuc

SEQ ID NO: 3680873 - RNA, 18 nt, Human
ugauuccuuccuguucug

SEQ ID NO: 3680874 - RNA, 20 nt, Human
ugauuccuuccuguucugaa

SEQ ID NO: 3680875 - RNA, 17 nt, Human
ugauuccuuuuuucaaa

SEQ ID NO: 3680876 - RNA, 23 nt, Human
ugauucgagcuauauuuaaguau

SEQ ID NO: 3680877 - RNA, 16 nt, Human
ugauucgcccaaagcc

SEQ ID NO: 3680878 - RNA, 22 nt, Human
ugauucgcccaaagccagacag

SEQ ID NO: 3680879 - RNA, 17 nt, Human
ugauucuaaugucuuca

SEQ ID NO: 3680880 - RNA, 21 nt, Human
ugauucuauuuauauguacau

SEQ ID NO: 3680881 - RNA, 13 nt, Human
ugauucucaugcc

SEQ ID NO: 3680882 - RNA, 14 nt, Human
ugauucucaugccu

SEQ ID NO: 3680883 - RNA, 15 nt, Human
ugauucuccugccuc

SEQ ID NO: 3680884 - RNA, 13 nt, Human
ugauucuccuuca

SEQ ID NO: 3680885 - RNA, 14 nt, Human
ugauucuccuucag

SEQ ID NO: 3680886 - RNA, 18 nt, Human
ugauucuccuucagcccu

SEQ ID NO: 3680887 - RNA, 19 nt, Human
ugauucuccuuuuaugugu

SEQ ID NO: 3680888 - RNA, 16 nt, Human
ugauucugcaguaaau

SEQ ID NO: 3680889 - RNA, 13 nt, Human
ugauucugccuuu

SEQ ID NO: 3680890 - RNA, 17 nt, Human
ugauucuggcuuuaagc

SEQ ID NO: 3680891 - RNA, 15 nt, Human
ugauucuugaguuua

SEQ ID NO: 3680892 - RNA, 23 nt, Human
ugauucuuuuuaaaguguuucug

SEQ ID NO: 3680893 - RNA, 22 nt, Human
ugauugaaaauaguaaaugcuu

SEQ ID NO: 3680894 - RNA, 14 nt, Human
ugauugaagaaaca

SEQ ID NO: 3680895 - RNA, 12 nt, Human
ugauugacagcu

SEQ ID NO: 3680896 - RNA, 21 nt, Human
ugauugacagcuuugcugcug

SEQ ID NO: 3680897 - RNA, 17 nt, Human
ugauugagaguaacuua

SEQ ID NO: 3680898 - RNA, 20 nt, Human
ugauugcagaauuguuuaga

SEQ ID NO: 3680899 - RNA, 18 nt, Human
ugauugccaagcucagga

SEQ ID NO: 3680900 - RNA, 17 nt, Human
ugauugccuuuuuauaa

SEQ ID NO: 3680901 - RNA, 16 nt, Human
ugauugcuaaauguaa

SEQ ID NO: 3680902 - RNA, 20 nt, Human
ugauugcuaaauguaacagu

SEQ ID NO: 3680903 - RNA, 19 nt, Human
ugauugcuguguccaacuc

SEQ ID NO: 3680904 - RNA, 20 nt, Human
ugauuggaagggcuuuucaa

SEQ ID NO: 3680905 - RNA, 19 nt, Human
ugauuggaauagcuucugg

SEQ ID NO: 3680906 - RNA, 17 nt, Human
ugauuggauuauucauu

SEQ ID NO: 3680907 - RNA, 18 nt, Human
ugauuggauuauucauuu

SEQ ID NO: 3680908 - RNA, 21 nt, Human
ugauuggauuauucauuuaaa

SEQ ID NO: 3680909 - RNA, 16 nt, Human
ugauuggcauauaaug

SEQ ID NO: 3680910 - RNA, 21 nt, Human
ugauuggcuuguagaauuguu

SEQ ID NO: 3680911 - RNA, 23 nt, Human
ugauuggcuuguagaauuguuau

SEQ ID NO: 3680912 - RNA, 18 nt, Human
ugauugggaaaacauuug

SEQ ID NO: 3680913 - RNA, 21 nt, Human
ugauugggaaaacauuugcug

SEQ ID NO: 3680914 - RNA, 16 nt, Human
ugauugggaauaaaua

SEQ ID NO: 3680915 - RNA, 21 nt, Human
ugauugggaauaaauaugccu

SEQ ID NO: 3680916 - RNA, 22 nt, Human
ugauugggacuggggcugaagg

SEQ ID NO: 3680917 - RNA, 17 nt, Human
ugauugggcacaucauu

SEQ ID NO: 3680918 - RNA, 19 nt, Human
ugauuggggaauuaaaagu

SEQ ID NO: 3680919 - RNA, 19 nt, Human
ugauuggugcaacccuuac

SEQ ID NO: 3680920 - RNA, 17 nt, Human
ugauuguaaaauagcuu

SEQ ID NO: 3680921 - RNA, 17 nt, Human
ugauuguaacguugcug

SEQ ID NO: 3680922 - RNA, 19 nt, Human
ugauuguacagaaucauug

SEQ ID NO: 3680923 - RNA, 14 nt, Human
ugauugucuuaaua

SEQ ID NO: 3680924 - RNA, 14 nt, Human
ugauuguuggcaca

SEQ ID NO: 3680925 - RNA, 14 nt, Human
ugauuuaaaacaug

SEQ ID NO: 3680926 - RNA, 15 nt, Human
ugauuuaaacacauu

SEQ ID NO: 3680927 - RNA, 13 nt, Human
ugauuuaaacuuc

SEQ ID NO: 3680928 - RNA, 21 nt, Human
ugauuuaaacuucuuaacugg

SEQ ID NO: 3680929 - RNA, 18 nt, Human
ugauuuaagacacuuuuu

SEQ ID NO: 3680930 - RNA, 13 nt, Human
ugauuuaauaaaa

SEQ ID NO: 3680931 - RNA, 17 nt, Human
ugauuuaauaaaauaau

SEQ ID NO: 3680932 - RNA, 19 nt, Human
ugauuuaauaaaauaauuc

SEQ ID NO: 3680933 - RNA, 21 nt, Human
ugauuuaauaaaauaauucua

SEQ ID NO: 3680934 - RNA, 14 nt, Human
ugauuuaauaacau

SEQ ID NO: 3680935 - RNA, 13 nt, Human
ugauuuaauagug

SEQ ID NO: 3680936 - RNA, 20 nt, Human
ugauuuaauaguguuaauca

SEQ ID NO: 3680937 - RNA, 22 nt, Human
ugauuuaauaguguuaaucaau

SEQ ID NO: 3680938 - RNA, 17 nt, Human
ugauuuaauaugcaaag

SEQ ID NO: 3680939 - RNA, 15 nt, Human
ugauuuaauauggau

SEQ ID NO: 3680940 - RNA, 15 nt, Human
ugauuuaauuugaaa

SEQ ID NO: 3680941 - RNA, 16 nt, Human
ugauuuacagcaagua

SEQ ID NO: 3680942 - RNA, 20 nt, Human
ugauuuacagcaaguagaua

SEQ ID NO: 3680943 - RNA, 15 nt, Human
ugauuuacaguuuca

SEQ ID NO: 3680944 - RNA, 16 nt, Human
ugauuuacgcucauug

SEQ ID NO: 3680945 - RNA, 21 nt, Human
ugauuuaggagaagccaggaa

SEQ ID NO: 3680946 - RNA, 22 nt, Human
ugauuuaggagaagccaggaau

SEQ ID NO: 3680947 - RNA, 13 nt, Human
ugauuuaugcaug

SEQ ID NO: 3680948 - RNA, 12 nt, Human
ugauuuauuaac

SEQ ID NO: 3680949 - RNA, 18 nt, Human
ugauuuauuuuguaugaa

SEQ ID NO: 3680950 - RNA, 15 nt, Human
ugauuucacaaauau

SEQ ID NO: 3680951 - RNA, 20 nt, Human
ugauuucacaaauauuaaaa

SEQ ID NO: 3680952 - RNA, 17 nt, Human
ugauuucagcucacugc

SEQ ID NO: 3680953 - RNA, 19 nt, Human
ugauuucaguucuaggaaa

SEQ ID NO: 3680954 - RNA, 20 nt, Human
ugauuucaguucuaggaaaa

SEQ ID NO: 3680955 - RNA, 15 nt, Human
ugauuucauuaauac

SEQ ID NO: 3680956 - RNA, 14 nt, Human
ugauuuccaaagag

SEQ ID NO: 3680957 - RNA, 18 nt, Human
ugauuuccaaagagaaaa

SEQ ID NO: 3680958 - RNA, 16 nt, Human
ugauuuccaaguaaua

SEQ ID NO: 3680959 - RNA, 17 nt, Human
ugauuuccccuuuugca

SEQ ID NO: 3680960 - RNA, 23 nt, Human
ugauuucccguggccccagccug

SEQ ID NO: 3680961 - RNA, 13 nt, Human
ugauuuccuugaa

SEQ ID NO: 3680962 - RNA, 17 nt, Human
ugauuuccuugaaugug

SEQ ID NO: 3680963 - RNA, 19 nt, Human
ugauuuccuugaauguggc

SEQ ID NO: 3680964 - RNA, 23 nt, Human
ugauuuccuugaauguggcuuga

SEQ ID NO: 3680965 - RNA, 14 nt, Human
ugauuucuauucaa

SEQ ID NO: 3680966 - RNA, 17 nt, Human
ugauuucugccuuccuu

SEQ ID NO: 3680967 - RNA, 22 nt, Human
ugauuucuuaggggaaggagaa

SEQ ID NO: 3680968 - RNA, 20 nt, Human
ugauuucuuuaaaagaauga

SEQ ID NO: 3680969 - RNA, 21 nt, Human
ugauuucuuuaaaagaaugac

SEQ ID NO: 3680970 - RNA, 20 nt, Human
ugauuucuuuucuuccuggc

SEQ ID NO: 3680971 - RNA, 21 nt, Human
ugauuucuuuucuuccuggcu

SEQ ID NO: 3680972 - RNA, 14 nt, Human
ugauuugacuguuu

SEQ ID NO: 3680973 - RNA, 13 nt, Human
ugauuugagauuu

SEQ ID NO: 3680974 - RNA, 14 nt, Human
ugauuugagauuuu

SEQ ID NO: 3680975 - RNA, 11 nt, Human
ugauuugcaau

SEQ ID NO: 3680976 - RNA, 12 nt, Human
ugauuuggaaaa

SEQ ID NO: 3680977 - RNA, 20 nt, Human
ugauuugggcugaauguaug

SEQ ID NO: 3680978 - RNA, 17 nt, Human
ugauuuggggauauuuu

SEQ ID NO: 3680979 - RNA, 13 nt, Human
ugauuuggugacc

SEQ ID NO: 3680980 - RNA, 14 nt, Human
ugauuuuaaaaugu

SEQ ID NO: 3680981 - RNA, 22 nt, Human
ugauuuuaaaauguacauguau

SEQ ID NO: 3680982 - RNA, 17 nt, Human
ugauuuuaaauguguga

SEQ ID NO: 3680983 - RNA, 19 nt, Human
ugauuuuaagaauccaaac

SEQ ID NO: 3680984 - RNA, 16 nt, Human
ugauuuuaauaauaua

SEQ ID NO: 3680985 - RNA, 19 nt, Human
ugauuuuagccuucucugu

SEQ ID NO: 3680986 - RNA, 22 nt, Human
ugauuuuaggagcuaaggcucu

SEQ ID NO: 3680987 - RNA, 16 nt, Human
ugauuuuaucugugaa

SEQ ID NO: 3680988 - RNA, 12 nt, Human
ugauuuuaugau

SEQ ID NO: 3680989 - RNA, 13 nt, Human
ugauuuuauucuu

SEQ ID NO: 3680990 - RNA, 20 nt, Human
ugauuuucaaagcuuuuucc

SEQ ID NO: 3680991 - RNA, 13 nt, Human
ugauuuucuggau

SEQ ID NO: 3680992 - RNA, 15 nt, Human
ugauuuugaaaccau

SEQ ID NO: 3680993 - RNA, 15 nt, Human
ugauuuugaaaucau

SEQ ID NO: 3680994 - RNA, 20 nt, Human
ugauuuuuagaugagauugu

SEQ ID NO: 3680995 - RNA, 14 nt, Human
ugauuuuuauccaa

SEQ ID NO: 3680996 - RNA, 22 nt, Human
ugauuuuucuaaccuugaaugc

SEQ ID NO: 3680997 - RNA, 19 nt, Human
ugauuuuucuggagguuga

SEQ ID NO: 3680998 - RNA, 14 nt, Human
ugauuuuucuuuac

SEQ ID NO: 3680999 - RNA, 18 nt, Human
ugauuuuuuuuucauaca

SEQ ID NO: 3681000 - RNA, 22 nt, Human
ugauuuuuuuuucauacacuua

SEQ ID NO: 3681001 - RNA, 17 nt, Human
ugauuuuuuuuuccuuc

SEQ ID NO: 3681002 - RNA, 22 nt, Human
ugauuuuuuuuuuuuuccuguc

SEQ ID NO: 3681003 - RNA, 21 nt, Human
ugauuuuuuuuuuuuuuuccu

SEQ ID NO: 3681004 - RNA, 21 nt, Human
ugcaaaaaaucuuaauacugu

SEQ ID NO: 3681005 - RNA, 14 nt, Human
ugcaaaaaggguca

SEQ ID NO: 3681006 - RNA, 14 nt, Human
ugcaaaaauaauca

SEQ ID NO: 3681007 - RNA, 12 nt, Human
ugcaaaaaugga

SEQ ID NO: 3681008 - RNA, 23 nt, Human
ugcaaaacagcguuuaagacugu

SEQ ID NO: 3681009 - RNA, 18 nt, Human
ugcaaaacaugcuaccug

SEQ ID NO: 3681010 - RNA, 19 nt, Human
ugcaaaaccuuuuacuggu

SEQ ID NO: 3681011 - RNA, 15 nt, Human
ugcaaaagcuucaaa

SEQ ID NO: 3681012 - RNA, 12 nt, Human
ugcaaaauacau

SEQ ID NO: 3681013 - RNA, 14 nt, Human
ugcaaaauacauga

SEQ ID NO: 3681014 - RNA, 17 nt, Human
ugcaaaaugagacccuc

SEQ ID NO: 3681015 - RNA, 18 nt, Human
ugcaaaaugaggaaugua

SEQ ID NO: 3681016 - RNA, 19 nt, Human
ugagccagucccaggggca

SEQ ID NO: 3681017 - RNA, 23 nt, Human
ugagccaguucaguaccuggagg

SEQ ID NO: 3681018 - RNA, 20 nt, Human
ugagcccacugcccaccccc

SEQ ID NO: 3681019 - RNA, 21 nt, Human
ugagcccacugcccacccccu

SEQ ID NO: 3681020 - RNA, 18 nt, Human
ugagcccagcccuguucu

SEQ ID NO: 3681021 - RNA, 12 nt, Human
ugagcccaggga

SEQ ID NO: 3681022 - RNA, 21 nt, Human
ugagcccauguucugccccca

SEQ ID NO: 3681023 - RNA, 17 nt, Human
ugagccccaaguccuga

SEQ ID NO: 3681024 - RNA, 21 nt, Human
ugagccccaaguccugaagag

SEQ ID NO: 3681025 - RNA, 22 nt, Human
ugagccccaaguccugaagagg

SEQ ID NO: 3681026 - RNA, 23 nt, Human
ugagccccaaguccugaagaggc

SEQ ID NO: 3681027 - RNA, 16 nt, Human
ugagccccaucuucac

SEQ ID NO: 3681028 - RNA, 13 nt, Human
ugagcccccagcu

SEQ ID NO: 3681029 - RNA, 23 nt, Human
ugagccccgcagaccuccccagc

SEQ ID NO: 3681030 - RNA, 20 nt, Human
ugagccccgcccucuuccug

SEQ ID NO: 3681031 - RNA, 21 nt, Human
ugagccccgcccucuuccuga

SEQ ID NO: 3681032 - RNA, 13 nt, Human
ugagccccuggga

SEQ ID NO: 3681033 - RNA, 15 nt, Human
ugagccccugggacu

SEQ ID NO: 3681034 - RNA, 14 nt, Human
ugagccccuuccuu

SEQ ID NO: 3681035 - RNA, 17 nt, Human
ugagcccggaugcuucu

SEQ ID NO: 3681036 - RNA, 15 nt, Human
ugagcccgggcugcc

SEQ ID NO: 3681037 - RNA, 20 nt, Human
ugagcccgggcugccugggc

SEQ ID NO: 3681038 - RNA, 14 nt, Human
ugagcccucagaac

SEQ ID NO: 3681039 - RNA, 17 nt, Human
ugagcccucagaacccu

SEQ ID NO: 3681040 - RNA, 20 nt, Human
ugagcccucagaacccuugg

SEQ ID NO: 3681041 - RNA, 13 nt, Human
ugagcccucccca

SEQ ID NO: 3681042 - RNA, 16 nt, Human
ugagcccuccccagga

SEQ ID NO: 3681043 - RNA, 23 nt, Human
ugagccgagaucacgccacugca

SEQ ID NO: 3681044 - RNA, 14 nt, Human
ugagccgcagagaa

SEQ ID NO: 3681045 - RNA, 21 nt, Human
ugagccgcaucuucuccaucu

SEQ ID NO: 3681046 - RNA, 18 nt, Human
ugagccgcccaaggccuu

SEQ ID NO: 3681047 - RNA, 20 nt, Human
ugagccuaaaaauaaagcac

SEQ ID NO: 3681048 - RNA, 16 nt, Human
ugagccuacgcugaag

SEQ ID NO: 3681049 - RNA, 17 nt, Human
ugagccucagcauccug

SEQ ID NO: 3681050 - RNA, 21 nt, Human
ugagccucagcauccuggcac

SEQ ID NO: 3681051 - RNA, 12 nt, Human
ugagccucugcu

SEQ ID NO: 3681052 - RNA, 12 nt, Human
ugagccuggcca

SEQ ID NO: 3681053 - RNA, 19 nt, Human
ugagccugggaggucaagg

SEQ ID NO: 3681054 - RNA, 15 nt, Human
ugagccuugaacuuu

SEQ ID NO: 3681055 - RNA, 17 nt, Human
ugagccuugaacuuuga

SEQ ID NO: 3681056 - RNA, 16 nt, Human
ugagccuuuucccucu

SEQ ID NO: 3681057 - RNA, 17 nt, Human
ugagcgaggacauucuc

SEQ ID NO: 3681058 - RNA, 18 nt, Human
ugagcgccuccauccaag

SEQ ID NO: 3681059 - RNA, 20 nt, Human
ugagcgccugugcacacaca

SEQ ID NO: 3681060 - RNA, 22 nt, Human
ugagcgcuccugccgcagagcu

SEQ ID NO: 3681061 - RNA, 16 nt, Human
ugagcgggaggcagag

SEQ ID NO: 3681062 - RNA, 20 nt, Human
ugagcggugcuguccucagg

SEQ ID NO: 3681063 - RNA, 13 nt, Human
ugagcuacaaaug

SEQ ID NO: 3681064 - RNA, 24 nt, Human
ugagcuacugccgucagugcugug

SEQ ID NO: 3681065 - RNA, 19 nt, Human
ugagcuacuggauucuuau

SEQ ID NO: 3681066 - RNA, 16 nt, Human
ugagcuagaacccucu

SEQ ID NO: 3681067 - RNA, 17 nt, Human
ugagcuagaacccucug

SEQ ID NO: 3681068 - RNA, 15 nt, Human
ugagcuauguauuaa

SEQ ID NO: 3681069 - RNA, 21 nt, Human
ugagcuauuaaaacucagccu

SEQ ID NO: 3681070 - RNA, 19 nt, Human
ugagcuauuuccauuccag

SEQ ID NO: 3681071 - RNA, 17 nt, Human
ugagcucacaaggcagc

SEQ ID NO: 3681072 - RNA, 20 nt, Human
ugagcucacaaggcagcaag

SEQ ID NO: 3681073 - RNA, 23 nt, Human
ugagcucacaaggcagcaaggcc

SEQ ID NO: 3681074 - RNA, 23 nt, Human
ugagcucagaaaauaucccuccu

SEQ ID NO: 3681075 - RNA, 11 nt, Human
ugagcucagga

SEQ ID NO: 3681076 - RNA, 18 nt, Human
ugagcuccagacccccag

SEQ ID NO: 3681077 - RNA, 21 nt, Human
ugagcuccagacccccagcaa

SEQ ID NO: 3681078 - RNA, 16 nt, Human
ugagcuccaugugccc

SEQ ID NO: 3681079 - RNA, 20 nt, Human
ugagcucccacaagccugag

SEQ ID NO: 3681080 - RNA, 21 nt, Human
ugagcucccacaagccugagg

SEQ ID NO: 3681081 - RNA, 18 nt, Human
ugagcuccuguccccugc

SEQ ID NO: 3681082 - RNA, 21 nt, Human
ugagcuccuuaaggcucuuuu

SEQ ID NO: 3681083 - RNA, 21 nt, Human
ugagcucgguggacccaggga

SEQ ID NO: 3681084 - RNA, 12 nt, Human
ugagcucugaaa

SEQ ID NO: 3681085 - RNA, 12 nt, Human
ugagcucugaga

SEQ ID NO: 3681086 - RNA, 18 nt, Human
ugagcucugagaggcccu

SEQ ID NO: 3681087 - RNA, 18 nt, Human
ugagcucugcagcccagg

SEQ ID NO: 3681088 - RNA, 21 nt, Human
ugagcucugcagcccagggac

SEQ ID NO: 3681089 - RNA, 21 nt, Human
ugagcucuuccuaucccucuc

SEQ ID NO: 3681090 - RNA, 13 nt, Human
ugagcucuuguga

SEQ ID NO: 3681091 - RNA, 18 nt, Human
ugagcucuugugaggaaa

SEQ ID NO: 3681092 - RNA, 16 nt, Human
ugagcugagcagggag

SEQ ID NO: 3681093 - RNA, 16 nt, Human
ugagcugagccaggcu

SEQ ID NO: 3681094 - RNA, 17 nt, Human
ugagcugauauaaauuc

SEQ ID NO: 3681095 - RNA, 21 nt, Human
ugagcugauauaaauucugug

SEQ ID NO: 3681096 - RNA, 15 nt, Human
ugagcugcaccaggu

SEQ ID NO: 3681097 - RNA, 14 nt, Human
ugagcugccagugg

SEQ ID NO: 3681098 - RNA, 17 nt, Human
ugagcugcccacagcag

SEQ ID NO: 3681099 - RNA, 12 nt, Human
ugagcugccuuc

SEQ ID NO: 3681100 - RNA, 15 nt, Human
ugagcugccuucccu

SEQ ID NO: 3681101 - RNA, 17 nt, Human
ugagcugccuucccuag

SEQ ID NO: 3681102 - RNA, 18 nt, Human
ugagcugcuuuuuuugaa

SEQ ID NO: 3681103 - RNA, 18 nt, Human
ugagcuggaccucaccaa

SEQ ID NO: 3681104 - RNA, 10 nt, Human
ugagcuggcc

SEQ ID NO: 3681105 - RNA, 18 nt, Human
ugagcuggccucucuagc

SEQ ID NO: 3681106 - RNA, 21 nt, Human
ugagcuggccucucuagcaca

SEQ ID NO: 3681107 - RNA, 14 nt, Human
ugagcugggccgga

SEQ ID NO: 3681108 - RNA, 16 nt, Human
ugagcugucaacgaga

SEQ ID NO: 3681109 - RNA, 11 nt, Human
ugagcuguuuu

SEQ ID NO: 3681110 - RNA, 16 nt, Human
ugagcuuaaaauacaa

SEQ ID NO: 3681111 - RNA, 17 nt, Human
ugagcuuaaaauacaag

SEQ ID NO: 3681112 - RNA, 21 nt, Human
ugagcuuaaaauacaagacug

SEQ ID NO: 3681113 - RNA, 19 nt, Human
ugagcuuggccagaagggg

SEQ ID NO: 3681114 - RNA, 16 nt, Human
ugagcuuucugaacag

SEQ ID NO: 3681115 - RNA, 17 nt, Human
ugagcuuucugaacagc

SEQ ID NO: 3681116 - RNA, 20 nt, Human
ugagcuuucugaacagcugg

SEQ ID NO: 3681117 - RNA, 23 nt, Human
ugagcuuucugaacagcuggugu

SEQ ID NO: 3681118 - RNA, 19 nt, Human
ugagcuuucuuuuuaaagc

SEQ ID NO: 3681119 - RNA, 15 nt, Human
ugagcuuuggacaca

SEQ ID NO: 3681120 - RNA, 21 nt, Human
ugagcuuuggacacacacagc

SEQ ID NO: 3681121 - RNA, 16 nt, Human
ugaggaaacaacagcu

SEQ ID NO: 3681122 - RNA, 16 nt, Human
ugaggaaaggccagcu

SEQ ID NO: 3681123 - RNA, 19 nt, Human
ugaggaaaggccagcuggc

SEQ ID NO: 3681124 - RNA, 15 nt, Human
ugaggaaagucauug

SEQ ID NO: 3681125 - RNA, 21 nt, Human
ugaggaaagucauuggcuuua

SEQ ID NO: 3681126 - RNA, 19 nt, Human
ugaggaacuguacagaaaa

SEQ ID NO: 3681127 - RNA, 21 nt, Human
ugaggaacuguagaugaugua

SEQ ID NO: 3681128 - RNA, 17 nt, Human
ugaggaagaacggggcu

SEQ ID NO: 3681129 - RNA, 17 nt, Human
ugaggaagagggacugu

SEQ ID NO: 3681130 - RNA, 14 nt, Human
ugaggaagagucuu

SEQ ID NO: 3681131 - RNA, 14 nt, Human
ugaggaagccgcug

SEQ ID NO: 3681132 - RNA, 22 nt, Human
ugaggaagcgugaaggccgaga

SEQ ID NO: 3681133 - RNA, 20 nt, Human
ugaggaagcuccaguccugc

SEQ ID NO: 3681134 - RNA, 19 nt, Human
ugaggaauaauuauuuauu

SEQ ID NO: 3681135 - RNA, 19 nt, Human
ugaggaaucaacagggcag

SEQ ID NO: 3681136 - RNA, 16 nt, Human
ugaggaaugaugaagc

SEQ ID NO: 3681137 - RNA, 14 nt, Human
ugaggaauucugua

SEQ ID NO: 3681138 - RNA, 19 nt, Human
ugaggaauucuguauagau

SEQ ID NO: 3681139 - RNA, 22 nt, Human
ugaggacaaaguggaggagggc

SEQ ID NO: 3681140 - RNA, 19 nt, Human
ugaggacaaccauuccaga

SEQ ID NO: 3681141 - RNA, 22 nt, Human
ugaggacaagagaaaaaagcca

SEQ ID NO: 3681142 - RNA, 13 nt, Human
ugaggacacaugu

SEQ ID NO: 3681143 - RNA, 15 nt, Human
ugaggacacaugucc

SEQ ID NO: 3681144 - RNA, 21 nt, Human
ugaggacacuaaccacgcugg

SEQ ID NO: 3681145 - RNA, 20 nt, Human
ugaggacagaugccuccuuc

SEQ ID NO: 3681146 - RNA, 13 nt, Human
ugaggacagcugu

SEQ ID NO: 3681147 - RNA, 17 nt, Human
ugaggacauaaaucuuc

SEQ ID NO: 3681148 - RNA, 17 nt, Human
ugaggaccguaaggccu

SEQ ID NO: 3681149 - RNA, 16 nt, Human
ugaggacuauggaaau

SEQ ID NO: 3681150 - RNA, 15 nt, Human
ugaggagacacaccu

SEQ ID NO: 3681151 - RNA, 17 nt, Human
ugaggagagaaaauaua

SEQ ID NO: 3681152 - RNA, 18 nt, Human
ugaggagauucugccuuu

SEQ ID NO: 3681153 - RNA, 22 nt, Human
ugaggagcagcaggagggggga

SEQ ID NO: 3681154 - RNA, 16 nt, Human
ugaggagcagcuucag

SEQ ID NO: 3681155 - RNA, 20 nt, Human
ugaggagcccauacucagcc

SEQ ID NO: 3681156 - RNA, 21 nt, Human
ugaggagcccauacucagccu

SEQ ID NO: 3681157 - RNA, 23 nt, Human
ugaggagcccauacucagccugc

SEQ ID NO: 3681158 - RNA, 16 nt, Human
ugaggagccccagcua

SEQ ID NO: 3681159 - RNA, 11 nt, Human
ugaggagcugc

SEQ ID NO: 3681160 - RNA, 12 nt, Human
ugaggagcugcu

SEQ ID NO: 3681161 - RNA, 14 nt, Human
ugaggagcugcugg

SEQ ID NO: 3681162 - RNA, 15 nt, Human
ugaggagcugcuggc

SEQ ID NO: 3681163 - RNA, 13 nt, Human
ugaggagcugggg

SEQ ID NO: 3681164 - RNA, 13 nt, Human
ugaggaggaagga

SEQ ID NO: 3681165 - RNA, 18 nt, Human
ugaggaggaaggagagaa

SEQ ID NO: 3681166 - RNA, 21 nt, Human
ugaggaggaaggagagaaggg

SEQ ID NO: 3681167 - RNA, 23 nt, Human
ugaggaggaugucccugggccag

SEQ ID NO: 3681168 - RNA, 17 nt, Human
ugaggaggcagaaagca

SEQ ID NO: 3681169 - RNA, 23 nt, Human
ugaggaggcagaaagcagaggcu

SEQ ID NO: 3681170 - RNA, 24 nt, Human
ugaggaggcagaaagcagaggcug

SEQ ID NO: 3681171 - RNA, 16 nt, Human
ugaggaggccuccauc

SEQ ID NO: 3681172 - RNA, 23 nt, Human
ugaggaggccuugggcucugcug

SEQ ID NO: 3681173 - RNA, 12 nt, Human
ugaggaggggag

SEQ ID NO: 3681174 - RNA, 13 nt, Human
ugaggaggggagg

SEQ ID NO: 3681175 - RNA, 19 nt, Human
ugaggaggggcagguaaac

SEQ ID NO: 3681176 - RNA, 16 nt, Human
ugaggagucugagguc

SEQ ID NO: 3681177 - RNA, 17 nt, Human
ugaggagucugaggucc

SEQ ID NO: 3681178 - RNA, 22 nt, Human
ugaggagucugagguccugagc

SEQ ID NO: 3681179 - RNA, 13 nt, Human
ugaggaucagagu

SEQ ID NO: 3681180 - RNA, 14 nt, Human
ugaggaugaggccg

SEQ ID NO: 3681181 - RNA, 20 nt, Human
ugaggaugggaaggagggag

SEQ ID NO: 3681182 - RNA, 22 nt, Human
ugaggauguaaagaucaauaaa

SEQ ID NO: 3681183 - RNA, 17 nt, Human
ugaggaugucacucaga

SEQ ID NO: 3681184 - RNA, 17 nt, Human
ugaggauuaguuuagaa

SEQ ID NO: 3681185 - RNA, 21 nt, Human
ugaggauuaguuuagaacagg

SEQ ID NO: 3681186 - RNA, 16 nt, Human
ugaggcaagugugggc

SEQ ID NO: 3681187 - RNA, 21 nt, Human
ugaggcaaugucaggaacaga

SEQ ID NO: 3681188 - RNA, 22 nt, Human
ugaggcacgaaugaucuuucuu

SEQ ID NO: 3681189 - RNA, 13 nt, Human
ugaggcagaagaa

SEQ ID NO: 3681190 - RNA, 18 nt, Human
ugaggcagaagaauugaa

SEQ ID NO: 3681191 - RNA, 16 nt, Human
ugaggcagacagcagc

SEQ ID NO: 3681192 - RNA, 24 nt, Human
ugaggcagacagcagcucaggcac

SEQ ID NO: 3681193 - RNA, 20 nt, Human
ugaggcagcacgugcacaaa

SEQ ID NO: 3681194 - RNA, 12 nt, Human
ugaggcaggaga

SEQ ID NO: 3681195 - RNA, 13 nt, Human
ugaggcagggaag

SEQ ID NO: 3681196 - RNA, 23 nt, Human
ugaggcaucgcaauguaagacuc

SEQ ID NO: 3681197 - RNA, 17 nt, Human
ugaggcauugcacaggg

SEQ ID NO: 3681198 - RNA, 22 nt, Human
ugaggcauuugggugguaagag

SEQ ID NO: 3681199 - RNA, 12 nt, Human
ugaggccacacu

SEQ ID NO: 3681200 - RNA, 13 nt, Human
ugaggccacacuc

SEQ ID NO: 3681201 - RNA, 16 nt, Human
ugaggccacccagagg

SEQ ID NO: 3681202 - RNA, 18 nt, Human
ugaggccacugaagagga

SEQ ID NO: 3681203 - RNA, 14 nt, Human
ugaggccagagaca

SEQ ID NO: 3681204 - RNA, 16 nt, Human
ugaggccagagacaca

SEQ ID NO: 3681205 - RNA, 20 nt, Human
ugaggccagagacacaagcc

SEQ ID NO: 3681206 - RNA, 13 nt, Human
ugaggccagccug

SEQ ID NO: 3681207 - RNA, 16 nt, Human
ugaggccagccuggcc

SEQ ID NO: 3681208 - RNA, 21 nt, Human
ugaggccagccuggccuccug

SEQ ID NO: 3681209 - RNA, 22 nt, Human
ugaggccagccuggccuccugc

SEQ ID NO: 3681210 - RNA, 13 nt, Human
ugaggccaggagu

SEQ ID NO: 3681211 - RNA, 13 nt, Human
ugaggccagggca

SEQ ID NO: 3681212 - RNA, 14 nt, Human
ugaggccauggacu

SEQ ID NO: 3681213 - RNA, 12 nt, Human
ugaggcccagag

SEQ ID NO: 3681214 - RNA, 13 nt, Human
ugaggcccagagg

SEQ ID NO: 3681215 - RNA, 23 nt, Human
ugaggcccagagggccugcaagg

SEQ ID NO: 3681216 - RNA, 14 nt, Human
ugaggcccagggag

SEQ ID NO: 3681217 - RNA, 23 nt, Human
ugaggcccagggagaggccauga

SEQ ID NO: 3681218 - RNA, 17 nt, Human
ugaggcccuccacaccu

SEQ ID NO: 3681219 - RNA, 23 nt, Human
ugaggcccuccacaccugcggcc

SEQ ID NO: 3681220 - RNA, 14 nt, Human
ugaggcccugccca

SEQ ID NO: 3681221 - RNA, 18 nt, Human
ugaggcccuucucuccag

SEQ ID NO: 3681222 - RNA, 19 nt, Human
ugaggcccuucucuccagc

SEQ ID NO: 3681223 - RNA, 24 nt, Human
ugaggcccuucucuccagccccug

SEQ ID NO: 3681224 - RNA, 19 nt, Human
ugaggccgcuagaggccug

SEQ ID NO: 3681225 - RNA, 22 nt, Human
ugaggccgcuagaggccugagg

SEQ ID NO: 3681226 - RNA, 14 nt, Human
ugaggccguugcug

SEQ ID NO: 3681227 - RNA, 20 nt, Human
ugaggccguugcugacuuag

SEQ ID NO: 3681228 - RNA, 15 nt, Human
ugaggccucagugga

SEQ ID NO: 3681229 - RNA, 15 nt, Human
ugaggccucuuggac

SEQ ID NO: 3681230 - RNA, 23 nt, Human
ugaggccucuuggaccucugcuc

SEQ ID NO: 3681231 - RNA, 16 nt, Human
ugaggccugagaccca

SEQ ID NO: 3681232 - RNA, 19 nt, Human
ugaggccugagacccagga

SEQ ID NO: 3681233 - RNA, 20 nt, Human
ugaggccugagacccaggac

SEQ ID NO: 3681234 - RNA, 17 nt, Human
ugaggccugcccucagg

SEQ ID NO: 3681235 - RNA, 18 nt, Human
ugaggccugcccucaggg

SEQ ID NO: 3681236 - RNA, 17 nt, Human
ugaggccuggccaggca

SEQ ID NO: 3681237 - RNA, 19 nt, Human
ugaggccugucugugaccu

SEQ ID NO: 3681238 - RNA, 12 nt, Human
ugaggccuugcu

SEQ ID NO: 3681239 - RNA, 13 nt, Human
ugaggccuugcuc

SEQ ID NO: 3681240 - RNA, 21 nt, Human
ugaggcgagaagggcugcuuc

SEQ ID NO: 3681241 - RNA, 23 nt, Human
ugaggcggguggaucaccugagg

SEQ ID NO: 3681242 - RNA, 20 nt, Human
ugaggcggguggaucacgag

SEQ ID NO: 3681243 - RNA, 20 nt, Human
ugaggcguauguggcaaaau

SEQ ID NO: 3681244 - RNA, 21 nt, Human
ugaggcucaggggugugccug

SEQ ID NO: 3681245 - RNA, 15 nt, Human
ugaggcuccugugcu

SEQ ID NO: 3681246 - RNA, 18 nt, Human
ugaggcucuuucugggcc

SEQ ID NO: 3681247 - RNA, 22 nt, Human
ugaggcuggacuccagaucugc

SEQ ID NO: 3681248 - RNA, 15 nt, Human
ugaggcuggcacagg

SEQ ID NO: 3681249 - RNA, 16 nt, Human
ugaggcugggcucccu

SEQ ID NO: 3681250 - RNA, 12 nt, Human
ugaggcuguccu

SEQ ID NO: 3681251 - RNA, 20 nt, Human
ugaggcuugcugagaggggc

SEQ ID NO: 3681252 - RNA, 18 nt, Human
ugaggcuuucagguuuua

SEQ ID NO: 3681253 - RNA, 14 nt, Human
ugaggcuuuguguu

SEQ ID NO: 3681254 - RNA, 18 nt, Human
ugaggcuuuguguuguaa

SEQ ID NO: 3681255 - RNA, 21 nt, Human
ugagggaaagugcauaugaaa

SEQ ID NO: 3681256 - RNA, 22 nt, Human
ugagggaacagacaggagaaau

SEQ ID NO: 3681257 - RNA, 22 nt, Human
ugagggacgucagacuuggcuc

SEQ ID NO: 3681258 - RNA, 23 nt, Human
ugagggaggacaggcgggaggag

SEQ ID NO: 3681259 - RNA, 15 nt, Human
ugagggaggaccugg

SEQ ID NO: 3681260 - RNA, 19 nt, Human
ugagggaggaggccaccuc

SEQ ID NO: 3681261 - RNA, 14 nt, Human
ugagggauaagcaa

SEQ ID NO: 3681262 - RNA, 19 nt, Human
ugagggauacccaucccau

SEQ ID NO: 3681263 - RNA, 17 nt, Human
ugagggaucacagggcc

SEQ ID NO: 3681264 - RNA, 22 nt, Human
ugagggcagcagccagcccugc

SEQ ID NO: 3681265 - RNA, 11 nt, Human
ugagggcaguc

SEQ ID NO: 3681266 - RNA, 14 nt, Human
ugagggcagugcaa

SEQ ID NO: 3681267 - RNA, 15 nt, Human
ugagggcagugcaag

SEQ ID NO: 3681268 - RNA, 20 nt, Human
ugagggcaguucgcagccac

SEQ ID NO: 3681269 - RNA, 17 nt, Human
ugagggcccagagcagg

SEQ ID NO: 3681270 - RNA, 21 nt, Human
ugagggcccagagcaggaagc

SEQ ID NO: 3681271 - RNA, 15 nt, Human
ugagggccccucugc

SEQ ID NO: 3681272 - RNA, 17 nt, Human
ugagggccccucugccc

SEQ ID NO: 3681273 - RNA, 13 nt, Human
ugagggccugcug

SEQ ID NO: 3681274 - RNA, 18 nt, Human
ugagggccugcuggaggc

SEQ ID NO: 3681275 - RNA, 17 nt, Human
ugagggcgaggggaggg

SEQ ID NO: 3681276 - RNA, 13 nt, Human
ugagggcugcagu

SEQ ID NO: 3681277 - RNA, 15 nt, Human
ugaggggaccaggag

SEQ ID NO: 3681278 - RNA, 23 nt, Human
ugaggggagacagagcaaccccu

SEQ ID NO: 3681279 - RNA, 21 nt, Human
ugaggggaggaucacuggagc

SEQ ID NO: 3681280 - RNA, 22 nt, Human
ugaggggcaucugccccucccc

SEQ ID NO: 3681281 - RNA, 16 nt, Human
ugaggggcccgagcag

SEQ ID NO: 3681282 - RNA, 19 nt, Human
ugaggggcuaccaggaaag

SEQ ID NO: 3681283 - RNA, 18 nt, Human
ugagggguaaaagcugau

SEQ ID NO: 3681284 - RNA, 20 nt, Human
ugagggguauaucugggcug

SEQ ID NO: 3681285 - RNA, 20 nt, Human
ugaggggucuccaggaggag

SEQ ID NO: 3681286 - RNA, 17 nt, Human
ugagggguuccuccccu

SEQ ID NO: 3681287 - RNA, 18 nt, Human
ugaggguaauaaacuuag

SEQ ID NO: 3681288 - RNA, 14 nt, Human
ugaggguccugcag

SEQ ID NO: 3681289 - RNA, 18 nt, Human
ugaggguccugcagccug

SEQ ID NO: 3681290 - RNA, 19 nt, Human
ugaggguccugcagccugc

SEQ ID NO: 3681291 - RNA, 21 nt, Human
ugaggguccugcagccugcag

SEQ ID NO: 3681292 - RNA, 20 nt, Human
ugaggguugggcugguguca

SEQ ID NO: 3681293 - RNA, 19 nt, Human
ugaggucagagccugcagu

SEQ ID NO: 3681294 - RNA, 22 nt, Human
ugaggucagcacaucucaacag

SEQ ID NO: 3681295 - RNA, 16 nt, Human
ugaggucaggaguucc

SEQ ID NO: 3681296 - RNA, 21 nt, Human
ugagguccagcccuggcugaa

SEQ ID NO: 3681297 - RNA, 23 nt, Human
ugagguccagcccuggcugaagg

SEQ ID NO: 3681298 - RNA, 13 nt, Human
ugaggucccaggc

SEQ ID NO: 3681299 - RNA, 15 nt, Human
ugaggucccaggcag

SEQ ID NO: 3681300 - RNA, 17 nt, Human
ugaggucccaggcagag

SEQ ID NO: 3681301 - RNA, 16 nt, Human
ugagguccugggggcc

SEQ ID NO: 3681302 - RNA, 18 nt, Human
ugagguccugggggccug

SEQ ID NO: 3681303 - RNA, 23 nt, Human
ugaggucucgcugaugcugggcu

SEQ ID NO: 3681304 - RNA, 15 nt, Human
ugaggucugcucggc

SEQ ID NO: 3681305 - RNA, 13 nt, Human
ugaggucuguucc

SEQ ID NO: 3681306 - RNA, 16 nt, Human
ugaggucuguuccuuu

SEQ ID NO: 3681307 - RNA, 14 nt, Human
ugaggucuguucuu

SEQ ID NO: 3681308 - RNA, 20 nt, Human
ugaggucuguucuuuccaaa

SEQ ID NO: 3681309 - RNA, 19 nt, Human
ugaggucuuuugacaugug

SEQ ID NO: 3681310 - RNA, 20 nt, Human
ugaggucuuuugacaugugg

SEQ ID NO: 3681311 - RNA, 22 nt, Human
ugaggucuuuugacauguggaa

SEQ ID NO: 3681312 - RNA, 15 nt, Human
ugaggugaaagggag

SEQ ID NO: 3681313 - RNA, 21 nt, Human
ugaggugaugaagacagcccg

SEQ ID NO: 3681314 - RNA, 15 nt, Human
ugaggugcacuggga

SEQ ID NO: 3681315 - RNA, 19 nt, Human
ugaggugcacugggaggcu

SEQ ID NO: 3681316 - RNA, 22 nt, Human
ugaggugcccagcuagcugcag

SEQ ID NO: 3681317 - RNA, 13 nt, Human
ugaggugcccagg

SEQ ID NO: 3681318 - RNA, 14 nt, Human
ugaggugcccagga

SEQ ID NO: 3681319 - RNA, 17 nt, Human
ugaggugcccaggagaa

SEQ ID NO: 3681320 - RNA, 16 nt, Human
ugaggugccuguccca

SEQ ID NO: 3681321 - RNA, 17 nt, Human
ugaggugcugggaggga

SEQ ID NO: 3681322 - RNA, 16 nt, Human
ugagguggaagcccuc

SEQ ID NO: 3681323 - RNA, 18 nt, Human
ugagguggcacuuuuuca

SEQ ID NO: 3681324 - RNA, 21 nt, Human
ugagguggcacuuuuucauuu

SEQ ID NO: 3681325 - RNA, 12 nt, Human
ugaggugggagg

SEQ ID NO: 3681326 - RNA, 21 nt, Human
ugaggugggaggaucucuuga

SEQ ID NO: 3681327 - RNA, 18 nt, Human
ugaggugggagguggaag

SEQ ID NO: 3681328 - RNA, 21 nt, Human
ugaggugggagguggaagaag

SEQ ID NO: 3681329 - RNA, 15 nt, Human
ugaggugggcccagg

SEQ ID NO: 3681330 - RNA, 20 nt, Human
ugaggugggcccaggaccag

SEQ ID NO: 3681331 - RNA, 17 nt, Human
ugagguggucugaaugu

SEQ ID NO: 3681332 - RNA, 22 nt, Human
ugagguggucugaauguucuga

SEQ ID NO: 3681333 - RNA, 12 nt, Human
ugagguguacca

SEQ ID NO: 3681334 - RNA, 15 nt, Human
ugagguguccaacug

SEQ ID NO: 3681335 - RNA, 23 nt, Human
ugaggugugggggcugcagcaug

SEQ ID NO: 3681336 - RNA, 15 nt, Human
ugaggugugucacaa

SEQ ID NO: 3681337 - RNA, 12 nt, Human
ugagguuaggag

SEQ ID NO: 3681338 - RNA, 20 nt, Human
ugagguuccucugccugccc

SEQ ID NO: 3681339 - RNA, 21 nt, Human
ugagguuccucugccugcccc

SEQ ID NO: 3681340 - RNA, 22 nt, Human
ugagguuuuauuucauuuuuca

SEQ ID NO: 3681341 - RNA, 15 nt, Human
ugagguuuuuaagcc

SEQ ID NO: 3681342 - RNA, 21 nt, Human
ugaguaaaauagauuuuauaa

SEQ ID NO: 3681343 - RNA, 18 nt, Human
ugaguaacauuugcuguu

SEQ ID NO: 3681344 - RNA, 19 nt, Human
ugaguaacauuugcuguuu

SEQ ID NO: 3681345 - RNA, 15 nt, Human
ugaguaacuauuauu

SEQ ID NO: 3681346 - RNA, 17 nt, Human
ugaguaagaaaugcugc

SEQ ID NO: 3681347 - RNA, 13 nt, Human
ugaguaagagcug

SEQ ID NO: 3681348 - RNA, 14 nt, Human
ugaguaagagcugg

SEQ ID NO: 3681349 - RNA, 16 nt, Human
ugaguaagagcuggug

SEQ ID NO: 3681350 - RNA, 18 nt, Human
ugaguaagagcugguguc

SEQ ID NO: 3681351 - RNA, 21 nt, Human
ugaguaagagcuggugucuga

SEQ ID NO: 3681352 - RNA, 15 nt, Human
ugaguacagcagaaa

SEQ ID NO: 3681353 - RNA, 19 nt, Human
ugaguaccccugcuuuggg

SEQ ID NO: 3681354 - RNA, 16 nt, Human
ugaguacguugugcau

SEQ ID NO: 3681355 - RNA, 18 nt, Human
ugaguagauauuacuuua

SEQ ID NO: 3681356 - RNA, 19 nt, Human
ugaguagauccauuuccau

SEQ ID NO: 3681357 - RNA, 21 nt, Human
ugaguagauccauuuccauug

SEQ ID NO: 3681358 - RNA, 21 nt, Human
ugaguagaugcgcagccccau

SEQ ID NO: 3681359 - RNA, 13 nt, Human
ugaguagcuggau

SEQ ID NO: 3681360 - RNA, 15 nt, Human
ugaguaucagaauug

SEQ ID NO: 3681361 - RNA, 21 nt, Human
ugaguauccuuucaguguuau

SEQ ID NO: 3681362 - RNA, 15 nt, Human
ugaguaucuccucgc

SEQ ID NO: 3681363 - RNA, 21 nt, Human
ugaguaucuccucgcaagcug

SEQ ID NO: 3681364 - RNA, 20 nt, Human
ugaguauggagcagccugga

SEQ ID NO: 3681365 - RNA, 17 nt, Human
ugaguauguggaaggca

SEQ ID NO: 3681366 - RNA, 21 nt, Human
ugaguauuguuuaaaauguaa

SEQ ID NO: 3681367 - RNA, 15 nt, Human
ugagucaaaaaaucu

SEQ ID NO: 3681368 - RNA, 13 nt, Human
ugagucaaugugc

SEQ ID NO: 3681369 - RNA, 18 nt, Human
ugagucaaugugcagugu

SEQ ID NO: 3681370 - RNA, 23 nt, Human
ugagucacaaagaacauguagaa

SEQ ID NO: 3681371 - RNA, 14 nt, Human
ugagucaccaagcc

SEQ ID NO: 3681372 - RNA, 13 nt, Human
ugagucaccagga

SEQ ID NO: 3681373 - RNA, 22 nt, Human
ugagucacccuaccugugccug

SEQ ID NO: 3681374 - RNA, 21 nt, Human
ugagucagagccaugucuucu

SEQ ID NO: 3681375 - RNA, 20 nt, Human
ugagucagguuugaguagag

SEQ ID NO: 3681376 - RNA, 15 nt, Human
ugagucaucuguuag

SEQ ID NO: 3681377 - RNA, 21 nt, Human
ugagucaugaucucccugccg

SEQ ID NO: 3681378 - RNA, 20 nt, Human
ugaguccaaacuggaaugag

SEQ ID NO: 3681379 - RNA, 13 nt, Human
ugaguccagaagu

SEQ ID NO: 3681380 - RNA, 19 nt, Human
ugaguccauucucccaggu

SEQ ID NO: 3681381 - RNA, 22 nt, Human
ugaguccauucucccagguacc

SEQ ID NO: 3681382 - RNA, 16 nt, Human
ugagucccaggagcug

SEQ ID NO: 3681383 - RNA, 20 nt, Human
ugagucccaggagcugccca

SEQ ID NO: 3681384 - RNA, 21 nt, Human
ugagucccaggagcugcccag

SEQ ID NO: 3681385 - RNA, 13 nt, Human
ugagucccaggcu

SEQ ID NO: 3681386 - RNA, 16 nt, Human
ugagucccagugggag

SEQ ID NO: 3681387 - RNA, 19 nt, Human
ugagucccagugggaggcg

SEQ ID NO: 3681388 - RNA, 16 nt, Human
ugagucccuuccaggc

SEQ ID NO: 3681389 - RNA, 15 nt, Human
ugaguccuccagaac

SEQ ID NO: 3681390 - RNA, 17 nt, Human
ugaguccuggaugauac

SEQ ID NO: 3681391 - RNA, 11 nt, Human
ugaguccuggc

SEQ ID NO: 3681392 - RNA, 19 nt, Human
ugaguccuggcaugggaau

SEQ ID NO: 3681393 - RNA, 15 nt, Human
ugaguccuggcccaa

SEQ ID NO: 3681394 - RNA, 18 nt, Human
ugaguccuugaaaauauu

SEQ ID NO: 3681395 - RNA, 16 nt, Human
ugagucgaggacaggg

SEQ ID NO: 3681396 - RNA, 19 nt, Human
ugagucgaggacagggagg

SEQ ID NO: 3681397 - RNA, 17 nt, Human
ugagucguacagaaagc

SEQ ID NO: 3681398 - RNA, 15 nt, Human
ugagucuagauguuu

SEQ ID NO: 3681399 - RNA, 21 nt, Human
ugagucuguacuaaacaguaa

SEQ ID NO: 3681400 - RNA, 15 nt, Human
ugagucuguugugug

SEQ ID NO: 3681401 - RNA, 16 nt, Human
ugagucuguuuuguaa

SEQ ID NO: 3681402 - RNA, 18 nt, Human
ugagucuguuuuguaaag

SEQ ID NO: 3681403 - RNA, 17 nt, Human
ugagucuuggcggcagc

SEQ ID NO: 3681404 - RNA, 23 nt, Human
ugagucuuggcggcagcagccau

SEQ ID NO: 3681405 - RNA, 16 nt, Human
ugagucuuugguucua

SEQ ID NO: 3681406 - RNA, 18 nt, Human
ugagucuuugguucuaag

SEQ ID NO: 3681407 - RNA, 21 nt, Human
ugagucuuugguucuaaggac

SEQ ID NO: 3681408 - RNA, 13 nt, Human
ugagugagaauau

SEQ ID NO: 3681409 - RNA, 15 nt, Human
ugagugagaggggag

SEQ ID NO: 3681410 - RNA, 16 nt, Human
ugagugagccuggcuc

SEQ ID NO: 3681411 - RNA, 17 nt, Human
ugagugcagcucuggag

SEQ ID NO: 3681412 - RNA, 16 nt, Human
ugagugcaggcccacc

SEQ ID NO: 3681413 - RNA, 15 nt, Human
ugagugcaguccuga

SEQ ID NO: 3681414 - RNA, 14 nt, Human
ugagugcauguacu

SEQ ID NO: 3681415 - RNA, 17 nt, Human
ugagugccuuacacaau

SEQ ID NO: 3681416 - RNA, 19 nt, Human
ugagugcucugaucccucu

SEQ ID NO: 3681417 - RNA, 13 nt, Human
ugaguggacugga

SEQ ID NO: 3681418 - RNA, 20 nt, Human
ugaguggacuggaguggagc

SEQ ID NO: 3681419 - RNA, 14 nt, Human
ugaguggaguuacu

SEQ ID NO: 3681420 - RNA, 21 nt, Human
ugaguggcaggggacaggagu

SEQ ID NO: 3681421 - RNA, 14 nt, Human
ugaguggccaggga

SEQ ID NO: 3681422 - RNA, 21 nt, Human
ugagugggguuaucucugugu

SEQ ID NO: 3681423 - RNA, 18 nt, Human
ugagugucuuaauuaaaa

SEQ ID NO: 3681424 - RNA, 13 nt, Human
ugagugugacagg

SEQ ID NO: 3681425 - RNA, 15 nt, Human
ugagugugacagggc

SEQ ID NO: 3681426 - RNA, 19 nt, Human
ugaguguuuuaugagaaag

SEQ ID NO: 3681427 - RNA, 22 nt, Human
ugaguguuuuuacuacaguugu

SEQ ID NO: 3681428 - RNA, 16 nt, Human
ugaguuacagccuguu

SEQ ID NO: 3681429 - RNA, 15 nt, Human
ugaguuacugugcau

SEQ ID NO: 3681430 - RNA, 15 nt, Human
ugaguuacuuccuau

SEQ ID NO: 3681431 - RNA, 20 nt, Human
ugaguuauauguucacuguc

SEQ ID NO: 3681432 - RNA, 23 nt, Human
ugaguuaucaugaauuuuaaagu

SEQ ID NO: 3681433 - RNA, 15 nt, Human
ugaguuaucuaagaa

SEQ ID NO: 3681434 - RNA, 16 nt, Human
ugaguuaucuaagaau

SEQ ID NO: 3681435 - RNA, 17 nt, Human
ugaguuauuuuaauuau

SEQ ID NO: 3681436 - RNA, 20 nt, Human
ugaguucaagggcuguaggu

SEQ ID NO: 3681437 - RNA, 16 nt, Human
ugaguucagguagcug

SEQ ID NO: 3681438 - RNA, 18 nt, Human
ugaguucauaaauuuaug

SEQ ID NO: 3681439 - RNA, 17 nt, Human
ugaguuccagaaaguaa

SEQ ID NO: 3681440 - RNA, 18 nt, Human
ugaguuccagaaaguaaa

SEQ ID NO: 3681441 - RNA, 16 nt, Human
ugaguuccaguugaag

SEQ ID NO: 3681442 - RNA, 19 nt, Human
ugaguuccaguugaaguua

SEQ ID NO: 3681443 - RNA, 22 nt, Human
ugaguucuacauaaguaauuca

SEQ ID NO: 3681444 - RNA, 16 nt, Human
ugaguucucagggcuc

SEQ ID NO: 3681445 - RNA, 16 nt, Human
ugaguugauagcacag

SEQ ID NO: 3681446 - RNA, 23 nt, Human
ugaguugccaagacaaaucaaca

SEQ ID NO: 3681447 - RNA, 16 nt, Human
ugaguuggcugggaau

SEQ ID NO: 3681448 - RNA, 19 nt, Human
ugaguuggggucuggcagc

SEQ ID NO: 3681449 - RNA, 14 nt, Human
ugaguuguuuuugu

SEQ ID NO: 3681450 - RNA, 16 nt, Human
ugaguuguuuuuguau

SEQ ID NO: 3681451 - RNA, 18 nt, Human
ugaguuuaaaaaucaacu

SEQ ID NO: 3681452 - RNA, 18 nt, Human
ugaguuuaccauuuguaa

SEQ ID NO: 3681453 - RNA, 16 nt, Human
ugaguuuaccuuguau

SEQ ID NO: 3681454 - RNA, 15 nt, Human
ugaguuucauagcua

SEQ ID NO: 3681455 - RNA, 14 nt, Human
ugaguuucuuuuau

SEQ ID NO: 3681456 - RNA, 16 nt, Human
ugaguuugagcugccu

SEQ ID NO: 3681457 - RNA, 17 nt, Human
ugaguuugagcugccuu

SEQ ID NO: 3681458 - RNA, 19 nt, Human
ugaguuugagcugccuucc

SEQ ID NO: 3681459 - RNA, 18 nt, Human
ugaguuuggucuggacug

SEQ ID NO: 3681460 - RNA, 19 nt, Human
ugaguuugucgcucaugug

SEQ ID NO: 3681461 - RNA, 19 nt, Human
ugaguuuguuucuuugaau

SEQ ID NO: 3681462 - RNA, 12 nt, Human
ugaguuuuacca

SEQ ID NO: 3681463 - RNA, 22 nt, Human
ugagacuuuuugguggauguaa

SEQ ID NO: 3681464 - RNA, 15 nt, Human
ugagagaagggacac

SEQ ID NO: 3681465 - RNA, 22 nt, Human
ugagagacacacugaagaagca

SEQ ID NO: 3681466 - RNA, 18 nt, Human
ugagagacauuaacucau

SEQ ID NO: 3681467 - RNA, 24 nt, Human
ugagagaccaggcaaagcaaguga

SEQ ID NO: 3681468 - RNA, 15 nt, Human
ugagagagacaagaa

SEQ ID NO: 3681469 - RNA, 22 nt, Human
ugagagagauguguaauuuuuc

SEQ ID NO: 3681470 - RNA, 17 nt, Human
ugagagagcagccagga

SEQ ID NO: 3681471 - RNA, 13 nt, Human
ugagagaggccau

SEQ ID NO: 3681472 - RNA, 20 nt, Human
ugagagaggcuaaaauguuu

SEQ ID NO: 3681473 - RNA, 20 nt, Human
ugagagcaucaggccuagag

SEQ ID NO: 3681474 - RNA, 15 nt, Human
ugagagcccagaggu

SEQ ID NO: 3681475 - RNA, 19 nt, Human
ugagagcugcucuggaaaa

SEQ ID NO: 3681476 - RNA, 11 nt, Human
ugagaggaaau

SEQ ID NO: 3681477 - RNA, 20 nt, Human
ugagaggaggcagcaggacu

SEQ ID NO: 3681478 - RNA, 20 nt, Human
ugagaggcaaugauuguuaa

SEQ ID NO: 3681479 - RNA, 22 nt, Human
ugagaggcauccaguaucuuga

SEQ ID NO: 3681480 - RNA, 23 nt, Human
ugagaggcauccaguaucuugaa

SEQ ID NO: 3681481 - RNA, 17 nt, Human
ugagagggcaugcgcac

SEQ ID NO: 3681482 - RNA, 14 nt, Human
ugagaggggaacag

SEQ ID NO: 3681483 - RNA, 12 nt, Human
ugagaggggaag

SEQ ID NO: 3681484 - RNA, 21 nt, Human
ugagagguggcuuuugcggcc

SEQ ID NO: 3681485 - RNA, 14 nt, Human
ugagagguuugacu

SEQ ID NO: 3681486 - RNA, 22 nt, Human
ugagagguuugacuagaugaug

SEQ ID NO: 3681487 - RNA, 17 nt, Human
ugagagucagcucucug

SEQ ID NO: 3681488 - RNA, 15 nt, Human
ugagagucuagauuc

SEQ ID NO: 3681489 - RNA, 16 nt, Human
ugagagugucucugau

SEQ ID NO: 3681490 - RNA, 24 nt, Human
ugagagugucuucacggcaggaca

SEQ ID NO: 3681491 - RNA, 12 nt, Human
ugagagugugac

SEQ ID NO: 3681492 - RNA, 15 nt, Human
ugagaguuuuggaug

SEQ ID NO: 3681493 - RNA, 22 nt, Human
ugagaguuuuggaugcagugcu

SEQ ID NO: 3681494 - RNA, 22 nt, Human
ugagauaaugugauauuauaca

SEQ ID NO: 3681495 - RNA, 16 nt, Human
ugagauaauguuagag

SEQ ID NO: 3681496 - RNA, 14 nt, Human
ugagauacauacag

SEQ ID NO: 3681497 - RNA, 21 nt, Human
ugagauacauacagaauuacu

SEQ ID NO: 3681498 - RNA, 18 nt, Human
ugagauacuuugcauugu

SEQ ID NO: 3681499 - RNA, 15 nt, Human
ugagauagaagaacu

SEQ ID NO: 3681500 - RNA, 16 nt, Human
ugagauagaagaacug

SEQ ID NO: 3681501 - RNA, 19 nt, Human
ugagauagaagaacugcaa

SEQ ID NO: 3681502 - RNA, 14 nt, Human
ugagauagaagaug

SEQ ID NO: 3681503 - RNA, 16 nt, Human
ugagauagaagauguu

SEQ ID NO: 3681504 - RNA, 19 nt, Human
ugagauagaagauguuugc

SEQ ID NO: 3681505 - RNA, 16 nt, Human
ugagauagcauuguga

SEQ ID NO: 3681506 - RNA, 23 nt, Human
ugagauagcauugugaacugaca

SEQ ID NO: 3681507 - RNA, 19 nt, Human
ugagauaguagcauacauu

SEQ ID NO: 3681508 - RNA, 23 nt, Human
ugagauaguagcauacauuuaua

SEQ ID NO: 3681509 - RNA, 17 nt, Human
ugagauaguuuucaucc

SEQ ID NO: 3681510 - RNA, 18 nt, Human
ugagauaguuuucaucca

SEQ ID NO: 3681511 - RNA, 13 nt, Human
ugagauauuaaug

SEQ ID NO: 3681512 - RNA, 20 nt, Human
ugagaucgugcuacugcacu

SEQ ID NO: 3681513 - RNA, 12 nt, Human
ugagaucuaaaa

SEQ ID NO: 3681514 - RNA, 15 nt, Human
ugagaucuaaaaaua

SEQ ID NO: 3681515 - RNA, 16 nt, Human
ugagaucuaagccuuu

SEQ ID NO: 3681516 - RNA, 20 nt, Human
ugagaugauacauccaaagc

SEQ ID NO: 3681517 - RNA, 21 nt, Human
ugagaugauuuccaagccucu

SEQ ID NO: 3681518 - RNA, 20 nt, Human
ugagaugcuagaacucccuu

SEQ ID NO: 3681519 - RNA, 15 nt, Human
ugagaugcuggagaa

SEQ ID NO: 3681520 - RNA, 17 nt, Human
ugagaugcuggagaaga

SEQ ID NO: 3681521 - RNA, 18 nt, Human
ugagaugcuggagaagag

SEQ ID NO: 3681522 - RNA, 21 nt, Human
ugagaugcugguaauggccau

SEQ ID NO: 3681523 - RNA, 16 nt, Human
ugagauggacacacug

SEQ ID NO: 3681524 - RNA, 17 nt, Human
ugagauggcccucuggu

SEQ ID NO: 3681525 - RNA, 20 nt, Human
ugagaugguaugcacaauuc

SEQ ID NO: 3681526 - RNA, 13 nt, Human
ugagauguaaaaa

SEQ ID NO: 3681527 - RNA, 17 nt, Human
ugagauguaugaaggcu

SEQ ID NO: 3681528 - RNA, 24 nt, Human
ugagaugugaacacaucagcuugc

SEQ ID NO: 3681529 - RNA, 17 nt, Human
ugagauguguaucagug

SEQ ID NO: 3681530 - RNA, 19 nt, Human
ugagauguguaucaguguu

SEQ ID NO: 3681531 - RNA, 20 nt, Human
ugagauguguggacuguggc

SEQ ID NO: 3681532 - RNA, 14 nt, Human
ugagauuaauuccu

SEQ ID NO: 3681533 - RNA, 17 nt, Human
ugagauuagagggaggu

SEQ ID NO: 3681534 - RNA, 17 nt, Human
ugagauucaauauugaa

SEQ ID NO: 3681535 - RNA, 18 nt, Human
ugagauucaauauugaau

SEQ ID NO: 3681536 - RNA, 18 nt, Human
ugagauugcaccacugca

SEQ ID NO: 3681537 - RNA, 18 nt, Human
ugagauugccccaggucu

SEQ ID NO: 3681538 - RNA, 16 nt, Human
ugagauuggcauggcu

SEQ ID NO: 3681539 - RNA, 17 nt, Human
ugagauuggcauggcuu

SEQ ID NO: 3681540 - RNA, 13 nt, Human
ugagauugguuuu

SEQ ID NO: 3681541 - RNA, 15 nt, Human
ugagauugguuuucc

SEQ ID NO: 3681542 - RNA, 22 nt, Human
ugagauugguuuuccuguggca

SEQ ID NO: 3681543 - RNA, 12 nt, Human
ugagauuguccu

SEQ ID NO: 3681544 - RNA, 23 nt, Human
ugagauuuaccagggauguagau

SEQ ID NO: 3681545 - RNA, 17 nt, Human
ugagauuuauuaaagaa

SEQ ID NO: 3681546 - RNA, 18 nt, Human
ugagauuucaucugcucu

SEQ ID NO: 3681547 - RNA, 17 nt, Human
ugagauuucuuaaauaa

SEQ ID NO: 3681548 - RNA, 14 nt, Human
ugagauuuugguau

SEQ ID NO: 3681549 - RNA, 17 nt, Human
ugagauuuuuuauugcu

SEQ ID NO: 3681550 - RNA, 20 nt, Human
ugagcaaagggaacagugag

SEQ ID NO: 3681551 - RNA, 16 nt, Human
ugagcaaaucaccaca

SEQ ID NO: 3681552 - RNA, 16 nt, Human
ugagcaaauguggcuc

SEQ ID NO: 3681553 - RNA, 18 nt, Human
ugagcaaauguggcuccu

SEQ ID NO: 3681554 - RNA, 16 nt, Human
ugagcaacucuugauu

SEQ ID NO: 3681555 - RNA, 19 nt, Human
ugagcaagacccugucucu

SEQ ID NO: 3681556 - RNA, 21 nt, Human
ugagcaaggagcacaagccac

SEQ ID NO: 3681557 - RNA, 18 nt, Human
ugagcaauguauaacccc

SEQ ID NO: 3681558 - RNA, 14 nt, Human
ugagcaauucuccu

SEQ ID NO: 3681559 - RNA, 13 nt, Human
ugagcacauucug

SEQ ID NO: 3681560 - RNA, 19 nt, Human
ugagcaccgucauggcuua

SEQ ID NO: 3681561 - RNA, 21 nt, Human
ugagcaccgugucaagcugcu

SEQ ID NO: 3681562 - RNA, 21 nt, Human
ugagcaccugcuucaugcuca

SEQ ID NO: 3681563 - RNA, 17 nt, Human
ugagcacucccaagucu

SEQ ID NO: 3681564 - RNA, 17 nt, Human
ugagcacugccaggagg

SEQ ID NO: 3681565 - RNA, 18 nt, Human
ugagcacugccaggaggg

SEQ ID NO: 3681566 - RNA, 15 nt, Human
ugagcacuguuuaua

SEQ ID NO: 3681567 - RNA, 15 nt, Human
ugagcacuguuuucu

SEQ ID NO: 3681568 - RNA, 21 nt, Human
ugagcacuguuuucuagugua

SEQ ID NO: 3681569 - RNA, 13 nt, Human
ugagcagaaggaa

SEQ ID NO: 3681570 - RNA, 14 nt, Human
ugagcagaaggaaa

SEQ ID NO: 3681571 - RNA, 19 nt, Human
ugagcagacuggugagcag

SEQ ID NO: 3681572 - RNA, 21 nt, Human
ugagcagacuggugagcagac

SEQ ID NO: 3681573 - RNA, 23 nt, Human
ugagcagacuggugagcagacug

SEQ ID NO: 3681574 - RNA, 12 nt, Human
ugagcagagucu

SEQ ID NO: 3681575 - RNA, 16 nt, Human
ugagcagccuggagcc

SEQ ID NO: 3681576 - RNA, 17 nt, Human
ugagcagcgagccugcu

SEQ ID NO: 3681577 - RNA, 19 nt, Human
ugagcaggaaggccugggu

SEQ ID NO: 3681578 - RNA, 15 nt, Human
ugagcaggauuuuaa

SEQ ID NO: 3681579 - RNA, 20 nt, Human
ugagcaggauuuuaaucuuu

SEQ ID NO: 3681580 - RNA, 17 nt, Human
ugagcagggauccuggu

SEQ ID NO: 3681581 - RNA, 16 nt, Human
ugagcagggccgggga

SEQ ID NO: 3681582 - RNA, 19 nt, Human
ugagcagggcucagcgggg

SEQ ID NO: 3681583 - RNA, 23 nt, Human
ugagcagggcucagcggggacag

SEQ ID NO: 3681584 - RNA, 15 nt, Human
ugagcagucaggaaa

SEQ ID NO: 3681585 - RNA, 14 nt, Human
ugagcagugauauu

SEQ ID NO: 3681586 - RNA, 20 nt, Human
ugagcagugauauucuuugu

SEQ ID NO: 3681587 - RNA, 14 nt, Human
ugagcaguggcugg

SEQ ID NO: 3681588 - RNA, 12 nt, Human
ugagcaucacag

SEQ ID NO: 3681589 - RNA, 14 nt, Human
ugagcaucacaguu

SEQ ID NO: 3681590 - RNA, 14 nt, Human
ugagcaucaggcca

SEQ ID NO: 3681591 - RNA, 16 nt, Human
ugagcaucaggccagg

SEQ ID NO: 3681592 - RNA, 18 nt, Human
ugagcaucaggccaggcc

SEQ ID NO: 3681593 - RNA, 18 nt, Human
ugagcauccugagccccg

SEQ ID NO: 3681594 - RNA, 19 nt, Human
ugagcauccugagccccgc

SEQ ID NO: 3681595 - RNA, 14 nt, Human
ugagcauggagcug

SEQ ID NO: 3681596 - RNA, 16 nt, Human
ugagcauguuacugac

SEQ ID NO: 3681597 - RNA, 14 nt, Human
ugagcauguuuaga

SEQ ID NO: 3681598 - RNA, 24 nt, Human
ugagcauguuuagacuuuaacaua

SEQ ID NO: 3681599 - RNA, 16 nt, Human
ugagcauuacaggcaa

SEQ ID NO: 3681600 - RNA, 14 nt, Human
ugagcauuagauuu

SEQ ID NO: 3681601 - RNA, 20 nt, Human
ugagcauuggauacagcagu

SEQ ID NO: 3681602 - RNA, 21 nt, Human
ugagcauuguggcugucagca

SEQ ID NO: 3681603 - RNA, 22 nt, Human
ugagcauuguggcugucagcag

SEQ ID NO: 3681604 - RNA, 23 nt, Human
ugagccaaucugcaauuucuacu

SEQ ID NO: 3681605 - RNA, 17 nt, Human
ugagccacagcagcauu

SEQ ID NO: 3681606 - RNA, 19 nt, Human
ugagccacagcagcauuuu

SEQ ID NO: 3681607 - RNA, 14 nt, Human
ugagccagacaaau

SEQ ID NO: 3681608 - RNA, 20 nt, Human
ugagccagacaaauggagga

SEQ ID NO: 3681609 - RNA, 22 nt, Human
ugagccagauuucacucuccuu

SEQ ID NO: 3681610 - RNA, 20 nt, Human
ugagccagguaaugagggac

SEQ ID NO: 3681611 - RNA, 13 nt, Human
ugagccaguccca

SEQ ID NO: 3681612 - RNA, 21 nt, Human
ugaccucuguuguccuccccu

SEQ ID NO: 3681613 - RNA, 12 nt, Human
ugaccucuugcu

SEQ ID NO: 3681614 - RNA, 13 nt, Human
ugaccucuugcug

SEQ ID NO: 3681615 - RNA, 18 nt, Human
ugaccucuugcugucucu

SEQ ID NO: 3681616 - RNA, 14 nt, Human
ugaccugaggaagc

SEQ ID NO: 3681617 - RNA, 12 nt, Human
ugaccugaggcc

SEQ ID NO: 3681618 - RNA, 12 nt, Human
ugaccugaggcu

SEQ ID NO: 3681619 - RNA, 20 nt, Human
ugaccugccccgcccagcug

SEQ ID NO: 3681620 - RNA, 18 nt, Human
ugaccugccucucacaca

SEQ ID NO: 3681621 - RNA, 12 nt, Human
ugaccugcuccg

SEQ ID NO: 3681622 - RNA, 15 nt, Human
ugaccugcuccgcug

SEQ ID NO: 3681623 - RNA, 13 nt, Human
ugaccugcugagc

SEQ ID NO: 3681624 - RNA, 21 nt, Human
ugaccugcuggguaaacugug

SEQ ID NO: 3681625 - RNA, 16 nt, Human
ugaccuggauggggca

SEQ ID NO: 3681626 - RNA, 12 nt, Human
ugaccuggcccc

SEQ ID NO: 3681627 - RNA, 12 nt, Human
ugaccugucacc

SEQ ID NO: 3681628 - RNA, 19 nt, Human
ugaccugucaugccccccu

SEQ ID NO: 3681629 - RNA, 13 nt, Human
ugaccugugacca

SEQ ID NO: 3681630 - RNA, 18 nt, Human
ugaccugugaccagcacu

SEQ ID NO: 3681631 - RNA, 21 nt, Human
ugaccuuaguguuucugugca

SEQ ID NO: 3681632 - RNA, 23 nt, Human
ugaccuuaguguuucugugcaug

SEQ ID NO: 3681633 - RNA, 19 nt, Human
ugaccuuauccuuccucuc

SEQ ID NO: 3681634 - RNA, 19 nt, Human
ugaccuucagcucacgcuu

SEQ ID NO: 3681635 - RNA, 18 nt, Human
ugaccuuccucgcagaga

SEQ ID NO: 3681636 - RNA, 21 nt, Human
ugaccuuccucgcagagaggc

SEQ ID NO: 3681637 - RNA, 14 nt, Human
ugaccuuccucugg

SEQ ID NO: 3681638 - RNA, 17 nt, Human
ugaccuuccucuggggc

SEQ ID NO: 3681639 - RNA, 24 nt, Human
ugaccuuccucuggggcucuaggg

SEQ ID NO: 3681640 - RNA, 14 nt, Human
ugaccuucucuaua

SEQ ID NO: 3681641 - RNA, 21 nt, Human
ugaccuugaggagucuugugu

SEQ ID NO: 3681642 - RNA, 17 nt, Human
ugaccuugaugagcugu

SEQ ID NO: 3681643 - RNA, 16 nt, Human
ugaccuugcaacuuca

SEQ ID NO: 3681644 - RNA, 13 nt, Human
ugaccuuguaaug

SEQ ID NO: 3681645 - RNA, 18 nt, Human
ugaccuuguaauguaacu

SEQ ID NO: 3681646 - RNA, 15 nt, Human
ugaccuuuagguauu

SEQ ID NO: 3681647 - RNA, 17 nt, Human
ugaccuuuuauguagua

SEQ ID NO: 3681648 - RNA, 18 nt, Human
ugaccuuuuauguaguaa

SEQ ID NO: 3681649 - RNA, 14 nt, Human
ugacgaagucucuu

SEQ ID NO: 3681650 - RNA, 20 nt, Human
ugacgacaaagcugcuaaau

SEQ ID NO: 3681651 - RNA, 20 nt, Human
ugacgacaagugcugaacag

SEQ ID NO: 3681652 - RNA, 21 nt, Human
ugacgaugauguacagauucu

SEQ ID NO: 3681653 - RNA, 17 nt, Human
ugacgauuccuucucug

SEQ ID NO: 3681654 - RNA, 14 nt, Human
ugacgccaucccag

SEQ ID NO: 3681655 - RNA, 16 nt, Human
ugacgccaucccagcc

SEQ ID NO: 3681656 - RNA, 18 nt, Human
ugacgccaucccagcccc

SEQ ID NO: 3681657 - RNA, 19 nt, Human
ugacgccaucccagcccca

SEQ ID NO: 3681658 - RNA, 20 nt, Human
ugacgccaucccagccccaa

SEQ ID NO: 3681659 - RNA, 14 nt, Human
ugacgcugaauaaa

SEQ ID NO: 3681660 - RNA, 15 nt, Human
ugacgcugauacaua

SEQ ID NO: 3681661 - RNA, 21 nt, Human
ugacgcugauacauaacuaaa

SEQ ID NO: 3681662 - RNA, 20 nt, Human
ugacggaagccaacuuggcu

SEQ ID NO: 3681663 - RNA, 19 nt, Human
ugacggccagggagaagcu

SEQ ID NO: 3681664 - RNA, 14 nt, Human
ugacggcccugcaa

SEQ ID NO: 3681665 - RNA, 15 nt, Human
ugacggcgcccccag

SEQ ID NO: 3681666 - RNA, 15 nt, Human
ugacggugacaaaga

SEQ ID NO: 3681667 - RNA, 20 nt, Human
ugacgguuccuacacaggac

SEQ ID NO: 3681668 - RNA, 22 nt, Human
ugacguacaaguaguucuguau

SEQ ID NO: 3681669 - RNA, 17 nt, Human
ugacgugaccggacuuu

SEQ ID NO: 3681670 - RNA, 19 nt, Human
ugacgugcaccuguacuca

SEQ ID NO: 3681671 - RNA, 23 nt, Human
ugacgugccuuuugcaccccucc

SEQ ID NO: 3681672 - RNA, 22 nt, Human
ugacuaaaaaacaaagaagaca

SEQ ID NO: 3681673 - RNA, 14 nt, Human
ugacuaaaaauauu

SEQ ID NO: 3681674 - RNA, 22 nt, Human
ugacuaaaaauauuauaacuua

SEQ ID NO: 3681675 - RNA, 12 nt, Human
ugacuaaacuuu

SEQ ID NO: 3681676 - RNA, 19 nt, Human
ugacuaaacuuuuuuucug

SEQ ID NO: 3681677 - RNA, 21 nt, Human
ugacuaaacuuuuuuucugua

SEQ ID NO: 3681678 - RNA, 21 nt, Human
ugacuaacaggccaaagaguc

SEQ ID NO: 3681679 - RNA, 11 nt, Human
ugacuaauuag

SEQ ID NO: 3681680 - RNA, 17 nt, Human
ugacuaauucuugcaua

SEQ ID NO: 3681681 - RNA, 14 nt, Human
ugacuaauuguaua

SEQ ID NO: 3681682 - RNA, 20 nt, Human
ugacuaauuguauaacaggu

SEQ ID NO: 3681683 - RNA, 22 nt, Human
ugacuaauuguauaacagguua

SEQ ID NO: 3681684 - RNA, 21 nt, Human
ugacuaauuuuacauguuuau

SEQ ID NO: 3681685 - RNA, 14 nt, Human
ugacuacagggccg

SEQ ID NO: 3681686 - RNA, 16 nt, Human
ugacuacagucaggaa

SEQ ID NO: 3681687 - RNA, 17 nt, Human
ugacuacagucaggaaa

SEQ ID NO: 3681688 - RNA, 18 nt, Human
ugacuacagucaggaaag

SEQ ID NO: 3681689 - RNA, 19 nt, Human
ugacuagacguucauuugu

SEQ ID NO: 3681690 - RNA, 17 nt, Human
ugacuagaggcagggag

SEQ ID NO: 3681691 - RNA, 20 nt, Human
ugacuagggagccauguuuc

SEQ ID NO: 3681692 - RNA, 17 nt, Human
ugacuagggauucaggc

SEQ ID NO: 3681693 - RNA, 23 nt, Human
ugacuagggauucaggcugcuug

SEQ ID NO: 3681694 - RNA, 16 nt, Human
ugacuaguacaaauua

SEQ ID NO: 3681695 - RNA, 23 nt, Human
ugacuaguacaaauuauaaaaag

SEQ ID NO: 3681696 - RNA, 17 nt, Human
ugacuagugcugaagcu

SEQ ID NO: 3681697 - RNA, 22 nt, Human
ugacuagugcugaagcuuauua

SEQ ID NO: 3681698 - RNA, 16 nt, Human
ugacuauaaccuuguu

SEQ ID NO: 3681699 - RNA, 14 nt, Human
ugacuauauagaga

SEQ ID NO: 3681700 - RNA, 16 nt, Human
ugacuauauagagaug

SEQ ID NO: 3681701 - RNA, 19 nt, Human
ugacuauauagagauguuu

SEQ ID NO: 3681702 - RNA, 21 nt, Human
ugacuauauagagauguuuuu

SEQ ID NO: 3681703 - RNA, 22 nt, Human
ugacuaucaaacugaagccaga

SEQ ID NO: 3681704 - RNA, 14 nt, Human
ugacuaugacauaa

SEQ ID NO: 3681705 - RNA, 12 nt, Human
ugacuauguaaa

SEQ ID NO: 3681706 - RNA, 16 nt, Human
ugacuauuauguuguu

SEQ ID NO: 3681707 - RNA, 20 nt, Human
ugacuauugaaguugcagau

SEQ ID NO: 3681708 - RNA, 18 nt, Human
ugacuauuuuuguuuuua

SEQ ID NO: 3681709 - RNA, 23 nt, Human
ugacuauuuuuguuuuuauuaaa

SEQ ID NO: 3681710 - RNA, 16 nt, Human
ugacucaaaucuccag

SEQ ID NO: 3681711 - RNA, 14 nt, Human
ugacucaacauguu

SEQ ID NO: 3681712 - RNA, 14 nt, Human
ugacucaagauucc

SEQ ID NO: 3681713 - RNA, 22 nt, Human
ugacucaagauucccaggaguu

SEQ ID NO: 3681714 - RNA, 12 nt, Human
ugacucacccaa

SEQ ID NO: 3681715 - RNA, 15 nt, Human
ugacucaggagccug

SEQ ID NO: 3681716 - RNA, 13 nt, Human
ugacucagggcuc

SEQ ID NO: 3681717 - RNA, 19 nt, Human
ugacucagggcuccugggu

SEQ ID NO: 3681718 - RNA, 19 nt, Human
ugacuccacgauccugcca

SEQ ID NO: 3681719 - RNA, 22 nt, Human
ugacuccacgauccugccaccc

SEQ ID NO: 3681720 - RNA, 19 nt, Human
ugacuccagaauuucccaa

SEQ ID NO: 3681721 - RNA, 23 nt, Human
ugacuccagaauuucccaaagca

SEQ ID NO: 3681722 - RNA, 12 nt, Human
ugacuccaggag

SEQ ID NO: 3681723 - RNA, 14 nt, Human
ugacuccaggagag

SEQ ID NO: 3681724 - RNA, 14 nt, Human
ugacuccugguccu

SEQ ID NO: 3681725 - RNA, 21 nt, Human
ugacucgaggguuggguucau

SEQ ID NO: 3681726 - RNA, 15 nt, Human
ugacucgggcuccug

SEQ ID NO: 3681727 - RNA, 18 nt, Human
ugacucgggcuccugugc

SEQ ID NO: 3681728 - RNA, 14 nt, Human
ugacucgguuucuc

SEQ ID NO: 3681729 - RNA, 15 nt, Human
ugacucgucugacug

SEQ ID NO: 3681730 - RNA, 16 nt, Human
ugacucgucugacugu

SEQ ID NO: 3681731 - RNA, 24 nt, Human
ugacucuaagguuaucuacuuuua

SEQ ID NO: 3681732 - RNA, 16 nt, Human
ugacucuauaagcaaa

SEQ ID NO: 3681733 - RNA, 11 nt, Human
ugacucuccag

SEQ ID NO: 3681734 - RNA, 14 nt, Human
ugacucuccagggg

SEQ ID NO: 3681735 - RNA, 15 nt, Human
ugacucucugugacc

SEQ ID NO: 3681736 - RNA, 11 nt, Human
ugacucugaaa

SEQ ID NO: 3681737 - RNA, 13 nt, Human
ugacucugccccc

SEQ ID NO: 3681738 - RNA, 15 nt, Human
ugacucugcccccug

SEQ ID NO: 3681739 - RNA, 19 nt, Human
ugacucugcccccugcugg

SEQ ID NO: 3681740 - RNA, 12 nt, Human
ugacucugcucu

SEQ ID NO: 3681741 - RNA, 16 nt, Human
ugacucuggcuuggcc

SEQ ID NO: 3681742 - RNA, 19 nt, Human
ugacucuggguccuuccug

SEQ ID NO: 3681743 - RNA, 12 nt, Human
ugacucuuaaga

SEQ ID NO: 3681744 - RNA, 15 nt, Human
ugacucuuaagaaga

SEQ ID NO: 3681745 - RNA, 14 nt, Human
ugacucuugaguug

SEQ ID NO: 3681746 - RNA, 22 nt, Human
ugacucuugaguuguuuuugua

SEQ ID NO: 3681747 - RNA, 19 nt, Human
ugacucuuggcacagcaug

SEQ ID NO: 3681748 - RNA, 20 nt, Human
ugacucuuguuuucaguuuc

SEQ ID NO: 3681749 - RNA, 17 nt, Human
ugacucuuuauugucug

SEQ ID NO: 3681750 - RNA, 20 nt, Human
ugacucuuuauugucuguaa

SEQ ID NO: 3681751 - RNA, 13 nt, Human
ugacucuuuccaa

SEQ ID NO: 3681752 - RNA, 16 nt, Human
ugacucuuuccaaccg

SEQ ID NO: 3681753 - RNA, 19 nt, Human
ugacucuuuccaaccggcu

SEQ ID NO: 3681754 - RNA, 21 nt, Human
ugacucuuucuauuguuucuu

SEQ ID NO: 3681755 - RNA, 19 nt, Human
ugacugaacgauccuucaa

SEQ ID NO: 3681756 - RNA, 21 nt, Human
ugacugaacgauccuucaaag

SEQ ID NO: 3681757 - RNA, 13 nt, Human
ugacugaauuucu

SEQ ID NO: 3681758 - RNA, 22 nt, Human
ugacugagcaagacccugucuc

SEQ ID NO: 3681759 - RNA, 19 nt, Human
ugacugagcagacugguga

SEQ ID NO: 3681760 - RNA, 11 nt, Human
ugacugagcuu

SEQ ID NO: 3681761 - RNA, 17 nt, Human
ugacugaggcaggcaug

SEQ ID NO: 3681762 - RNA, 16 nt, Human
ucugccuuugcagaaa

SEQ ID NO: 3681763 - RNA, 19 nt, Human
ucugccuuugcagaaacag

SEQ ID NO: 3681764 - RNA, 20 nt, Human
ucugccuuugcagaaacaga

SEQ ID NO: 3681765 - RNA, 13 nt, Human
ucugccuuuuuua

SEQ ID NO: 3681766 - RNA, 17 nt, Human
ucugcggaccccagcug

SEQ ID NO: 3681767 - RNA, 21 nt, Human
ucugcggagcacacuggcuca

SEQ ID NO: 3681768 - RNA, 22 nt, Human
ucugcggagcacacuggcucac

SEQ ID NO: 3681769 - RNA, 17 nt, Human
ucugcggaucucagcuu

SEQ ID NO: 3681770 - RNA, 18 nt, Human
ucugcgggggcagugcuc

SEQ ID NO: 3681771 - RNA, 20 nt, Human
ucugcgggggcagugcucac

SEQ ID NO: 3681772 - RNA, 20 nt, Human
ucugcgucgguccuggugcc

SEQ ID NO: 3681773 - RNA, 19 nt, Human
ucugcgucucugcuuuaaa

SEQ ID NO: 3681774 - RNA, 20 nt, Human
ucugcgucucugcuuuaaag

SEQ ID NO: 3681775 - RNA, 16 nt, Human
ucugcgugacaauaaa

SEQ ID NO: 3681776 - RNA, 16 nt, Human
ucugcgugcagggaca

SEQ ID NO: 3681777 - RNA, 22 nt, Human
ucugcgugguuccuuucucagc

SEQ ID NO: 3681778 - RNA, 15 nt, Human
ucugcgugucaccug

SEQ ID NO: 3681779 - RNA, 20 nt, Human
ucugcgugucaccugugcuu

SEQ ID NO: 3681780 - RNA, 15 nt, Human
ucugcuaaauuucaa

SEQ ID NO: 3681781 - RNA, 21 nt, Human
ucugcuaacuuggagccccag

SEQ ID NO: 3681782 - RNA, 14 nt, Human
ucugcuaccuugcc

SEQ ID NO: 3681783 - RNA, 21 nt, Human
ucugcuacguuccuauuguca

SEQ ID NO: 3681784 - RNA, 16 nt, Human
ucugcuacuuugcugc

SEQ ID NO: 3681785 - RNA, 14 nt, Human
ucugcuaugcuuga

SEQ ID NO: 3681786 - RNA, 13 nt, Human
ucugcucagcagc

SEQ ID NO: 3681787 - RNA, 14 nt, Human
ucugcucagcagcu

SEQ ID NO: 3681788 - RNA, 12 nt, Human
ucugcucagcca

SEQ ID NO: 3681789 - RNA, 13 nt, Human
ucugcucagccaa

SEQ ID NO: 3681790 - RNA, 15 nt, Human
ucugcucagccaagc

SEQ ID NO: 3681791 - RNA, 13 nt, Human
ucugcucagcccu

SEQ ID NO: 3681792 - RNA, 17 nt, Human
ucugcucagcccuggag

SEQ ID NO: 3681793 - RNA, 18 nt, Human
ucugcucagcuucuccug

SEQ ID NO: 3681794 - RNA, 22 nt, Human
ucugcucaggagaccuggagga

SEQ ID NO: 3681795 - RNA, 12 nt, Human
ucugcucaucau

SEQ ID NO: 3681796 - RNA, 15 nt, Human
ucugcucaucauucu

SEQ ID NO: 3681797 - RNA, 18 nt, Human
ucugcucaucauucucug

SEQ ID NO: 3681798 - RNA, 15 nt, Human
ucugcuccacccuug

SEQ ID NO: 3681799 - RNA, 17 nt, Human
ucugcuccacccuuggc

SEQ ID NO: 3681800 - RNA, 21 nt, Human
ucugcuccaccuuucagccca

SEQ ID NO: 3681801 - RNA, 20 nt, Human
ucugcucccaaggggccuga

SEQ ID NO: 3681802 - RNA, 12 nt, Human
ucugcuccucuc

SEQ ID NO: 3681803 - RNA, 20 nt, Human
ucugcuccucuccaggcacc

SEQ ID NO: 3681804 - RNA, 21 nt, Human
ucugcuccucuccccagcaag

SEQ ID NO: 3681805 - RNA, 12 nt, Human
ucugcuccuucc

SEQ ID NO: 3681806 - RNA, 15 nt, Human
ucugcuccuucccca

SEQ ID NO: 3681807 - RNA, 21 nt, Human
ucugcucgcccuccuuucugu

SEQ ID NO: 3681808 - RNA, 14 nt, Human
ucugcucggccguc

SEQ ID NO: 3681809 - RNA, 19 nt, Human
ucugcucugaggcuuccag

SEQ ID NO: 3681810 - RNA, 20 nt, Human
ucugcucugaggcuuccaga

SEQ ID NO: 3681811 - RNA, 11 nt, Human
ucugcucugau

SEQ ID NO: 3681812 - RNA, 14 nt, Human
ucugcucugaugca

SEQ ID NO: 3681813 - RNA, 21 nt, Human
ucugcucugcgugucaccugu

SEQ ID NO: 3681814 - RNA, 21 nt, Human
ucugcucugguuguuucuguu

SEQ ID NO: 3681815 - RNA, 23 nt, Human
ucugcucuuucuucuuccacaca

SEQ ID NO: 3681816 - RNA, 22 nt, Human
ucugcugacagacacaggcccg

SEQ ID NO: 3681817 - RNA, 15 nt, Human
ucugcugcagagcag

SEQ ID NO: 3681818 - RNA, 22 nt, Human
ucugcugcagagcaguaaggga

SEQ ID NO: 3681819 - RNA, 15 nt, Human
ucugcugcccuccau

SEQ ID NO: 3681820 - RNA, 17 nt, Human
ucugcugccugcccgca

SEQ ID NO: 3681821 - RNA, 22 nt, Human
ucugcugccugcccgcacagca

SEQ ID NO: 3681822 - RNA, 15 nt, Human
ucugcugcuggcugg

SEQ ID NO: 3681823 - RNA, 23 nt, Human
ucugcuggaguuucauguacaag

SEQ ID NO: 3681824 - RNA, 14 nt, Human
ucugcuggcccagc

SEQ ID NO: 3681825 - RNA, 17 nt, Human
ucugcuggccucugcga

SEQ ID NO: 3681826 - RNA, 17 nt, Human
ucugcuggccuggaucu

SEQ ID NO: 3681827 - RNA, 14 nt, Human
ucugcugggcuggg

SEQ ID NO: 3681828 - RNA, 23 nt, Human
ucugcuggggccugggacaacug

SEQ ID NO: 3681829 - RNA, 17 nt, Human
ucugcuggucuucaauu

SEQ ID NO: 3681830 - RNA, 14 nt, Human
ucugcuguccagac

SEQ ID NO: 3681831 - RNA, 18 nt, Human
ucugcuguccagacagcc

SEQ ID NO: 3681832 - RNA, 23 nt, Human
ucugcugugggcacaggucaggc

SEQ ID NO: 3681833 - RNA, 13 nt, Human
ucugcuguuaacu

SEQ ID NO: 3681834 - RNA, 14 nt, Human
ucugcuguuccagu

SEQ ID NO: 3681835 - RNA, 21 nt, Human
ucugcuuacaauucccugcug

SEQ ID NO: 3681836 - RNA, 12 nt, Human
ucugcuuagaaa

SEQ ID NO: 3681837 - RNA, 17 nt, Human
ucugcuuaggagagacc

SEQ ID NO: 3681838 - RNA, 12 nt, Human
ucugcuucaaua

SEQ ID NO: 3681839 - RNA, 14 nt, Human
ucugcuucagcuug

SEQ ID NO: 3681840 - RNA, 13 nt, Human
ucugcuucccagg

SEQ ID NO: 3681841 - RNA, 14 nt, Human
ucugcuucucugac

SEQ ID NO: 3681842 - RNA, 18 nt, Human
ucugcuugacaacaucug

SEQ ID NO: 3681843 - RNA, 18 nt, Human
ucugcuugauuuuugccu

SEQ ID NO: 3681844 - RNA, 11 nt, Human
ucugcuugcca

SEQ ID NO: 3681845 - RNA, 16 nt, Human
ucugcuuguauuccaa

SEQ ID NO: 3681846 - RNA, 19 nt, Human
ucugcuuguuauuagagau

SEQ ID NO: 3681847 - RNA, 18 nt, Human
ucugcuuuaaagggccug

SEQ ID NO: 3681848 - RNA, 12 nt, Human
ucugcuuuagac

SEQ ID NO: 3681849 - RNA, 21 nt, Human
ucugcuuugacugagcagacu

SEQ ID NO: 3681850 - RNA, 15 nt, Human
ucugcuuuguugugu

SEQ ID NO: 3681851 - RNA, 13 nt, Human
ucugcuuuuacca

SEQ ID NO: 3681852 - RNA, 18 nt, Human
ucugcuuuuaccaugccc

SEQ ID NO: 3681853 - RNA, 15 nt, Human
ucugcuuuucugccc

SEQ ID NO: 3681854 - RNA, 17 nt, Human
ucugcuuuucugcccug

SEQ ID NO: 3681855 - RNA, 20 nt, Human
ucugcuuuucugcccuggcu

SEQ ID NO: 3681856 - RNA, 21 nt, Human
ucugcuuuucugcccuggcug

SEQ ID NO: 3681857 - RNA, 15 nt, Human
ucuggaaaauaaaag

SEQ ID NO: 3681858 - RNA, 18 nt, Human
ucuggaaaaugugaccca

SEQ ID NO: 3681859 - RNA, 16 nt, Human
ucuggaaaggaggaag

SEQ ID NO: 3681860 - RNA, 13 nt, Human
ucuggaacccaga

SEQ ID NO: 3681861 - RNA, 23 nt, Human
ucuggaacccagacucagacauu

SEQ ID NO: 3681862 - RNA, 17 nt, Human
ucuggaaccucagccug

SEQ ID NO: 3681863 - RNA, 18 nt, Human
ucuggaaccucagccugg

SEQ ID NO: 3681864 - RNA, 23 nt, Human
ucuggaaccucagccuggccaga

SEQ ID NO: 3681865 - RNA, 13 nt, Human
ucuggaagaaaaa

SEQ ID NO: 3681866 - RNA, 23 nt, Human
ucuggaagauggggaccagcagc

SEQ ID NO: 3681867 - RNA, 18 nt, Human
ucuggaagccccugggcc

SEQ ID NO: 3681868 - RNA, 13 nt, Human
ucuggaaguccaa

SEQ ID NO: 3681869 - RNA, 23 nt, Human
ucuggaaugguacaugucuucca

SEQ ID NO: 3681870 - RNA, 15 nt, Human
ucuggaauguaauca

SEQ ID NO: 3681871 - RNA, 12 nt, Human
ucuggacaagcc

SEQ ID NO: 3681872 - RNA, 21 nt, Human
ucuggacaagccaacuuguaa

SEQ ID NO: 3681873 - RNA, 23 nt, Human
ucuggacaagccaacuuguaaau

SEQ ID NO: 3681874 - RNA, 19 nt, Human
ucuggacagccccacccug

SEQ ID NO: 3681875 - RNA, 20 nt, Human
ucuggacagccccacccugg

SEQ ID NO: 3681876 - RNA, 14 nt, Human
ucuggacaggcaug

SEQ ID NO: 3681877 - RNA, 14 nt, Human
ucuggacaggcucu

SEQ ID NO: 3681878 - RNA, 20 nt, Human
ucuggacaggcucugcuucu

SEQ ID NO: 3681879 - RNA, 14 nt, Human
ucuggaccccaucu

SEQ ID NO: 3681880 - RNA, 19 nt, Human
ucuggaccccaucugugaa

SEQ ID NO: 3681881 - RNA, 18 nt, Human
ucuggacccuuauaaaau

SEQ ID NO: 3681882 - RNA, 17 nt, Human
ucuggacggcaggcuca

SEQ ID NO: 3681883 - RNA, 12 nt, Human
ucuggacucugg

SEQ ID NO: 3681884 - RNA, 15 nt, Human
ucuggacucuggacu

SEQ ID NO: 3681885 - RNA, 19 nt, Human
ucuggacugccccagaaaa

SEQ ID NO: 3681886 - RNA, 15 nt, Human
ucuggagaagcagug

SEQ ID NO: 3681887 - RNA, 23 nt, Human
ucuggagaagcucccaggaacaa

SEQ ID NO: 3681888 - RNA, 19 nt, Human
ucuggagaccagggagccu

SEQ ID NO: 3681889 - RNA, 12 nt, Human
ucuggagagaaa

SEQ ID NO: 3681890 - RNA, 15 nt, Human
ucuggagagaaacaa

SEQ ID NO: 3681891 - RNA, 14 nt, Human
ucuggagagcccag

SEQ ID NO: 3681892 - RNA, 21 nt, Human
ucuggagagcuagaaccugga

SEQ ID NO: 3681893 - RNA, 14 nt, Human
ucuggagccagccg

SEQ ID NO: 3681894 - RNA, 16 nt, Human
ucuggagcccuugggu

SEQ ID NO: 3681895 - RNA, 18 nt, Human
ucuggaggaaagggagga

SEQ ID NO: 3681896 - RNA, 19 nt, Human
ucuggaggaaagggaggag

SEQ ID NO: 3681897 - RNA, 22 nt, Human
ucuggaggggagcucugucugu

SEQ ID NO: 3681898 - RNA, 14 nt, Human
ucuggaggggaggg

SEQ ID NO: 3681899 - RNA, 15 nt, Human
ucuggaggggccccu

SEQ ID NO: 3681900 - RNA, 14 nt, Human
ucuggaguggccac

SEQ ID NO: 3681901 - RNA, 13 nt, Human
ucuggagugggca

SEQ ID NO: 3681902 - RNA, 14 nt, Human
ucuggagugggcag

SEQ ID NO: 3681903 - RNA, 23 nt, Human
ucuggauaauuuugcauaaaauu

SEQ ID NO: 3681904 - RNA, 20 nt, Human
ucuggauaggagccugcugg

SEQ ID NO: 3681905 - RNA, 19 nt, Human
ucuggauuauucugggggc

SEQ ID NO: 3681906 - RNA, 13 nt, Human
ucuggauucagcc

SEQ ID NO: 3681907 - RNA, 17 nt, Human
ucuggauucagccuucu

SEQ ID NO: 3681908 - RNA, 19 nt, Human
ucuggauucauauuuaauu

SEQ ID NO: 3681909 - RNA, 14 nt, Human
ucuggauuccagag

SEQ ID NO: 3681910 - RNA, 17 nt, Human
ucuggauucccaggaug

SEQ ID NO: 3681911 - RNA, 16 nt, Human
ucuggauucuuggccc

SEQ ID NO: 3681912 - RNA, 15 nt, Human
ucuggcaacaucuuu

SEQ ID NO: 3681913 - RNA, 22 nt, Human
ucuauucgccacacaguauuuu

SEQ ID NO: 3681914 - RNA, 18 nt, Human
ucuauucugagaaaacaa

SEQ ID NO: 3681915 - RNA, 13 nt, Human
ucuauucuuuaac

SEQ ID NO: 3681916 - RNA, 22 nt, Human
ucuauugacuucaaugauagua

SEQ ID NO: 3681917 - RNA, 16 nt, Human
ucuauugauguacagu

SEQ ID NO: 3681918 - RNA, 23 nt, Human
ucuauugcaguuauagaaaaucu

SEQ ID NO: 3681919 - RNA, 12 nt, Human
ucuauugccucu

SEQ ID NO: 3681920 - RNA, 22 nt, Human
ucuauugccucugagagcauca

SEQ ID NO: 3681921 - RNA, 17 nt, Human
ucuauugccuucuuuga

SEQ ID NO: 3681922 - RNA, 15 nt, Human
ucuauuggguucauu

SEQ ID NO: 3681923 - RNA, 17 nt, Human
ucuauuggguucauuau

SEQ ID NO: 3681924 - RNA, 22 nt, Human
ucuauuggguucauuauuggaa

SEQ ID NO: 3681925 - RNA, 13 nt, Human
ucuauuguaagau

SEQ ID NO: 3681926 - RNA, 13 nt, Human
ucuauuguacaga

SEQ ID NO: 3681927 - RNA, 15 nt, Human
ucuauuguagcauuu

SEQ ID NO: 3681928 - RNA, 18 nt, Human
ucuauuguagcauuucuu

SEQ ID NO: 3681929 - RNA, 15 nt, Human
ucuauuguccaaagu

SEQ ID NO: 3681930 - RNA, 12 nt, Human
ucuauuguuacu

SEQ ID NO: 3681931 - RNA, 12 nt, Human
ucuauuuaagcc

SEQ ID NO: 3681932 - RNA, 14 nt, Human
ucuauuuaagugua

SEQ ID NO: 3681933 - RNA, 13 nt, Human
ucuauuuaauuuu

SEQ ID NO: 3681934 - RNA, 15 nt, Human
ucuauuuauguuugc

SEQ ID NO: 3681935 - RNA, 16 nt, Human
ucuauuuauuaauauu

SEQ ID NO: 3681936 - RNA, 13 nt, Human
ucuauuuauugga

SEQ ID NO: 3681937 - RNA, 15 nt, Human
ucuauuuauuuacug

SEQ ID NO: 3681938 - RNA, 14 nt, Human
ucuauuucacugga

SEQ ID NO: 3681939 - RNA, 15 nt, Human
ucuauuucaucagaa

SEQ ID NO: 3681940 - RNA, 21 nt, Human
ucuauuucaucagaacagcug

SEQ ID NO: 3681941 - RNA, 21 nt, Human
ucuauuucccccuuucuuccu

SEQ ID NO: 3681942 - RNA, 22 nt, Human
ucuauuucccccuuucuuccuc

SEQ ID NO: 3681943 - RNA, 17 nt, Human
ucuauuucuaugagaaa

SEQ ID NO: 3681944 - RNA, 16 nt, Human
ucuauuucugccuccc

SEQ ID NO: 3681945 - RNA, 21 nt, Human
ucuauuucuggaugaaugccc

SEQ ID NO: 3681946 - RNA, 14 nt, Human
ucuauuugacuugu

SEQ ID NO: 3681947 - RNA, 18 nt, Human
ucuauuuggggcuugaug

SEQ ID NO: 3681948 - RNA, 14 nt, Human
ucuauuuuaaagac

SEQ ID NO: 3681949 - RNA, 12 nt, Human
ucuauuuuaauc

SEQ ID NO: 3681950 - RNA, 12 nt, Human
ucuauuuuaauu

SEQ ID NO: 3681951 - RNA, 18 nt, Human
ucuauuuuauuaugaaga

SEQ ID NO: 3681952 - RNA, 15 nt, Human
ucuauuuucuaugua

SEQ ID NO: 3681953 - RNA, 19 nt, Human
ucuauuuucucugauacuu

SEQ ID NO: 3681954 - RNA, 20 nt, Human
ucuauuuucucugauacuuu

SEQ ID NO: 3681955 - RNA, 20 nt, Human
ucuauuuugaugcagcauuu

SEQ ID NO: 3681956 - RNA, 21 nt, Human
ucuauuuugaugcagcauuug

SEQ ID NO: 3681957 - RNA, 18 nt, Human
ucuauuuuggauuguaua

SEQ ID NO: 3681958 - RNA, 13 nt, Human
ucuauuuuuacau

SEQ ID NO: 3681959 - RNA, 17 nt, Human
ucuauuuuuacauuuaa

SEQ ID NO: 3681960 - RNA, 16 nt, Human
ucuauuuuucucuuca

SEQ ID NO: 3681961 - RNA, 18 nt, Human
ucuauuuuuggagguuua

SEQ ID NO: 3681962 - RNA, 19 nt, Human
ucuauuuuuggagguuuau

SEQ ID NO: 3681963 - RNA, 21 nt, Human
ucuauuuuuggagguuuauua

SEQ ID NO: 3681964 - RNA, 13 nt, Human
ucuauuuuugucu

SEQ ID NO: 3681965 - RNA, 13 nt, Human
ucucaaaaaauaa

SEQ ID NO: 3681966 - RNA, 16 nt, Human
ucucaaaaauacaaaa

SEQ ID NO: 3681967 - RNA, 23 nt, Human
ucucaaaaauacaaaauaaaaac

SEQ ID NO: 3681968 - RNA, 18 nt, Human
ucucaaaagaacuuaccc

SEQ ID NO: 3681969 - RNA, 19 nt, Human
ucucaaaagaacuuacccc

SEQ ID NO: 3681970 - RNA, 13 nt, Human
ucucaaaagcauu

SEQ ID NO: 3681971 - RNA, 13 nt, Human
ucucaaaccucca

SEQ ID NO: 3681972 - RNA, 18 nt, Human
ucucaaaccuccaaaagc

SEQ ID NO: 3681973 - RNA, 20 nt, Human
ucucaaacgguacacagacu

SEQ ID NO: 3681974 - RNA, 15 nt, Human
ucucaaacuaacagg

SEQ ID NO: 3681975 - RNA, 17 nt, Human
ucucaaagaaauauuaa

SEQ ID NO: 3681976 - RNA, 17 nt, Human
ucucaaagaaauuucca

SEQ ID NO: 3681977 - RNA, 19 nt, Human
ucucaaagaaauuuccacu

SEQ ID NO: 3681978 - RNA, 19 nt, Human
ucucaaagccccauuaacu

SEQ ID NO: 3681979 - RNA, 21 nt, Human
ucucaaagccccauuaacugc

SEQ ID NO: 3681980 - RNA, 17 nt, Human
ucucaaaguguggucuc

SEQ ID NO: 3681981 - RNA, 17 nt, Human
ucucaaaguuuugaaaa

SEQ ID NO: 3681982 - RNA, 20 nt, Human
ucucaaaguuuugaaaagcu

SEQ ID NO: 3681983 - RNA, 23 nt, Human
ucucaaaguuuugaaaagcuauu

SEQ ID NO: 3681984 - RNA, 17 nt, Human
ucucaaauaacuaaaag

SEQ ID NO: 3681985 - RNA, 17 nt, Human
ucucaaauucucaaccu

SEQ ID NO: 3681986 - RNA, 23 nt, Human
ucucaaauuguaauuaauaauag

SEQ ID NO: 3681987 - RNA, 16 nt, Human
ucucaaauuucuaaau

SEQ ID NO: 3681988 - RNA, 19 nt, Human
ucucaacaaagcacagugu

SEQ ID NO: 3681989 - RNA, 19 nt, Human
ucucaacaggccucagggc

SEQ ID NO: 3681990 - RNA, 22 nt, Human
ucucaaccuaccaccccuuccu

SEQ ID NO: 3681991 - RNA, 23 nt, Human
ucucaaccuaccaccccuuccug

SEQ ID NO: 3681992 - RNA, 15 nt, Human
ucucaacuccaaacu

SEQ ID NO: 3681993 - RNA, 21 nt, Human
ucucaagaugggggcagggcu

SEQ ID NO: 3681994 - RNA, 22 nt, Human
ucucaagaugggggcagggcug

SEQ ID NO: 3681995 - RNA, 21 nt, Human
ucucaagccgcaucccagacu

SEQ ID NO: 3681996 - RNA, 15 nt, Human
ucucaagcucuuccu

SEQ ID NO: 3681997 - RNA, 20 nt, Human
ucucaaggugggccuugcua

SEQ ID NO: 3681998 - RNA, 15 nt, Human
ucucaaguucuaaga

SEQ ID NO: 3681999 - RNA, 17 nt, Human
ucucaauauucaauaaa

SEQ ID NO: 3682000 - RNA, 12 nt, Human
ucucaaugaaaa

SEQ ID NO: 3682001 - RNA, 12 nt, Human
ucucaaugugaa

SEQ ID NO: 3682002 - RNA, 13 nt, Human
ucucaaugugaaa

SEQ ID NO: 3682003 - RNA, 12 nt, Human
ucucaauuucua

SEQ ID NO: 3682004 - RNA, 12 nt, Human
ucucacacacau

SEQ ID NO: 3682005 - RNA, 14 nt, Human
ucucacacccaccg

SEQ ID NO: 3682006 - RNA, 20 nt, Human
ucucacacugguucucaaug

SEQ ID NO: 3682007 - RNA, 12 nt, Human
ucucacagacag

SEQ ID NO: 3682008 - RNA, 13 nt, Human
ucucacagacagg

SEQ ID NO: 3682009 - RNA, 19 nt, Human
ucucacagacaggaccccu

SEQ ID NO: 3682010 - RNA, 23 nt, Human
ucucacagacaggaccccugcag

SEQ ID NO: 3682011 - RNA, 20 nt, Human
ucucacagcacacucagcac

SEQ ID NO: 3682012 - RNA, 18 nt, Human
ucucacagcuaugcaaaa

SEQ ID NO: 3682013 - RNA, 22 nt, Human
ucucacagcuaugcaaaaagcu

SEQ ID NO: 3682014 - RNA, 22 nt, Human
ucucacagugggagccagggcu

SEQ ID NO: 3682015 - RNA, 20 nt, Human
ucucacaugauuccagccau

SEQ ID NO: 3682016 - RNA, 22 nt, Human
ucucacauggugcuacgccugc

SEQ ID NO: 3682017 - RNA, 23 nt, Human
ucucacauuuuuauaccuguuua

SEQ ID NO: 3682018 - RNA, 17 nt, Human
ucucaccagcugcaaag

SEQ ID NO: 3682019 - RNA, 19 nt, Human
ucucaccagcugcaaagug

SEQ ID NO: 3682020 - RNA, 13 nt, Human
ucucaccaggcag

SEQ ID NO: 3682021 - RNA, 20 nt, Human
ucucaccauuuccccagggc

SEQ ID NO: 3682022 - RNA, 21 nt, Human
ucucaccauuuccccagggca

SEQ ID NO: 3682023 - RNA, 23 nt, Human
ucucacccaugcaagcagaggac

SEQ ID NO: 3682024 - RNA, 19 nt, Human
ucucaccccaucccacacc

SEQ ID NO: 3682025 - RNA, 14 nt, Human
ucucacccuggagg

SEQ ID NO: 3682026 - RNA, 18 nt, Human
ucucacccuggaggcacc

SEQ ID NO: 3682027 - RNA, 21 nt, Human
ucucaccggcucucaccuggc

SEQ ID NO: 3682028 - RNA, 15 nt, Human
ucucaccuccugcug

SEQ ID NO: 3682029 - RNA, 18 nt, Human
ucucaccuccugcugggc

SEQ ID NO: 3682030 - RNA, 14 nt, Human
ucucaccucuaggu

SEQ ID NO: 3682031 - RNA, 14 nt, Human
ucucaccuggcccu

SEQ ID NO: 3682032 - RNA, 21 nt, Human
ucucaccuggcccugcuuccu

SEQ ID NO: 3682033 - RNA, 15 nt, Human
ucucaccuuccaaau

SEQ ID NO: 3682034 - RNA, 16 nt, Human
ucuccaccugcuccca

SEQ ID NO: 3682035 - RNA, 17 nt, Human
ucuccacucaguugcaa

SEQ ID NO: 3682036 - RNA, 15 nt, Human
ucuccacugccuucg

SEQ ID NO: 3682037 - RNA, 21 nt, Human
ucuccacugugcacacccacc

SEQ ID NO: 3682038 - RNA, 18 nt, Human
ucuccagaugagaguaca

SEQ ID NO: 3682039 - RNA, 19 nt, Human
ucuccagauguuuccagac

SEQ ID NO: 3682040 - RNA, 21 nt, Human
ucuccagauuuuucggaggcc

SEQ ID NO: 3682041 - RNA, 13 nt, Human
ucuccagccagca

SEQ ID NO: 3682042 - RNA, 12 nt, Human
ucuccagccccu

SEQ ID NO: 3682043 - RNA, 22 nt, Human
ucuccagccccuggaugcagcc

SEQ ID NO: 3682044 - RNA, 23 nt, Human
ucuccagccccuucucagaaucu

SEQ ID NO: 3682045 - RNA, 23 nt, Human
ucuccagccuggacccccagcuu

SEQ ID NO: 3682046 - RNA, 20 nt, Human
ucuccagcggcccugucauc

SEQ ID NO: 3682047 - RNA, 16 nt, Human
ucuccagcucagaacc

SEQ ID NO: 3682048 - RNA, 12 nt, Human
ucuccagcugac

SEQ ID NO: 3682049 - RNA, 21 nt, Human
ucuccagcugggcucugcaau

SEQ ID NO: 3682050 - RNA, 13 nt, Human
ucuccagcuuccc

SEQ ID NO: 3682051 - RNA, 17 nt, Human
ucuccaggcacccuucu

SEQ ID NO: 3682052 - RNA, 13 nt, Human
ucuccaggcauuu

SEQ ID NO: 3682053 - RNA, 18 nt, Human
ucuccaggggcugcuucc

SEQ ID NO: 3682054 - RNA, 23 nt, Human
ucuccaggggcugcuuccuccug

SEQ ID NO: 3682055 - RNA, 20 nt, Human
ucuccagugguugcuguuga

SEQ ID NO: 3682056 - RNA, 21 nt, Human
ucuccauaaccccacccuugc

SEQ ID NO: 3682057 - RNA, 14 nt, Human
ucuccauauguuac

SEQ ID NO: 3682058 - RNA, 15 nt, Human
ucuccauauguuaca

SEQ ID NO: 3682059 - RNA, 21 nt, Human
ucuccaucacccucuuccugu

SEQ ID NO: 3682060 - RNA, 17 nt, Human
ucuccaucagaggacac

SEQ ID NO: 3682061 - RNA, 16 nt, Human
ucuccaucucucuggc

SEQ ID NO: 3682062 - RNA, 17 nt, Human
ucuccaucuggcagggu

SEQ ID NO: 3682063 - RNA, 14 nt, Human
ucuccaucuguuug

SEQ ID NO: 3682064 - RNA, 20 nt, Human
ucuccauggccaccuuuuca

SEQ ID NO: 3682065 - RNA, 15 nt, Human
ucuccauggcccugc

SEQ ID NO: 3682066 - RNA, 17 nt, Human
ucuccauggcuuccucc

SEQ ID NO: 3682067 - RNA, 17 nt, Human
ucuccauuucacuggcu

SEQ ID NO: 3682068 - RNA, 23 nt, Human
ucuccauuugcucuucagaugcc

SEQ ID NO: 3682069 - RNA, 22 nt, Human
ucuccauuuuggugucuuucuc

SEQ ID NO: 3682070 - RNA, 22 nt, Human
ucucccaacucuugcacaguca

SEQ ID NO: 3682071 - RNA, 13 nt, Human
ucucccacccucu

SEQ ID NO: 3682072 - RNA, 15 nt, Human
ucucccacccucuuc

SEQ ID NO: 3682073 - RNA, 12 nt, Human
ucucccacccug

SEQ ID NO: 3682074 - RNA, 19 nt, Human
ucucccacuagacaagucc

SEQ ID NO: 3682075 - RNA, 17 nt, Human
ucucccagcucuagaca

SEQ ID NO: 3682076 - RNA, 13 nt, Human
ucucccaggcccc

SEQ ID NO: 3682077 - RNA, 22 nt, Human
ucucccagggcuacucacucaa

SEQ ID NO: 3682078 - RNA, 11 nt, Human
ucucccaguug

SEQ ID NO: 3682079 - RNA, 13 nt, Human
ucucccaguuguc

SEQ ID NO: 3682080 - RNA, 11 nt, Human
ucucccauccc

SEQ ID NO: 3682081 - RNA, 13 nt, Human
ucucccauccccc

SEQ ID NO: 3682082 - RNA, 14 nt, Human
ucucccaucccccu

SEQ ID NO: 3682083 - RNA, 18 nt, Human
ucucccaucccccugccc

SEQ ID NO: 3682084 - RNA, 22 nt, Human
ucucccaucccccugcccucgu

SEQ ID NO: 3682085 - RNA, 18 nt, Human
ucucccaucucuuccuug

SEQ ID NO: 3682086 - RNA, 15 nt, Human
ucucccauggagccc

SEQ ID NO: 3682087 - RNA, 18 nt, Human
ucucccauugucccucug

SEQ ID NO: 3682088 - RNA, 19 nt, Human
ucucccauugucccucugc

SEQ ID NO: 3682089 - RNA, 22 nt, Human
ucuccccaacccccauucucau

SEQ ID NO: 3682090 - RNA, 23 nt, Human
ucuccccaacccccauucucauc

SEQ ID NO: 3682091 - RNA, 13 nt, Human
ucuccccacacua

SEQ ID NO: 3682092 - RNA, 12 nt, Human
ucuccccagagu

SEQ ID NO: 3682093 - RNA, 16 nt, Human
ucuccccagcccagag

SEQ ID NO: 3682094 - RNA, 20 nt, Human
ucuccccaggguucaguccu

SEQ ID NO: 3682095 - RNA, 22 nt, Human
ucuccccaugugccugcaccag

SEQ ID NO: 3682096 - RNA, 17 nt, Human
ucucccccaacagcugg

SEQ ID NO: 3682097 - RNA, 23 nt, Human
ucucccccacccuuguuccaguu

SEQ ID NO: 3682098 - RNA, 13 nt, Human
ucucccccccggg

SEQ ID NO: 3682099 - RNA, 22 nt, Human
ucuccccgcuaaggaagauauc

SEQ ID NO: 3682100 - RNA, 13 nt, Human
ucuccccucaaag

SEQ ID NO: 3682101 - RNA, 13 nt, Human
ucuccccucagag

SEQ ID NO: 3682102 - RNA, 18 nt, Human
ucuccccucagagugcaa

SEQ ID NO: 3682103 - RNA, 14 nt, Human
ucuccccuccagcc

SEQ ID NO: 3682104 - RNA, 16 nt, Human
ucuccccuccagccuu

SEQ ID NO: 3682105 - RNA, 13 nt, Human
ucuccccucugcu

SEQ ID NO: 3682106 - RNA, 16 nt, Human
ucuccccucugcuggc

SEQ ID NO: 3682107 - RNA, 16 nt, Human
ucuccccugcacugua

SEQ ID NO: 3682108 - RNA, 20 nt, Human
ucucccggagguuggguggg

SEQ ID NO: 3682109 - RNA, 20 nt, Human
ucucccgggaagccacccuc

SEQ ID NO: 3682110 - RNA, 16 nt, Human
ucucccuagcuccucc

SEQ ID NO: 3682111 - RNA, 18 nt, Human
ucucccuauaaugcugga

SEQ ID NO: 3682112 - RNA, 23 nt, Human
ucucccucagucuggcccuuccu

SEQ ID NO: 3682113 - RNA, 18 nt, Human
ucucccuccccugccauu

SEQ ID NO: 3682114 - RNA, 12 nt, Human
ucucccucucac

SEQ ID NO: 3682115 - RNA, 17 nt, Human
ucucccucucacugucu

SEQ ID NO: 3682116 - RNA, 14 nt, Human
ucucccucuccugc

SEQ ID NO: 3682117 - RNA, 16 nt, Human
ucucccucuccugccu

SEQ ID NO: 3682118 - RNA, 17 nt, Human
ucucccucuccugccua

SEQ ID NO: 3682119 - RNA, 16 nt, Human
ucucccucuggcccug

SEQ ID NO: 3682120 - RNA, 17 nt, Human
ucucccucuggcccugc

SEQ ID NO: 3682121 - RNA, 18 nt, Human
ucucccucuggcccugcc

SEQ ID NO: 3682122 - RNA, 16 nt, Human
ucucccucugguccca

SEQ ID NO: 3682123 - RNA, 21 nt, Human
ucucccucuucucaagugccu

SEQ ID NO: 3682124 - RNA, 22 nt, Human
ucucccugagaugggcuuccca

SEQ ID NO: 3682125 - RNA, 14 nt, Human
ucucccugcauggc

SEQ ID NO: 3682126 - RNA, 15 nt, Human
ucucccugccagagg

SEQ ID NO: 3682127 - RNA, 14 nt, Human
ucucccugccgccu

SEQ ID NO: 3682128 - RNA, 12 nt, Human
ucucccugccug

SEQ ID NO: 3682129 - RNA, 17 nt, Human
ucucccugccuggcccc

SEQ ID NO: 3682130 - RNA, 18 nt, Human
ucucccugcugcuccuag

SEQ ID NO: 3682131 - RNA, 20 nt, Human
ucucccugcugcuccuagga

SEQ ID NO: 3682132 - RNA, 20 nt, Human
ucucccuggaaugaguugag

SEQ ID NO: 3682133 - RNA, 13 nt, Human
ucucccuggcccu

SEQ ID NO: 3682134 - RNA, 14 nt, Human
ucucccuggcccuc

SEQ ID NO: 3682135 - RNA, 13 nt, Human
ucucccuggugcu

SEQ ID NO: 3682136 - RNA, 13 nt, Human
ucucccuucccuc

SEQ ID NO: 3682137 - RNA, 19 nt, Human
ucucccuuggauugucccc

SEQ ID NO: 3682138 - RNA, 21 nt, Human
ucucccuuggauuguccccga

SEQ ID NO: 3682139 - RNA, 17 nt, Human
ucucccuugggcucuga

SEQ ID NO: 3682140 - RNA, 18 nt, Human
ucucccuugggcucugau

SEQ ID NO: 3682141 - RNA, 17 nt, Human
ucuccgaaaugcugucu

SEQ ID NO: 3682142 - RNA, 23 nt, Human
ucuccgaaaugcugucuuucuug

SEQ ID NO: 3682143 - RNA, 17 nt, Human
ucuccgaccagacaccu

SEQ ID NO: 3682144 - RNA, 14 nt, Human
ucuccgccagccuc

SEQ ID NO: 3682145 - RNA, 18 nt, Human
ucuccgccagccuccucu

SEQ ID NO: 3682146 - RNA, 20 nt, Human
ucuccgccagccuccucugg

SEQ ID NO: 3682147 - RNA, 21 nt, Human
ucuccgccccugagcccacug

SEQ ID NO: 3682148 - RNA, 18 nt, Human
ucuccggccucuccagcc

SEQ ID NO: 3682149 - RNA, 14 nt, Human
ucuccggcucccag

SEQ ID NO: 3682150 - RNA, 21 nt, Human
ucuccguuagcuccuguggcc

SEQ ID NO: 3682151 - RNA, 14 nt, Human
ucuccuacuccuga

SEQ ID NO: 3682152 - RNA, 16 nt, Human
ucuccuacuccugacu

SEQ ID NO: 3682153 - RNA, 19 nt, Human
ucuccuagagacagaagca

SEQ ID NO: 3682154 - RNA, 14 nt, Human
ucuccuagccccug

SEQ ID NO: 3682155 - RNA, 21 nt, Human
ucuccuaggcauucuggaccu

SEQ ID NO: 3682156 - RNA, 19 nt, Human
ucuccuauaaucugucaaa

SEQ ID NO: 3682157 - RNA, 15 nt, Human
ucuccuauauauuuc

SEQ ID NO: 3682158 - RNA, 14 nt, Human
ucuccuauguguaa

SEQ ID NO: 3682159 - RNA, 20 nt, Human
ucuccuauuuuuuuaaaauc

SEQ ID NO: 3682160 - RNA, 20 nt, Human
ucuccucaaguccccaagau

SEQ ID NO: 3682161 - RNA, 13 nt, Human
ucuccucacuccc

SEQ ID NO: 3682162 - RNA, 23 nt, Human
ucuccucacucccuucuaccugc

SEQ ID NO: 3682163 - RNA, 14 nt, Human
ucuccucagacugc

SEQ ID NO: 3682164 - RNA, 20 nt, Human
ucuccucagccuccucaucu

SEQ ID NO: 3682165 - RNA, 14 nt, Human
ucuccucaggacca

SEQ ID NO: 3682166 - RNA, 16 nt, Human
ucuccucauguucugc

SEQ ID NO: 3682167 - RNA, 20 nt, Human
ucuccuccaccgccauggcu

SEQ ID NO: 3682168 - RNA, 17 nt, Human
ucuccuccauacucagg

SEQ ID NO: 3682169 - RNA, 18 nt, Human
ucuccuccauacucagga

SEQ ID NO: 3682170 - RNA, 20 nt, Human
ucuccuccaugggagaaaau

SEQ ID NO: 3682171 - RNA, 12 nt, Human
ucuccucccagg

SEQ ID NO: 3682172 - RNA, 13 nt, Human
ucuccucccuucc

SEQ ID NO: 3682173 - RNA, 21 nt, Human
ucuccuccuuuucacaguucu

SEQ ID NO: 3682174 - RNA, 13 nt, Human
ucuccucuccccu

SEQ ID NO: 3682175 - RNA, 16 nt, Human
ucuccucugcugcugg

SEQ ID NO: 3682176 - RNA, 20 nt, Human
ucuccucugcugcuggcugg

SEQ ID NO: 3682177 - RNA, 12 nt, Human
ucuccucuuaaa

SEQ ID NO: 3682178 - RNA, 13 nt, Human
ucuccucuugcca

SEQ ID NO: 3682179 - RNA, 16 nt, Human
ucuccucuugccacug

SEQ ID NO: 3682180 - RNA, 17 nt, Human
ucuccucuugccacugc

SEQ ID NO: 3682181 - RNA, 23 nt, Human
ucuccucuuguaaauaaagcccu

SEQ ID NO: 3682182 - RNA, 20 nt, Human
ucuccucuuuaaaacaaaac

SEQ ID NO: 3682183 - RNA, 16 nt, Human
ucuccucuuuuaucuu

SEQ ID NO: 3682184 - RNA, 15 nt, Human
ucuccugacuggugc

SEQ ID NO: 3682185 - RNA, 22 nt, Human
ucuccugccacauuagaacuuc

SEQ ID NO: 3682186 - RNA, 14 nt, Human
ucuccugccucagc

SEQ ID NO: 3682187 - RNA, 20 nt, Human
ucuccugccugugcugugac

SEQ ID NO: 3682188 - RNA, 16 nt, Human
ucuccugccuuccucc

SEQ ID NO: 3682189 - RNA, 13 nt, Human
ucuccugccuuug

SEQ ID NO: 3682190 - RNA, 19 nt, Human
ucuccugcugcucccucag

SEQ ID NO: 3682191 - RNA, 21 nt, Human
ucuccugcugcucccucagac

SEQ ID NO: 3682192 - RNA, 11 nt, Human
ucuccuggagg

SEQ ID NO: 3682193 - RNA, 12 nt, Human
ucuccuggagga

SEQ ID NO: 3682194 - RNA, 13 nt, Human
ucuccuggaggau

SEQ ID NO: 3682195 - RNA, 22 nt, Human
ucuccuggcuucccauccccag

SEQ ID NO: 3682196 - RNA, 13 nt, Human
ucuccugggcagc

SEQ ID NO: 3682197 - RNA, 17 nt, Human
ucuccugggcagcugcc

SEQ ID NO: 3682198 - RNA, 19 nt, Human
ucuccugggccccucccua

SEQ ID NO: 3682199 - RNA, 20 nt, Human
ucuccugggccccucccuac

SEQ ID NO: 3682200 - RNA, 22 nt, Human
ucuccugggccccucccuaccu

SEQ ID NO: 3682201 - RNA, 15 nt, Human
ucuccuguaccucuu

SEQ ID NO: 3682202 - RNA, 16 nt, Human
ucuccuguaccucuug

SEQ ID NO: 3682203 - RNA, 16 nt, Human
ucuccuguccaaccua

SEQ ID NO: 3682204 - RNA, 23 nt, Human
ucuccugugcaugggugaaggga

SEQ ID NO: 3682205 - RNA, 15 nt, Human
ucuccugugcccaca

SEQ ID NO: 3682206 - RNA, 18 nt, Human
ucuccuguuucccuuccc

SEQ ID NO: 3682207 - RNA, 20 nt, Human
ucuccuuaaagaguguggca

SEQ ID NO: 3682208 - RNA, 18 nt, Human
ucuccuuaagagacaauu

SEQ ID NO: 3682209 - RNA, 20 nt, Human
ucuccuuaagcugcagagau

SEQ ID NO: 3682210 - RNA, 17 nt, Human
ucuccuuagcuucuggc

SEQ ID NO: 3682211 - RNA, 14 nt, Human
ucuccuuagucuuc

SEQ ID NO: 3682212 - RNA, 19 nt, Human
ucuccuuagucuucucaua

SEQ ID NO: 3682213 - RNA, 19 nt, Human
ucuccuucagcccucaccc

SEQ ID NO: 3682214 - RNA, 20 nt, Human
ucuccuucagcccucacccc

SEQ ID NO: 3682215 - RNA, 11 nt, Human
ucuccuuccaa

SEQ ID NO: 3682216 - RNA, 15 nt, Human
ucuccuuccaacugc

SEQ ID NO: 3682217 - RNA, 21 nt, Human
ucuccuuccaacugcugcccc

SEQ ID NO: 3682218 - RNA, 19 nt, Human
ucuccuuccccuuucccca

SEQ ID NO: 3682219 - RNA, 14 nt, Human
ucuccuuccugugu

SEQ ID NO: 3682220 - RNA, 16 nt, Human
ucuccuuccugugugu

SEQ ID NO: 3682221 - RNA, 18 nt, Human
ucuccuucguaucccgag

SEQ ID NO: 3682222 - RNA, 19 nt, Human
ucuccuucguaucccgagu

SEQ ID NO: 3682223 - RNA, 19 nt, Human
ucuccuucuaaaaacuucu

SEQ ID NO: 3682224 - RNA, 13 nt, Human
ucuccuucuuagc

SEQ ID NO: 3682225 - RNA, 16 nt, Human
ucuccuugauaacagc

SEQ ID NO: 3682226 - RNA, 13 nt, Human
ucuccuugcccua

SEQ ID NO: 3682227 - RNA, 19 nt, Human
ucuccuugcccuagaugag

SEQ ID NO: 3682228 - RNA, 21 nt, Human
ucuccuuggugucgggcauga

SEQ ID NO: 3682229 - RNA, 21 nt, Human
ucuccuuguguuacuaaguuu

SEQ ID NO: 3682230 - RNA, 16 nt, Human
ucuccuuucacaaccu

SEQ ID NO: 3682231 - RNA, 23 nt, Human
ucuccuuucaccccagggccuga

SEQ ID NO: 3682232 - RNA, 20 nt, Human
ucuccuuucuuuuucuucuu

SEQ ID NO: 3682233 - RNA, 22 nt, Human
ucuccuuugcacugagggccac

SEQ ID NO: 3682234 - RNA, 23 nt, Human
ucuccuuugcaggcucauaggga

SEQ ID NO: 3682235 - RNA, 19 nt, Human
ucuccuuuguacuuugugc

SEQ ID NO: 3682236 - RNA, 22 nt, Human
ucuccuuuguauauuauuucua

SEQ ID NO: 3682237 - RNA, 17 nt, Human
ucuccuuuguauucugu

SEQ ID NO: 3682238 - RNA, 17 nt, Human
ucuccuuuucuuuuguu

SEQ ID NO: 3682239 - RNA, 20 nt, Human
ucuccuuuucuuuuguuacu

SEQ ID NO: 3682240 - RNA, 22 nt, Human
ucuccuuuucuuuuguuacugu

SEQ ID NO: 3682241 - RNA, 16 nt, Human
ucucgagcgcccugca

SEQ ID NO: 3682242 - RNA, 22 nt, Human
ucucgagcgcccugcagacccu

SEQ ID NO: 3682243 - RNA, 12 nt, Human
ucucgagcuugg

SEQ ID NO: 3682244 - RNA, 17 nt, Human
ucucgaugcaaugaaca

SEQ ID NO: 3682245 - RNA, 16 nt, Human
ucucgcauaggaccuu

SEQ ID NO: 3682246 - RNA, 18 nt, Human
ucucgcucccucccagga

SEQ ID NO: 3682247 - RNA, 21 nt, Human
ucucgcucuguugcccaggcu

SEQ ID NO: 3682248 - RNA, 17 nt, Human
ucucggaaggcuggcug

SEQ ID NO: 3682249 - RNA, 22 nt, Human
ucucuugguguuaaaacacuuc

SEQ ID NO: 3682250 - RNA, 17 nt, Human
ucucuuuaacucaggac

SEQ ID NO: 3682251 - RNA, 20 nt, Human
ucucuuuaacucaggacucc

SEQ ID NO: 3682252 - RNA, 23 nt, Human
ucucuuuaacucaggacuccagc

SEQ ID NO: 3682253 - RNA, 16 nt, Human
ucucuuuaaucuucag

SEQ ID NO: 3682254 - RNA, 20 nt, Human
ucucuuuaaucuucaguuuu

SEQ ID NO: 3682255 - RNA, 14 nt, Human
ucucuuuauuccua

SEQ ID NO: 3682256 - RNA, 15 nt, Human
ucucuuuauuccuag

SEQ ID NO: 3682257 - RNA, 16 nt, Human
ucucuuucccuggucc

SEQ ID NO: 3682258 - RNA, 19 nt, Human
ucucuuucccuggucccuu

SEQ ID NO: 3682259 - RNA, 14 nt, Human
ucucuuucucucuu

SEQ ID NO: 3682260 - RNA, 17 nt, Human
ucucuuucucucuuccc

SEQ ID NO: 3682261 - RNA, 20 nt, Human
ucucuuucuuccuuuacuuu

SEQ ID NO: 3682262 - RNA, 18 nt, Human
ucucuuugauuauuugca

SEQ ID NO: 3682263 - RNA, 13 nt, Human
ucucuuugccuca

SEQ ID NO: 3682264 - RNA, 21 nt, Human
ucucuuuguggggcuuggcgu

SEQ ID NO: 3682265 - RNA, 17 nt, Human
ucucuuuguucuaaaga

SEQ ID NO: 3682266 - RNA, 16 nt, Human
ucucuuuucaaaacau

SEQ ID NO: 3682267 - RNA, 14 nt, Human
ucucuuuucaagaa

SEQ ID NO: 3682268 - RNA, 12 nt, Human
ucucuuuuccac

SEQ ID NO: 3682269 - RNA, 22 nt, Human
ucucuuuuccacuccauugucg

SEQ ID NO: 3682270 - RNA, 21 nt, Human
ucucuuuuccccuuuccuguc

SEQ ID NO: 3682271 - RNA, 21 nt, Human
ucucuuuuccuguuguauuga

SEQ ID NO: 3682272 - RNA, 12 nt, Human
ucucuuuucucu

SEQ ID NO: 3682273 - RNA, 20 nt, Human
ucucuuuugaaacaauacuc

SEQ ID NO: 3682274 - RNA, 13 nt, Human
ucucuuuuucagu

SEQ ID NO: 3682275 - RNA, 21 nt, Human
ucucuuuuugacucuugcaau

SEQ ID NO: 3682276 - RNA, 16 nt, Human
ucucuuuuuuacaaag

SEQ ID NO: 3682277 - RNA, 22 nt, Human
ucugaaaaccccauuugcuuuc

SEQ ID NO: 3682278 - RNA, 17 nt, Human
ucugaaaacggcccucu

SEQ ID NO: 3682279 - RNA, 14 nt, Human
ucugaaaacuggaa

SEQ ID NO: 3682280 - RNA, 13 nt, Human
ucugaaaagaaau

SEQ ID NO: 3682281 - RNA, 15 nt, Human
ucugaaaagaaauaa

SEQ ID NO: 3682282 - RNA, 18 nt, Human
ucugaaaagugaagacag

SEQ ID NO: 3682283 - RNA, 19 nt, Human
ucugaaaagugaagacaga

SEQ ID NO: 3682284 - RNA, 13 nt, Human
ucugaaaauauaa

SEQ ID NO: 3682285 - RNA, 18 nt, Human
ucugaaaauuaacacugc

SEQ ID NO: 3682286 - RNA, 19 nt, Human
ucugaaaauuaacacugcu

SEQ ID NO: 3682287 - RNA, 9 nt, Human
ucugaaaca

SEQ ID NO: 3682288 - RNA, 13 nt, Human
ucugaaacagcug

SEQ ID NO: 3682289 - RNA, 20 nt, Human
ucugaaacauuucauaauuu

SEQ ID NO: 3682290 - RNA, 16 nt, Human
ucugaaaccaaaugua

SEQ ID NO: 3682291 - RNA, 15 nt, Human
ucugaaacuaaugaa

SEQ ID NO: 3682292 - RNA, 12 nt, Human
ucugaaagagaa

SEQ ID NO: 3682293 - RNA, 13 nt, Human
ucugaaagcacag

SEQ ID NO: 3682294 - RNA, 19 nt, Human
ucugaaaguuacccacuga

SEQ ID NO: 3682295 - RNA, 17 nt, Human
ucugaaauaggaaacaa

SEQ ID NO: 3682296 - RNA, 17 nt, Human
ucugaaauauaaagucu

SEQ ID NO: 3682297 - RNA, 14 nt, Human
ucugaaaucuccuu

SEQ ID NO: 3682298 - RNA, 16 nt, Human
ucugaaaucugaagac

SEQ ID NO: 3682299 - RNA, 14 nt, Human
ucugaaaugaaaca

SEQ ID NO: 3682300 - RNA, 14 nt, Human
ucugaaauucuaaa

SEQ ID NO: 3682301 - RNA, 17 nt, Human
ucugaaauuuccuggga

SEQ ID NO: 3682302 - RNA, 20 nt, Human
ucugaaauuuccugggagcu

SEQ ID NO: 3682303 - RNA, 18 nt, Human
ucugaacacaggcagcuu

SEQ ID NO: 3682304 - RNA, 15 nt, Human
ucugaacacgaagcu

SEQ ID NO: 3682305 - RNA, 14 nt, Human
ucugaacagcuggu

SEQ ID NO: 3682306 - RNA, 20 nt, Human
ucugaacagcugguguagcu

SEQ ID NO: 3682307 - RNA, 21 nt, Human
ucugaacagcugguguagcua

SEQ ID NO: 3682308 - RNA, 16 nt, Human
ucugaaccauuaaagu

SEQ ID NO: 3682309 - RNA, 12 nt, Human
ucugaacucaaa

SEQ ID NO: 3682310 - RNA, 15 nt, Human
ucugaacuggagcca

SEQ ID NO: 3682311 - RNA, 20 nt, Human
ucugaacuggagccaugggc

SEQ ID NO: 3682312 - RNA, 17 nt, Human
ucugaacuugccuuaaa

SEQ ID NO: 3682313 - RNA, 20 nt, Human
ucugaacuuggcgcugcccc

SEQ ID NO: 3682314 - RNA, 21 nt, Human
ucugaacuuugggaagccuuu

SEQ ID NO: 3682315 - RNA, 22 nt, Human
ucugaagaccucgagcagauga

SEQ ID NO: 3682316 - RNA, 22 nt, Human
ucugaagaguggguuucacaag

SEQ ID NO: 3682317 - RNA, 12 nt, Human
ucugaagcagau

SEQ ID NO: 3682318 - RNA, 13 nt, Human
ucugaagcauguu

SEQ ID NO: 3682319 - RNA, 21 nt, Human
ucugaagcgugauuuuaaaau

SEQ ID NO: 3682320 - RNA, 21 nt, Human
ucugaagcucaacucucuuau

SEQ ID NO: 3682321 - RNA, 21 nt, Human
ucugaagcugacgaacuucca

SEQ ID NO: 3682322 - RNA, 18 nt, Human
ucugaagcuugacuccca

SEQ ID NO: 3682323 - RNA, 21 nt, Human
ucugaagcuuuaccagcugaa

SEQ ID NO: 3682324 - RNA, 19 nt, Human
ucugaaggacacuuccugc

SEQ ID NO: 3682325 - RNA, 20 nt, Human
ucugaaggacacuuccugcc

SEQ ID NO: 3682326 - RNA, 21 nt, Human
ucugaaggacauugcggacag

SEQ ID NO: 3682327 - RNA, 17 nt, Human
ucugaaggaggccaccu

SEQ ID NO: 3682328 - RNA, 18 nt, Human
ucugaaggcuggguucug

SEQ ID NO: 3682329 - RNA, 13 nt, Human
ucugaagggaggu

SEQ ID NO: 3682330 - RNA, 16 nt, Human
ucugaagucacugcac

SEQ ID NO: 3682331 - RNA, 18 nt, Human
ucugaagucacugcacag

SEQ ID NO: 3682332 - RNA, 22 nt, Human
ucugaagugaaacugcuuguuu

SEQ ID NO: 3682333 - RNA, 18 nt, Human
ucugaaguuauauuuccu

SEQ ID NO: 3682334 - RNA, 19 nt, Human
ucugaaguuauauuuccua

SEQ ID NO: 3682335 - RNA, 16 nt, Human
ucugaaguuggacagc

SEQ ID NO: 3682336 - RNA, 14 nt, Human
ucugaauaugcugc

SEQ ID NO: 3682337 - RNA, 19 nt, Human
ucugaaucucaagaugggg

SEQ ID NO: 3682338 - RNA, 15 nt, Human
ucugaaucuucugaa

SEQ ID NO: 3682339 - RNA, 17 nt, Human
ucugaaugcugcuacuu

SEQ ID NO: 3682340 - RNA, 13 nt, Human
ucugaaugcuucu

SEQ ID NO: 3682341 - RNA, 13 nt, Human
ucugaauggucca

SEQ ID NO: 3682342 - RNA, 16 nt, Human
ucugaauguaauuugu

SEQ ID NO: 3682343 - RNA, 23 nt, Human
ucugaauguaauuuguguaauaa

SEQ ID NO: 3682344 - RNA, 16 nt, Human
ucugaauguucugaca

SEQ ID NO: 3682345 - RNA, 19 nt, Human
ucugaauuaguccuugcuu

SEQ ID NO: 3682346 - RNA, 14 nt, Human
ucugaauuccaagu

SEQ ID NO: 3682347 - RNA, 21 nt, Human
ucugaauuuacuuccuugcau

SEQ ID NO: 3682348 - RNA, 20 nt, Human
ucugaauuugcaaaguacug

SEQ ID NO: 3682349 - RNA, 19 nt, Human
ucugaauuugcccugggaa

SEQ ID NO: 3682350 - RNA, 22 nt, Human
ucugaauuuuggggauuuucaa

SEQ ID NO: 3682351 - RNA, 15 nt, Human
ucugaauuuuuaaac

SEQ ID NO: 3682352 - RNA, 23 nt, Human
ucugacaagggcugaccugccuc

SEQ ID NO: 3682353 - RNA, 14 nt, Human
ucugacacaaaaaa

SEQ ID NO: 3682354 - RNA, 16 nt, Human
ucugacacacagcucu

SEQ ID NO: 3682355 - RNA, 18 nt, Human
ucugacacacagcucugu

SEQ ID NO: 3682356 - RNA, 13 nt, Human
ucugacaccuauu

SEQ ID NO: 3682357 - RNA, 13 nt, Human
ucugacagcagca

SEQ ID NO: 3682358 - RNA, 14 nt, Human
ucugacagcagcau

SEQ ID NO: 3682359 - RNA, 15 nt, Human
ucugacauaaguauu

SEQ ID NO: 3682360 - RNA, 12 nt, Human
ucugacaucucu

SEQ ID NO: 3682361 - RNA, 16 nt, Human
ucugacaucucugcaa

SEQ ID NO: 3682362 - RNA, 22 nt, Human
ucugacauuaacaguuuuccau

SEQ ID NO: 3682363 - RNA, 13 nt, Human
ucugaccacgugc

SEQ ID NO: 3682364 - RNA, 17 nt, Human
ucugaccagcagcgccu

SEQ ID NO: 3682365 - RNA, 11 nt, Human
ucugacccagu

SEQ ID NO: 3682366 - RNA, 15 nt, Human
ucugacccagugaga

SEQ ID NO: 3682367 - RNA, 13 nt, Human
ucugacccagugc

SEQ ID NO: 3682368 - RNA, 14 nt, Human
ucugacccaugcug

SEQ ID NO: 3682369 - RNA, 15 nt, Human
ucugacccaugcugc

SEQ ID NO: 3682370 - RNA, 16 nt, Human
ucugacccaugcugcc

SEQ ID NO: 3682371 - RNA, 20 nt, Human
ucugacccaugcugcccugu

SEQ ID NO: 3682372 - RNA, 13 nt, Human
ucugaccccuccu

SEQ ID NO: 3682373 - RNA, 18 nt, Human
ucugaccccuccucacug

SEQ ID NO: 3682374 - RNA, 21 nt, Human
ucugacccuagcucuuuccuu

SEQ ID NO: 3682375 - RNA, 14 nt, Human
ucugacccucucca

SEQ ID NO: 3682376 - RNA, 12 nt, Human
ucugaccucagc

SEQ ID NO: 3682377 - RNA, 14 nt, Human
ucugaccucagcau

SEQ ID NO: 3682378 - RNA, 18 nt, Human
ucugaccugcacugggga

SEQ ID NO: 3682379 - RNA, 15 nt, Human
ucugaccugcaggcc

SEQ ID NO: 3682380 - RNA, 16 nt, Human
ucugaccugcaggcca

SEQ ID NO: 3682381 - RNA, 17 nt, Human
ucugaccugcaggccaa

SEQ ID NO: 3682382 - RNA, 15 nt, Human
ucugaccuucagcuc

SEQ ID NO: 3682383 - RNA, 22 nt, Human
ucugacgcaaaaccacuuuccu

SEQ ID NO: 3682384 - RNA, 17 nt, Human
ucugacggcccugcaau

SEQ ID NO: 3682385 - RNA, 15 nt, Human
ucugacgggauuugu

SEQ ID NO: 3682386 - RNA, 20 nt, Human
ucugacgugccuuuugcacc

SEQ ID NO: 3682387 - RNA, 23 nt, Human
ucugacgugccuuuugcaccccu

SEQ ID NO: 3682388 - RNA, 22 nt, Human
ucugacuacugggcaaagagug

SEQ ID NO: 3682389 - RNA, 16 nt, Human
ucugacucacaagaag

SEQ ID NO: 3682390 - RNA, 19 nt, Human
ucugacucccaaagagcug

SEQ ID NO: 3682391 - RNA, 16 nt, Human
ucugacucgguuucuc

SEQ ID NO: 3682392 - RNA, 14 nt, Human
ucugacucugagcu

SEQ ID NO: 3682393 - RNA, 16 nt, Human
ucugacucuuccccag

SEQ ID NO: 3682394 - RNA, 21 nt, Human
ucugacuguuuccaucaaggg

SEQ ID NO: 3682395 - RNA, 19 nt, Human
ucugacuuaagcaaaagaa

SEQ ID NO: 3682396 - RNA, 23 nt, Human
ucugacuuccccgcauuccaggc

SEQ ID NO: 3682397 - RNA, 12 nt, Human
ucugacuucugc

SEQ ID NO: 3682398 - RNA, 14 nt, Human
ucugacuucugccu

SEQ ID NO: 3682399 - RNA, 14 nt, Human
ucugacuuggggac

SEQ ID NO: 3682400 - RNA, 17 nt, Human
aagaugggggcaagaag

SEQ ID NO: 3682401 - RNA, 21 nt, Human
aagaugggggcagggcugugc

SEQ ID NO: 3682402 - RNA, 23 nt, Human
aagaugggggcagggcugugcuu

SEQ ID NO: 3682403 - RNA, 20 nt, Human
aagauggggucuguaaaauc

SEQ ID NO: 3682404 - RNA, 16 nt, Human
aagaugguauauuugg

SEQ ID NO: 3682405 - RNA, 17 nt, Human
aagaugguuaaacauuu

SEQ ID NO: 3682406 - RNA, 19 nt, Human
aagauguagauuuauuuca

SEQ ID NO: 3682407 - RNA, 14 nt, Human
aagauguagcaaac

SEQ ID NO: 3682408 - RNA, 18 nt, Human
aagauguagcaaacccug

SEQ ID NO: 3682409 - RNA, 23 nt, Human
aagaugucucagguuuguuuugu

SEQ ID NO: 3682410 - RNA, 11 nt, Human
aagaugucugu

SEQ ID NO: 3682411 - RNA, 20 nt, Human
aagaugucuguuugcugaug

SEQ ID NO: 3682412 - RNA, 15 nt, Human
aagaugugaauuauu

SEQ ID NO: 3682413 - RNA, 18 nt, Human
aagaugugaauuauugac

SEQ ID NO: 3682414 - RNA, 23 nt, Human
aagaugugaauuauugacacuga

SEQ ID NO: 3682415 - RNA, 14 nt, Human
aagaugugacaugu

SEQ ID NO: 3682416 - RNA, 18 nt, Human
aagaugugauauucuaag

SEQ ID NO: 3682417 - RNA, 15 nt, Human
aagaugugucuucaa

SEQ ID NO: 3682418 - RNA, 18 nt, Human
aagauguguucuuauuuu

SEQ ID NO: 3682419 - RNA, 16 nt, Human
aagauguuauauuuuu

SEQ ID NO: 3682420 - RNA, 16 nt, Human
aagauguuaugguguu

SEQ ID NO: 3682421 - RNA, 21 nt, Human
aagauguugauuuuuacugug

SEQ ID NO: 3682422 - RNA, 20 nt, Human
aagauuacucaguaauuugu

SEQ ID NO: 3682423 - RNA, 18 nt, Human
aagauuacuuagaggaaa

SEQ ID NO: 3682424 - RNA, 17 nt, Human
aagauuacuuuuucuuu

SEQ ID NO: 3682425 - RNA, 13 nt, Human
aagauuagaauga

SEQ ID NO: 3682426 - RNA, 22 nt, Human
aagauuagcaaggucauuucuu

SEQ ID NO: 3682427 - RNA, 14 nt, Human
aagauuauagauuc

SEQ ID NO: 3682428 - RNA, 20 nt, Human
aagauucaaugccccugaau

SEQ ID NO: 3682429 - RNA, 20 nt, Human
aagauucauauuuacuucuu

SEQ ID NO: 3682430 - RNA, 17 nt, Human
aagauucauccauuuau

SEQ ID NO: 3682431 - RNA, 21 nt, Human
aagauucauuuuuaaucauga

SEQ ID NO: 3682432 - RNA, 20 nt, Human
aagauuccaaaaagcacaua

SEQ ID NO: 3682433 - RNA, 19 nt, Human
aagauucccagagacagga

SEQ ID NO: 3682434 - RNA, 13 nt, Human
aagauucccagga

SEQ ID NO: 3682435 - RNA, 14 nt, Human
aagauucccaggag

SEQ ID NO: 3682436 - RNA, 18 nt, Human
aagauuccuuuucuuguu

SEQ ID NO: 3682437 - RNA, 12 nt, Human
aagauucuaaag

SEQ ID NO: 3682438 - RNA, 13 nt, Human
aagauucuaaagg

SEQ ID NO: 3682439 - RNA, 16 nt, Human
aagauucuaaugauga

SEQ ID NO: 3682440 - RNA, 13 nt, Human
aagauucuagauc

SEQ ID NO: 3682441 - RNA, 17 nt, Human
aagauucuauaguucua

SEQ ID NO: 3682442 - RNA, 22 nt, Human
aagauucuauguuaauauuuua

SEQ ID NO: 3682443 - RNA, 20 nt, Human
aagauucuucuguguuuaua

SEQ ID NO: 3682444 - RNA, 13 nt, Human
aagauucuuuccc

SEQ ID NO: 3682445 - RNA, 16 nt, Human
aagauucuuucccaau

SEQ ID NO: 3682446 - RNA, 14 nt, Human
aagauucuuuuaaa

SEQ ID NO: 3682447 - RNA, 21 nt, Human
aagauugauaucuauaaaaua

SEQ ID NO: 3682448 - RNA, 15 nt, Human
aagauugcugaaauu

SEQ ID NO: 3682449 - RNA, 16 nt, Human
aagauugcuuaaaaua

SEQ ID NO: 3682450 - RNA, 23 nt, Human
aagauuggucucccauaugcaga

SEQ ID NO: 3682451 - RNA, 21 nt, Human
aagauuggugggauuuuuugu

SEQ ID NO: 3682452 - RNA, 17 nt, Human
aagauugguguuuuuuu

SEQ ID NO: 3682453 - RNA, 19 nt, Human
aagauugguguuuuuuucu

SEQ ID NO: 3682454 - RNA, 16 nt, Human
aagauuguauugcugu

SEQ ID NO: 3682455 - RNA, 21 nt, Human
aagauugugucccauuccccc

SEQ ID NO: 3682456 - RNA, 19 nt, Human
aagauuguuauuaaaugua

SEQ ID NO: 3682457 - RNA, 22 nt, Human
aagauuguuuaucuagauguaa

SEQ ID NO: 3682458 - RNA, 23 nt, Human
aagauuuaauuugccaaaauaau

SEQ ID NO: 3682459 - RNA, 17 nt, Human
aagauuuccuugugcaa

SEQ ID NO: 3682460 - RNA, 13 nt, Human
aagauuucuugag

SEQ ID NO: 3682461 - RNA, 20 nt, Human
aagauuuggaagcucuucuu

SEQ ID NO: 3682462 - RNA, 17 nt, Human
aagauuuggaauaaagu

SEQ ID NO: 3682463 - RNA, 21 nt, Human
aagauuuguuuugucaagugu

SEQ ID NO: 3682464 - RNA, 14 nt, Human
aagauuuguuuuua

SEQ ID NO: 3682465 - RNA, 23 nt, Human
aagauuuucugggccuaaaggau

SEQ ID NO: 3682466 - RNA, 11 nt, Human
aagauuuugaa

SEQ ID NO: 3682467 - RNA, 15 nt, Human
aagauuuugaaaacu

SEQ ID NO: 3682468 - RNA, 20 nt, Human
aagauuuugaaaacuacauu

SEQ ID NO: 3682469 - RNA, 21 nt, Human
aagauuuugaaugcuuccuga

SEQ ID NO: 3682470 - RNA, 23 nt, Human
aagauuuugaucucacauuuuua

SEQ ID NO: 3682471 - RNA, 23 nt, Human
aagauuuuggaggguccuccaca

SEQ ID NO: 3682472 - RNA, 13 nt, Human
aagauuuuucuca

SEQ ID NO: 3682473 - RNA, 14 nt, Human
aagauuuuucucaa

SEQ ID NO: 3682474 - RNA, 19 nt, Human
aagauuuuucucaaaguuu

SEQ ID NO: 3682475 - RNA, 21 nt, Human
aagauuuuucucaaaguuuug

SEQ ID NO: 3682476 - RNA, 13 nt, Human
aagauuuuuuaau

SEQ ID NO: 3682477 - RNA, 18 nt, Human
aagcaaaaacgaaagcug

SEQ ID NO: 3682478 - RNA, 16 nt, Human
aagcaaaauaaaaacu

SEQ ID NO: 3682479 - RNA, 13 nt, Human
aagcaaaauauua

SEQ ID NO: 3682480 - RNA, 13 nt, Human
aagcaaaauguga

SEQ ID NO: 3682481 - RNA, 14 nt, Human
aagcaaacacauua

SEQ ID NO: 3682482 - RNA, 19 nt, Human
aagcaaacccagacggcuc

SEQ ID NO: 3682483 - RNA, 12 nt, Human
aagcaaagcaca

SEQ ID NO: 3682484 - RNA, 13 nt, Human
aagcaaaggagau

SEQ ID NO: 3682485 - RNA, 18 nt, Human
aagcaaaggggacagcug

SEQ ID NO: 3682486 - RNA, 11 nt, Human
aagcaaaggug

SEQ ID NO: 3682487 - RNA, 13 nt, Human
aagcaaauaaaua

SEQ ID NO: 3682488 - RNA, 12 nt, Human
aagcaaauacuu

SEQ ID NO: 3682489 - RNA, 13 nt, Human
aagcaaauacuua

SEQ ID NO: 3682490 - RNA, 16 nt, Human
aagcaaaucauuuguu

SEQ ID NO: 3682491 - RNA, 19 nt, Human
aagcaaaugucaugcugcc

SEQ ID NO: 3682492 - RNA, 20 nt, Human
aagcaaaugucaugcugccu

SEQ ID NO: 3682493 - RNA, 22 nt, Human
aagcaaaugucaugcugccuua

SEQ ID NO: 3682494 - RNA, 12 nt, Human
aagcaaaugucu

SEQ ID NO: 3682495 - RNA, 13 nt, Human
aagcaaaugugaa

SEQ ID NO: 3682496 - RNA, 14 nt, Human
aagcaaaugugaau

SEQ ID NO: 3682497 - RNA, 17 nt, Human
aagcaaauguuaaaagu

SEQ ID NO: 3682498 - RNA, 19 nt, Human
aagcaaauguuaaaaguuu

SEQ ID NO: 3682499 - RNA, 14 nt, Human
aagcaaauugauga

SEQ ID NO: 3682500 - RNA, 17 nt, Human
aagcaaauugcuuuuuu

SEQ ID NO: 3682501 - RNA, 22 nt, Human
aagcaaauuucaaaagacaugu

SEQ ID NO: 3682502 - RNA, 12 nt, Human
aagcaacaauuu

SEQ ID NO: 3682503 - RNA, 16 nt, Human
aagcaacacuuuuuau

SEQ ID NO: 3682504 - RNA, 14 nt, Human
aagcaacauggcuu

SEQ ID NO: 3682505 - RNA, 19 nt, Human
aagcaaccauauagaaagc

SEQ ID NO: 3682506 - RNA, 17 nt, Human
aagcaacccaaauguuc

SEQ ID NO: 3682507 - RNA, 18 nt, Human
aagcaaccucaguaauuu

SEQ ID NO: 3682508 - RNA, 18 nt, Human
aagcaaccuggguccaaa

SEQ ID NO: 3682509 - RNA, 23 nt, Human
aagcaaccuggguccaaauaaaa

SEQ ID NO: 3682510 - RNA, 21 nt, Human
aagcaacugucuauuucugcu

SEQ ID NO: 3682511 - RNA, 15 nt, Human
aagcaagaaagaaac

SEQ ID NO: 3682512 - RNA, 22 nt, Human
aagcaagaggcaagcugaaauu

SEQ ID NO: 3682513 - RNA, 15 nt, Human
aagcaagcaagaggc

SEQ ID NO: 3682514 - RNA, 19 nt, Human
aagcaagcugauuaaauga

SEQ ID NO: 3682515 - RNA, 20 nt, Human
aagcaaggaagauauacaug

SEQ ID NO: 3682516 - RNA, 15 nt, Human
aagcaagggggugau

SEQ ID NO: 3682517 - RNA, 16 nt, Human
aagcaaguauuagaau

SEQ ID NO: 3682518 - RNA, 14 nt, Human
aagcaauaaaugaa

SEQ ID NO: 3682519 - RNA, 16 nt, Human
aagcaauaaaugaaug

SEQ ID NO: 3682520 - RNA, 22 nt, Human
aagcaauaauggucccauccag

SEQ ID NO: 3682521 - RNA, 13 nt, Human
aagcaauaugcau

SEQ ID NO: 3682522 - RNA, 14 nt, Human
aagcaauauuguau

SEQ ID NO: 3682523 - RNA, 15 nt, Human
aagcaauccuaggua

SEQ ID NO: 3682524 - RNA, 20 nt, Human
aagcaauccucucaccucag

SEQ ID NO: 3682525 - RNA, 11 nt, Human
aagcaaugcau

SEQ ID NO: 3682526 - RNA, 22 nt, Human
aagcaaugcugaugaaucacug

SEQ ID NO: 3682527 - RNA, 17 nt, Human
aagcaauggauauuugu

SEQ ID NO: 3682528 - RNA, 15 nt, Human
aagcaauuccaaccu

SEQ ID NO: 3682529 - RNA, 15 nt, Human
aagcaauuucuugcu

SEQ ID NO: 3682530 - RNA, 20 nt, Human
aagcaauuuuccuugaagcc

SEQ ID NO: 3682531 - RNA, 22 nt, Human
aagcaauuuuccuugaagccga

SEQ ID NO: 3682532 - RNA, 15 nt, Human
aagcacaaacuuuag

SEQ ID NO: 3682533 - RNA, 18 nt, Human
aagcacacacaaaauaaa

SEQ ID NO: 3682534 - RNA, 22 nt, Human
aagcacaccaaucuuacuuugu

SEQ ID NO: 3682535 - RNA, 23 nt, Human
aagcacaccaaucuuacuuugua

SEQ ID NO: 3682536 - RNA, 16 nt, Human
aagcacacuugacauc

SEQ ID NO: 3682537 - RNA, 11 nt, Human
aagcacagcag

SEQ ID NO: 3682538 - RNA, 13 nt, Human
aagcacaguggug

SEQ ID NO: 3682539 - RNA, 18 nt, Human
aagcacagugguggcagg

SEQ ID NO: 3682540 - RNA, 19 nt, Human
aagcacagugguggcaggg

SEQ ID NO: 3682541 - RNA, 18 nt, Human
aagcacaguguuaaauga

SEQ ID NO: 3682542 - RNA, 20 nt, Human
aagcacaguguuaaaugaaa

SEQ ID NO: 3682543 - RNA, 21 nt, Human
aagcacaugccucucucaggc

SEQ ID NO: 3682544 - RNA, 17 nt, Human
aagcaccaaaauaagaa

SEQ ID NO: 3682545 - RNA, 19 nt, Human
aagcaccaaaauaagaaaa

SEQ ID NO: 3682546 - RNA, 21 nt, Human
aagcaccaaaauaagaaaaga

SEQ ID NO: 3682547 - RNA, 14 nt, Human
aagcaccaagcuca

SEQ ID NO: 3682548 - RNA, 19 nt, Human
aagcaccagcuucuccagg

SEQ ID NO: 3682549 - RNA, 16 nt, Human
aagcaccauccccucc

SEQ ID NO: 3682550 - RNA, 18 nt, Human
ucugacuuuacacucggc

SEQ ID NO: 3682551 - RNA, 12 nt, Human
ucugagaaaaca

SEQ ID NO: 3682552 - RNA, 23 nt, Human
ucugagaaagacuauucaaacag

SEQ ID NO: 3682553 - RNA, 16 nt, Human
ucugagaagcucugaa

SEQ ID NO: 3682554 - RNA, 18 nt, Human
ucugagaagguccuuaau

SEQ ID NO: 3682555 - RNA, 15 nt, Human
ucugagaaucuuuau

SEQ ID NO: 3682556 - RNA, 19 nt, Human
ucugagaaucuuuauugag

SEQ ID NO: 3682557 - RNA, 14 nt, Human
ucugagacucacag

SEQ ID NO: 3682558 - RNA, 14 nt, Human
ucugagagaggcca

SEQ ID NO: 3682559 - RNA, 22 nt, Human
ucugagagaggcuaaaauguuu

SEQ ID NO: 3682560 - RNA, 23 nt, Human
ucugagagaggcuaaaauguuuu

SEQ ID NO: 3682561 - RNA, 15 nt, Human
ucugagagcaaacug

SEQ ID NO: 3682562 - RNA, 13 nt, Human
ucugagaggcccu

SEQ ID NO: 3682563 - RNA, 14 nt, Human
ucugagaggcccug

SEQ ID NO: 3682564 - RNA, 15 nt, Human
ucugagagucuagau

SEQ ID NO: 3682565 - RNA, 21 nt, Human
ucugagagucuagauucucug

SEQ ID NO: 3682566 - RNA, 22 nt, Human
ucugagagucuagauucucugg

SEQ ID NO: 3682567 - RNA, 19 nt, Human
ucugagauggcucccaggg

SEQ ID NO: 3682568 - RNA, 16 nt, Human
ucugagcaagagcugg

SEQ ID NO: 3682569 - RNA, 22 nt, Human
ucugagcaagaggauuuugcgu

SEQ ID NO: 3682570 - RNA, 18 nt, Human
ucugagcagcgagccugc

SEQ ID NO: 3682571 - RNA, 21 nt, Human
ucugagcagcgagccugcuag

SEQ ID NO: 3682572 - RNA, 20 nt, Human
ucugagccacagcagcauuu

SEQ ID NO: 3682573 - RNA, 21 nt, Human
ucugagccacagcagcauuuu

SEQ ID NO: 3682574 - RNA, 12 nt, Human
ucugagccaguu

SEQ ID NO: 3682575 - RNA, 18 nt, Human
ucugagcccgggcugccu

SEQ ID NO: 3682576 - RNA, 19 nt, Human
ucugagcccgggcugccug

SEQ ID NO: 3682577 - RNA, 20 nt, Human
ucugagcccgggcugccugg

SEQ ID NO: 3682578 - RNA, 23 nt, Human
ucugagcccgguaagagcaaaag

SEQ ID NO: 3682579 - RNA, 15 nt, Human
ucugagccugauauu

SEQ ID NO: 3682580 - RNA, 21 nt, Human
ucugagcgccuccauccaagg

SEQ ID NO: 3682581 - RNA, 17 nt, Human
ucugagcgggaggcaga

SEQ ID NO: 3682582 - RNA, 22 nt, Human
ucugagcgggaggcagaguuug

SEQ ID NO: 3682583 - RNA, 17 nt, Human
ucugagcugagccaggc

SEQ ID NO: 3682584 - RNA, 16 nt, Human
ucugagcuggccucuc

SEQ ID NO: 3682585 - RNA, 10 nt, Human
ucugagcugu

SEQ ID NO: 3682586 - RNA, 21 nt, Human
ucugaggaaucaacagggcag

SEQ ID NO: 3682587 - RNA, 18 nt, Human
ucugaggaauucuguaua

SEQ ID NO: 3682588 - RNA, 19 nt, Human
ucugaggaauucuguauag

SEQ ID NO: 3682589 - RNA, 20 nt, Human
ucugaggacacuaaccacgc

SEQ ID NO: 3682590 - RNA, 12 nt, Human
ucugaggacauu

SEQ ID NO: 3682591 - RNA, 13 nt, Human
ucugaggccagcc

SEQ ID NO: 3682592 - RNA, 15 nt, Human
ucugaggccagccug

SEQ ID NO: 3682593 - RNA, 12 nt, Human
ucugaggcugua

SEQ ID NO: 3682594 - RNA, 19 nt, Human
ucugaggcuuccagagagu

SEQ ID NO: 3682595 - RNA, 16 nt, Human
ucugagggaaauguuu

SEQ ID NO: 3682596 - RNA, 22 nt, Human
ucugagggaaauguuuuguaaa

SEQ ID NO: 3682597 - RNA, 18 nt, Human
ucugagggaggaggccac

SEQ ID NO: 3682598 - RNA, 20 nt, Human
ucugagggaggaggccaccu

SEQ ID NO: 3682599 - RNA, 22 nt, Human
ucugagggaggaggccaccucu

SEQ ID NO: 3682600 - RNA, 16 nt, Human
ucugagguccugagca

SEQ ID NO: 3682601 - RNA, 17 nt, Human
ucugagguccugagcac

SEQ ID NO: 3682602 - RNA, 21 nt, Human
ucugaggugccugucccaccc

SEQ ID NO: 3682603 - RNA, 20 nt, Human
ucugagucagagccaugucu

SEQ ID NO: 3682604 - RNA, 14 nt, Human
ucugagucccagga

SEQ ID NO: 3682605 - RNA, 23 nt, Human
ucugagucccaggagcugcccag

SEQ ID NO: 3682606 - RNA, 13 nt, Human
ucugaguccugga

SEQ ID NO: 3682607 - RNA, 16 nt, Human
ucugagugccuucugu

SEQ ID NO: 3682608 - RNA, 19 nt, Human
ucugagugccuucuguggg

SEQ ID NO: 3682609 - RNA, 23 nt, Human
ucugaguguuuuaugagaaagcc

SEQ ID NO: 3682610 - RNA, 23 nt, Human
ucugaguuccggcaccaguagca

SEQ ID NO: 3682611 - RNA, 17 nt, Human
ucugaguuccugcaugc

SEQ ID NO: 3682612 - RNA, 21 nt, Human
ucugaguugccaagacaaauc

SEQ ID NO: 3682613 - RNA, 14 nt, Human
ucugaguuuaccau

SEQ ID NO: 3682614 - RNA, 20 nt, Human
ucugaguuuaccauuuguaa

SEQ ID NO: 3682615 - RNA, 22 nt, Human
ucugaguuuaccauuuguaaua

SEQ ID NO: 3682616 - RNA, 24 nt, Human
ucugaguuucauucuccugccugu

SEQ ID NO: 3682617 - RNA, 14 nt, Human
ucugaguuuuacca

SEQ ID NO: 3682618 - RNA, 19 nt, Human
ucugauaagagaaucaaca

SEQ ID NO: 3682619 - RNA, 14 nt, Human
ucugauacccagag

SEQ ID NO: 3682620 - RNA, 17 nt, Human
ucugauacuuuuuugaa

SEQ ID NO: 3682621 - RNA, 12 nt, Human
ucugauagaauu

SEQ ID NO: 3682622 - RNA, 22 nt, Human
ucugauauuaauuuaucagauu

SEQ ID NO: 3682623 - RNA, 15 nt, Human
ucugaucaaggccuu

SEQ ID NO: 3682624 - RNA, 18 nt, Human
ucugaucacugaaauaaa

SEQ ID NO: 3682625 - RNA, 21 nt, Human
ucugaucauccacugugccau

SEQ ID NO: 3682626 - RNA, 14 nt, Human
ucugauccaguuuu

SEQ ID NO: 3682627 - RNA, 21 nt, Human
ucugauccaguuuuguuugga

SEQ ID NO: 3682628 - RNA, 22 nt, Human
ucugaucgugacgcugaauaaa

SEQ ID NO: 3682629 - RNA, 14 nt, Human
ucugaucugugcuu

SEQ ID NO: 3682630 - RNA, 15 nt, Human
ucugaucugugcuuu

SEQ ID NO: 3682631 - RNA, 18 nt, Human
ucugaucugugcuuucca

SEQ ID NO: 3682632 - RNA, 21 nt, Human
ucugaucugugcuuuccagcu

SEQ ID NO: 3682633 - RNA, 22 nt, Human
ucugaucugugcuuuccagcuc

SEQ ID NO: 3682634 - RNA, 13 nt, Human
ucugaugaaaugu

SEQ ID NO: 3682635 - RNA, 20 nt, Human
ucugaugaaauguuaacaau

SEQ ID NO: 3682636 - RNA, 16 nt, Human
ucugaugcagcuuaua

SEQ ID NO: 3682637 - RNA, 18 nt, Human
ucugauggaccuucuaga

SEQ ID NO: 3682638 - RNA, 13 nt, Human
ucugauggccuua

SEQ ID NO: 3682639 - RNA, 15 nt, Human
ucugauggccuuaau

SEQ ID NO: 3682640 - RNA, 15 nt, Human
ucugauggcuucucc

SEQ ID NO: 3682641 - RNA, 14 nt, Human
ucugauguaaauga

SEQ ID NO: 3682642 - RNA, 16 nt, Human
ucugauguaaaugaag

SEQ ID NO: 3682643 - RNA, 18 nt, Human
ucugauguaaaugaagua

SEQ ID NO: 3682644 - RNA, 19 nt, Human
ucugauguaaaugaaguaa

SEQ ID NO: 3682645 - RNA, 16 nt, Human
ucugauguacucuaaa

SEQ ID NO: 3682646 - RNA, 17 nt, Human
ucugauguacucuaaau

SEQ ID NO: 3682647 - RNA, 14 nt, Human
ucugaugucucuaa

SEQ ID NO: 3682648 - RNA, 17 nt, Human
ucugauuagcuuugugu

SEQ ID NO: 3682649 - RNA, 11 nt, Human
ucugauuccac

SEQ ID NO: 3682650 - RNA, 15 nt, Human
ucugauucuggcuuu

SEQ ID NO: 3682651 - RNA, 19 nt, Human
ucugauucuggcuuuaagc

SEQ ID NO: 3682652 - RNA, 23 nt, Human
ucugauucuggcuuuaagccuuc

SEQ ID NO: 3682653 - RNA, 17 nt, Human
ucugauuggcucaccca

SEQ ID NO: 3682654 - RNA, 18 nt, Human
ucugauuggcucacccaa

SEQ ID NO: 3682655 - RNA, 13 nt, Human
ucugauuggcuug

SEQ ID NO: 3682656 - RNA, 22 nt, Human
ucugauuggcuuguagaauugu

SEQ ID NO: 3682657 - RNA, 20 nt, Human
ucugauuuauuuuguaugaa

SEQ ID NO: 3682658 - RNA, 22 nt, Human
ucugauuuauuuuguaugaaau

SEQ ID NO: 3682659 - RNA, 13 nt, Human
ucugauuucagga

SEQ ID NO: 3682660 - RNA, 20 nt, Human
ucugauuugucccuaugcau

SEQ ID NO: 3682661 - RNA, 21 nt, Human
ucugauuuugugcaaaagcuu

SEQ ID NO: 3682662 - RNA, 14 nt, Human
ucugauuuuuauga

SEQ ID NO: 3682663 - RNA, 20 nt, Human
ucugcaaaaauauuuauaaa

SEQ ID NO: 3682664 - RNA, 14 nt, Human
ucugcaaacugccu

SEQ ID NO: 3682665 - RNA, 15 nt, Human
ucugcaaacugccuu

SEQ ID NO: 3682666 - RNA, 14 nt, Human
ucugcaaauagaaa

SEQ ID NO: 3682667 - RNA, 17 nt, Human
ucugcaacaagcaugca

SEQ ID NO: 3682668 - RNA, 15 nt, Human
ucugcaacucugaag

SEQ ID NO: 3682669 - RNA, 20 nt, Human
ucugcaagaauugaagcagg

SEQ ID NO: 3682670 - RNA, 20 nt, Human
ucugcaagcacaucugcauu

SEQ ID NO: 3682671 - RNA, 15 nt, Human
ucugcaagccugcgu

SEQ ID NO: 3682672 - RNA, 22 nt, Human
ucugcaaguauacuagggagcc

SEQ ID NO: 3682673 - RNA, 13 nt, Human
ucugcaagucaga

SEQ ID NO: 3682674 - RNA, 23 nt, Human
ucugcaagucagaggauggccag

SEQ ID NO: 3682675 - RNA, 14 nt, Human
ucugcaaucuucuc

SEQ ID NO: 3682676 - RNA, 16 nt, Human
ucugcaaugggcacug

SEQ ID NO: 3682677 - RNA, 14 nt, Human
ucugcaauucaaaa

SEQ ID NO: 3682678 - RNA, 18 nt, Human
ucugcaauuccccucugc

SEQ ID NO: 3682679 - RNA, 19 nt, Human
ucugcacaagcugcacccu

SEQ ID NO: 3682680 - RNA, 22 nt, Human
ucugcacacccuccagagacaa

SEQ ID NO: 3682681 - RNA, 23 nt, Human
ucugcacaccuugaaucugccug

SEQ ID NO: 3682682 - RNA, 13 nt, Human
ucugcacagaugg

SEQ ID NO: 3682683 - RNA, 15 nt, Human
ucugcacagcuggcc

SEQ ID NO: 3682684 - RNA, 22 nt, Human
ucugcacaucuguaaaucuaca

SEQ ID NO: 3682685 - RNA, 23 nt, Human
ucugcacaugcagcugcacccuc

SEQ ID NO: 3682686 - RNA, 12 nt, Human
ucugcacauguc

SEQ ID NO: 3682687 - RNA, 15 nt, Human
ucugcaccccccugg

SEQ ID NO: 3682688 - RNA, 13 nt, Human
ucugcaccccucu

SEQ ID NO: 3682689 - RNA, 21 nt, Human
ucugcaccccucugcccucau

SEQ ID NO: 3682690 - RNA, 21 nt, Human
ucugcaccccuucucuccucc

SEQ ID NO: 3682691 - RNA, 22 nt, Human
ucugcaccccuucucuccuccc

SEQ ID NO: 3682692 - RNA, 12 nt, Human
ucugcacccucc

SEQ ID NO: 3682693 - RNA, 21 nt, Human
ucugcacccuccacccugucc

SEQ ID NO: 3682694 - RNA, 15 nt, Human
ucugcacccuucuuu

SEQ ID NO: 3682695 - RNA, 21 nt, Human
ucugcacccuucuuuucucau

SEQ ID NO: 3682696 - RNA, 22 nt, Human
ucugcaccgccggccagcuggg

SEQ ID NO: 3682697 - RNA, 14 nt, Human
ucugcacuacuccu

SEQ ID NO: 3682698 - RNA, 18 nt, Human
ucugcacuacugacaugu

SEQ ID NO: 3682699 - RNA, 17 nt, Human
ugaaauaacaaaaugga

SEQ ID NO: 3682700 - RNA, 20 nt, Human
ugaaauaacuggaacaaauu

SEQ ID NO: 3682701 - RNA, 15 nt, Human
ugaaauaagaauuca

SEQ ID NO: 3682702 - RNA, 20 nt, Human
ugaaauaagccagacaucaa

SEQ ID NO: 3682703 - RNA, 12 nt, Human
ugaaauaauaga

SEQ ID NO: 3682704 - RNA, 23 nt, Human
ugaaauaauguguaguucaugua

SEQ ID NO: 3682705 - RNA, 19 nt, Human
ugaaauacacaaguaaaca

SEQ ID NO: 3682706 - RNA, 21 nt, Human
ugaaauaccaaccugaagaca

SEQ ID NO: 3682707 - RNA, 16 nt, Human
ugaaauaccauuauua

SEQ ID NO: 3682708 - RNA, 12 nt, Human
ugaaauaccuca

SEQ ID NO: 3682709 - RNA, 13 nt, Human
ugaaauacuacuu

SEQ ID NO: 3682710 - RNA, 21 nt, Human
ugaaauagugguucuuggaaa

SEQ ID NO: 3682711 - RNA, 16 nt, Human
ugaaauauacacacag

SEQ ID NO: 3682712 - RNA, 16 nt, Human
ugaaauauaugugaaa

SEQ ID NO: 3682713 - RNA, 19 nt, Human
ugaaauauaugugaaagga

SEQ ID NO: 3682714 - RNA, 20 nt, Human
ugaaauaucccggggguggg

SEQ ID NO: 3682715 - RNA, 15 nt, Human
ugaaauauccugcuu

SEQ ID NO: 3682716 - RNA, 15 nt, Human
ugaaauaugcucuuu

SEQ ID NO: 3682717 - RNA, 17 nt, Human
ugaaauauguauaacuu

SEQ ID NO: 3682718 - RNA, 16 nt, Human
ugaaauauugacuuuu

SEQ ID NO: 3682719 - RNA, 13 nt, Human
ugaaauauugcug

SEQ ID NO: 3682720 - RNA, 20 nt, Human
ugaaaucaguaaacacugug

SEQ ID NO: 3682721 - RNA, 14 nt, Human
ugaaauccugcuuc

SEQ ID NO: 3682722 - RNA, 22 nt, Human
ugaaauccuggguuuucuuaac

SEQ ID NO: 3682723 - RNA, 17 nt, Human
ugaaaucuaggaaaauu

SEQ ID NO: 3682724 - RNA, 12 nt, Human
ugaaaucuuuuu

SEQ ID NO: 3682725 - RNA, 13 nt, Human
ugaaaugaaaaca

SEQ ID NO: 3682726 - RNA, 21 nt, Human
ugaaaugaaacaaauaaucac

SEQ ID NO: 3682727 - RNA, 18 nt, Human
ugaaaugaacacaaauua

SEQ ID NO: 3682728 - RNA, 17 nt, Human
ugaaaugagcaccucca

SEQ ID NO: 3682729 - RNA, 21 nt, Human
ugaaaugaggucagagccugc

SEQ ID NO: 3682730 - RNA, 23 nt, Human
ugaaaugaggucagagccugcag

SEQ ID NO: 3682731 - RNA, 17 nt, Human
ugaaaugauagauuuga

SEQ ID NO: 3682732 - RNA, 22 nt, Human
ugaaaugauagauuugaccucc

SEQ ID NO: 3682733 - RNA, 14 nt, Human
ugaaaugccuuacu

SEQ ID NO: 3682734 - RNA, 15 nt, Human
ugaaaugccuuacuu

SEQ ID NO: 3682735 - RNA, 22 nt, Human
ugaaaugccuuacuuuguauga

SEQ ID NO: 3682736 - RNA, 23 nt, Human
ugaaaugccuuacuuuguaugau

SEQ ID NO: 3682737 - RNA, 15 nt, Human
ugaaaugcugaaaau

SEQ ID NO: 3682738 - RNA, 16 nt, Human
ugaaaugcugaaaauu

SEQ ID NO: 3682739 - RNA, 19 nt, Human
ugaaaugcugaaaauugcc

SEQ ID NO: 3682740 - RNA, 16 nt, Human
ugaaaugcuggcauuu

SEQ ID NO: 3682741 - RNA, 16 nt, Human
ugaaauggagguccuu

SEQ ID NO: 3682742 - RNA, 15 nt, Human
ugaaauguaaggcug

SEQ ID NO: 3682743 - RNA, 22 nt, Human
ugaaaugucacguacugucuga

SEQ ID NO: 3682744 - RNA, 17 nt, Human
ugaaaugucaguucuga

SEQ ID NO: 3682745 - RNA, 18 nt, Human
ugaaaugucaguucugau

SEQ ID NO: 3682746 - RNA, 20 nt, Human
ugaaaugucaguucugauau

SEQ ID NO: 3682747 - RNA, 12 nt, Human
ugaaaugugaau

SEQ ID NO: 3682748 - RNA, 22 nt, Human
ugaaaugugaauuuuuauuguu

SEQ ID NO: 3682749 - RNA, 17 nt, Human
ugaaaugugguuuuccu

SEQ ID NO: 3682750 - RNA, 16 nt, Human
ugaaaugugugugaug

SEQ ID NO: 3682751 - RNA, 20 nt, Human
ugaaaugugugugaugugac

SEQ ID NO: 3682752 - RNA, 13 nt, Human
ugaaauguguuuc

SEQ ID NO: 3682753 - RNA, 21 nt, Human
ugaaauguuaacaaugccuau

SEQ ID NO: 3682754 - RNA, 21 nt, Human
ugaaauguuagucauuguuau

SEQ ID NO: 3682755 - RNA, 18 nt, Human
ugaaauguuuuaaggcuu

SEQ ID NO: 3682756 - RNA, 22 nt, Human
ugaaauuaacuggguaaugaaa

SEQ ID NO: 3682757 - RNA, 19 nt, Human
ugaaauuaagaaggcaaaa

SEQ ID NO: 3682758 - RNA, 22 nt, Human
ugaaauuacggguaccugaaga

SEQ ID NO: 3682759 - RNA, 23 nt, Human
ugaaauuacuacaaaauuugaaa

SEQ ID NO: 3682760 - RNA, 22 nt, Human
ugaaauuacuuaucauccacau

SEQ ID NO: 3682761 - RNA, 18 nt, Human
ugaaauuauaguuucaag

SEQ ID NO: 3682762 - RNA, 21 nt, Human
ugaaauuauaguuucaagcca

SEQ ID NO: 3682763 - RNA, 14 nt, Human
ugaaauuauaucug

SEQ ID NO: 3682764 - RNA, 13 nt, Human
ugaaauuauguaa

SEQ ID NO: 3682765 - RNA, 18 nt, Human
ugaaauuauguauguuua

SEQ ID NO: 3682766 - RNA, 19 nt, Human
ugaaauuauguauguuuac

SEQ ID NO: 3682767 - RNA, 14 nt, Human
ugaaauuccaaagu

SEQ ID NO: 3682768 - RNA, 15 nt, Human
ugaaauuccaaaguc

SEQ ID NO: 3682769 - RNA, 17 nt, Human
ugaaauuccaaagucuc

SEQ ID NO: 3682770 - RNA, 19 nt, Human
ugaaauuccaaagucucua

SEQ ID NO: 3682771 - RNA, 13 nt, Human
ugaaauucuaaag

SEQ ID NO: 3682772 - RNA, 16 nt, Human
ugaaauucuccuggag

SEQ ID NO: 3682773 - RNA, 12 nt, Human
ugaaauucugaa

SEQ ID NO: 3682774 - RNA, 15 nt, Human
ugaaauucugaauuu

SEQ ID NO: 3682775 - RNA, 20 nt, Human
ugaaauucugaauuugcaaa

SEQ ID NO: 3682776 - RNA, 19 nt, Human
ugaaauugaaccuuugugc

SEQ ID NO: 3682777 - RNA, 22 nt, Human
ugaaauugaaccuuugugcccu

SEQ ID NO: 3682778 - RNA, 22 nt, Human
ugaaauugauaaugcuuucaca

SEQ ID NO: 3682779 - RNA, 13 nt, Human
ugaaauuguaauu

SEQ ID NO: 3682780 - RNA, 15 nt, Human
ugaaauuguaauuau

SEQ ID NO: 3682781 - RNA, 23 nt, Human
ugaaauuguacauauuuguggaa

SEQ ID NO: 3682782 - RNA, 22 nt, Human
ugaaauugucuagcagagcagg

SEQ ID NO: 3682783 - RNA, 22 nt, Human
ugaaauugugaacucauugcuc

SEQ ID NO: 3682784 - RNA, 18 nt, Human
ugaaauuguuuaaguguu

SEQ ID NO: 3682785 - RNA, 22 nt, Human
ugaaauuuaauauagcuauuuu

SEQ ID NO: 3682786 - RNA, 15 nt, Human
ugaaauuuauugagg

SEQ ID NO: 3682787 - RNA, 17 nt, Human
ugaaauuuauugaggaa

SEQ ID NO: 3682788 - RNA, 17 nt, Human
ugaaauuuauuuaaugu

SEQ ID NO: 3682789 - RNA, 22 nt, Human
ugaaauuucagauucccagagc

SEQ ID NO: 3682790 - RNA, 15 nt, Human
ugaaauuuccuggga

SEQ ID NO: 3682791 - RNA, 15 nt, Human
ugaaauuucuagccu

SEQ ID NO: 3682792 - RNA, 16 nt, Human
ugaaauuucuagccug

SEQ ID NO: 3682793 - RNA, 17 nt, Human
ugaaauuugaauuuugu

SEQ ID NO: 3682794 - RNA, 19 nt, Human
ugaaauuuuaaaaauuguu

SEQ ID NO: 3682795 - RNA, 14 nt, Human
ugaaauuuuaaccu

SEQ ID NO: 3682796 - RNA, 12 nt, Human
ugaaauuuugca

SEQ ID NO: 3682797 - RNA, 19 nt, Human
ugaaauuuugcaaauauaa

SEQ ID NO: 3682798 - RNA, 20 nt, Human
ugaaauuuugcaaauauaaa

SEQ ID NO: 3682799 - RNA, 19 nt, Human
ugaaauuuuuauuaaauua

SEQ ID NO: 3682800 - RNA, 20 nt, Human
ugaaauuuuuauuaaauuau

SEQ ID NO: 3682801 - RNA, 20 nt, Human
ugaaauuuuucauauuuuaa

SEQ ID NO: 3682802 - RNA, 13 nt, Human
ugaaauuuuucuu

SEQ ID NO: 3682803 - RNA, 14 nt, Human
ugaacaaaaaaaug

SEQ ID NO: 3682804 - RNA, 16 nt, Human
ugaacaaaauaaauug

SEQ ID NO: 3682805 - RNA, 18 nt, Human
ugaacaaaauaaauugga

SEQ ID NO: 3682806 - RNA, 19 nt, Human
ugaacaaagaccaauuuuu

SEQ ID NO: 3682807 - RNA, 15 nt, Human
ugaacaaagcagcca

SEQ ID NO: 3682808 - RNA, 18 nt, Human
ugaacaaauugaacucuu

SEQ ID NO: 3682809 - RNA, 21 nt, Human
ugaacaaauugaacucuuuga

SEQ ID NO: 3682810 - RNA, 18 nt, Human
ugaacaaauuuacagaga

SEQ ID NO: 3682811 - RNA, 19 nt, Human
ugaacaacgagccuuuuca

SEQ ID NO: 3682812 - RNA, 17 nt, Human
ugaacaagagaagcauu

SEQ ID NO: 3682813 - RNA, 17 nt, Human
ugaacaagcuucaguaa

SEQ ID NO: 3682814 - RNA, 19 nt, Human
ugaacaaguuuuaauguau

SEQ ID NO: 3682815 - RNA, 15 nt, Human
ugaacacacuguguc

SEQ ID NO: 3682816 - RNA, 17 nt, Human
ugaacacaggcagcuuu

SEQ ID NO: 3682817 - RNA, 13 nt, Human
ugaacacaguauu

SEQ ID NO: 3682818 - RNA, 18 nt, Human
ugaacacaucagcuagca

SEQ ID NO: 3682819 - RNA, 14 nt, Human
ugaacacauuucuu

SEQ ID NO: 3682820 - RNA, 17 nt, Human
ugaacacucaugcugaa

SEQ ID NO: 3682821 - RNA, 19 nt, Human
ugaacacuccaauuaagga

SEQ ID NO: 3682822 - RNA, 18 nt, Human
ugaacacuggcaacaaca

SEQ ID NO: 3682823 - RNA, 22 nt, Human
ugaacacugggggaggggacau

SEQ ID NO: 3682824 - RNA, 15 nt, Human
ugaacacuuggugcu

SEQ ID NO: 3682825 - RNA, 21 nt, Human
ugaacagaagcucuuacucuu

SEQ ID NO: 3682826 - RNA, 18 nt, Human
ugaacagacugaccuuga

SEQ ID NO: 3682827 - RNA, 19 nt, Human
ugaacagaggccacauuac

SEQ ID NO: 3682828 - RNA, 19 nt, Human
ugaacagcugguguagcua

SEQ ID NO: 3682829 - RNA, 22 nt, Human
ugaacaggaaacuccugugacc

SEQ ID NO: 3682830 - RNA, 22 nt, Human
ugaacaguuuaucgaccaguuu

SEQ ID NO: 3682831 - RNA, 16 nt, Human
ugaacauaauucuuau

SEQ ID NO: 3682832 - RNA, 23 nt, Human
ugaacauacaaaugcaucuuuga

SEQ ID NO: 3682833 - RNA, 19 nt, Human
ugaacauacuggcugguga

SEQ ID NO: 3682834 - RNA, 20 nt, Human
ugaacaucccuuuuucaaug

SEQ ID NO: 3682835 - RNA, 17 nt, Human
ugaacaucugaguccug

SEQ ID NO: 3682836 - RNA, 13 nt, Human
ugaacauuccaga

SEQ ID NO: 3682837 - RNA, 14 nt, Human
ugaacauuccagag

SEQ ID NO: 3682838 - RNA, 19 nt, Human
ugaacauucuccuguggaa

SEQ ID NO: 3682839 - RNA, 22 nt, Human
ugaacauuuaucaaucaguaua

SEQ ID NO: 3682840 - RNA, 23 nt, Human
ugaacauuuggguuacuauuucu

SEQ ID NO: 3682841 - RNA, 16 nt, Human
ugaacauuugugauau

SEQ ID NO: 3682842 - RNA, 21 nt, Human
ugaaccacaucuugcucugcu

SEQ ID NO: 3682843 - RNA, 22 nt, Human
ugaaccacaucuugcucugcug

SEQ ID NO: 3682844 - RNA, 17 nt, Human
ugaaccaccacacccag

SEQ ID NO: 3682845 - RNA, 21 nt, Human
ugaaccaccacacccagccca

SEQ ID NO: 3682846 - RNA, 16 nt, Human
ugaaccacuucauucu

SEQ ID NO: 3682847 - RNA, 15 nt, Human
ugaaccacuucccuc

SEQ ID NO: 3682848 - RNA, 16 nt, Human
ugaaccacuuguagau

SEQ ID NO: 3682849 - RNA, 21 nt, Human
ugaaccauaaauucaacuuug

SEQ ID NO: 3682850 - RNA, 23 nt, Human
ugaaccauggugaagugcuugga

SEQ ID NO: 3682851 - RNA, 17 nt, Human
ugaaccauuaaagucga

SEQ ID NO: 3682852 - RNA, 12 nt, Human
ugaacccaggag

SEQ ID NO: 3682853 - RNA, 22 nt, Human
ugaacccauauuuguacaccaa

SEQ ID NO: 3682854 - RNA, 21 nt, Human
ugaacccuggggccugacugc

SEQ ID NO: 3682855 - RNA, 14 nt, Human
ugaacccugugcug

SEQ ID NO: 3682856 - RNA, 17 nt, Human
ugaacccuuuguuucuu

SEQ ID NO: 3682857 - RNA, 20 nt, Human
ugaaccgaggggcucaggaa

SEQ ID NO: 3682858 - RNA, 14 nt, Human
ugaaccuaccuuca

SEQ ID NO: 3682859 - RNA, 22 nt, Human
ugaaccuaggagugccccauuc

SEQ ID NO: 3682860 - RNA, 16 nt, Human
ugaaccuauuucucuu

SEQ ID NO: 3682861 - RNA, 23 nt, Human
ugaaccucaccccgaggcccugc

SEQ ID NO: 3682862 - RNA, 15 nt, Human
ugaaccugaugcuga

SEQ ID NO: 3682863 - RNA, 12 nt, Human
ugaaccugcccu

SEQ ID NO: 3682864 - RNA, 13 nt, Human
ugaacgcccagag

SEQ ID NO: 3682865 - RNA, 15 nt, Human
ugaacggggagaaaa

SEQ ID NO: 3682866 - RNA, 15 nt, Human
ugaacggugagcauu

SEQ ID NO: 3682867 - RNA, 16 nt, Human
ugaacguccacaugaa

SEQ ID NO: 3682868 - RNA, 15 nt, Human
ugaacguuuucuaau

SEQ ID NO: 3682869 - RNA, 16 nt, Human
ugaacguuuucuaauu

SEQ ID NO: 3682870 - RNA, 19 nt, Human
ugaacguuuucuaauugcu

SEQ ID NO: 3682871 - RNA, 14 nt, Human
ugaacuaagaaacu

SEQ ID NO: 3682872 - RNA, 18 nt, Human
ugaacuaagaaacuuuug

SEQ ID NO: 3682873 - RNA, 22 nt, Human
ugaacuaagaaacuuuuguaaa

SEQ ID NO: 3682874 - RNA, 21 nt, Human
ugaacuacgcuugcucauuuu

SEQ ID NO: 3682875 - RNA, 19 nt, Human
ugaacuagcuggaauuuuu

SEQ ID NO: 3682876 - RNA, 21 nt, Human
ugaacuaggauuguaguccca

SEQ ID NO: 3682877 - RNA, 23 nt, Human
ugaacuaggguggugcauuuuug

SEQ ID NO: 3682878 - RNA, 23 nt, Human
ugaacuauuccccagcagggucu

SEQ ID NO: 3682879 - RNA, 14 nt, Human
ugaacucaaacuga

SEQ ID NO: 3682880 - RNA, 13 nt, Human
ugaacucagccaa

SEQ ID NO: 3682881 - RNA, 16 nt, Human
ugaacucagccaagca

SEQ ID NO: 3682882 - RNA, 18 nt, Human
ugaacucagccaagcaca

SEQ ID NO: 3682883 - RNA, 19 nt, Human
ugaacucagccaagcacag

SEQ ID NO: 3682884 - RNA, 20 nt, Human
ugaacucagccaagcacagu

SEQ ID NO: 3682885 - RNA, 11 nt, Human
ugaacuccugg

SEQ ID NO: 3682886 - RNA, 16 nt, Human
ugaacucugaacuuug

SEQ ID NO: 3682887 - RNA, 14 nt, Human
ugaacucuuaauca

SEQ ID NO: 3682888 - RNA, 15 nt, Human
ugaacucuucaaucu

SEQ ID NO: 3682889 - RNA, 12 nt, Human
ugaacugaacac

SEQ ID NO: 3682890 - RNA, 14 nt, Human
ugaacugaacucug

SEQ ID NO: 3682891 - RNA, 11 nt, Human
ugaacugaagg

SEQ ID NO: 3682892 - RNA, 20 nt, Human
ugaacugaaggcagcaugua

SEQ ID NO: 3682893 - RNA, 12 nt, Human
ugaacugaaguu

SEQ ID NO: 3682894 - RNA, 13 nt, Human
ugaacugaaguuu

SEQ ID NO: 3682895 - RNA, 15 nt, Human
ugaacugauaaagau

SEQ ID NO: 3682896 - RNA, 19 nt, Human
ugaacugauaguuacuguu

SEQ ID NO: 3682897 - RNA, 21 nt, Human
ugaacugauaguuacuguugu

SEQ ID NO: 3682898 - RNA, 23 nt, Human
ugaacugauaguuacuguuguga

SEQ ID NO: 3682899 - RNA, 12 nt, Human
ugaacugauuca

SEQ ID NO: 3682900 - RNA, 20 nt, Human
ugaacugauucacaucucau

SEQ ID NO: 3682901 - RNA, 19 nt, Human
ugaacuggacccuguugcu

SEQ ID NO: 3682902 - RNA, 22 nt, Human
ugaacuggacccuguugcuaag

SEQ ID NO: 3682903 - RNA, 17 nt, Human
ugaacuggcaauugucu

SEQ ID NO: 3682904 - RNA, 14 nt, Human
ugaacugggaccuu

SEQ ID NO: 3682905 - RNA, 23 nt, Human
ugaacuggguacuuguggacaca

SEQ ID NO: 3682906 - RNA, 15 nt, Human
ugaacuggucuuccu

SEQ ID NO: 3682907 - RNA, 16 nt, Human
ugaacuggucuuccuu

SEQ ID NO: 3682908 - RNA, 22 nt, Human
ugaacuguguguaauuguuccu

SEQ ID NO: 3682909 - RNA, 14 nt, Human
ugaacuguuagaau

SEQ ID NO: 3682910 - RNA, 18 nt, Human
ugaacuuaaaaugaaagu

SEQ ID NO: 3682911 - RNA, 14 nt, Human
ugaacuuaacaugc

SEQ ID NO: 3682912 - RNA, 15 nt, Human
ugaacuuaacaugcu

SEQ ID NO: 3682913 - RNA, 19 nt, Human
ugaacuuaacaugcugugu

SEQ ID NO: 3682914 - RNA, 20 nt, Human
ugaacuuacuguagccucag

SEQ ID NO: 3682915 - RNA, 17 nt, Human
ugaacuuagauuuuaca

SEQ ID NO: 3682916 - RNA, 21 nt, Human
ugaacuuagauuuuacaugaa

SEQ ID NO: 3682917 - RNA, 22 nt, Human
ugaacuuccugcagguaaacag

SEQ ID NO: 3682918 - RNA, 14 nt, Human
ugaacuucgcauca

SEQ ID NO: 3682919 - RNA, 17 nt, Human
ugaacuucuuugaauuu

SEQ ID NO: 3682920 - RNA, 22 nt, Human
ugaacuugaggacacaugucca

SEQ ID NO: 3682921 - RNA, 14 nt, Human
ugaacuuggcgcug

SEQ ID NO: 3682922 - RNA, 15 nt, Human
ugaacuuguagcugu

SEQ ID NO: 3682923 - RNA, 16 nt, Human
ugaacuuguagcugua

SEQ ID NO: 3682924 - RNA, 17 nt, Human
ugaacuuguagcuguaa

SEQ ID NO: 3682925 - RNA, 18 nt, Human
ugaacuuguagcuguaaa

SEQ ID NO: 3682926 - RNA, 19 nt, Human
ugaacuuguagcuguaaaa

SEQ ID NO: 3682927 - RNA, 21 nt, Human
ugaacuuuccuggaugucuga

SEQ ID NO: 3682928 - RNA, 11 nt, Human
ugaacuuucuc

SEQ ID NO: 3682929 - RNA, 22 nt, Human
ugaacuuucucuucauacuuuu

SEQ ID NO: 3682930 - RNA, 22 nt, Human
ugaacuuugaccucugcagcaa

SEQ ID NO: 3682931 - RNA, 18 nt, Human
ugaacuuuuguacugaau

SEQ ID NO: 3682932 - RNA, 13 nt, Human
ugaacuuuuugua

SEQ ID NO: 3682933 - RNA, 17 nt, Human
ugaagaaaaaauacauu

SEQ ID NO: 3682934 - RNA, 19 nt, Human
ugaagaaaaaauacauuuu

SEQ ID NO: 3682935 - RNA, 12 nt, Human
ugaagaaaauac

SEQ ID NO: 3682936 - RNA, 15 nt, Human
ugaagaaaaucacuu

SEQ ID NO: 3682937 - RNA, 21 nt, Human
ugaagaaagccuguuguuuaa

SEQ ID NO: 3682938 - RNA, 18 nt, Human
ugaagaaauacugcacuu

SEQ ID NO: 3682939 - RNA, 19 nt, Human
ugaagaaauacugcacuua

SEQ ID NO: 3682940 - RNA, 13 nt, Human
ugaagaacaugug

SEQ ID NO: 3682941 - RNA, 19 nt, Human
ugaagaaccagucccccca

SEQ ID NO: 3682942 - RNA, 20 nt, Human
ugaagaaccaguccccccac

SEQ ID NO: 3682943 - RNA, 17 nt, Human
ugaagaacuagcauaua

SEQ ID NO: 3682944 - RNA, 19 nt, Human
ugaagaacuauuuuauucu

SEQ ID NO: 3682945 - RNA, 18 nt, Human
ugaagaacugcaggcccu

SEQ ID NO: 3682946 - RNA, 14 nt, Human
ugaagaagauggua

SEQ ID NO: 3682947 - RNA, 22 nt, Human
ugaagaagcuaaauccuuuacu

SEQ ID NO: 3682948 - RNA, 15 nt, Human
ugaagaaggugaaua

SEQ ID NO: 3682949 - RNA, 19 nt, Human
ugaagaagguggaccuuuu

SEQ ID NO: 3682950 - RNA, 19 nt, Human
ugaagaauacuucucauuu

SEQ ID NO: 3682951 - RNA, 21 nt, Human
ugaagaauccuuuuguagaau

SEQ ID NO: 3682952 - RNA, 20 nt, Human
ugaagaaucuacuuaacccu

SEQ ID NO: 3682953 - RNA, 11 nt, Human
ugaagaauuaa

SEQ ID NO: 3682954 - RNA, 13 nt, Human
ugaagaauugaaa

SEQ ID NO: 3682955 - RNA, 11 nt, Human
ugaagaauuua

SEQ ID NO: 3682956 - RNA, 13 nt, Human
ugaagaauuuaaa

SEQ ID NO: 3682957 - RNA, 18 nt, Human
ugaagacaaaaauacucu

SEQ ID NO: 3682958 - RNA, 13 nt, Human
ugaagacaaugac

SEQ ID NO: 3682959 - RNA, 22 nt, Human
ugaagacaauuugauacauaau

SEQ ID NO: 3682960 - RNA, 19 nt, Human
ugaagacagaaccacaggg

SEQ ID NO: 3682961 - RNA, 14 nt, Human
ugaagacaggaugg

SEQ ID NO: 3682962 - RNA, 17 nt, Human
ugaagaccuaaccaggg

SEQ ID NO: 3682963 - RNA, 15 nt, Human
ugaagaccuuuuucu

SEQ ID NO: 3682964 - RNA, 18 nt, Human
ugaagaccuuuuucugca

SEQ ID NO: 3682965 - RNA, 23 nt, Human
ugaagaccuuuuucugcacuaua

SEQ ID NO: 3682966 - RNA, 16 nt, Human
ugaagacuaugaaaau

SEQ ID NO: 3682967 - RNA, 13 nt, Human
ugaagacuccaga

SEQ ID NO: 3682968 - RNA, 18 nt, Human
ugaagacuggaagcuaau

SEQ ID NO: 3682969 - RNA, 14 nt, Human
ugaagacuuuucuu

SEQ ID NO: 3682970 - RNA, 17 nt, Human
ugaagacuuuucuuuca

SEQ ID NO: 3682971 - RNA, 22 nt, Human
ugaagagaagggcagggcugag

SEQ ID NO: 3682972 - RNA, 23 nt, Human
ugaagagacaguuauuuauaguc

SEQ ID NO: 3682973 - RNA, 15 nt, Human
ugaagagagauauau

SEQ ID NO: 3682974 - RNA, 22 nt, Human
ugaagagagauauaucugaaaa

SEQ ID NO: 3682975 - RNA, 16 nt, Human
ugaagagcaaaaauau

SEQ ID NO: 3682976 - RNA, 17 nt, Human
ugaagagccacugccau

SEQ ID NO: 3682977 - RNA, 16 nt, Human
ugaagagcuugcuuug

SEQ ID NO: 3682978 - RNA, 17 nt, Human
ugaagagcuugcuuuga

SEQ ID NO: 3682979 - RNA, 19 nt, Human
ugaagagcuugcuuugauu

SEQ ID NO: 3682980 - RNA, 16 nt, Human
ugaagaggaaaaugaa

SEQ ID NO: 3682981 - RNA, 19 nt, Human
ugaagaggcgggccagcca

SEQ ID NO: 3682982 - RNA, 23 nt, Human
ugaagaggcgggccagccaggcg

SEQ ID NO: 3682983 - RNA, 18 nt, Human
ugaagagggagaagcaug

SEQ ID NO: 3682984 - RNA, 13 nt, Human
ugaagaggggcag

SEQ ID NO: 3682985 - RNA, 15 nt, Human
ugaagaggugagcac

SEQ ID NO: 3682986 - RNA, 19 nt, Human
ugaagagguuuuaaagcuu

SEQ ID NO: 3682987 - RNA, 20 nt, Human
ugaagagguuuuaaagcuuc

SEQ ID NO: 3682988 - RNA, 21 nt, Human
ugaagagguuuuaaagcuucc

SEQ ID NO: 3682989 - RNA, 23 nt, Human
ugaagauaaguguauuuuucaau

SEQ ID NO: 3682990 - RNA, 15 nt, Human
ugaagauacaugucu

SEQ ID NO: 3682991 - RNA, 14 nt, Human
ugaagauacuuugu

SEQ ID NO: 3682992 - RNA, 16 nt, Human
ugaagauacuuuguau

SEQ ID NO: 3682993 - RNA, 17 nt, Human
ugaagauagaagaaaaa

SEQ ID NO: 3682994 - RNA, 21 nt, Human
ugaagauaucuugaaaugaaa

SEQ ID NO: 3682995 - RNA, 17 nt, Human
ugaagauccagcugccu

SEQ ID NO: 3682996 - RNA, 19 nt, Human
ugaagaucguuaguaucua

SEQ ID NO: 3682997 - RNA, 21 nt, Human
ugaauggauuggauuauuuaa

SEQ ID NO: 3682998 - RNA, 22 nt, Human
ugaauggauuggauuauuuaau

SEQ ID NO: 3682999 - RNA, 19 nt, Human
ugaauggcaauguuuugcu

SEQ ID NO: 3683000 - RNA, 11 nt, Human
ugaauggcuuu

SEQ ID NO: 3683001 - RNA, 18 nt, Human
ugaaugggaaaagagaug

SEQ ID NO: 3683002 - RNA, 18 nt, Human
ugaauggggucucaaagu

SEQ ID NO: 3683003 - RNA, 17 nt, Human
ugaauggguccauuuug

SEQ ID NO: 3683004 - RNA, 20 nt, Human
ugaaugguauggaacucucu

SEQ ID NO: 3683005 - RNA, 13 nt, Human
ugaauggucagcg

SEQ ID NO: 3683006 - RNA, 21 nt, Human
ugaaugguguuguaugccuuu

SEQ ID NO: 3683007 - RNA, 16 nt, Human
ugaauguaaauuugua

SEQ ID NO: 3683008 - RNA, 20 nt, Human
ugaauguaaauuuguacuau

SEQ ID NO: 3683009 - RNA, 19 nt, Human
ugaauguagcagccccggg

SEQ ID NO: 3683010 - RNA, 14 nt, Human
ugaauguaugcuuc

SEQ ID NO: 3683011 - RNA, 22 nt, Human
ugaauguauguaauguguggug

SEQ ID NO: 3683012 - RNA, 16 nt, Human
ugaaugugaagccuuc

SEQ ID NO: 3683013 - RNA, 14 nt, Human
ugaauguguguggu

SEQ ID NO: 3683014 - RNA, 18 nt, Human
ugaauguuaaauaaauug

SEQ ID NO: 3683015 - RNA, 14 nt, Human
ugaauguucugaca

SEQ ID NO: 3683016 - RNA, 15 nt, Human
ugaauguucugacau

SEQ ID NO: 3683017 - RNA, 18 nt, Human
ugaauguucugacauuaa

SEQ ID NO: 3683018 - RNA, 21 nt, Human
ugaauguucugacauuaacag

SEQ ID NO: 3683019 - RNA, 23 nt, Human
ugaauguucugacauuaacaguu

SEQ ID NO: 3683020 - RNA, 20 nt, Human
ugaauguugcaaugugaaaa

SEQ ID NO: 3683021 - RNA, 13 nt, Human
ugaauguuuuucu

SEQ ID NO: 3683022 - RNA, 17 nt, Human
ugaauguuuuucuaaag

SEQ ID NO: 3683023 - RNA, 20 nt, Human
ugaauguuuuucuaaaggag

SEQ ID NO: 3683024 - RNA, 22 nt, Human
ugaauuaaaacuucuuaaauau

SEQ ID NO: 3683025 - RNA, 19 nt, Human
ugaauuaauaucccuacau

SEQ ID NO: 3683026 - RNA, 23 nt, Human
ugaauuaauaucccuacauguau

SEQ ID NO: 3683027 - RNA, 17 nt, Human
ugaauuaccuggauguu

SEQ ID NO: 3683028 - RNA, 21 nt, Human
ugaauuagaaacauaaauaaa

SEQ ID NO: 3683029 - RNA, 17 nt, Human
ugaauuaggcuguaacu

SEQ ID NO: 3683030 - RNA, 22 nt, Human
ugaauuaggcuguaacuacuuu

SEQ ID NO: 3683031 - RNA, 15 nt, Human
ugaauuaguuuuaaa

SEQ ID NO: 3683032 - RNA, 21 nt, Human
ugaauuaucuugguugaaaau

SEQ ID NO: 3683033 - RNA, 17 nt, Human
ugaauuaugaaacuuuu

SEQ ID NO: 3683034 - RNA, 16 nt, Human
ugaauuauuacagugu

SEQ ID NO: 3683035 - RNA, 17 nt, Human
ugaauuauuacaguguu

SEQ ID NO: 3683036 - RNA, 18 nt, Human
ugaauuauuauauacaua

SEQ ID NO: 3683037 - RNA, 13 nt, Human
ugaauuauucaau

SEQ ID NO: 3683038 - RNA, 19 nt, Human
ugaauucaccacagacuuu

SEQ ID NO: 3683039 - RNA, 12 nt, Human
ugaauucagauu

SEQ ID NO: 3683040 - RNA, 22 nt, Human
ugaauucuugguugaggaaaca

SEQ ID NO: 3683041 - RNA, 15 nt, Human
ugaauucuuuugcca

SEQ ID NO: 3683042 - RNA, 12 nt, Human
ugaauugaaguu

SEQ ID NO: 3683043 - RNA, 17 nt, Human
ugaauugaaguuucaag

SEQ ID NO: 3683044 - RNA, 19 nt, Human
ugaauugaaguuucaaguu

SEQ ID NO: 3683045 - RNA, 20 nt, Human
ugaauugagccuaaaaauaa

SEQ ID NO: 3683046 - RNA, 20 nt, Human
ugaauugaggggauuaauau

SEQ ID NO: 3683047 - RNA, 13 nt, Human
ugaauugauaaua

SEQ ID NO: 3683048 - RNA, 16 nt, Human
ugaauugccugcagag

SEQ ID NO: 3683049 - RNA, 22 nt, Human
ugaauugccugcagagagaagc

SEQ ID NO: 3683050 - RNA, 15 nt, Human
ugaauuguccccagu

SEQ ID NO: 3683051 - RNA, 17 nt, Human
ugaauugugaccaaguu

SEQ ID NO: 3683052 - RNA, 15 nt, Human
ugaauuguuugaacc

SEQ ID NO: 3683053 - RNA, 13 nt, Human
ugaauuuaacaau

SEQ ID NO: 3683054 - RNA, 18 nt, Human
ugaauuuaacaaugcgaa

SEQ ID NO: 3683055 - RNA, 23 nt, Human
ugaauuuaacaaugcgaauggua

SEQ ID NO: 3683056 - RNA, 17 nt, Human
ugaauuuacuuccuugc

SEQ ID NO: 3683057 - RNA, 21 nt, Human
ugaauuuacuuccuugcaugu

SEQ ID NO: 3683058 - RNA, 13 nt, Human
ugaauuuaucuuu

SEQ ID NO: 3683059 - RNA, 21 nt, Human
ugaauuuauuggcuuuucuga

SEQ ID NO: 3683060 - RNA, 12 nt, Human
ugaauuucucua

SEQ ID NO: 3683061 - RNA, 13 nt, Human
ugaauuugaauga

SEQ ID NO: 3683062 - RNA, 15 nt, Human
ugaauuugaaugaaa

SEQ ID NO: 3683063 - RNA, 19 nt, Human
ugaauuugaaugaaaaauu

SEQ ID NO: 3683064 - RNA, 11 nt, Human
ugaauuugcaa

SEQ ID NO: 3683065 - RNA, 14 nt, Human
ugaauuugcaaagu

SEQ ID NO: 3683066 - RNA, 17 nt, Human
ugaauuugcccugggaa

SEQ ID NO: 3683067 - RNA, 20 nt, Human
ugaauuuggccugcacuaau

SEQ ID NO: 3683068 - RNA, 15 nt, Human
ugaauuuuaaaaucu

SEQ ID NO: 3683069 - RNA, 22 nt, Human
ugaauuuuaaaguaugcauuau

SEQ ID NO: 3683070 - RNA, 17 nt, Human
ugaauuuuaaaucuaaa

SEQ ID NO: 3683071 - RNA, 15 nt, Human
ugaauuuuagcuuuu

SEQ ID NO: 3683072 - RNA, 13 nt, Human
ugaauuuucaagc

SEQ ID NO: 3683073 - RNA, 13 nt, Human
ugaauuuucacau

SEQ ID NO: 3683074 - RNA, 19 nt, Human
ugaauuuucacaugaacau

SEQ ID NO: 3683075 - RNA, 11 nt, Human
ugaauuuucau

SEQ ID NO: 3683076 - RNA, 12 nt, Human
ugaauuuucauu

SEQ ID NO: 3683077 - RNA, 14 nt, Human
ugaauuuucauuuu

SEQ ID NO: 3683078 - RNA, 16 nt, Human
ugaauuuucauuuuac

SEQ ID NO: 3683079 - RNA, 17 nt, Human
ugaauuuucauuuuaca

SEQ ID NO: 3683080 - RNA, 14 nt, Human
ugaauuuucccacu

SEQ ID NO: 3683081 - RNA, 20 nt, Human
ugaauuuucccacugcaccc

SEQ ID NO: 3683082 - RNA, 13 nt, Human
ugaauuuucugug

SEQ ID NO: 3683083 - RNA, 14 nt, Human
ugaauuuucugugu

SEQ ID NO: 3683084 - RNA, 20 nt, Human
ugaauuuuggggauuuucaa

SEQ ID NO: 3683085 - RNA, 21 nt, Human
ugaauuuuggggauuuucaaa

SEQ ID NO: 3683086 - RNA, 21 nt, Human
ugaauuuuguguuagagauuu

SEQ ID NO: 3683087 - RNA, 17 nt, Human
ugaauuuuguucucugg

SEQ ID NO: 3683088 - RNA, 18 nt, Human
ugaauuuuguucucuggg

SEQ ID NO: 3683089 - RNA, 16 nt, Human
ugaauuuuguugcugu

SEQ ID NO: 3683090 - RNA, 19 nt, Human
ugaauuuuuaaacaaguau

SEQ ID NO: 3683091 - RNA, 18 nt, Human
ugaauuuuuaugugugau

SEQ ID NO: 3683092 - RNA, 14 nt, Human
ugaauuuuuauugu

SEQ ID NO: 3683093 - RNA, 22 nt, Human
ugaauuuuucucuaacucagaa

SEQ ID NO: 3683094 - RNA, 14 nt, Human
ugaauuuuugcaau

SEQ ID NO: 3683095 - RNA, 15 nt, Human
ugaauuuuugcaaua

SEQ ID NO: 3683096 - RNA, 22 nt, Human
ugaauuuuuuuguaauaagcaa

SEQ ID NO: 3683097 - RNA, 16 nt, Human
ugaauuuuuuuuaaca

SEQ ID NO: 3683098 - RNA, 19 nt, Human
ugaauuuuuuuuaacauuc

SEQ ID NO: 3683099 - RNA, 20 nt, Human
ugaauuuuuuuuaacauucc

SEQ ID NO: 3683100 - RNA, 19 nt, Human
ugaauuuuuuuuuccuagc

SEQ ID NO: 3683101 - RNA, 20 nt, Human
ugaauuuuuuuuuccuagcc

SEQ ID NO: 3683102 - RNA, 18 nt, Human
ugacaaaaaauguuuuaa

SEQ ID NO: 3683103 - RNA, 13 nt, Human
ugacaaaauuuug

SEQ ID NO: 3683104 - RNA, 14 nt, Human
ugacaaaauuuugc

SEQ ID NO: 3683105 - RNA, 22 nt, Human
ugacaaacuucuuucacucaca

SEQ ID NO: 3683106 - RNA, 15 nt, Human
ugacaaagaaaccca

SEQ ID NO: 3683107 - RNA, 19 nt, Human
ugacaaagaaacccaagug

SEQ ID NO: 3683108 - RNA, 19 nt, Human
ugacaaagacugaguacgu

SEQ ID NO: 3683109 - RNA, 14 nt, Human
ugacaaagauggcu

SEQ ID NO: 3683110 - RNA, 20 nt, Human
ugacaaaucaaguuuccaag

SEQ ID NO: 3683111 - RNA, 17 nt, Human
ugacaaauguaaacauu

SEQ ID NO: 3683112 - RNA, 15 nt, Human
ugacaacagacuucu

SEQ ID NO: 3683113 - RNA, 19 nt, Human
ugacaacagacuucugaaa

SEQ ID NO: 3683114 - RNA, 20 nt, Human
ugacaaccaccgcuccccag

SEQ ID NO: 3683115 - RNA, 17 nt, Human
ugacaaccacuggucug

SEQ ID NO: 3683116 - RNA, 17 nt, Human
ugacaaccauuaaaguc

SEQ ID NO: 3683117 - RNA, 19 nt, Human
ugacaaccgagaagguuua

SEQ ID NO: 3683118 - RNA, 13 nt, Human
ugacaaccuccau

SEQ ID NO: 3683119 - RNA, 20 nt, Human
ugacaaccuccauucuauuu

SEQ ID NO: 3683120 - RNA, 21 nt, Human
ugacaaccuccauucuauuuu

SEQ ID NO: 3683121 - RNA, 15 nt, Human
ugacaacuggcaggc

SEQ ID NO: 3683122 - RNA, 18 nt, Human
ugacaacuggcaggcagg

SEQ ID NO: 3683123 - RNA, 14 nt, Human
ugacaacuucuaau

SEQ ID NO: 3683124 - RNA, 19 nt, Human
ugacaacuucuaauugcca

SEQ ID NO: 3683125 - RNA, 22 nt, Human
ugacaacuucuaauugccaugu

SEQ ID NO: 3683126 - RNA, 23 nt, Human
ugacaagaaaggcugcuguacug

SEQ ID NO: 3683127 - RNA, 22 nt, Human
ugacaagcagauacugcugugu

SEQ ID NO: 3683128 - RNA, 13 nt, Human
ugacaagccccag

SEQ ID NO: 3683129 - RNA, 17 nt, Human
ugacaagccccaggcag

SEQ ID NO: 3683130 - RNA, 12 nt, Human
ugacaagcucac

SEQ ID NO: 3683131 - RNA, 18 nt, Human
ugacaagcuccauuuaaa

SEQ ID NO: 3683132 - RNA, 17 nt, Human
ugacaaggcacuucaug

SEQ ID NO: 3683133 - RNA, 13 nt, Human
ugacaaggcccca

SEQ ID NO: 3683134 - RNA, 15 nt, Human
ugacaaggccccaga

SEQ ID NO: 3683135 - RNA, 22 nt, Human
ugacaaggccccagagacucag

SEQ ID NO: 3683136 - RNA, 16 nt, Human
ugacaaggucaaauuu

SEQ ID NO: 3683137 - RNA, 12 nt, Human
ugacaauaaaac

SEQ ID NO: 3683138 - RNA, 14 nt, Human
ugacaauaaaacau

SEQ ID NO: 3683139 - RNA, 14 nt, Human
ugacaauaaagcuu

SEQ ID NO: 3683140 - RNA, 13 nt, Human
ugacaauguugua

SEQ ID NO: 3683141 - RNA, 14 nt, Human
ugacaauguuguag

SEQ ID NO: 3683142 - RNA, 17 nt, Human
ugacaauucuguuuuua

SEQ ID NO: 3683143 - RNA, 14 nt, Human
ugacaauugggagc

SEQ ID NO: 3683144 - RNA, 22 nt, Human
ugacaauuuuguacaaauuugu

SEQ ID NO: 3683145 - RNA, 17 nt, Human
ugacacaaaaaaaguug

SEQ ID NO: 3683146 - RNA, 17 nt, Human
ugacacaaguggaccuu

SEQ ID NO: 3683147 - RNA, 19 nt, Human
ugacacaaguggaccuuag

SEQ ID NO: 3683148 - RNA, 15 nt, Human
ugacacacagcucug

SEQ ID NO: 3683149 - RNA, 18 nt, Human
ugacacacagcucugucc

SEQ ID NO: 3683150 - RNA, 19 nt, Human
ugacacacagcucuguccu

SEQ ID NO: 3683151 - RNA, 20 nt, Human
ugacacacuaaccaagcuga

SEQ ID NO: 3683152 - RNA, 18 nt, Human
ugacacagaaaauguuga

SEQ ID NO: 3683153 - RNA, 12 nt, Human
ugacacagacuc

SEQ ID NO: 3683154 - RNA, 17 nt, Human
ugacacagacucauccu

SEQ ID NO: 3683155 - RNA, 19 nt, Human
ugacacagacucauccuga

SEQ ID NO: 3683156 - RNA, 22 nt, Human
ugacacauaugcaccuuguguc

SEQ ID NO: 3683157 - RNA, 22 nt, Human
ugacacauggccccucccccug

SEQ ID NO: 3683158 - RNA, 22 nt, Human
ugacacauuacaagccuggaaa

SEQ ID NO: 3683159 - RNA, 14 nt, Human
ugacaccaaagcca

SEQ ID NO: 3683160 - RNA, 24 nt, Human
ugacaccagcuguucugucccuug

SEQ ID NO: 3683161 - RNA, 17 nt, Human
ugacaccaucuuuuauu

SEQ ID NO: 3683162 - RNA, 21 nt, Human
ugacaccaucuuuuauucuuu

SEQ ID NO: 3683163 - RNA, 19 nt, Human
ugacacccauguuucucug

SEQ ID NO: 3683164 - RNA, 17 nt, Human
ugacaccccacuuagcc

SEQ ID NO: 3683165 - RNA, 21 nt, Human
ugacacccgugagcgccugug

SEQ ID NO: 3683166 - RNA, 17 nt, Human
ugacaccucuuuuuucg

SEQ ID NO: 3683167 - RNA, 15 nt, Human
ugacaccugcugaga

SEQ ID NO: 3683168 - RNA, 18 nt, Human
ugacaccuuugcaggcau

SEQ ID NO: 3683169 - RNA, 19 nt, Human
ugacacgccuaaggucaca

SEQ ID NO: 3683170 - RNA, 18 nt, Human
ugacacuauaguuuaaaa

SEQ ID NO: 3683171 - RNA, 19 nt, Human
ugacacuauaucuguauau

SEQ ID NO: 3683172 - RNA, 22 nt, Human
ugacacuauaucuguauauaaa

SEQ ID NO: 3683173 - RNA, 16 nt, Human
ugacacucauauaauu

SEQ ID NO: 3683174 - RNA, 14 nt, Human
ugacacucccuugg

SEQ ID NO: 3683175 - RNA, 17 nt, Human
ugacacucuccuugcag

SEQ ID NO: 3683176 - RNA, 22 nt, Human
ugacacugaaaguuuuguaaaa

SEQ ID NO: 3683177 - RNA, 14 nt, Human
ugacacugaaaugc

SEQ ID NO: 3683178 - RNA, 18 nt, Human
ugacacugaaaugccuua

SEQ ID NO: 3683179 - RNA, 13 nt, Human
ugacacugagaac

SEQ ID NO: 3683180 - RNA, 20 nt, Human
ugacacugguauuccugccu

SEQ ID NO: 3683181 - RNA, 16 nt, Human
ugacacuucagagagc

SEQ ID NO: 3683182 - RNA, 19 nt, Human
ugacacuucagagagcugg

SEQ ID NO: 3683183 - RNA, 23 nt, Human
ugacacuucagagagcugguagu

SEQ ID NO: 3683184 - RNA, 24 nt, Human
ugacacuucagagagcugguaguu

SEQ ID NO: 3683185 - RNA, 15 nt, Human
ugacacuugucccca

SEQ ID NO: 3683186 - RNA, 14 nt, Human
ugacagaaaauaug

SEQ ID NO: 3683187 - RNA, 21 nt, Human
ugacagaacacugucuugaag

SEQ ID NO: 3683188 - RNA, 22 nt, Human
ugacagaauauguuucaaacuu

SEQ ID NO: 3683189 - RNA, 16 nt, Human
ugacagacacaggccc

SEQ ID NO: 3683190 - RNA, 15 nt, Human
ugacagacaggcucu

SEQ ID NO: 3683191 - RNA, 18 nt, Human
ugacagaccacaucuuua

SEQ ID NO: 3683192 - RNA, 22 nt, Human
ugacagaccacaucuuuaucug

SEQ ID NO: 3683193 - RNA, 14 nt, Human
ugacagacuccuga

SEQ ID NO: 3683194 - RNA, 19 nt, Human
ugacagacuccugaggaca

SEQ ID NO: 3683195 - RNA, 20 nt, Human
ugacagagagagauacucug

SEQ ID NO: 3683196 - RNA, 22 nt, Human
ugacagagcaagacucugucua

SEQ ID NO: 3683197 - RNA, 14 nt, Human
ugacagagccugcc

SEQ ID NO: 3683198 - RNA, 22 nt, Human
ugacagagccuucugaggacau

SEQ ID NO: 3683199 - RNA, 14 nt, Human
ugacagaggcagcc

SEQ ID NO: 3683200 - RNA, 17 nt, Human
ugacagaggcagcccca

SEQ ID NO: 3683201 - RNA, 14 nt, Human
ugacagagugagac

SEQ ID NO: 3683202 - RNA, 22 nt, Human
ugacagagugagacucugucuc

SEQ ID NO: 3683203 - RNA, 21 nt, Human
ugacagaucaagcugugagac

SEQ ID NO: 3683204 - RNA, 22 nt, Human
ugacagcuaggaugugcauucu

SEQ ID NO: 3683205 - RNA, 13 nt, Human
ugacagcuguccc

SEQ ID NO: 3683206 - RNA, 20 nt, Human
ugacagcugucccugucacc

SEQ ID NO: 3683207 - RNA, 13 nt, Human
ugacagcugugcu

SEQ ID NO: 3683208 - RNA, 14 nt, Human
ugacagcuuugcug

SEQ ID NO: 3683209 - RNA, 13 nt, Human
ugacaggcagcag

SEQ ID NO: 3683210 - RNA, 16 nt, Human
ugacaggcagcagaga

SEQ ID NO: 3683211 - RNA, 14 nt, Human
ugacaggccugucc

SEQ ID NO: 3683212 - RNA, 13 nt, Human
ugacagggaagcu

SEQ ID NO: 3683213 - RNA, 14 nt, Human
ugacagggaagcua

SEQ ID NO: 3683214 - RNA, 16 nt, Human
ugacagggaagcuaca

SEQ ID NO: 3683215 - RNA, 17 nt, Human
ugacagggaagcuacag

SEQ ID NO: 3683216 - RNA, 11 nt, Human
ugacagggcca

SEQ ID NO: 3683217 - RNA, 16 nt, Human
ugacagggccagugca

SEQ ID NO: 3683218 - RNA, 19 nt, Human
ugacagggccagugcaguu

SEQ ID NO: 3683219 - RNA, 17 nt, Human
ugacagguuugggaccc

SEQ ID NO: 3683220 - RNA, 22 nt, Human
ugacaguaacuugguuauacau

SEQ ID NO: 3683221 - RNA, 14 nt, Human
ugacaguaauugug

SEQ ID NO: 3683222 - RNA, 21 nt, Human
ugacaguaguaccaaaugcuu

SEQ ID NO: 3683223 - RNA, 21 nt, Human
ugacaguauuauacgcuggca

SEQ ID NO: 3683224 - RNA, 11 nt, Human
ugacagucauc

SEQ ID NO: 3683225 - RNA, 18 nt, Human
ugacagucaucaucaggg

SEQ ID NO: 3683226 - RNA, 22 nt, Human
ugacagucaucaucagggccug

SEQ ID NO: 3683227 - RNA, 23 nt, Human
ugacagucaucaucagggccugg

SEQ ID NO: 3683228 - RNA, 16 nt, Human
ugacagucaugcaguc

SEQ ID NO: 3683229 - RNA, 18 nt, Human
ugacaguccgucaaaaca

SEQ ID NO: 3683230 - RNA, 16 nt, Human
ugacaguccucuccac

SEQ ID NO: 3683231 - RNA, 18 nt, Human
ugacaguccucuccaccu

SEQ ID NO: 3683232 - RNA, 21 nt, Human
ugacagugccugggaauguau

SEQ ID NO: 3683233 - RNA, 18 nt, Human
ugacaguggaacuacauu

SEQ ID NO: 3683234 - RNA, 19 nt, Human
ugacaguguugaaaauguu

SEQ ID NO: 3683235 - RNA, 17 nt, Human
ugacauaacacuauaaa

SEQ ID NO: 3683236 - RNA, 21 nt, Human
ugacauaacacuauaaagguu

SEQ ID NO: 3683237 - RNA, 15 nt, Human
ugacauaccuuuuau

SEQ ID NO: 3683238 - RNA, 18 nt, Human
ugacauauacauacuuac

SEQ ID NO: 3683239 - RNA, 16 nt, Human
ugacauauuaugucuu

SEQ ID NO: 3683240 - RNA, 15 nt, Human
ugacauauuggcucu

SEQ ID NO: 3683241 - RNA, 14 nt, Human
ugacauauuuaaug

SEQ ID NO: 3683242 - RNA, 22 nt, Human
ugacauauuuaauguuuuaaau

SEQ ID NO: 3683243 - RNA, 15 nt, Human
ugacauauuuuugcu

SEQ ID NO: 3683244 - RNA, 14 nt, Human
ugacaucaaaaaag

SEQ ID NO: 3683245 - RNA, 23 nt, Human
ugacaucaacugcaucaagaugu

SEQ ID NO: 3683246 - RNA, 15 nt, Human
ugacaucacagcagc

SEQ ID NO: 3683247 - RNA, 16 nt, Human
ugacaucacuggcaug

SEQ ID NO: 3683248 - RNA, 17 nt, Human
ugacaucacuggcaugg

SEQ ID NO: 3683249 - RNA, 16 nt, Human
ugacaucacuuguaca

SEQ ID NO: 3683250 - RNA, 17 nt, Human
ugacaucacuuguacaa

SEQ ID NO: 3683251 - RNA, 22 nt, Human
ugacaucacuuguacaaaauaa

SEQ ID NO: 3683252 - RNA, 14 nt, Human
ugacaucagcauca

SEQ ID NO: 3683253 - RNA, 13 nt, Human
ugacaucagccag

SEQ ID NO: 3683254 - RNA, 14 nt, Human
ugacaucagccagc

SEQ ID NO: 3683255 - RNA, 18 nt, Human
ugacaucagguuuuuccc

SEQ ID NO: 3683256 - RNA, 18 nt, Human
ugacauccacaaaugcag

SEQ ID NO: 3683257 - RNA, 18 nt, Human
ugacaucucaggggccag

SEQ ID NO: 3683258 - RNA, 21 nt, Human
ugacaucucaggggccagagg

SEQ ID NO: 3683259 - RNA, 13 nt, Human
ugacaucucuuug

SEQ ID NO: 3683260 - RNA, 16 nt, Human
ugacaucuguguuuca

SEQ ID NO: 3683261 - RNA, 20 nt, Human
ugacaucuugaauccuucca

SEQ ID NO: 3683262 - RNA, 12 nt, Human
ugacaugaaaaa

SEQ ID NO: 3683263 - RNA, 17 nt, Human
ugacaugaauuuuagcu

SEQ ID NO: 3683264 - RNA, 22 nt, Human
ugacaugaauuuuagcuuuugu

SEQ ID NO: 3683265 - RNA, 14 nt, Human
ugacaugaucgcuu

SEQ ID NO: 3683266 - RNA, 15 nt, Human
ugacaugaucgcuuu

SEQ ID NO: 3683267 - RNA, 16 nt, Human
ugacaugauuccuucc

SEQ ID NO: 3683268 - RNA, 15 nt, Human
ugacaugcacugacc

SEQ ID NO: 3683269 - RNA, 21 nt, Human
ugacaugcacugacccuucca

SEQ ID NO: 3683270 - RNA, 16 nt, Human
ugacaugcccucccuu

SEQ ID NO: 3683271 - RNA, 17 nt, Human
ugacaugcgggcugggc

SEQ ID NO: 3683272 - RNA, 22 nt, Human
ugacaugcgggcugggcagcug

SEQ ID NO: 3683273 - RNA, 16 nt, Human
ugacauggugccugag

SEQ ID NO: 3683274 - RNA, 18 nt, Human
ugacauggugccugagag

SEQ ID NO: 3683275 - RNA, 13 nt, Human
ugacauguaacag

SEQ ID NO: 3683276 - RNA, 13 nt, Human
ugacauguacaga

SEQ ID NO: 3683277 - RNA, 17 nt, Human
ugacauguccuucugag

SEQ ID NO: 3683278 - RNA, 12 nt, Human
ugacaugugaaa

SEQ ID NO: 3683279 - RNA, 13 nt, Human
ugacaugugaaac

SEQ ID NO: 3683280 - RNA, 19 nt, Human
ugacaugugaaaccuuuuu

SEQ ID NO: 3683281 - RNA, 21 nt, Human
ugacaugugaaaccuuuuuua

SEQ ID NO: 3683282 - RNA, 16 nt, Human
ugacaugugacuccua

SEQ ID NO: 3683283 - RNA, 17 nt, Human
ugacauguggaaaguga

SEQ ID NO: 3683284 - RNA, 22 nt, Human
ugacauguggaaagugaauuug

SEQ ID NO: 3683285 - RNA, 17 nt, Human
ugacauguggggccagg

SEQ ID NO: 3683286 - RNA, 18 nt, Human
ugacauguuauauauuuu

SEQ ID NO: 3683287 - RNA, 13 nt, Human
ugacauuaacagu

SEQ ID NO: 3683288 - RNA, 19 nt, Human
ugacauuaacaguuuucca

SEQ ID NO: 3683289 - RNA, 15 nt, Human
ugacauuaagaaugu

SEQ ID NO: 3683290 - RNA, 21 nt, Human
ugacauuaagaauguugguuu

SEQ ID NO: 3683291 - RNA, 15 nt, Human
ugacauuauagacau

SEQ ID NO: 3683292 - RNA, 12 nt, Human
ugacauucaccu

SEQ ID NO: 3683293 - RNA, 15 nt, Human
ugacauucaccugcc

SEQ ID NO: 3683294 - RNA, 15 nt, Human
ugacauucaugccug

SEQ ID NO: 3683295 - RNA, 20 nt, Human
ugacauuccuaaacuaucuu

SEQ ID NO: 3683296 - RNA, 15 nt, Human
ugacauucugaaugc

SEQ ID NO: 3683297 - RNA, 18 nt, Human
ucuguacgucugacaggc

SEQ ID NO: 3683298 - RNA, 23 nt, Human
ucuguacugauucaauuugaugu

SEQ ID NO: 3683299 - RNA, 12 nt, Human
ucuguacuuggu

SEQ ID NO: 3683300 - RNA, 13 nt, Human
ucuguacuuuuug

SEQ ID NO: 3683301 - RNA, 21 nt, Human
ucuguagaaaugguuguauua

SEQ ID NO: 3683302 - RNA, 20 nt, Human
ucuguagagggcccuggugu

SEQ ID NO: 3683303 - RNA, 20 nt, Human
ucuguagcuauaaugagcau

SEQ ID NO: 3683304 - RNA, 23 nt, Human
ucuguagcuccucaacucaccua

SEQ ID NO: 3683305 - RNA, 16 nt, Human
ucuguagguuaaaaaa

SEQ ID NO: 3683306 - RNA, 23 nt, Human
ucuguagguugcacacuuuggua

SEQ ID NO: 3683307 - RNA, 16 nt, Human
ucuguauaaguaagaa

SEQ ID NO: 3683308 - RNA, 15 nt, Human
ucuguauauaaaaua

SEQ ID NO: 3683309 - RNA, 22 nt, Human
ucuguauauaaaauauuuucau

SEQ ID NO: 3683310 - RNA, 16 nt, Human
ucuguauauuuuggga

SEQ ID NO: 3683311 - RNA, 17 nt, Human
ucuguaucacucugugu

SEQ ID NO: 3683312 - RNA, 18 nt, Human
ucuguaucggagacagug

SEQ ID NO: 3683313 - RNA, 19 nt, Human
ucuguaucggagacaguga

SEQ ID NO: 3683314 - RNA, 12 nt, Human
ucuguaucucuc

SEQ ID NO: 3683315 - RNA, 14 nt, Human
ucuguaucuuuucu

SEQ ID NO: 3683316 - RNA, 14 nt, Human
ucuguaugauucua

SEQ ID NO: 3683317 - RNA, 17 nt, Human
ucuguauguauuaguga

SEQ ID NO: 3683318 - RNA, 17 nt, Human
ucuguauugugcugauu

SEQ ID NO: 3683319 - RNA, 15 nt, Human
ucuguauuuaauuuu

SEQ ID NO: 3683320 - RNA, 13 nt, Human
ucuguauuucaug

SEQ ID NO: 3683321 - RNA, 23 nt, Human
ucuguauuuccccaacauguaau

SEQ ID NO: 3683322 - RNA, 15 nt, Human
ucuguauuugaaagu

SEQ ID NO: 3683323 - RNA, 18 nt, Human
ucuguauuugaaagugcc

SEQ ID NO: 3683324 - RNA, 22 nt, Human
ucuguauuugaaagugccuuug

SEQ ID NO: 3683325 - RNA, 23 nt, Human
ucuguauuuuauuuagacaagag

SEQ ID NO: 3683326 - RNA, 21 nt, Human
ucuguauuuuuucuugcauug

SEQ ID NO: 3683327 - RNA, 16 nt, Human
ucugucaaaacacugu

SEQ ID NO: 3683328 - RNA, 15 nt, Human
ucugucaaagucaga

SEQ ID NO: 3683329 - RNA, 17 nt, Human
ucugucaagaguaguua

SEQ ID NO: 3683330 - RNA, 20 nt, Human
ucugucaagaguaguuauau

SEQ ID NO: 3683331 - RNA, 20 nt, Human
ucugucacaguaaaaauaaa

SEQ ID NO: 3683332 - RNA, 19 nt, Human
ucugucaccaauugguuaa

SEQ ID NO: 3683333 - RNA, 18 nt, Human
ucugucagaugagaacaa

SEQ ID NO: 3683334 - RNA, 20 nt, Human
ucugucauuugagcagggcu

SEQ ID NO: 3683335 - RNA, 23 nt, Human
ucuguccaaaggaggcuggcagg

SEQ ID NO: 3683336 - RNA, 18 nt, Human
ucuguccaacugagaagu

SEQ ID NO: 3683337 - RNA, 19 nt, Human
ucuguccaacugagaagua

SEQ ID NO: 3683338 - RNA, 12 nt, Human
ucuguccaagga

SEQ ID NO: 3683339 - RNA, 14 nt, Human
ucuguccaccagcc

SEQ ID NO: 3683340 - RNA, 13 nt, Human
ucuguccaucugc

SEQ ID NO: 3683341 - RNA, 14 nt, Human
ucuguccaucugcc

SEQ ID NO: 3683342 - RNA, 19 nt, Human
ucuguccauuuauccacag

SEQ ID NO: 3683343 - RNA, 13 nt, Human
ucugucccagguu

SEQ ID NO: 3683344 - RNA, 19 nt, Human
ucugucccauucccuggga

SEQ ID NO: 3683345 - RNA, 24 nt, Human
ucugucccauucccugggaucugg

SEQ ID NO: 3683346 - RNA, 15 nt, Human
ucuguccccagccug

SEQ ID NO: 3683347 - RNA, 23 nt, Human
ucugucccccuuuagaucucuga

SEQ ID NO: 3683348 - RNA, 15 nt, Human
ucuguccccuucucu

SEQ ID NO: 3683349 - RNA, 15 nt, Human
ucugucccucacagc

SEQ ID NO: 3683350 - RNA, 23 nt, Human
ucugucccugagagugucucuga

SEQ ID NO: 3683351 - RNA, 23 nt, Human
ucugucccuucugucccucacag

SEQ ID NO: 3683352 - RNA, 14 nt, Human
ucugucccuugcug

SEQ ID NO: 3683353 - RNA, 17 nt, Human
ucugucccuugcuguau

SEQ ID NO: 3683354 - RNA, 15 nt, Human
ucuguccuacucugu

SEQ ID NO: 3683355 - RNA, 19 nt, Human
ucuguccuacucuguguca

SEQ ID NO: 3683356 - RNA, 15 nt, Human
ucuguccucagccuu

SEQ ID NO: 3683357 - RNA, 10 nt, Human
ucuguccuga

SEQ ID NO: 3683358 - RNA, 16 nt, Human
ucuguccugcuucuga

SEQ ID NO: 3683359 - RNA, 12 nt, Human
ucuguccuggga

SEQ ID NO: 3683360 - RNA, 14 nt, Human
ucuguccugguguc

SEQ ID NO: 3683361 - RNA, 21 nt, Human
ucuguccugugagguuuccca

SEQ ID NO: 3683362 - RNA, 16 nt, Human
ucugucgcccagucug

SEQ ID NO: 3683363 - RNA, 18 nt, Human
ucugucgccuuagcaugu

SEQ ID NO: 3683364 - RNA, 15 nt, Human
ucugucuaaaaaaca

SEQ ID NO: 3683365 - RNA, 22 nt, Human
ucugucuacaaauauaagauuu

SEQ ID NO: 3683366 - RNA, 14 nt, Human
ucugucuaccaucu

SEQ ID NO: 3683367 - RNA, 18 nt, Human
ucugucuaccaucucccu

SEQ ID NO: 3683368 - RNA, 22 nt, Human
ucugucucagacuuuuguacau

SEQ ID NO: 3683369 - RNA, 17 nt, Human
ucugucucauccaucau

SEQ ID NO: 3683370 - RNA, 17 nt, Human
ucugucucauccuccug

SEQ ID NO: 3683371 - RNA, 14 nt, Human
ucugucuccuuaac

SEQ ID NO: 3683372 - RNA, 19 nt, Human
ucugucuccuuaacacuga

SEQ ID NO: 3683373 - RNA, 21 nt, Human
ucugucucgagcgcccugcag

SEQ ID NO: 3683374 - RNA, 22 nt, Human
ucugucucgagcgcccugcaga

SEQ ID NO: 3683375 - RNA, 12 nt, Human
ucugucucucuc

SEQ ID NO: 3683376 - RNA, 12 nt, Human
ucugucucugcc

SEQ ID NO: 3683377 - RNA, 22 nt, Human
ucugucucuggauuauauuaug

SEQ ID NO: 3683378 - RNA, 21 nt, Human
ucugucugccaaccuaaaacu

SEQ ID NO: 3683379 - RNA, 22 nt, Human
ucugucugcuggucacuucuuc

SEQ ID NO: 3683380 - RNA, 12 nt, Human
ucugucuggcac

SEQ ID NO: 3683381 - RNA, 13 nt, Human
ucugucugguggc

SEQ ID NO: 3683382 - RNA, 15 nt, Human
ucugucugucugucc

SEQ ID NO: 3683383 - RNA, 15 nt, Human
ucugucuucacaaca

SEQ ID NO: 3683384 - RNA, 14 nt, Human
ucugucuucacagc

SEQ ID NO: 3683385 - RNA, 14 nt, Human
ucugucuucuggac

SEQ ID NO: 3683386 - RNA, 19 nt, Human
ucugucuuggcuuucaugu

SEQ ID NO: 3683387 - RNA, 14 nt, Human
ucugucuuuccuga

SEQ ID NO: 3683388 - RNA, 21 nt, Human
ucugucuuuccugaaccaugu

SEQ ID NO: 3683389 - RNA, 18 nt, Human
ucugucuuuuaaacucug

SEQ ID NO: 3683390 - RNA, 16 nt, Human
ucugugaaauaucauc

SEQ ID NO: 3683391 - RNA, 17 nt, Human
ucugugaaaugcuggca

SEQ ID NO: 3683392 - RNA, 17 nt, Human
ucugugaacgauuuaga

SEQ ID NO: 3683393 - RNA, 14 nt, Human
ucugugaagagcaa

SEQ ID NO: 3683394 - RNA, 19 nt, Human
ucugugaagugagaccuuc

SEQ ID NO: 3683395 - RNA, 16 nt, Human
ucugugaccaaugucu

SEQ ID NO: 3683396 - RNA, 18 nt, Human
ucugugaccaaugucuug

SEQ ID NO: 3683397 - RNA, 19 nt, Human
ucugugaccaaugucuuga

SEQ ID NO: 3683398 - RNA, 16 nt, Human
ucugugaccucaggca

SEQ ID NO: 3683399 - RNA, 16 nt, Human
ucugugaccugcaucu

SEQ ID NO: 3683400 - RNA, 19 nt, Human
ucugugagaagguuuauug

SEQ ID NO: 3683401 - RNA, 20 nt, Human
ucugugaggaaagcacacag

SEQ ID NO: 3683402 - RNA, 20 nt, Human
ucugugaucuuuuaaagugu

SEQ ID NO: 3683403 - RNA, 17 nt, Human
ucugugaugacauuccc

SEQ ID NO: 3683404 - RNA, 20 nt, Human
ucugugaugacauucccugc

SEQ ID NO: 3683405 - RNA, 16 nt, Human
ucugugcaccugggcu

SEQ ID NO: 3683406 - RNA, 19 nt, Human
ucugugcacgcaguggccu

SEQ ID NO: 3683407 - RNA, 19 nt, Human
ucugugcaugguggcacca

SEQ ID NO: 3683408 - RNA, 22 nt, Human
ucugugcaugguggcaccagcg

SEQ ID NO: 3683409 - RNA, 13 nt, Human
ucugugccagagc

SEQ ID NO: 3683410 - RNA, 19 nt, Human
ucugugccagagccugggg

SEQ ID NO: 3683411 - RNA, 20 nt, Human
ucugugccagagccuggggc

SEQ ID NO: 3683412 - RNA, 22 nt, Human
ucugugccagagccuggggcuc

SEQ ID NO: 3683413 - RNA, 12 nt, Human
ucugugcccagc

SEQ ID NO: 3683414 - RNA, 13 nt, Human
ucugugcccagcu

SEQ ID NO: 3683415 - RNA, 19 nt, Human
ucugugcccagcucagucu

SEQ ID NO: 3683416 - RNA, 15 nt, Human
ucugugcccaugggc

SEQ ID NO: 3683417 - RNA, 20 nt, Human
ucugugcccaugggcacugc

SEQ ID NO: 3683418 - RNA, 15 nt, Human
ucugugccccaugcc

SEQ ID NO: 3683419 - RNA, 22 nt, Human
ucugugccccaugccuguccag

SEQ ID NO: 3683420 - RNA, 15 nt, Human
ucugugccuggagcu

SEQ ID NO: 3683421 - RNA, 16 nt, Human
ucugugccuucgucuu

SEQ ID NO: 3683422 - RNA, 18 nt, Human
ucugugccuucuuuugau

SEQ ID NO: 3683423 - RNA, 17 nt, Human
ucugugccuuguuuuuu

SEQ ID NO: 3683424 - RNA, 18 nt, Human
ucugugcuguuucaaagu

SEQ ID NO: 3683425 - RNA, 16 nt, Human
ucugugcuuuccagcu

SEQ ID NO: 3683426 - RNA, 21 nt, Human
ucugugcuuuccagcucaccc

SEQ ID NO: 3683427 - RNA, 20 nt, Human
ucuguggaaaguguaaagca

SEQ ID NO: 3683428 - RNA, 19 nt, Human
ucuguggacugaccuugua

SEQ ID NO: 3683429 - RNA, 19 nt, Human
ucuguggagguggaaaagc

SEQ ID NO: 3683430 - RNA, 18 nt, Human
ucuguggauggucauugc

SEQ ID NO: 3683431 - RNA, 22 nt, Human
ucuguggccuuguucucucuau

SEQ ID NO: 3683432 - RNA, 12 nt, Human
ucugugggcugc

SEQ ID NO: 3683433 - RNA, 16 nt, Human
ucugugggcugcacuc

SEQ ID NO: 3683434 - RNA, 17 nt, Human
ucugugguuccucugcu

SEQ ID NO: 3683435 - RNA, 19 nt, Human
ucugugguuccucugcuca

SEQ ID NO: 3683436 - RNA, 20 nt, Human
ucugugguuccucugcucac

SEQ ID NO: 3683437 - RNA, 14 nt, Human
ucugugguuggcug

SEQ ID NO: 3683438 - RNA, 20 nt, Human
ucugugguuggcugggaaau

SEQ ID NO: 3683439 - RNA, 14 nt, Human
ucuguguacaaaga

SEQ ID NO: 3683440 - RNA, 14 nt, Human
ucuguguauauuau

SEQ ID NO: 3683441 - RNA, 19 nt, Human
ucuguguauauuauuuggc

SEQ ID NO: 3683442 - RNA, 18 nt, Human
ucuguguauuuucaguca

SEQ ID NO: 3683443 - RNA, 22 nt, Human
ucugugucagguggggcagcuu

SEQ ID NO: 3683444 - RNA, 11 nt, Human
ucuguguccuu

SEQ ID NO: 3683445 - RNA, 15 nt, Human
ucuguguccuucccu

SEQ ID NO: 3683446 - RNA, 18 nt, Human
ucuguguccuucccugca

SEQ ID NO: 3683447 - RNA, 14 nt, Human
ucugugucuaagau

SEQ ID NO: 3683448 - RNA, 15 nt, Human
ucugugucuguguuu

SEQ ID NO: 3683449 - RNA, 19 nt, Human
ucugugugaaacuuucauu

SEQ ID NO: 3683450 - RNA, 13 nt, Human
ucugugugaaugu

SEQ ID NO: 3683451 - RNA, 14 nt, Human
ucugugugaaugug

SEQ ID NO: 3683452 - RNA, 14 nt, Human
ucugugugcacaaa

SEQ ID NO: 3683453 - RNA, 22 nt, Human
ucugugugcaccuuaccaacuu

SEQ ID NO: 3683454 - RNA, 13 nt, Human
ucugugugucagu

SEQ ID NO: 3683455 - RNA, 19 nt, Human
ucugugugugaccccuccu

SEQ ID NO: 3683456 - RNA, 22 nt, Human
ucugugugugaccccuccuggg

SEQ ID NO: 3683457 - RNA, 23 nt, Human
ucugugugugaccccuccugggg

SEQ ID NO: 3683458 - RNA, 13 nt, Human
ucugugugugugu

SEQ ID NO: 3683459 - RNA, 13 nt, Human
ucuguguguuccu

SEQ ID NO: 3683460 - RNA, 16 nt, Human
ucuguguugccaagcu

SEQ ID NO: 3683461 - RNA, 23 nt, Human
ucuguguuggcccaagcucuugu

SEQ ID NO: 3683462 - RNA, 23 nt, Human
ucuguguuuaauuucuucaaaau

SEQ ID NO: 3683463 - RNA, 12 nt, Human
ucuguguuuauu

SEQ ID NO: 3683464 - RNA, 16 nt, Human
ucuguguuuuugaaau

SEQ ID NO: 3683465 - RNA, 13 nt, Human
ucuguuaaaaugc

SEQ ID NO: 3683466 - RNA, 15 nt, Human
ucuguuaaaaugcau

SEQ ID NO: 3683467 - RNA, 16 nt, Human
ucuguuaacugaauac

SEQ ID NO: 3683468 - RNA, 17 nt, Human
ucuguuaagugguuuca

SEQ ID NO: 3683469 - RNA, 16 nt, Human
ucuguuacaaaaugua

SEQ ID NO: 3683470 - RNA, 22 nt, Human
ucuguuacaaaauguaacuguu

SEQ ID NO: 3683471 - RNA, 21 nt, Human
ucuguuaccaugucacugugg

SEQ ID NO: 3683472 - RNA, 17 nt, Human
ucuguuaugcugugaca

SEQ ID NO: 3683473 - RNA, 14 nt, Human
ucuguuauguacug

SEQ ID NO: 3683474 - RNA, 17 nt, Human
ucuguuauguacuguac

SEQ ID NO: 3683475 - RNA, 16 nt, Human
ucuguucaaggaauca

SEQ ID NO: 3683476 - RNA, 13 nt, Human
ucuguucaccuuc

SEQ ID NO: 3683477 - RNA, 19 nt, Human
ucuguucacuuuuccuccc

SEQ ID NO: 3683478 - RNA, 14 nt, Human
ucuguucagcguuu

SEQ ID NO: 3683479 - RNA, 19 nt, Human
ucuguucagcguuuugcaa

SEQ ID NO: 3683480 - RNA, 22 nt, Human
ucuguucaguaacagggccuug

SEQ ID NO: 3683481 - RNA, 16 nt, Human
ucuguucaguguaaau

SEQ ID NO: 3683482 - RNA, 17 nt, Human
ucuguucauuccuccag

SEQ ID NO: 3683483 - RNA, 12 nt, Human
ucuguuccaaau

SEQ ID NO: 3683484 - RNA, 14 nt, Human
ucuguuccaaauuc

SEQ ID NO: 3683485 - RNA, 19 nt, Human
ucuguuccaaauucaguuu

SEQ ID NO: 3683486 - RNA, 18 nt, Human
ucuguucccccuucacaa

SEQ ID NO: 3683487 - RNA, 23 nt, Human
ucuguuccuggcucagccucaaa

SEQ ID NO: 3683488 - RNA, 13 nt, Human
ucuguuccuucac

SEQ ID NO: 3683489 - RNA, 14 nt, Human
ucuguucuacccgu

SEQ ID NO: 3683490 - RNA, 18 nt, Human
ucuguucugcacacagca

SEQ ID NO: 3683491 - RNA, 15 nt, Human
ucuguucuguggaaa

SEQ ID NO: 3683492 - RNA, 16 nt, Human
ucuguucuguggaaag

SEQ ID NO: 3683493 - RNA, 22 nt, Human
ucuguucuguggaaaguguaaa

SEQ ID NO: 3683494 - RNA, 16 nt, Human
ucuguucuguuucaag

SEQ ID NO: 3683495 - RNA, 18 nt, Human
ucuguucuuccucagcca

SEQ ID NO: 3683496 - RNA, 13 nt, Human
ucuguucuugaag

SEQ ID NO: 3683497 - RNA, 18 nt, Human
ucuguucuuuaauuuauu

SEQ ID NO: 3683498 - RNA, 17 nt, Human
ucuguucuuuugacuua

SEQ ID NO: 3683499 - RNA, 18 nt, Human
ucuguugcaagccccucu

SEQ ID NO: 3683500 - RNA, 15 nt, Human
ucuguugcaauuagg

SEQ ID NO: 3683501 - RNA, 16 nt, Human
ucuguugcaauuagga

SEQ ID NO: 3683502 - RNA, 18 nt, Human
ucuguugccacaacccug

SEQ ID NO: 3683503 - RNA, 16 nt, Human
ucuguuggauuccaug

SEQ ID NO: 3683504 - RNA, 20 nt, Human
ucuguuggcaggcuggccag

SEQ ID NO: 3683505 - RNA, 20 nt, Human
ucuguuggccagugugacaa

SEQ ID NO: 3683506 - RNA, 13 nt, Human
ucuguuguaacuu

SEQ ID NO: 3683507 - RNA, 16 nt, Human
ucuguuguauucauug

SEQ ID NO: 3683508 - RNA, 17 nt, Human
ucuguuguccuccccuu

SEQ ID NO: 3683509 - RNA, 14 nt, Human
ucuguuguguguca

SEQ ID NO: 3683510 - RNA, 19 nt, Human
ucuguuuaagaaaaguauu

SEQ ID NO: 3683511 - RNA, 15 nt, Human
ucuguuuaauacuca

SEQ ID NO: 3683512 - RNA, 20 nt, Human
ucuguuuacaucaguuuuaa

SEQ ID NO: 3683513 - RNA, 13 nt, Human
ucuguuuagauaa

SEQ ID NO: 3683514 - RNA, 19 nt, Human
ucuguuuagauaauacacc

SEQ ID NO: 3683515 - RNA, 23 nt, Human
ucuguuuagauaauacaccacua

SEQ ID NO: 3683516 - RNA, 16 nt, Human
ucuguuuaugcuuuug

SEQ ID NO: 3683517 - RNA, 20 nt, Human
ucuguuuccugacauugucu

SEQ ID NO: 3683518 - RNA, 12 nt, Human
ucuguuuccugu

SEQ ID NO: 3683519 - RNA, 13 nt, Human
ucuguuuccuuuu

SEQ ID NO: 3683520 - RNA, 12 nt, Human
ucuguuucuagu

SEQ ID NO: 3683521 - RNA, 22 nt, Human
ucuguuucuauucucuccucag

SEQ ID NO: 3683522 - RNA, 13 nt, Human
ucuguuugauucu

SEQ ID NO: 3683523 - RNA, 14 nt, Human
ucuguuugauucuu

SEQ ID NO: 3683524 - RNA, 21 nt, Human
ucuguuuguuaaaacuggcau

SEQ ID NO: 3683525 - RNA, 13 nt, Human
ucuguuuguuauu

SEQ ID NO: 3683526 - RNA, 13 nt, Human
ucuguuuguuuca

SEQ ID NO: 3683527 - RNA, 13 nt, Human
ucuguuuuacugc

SEQ ID NO: 3683528 - RNA, 18 nt, Human
ucuguuuuagguuaaaaa

SEQ ID NO: 3683529 - RNA, 22 nt, Human
ucuguuuucaaucucguauaga

SEQ ID NO: 3683530 - RNA, 23 nt, Human
ucuguuuucuuucuaaugagaua

SEQ ID NO: 3683531 - RNA, 13 nt, Human
ucuguuuuguaaa

SEQ ID NO: 3683532 - RNA, 15 nt, Human
ucuguuuuguaaagu

SEQ ID NO: 3683533 - RNA, 20 nt, Human
ucuguuuugugguuuggaau

SEQ ID NO: 3683534 - RNA, 13 nt, Human
ucuguuuugugua

SEQ ID NO: 3683535 - RNA, 15 nt, Human
ucuguuuuuaaaaau

SEQ ID NO: 3683536 - RNA, 19 nt, Human
ucuguuuuuaaugcuauuu

SEQ ID NO: 3683537 - RNA, 18 nt, Human
ucuguuuuucuaacuggg

SEQ ID NO: 3683538 - RNA, 14 nt, Human
ucuguuuuucuuuu

SEQ ID NO: 3683539 - RNA, 22 nt, Human
ucuuaaaaaguuauaaccaacu

SEQ ID NO: 3683540 - RNA, 16 nt, Human
ucuuaaaaaguuguuc

SEQ ID NO: 3683541 - RNA, 20 nt, Human
ucuuaaaaauguuuuuucau

SEQ ID NO: 3683542 - RNA, 20 nt, Human
ucuuaaaacauuaugaguuu

SEQ ID NO: 3683543 - RNA, 19 nt, Human
ucuuaaaauauauuucaga

SEQ ID NO: 3683544 - RNA, 15 nt, Human
ucuuaaaaugcaaua

SEQ ID NO: 3683545 - RNA, 23 nt, Human
ucuuaaaauggcaaguuuuccau

SEQ ID NO: 3683546 - RNA, 16 nt, Human
ucuuaaaccuucaguu

SEQ ID NO: 3683547 - RNA, 12 nt, Human
ucuuaaacuaaa

SEQ ID NO: 3683548 - RNA, 14 nt, Human
ucuuaaacuuguga

SEQ ID NO: 3683549 - RNA, 16 nt, Human
ucuuaaagaaacagcu

SEQ ID NO: 3683550 - RNA, 19 nt, Human
ucuuaaagcugccuguagu

SEQ ID NO: 3683551 - RNA, 20 nt, Human
ucuuaaagcugccuguaguu

SEQ ID NO: 3683552 - RNA, 18 nt, Human
ucuuaaagugcaguucuu

SEQ ID NO: 3683553 - RNA, 14 nt, Human
ucuuaaaguugaau

SEQ ID NO: 3683554 - RNA, 16 nt, Human
ucuuaaaguugaauuu

SEQ ID NO: 3683555 - RNA, 15 nt, Human
ucuuaaauaaaagaa

SEQ ID NO: 3683556 - RNA, 19 nt, Human
ucuuaaauaaaagaaaugc

SEQ ID NO: 3683557 - RNA, 15 nt, Human
ucuuaaauaagaaac

SEQ ID NO: 3683558 - RNA, 15 nt, Human
ucuuaaauaauaaag

SEQ ID NO: 3683559 - RNA, 13 nt, Human
ucuuaaauaucuu

SEQ ID NO: 3683560 - RNA, 14 nt, Human
ucuuaaauaucuuu

SEQ ID NO: 3683561 - RNA, 15 nt, Human
ucuuaaauaucuuuu

SEQ ID NO: 3683562 - RNA, 17 nt, Human
ucuuaaauaucuuuuau

SEQ ID NO: 3683563 - RNA, 22 nt, Human
ucuuaaauauguggaguucauc

SEQ ID NO: 3683564 - RNA, 17 nt, Human
ucuuaaccagaucauug

SEQ ID NO: 3683565 - RNA, 22 nt, Human
ucuuaacguuagaccacaaaua

SEQ ID NO: 3683566 - RNA, 12 nt, Human
ucuuaacucuuu

SEQ ID NO: 3683567 - RNA, 16 nt, Human
ucuuaacuucuugcuu

SEQ ID NO: 3683568 - RNA, 24 nt, Human
ucuuaagacagcauguguuaaucu

SEQ ID NO: 3683569 - RNA, 23 nt, Human
ucuuaagaccaccucaaauuuaa

SEQ ID NO: 3683570 - RNA, 12 nt, Human
ucuuaagccauc

SEQ ID NO: 3683571 - RNA, 13 nt, Human
ucuuaagccaucu

SEQ ID NO: 3683572 - RNA, 23 nt, Human
ucuuaagccaucuugguaaauuu

SEQ ID NO: 3683573 - RNA, 18 nt, Human
ucuuaagccuaaaugccu

SEQ ID NO: 3683574 - RNA, 12 nt, Human
ucuuaagcuucc

SEQ ID NO: 3683575 - RNA, 16 nt, Human
ucuuaaggacaaagug

SEQ ID NO: 3683576 - RNA, 23 nt, Human
ucuuaaggauugugauauuuuua

SEQ ID NO: 3683577 - RNA, 22 nt, Human
ucuuaauacuguuauucuuugc

SEQ ID NO: 3683578 - RNA, 15 nt, Human
ucuuaauauaaauuc

SEQ ID NO: 3683579 - RNA, 21 nt, Human
ucuuaauauaaauucacuuuc

SEQ ID NO: 3683580 - RNA, 15 nt, Human
ucuuaauauauuuga

SEQ ID NO: 3683581 - RNA, 14 nt, Human
ucuuaauauucugg

SEQ ID NO: 3683582 - RNA, 22 nt, Human
ucuuaauauuuuuacaugcaga

SEQ ID NO: 3683583 - RNA, 14 nt, Human
ucuuaauccagucu

SEQ ID NO: 3683584 - RNA, 17 nt, Human
ucuuaaucuuuucacaa

SEQ ID NO: 3683585 - RNA, 20 nt, Human
ucuuaaucuuuucacaaaua

SEQ ID NO: 3683586 - RNA, 21 nt, Human
ucuuaaucuuuucacaaauaa

SEQ ID NO: 3683587 - RNA, 22 nt, Human
ucuuaaucuuuucacaaauaaa

SEQ ID NO: 3683588 - RNA, 15 nt, Human
ucuuaaugaaguuug

SEQ ID NO: 3683589 - RNA, 16 nt, Human
ucuuaaugaaguuuga

SEQ ID NO: 3683590 - RNA, 20 nt, Human
ucuuaaugaaguuugaaugu

SEQ ID NO: 3683591 - RNA, 21 nt, Human
ucuuaaugaaguuugaauguu

SEQ ID NO: 3683592 - RNA, 23 nt, Human
ucuuaaugaaguuugaauguuaa

SEQ ID NO: 3683593 - RNA, 13 nt, Human
ucuuaauguacau

SEQ ID NO: 3683594 - RNA, 13 nt, Human
ucuuaauuaagua

SEQ ID NO: 3683595 - RNA, 18 nt, Human
ucuuaauuaaguaaacua

SEQ ID NO: 3683596 - RNA, 19 nt, Human
ucuuaauuaaguaaacuaa

SEQ ID NO: 3683597 - RNA, 20 nt, Human
ucuuaauuaaguaaacuaau

SEQ ID NO: 3683598 - RNA, 16 nt, Human
ucuugaacuccuggcc

SEQ ID NO: 3683599 - RNA, 18 nt, Human
ucuugaacugagcuugga

SEQ ID NO: 3683600 - RNA, 13 nt, Human
ucuugaagacuuu

SEQ ID NO: 3683601 - RNA, 18 nt, Human
ucuugaaggaaaaauuca

SEQ ID NO: 3683602 - RNA, 22 nt, Human
ucuugaaggaaaaauucaauag

SEQ ID NO: 3683603 - RNA, 16 nt, Human
ucuugaaguccuggcu

SEQ ID NO: 3683604 - RNA, 18 nt, Human
ucuugaaguccuggcuuc

SEQ ID NO: 3683605 - RNA, 22 nt, Human
ucuugaaguccuggcuucaggc

SEQ ID NO: 3683606 - RNA, 18 nt, Human
ucuugaauacucugcccu

SEQ ID NO: 3683607 - RNA, 15 nt, Human
ucuugaauauaaaaa

SEQ ID NO: 3683608 - RNA, 13 nt, Human
ucuugaaucccau

SEQ ID NO: 3683609 - RNA, 14 nt, Human
ucuugaaugucuuu

SEQ ID NO: 3683610 - RNA, 22 nt, Human
ucuugaauguugaagaacucau

SEQ ID NO: 3683611 - RNA, 17 nt, Human
ucuugaauuguaaggaa

SEQ ID NO: 3683612 - RNA, 18 nt, Human
ucuugaauuucuaaaaaa

SEQ ID NO: 3683613 - RNA, 19 nt, Human
ucuugaccaagcaggaagc

SEQ ID NO: 3683614 - RNA, 18 nt, Human
ucuugacccugcacccuc

SEQ ID NO: 3683615 - RNA, 15 nt, Human
ucuugacucuugccu

SEQ ID NO: 3683616 - RNA, 16 nt, Human
ucuugagaugucuucu

SEQ ID NO: 3683617 - RNA, 16 nt, Human
ucuugagccuugaacu

SEQ ID NO: 3683618 - RNA, 17 nt, Human
ucuugagccuugaacuu

SEQ ID NO: 3683619 - RNA, 17 nt, Human
ucuugagcuggccucuc

SEQ ID NO: 3683620 - RNA, 21 nt, Human
ucuugagcuggccucucuagc

SEQ ID NO: 3683621 - RNA, 14 nt, Human
ucuugagggagcuu

SEQ ID NO: 3683622 - RNA, 15 nt, Human
ucuugaggggaccag

SEQ ID NO: 3683623 - RNA, 17 nt, Human
ucuugaggggaccagga

SEQ ID NO: 3683624 - RNA, 19 nt, Human
ucuugaggggaccaggagu

SEQ ID NO: 3683625 - RNA, 23 nt, Human
ucuugaggugguaguaaaacaca

SEQ ID NO: 3683626 - RNA, 20 nt, Human
ucuugaguuguuuuuguaua

SEQ ID NO: 3683627 - RNA, 21 nt, Human
ucuugaguuguuuuuguauau

SEQ ID NO: 3683628 - RNA, 20 nt, Human
ucuugaguuugucgcucaug

SEQ ID NO: 3683629 - RNA, 22 nt, Human
ucuugaguuugucgcucaugug

SEQ ID NO: 3683630 - RNA, 21 nt, Human
ucuugaguuuuguuuuaaaau

SEQ ID NO: 3683631 - RNA, 22 nt, Human
ucuugauaagaccaccaccuca

SEQ ID NO: 3683632 - RNA, 18 nt, Human
ucuugaucaacaucuuuu

SEQ ID NO: 3683633 - RNA, 17 nt, Human
ucuugaucaguaguuug

SEQ ID NO: 3683634 - RNA, 23 nt, Human
ucuugaucugcucagcccuggag

SEQ ID NO: 3683635 - RNA, 15 nt, Human
ucuugaucuguucug

SEQ ID NO: 3683636 - RNA, 22 nt, Human
ucuugaugaaaagcuuuguuug

SEQ ID NO: 3683637 - RNA, 14 nt, Human
ucuugaugccuggc

SEQ ID NO: 3683638 - RNA, 18 nt, Human
ucuugaugccuggcgggg

SEQ ID NO: 3683639 - RNA, 20 nt, Human
ucuugaugccuggcggggug

SEQ ID NO: 3683640 - RNA, 21 nt, Human
ucuugaugccuggcggggugg

SEQ ID NO: 3683641 - RNA, 14 nt, Human
ucuugauuauccau

SEQ ID NO: 3683642 - RNA, 17 nt, Human
ucuugauucagucacau

SEQ ID NO: 3683643 - RNA, 20 nt, Human
ucuugauuuguuuuagaaug

SEQ ID NO: 3683644 - RNA, 21 nt, Human
ucuugauuuguuuuagaauga

SEQ ID NO: 3683645 - RNA, 22 nt, Human
ucuugcaauggcagccuuggca

SEQ ID NO: 3683646 - RNA, 23 nt, Human
ucuugcaauggcagccuuggcaa

SEQ ID NO: 3683647 - RNA, 16 nt, Human
ucuugcaccaaauuau

SEQ ID NO: 3683648 - RNA, 20 nt, Human
ucuugcacccgccucucccg

SEQ ID NO: 3683649 - RNA, 23 nt, Human
ucuugcaggaaggacuaugaaaa

SEQ ID NO: 3683650 - RNA, 14 nt, Human
ucuugcagugauua

SEQ ID NO: 3683651 - RNA, 19 nt, Human
ucuugcaugguuuggagcu

SEQ ID NO: 3683652 - RNA, 15 nt, Human
ucuugcauuaugcaa

SEQ ID NO: 3683653 - RNA, 17 nt, Human
ucuugcauuaugcaauu

SEQ ID NO: 3683654 - RNA, 17 nt, Human
ucuugcauugacauuau

SEQ ID NO: 3683655 - RNA, 14 nt, Human
ucuugcauuucacu

SEQ ID NO: 3683656 - RNA, 23 nt, Human
ucuugccaaccuguaauaaauau

SEQ ID NO: 3683657 - RNA, 16 nt, Human
ucuugccacugccucu

SEQ ID NO: 3683658 - RNA, 17 nt, Human
ucuugccacugccucuu

SEQ ID NO: 3683659 - RNA, 16 nt, Human
ucuugccaucuauagg

SEQ ID NO: 3683660 - RNA, 21 nt, Human
ucuugccccaacccccagcac

SEQ ID NO: 3683661 - RNA, 17 nt, Human
ucuugccgaggagccag

SEQ ID NO: 3683662 - RNA, 20 nt, Human
ucuugccucagcuuccccag

SEQ ID NO: 3683663 - RNA, 20 nt, Human
ucuugccuccauggugccuc

SEQ ID NO: 3683664 - RNA, 16 nt, Human
ucuugccucugucccc

SEQ ID NO: 3683665 - RNA, 21 nt, Human
ucuugccucuguccccuucuc

SEQ ID NO: 3683666 - RNA, 14 nt, Human
ucuugccucugugc

SEQ ID NO: 3683667 - RNA, 21 nt, Human
ucuugccugccuaacaaaaua

SEQ ID NO: 3683668 - RNA, 12 nt, Human
ucuugccuucag

SEQ ID NO: 3683669 - RNA, 20 nt, Human
ucuugcgaauccaagcuccc

SEQ ID NO: 3683670 - RNA, 19 nt, Human
ucuugcuaaucagugucuc

SEQ ID NO: 3683671 - RNA, 20 nt, Human
ucuugcuaaucagugucuca

SEQ ID NO: 3683672 - RNA, 21 nt, Human
ucuugcuaaucagugucucac

SEQ ID NO: 3683673 - RNA, 22 nt, Human
ucuugcuaaucagugucucaca

SEQ ID NO: 3683674 - RNA, 14 nt, Human
ucuugcuaccagua

SEQ ID NO: 3683675 - RNA, 20 nt, Human
ucuugcuaccaguauuuaga

SEQ ID NO: 3683676 - RNA, 20 nt, Human
ucuugcuaccucagucagua

SEQ ID NO: 3683677 - RNA, 18 nt, Human
ucuugcucaaaaaucugu

SEQ ID NO: 3683678 - RNA, 17 nt, Human
ucuugcucccuucagcc

SEQ ID NO: 3683679 - RNA, 21 nt, Human
ucuugcucuaucucacagcac

SEQ ID NO: 3683680 - RNA, 11 nt, Human
ucuugcucugc

SEQ ID NO: 3683681 - RNA, 14 nt, Human
ucuugcucugcuga

SEQ ID NO: 3683682 - RNA, 13 nt, Human
ucuugcucuguaa

SEQ ID NO: 3683683 - RNA, 14 nt, Human
ucuugcucuguaau

SEQ ID NO: 3683684 - RNA, 17 nt, Human
ucuugcucuguaaucuc

SEQ ID NO: 3683685 - RNA, 13 nt, Human
ucuugcugcuaga

SEQ ID NO: 3683686 - RNA, 16 nt, Human
ucuugcugcuagaacu

SEQ ID NO: 3683687 - RNA, 17 nt, Human
ucuugcugcuagaacuu

SEQ ID NO: 3683688 - RNA, 18 nt, Human
ucuugcugcuagaacuuu

SEQ ID NO: 3683689 - RNA, 19 nt, Human
ucuugcugcuagaacuuuu

SEQ ID NO: 3683690 - RNA, 16 nt, Human
ucuugcugucucugcu

SEQ ID NO: 3683691 - RNA, 14 nt, Human
ucuugcuguggucu

SEQ ID NO: 3683692 - RNA, 14 nt, Human
ucuugcuguugaca

SEQ ID NO: 3683693 - RNA, 21 nt, Human
ucuugcuguugacauauuuaa

SEQ ID NO: 3683694 - RNA, 22 nt, Human
ucuugcuucccuaaucuauggu

SEQ ID NO: 3683695 - RNA, 11 nt, Human
ucuugcuucuu

SEQ ID NO: 3683696 - RNA, 14 nt, Human
ucuugcuugaacuu

SEQ ID NO: 3683697 - RNA, 12 nt, Human
ucuugcuuguac

SEQ ID NO: 3683698 - RNA, 17 nt, Human
ucuugcuuguaccucug

SEQ ID NO: 3683699 - RNA, 22 nt, Human
ucuugcuuguaccucuggcuga

SEQ ID NO: 3683700 - RNA, 15 nt, Human
ucuuggaaaaaguga

SEQ ID NO: 3683701 - RNA, 16 nt, Human
ucuuggaaaaagugau

SEQ ID NO: 3683702 - RNA, 16 nt, Human
ucuuggaaagaaacaa

SEQ ID NO: 3683703 - RNA, 20 nt, Human
ucuuggaacuugccugccuu

SEQ ID NO: 3683704 - RNA, 15 nt, Human
ucuuggacaaaucac

SEQ ID NO: 3683705 - RNA, 17 nt, Human
ucuuggacacuguacaa

SEQ ID NO: 3683706 - RNA, 18 nt, Human
ucuuggacacuuaauucu

SEQ ID NO: 3683707 - RNA, 19 nt, Human
ucuuggacacuuaauucug

SEQ ID NO: 3683708 - RNA, 21 nt, Human
ucuuggacacuuaauucuguu

SEQ ID NO: 3683709 - RNA, 12 nt, Human
ucuuggagccug

SEQ ID NO: 3683710 - RNA, 14 nt, Human
ucuuggagccugca

SEQ ID NO: 3683711 - RNA, 18 nt, Human
ucuuggagccugcagagc

SEQ ID NO: 3683712 - RNA, 15 nt, Human
ucuuggaguuuuuca

SEQ ID NO: 3683713 - RNA, 21 nt, Human
ucuuggcaaaagccuugugua

SEQ ID NO: 3683714 - RNA, 22 nt, Human
ucuuggcaaaagccuuguguau

SEQ ID NO: 3683715 - RNA, 17 nt, Human
ucuuggcaauauuccuu

SEQ ID NO: 3683716 - RNA, 13 nt, Human
ucuuggcagucac

SEQ ID NO: 3683717 - RNA, 13 nt, Human
ucuuggccagcca

SEQ ID NO: 3683718 - RNA, 22 nt, Human
ucuuggccaugggaggccuuuc

SEQ ID NO: 3683719 - RNA, 18 nt, Human
ucuuggcccgcacagagc

SEQ ID NO: 3683720 - RNA, 18 nt, Human
ucuuggcggcagcagcca

SEQ ID NO: 3683721 - RNA, 13 nt, Human
ucuuggcucacug

SEQ ID NO: 3683722 - RNA, 19 nt, Human
ucuuggcuuacugcagccu

SEQ ID NO: 3683723 - RNA, 12 nt, Human
ucuuggcuuugu

SEQ ID NO: 3683724 - RNA, 12 nt, Human
ucuugggaaaua

SEQ ID NO: 3683725 - RNA, 14 nt, Human
ucuugggaaauaug

SEQ ID NO: 3683726 - RNA, 20 nt, Human
ucuugggaaauaugaaugcc

SEQ ID NO: 3683727 - RNA, 22 nt, Human
ucuugggacuggguuuggaccc

SEQ ID NO: 3683728 - RNA, 23 nt, Human
ucuugggcagagcuggcucugag

SEQ ID NO: 3683729 - RNA, 13 nt, Human
ucuuggggaagau

SEQ ID NO: 3683730 - RNA, 16 nt, Human
ucuugggggaaaauac

SEQ ID NO: 3683731 - RNA, 23 nt, Human
ucuugggggacagggcuggccca

SEQ ID NO: 3683732 - RNA, 20 nt, Human
ucuuggggggguggccgcug

SEQ ID NO: 3683733 - RNA, 14 nt, Human
ucuugguccugcug

SEQ ID NO: 3683734 - RNA, 17 nt, Human
ucuugguccugcugcag

SEQ ID NO: 3683735 - RNA, 17 nt, Human
ucuugguguuaaaacac

SEQ ID NO: 3683736 - RNA, 21 nt, Human
ucuugguucauaaaugaauuu

SEQ ID NO: 3683737 - RNA, 13 nt, Human
ucuugguuccagc

SEQ ID NO: 3683738 - RNA, 18 nt, Human
ucuugguuccagccugcc

SEQ ID NO: 3683739 - RNA, 19 nt, Human
ucuugguugaaaauaaaaa

SEQ ID NO: 3683740 - RNA, 17 nt, Human
ucuugguuggcuggccu

SEQ ID NO: 3683741 - RNA, 22 nt, Human
ucuugguuucucucuacagugc

SEQ ID NO: 3683742 - RNA, 20 nt, Human
ucuugguuuucccuuugccu

SEQ ID NO: 3683743 - RNA, 15 nt, Human
ucuuguaaagacugg

SEQ ID NO: 3683744 - RNA, 18 nt, Human
ucuuguaaauaaagcccu

SEQ ID NO: 3683745 - RNA, 14 nt, Human
ucuuguaaaugugu

SEQ ID NO: 3683746 - RNA, 18 nt, Human
ucuuguaaauguguugga

SEQ ID NO: 3683747 - RNA, 22 nt, Human
ucuuguaaauguguuggacaaa

SEQ ID NO: 3683748 - RNA, 13 nt, Human
ucuuguaagauuu

SEQ ID NO: 3683749 - RNA, 15 nt, Human
ucuuguaagcaaaag

SEQ ID NO: 3683750 - RNA, 17 nt, Human
ucuuguaaggcuuugau

SEQ ID NO: 3683751 - RNA, 18 nt, Human
ucuuguaaggcuuugauu

SEQ ID NO: 3683752 - RNA, 19 nt, Human
ucuuguaauccgaaucucu

SEQ ID NO: 3683753 - RNA, 23 nt, Human
ucuuguaauuuaaacaggcccag

SEQ ID NO: 3683754 - RNA, 19 nt, Human
ucuuguaauuuuacacgcu

SEQ ID NO: 3683755 - RNA, 17 nt, Human
ucuuguacauguguagc

SEQ ID NO: 3683756 - RNA, 19 nt, Human
ucuuguacauguguagccu

SEQ ID NO: 3683757 - RNA, 21 nt, Human
ucuuguauaagauccuagauc

SEQ ID NO: 3683758 - RNA, 15 nt, Human
ucuuguauuaagaau

SEQ ID NO: 3683759 - RNA, 16 nt, Human
ucuuguauuaaguugu

SEQ ID NO: 3683760 - RNA, 18 nt, Human
ucuuguauuaaguuguua

SEQ ID NO: 3683761 - RNA, 16 nt, Human
ucuugucacaauaaau

SEQ ID NO: 3683762 - RNA, 14 nt, Human
ucuugucagacaua

SEQ ID NO: 3683763 - RNA, 19 nt, Human
ucuugucagacauaaagcc

SEQ ID NO: 3683764 - RNA, 20 nt, Human
ucuugucagacauaaagcca

SEQ ID NO: 3683765 - RNA, 15 nt, Human
ucuugucauguguau

SEQ ID NO: 3683766 - RNA, 13 nt, Human
ucuugucauuuuu

SEQ ID NO: 3683767 - RNA, 22 nt, Human
ucuuguccagagacaagacuuc

SEQ ID NO: 3683768 - RNA, 22 nt, Human
ucuuguccaugugguucuucaa

SEQ ID NO: 3683769 - RNA, 21 nt, Human
ucuuguccccaacaccccaca

SEQ ID NO: 3683770 - RNA, 12 nt, Human
ucuugucuauaa

SEQ ID NO: 3683771 - RNA, 16 nt, Human
ucuugucuauaaagca

SEQ ID NO: 3683772 - RNA, 18 nt, Human
ucuugucucaaugcucau

SEQ ID NO: 3683773 - RNA, 15 nt, Human
ucuugucucagauuu

SEQ ID NO: 3683774 - RNA, 16 nt, Human
ucuugucuccccuguu

SEQ ID NO: 3683775 - RNA, 13 nt, Human
ucuugucucuggg

SEQ ID NO: 3683776 - RNA, 15 nt, Human
ucuugucuuccuauu

SEQ ID NO: 3683777 - RNA, 10 nt, Human
ucuugugaag

SEQ ID NO: 3683778 - RNA, 11 nt, Human
ucuugugaagg

SEQ ID NO: 3683779 - RNA, 14 nt, Human
ucuugugacuagug

SEQ ID NO: 3683780 - RNA, 17 nt, Human
ucuugugcuagaauacu

SEQ ID NO: 3683781 - RNA, 19 nt, Human
ucuuguggauguuuuaauu

SEQ ID NO: 3683782 - RNA, 23 nt, Human
ucuuguggauguuuuaauuccau

SEQ ID NO: 3683783 - RNA, 23 nt, Human
ucuugugguuauaacuuaaugaa

SEQ ID NO: 3683784 - RNA, 15 nt, Human
ucuugugucuuugga

SEQ ID NO: 3683785 - RNA, 20 nt, Human
ucuugugucuuuggaggugc

SEQ ID NO: 3683786 - RNA, 21 nt, Human
ucuugugugguuuggcccuuc

SEQ ID NO: 3683787 - RNA, 21 nt, Human
ucuuguguguaugcacaugaa

SEQ ID NO: 3683788 - RNA, 22 nt, Human
ucuuguguguaugcacaugaac

SEQ ID NO: 3683789 - RNA, 16 nt, Human
ucuuguguguuuauug

SEQ ID NO: 3683790 - RNA, 13 nt, Human
ucuuguguuggcu

SEQ ID NO: 3683791 - RNA, 22 nt, Human
ucuuguguuuccacagccugca

SEQ ID NO: 3683792 - RNA, 21 nt, Human
ucuuguuaauauucuuucaau

SEQ ID NO: 3683793 - RNA, 19 nt, Human
ucuuguuaugguagaaaaa

SEQ ID NO: 3683794 - RNA, 15 nt, Human
ucuuguuccaaggcc

SEQ ID NO: 3683795 - RNA, 16 nt, Human
ucuuguucugagauuc

SEQ ID NO: 3683796 - RNA, 15 nt, Human
ucuuguucugucacu

SEQ ID NO: 3683797 - RNA, 14 nt, Human
ucuuguugcuuugu

SEQ ID NO: 3683798 - RNA, 16 nt, Human
ucuuguuggugcacag

SEQ ID NO: 3683799 - RNA, 13 nt, Human
ucuuguuucucca

SEQ ID NO: 3683800 - RNA, 14 nt, Human
ucuuguuucucccg

SEQ ID NO: 3683801 - RNA, 14 nt, Human
ucuuguuucugaaa

SEQ ID NO: 3683802 - RNA, 16 nt, Human
ucuuguuuuguuuguc

SEQ ID NO: 3683803 - RNA, 16 nt, Human
ucuuguuuuuaaguuu

SEQ ID NO: 3683804 - RNA, 15 nt, Human
ucuuguuuuuauuaa

SEQ ID NO: 3683805 - RNA, 13 nt, Human
ucuuguuuuucca

SEQ ID NO: 3683806 - RNA, 18 nt, Human
ucuuguuuuuuuuuucca

SEQ ID NO: 3683807 - RNA, 15 nt, Human
ucuuuaaaagaauga

SEQ ID NO: 3683808 - RNA, 16 nt, Human
ucuuuaaaagaaugac

SEQ ID NO: 3683809 - RNA, 15 nt, Human
ucuuuaaaagagaga

SEQ ID NO: 3683810 - RNA, 18 nt, Human
ucuuuaaaaggaaagaaa

SEQ ID NO: 3683811 - RNA, 15 nt, Human
ucuuuaaacugucgu

SEQ ID NO: 3683812 - RNA, 15 nt, Human
ucuuuaaaggcccag

SEQ ID NO: 3683813 - RNA, 18 nt, Human
ucuuuaaaggcccagccc

SEQ ID NO: 3683814 - RNA, 22 nt, Human
ucuuuaaaggcccagccccuag

SEQ ID NO: 3683815 - RNA, 18 nt, Human
ucuuuaaagucaggucca

SEQ ID NO: 3683816 - RNA, 23 nt, Human
ucuuuaaagugacuaauggcaug

SEQ ID NO: 3683817 - RNA, 12 nt, Human
ucuuuaaauaga

SEQ ID NO: 3683818 - RNA, 14 nt, Human
ucuuuaaauagaua

SEQ ID NO: 3683819 - RNA, 18 nt, Human
ucuuuaaccuuguauaaa

SEQ ID NO: 3683820 - RNA, 14 nt, Human
ucuuuaacucagga

SEQ ID NO: 3683821 - RNA, 23 nt, Human
ucuuuaacucccauuaccaugua

SEQ ID NO: 3683822 - RNA, 20 nt, Human
ucuuuaacugccguaauuua

SEQ ID NO: 3683823 - RNA, 16 nt, Human
ucuuuaacuuguaaua

SEQ ID NO: 3683824 - RNA, 11 nt, Human
ucuuuaacuuu

SEQ ID NO: 3683825 - RNA, 19 nt, Human
ucuuuaaguauugauucug

SEQ ID NO: 3683826 - RNA, 15 nt, Human
ucuuuaauaaauaac

SEQ ID NO: 3683827 - RNA, 14 nt, Human
ucuuuaaucuucag

SEQ ID NO: 3683828 - RNA, 13 nt, Human
ucuuuaaugcuuu

SEQ ID NO: 3683829 - RNA, 18 nt, Human
ucuuuaaugucacaggca

SEQ ID NO: 3683830 - RNA, 22 nt, Human
ucuuuaaugucacaggcagguc

SEQ ID NO: 3683831 - RNA, 16 nt, Human
ucuuuaauuuuggaau

SEQ ID NO: 3683832 - RNA, 14 nt, Human
ucuuuacaaaacaa

SEQ ID NO: 3683833 - RNA, 23 nt, Human
ucuuuacaaaacaaacucauuca

SEQ ID NO: 3683834 - RNA, 16 nt, Human
ucuuuaccugagacca

SEQ ID NO: 3683835 - RNA, 18 nt, Human
ucuuuaccugagaccagu

SEQ ID NO: 3683836 - RNA, 19 nt, Human
ucuuuaccuguauacagug

SEQ ID NO: 3683837 - RNA, 15 nt, Human
ucuuuagaaaaggca

SEQ ID NO: 3683838 - RNA, 11 nt, Human
ucuuuagaaca

SEQ ID NO: 3683839 - RNA, 13 nt, Human
ucuuuagagaacu

SEQ ID NO: 3683840 - RNA, 17 nt, Human
ucuuuagagaacugaaa

SEQ ID NO: 3683841 - RNA, 19 nt, Human
ucuuuagagaacugaaaag

SEQ ID NO: 3683842 - RNA, 23 nt, Human
ucuuuaggauugugaugguucgu

SEQ ID NO: 3683843 - RNA, 17 nt, Human
ucuuuaggucuuugccu

SEQ ID NO: 3683844 - RNA, 17 nt, Human
ucuuuaggucuuuguaa

SEQ ID NO: 3683845 - RNA, 13 nt, Human
ucuuuauaagaaa

SEQ ID NO: 3683846 - RNA, 15 nt, Human
ucuuuauaagaaagc

SEQ ID NO: 3683847 - RNA, 19 nt, Human
ucuuuauaagaaagccuga

SEQ ID NO: 3683848 - RNA, 20 nt, Human
ucuuuauaauucuacuuuga

SEQ ID NO: 3683849 - RNA, 13 nt, Human
ucuuuauacaaca

SEQ ID NO: 3683850 - RNA, 21 nt, Human
ucuuuauacaacagugcuaaa

SEQ ID NO: 3683851 - RNA, 15 nt, Human
ucuuuauacagcugu

SEQ ID NO: 3683852 - RNA, 15 nt, Human
ucuuuauagugcaca

SEQ ID NO: 3683853 - RNA, 22 nt, Human
ucuuuauauacaauaauggaaa

SEQ ID NO: 3683854 - RNA, 23 nt, Human
ucuuuauauacaauaauggaaaa

SEQ ID NO: 3683855 - RNA, 17 nt, Human
ucuuuauuaaauguaga

SEQ ID NO: 3683856 - RNA, 16 nt, Human
ucuuuauuaaucacua

SEQ ID NO: 3683857 - RNA, 12 nt, Human
ucuuuauugaaa

SEQ ID NO: 3683858 - RNA, 16 nt, Human
ucuuuauugagaaaga

SEQ ID NO: 3683859 - RNA, 19 nt, Human
ucuuuauugcucauuuuuu

SEQ ID NO: 3683860 - RNA, 16 nt, Human
ucuuuauugucuguaa

SEQ ID NO: 3683861 - RNA, 16 nt, Human
ucuuuauuuuguguaa

SEQ ID NO: 3683862 - RNA, 11 nt, Human
ucuuucaaaac

SEQ ID NO: 3683863 - RNA, 20 nt, Human
ucuuucaaaaccuuuugaaa

SEQ ID NO: 3683864 - RNA, 12 nt, Human
ucuuucaaacuc

SEQ ID NO: 3683865 - RNA, 23 nt, Human
ucuuucaaaggaacauugugucu

SEQ ID NO: 3683866 - RNA, 22 nt, Human
ucuuucaaagguagccaucaug

SEQ ID NO: 3683867 - RNA, 18 nt, Human
ucuuucaaauugagagaa

SEQ ID NO: 3683868 - RNA, 18 nt, Human
ucuuucaagggcuuuccu

SEQ ID NO: 3683869 - RNA, 19 nt, Human
ucuuucaauaaacuaaaga

SEQ ID NO: 3683870 - RNA, 23 nt, Human
ucuuucacacuuccaccagccug

SEQ ID NO: 3683871 - RNA, 19 nt, Human
ucuuucacccacagaaaga

SEQ ID NO: 3683872 - RNA, 23 nt, Human
ucuuucacccacagaaagagagc

SEQ ID NO: 3683873 - RNA, 14 nt, Human
ucuuucagaaaaca

SEQ ID NO: 3683874 - RNA, 15 nt, Human
ucuuucagaaaacag

SEQ ID NO: 3683875 - RNA, 18 nt, Human
ucuuucagaaauauaaca

SEQ ID NO: 3683876 - RNA, 23 nt, Human
ucuuucagaaauauaacacauuu

SEQ ID NO: 3683877 - RNA, 15 nt, Human
ucuuucagcaagaua

SEQ ID NO: 3683878 - RNA, 16 nt, Human
ucuuucagccaagaau

SEQ ID NO: 3683879 - RNA, 17 nt, Human
ucuuucagcuaucagua

SEQ ID NO: 3683880 - RNA, 18 nt, Human
ucuuucagcuaucaguag

SEQ ID NO: 3683881 - RNA, 17 nt, Human
ucuuucagggauuuuuu

SEQ ID NO: 3683882 - RNA, 16 nt, Human
ucuuucaguacuuuuu

SEQ ID NO: 3683883 - RNA, 23 nt, Human
ucuuucaguacuuuuuuaaauau

SEQ ID NO: 3683884 - RNA, 13 nt, Human
ucuuuccaaagua

SEQ ID NO: 3683885 - RNA, 17 nt, Human
ucuuuccacagaagcuc

SEQ ID NO: 3683886 - RNA, 16 nt, Human
ucuuuccauuucucuc

SEQ ID NO: 3683887 - RNA, 14 nt, Human
ucuuuccauuugca

SEQ ID NO: 3683888 - RNA, 17 nt, Human
ucuuuccauuugcauuu

SEQ ID NO: 3683889 - RNA, 12 nt, Human
ucuuucccuccc

SEQ ID NO: 3683890 - RNA, 12 nt, Human
ucuuucccuccu

SEQ ID NO: 3683891 - RNA, 14 nt, Human
ucuuucccuggucc

SEQ ID NO: 3683892 - RNA, 15 nt, Human
ucuuucccuuccucc

SEQ ID NO: 3683893 - RNA, 17 nt, Human
ucuuuccuaagaccugg

SEQ ID NO: 3683894 - RNA, 17 nt, Human
ucuuuccuaaggcugca

SEQ ID NO: 3683895 - RNA, 19 nt, Human
ucuuuccuagauggcaguc

SEQ ID NO: 3683896 - RNA, 22 nt, Human
ucuuuccuagauggcagucacu

SEQ ID NO: 3683897 - RNA, 16 nt, Human
ucuuuccuauuucagu

SEQ ID NO: 3683898 - RNA, 12 nt, Human
ucuuuccuccuu

SEQ ID NO: 3683899 - RNA, 14 nt, Human
ucuuuccuccuuuc

SEQ ID NO: 3683900 - RNA, 20 nt, Human
ucuuuccucuuccccuugcc

SEQ ID NO: 3683901 - RNA, 23 nt, Human
ucuuuccucuuccccuugcccuu

SEQ ID NO: 3683902 - RNA, 16 nt, Human
ucuuuccugaaccaug

SEQ ID NO: 3683903 - RNA, 12 nt, Human
ucuuuccugagg

SEQ ID NO: 3683904 - RNA, 13 nt, Human
ucuuuccugaggc

SEQ ID NO: 3683905 - RNA, 15 nt, Human
ucuuuccugaggcug

SEQ ID NO: 3683906 - RNA, 11 nt, Human
ucuuuccuguc

SEQ ID NO: 3683907 - RNA, 12 nt, Human
ucuuuccuuccu

SEQ ID NO: 3683908 - RNA, 15 nt, Human
ucuuucgucacccuu

SEQ ID NO: 3683909 - RNA, 14 nt, Human
ucuuucuaagaaau

SEQ ID NO: 3683910 - RNA, 23 nt, Human
ucuuucuacaaagcacuagagaa

SEQ ID NO: 3683911 - RNA, 14 nt, Human
ucuuucuacaguau

SEQ ID NO: 3683912 - RNA, 15 nt, Human
ucuuucuaguggucu

SEQ ID NO: 3683913 - RNA, 21 nt, Human
ucuuucuaugcugcuuuuaua

SEQ ID NO: 3683914 - RNA, 15 nt, Human
ucuuucucaaagaaa

SEQ ID NO: 3683915 - RNA, 21 nt, Human
ucuuucuccuuagucuucuca

SEQ ID NO: 3683916 - RNA, 24 nt, Human
ucuuucuccuuagucuucucauag

SEQ ID NO: 3683917 - RNA, 24 nt, Human
ucuuucuccuugaauaucuuucga

SEQ ID NO: 3683918 - RNA, 10 nt, Human
ucuuucucuc

SEQ ID NO: 3683919 - RNA, 12 nt, Human
ucuuucucucag

SEQ ID NO: 3683920 - RNA, 11 nt, Human
ucuuucucugc

SEQ ID NO: 3683921 - RNA, 15 nt, Human
ucuuucucugccagu

SEQ ID NO: 3683922 - RNA, 12 nt, Human
ucuuucucuuuc

SEQ ID NO: 3683923 - RNA, 23 nt, Human
ucuuucuggccugccuucguuaa

SEQ ID NO: 3683924 - RNA, 18 nt, Human
ucuuucuggcuaugcauu

SEQ ID NO: 3683925 - RNA, 21 nt, Human
ucuuucugguuguuuuuaaac

SEQ ID NO: 3683926 - RNA, 10 nt, Human
ucuuucugua

SEQ ID NO: 3683927 - RNA, 16 nt, Human
ucuuucuguccccucu

SEQ ID NO: 3683928 - RNA, 20 nt, Human
ucuuucuuacaaggaaggug

SEQ ID NO: 3683929 - RNA, 13 nt, Human
ucuuucuuagaaa

SEQ ID NO: 3683930 - RNA, 14 nt, Human
ucuuucuuagaaau

SEQ ID NO: 3683931 - RNA, 16 nt, Human
ucuuucuuagaaauuu

SEQ ID NO: 3683932 - RNA, 19 nt, Human
ucuuucuuagaaauuuauu

SEQ ID NO: 3683933 - RNA, 14 nt, Human
ucuuucuuccucug

SEQ ID NO: 3683934 - RNA, 12 nt, Human
ucuuucuuccuu

SEQ ID NO: 3683935 - RNA, 18 nt, Human
ucuuucuugcucccugac

SEQ ID NO: 3683936 - RNA, 12 nt, Human
ucuuucuuuaaa

SEQ ID NO: 3683937 - RNA, 13 nt, Human
ucuuucuuuaaau

SEQ ID NO: 3683938 - RNA, 22 nt, Human
ucuuucuuugggaauauuugaa

SEQ ID NO: 3683939 - RNA, 18 nt, Human
ucuuucuuuggugccuuu

SEQ ID NO: 3683940 - RNA, 21 nt, Human
ucuuucuuuggugccuuuccu

SEQ ID NO: 3683941 - RNA, 20 nt, Human
ucuuugaaaauaguuauuca

SEQ ID NO: 3683942 - RNA, 22 nt, Human
ucuuugaaagaaggaagacuuu

SEQ ID NO: 3683943 - RNA, 21 nt, Human
ucuuugaaauagucuguguga

SEQ ID NO: 3683944 - RNA, 15 nt, Human
ucuuugaaauuaugu

SEQ ID NO: 3683945 - RNA, 23 nt, Human
ucuuugaagaagguggaccuuuu

SEQ ID NO: 3683946 - RNA, 13 nt, Human
ucuuugaauaaau

SEQ ID NO: 3683947 - RNA, 16 nt, Human
ucuuugaauaaauguc

SEQ ID NO: 3683948 - RNA, 17 nt, Human
ucuuugaauaaauguca

SEQ ID NO: 3683949 - RNA, 16 nt, Human
ucuuugaaugacaaag

SEQ ID NO: 3683950 - RNA, 16 nt, Human
ucuuugaauuuucugu

SEQ ID NO: 3683951 - RNA, 18 nt, Human
ucuuugagauagaagaac

SEQ ID NO: 3683952 - RNA, 22 nt, Human
ucuuugagauagaagaacugca

SEQ ID NO: 3683953 - RNA, 21 nt, Human
ucuuugauaauguuaaauuug

SEQ ID NO: 3683954 - RNA, 20 nt, Human
ucuuugauacuuguucaaaa

SEQ ID NO: 3683955 - RNA, 14 nt, Human
ucuuugaucaugaa

SEQ ID NO: 3683956 - RNA, 16 nt, Human
ucuuugauguguuguu

SEQ ID NO: 3683957 - RNA, 18 nt, Human
ucuuugauuauuugcaug

SEQ ID NO: 3683958 - RNA, 20 nt, Human
ucuuugauuauuugcauguu

SEQ ID NO: 3683959 - RNA, 16 nt, Human
ucuuugauucuccuuc

SEQ ID NO: 3683960 - RNA, 20 nt, Human
ucuuugauucuccuuuuaug

SEQ ID NO: 3683961 - RNA, 21 nt, Human
ucuuugauucuccuuuuaugu

SEQ ID NO: 3683962 - RNA, 13 nt, Human
ucuuugauucugu

SEQ ID NO: 3683963 - RNA, 22 nt, Human
ucuuugcaaaguauuguaaauu

SEQ ID NO: 3683964 - RNA, 13 nt, Human
ucuuugcaacugu

SEQ ID NO: 3683965 - RNA, 20 nt, Human
ucuuugcacuuuuucuuaau

SEQ ID NO: 3683966 - RNA, 17 nt, Human
ucuuugcagacaggcaa

SEQ ID NO: 3683967 - RNA, 15 nt, Human
ucuuugcccuuuacu

SEQ ID NO: 3683968 - RNA, 15 nt, Human
ucuuugccuguucag

SEQ ID NO: 3683969 - RNA, 23 nt, Human
ucuuugccuguucaguuacagaa

SEQ ID NO: 3683970 - RNA, 13 nt, Human
ucuuugcugcaga

SEQ ID NO: 3683971 - RNA, 19 nt, Human
ucuuugcuguaagaugucu

SEQ ID NO: 3683972 - RNA, 19 nt, Human
ucuuugcuucacuucuccc

SEQ ID NO: 3683973 - RNA, 11 nt, Human
ucuuugcuuug

SEQ ID NO: 3683974 - RNA, 18 nt, Human
ucuuugcuuugcuuucug

SEQ ID NO: 3683975 - RNA, 19 nt, Human
ucuuuggaaaaauguuugu

SEQ ID NO: 3683976 - RNA, 18 nt, Human
ucuuuggaaggagugaga

SEQ ID NO: 3683977 - RNA, 17 nt, Human
ucuuuggacacucacac

SEQ ID NO: 3683978 - RNA, 21 nt, Human
ucuuuggacagaagcagcucu

SEQ ID NO: 3683979 - RNA, 13 nt, Human
ucuuuggacccug

SEQ ID NO: 3683980 - RNA, 14 nt, Human
ucuuuggacccuga

SEQ ID NO: 3683981 - RNA, 18 nt, Human
ucuuugggaauauuugaa

SEQ ID NO: 3683982 - RNA, 16 nt, Human
ucuuugggccagacau

SEQ ID NO: 3683983 - RNA, 20 nt, Human
ucuuugggccagacaugcca

SEQ ID NO: 3683984 - RNA, 19 nt, Human
ucuuuggguaccuauuuuc

SEQ ID NO: 3683985 - RNA, 14 nt, Human
ucuuuggucuacac

SEQ ID NO: 3683986 - RNA, 20 nt, Human
ucuuuggugccuuuccuguu

SEQ ID NO: 3683987 - RNA, 17 nt, Human
ucuuugguggcuuugca

SEQ ID NO: 3683988 - RNA, 17 nt, Human
ucuuugguguacagacu

SEQ ID NO: 3683989 - RNA, 12 nt, Human
ucuuugguucua

SEQ ID NO: 3683990 - RNA, 14 nt, Human
ucuuugguucuaag

SEQ ID NO: 3683991 - RNA, 12 nt, Human
ucuuuguaagaa

SEQ ID NO: 3683992 - RNA, 18 nt, Human
ucuuuguaagaguguaga

SEQ ID NO: 3683993 - RNA, 22 nt, Human
ucuuuguaaguaaacugcccug

SEQ ID NO: 3683994 - RNA, 12 nt, Human
ucuuuguaaguc

SEQ ID NO: 3683995 - RNA, 22 nt, Human
ucuuuguaagucaguguugaga

SEQ ID NO: 3683996 - RNA, 23 nt, Human
ucuuuguaaucguuaugugugua

SEQ ID NO: 3683997 - RNA, 14 nt, Human
ucuuuguaauuauu

SEQ ID NO: 3683998 - RNA, 14 nt, Human
ucuuuguacagaca

SEQ ID NO: 3683999 - RNA, 14 nt, Human
ucuuuguaccaaaa

SEQ ID NO: 3684000 - RNA, 16 nt, Human
ucuuuguaucuuccau

SEQ ID NO: 3684001 - RNA, 13 nt, Human
ucuuugucuaaaa

SEQ ID NO: 3684002 - RNA, 19 nt, Human
ucuuugucuaaaacaauaa

SEQ ID NO: 3684003 - RNA, 20 nt, Human
ucuuugucuaaaacaauaaa

SEQ ID NO: 3684004 - RNA, 20 nt, Human
ucuuugucuuaucuggcccu

SEQ ID NO: 3684005 - RNA, 16 nt, Human
ucuuugugaaggccuc

SEQ ID NO: 3684006 - RNA, 16 nt, Human
ucuuugugauaauuua

SEQ ID NO: 3684007 - RNA, 16 nt, Human
ucuuugugcuuuggcu

SEQ ID NO: 3684008 - RNA, 13 nt, Human
ucuuuguggccaa

SEQ ID NO: 3684009 - RNA, 14 nt, Human
ucuuuguggccaag

SEQ ID NO: 3684010 - RNA, 18 nt, Human
ucuuuguuaagacugcug

SEQ ID NO: 3684011 - RNA, 15 nt, Human
ucuuuguuacaggca

SEQ ID NO: 3684012 - RNA, 21 nt, Human
ucuuuguuaucaaacuucagc

SEQ ID NO: 3684013 - RNA, 14 nt, Human
ucuuuguucaagau

SEQ ID NO: 3684014 - RNA, 20 nt, Human
ucuuuguucucagcuccccc

SEQ ID NO: 3684015 - RNA, 18 nt, Human
ucuuuguuggaaaagaau

SEQ ID NO: 3684016 - RNA, 12 nt, Human
ucuuuguuuugu

SEQ ID NO: 3684017 - RNA, 17 nt, Human
ucuuuguuuugugucuc

SEQ ID NO: 3684018 - RNA, 14 nt, Human
ucuuuuaaaaagua

SEQ ID NO: 3684019 - RNA, 16 nt, Human
ucuuuuaaaaaguauu

SEQ ID NO: 3684020 - RNA, 14 nt, Human
ugaaagcugagaac

SEQ ID NO: 3684021 - RNA, 19 nt, Human
ugaaagcugagaacuccug

SEQ ID NO: 3684022 - RNA, 21 nt, Human
ugaaagcugauuacugucaau

SEQ ID NO: 3684023 - RNA, 11 nt, Human
ugaaagcugug

SEQ ID NO: 3684024 - RNA, 20 nt, Human
ugaaaggaaauuaaggcaac

SEQ ID NO: 3684025 - RNA, 22 nt, Human
ugaaaggaauuuugcuaaguaa

SEQ ID NO: 3684026 - RNA, 22 nt, Human
ugaaaggagagcaucggccuag

SEQ ID NO: 3684027 - RNA, 14 nt, Human
ugaaaggagcccuu

SEQ ID NO: 3684028 - RNA, 17 nt, Human
ugaaaggcauucucuga

SEQ ID NO: 3684029 - RNA, 15 nt, Human
ugaaaggcuuuuaaa

SEQ ID NO: 3684030 - RNA, 13 nt, Human
ugaaagggcccag

SEQ ID NO: 3684031 - RNA, 13 nt, Human
ugaaagguacuau

SEQ ID NO: 3684032 - RNA, 14 nt, Human
ugaaagguacuaua

SEQ ID NO: 3684033 - RNA, 18 nt, Human
ugaaagguacuauauuug

SEQ ID NO: 3684034 - RNA, 15 nt, Human
ugaaagguagacuuu

SEQ ID NO: 3684035 - RNA, 21 nt, Human
ugaaaggugccauggaagagg

SEQ ID NO: 3684036 - RNA, 19 nt, Human
ugaaagguuacccuguaac

SEQ ID NO: 3684037 - RNA, 23 nt, Human
ugaaaguacauuuggagacacaa

SEQ ID NO: 3684038 - RNA, 18 nt, Human
ugaaagucagaugcccag

SEQ ID NO: 3684039 - RNA, 21 nt, Human
ugaaagucaguuuaagaggcu

SEQ ID NO: 3684040 - RNA, 18 nt, Human
ugaaagucaugaacacau

SEQ ID NO: 3684041 - RNA, 16 nt, Human
ugaaagucuguccuug

SEQ ID NO: 3684042 - RNA, 18 nt, Human
ugaaagucuugugacuag

SEQ ID NO: 3684043 - RNA, 20 nt, Human
ugaaagucuugugacuagug

SEQ ID NO: 3684044 - RNA, 19 nt, Human
ugaaagugaggaaauaaag

SEQ ID NO: 3684045 - RNA, 15 nt, Human
ugaaaguuaauccac

SEQ ID NO: 3684046 - RNA, 17 nt, Human
ugaaaguuugcacugua

SEQ ID NO: 3684047 - RNA, 20 nt, Human
ugaaaguuuuguaaaagaaa

SEQ ID NO: 3684048 - RNA, 22 nt, Human
ugaaaguuuuguaaaagaaauc

SEQ ID NO: 3684049 - RNA, 22 nt, Human
ugaaauaaaacuggcuuuggcu

SEQ ID NO: 3684050 - RNA, 18 nt, Human
ugaaauaaacgucuuaaa

SEQ ID NO: 3684051 - RNA, 20 nt, Human
ugaaauaaagaaauugcaau

SEQ ID NO: 3684052 - RNA, 21 nt, Human
uuuaauaaacuacucuuugau

SEQ ID NO: 3684053 - RNA, 19 nt, Human
uuuaauaaagcgaaaaacu

SEQ ID NO: 3684054 - RNA, 15 nt, Human
uuuaauaacauuacc

SEQ ID NO: 3684055 - RNA, 20 nt, Human
uuuaauaacauuaccuuacu

SEQ ID NO: 3684056 - RNA, 20 nt, Human
uuuaauaagcuacuagcaaa

SEQ ID NO: 3684057 - RNA, 16 nt, Human
uuuaauaauaaucuag

SEQ ID NO: 3684058 - RNA, 17 nt, Human
uuuaauaauauacuugu

SEQ ID NO: 3684059 - RNA, 14 nt, Human
uuuaauaauguuuc

SEQ ID NO: 3684060 - RNA, 18 nt, Human
uuuaauaauuauaugcua

SEQ ID NO: 3684061 - RNA, 11 nt, Human
uuuaauaauuu

SEQ ID NO: 3684062 - RNA, 19 nt, Human
uuuaauagaauauaauuau

SEQ ID NO: 3684063 - RNA, 21 nt, Human
uuuaauagaauauaauuaucg

SEQ ID NO: 3684064 - RNA, 17 nt, Human
uuuaauagcaaagaauu

SEQ ID NO: 3684065 - RNA, 22 nt, Human
uuuaauagcgucauaacuagaa

SEQ ID NO: 3684066 - RNA, 14 nt, Human
uuuaauaguguuaa

SEQ ID NO: 3684067 - RNA, 23 nt, Human
uuuaauauaaaguaguccuguga

SEQ ID NO: 3684068 - RNA, 16 nt, Human
uuuaauauaaaguuuu

SEQ ID NO: 3684069 - RNA, 15 nt, Human
uuuaauauaaaugca

SEQ ID NO: 3684070 - RNA, 15 nt, Human
uuuaauauagcuauu

SEQ ID NO: 3684071 - RNA, 21 nt, Human
uuuaauauuaaagccauguuu

SEQ ID NO: 3684072 - RNA, 24 nt, Human
uuuaauauuaccuaaugaaaguga

SEQ ID NO: 3684073 - RNA, 17 nt, Human
uuuaauauuauuacugu

SEQ ID NO: 3684074 - RNA, 22 nt, Human
uuuaauauugagaaagaaacua

SEQ ID NO: 3684075 - RNA, 15 nt, Human
uuuaauauuuaaaca

SEQ ID NO: 3684076 - RNA, 16 nt, Human
uuuaauauuuacucua

SEQ ID NO: 3684077 - RNA, 14 nt, Human
uuuaaucauauaaa

SEQ ID NO: 3684078 - RNA, 18 nt, Human
uuuaaucauauaaauaga

SEQ ID NO: 3684079 - RNA, 23 nt, Human
uuuaaucauauaaauagaaugua

SEQ ID NO: 3684080 - RNA, 13 nt, Human
uuuaaucaugaaa

SEQ ID NO: 3684081 - RNA, 19 nt, Human
uuuaaucaugaaauuacuu

SEQ ID NO: 3684082 - RNA, 24 nt, Human
uuuaaucaugaaauuacuuaucau

SEQ ID NO: 3684083 - RNA, 15 nt, Human
uuuaaucaugaauau

SEQ ID NO: 3684084 - RNA, 21 nt, Human
uuuaauccuucuaguuuccca

SEQ ID NO: 3684085 - RNA, 23 nt, Human
uuuaauccuucuaguuucccaca

SEQ ID NO: 3684086 - RNA, 13 nt, Human
uuuaaucuuuuau

SEQ ID NO: 3684087 - RNA, 16 nt, Human
uuuaaugaaagacugu

SEQ ID NO: 3684088 - RNA, 12 nt, Human
uuuaaugcugcc

SEQ ID NO: 3684089 - RNA, 13 nt, Human
uuuaaugcugccu

SEQ ID NO: 3684090 - RNA, 14 nt, Human
uuuaaugcugccuu

SEQ ID NO: 3684091 - RNA, 19 nt, Human
uuuaauggacacuuuucac

SEQ ID NO: 3684092 - RNA, 17 nt, Human
uuuaauggauuguuaau

SEQ ID NO: 3684093 - RNA, 20 nt, Human
uuuaauggauuguuaauuuc

SEQ ID NO: 3684094 - RNA, 20 nt, Human
uuuaauggggguagcagcug

SEQ ID NO: 3684095 - RNA, 22 nt, Human
uuuaauggggguagcagcugga

SEQ ID NO: 3684096 - RNA, 17 nt, Human
uuuaaugugaacuugua

SEQ ID NO: 3684097 - RNA, 18 nt, Human
uuuaaugugcuguguaaa

SEQ ID NO: 3684098 - RNA, 22 nt, Human
uuuaaugugcuguguaaaguua

SEQ ID NO: 3684099 - RNA, 15 nt, Human
uuuaauguucuguga

SEQ ID NO: 3684100 - RNA, 16 nt, Human
uuuaauguuuaaaaca

SEQ ID NO: 3684101 - RNA, 19 nt, Human
uuuaauguuuuaaauguac

SEQ ID NO: 3684102 - RNA, 21 nt, Human
uuuaauuaaaaacuaguaguu

SEQ ID NO: 3684103 - RNA, 15 nt, Human
uuuaauuaaaugcuc

SEQ ID NO: 3684104 - RNA, 19 nt, Human
uuuaauuaaucaugaaugu

SEQ ID NO: 3684105 - RNA, 19 nt, Human
uuuaauuaaugaaauaucu

SEQ ID NO: 3684106 - RNA, 22 nt, Human
uuuaauuaauugggccagcuuu

SEQ ID NO: 3684107 - RNA, 21 nt, Human
uuuaauuagggguugcuaaga

SEQ ID NO: 3684108 - RNA, 19 nt, Human
uuuaauuagugcuaagugu

SEQ ID NO: 3684109 - RNA, 18 nt, Human
uuuaauuauuaacuacau

SEQ ID NO: 3684110 - RNA, 14 nt, Human
uuuaauuauuauuc

SEQ ID NO: 3684111 - RNA, 16 nt, Human
uuuaauuccaauauga

SEQ ID NO: 3684112 - RNA, 20 nt, Human
uuuaauugaaagaauguaaa

SEQ ID NO: 3684113 - RNA, 16 nt, Human
uuuaauugaaggaaag

SEQ ID NO: 3684114 - RNA, 14 nt, Human
uuuaauugauuauu

SEQ ID NO: 3684115 - RNA, 15 nt, Human
uuuaauuguaaacug

SEQ ID NO: 3684116 - RNA, 16 nt, Human
uuuaauuguaaacugu

SEQ ID NO: 3684117 - RNA, 17 nt, Human
uuuaauuguaaacugua

SEQ ID NO: 3684118 - RNA, 15 nt, Human
uuuaauuguaaagua

SEQ ID NO: 3684119 - RNA, 14 nt, Human
uuuaauuguauuuu

SEQ ID NO: 3684120 - RNA, 13 nt, Human
uuuaauugucaug

SEQ ID NO: 3684121 - RNA, 22 nt, Human
uuuaauuguuguuucuuucuag

SEQ ID NO: 3684122 - RNA, 24 nt, Human
uuuaauuguuguuucuuucuagug

SEQ ID NO: 3684123 - RNA, 16 nt, Human
uuuaauuuauuuauua

SEQ ID NO: 3684124 - RNA, 20 nt, Human
uuuaauuuauuuauuaagau

SEQ ID NO: 3684125 - RNA, 21 nt, Human
uuuaauuugaugaaagcugau

SEQ ID NO: 3684126 - RNA, 20 nt, Human
uuuaauuugccaaaauaaug

SEQ ID NO: 3684127 - RNA, 12 nt, Human
uuuaauuuuaca

SEQ ID NO: 3684128 - RNA, 22 nt, Human
uuuaauuuugacacuauaucug

SEQ ID NO: 3684129 - RNA, 22 nt, Human
uuuaauuuuugcuuuuagaaaa

SEQ ID NO: 3684130 - RNA, 19 nt, Human
uuuaauuuuuuugagacag

SEQ ID NO: 3684131 - RNA, 17 nt, Human
uuuaauuuuuuuuagua

SEQ ID NO: 3684132 - RNA, 16 nt, Human
uuuacaaaaauauaaa

SEQ ID NO: 3684133 - RNA, 11 nt, Human
uuuacaaaaga

SEQ ID NO: 3684134 - RNA, 13 nt, Human
uuuacaaaagaug

SEQ ID NO: 3684135 - RNA, 12 nt, Human
uuuacaaagugu

SEQ ID NO: 3684136 - RNA, 16 nt, Human
uuuacaaaguguguau

SEQ ID NO: 3684137 - RNA, 21 nt, Human
uuuacaaauguuaaaaugugu

SEQ ID NO: 3684138 - RNA, 14 nt, Human
uuuacaacacuuua

SEQ ID NO: 3684139 - RNA, 20 nt, Human
uuuacaacacuuuaaugggu

SEQ ID NO: 3684140 - RNA, 16 nt, Human
uuuacaaccuagaagu

SEQ ID NO: 3684141 - RNA, 16 nt, Human
uuuacaagaaguuuau

SEQ ID NO: 3684142 - RNA, 19 nt, Human
uuuacaagaaguuuauucu

SEQ ID NO: 3684143 - RNA, 15 nt, Human
uuuacaagccccccc

SEQ ID NO: 3684144 - RNA, 20 nt, Human
uuuacaagggcauaaaguaa

SEQ ID NO: 3684145 - RNA, 16 nt, Human
uuuacaaguaacaaaa

SEQ ID NO: 3684146 - RNA, 15 nt, Human
uuuacaauguaauua

SEQ ID NO: 3684147 - RNA, 17 nt, Human
uuuacaauguaauuauu

SEQ ID NO: 3684148 - RNA, 14 nt, Human
uuuacaauguauua

SEQ ID NO: 3684149 - RNA, 15 nt, Human
uuuacaauugaaaug

SEQ ID NO: 3684150 - RNA, 18 nt, Human
uuuacaauuuacaaagug

SEQ ID NO: 3684151 - RNA, 19 nt, Human
uuuacaauuuacaaagugu

SEQ ID NO: 3684152 - RNA, 21 nt, Human
uuuacacacuguacacauaag

SEQ ID NO: 3684153 - RNA, 22 nt, Human
uuuacacacuguacacauaagc

SEQ ID NO: 3684154 - RNA, 18 nt, Human
uuuacacucggcuuugga

SEQ ID NO: 3684155 - RNA, 16 nt, Human
uuuacacucuuuguaa

SEQ ID NO: 3684156 - RNA, 11 nt, Human
uuuacacugua

SEQ ID NO: 3684157 - RNA, 13 nt, Human
uuuacacuguacc

SEQ ID NO: 3684158 - RNA, 14 nt, Human
uuuacacuguacca

SEQ ID NO: 3684159 - RNA, 19 nt, Human
uuuacacuuuugagacuuu

SEQ ID NO: 3684160 - RNA, 12 nt, Human
uuuacagaaaaa

SEQ ID NO: 3684161 - RNA, 13 nt, Human
uuuacagaaaaag

SEQ ID NO: 3684162 - RNA, 19 nt, Human
uuuacagaauugcuuguuu

SEQ ID NO: 3684163 - RNA, 13 nt, Human
uuuacagaauuuu

SEQ ID NO: 3684164 - RNA, 16 nt, Human
uuuacagcacuacucu

SEQ ID NO: 3684165 - RNA, 21 nt, Human
uuuacagcacuacucugugcc

SEQ ID NO: 3684166 - RNA, 22 nt, Human
uuuacagccagugggagauguu

SEQ ID NO: 3684167 - RNA, 23 nt, Human
uuuacagcuuucaugauuagcaa

SEQ ID NO: 3684168 - RNA, 14 nt, Human
uuuacaggaacuuc

SEQ ID NO: 3684169 - RNA, 19 nt, Human
uuuacaggaacuucaucau

SEQ ID NO: 3684170 - RNA, 22 nt, Human
uuuacagggagccuccugccca

SEQ ID NO: 3684171 - RNA, 23 nt, Human
uuuacagggagccuccugcccag

SEQ ID NO: 3684172 - RNA, 15 nt, Human
uuuacaguaaauaaa

SEQ ID NO: 3684173 - RNA, 20 nt, Human
uuuacaguaaauaaauuguu

SEQ ID NO: 3684174 - RNA, 18 nt, Human
uuuacagucuauuugaga

SEQ ID NO: 3684175 - RNA, 19 nt, Human
uuuacagugaaaauguaag

SEQ ID NO: 3684176 - RNA, 19 nt, Human
uuuacaguguuucuggcuu

SEQ ID NO: 3684177 - RNA, 15 nt, Human
uuuacaguuacuuuu

SEQ ID NO: 3684178 - RNA, 21 nt, Human
uuuacaguuacuuuuccuugc

SEQ ID NO: 3684179 - RNA, 15 nt, Human
uuuacaguuauagaa

SEQ ID NO: 3684180 - RNA, 21 nt, Human
uuuacaguuucaaaaacugua

SEQ ID NO: 3684181 - RNA, 19 nt, Human
uuuacauaacugccuugaa

SEQ ID NO: 3684182 - RNA, 13 nt, Human
uuuacauagucug

SEQ ID NO: 3684183 - RNA, 19 nt, Human
uuuacauccuucacugcuc

SEQ ID NO: 3684184 - RNA, 14 nt, Human
uuuacaugcuuauu

SEQ ID NO: 3684185 - RNA, 16 nt, Human
uuuacaugcuuauucc

SEQ ID NO: 3684186 - RNA, 20 nt, Human
uuuacaugcuuauuccauga

SEQ ID NO: 3684187 - RNA, 16 nt, Human
uuuacauggcuggagc

SEQ ID NO: 3684188 - RNA, 22 nt, Human
uuuacauggcuggagcuagaau

SEQ ID NO: 3684189 - RNA, 21 nt, Human
uuuacaugugauguuuuagug

SEQ ID NO: 3684190 - RNA, 20 nt, Human
uuuacauguguagccuaugu

SEQ ID NO: 3684191 - RNA, 21 nt, Human
uuuacauguguagccuauguu

SEQ ID NO: 3684192 - RNA, 13 nt, Human
uuuacauuguaaa

SEQ ID NO: 3684193 - RNA, 15 nt, Human
uuuacauuguaaaua

SEQ ID NO: 3684194 - RNA, 18 nt, Human
uuuacauuuaaagcauug

SEQ ID NO: 3684195 - RNA, 13 nt, Human
uuuacauuuuaca

SEQ ID NO: 3684196 - RNA, 19 nt, Human
uuuacauuuuuauuuauga

SEQ ID NO: 3684197 - RNA, 20 nt, Human
uuuacauuuuuauuuaugaa

SEQ ID NO: 3684198 - RNA, 22 nt, Human
uuuacauuuuuauuuaugaagu

SEQ ID NO: 3684199 - RNA, 16 nt, Human
uuuaccaaacagcaaa

SEQ ID NO: 3684200 - RNA, 17 nt, Human
uuuaccaaguuauauaa

SEQ ID NO: 3684201 - RNA, 17 nt, Human
ucacguacugucugauu

SEQ ID NO: 3684202 - RNA, 16 nt, Human
ucacgugcgcugggca

SEQ ID NO: 3684203 - RNA, 21 nt, Human
ucacguggaggagcagugcag

SEQ ID NO: 3684204 - RNA, 16 nt, Human
ucacguguacuggcuc

SEQ ID NO: 3684205 - RNA, 16 nt, Human
ucacgugugugacuca

SEQ ID NO: 3684206 - RNA, 20 nt, Human
ucacguuaccauuuacaugu

SEQ ID NO: 3684207 - RNA, 20 nt, Human
ucacguuaccuugacacaua

SEQ ID NO: 3684208 - RNA, 20 nt, Human
ucacguuggggugauuuaau

SEQ ID NO: 3684209 - RNA, 22 nt, Human
ucacguuucauguaauccucaa

SEQ ID NO: 3684210 - RNA, 17 nt, Human
ucacguuuggugcuucu

SEQ ID NO: 3684211 - RNA, 21 nt, Human
ucacguuuggugcuucucaga

SEQ ID NO: 3684212 - RNA, 13 nt, Human
ucacuaaacuuua

SEQ ID NO: 3684213 - RNA, 23 nt, Human
ucacuaaagcaugaaaugugaau

SEQ ID NO: 3684214 - RNA, 12 nt, Human
ucacuaaaucuu

SEQ ID NO: 3684215 - RNA, 17 nt, Human
ucacuaaaucuuuuaua

SEQ ID NO: 3684216 - RNA, 16 nt, Human
ucacuaacauuauauu

SEQ ID NO: 3684217 - RNA, 22 nt, Human
ucacuaagaacaaaagaagcag

SEQ ID NO: 3684218 - RNA, 15 nt, Human
ucacuaauucauuaa

SEQ ID NO: 3684219 - RNA, 18 nt, Human
ucacuacaagucagcucc

SEQ ID NO: 3684220 - RNA, 19 nt, Human
ucacuacaagucagcucca

SEQ ID NO: 3684221 - RNA, 23 nt, Human
ucacuacccuaauagacuaaaug

SEQ ID NO: 3684222 - RNA, 19 nt, Human
ucacuacccuauucucucu

SEQ ID NO: 3684223 - RNA, 20 nt, Human
ucacuaccuccucagggaug

SEQ ID NO: 3684224 - RNA, 21 nt, Human
ucacuacgggggggagaagga

SEQ ID NO: 3684225 - RNA, 19 nt, Human
ucacuacucacagucucuu

SEQ ID NO: 3684226 - RNA, 15 nt, Human
ucacuacucagcaug

SEQ ID NO: 3684227 - RNA, 17 nt, Human
ucacuagaauggauaaa

SEQ ID NO: 3684228 - RNA, 19 nt, Human
ucacuaggcccccacuugc

SEQ ID NO: 3684229 - RNA, 22 nt, Human
ucacuaggcccccacuugccuc

SEQ ID NO: 3684230 - RNA, 23 nt, Human
ucacuaggcccccacuugccucu

SEQ ID NO: 3684231 - RNA, 21 nt, Human
ucacuauauaggcaucacauu

SEQ ID NO: 3684232 - RNA, 19 nt, Human
ucacuaucccggcugcccu

SEQ ID NO: 3684233 - RNA, 21 nt, Human
ucacuauguugcccaggcagg

SEQ ID NO: 3684234 - RNA, 13 nt, Human
ucacuauuuccuu

SEQ ID NO: 3684235 - RNA, 15 nt, Human
ucacuauuuccuuua

SEQ ID NO: 3684236 - RNA, 19 nt, Human
ucacuauuuccuuuauaau

SEQ ID NO: 3684237 - RNA, 14 nt, Human
ucacucaagcacug

SEQ ID NO: 3684238 - RNA, 17 nt, Human
ucacucaaguucaagga

SEQ ID NO: 3684239 - RNA, 21 nt, Human
ucacucaaguucaaggaccaa

SEQ ID NO: 3684240 - RNA, 13 nt, Human
ucacucacaucuu

SEQ ID NO: 3684241 - RNA, 13 nt, Human
ucacucagagcag

SEQ ID NO: 3684242 - RNA, 13 nt, Human
ucacucagcacca

SEQ ID NO: 3684243 - RNA, 19 nt, Human
ucacucagccacccugagu

SEQ ID NO: 3684244 - RNA, 20 nt, Human
ucacucagccacccugaguu

SEQ ID NO: 3684245 - RNA, 14 nt, Human
ucacucaggcugga

SEQ ID NO: 3684246 - RNA, 17 nt, Human
ucacucauacaucuggc

SEQ ID NO: 3684247 - RNA, 22 nt, Human
ucacucauugcugagccucugc

SEQ ID NO: 3684248 - RNA, 15 nt, Human
ucacuccaccaccca

SEQ ID NO: 3684249 - RNA, 21 nt, Human
ucacuccaggaaggggcugga

SEQ ID NO: 3684250 - RNA, 19 nt, Human
ucacucccaccugcaucug

SEQ ID NO: 3684251 - RNA, 14 nt, Human
ucacuccccaagga

SEQ ID NO: 3684252 - RNA, 16 nt, Human
ucacuccccagccugg

SEQ ID NO: 3684253 - RNA, 18 nt, Human
ucacuccccagccugggc

SEQ ID NO: 3684254 - RNA, 17 nt, Human
ucacuccccuccuuucc

SEQ ID NO: 3684255 - RNA, 21 nt, Human
ucacucccuucuaccugccac

SEQ ID NO: 3684256 - RNA, 20 nt, Human
ucacuccggugugccugcag

SEQ ID NO: 3684257 - RNA, 21 nt, Human
ucacuccggugugccugcagc

SEQ ID NO: 3684258 - RNA, 16 nt, Human
uuucaaguagcuggga

SEQ ID NO: 3684259 - RNA, 14 nt, Human
uuucaauaaaguuu

SEQ ID NO: 3684260 - RNA, 22 nt, Human
uuucaauaacgaaguugggcaa

SEQ ID NO: 3684261 - RNA, 20 nt, Human
uuucaauagcguguguagau

SEQ ID NO: 3684262 - RNA, 14 nt, Human
uuucaauaggaaaa

SEQ ID NO: 3684263 - RNA, 22 nt, Human
uuucaauauauugaacuuuugu

SEQ ID NO: 3684264 - RNA, 21 nt, Human
uuucaaucacuguccuccaca

SEQ ID NO: 3684265 - RNA, 13 nt, Human
uuucaaucucgua

SEQ ID NO: 3684266 - RNA, 19 nt, Human
uuucaaucucguauagaag

SEQ ID NO: 3684267 - RNA, 15 nt, Human
uuucaaucuucaauc

SEQ ID NO: 3684268 - RNA, 10 nt, Human
uuucaaugug

SEQ ID NO: 3684269 - RNA, 14 nt, Human
uuucaauuaaacgg

SEQ ID NO: 3684270 - RNA, 23 nt, Human
uuucaauuaauauuaauuuucua

SEQ ID NO: 3684271 - RNA, 18 nt, Human
uuucaauucaaaaaugua

SEQ ID NO: 3684272 - RNA, 12 nt, Human
uuucacaaauau

SEQ ID NO: 3684273 - RNA, 16 nt, Human
uuucacaaauauuaaa

SEQ ID NO: 3684274 - RNA, 20 nt, Human
uuucacaaauauuaaaaagu

SEQ ID NO: 3684275 - RNA, 22 nt, Human
uuucacaaccuucuguggcuca

SEQ ID NO: 3684276 - RNA, 14 nt, Human
uuucacaaggucuu

SEQ ID NO: 3684277 - RNA, 19 nt, Human
uuucacaccugaaaauguu

SEQ ID NO: 3684278 - RNA, 17 nt, Human
uuucacagaaaauaagg

SEQ ID NO: 3684279 - RNA, 19 nt, Human
uuucacaguguguuuguga

SEQ ID NO: 3684280 - RNA, 18 nt, Human
uuucacaguuugaaauaa

SEQ ID NO: 3684281 - RNA, 15 nt, Human
uuucacaguuuuucc

SEQ ID NO: 3684282 - RNA, 15 nt, Human
uuucacauaaaugca

SEQ ID NO: 3684283 - RNA, 18 nt, Human
uuucacauagcugucuag

SEQ ID NO: 3684284 - RNA, 21 nt, Human
uuucacauaucuaguaugaaa

SEQ ID NO: 3684285 - RNA, 14 nt, Human
uuucacaugaacau

SEQ ID NO: 3684286 - RNA, 13 nt, Human
uuucacauucuua

SEQ ID NO: 3684287 - RNA, 15 nt, Human
uuucacauucuuaua

SEQ ID NO: 3684288 - RNA, 21 nt, Human
uuucacauucuuauaaauaug

SEQ ID NO: 3684289 - RNA, 16 nt, Human
uuucacauucuuggcu

SEQ ID NO: 3684290 - RNA, 21 nt, Human
uuucaccaacuauagaaugua

SEQ ID NO: 3684291 - RNA, 21 nt, Human
uuucaccaugauggccaggcu

SEQ ID NO: 3684292 - RNA, 15 nt, Human
uuucacccacagaaa

SEQ ID NO: 3684293 - RNA, 17 nt, Human
uuucacccacagaaaga

SEQ ID NO: 3684294 - RNA, 19 nt, Human
uuucacccacagaaagaga

SEQ ID NO: 3684295 - RNA, 14 nt, Human
uuucaccccucccu

SEQ ID NO: 3684296 - RNA, 17 nt, Human
uuucaccccucccuuuc

SEQ ID NO: 3684297 - RNA, 18 nt, Human
uuucaccccucccuuucu

SEQ ID NO: 3684298 - RNA, 21 nt, Human
uuucacccuuaacccaaggag

SEQ ID NO: 3684299 - RNA, 21 nt, Human
uuucaccuccuucaauuccau

SEQ ID NO: 3684300 - RNA, 14 nt, Human
uuucaccuguaaac

SEQ ID NO: 3684301 - RNA, 22 nt, Human
uuucaccuguuuuuaagcuguu

SEQ ID NO: 3684302 - RNA, 23 nt, Human
uuucaccuguuuuuaagcuguuu

SEQ ID NO: 3684303 - RNA, 19 nt, Human
uuucaccuuuacuuuagaa

SEQ ID NO: 3684304 - RNA, 18 nt, Human
uuucaccuuuucaggaaa

SEQ ID NO: 3684305 - RNA, 20 nt, Human
uuucacgccugaggcaauua

SEQ ID NO: 3684306 - RNA, 18 nt, Human
uuucacggaaguuuucaa

SEQ ID NO: 3684307 - RNA, 12 nt, Human
uuucacucacau

SEQ ID NO: 3684308 - RNA, 18 nt, Human
uuucacucuaagucaugu

SEQ ID NO: 3684309 - RNA, 13 nt, Human
uuucacugccaua

SEQ ID NO: 3684310 - RNA, 20 nt, Human
uuucacugcugcaaggccuu

SEQ ID NO: 3684311 - RNA, 15 nt, Human
uuucacuggagcaca

SEQ ID NO: 3684312 - RNA, 16 nt, Human
uuucacuggagcacaa

SEQ ID NO: 3684313 - RNA, 14 nt, Human
uuucacuuauaccu

SEQ ID NO: 3684314 - RNA, 14 nt, Human
uuucacuucuuucc

SEQ ID NO: 3684315 - RNA, 21 nt, Human
uuucacuuucacauagauguc

SEQ ID NO: 3684316 - RNA, 22 nt, Human
uuucagaaauacagauaaauga

SEQ ID NO: 3684317 - RNA, 20 nt, Human
uuucagaaguuaguuuguau

SEQ ID NO: 3684318 - RNA, 22 nt, Human
uuucagaaguuaguuuguauau

SEQ ID NO: 3684319 - RNA, 22 nt, Human
uuucagaaguuuaaauauuaag

SEQ ID NO: 3684320 - RNA, 11 nt, Human
uuucagaaucu

SEQ ID NO: 3684321 - RNA, 17 nt, Human
uuucagaaucugaaugu

SEQ ID NO: 3684322 - RNA, 20 nt, Human
uuucagaaucugaauguaau

SEQ ID NO: 3684323 - RNA, 13 nt, Human
uuucagaccuuuu

SEQ ID NO: 3684324 - RNA, 11 nt, Human
uuucagacucc

SEQ ID NO: 3684325 - RNA, 13 nt, Human
uuucagacugcuu

SEQ ID NO: 3684326 - RNA, 16 nt, Human
uuucagagaccauugc

SEQ ID NO: 3684327 - RNA, 17 nt, Human
uuucagagaccauugca

SEQ ID NO: 3684328 - RNA, 15 nt, Human
uuucagauaaucaca

SEQ ID NO: 3684329 - RNA, 14 nt, Human
uuucagauauaaaa

SEQ ID NO: 3684330 - RNA, 16 nt, Human
uuucagauauaaaaga

SEQ ID NO: 3684331 - RNA, 15 nt, Human
uuucagauguaaugu

SEQ ID NO: 3684332 - RNA, 19 nt, Human
uuucagauguaauguuuuc

SEQ ID NO: 3684333 - RNA, 12 nt, Human
uuucagaugucu

SEQ ID NO: 3684334 - RNA, 17 nt, Human
uuucagaugucuucugc

SEQ ID NO: 3684335 - RNA, 16 nt, Human
uuucagauuugcacaa

SEQ ID NO: 3684336 - RNA, 15 nt, Human
uuucagauuuugaua

SEQ ID NO: 3684337 - RNA, 20 nt, Human
uuucagauuuuuuauuugaa

SEQ ID NO: 3684338 - RNA, 12 nt, Human
uuucagcacuag

SEQ ID NO: 3684339 - RNA, 14 nt, Human
uuucagcagacuau

SEQ ID NO: 3684340 - RNA, 15 nt, Human
uuucagcagcugcag

SEQ ID NO: 3684341 - RNA, 18 nt, Human
uuucagcaugaaaaugug

SEQ ID NO: 3684342 - RNA, 14 nt, Human
uuucagcauugaua

SEQ ID NO: 3684343 - RNA, 15 nt, Human
uuucagccaagaauu

SEQ ID NO: 3684344 - RNA, 16 nt, Human
uuucagccaagaauuc

SEQ ID NO: 3684345 - RNA, 17 nt, Human
uuucagcgauguaugca

SEQ ID NO: 3684346 - RNA, 21 nt, Human
uuucagcgauguaugcagcua

SEQ ID NO: 3684347 - RNA, 20 nt, Human
uuucagcuaagggaagacau

SEQ ID NO: 3684348 - RNA, 21 nt, Human
uuucagcuaagggaagacauu

SEQ ID NO: 3684349 - RNA, 23 nt, Human
uuucagcuaagggaagacauuuc

SEQ ID NO: 3684350 - RNA, 22 nt, Human
uuucagcuaggaacaaaucuuc

SEQ ID NO: 3684351 - RNA, 16 nt, Human
uuucagcuccugacca

SEQ ID NO: 3684352 - RNA, 21 nt, Human
uuucagcucucuguauaaaca

SEQ ID NO: 3684353 - RNA, 21 nt, Human
uuucagcugugaacauggacu

SEQ ID NO: 3684354 - RNA, 14 nt, Human
uuucagcuucugcu

SEQ ID NO: 3684355 - RNA, 20 nt, Human
uuucagcuucugcugggcug

SEQ ID NO: 3684356 - RNA, 12 nt, Human
uuucaggaaaau

SEQ ID NO: 3684357 - RNA, 21 nt, Human
uuucaggaggaauacugaaca

SEQ ID NO: 3684358 - RNA, 16 nt, Human
uuucaggauacucugu

SEQ ID NO: 3684359 - RNA, 15 nt, Human
uuucagggcuggcuc

SEQ ID NO: 3684360 - RNA, 19 nt, Human
uuucaggugcucaaaaugc

SEQ ID NO: 3684361 - RNA, 18 nt, Human
uuucagguguuuaguugc

SEQ ID NO: 3684362 - RNA, 18 nt, Human
uuucagguuauauccaau

SEQ ID NO: 3684363 - RNA, 14 nt, Human
uuucagguuuguca

SEQ ID NO: 3684364 - RNA, 14 nt, Human
uuucagguuuuagu

SEQ ID NO: 3684365 - RNA, 16 nt, Human
uuucaguaagaucaag

SEQ ID NO: 3684366 - RNA, 18 nt, Human
uuucaguaauaaaacauc

SEQ ID NO: 3684367 - RNA, 21 nt, Human
uuucaguacuucagcaagaga

SEQ ID NO: 3684368 - RNA, 23 nt, Human
uuucaguacuucagcaagagaga

SEQ ID NO: 3684369 - RNA, 19 nt, Human
uuucaguacuuuuuuaaau

SEQ ID NO: 3684370 - RNA, 14 nt, Human
uuucaguauaauuu

SEQ ID NO: 3684371 - RNA, 14 nt, Human
uuucaguauuauau

SEQ ID NO: 3684372 - RNA, 16 nt, Human
uuucagucaaaacuuu

SEQ ID NO: 3684373 - RNA, 21 nt, Human
uuucagucauauaaaagcuau

SEQ ID NO: 3684374 - RNA, 18 nt, Human
uuucaguccccacagaua

SEQ ID NO: 3684375 - RNA, 17 nt, Human
uuucaguccuguaguuu

SEQ ID NO: 3684376 - RNA, 17 nt, Human
uuucagugaaagcauca

SEQ ID NO: 3684377 - RNA, 22 nt, Human
uuucaguggcacgucaucuagu

SEQ ID NO: 3684378 - RNA, 21 nt, Human
uuucaguggggcagucauuau

SEQ ID NO: 3684379 - RNA, 14 nt, Human
uuucaguguacaug

SEQ ID NO: 3684380 - RNA, 21 nt, Human
uuucagugucaaauaaacacu

SEQ ID NO: 3684381 - RNA, 16 nt, Human
uuucaguguuaccugu

SEQ ID NO: 3684382 - RNA, 18 nt, Human
uuucauaaauuauuugau

SEQ ID NO: 3684383 - RNA, 14 nt, Human
uuucauaaauuuga

SEQ ID NO: 3684384 - RNA, 22 nt, Human
uuucauaacuuauugcugauuu

SEQ ID NO: 3684385 - RNA, 19 nt, Human
uuucauacucuagauuuug

SEQ ID NO: 3684386 - RNA, 20 nt, Human
uuucauagauugagaaguuu

SEQ ID NO: 3684387 - RNA, 16 nt, Human
uuucauaggucugaaa

SEQ ID NO: 3684388 - RNA, 15 nt, Human
uuucauauaguuagc

SEQ ID NO: 3684389 - RNA, 22 nt, Human
uuucauauguugcucagucucc

SEQ ID NO: 3684390 - RNA, 16 nt, Human
uuucauauucuuucaa

SEQ ID NO: 3684391 - RNA, 18 nt, Human
uuucauauucuuucaauu

SEQ ID NO: 3684392 - RNA, 21 nt, Human
uuucauauuuuagcuacuaua

SEQ ID NO: 3684393 - RNA, 17 nt, Human
uuucaucagaacagcug

SEQ ID NO: 3684394 - RNA, 13 nt, Human
uuucaucauuuuu

SEQ ID NO: 3684395 - RNA, 22 nt, Human
uuucauccuaaagaacaaagua

SEQ ID NO: 3684396 - RNA, 18 nt, Human
uuucaucuauuucugaga

SEQ ID NO: 3684397 - RNA, 23 nt, Human
uuucaucucauuuaagggaaaaa

SEQ ID NO: 3684398 - RNA, 15 nt, Human
uuucaucugcucucc

SEQ ID NO: 3684399 - RNA, 18 nt, Human
uuucaucugcucuccuuc

SEQ ID NO: 3684400 - RNA, 15 nt, Human
uuucaucuucaguug

SEQ ID NO: 3684401 - RNA, 17 nt, Human
uuucaugaaaauaccau

SEQ ID NO: 3684402 - RNA, 16 nt, Human
uuucaugauuuugaaa

SEQ ID NO: 3684403 - RNA, 17 nt, Human
uuucaugcaaacucuuu

SEQ ID NO: 3684404 - RNA, 17 nt, Human
uuucaugcucugcaaaa

SEQ ID NO: 3684405 - RNA, 21 nt, Human
uuucaugcuguucaugaaaga

SEQ ID NO: 3684406 - RNA, 14 nt, Human
uuucaugcuuuauc

SEQ ID NO: 3684407 - RNA, 16 nt, Human
uuucaugcuuuaucaa

SEQ ID NO: 3684408 - RNA, 19 nt, Human
uuucauggggguauuaucc

SEQ ID NO: 3684409 - RNA, 14 nt, Human
uuucauguaaaaca

SEQ ID NO: 3684410 - RNA, 15 nt, Human
uuucauguacugcau

SEQ ID NO: 3684411 - RNA, 18 nt, Human
uuucaugucccagaacuu

SEQ ID NO: 3684412 - RNA, 17 nt, Human
uuucauguccuguguca

SEQ ID NO: 3684413 - RNA, 22 nt, Human
uuucauguccugugucaguuua

SEQ ID NO: 3684414 - RNA, 16 nt, Human
uuucauguuuuaacaa

SEQ ID NO: 3684415 - RNA, 17 nt, Human
uuucauguuuuaacaaa

SEQ ID NO: 3684416 - RNA, 16 nt, Human
uuucauguuuugugac

SEQ ID NO: 3684417 - RNA, 18 nt, Human
uuucauguuuugugacua

SEQ ID NO: 3684418 - RNA, 23 nt, Human
uuucauuaaaggcuucucucuca

SEQ ID NO: 3684419 - RNA, 21 nt, Human
uuucauuaauacagggcauuu

SEQ ID NO: 3684420 - RNA, 21 nt, Human
uuucauuacaauggaaacaau

SEQ ID NO: 3684421 - RNA, 13 nt, Human
uuucauuauuuua

SEQ ID NO: 3684422 - RNA, 15 nt, Human
uuucauuauuuuauu

SEQ ID NO: 3684423 - RNA, 11 nt, Human
uuucauuccau

SEQ ID NO: 3684424 - RNA, 13 nt, Human
uuucauuccuuca

SEQ ID NO: 3684425 - RNA, 21 nt, Human
uuucauuccuucagauuuggc

SEQ ID NO: 3684426 - RNA, 21 nt, Human
uuucauugauaugaaaaauau

SEQ ID NO: 3684427 - RNA, 14 nt, Human
uuucauugucugug

SEQ ID NO: 3684428 - RNA, 15 nt, Human
uuucauugucuguga

SEQ ID NO: 3684429 - RNA, 16 nt, Human
uuucauugucugugaa

SEQ ID NO: 3684430 - RNA, 19 nt, Human
uuucauuuaagggaaagaa

SEQ ID NO: 3684431 - RNA, 17 nt, Human
uuucauuuacuguggcu

SEQ ID NO: 3684432 - RNA, 19 nt, Human
uuucauuuagucaugugac

SEQ ID NO: 3684433 - RNA, 20 nt, Human
uuucauuuaucuauaauuua

SEQ ID NO: 3684434 - RNA, 19 nt, Human
uuucauuuaugauacaaaa

SEQ ID NO: 3684435 - RNA, 16 nt, Human
uuucauuucaaaaugc

SEQ ID NO: 3684436 - RNA, 16 nt, Human
uuucauuucuucuaca

SEQ ID NO: 3684437 - RNA, 12 nt, Human
uuucauuucuug

SEQ ID NO: 3684438 - RNA, 14 nt, Human
uuucauuuuaaaaa

SEQ ID NO: 3684439 - RNA, 17 nt, Human
uuucauuuuaaaaaguc

SEQ ID NO: 3684440 - RNA, 16 nt, Human
uuucauuuucucucag

SEQ ID NO: 3684441 - RNA, 14 nt, Human
uuucauuuucugca

SEQ ID NO: 3684442 - RNA, 15 nt, Human
uuucauuuugcuuua

SEQ ID NO: 3684443 - RNA, 22 nt, Human
uuucauuuuguaacaaaugaac

SEQ ID NO: 3684444 - RNA, 22 nt, Human
uuuccaaaacaaaaagaugucu

SEQ ID NO: 3684445 - RNA, 18 nt, Human
uuuccaaaaguggccucu

SEQ ID NO: 3684446 - RNA, 19 nt, Human
uuuccaaaaucucccauuu

SEQ ID NO: 3684447 - RNA, 15 nt, Human
uuuccaaaauuuuuc

SEQ ID NO: 3684448 - RNA, 16 nt, Human
uuuccaaaccuuaucu

SEQ ID NO: 3684449 - RNA, 13 nt, Human
uuuccaaauuauu

SEQ ID NO: 3684450 - RNA, 14 nt, Human
uuuccaaauuauuu

SEQ ID NO: 3684451 - RNA, 15 nt, Human
uuuccaaauucacaa

SEQ ID NO: 3684452 - RNA, 18 nt, Human
uuuccaacaccacagaca

SEQ ID NO: 3684453 - RNA, 21 nt, Human
uuuccaacaccacagacacac

SEQ ID NO: 3684454 - RNA, 22 nt, Human
uuuccaacaccacagacacaca

SEQ ID NO: 3684455 - RNA, 17 nt, Human
uuuccaacguuuggaag

SEQ ID NO: 3684456 - RNA, 13 nt, Human
uuuccaagagcug

SEQ ID NO: 3684457 - RNA, 14 nt, Human
uuuccaagagcuga

SEQ ID NO: 3684458 - RNA, 14 nt, Human
uuuccaagcaaaug

SEQ ID NO: 3684459 - RNA, 18 nt, Human
uuuccaaguaauauaaug

SEQ ID NO: 3684460 - RNA, 16 nt, Human
uuuccaauuauuugac

SEQ ID NO: 3684461 - RNA, 14 nt, Human
uuuccaauucuccu

SEQ ID NO: 3684462 - RNA, 17 nt, Human
uuuccaauucuccuuua

SEQ ID NO: 3684463 - RNA, 19 nt, Human
uuuccacaaaaucugucca

SEQ ID NO: 3684464 - RNA, 17 nt, Human
uuuccacaccuggcacu

SEQ ID NO: 3684465 - RNA, 23 nt, Human
uuuccaccacagccagcaccugg

SEQ ID NO: 3684466 - RNA, 14 nt, Human
uuuccacuacugcu

SEQ ID NO: 3684467 - RNA, 17 nt, Human
uuuccacucaggucugu

SEQ ID NO: 3684468 - RNA, 19 nt, Human
uuuccacuccuccuagcca

SEQ ID NO: 3684469 - RNA, 21 nt, Human
uuuccagaaccacacuugaaa

SEQ ID NO: 3684470 - RNA, 13 nt, Human
uuuccagagcauu

SEQ ID NO: 3684471 - RNA, 16 nt, Human
uuuccagcagaagaca

SEQ ID NO: 3684472 - RNA, 21 nt, Human
uuuccagcagaagacaaaaag

SEQ ID NO: 3684473 - RNA, 18 nt, Human
uuuccaggaaaaagaacu

SEQ ID NO: 3684474 - RNA, 13 nt, Human
uuuccaggaaggc

SEQ ID NO: 3684475 - RNA, 20 nt, Human
uuuccaggacuguuucaaac

SEQ ID NO: 3684476 - RNA, 23 nt, Human
uuuccaggcuucugcuggggccu

SEQ ID NO: 3684477 - RNA, 18 nt, Human
uuuccagguucugaaaga

SEQ ID NO: 3684478 - RNA, 21 nt, Human
uuuccaguaaggaaugauauu

SEQ ID NO: 3684479 - RNA, 15 nt, Human
uuuccaguaccuuug

SEQ ID NO: 3684480 - RNA, 15 nt, Human
uuuccaguauuuuag

SEQ ID NO: 3684481 - RNA, 14 nt, Human
uuuccagucucuug

SEQ ID NO: 3684482 - RNA, 22 nt, Human
uuuccaguggccuggcuccgcu

SEQ ID NO: 3684483 - RNA, 19 nt, Human
uuuccauauuuuuuuccuu

SEQ ID NO: 3684484 - RNA, 22 nt, Human
uuuccauauuuuuuuccuuaca

SEQ ID NO: 3684485 - RNA, 19 nt, Human
uuuccauccauggccagca

SEQ ID NO: 3684486 - RNA, 20 nt, Human
uuuccaugacugcauuuuac

SEQ ID NO: 3684487 - RNA, 21 nt, Human
uuuccauggcaggaaggcuug

SEQ ID NO: 3684488 - RNA, 22 nt, Human
uuuccaugggaccacaacuauu

SEQ ID NO: 3684489 - RNA, 13 nt, Human
uuuccauguaucu

SEQ ID NO: 3684490 - RNA, 14 nt, Human
uuuccauguugcug

SEQ ID NO: 3684491 - RNA, 18 nt, Human
uuuccauuacaaguauuu

SEQ ID NO: 3684492 - RNA, 14 nt, Human
uuuccauuguuuga

SEQ ID NO: 3684493 - RNA, 17 nt, Human
uuuccauuuacuuaaga

SEQ ID NO: 3684494 - RNA, 14 nt, Human
uuuccauuugcauu

SEQ ID NO: 3684495 - RNA, 21 nt, Human
uuuccauuugcauuuguuuau

SEQ ID NO: 3684496 - RNA, 18 nt, Human
uuuccauuuuauaaaugu

SEQ ID NO: 3684497 - RNA, 22 nt, Human
uuucccaaagcaucccucuuag

SEQ ID NO: 3684498 - RNA, 23 nt, Human
uuucccaccccaaccugcucucc

SEQ ID NO: 3684499 - RNA, 12 nt, Human
uuucccacucca

SEQ ID NO: 3684500 - RNA, 15 nt, Human
uuucccacugcaccc

SEQ ID NO: 3684501 - RNA, 21 nt, Human
uuucccacuguuuaaggaguu

SEQ ID NO: 3684502 - RNA, 20 nt, Human
uuucccagcuacaccuuucu

SEQ ID NO: 3684503 - RNA, 11 nt, Human
uuucccaggac

SEQ ID NO: 3684504 - RNA, 14 nt, Human
uuucccaggacccu

SEQ ID NO: 3684505 - RNA, 22 nt, Human
uuucccaggcccacugugccuc

SEQ ID NO: 3684506 - RNA, 16 nt, Human
uuucccagguucuguu

SEQ ID NO: 3684507 - RNA, 14 nt, Human
uuucccauaauuuu

SEQ ID NO: 3684508 - RNA, 14 nt, Human
uuucccaugauuuc

SEQ ID NO: 3684509 - RNA, 21 nt, Human
uuucccauuugugccagagga

SEQ ID NO: 3684510 - RNA, 14 nt, Human
uuuccccaacagug

SEQ ID NO: 3684511 - RNA, 18 nt, Human
uuuccccaccagaugcug

SEQ ID NO: 3684512 - RNA, 19 nt, Human
uuuccccagcaucacuccc

SEQ ID NO: 3684513 - RNA, 11 nt, Human
uuuccccagcc

SEQ ID NO: 3684514 - RNA, 15 nt, Human
uuuccccauaacuca

SEQ ID NO: 3684515 - RNA, 15 nt, Human
uuucccccaaagugg

SEQ ID NO: 3684516 - RNA, 22 nt, Human
uuucccccaccccauuucucuc

SEQ ID NO: 3684517 - RNA, 13 nt, Human
uuuccccccacuc

SEQ ID NO: 3684518 - RNA, 17 nt, Human
uuuccccccacucuccc

SEQ ID NO: 3684519 - RNA, 18 nt, Human
uuucccccuagccugccu

SEQ ID NO: 3684520 - RNA, 23 nt, Human
uuucccccugcauucuuucugua

SEQ ID NO: 3684521 - RNA, 14 nt, Human
uuucccccuuucuu

SEQ ID NO: 3684522 - RNA, 18 nt, Human
uuucccccuuucuuccuc

SEQ ID NO: 3684523 - RNA, 18 nt, Human
uuuccccggucccuugag

SEQ ID NO: 3684524 - RNA, 12 nt, Human
uuuccccuuccu

SEQ ID NO: 3684525 - RNA, 14 nt, Human
uuuccccuuuccug

SEQ ID NO: 3684526 - RNA, 15 nt, Human
uuuccccuuuccugu

SEQ ID NO: 3684527 - RNA, 16 nt, Human
uuuccccuuuccuguc

SEQ ID NO: 3684528 - RNA, 19 nt, Human
uuucccggacuuagaaaac

SEQ ID NO: 3684529 - RNA, 14 nt, Human
uuucccgggcuguc

SEQ ID NO: 3684530 - RNA, 20 nt, Human
uuucccguggccccagccug

SEQ ID NO: 3684531 - RNA, 19 nt, Human
uuucccuaaaauacauuua

SEQ ID NO: 3684532 - RNA, 16 nt, Human
uuucccuauuagagaa

SEQ ID NO: 3684533 - RNA, 21 nt, Human
uugauaauguuaaauuuguaa

SEQ ID NO: 3684534 - RNA, 21 nt, Human
uugauaauucuuauuuugugg

SEQ ID NO: 3684535 - RNA, 16 nt, Human
uugauaauuuuccuuu

SEQ ID NO: 3684536 - RNA, 19 nt, Human
uugauacaguuuucagaaa

SEQ ID NO: 3684537 - RNA, 17 nt, Human
uugauacauucaaauuu

SEQ ID NO: 3684538 - RNA, 18 nt, Human
uugauacauucaaauuug

SEQ ID NO: 3684539 - RNA, 16 nt, Human
uugauaccccugggga

SEQ ID NO: 3684540 - RNA, 20 nt, Human
uugauaccccuggggaacau

SEQ ID NO: 3684541 - RNA, 15 nt, Human
uugauacuaagcauu

SEQ ID NO: 3684542 - RNA, 15 nt, Human
uugauacuacaguuu

SEQ ID NO: 3684543 - RNA, 17 nt, Human
uugauacuacaguuugu

SEQ ID NO: 3684544 - RNA, 16 nt, Human
uugauacuuauauuuu

SEQ ID NO: 3684545 - RNA, 20 nt, Human
uugauacuuauauuuucgua

SEQ ID NO: 3684546 - RNA, 15 nt, Human
uugauagaaaugcca

SEQ ID NO: 3684547 - RNA, 21 nt, Human
uugauagcacagacccugccc

SEQ ID NO: 3684548 - RNA, 12 nt, Human
uugauaguggga

SEQ ID NO: 3684549 - RNA, 13 nt, Human
uugauauaccaaa

SEQ ID NO: 3684550 - RNA, 13 nt, Human
uugauauauauua

SEQ ID NO: 3684551 - RNA, 14 nt, Human
uugauauauauuau

SEQ ID NO: 3684552 - RNA, 16 nt, Human
uugauaucuauaaaau

SEQ ID NO: 3684553 - RNA, 16 nt, Human
uugauaugcuuauaca

SEQ ID NO: 3684554 - RNA, 12 nt, Human
uugauauuguga

SEQ ID NO: 3684555 - RNA, 14 nt, Human
uugauauugugaac

SEQ ID NO: 3684556 - RNA, 15 nt, Human
uugauauuucuagcu

SEQ ID NO: 3684557 - RNA, 13 nt, Human
uugauauuuguau

SEQ ID NO: 3684558 - RNA, 15 nt, Human
uugauauuuguauuu

SEQ ID NO: 3684559 - RNA, 18 nt, Human
uugauauuugugcauuuu

SEQ ID NO: 3684560 - RNA, 21 nt, Human
uugauauuugugcauuuucua

SEQ ID NO: 3684561 - RNA, 17 nt, Human
uugauauuuuuucucuc

SEQ ID NO: 3684562 - RNA, 18 nt, Human
uugaucagaucugacaug

SEQ ID NO: 3684563 - RNA, 20 nt, Human
uugaucagccccacccuggc

SEQ ID NO: 3684564 - RNA, 21 nt, Human
uugaucagccccacccuggcc

SEQ ID NO: 3684565 - RNA, 17 nt, Human
uugaucaguaguuugca

SEQ ID NO: 3684566 - RNA, 14 nt, Human
uugaucaguauaau

SEQ ID NO: 3684567 - RNA, 12 nt, Human
uugaucaguuaa

SEQ ID NO: 3684568 - RNA, 23 nt, Human
uugaucauaaacugacuaucaua

SEQ ID NO: 3684569 - RNA, 17 nt, Human
uugauccauuucuaauu

SEQ ID NO: 3684570 - RNA, 21 nt, Human
uugaucccuguuacccagaga

SEQ ID NO: 3684571 - RNA, 18 nt, Human
uugaucccuucuguuggu

SEQ ID NO: 3684572 - RNA, 17 nt, Human
uugaucugcucagcccu

SEQ ID NO: 3684573 - RNA, 18 nt, Human
uugaucugcucagcccug

SEQ ID NO: 3684574 - RNA, 20 nt, Human
uugaucugcucagcccugga

SEQ ID NO: 3684575 - RNA, 14 nt, Human
uugaucuggaaccc

SEQ ID NO: 3684576 - RNA, 15 nt, Human
uuucuucaaaaugua

SEQ ID NO: 3684577 - RNA, 16 nt, Human
uuucuucaaaauguau

SEQ ID NO: 3684578 - RNA, 23 nt, Human
uuucuucaccucugcuacucaag

SEQ ID NO: 3684579 - RNA, 16 nt, Human
uuucuucacugcaaca

SEQ ID NO: 3684580 - RNA, 15 nt, Human
uuucuucagggcugc

SEQ ID NO: 3684581 - RNA, 13 nt, Human
uuucuucauccaa

SEQ ID NO: 3684582 - RNA, 18 nt, Human
uuucuucaugcaaugaca

SEQ ID NO: 3684583 - RNA, 22 nt, Human
uuucuucaugcaaugacaucuu

SEQ ID NO: 3684584 - RNA, 18 nt, Human
uuucuuccuguuaaugua

SEQ ID NO: 3684585 - RNA, 11 nt, Human
uuucuuccuuu

SEQ ID NO: 3684586 - RNA, 12 nt, Human
uuucuucuauuu

SEQ ID NO: 3684587 - RNA, 12 nt, Human
uuucuucucccu

SEQ ID NO: 3684588 - RNA, 20 nt, Human
uuucuucucugugagaaggu

SEQ ID NO: 3684589 - RNA, 21 nt, Human
uuucuucuuccacacaugcaa

SEQ ID NO: 3684590 - RNA, 13 nt, Human
uuucuucuucccu

SEQ ID NO: 3684591 - RNA, 20 nt, Human
uuucuugacaaaaccuaacu

SEQ ID NO: 3684592 - RNA, 22 nt, Human
uuucuugagguacucugcacau

SEQ ID NO: 3684593 - RNA, 21 nt, Human
uuucuugauaauuuuccuuua

SEQ ID NO: 3684594 - RNA, 21 nt, Human
uuucuugaucaacaucuuuuc

SEQ ID NO: 3684595 - RNA, 13 nt, Human
uuucuugcauuga

SEQ ID NO: 3684596 - RNA, 13 nt, Human
uuucuugcucccu

SEQ ID NO: 3684597 - RNA, 16 nt, Human
uuucuugcucccuuca

SEQ ID NO: 3684598 - RNA, 19 nt, Human
uuucuugcucccuucagcc

SEQ ID NO: 3684599 - RNA, 15 nt, Human
uuucuugcuuguacc

SEQ ID NO: 3684600 - RNA, 22 nt, Human
uuucuuggcaaaagccuugugu

SEQ ID NO: 3684601 - RNA, 14 nt, Human
uuucuuguaucugg

SEQ ID NO: 3684602 - RNA, 18 nt, Human
uuucuugucuauaaagca

SEQ ID NO: 3684603 - RNA, 20 nt, Human
uuucuugucuauaaagcauu

SEQ ID NO: 3684604 - RNA, 19 nt, Human
uuucuuguguguuuauugu

SEQ ID NO: 3684605 - RNA, 12 nt, Human
uuucuuguuuau

SEQ ID NO: 3684606 - RNA, 13 nt, Human
uuucuuguuuauu

SEQ ID NO: 3684607 - RNA, 15 nt, Human
uuucuuuaaaaaaca

SEQ ID NO: 3684608 - RNA, 14 nt, Human
uuucuuuaaaagaa

SEQ ID NO: 3684609 - RNA, 15 nt, Human
uuucuuuaagaaagu

SEQ ID NO: 3684610 - RNA, 18 nt, Human
uuucuuuaggagauuuau

SEQ ID NO: 3684611 - RNA, 20 nt, Human
uuucuuuauauuuauccacu

SEQ ID NO: 3684612 - RNA, 15 nt, Human
uuucuuucacaaaaa

SEQ ID NO: 3684613 - RNA, 12 nt, Human
uuucuuucuagu

SEQ ID NO: 3684614 - RNA, 13 nt, Human
uuucuuucuuucu

SEQ ID NO: 3684615 - RNA, 15 nt, Human
uuucuuugaauaaau

SEQ ID NO: 3684616 - RNA, 16 nt, Human
uuucuuugaucaugaa

SEQ ID NO: 3684617 - RNA, 15 nt, Human
uuucuuugcaaagua

SEQ ID NO: 3684618 - RNA, 15 nt, Human
uuucuuugccaucuc

SEQ ID NO: 3684619 - RNA, 22 nt, Human
uuucuuugccaucucugcucca

SEQ ID NO: 3684620 - RNA, 21 nt, Human
uuucuuugggaauauuugaau

SEQ ID NO: 3684621 - RNA, 19 nt, Human
uuucuuuggugccuuuccu

SEQ ID NO: 3684622 - RNA, 22 nt, Human
uuucuuuucuggaauguaauca

SEQ ID NO: 3684623 - RNA, 23 nt, Human
uuucuuuugguaaagacuggcuu

SEQ ID NO: 3684624 - RNA, 19 nt, Human
uuucuuuuguaauaaacua

SEQ ID NO: 3684625 - RNA, 20 nt, Human
uuucuuuuguuacuguucuu

SEQ ID NO: 3684626 - RNA, 21 nt, Human
uuucuuuuguuuuuugaagug

SEQ ID NO: 3684627 - RNA, 12 nt, Human
uuucuuuuuaca

SEQ ID NO: 3684628 - RNA, 14 nt, Human
uuucuuuuuacaua

SEQ ID NO: 3684629 - RNA, 19 nt, Human
uuucuuuuucuucuucccu

SEQ ID NO: 3684630 - RNA, 17 nt, Human
uuucuuuuuuaaaauca

SEQ ID NO: 3684631 - RNA, 18 nt, Human
uuucuuuuuuaaauuaau

SEQ ID NO: 3684632 - RNA, 15 nt, Human
uuucuuuuuugauau

SEQ ID NO: 3684633 - RNA, 18 nt, Human
uuugaaaaacugcucaua

SEQ ID NO: 3684634 - RNA, 12 nt, Human
uuugaaaaauau

SEQ ID NO: 3684635 - RNA, 13 nt, Human
uuugaaaaauaua

SEQ ID NO: 3684636 - RNA, 22 nt, Human
uuugaaaaauuccuauugugau

SEQ ID NO: 3684637 - RNA, 16 nt, Human
uuugaaaacagaaauu

SEQ ID NO: 3684638 - RNA, 18 nt, Human
uuugaaaagcagacauuu

SEQ ID NO: 3684639 - RNA, 15 nt, Human
uuugaaaagcuauua

SEQ ID NO: 3684640 - RNA, 19 nt, Human
uuugaaaagcuauuagcca

SEQ ID NO: 3684641 - RNA, 22 nt, Human
uuugaaaagcuucuuaauuaau

SEQ ID NO: 3684642 - RNA, 20 nt, Human
uuugaaaaggcgguacuagu

SEQ ID NO: 3684643 - RNA, 18 nt, Human
uuugaaaauaguuauuca

SEQ ID NO: 3684644 - RNA, 20 nt, Human
uuugaaaauaguuauucagu

SEQ ID NO: 3684645 - RNA, 15 nt, Human
uuugaaaauaguuua

SEQ ID NO: 3684646 - RNA, 18 nt, Human
uuugaaaauaguuuauuu

SEQ ID NO: 3684647 - RNA, 23 nt, Human
uuugaaacacugguuuuaaauau

SEQ ID NO: 3684648 - RNA, 13 nt, Human
uuugaaacauugc

SEQ ID NO: 3684649 - RNA, 16 nt, Human
uuugaaacauugcuuu

SEQ ID NO: 3684650 - RNA, 21 nt, Human
uuugaaagaauagaacacagu

SEQ ID NO: 3684651 - RNA, 23 nt, Human
uuugaaagacuuccaaagaaugu

SEQ ID NO: 3684652 - RNA, 22 nt, Human
uuugaaagggaucaucaugcag

SEQ ID NO: 3684653 - RNA, 19 nt, Human
uuugaaagucuguccuuga

SEQ ID NO: 3684654 - RNA, 21 nt, Human
uuugaaagugaauaaacuuca

SEQ ID NO: 3684655 - RNA, 14 nt, Human
uuugaaagugccuu

SEQ ID NO: 3684656 - RNA, 21 nt, Human
uuugaaagugccuuugcagcu

SEQ ID NO: 3684657 - RNA, 23 nt, Human
uuugaaagugccuuugcagcuca

SEQ ID NO: 3684658 - RNA, 16 nt, Human
uuugaaauaagcuauu

SEQ ID NO: 3684659 - RNA, 19 nt, Human
uuugaaauaagcuauuuga

SEQ ID NO: 3684660 - RNA, 19 nt, Human
uuugaaauaccucauguuu

SEQ ID NO: 3684661 - RNA, 16 nt, Human
uuugaaauauggucuu

SEQ ID NO: 3684662 - RNA, 15 nt, Human
uuugaaauauugacu

SEQ ID NO: 3684663 - RNA, 14 nt, Human
uuugaaaucaguaa

SEQ ID NO: 3684664 - RNA, 20 nt, Human
uuugaaaucaguaaacacug

SEQ ID NO: 3684665 - RNA, 13 nt, Human
uuugaaaugaaau

SEQ ID NO: 3684666 - RNA, 15 nt, Human
uuugaaaugaaauuu

SEQ ID NO: 3684667 - RNA, 22 nt, Human
uuugaaaugaaauuuaaacauu

SEQ ID NO: 3684668 - RNA, 21 nt, Human
uuugaaauuauguaaauuaug

SEQ ID NO: 3684669 - RNA, 17 nt, Human
uuugaaauucugaauuu

SEQ ID NO: 3684670 - RNA, 14 nt, Human
uuugaacacuggcu

SEQ ID NO: 3684671 - RNA, 14 nt, Human
uuugaaccaaaaca

SEQ ID NO: 3684672 - RNA, 13 nt, Human
uuugaaccaauaa

SEQ ID NO: 3684673 - RNA, 15 nt, Human
uuugaacuaagaaac

SEQ ID NO: 3684674 - RNA, 15 nt, Human
uuugaacucagaucu

SEQ ID NO: 3684675 - RNA, 14 nt, Human
uuugaacucuucaa

SEQ ID NO: 3684676 - RNA, 15 nt, Human
uuugaacugauaaag

SEQ ID NO: 3684677 - RNA, 19 nt, Human
uuugaacugauaaagauga

SEQ ID NO: 3684678 - RNA, 17 nt, Human
uuugaacuggcaauugu

SEQ ID NO: 3684679 - RNA, 22 nt, Human
uuugaacuggcaauugucuauu

SEQ ID NO: 3684680 - RNA, 19 nt, Human
uuugaagaaugaacaaauu

SEQ ID NO: 3684681 - RNA, 18 nt, Human
uuugaagcacagugauca

SEQ ID NO: 3684682 - RNA, 21 nt, Human
uuugaagguagaauguuuuca

SEQ ID NO: 3684683 - RNA, 22 nt, Human
uuugaaguaaucccgccaccua

SEQ ID NO: 3684684 - RNA, 13 nt, Human
uuugaaguauuua

SEQ ID NO: 3684685 - RNA, 21 nt, Human
uuugaaguguaggcagacaca

SEQ ID NO: 3684686 - RNA, 22 nt, Human
uuugaaguguaggcagacacag

SEQ ID NO: 3684687 - RNA, 17 nt, Human
uuugaaguuagcuuuaa

SEQ ID NO: 3684688 - RNA, 13 nt, Human
uuugaaguuuaca

SEQ ID NO: 3684689 - RNA, 21 nt, Human
uuugaauaaagaauacuugaa

SEQ ID NO: 3684690 - RNA, 20 nt, Human
uuugaauaaaugucacuuuu

SEQ ID NO: 3684691 - RNA, 23 nt, Human
uuugaauaccauuaaaacugcuu

SEQ ID NO: 3684692 - RNA, 17 nt, Human
uuugaauauaaacacua

SEQ ID NO: 3684693 - RNA, 18 nt, Human
uuugaauauaaacacuau

SEQ ID NO: 3684694 - RNA, 16 nt, Human
uuugaauauuacuccu

SEQ ID NO: 3684695 - RNA, 18 nt, Human
uuugaaucaucaagucuu

SEQ ID NO: 3684696 - RNA, 14 nt, Human
uuugaaugaaaaau

SEQ ID NO: 3684697 - RNA, 22 nt, Human
uuugaauguaugcuucauacag

SEQ ID NO: 3684698 - RNA, 22 nt, Human
uuugaaugugauuuuaaagagu

SEQ ID NO: 3684699 - RNA, 15 nt, Human
uuugaauguguuuca

SEQ ID NO: 3684700 - RNA, 16 nt, Human
uuugaauguuaaauaa

SEQ ID NO: 3684701 - RNA, 21 nt, Human
uuugaauguuaaauaaauugu

SEQ ID NO: 3684702 - RNA, 16 nt, Human
uuugaauuaucagcaa

SEQ ID NO: 3684703 - RNA, 14 nt, Human
uuugaauuuacugg

SEQ ID NO: 3684704 - RNA, 12 nt, Human
uuugaauuuugu

SEQ ID NO: 3684705 - RNA, 14 nt, Human
uuugaauuuugugu

SEQ ID NO: 3684706 - RNA, 18 nt, Human
uuugacaaagguaaauca

SEQ ID NO: 3684707 - RNA, 20 nt, Human
uuugacaauuccuagauaaa

SEQ ID NO: 3684708 - RNA, 17 nt, Human
uuugacacugaaaguuu

SEQ ID NO: 3684709 - RNA, 18 nt, Human
uuugacacugaaaguuuu

SEQ ID NO: 3684710 - RNA, 18 nt, Human
uuugacagaauauguuuc

SEQ ID NO: 3684711 - RNA, 19 nt, Human
uuugacagaauauguuuca

SEQ ID NO: 3684712 - RNA, 17 nt, Human
uuugacauguggaaagu

SEQ ID NO: 3684713 - RNA, 14 nt, Human
uuugacauuuaauu

SEQ ID NO: 3684714 - RNA, 16 nt, Human
uuugacauuuaauuua

SEQ ID NO: 3684715 - RNA, 10 nt, Human
uuugaccucc

SEQ ID NO: 3684716 - RNA, 19 nt, Human
uuugaccucugcagcaaua

SEQ ID NO: 3684717 - RNA, 19 nt, Human
uuugaccuuuuauguagua

SEQ ID NO: 3684718 - RNA, 21 nt, Human
uuugacgucacugauauuuuu

SEQ ID NO: 3684719 - RNA, 21 nt, Human
uuugacuagggauucaggcug

SEQ ID NO: 3684720 - RNA, 16 nt, Human
uuugacuauucuguau

SEQ ID NO: 3684721 - RNA, 19 nt, Human
uuugacucuauuaaaaucu

SEQ ID NO: 3684722 - RNA, 19 nt, Human
uuugacucuggcaaagcuu

SEQ ID NO: 3684723 - RNA, 21 nt, Human
uuugacucuggcaaagcuuuu

SEQ ID NO: 3684724 - RNA, 15 nt, Human
uuugacuggauauuc

SEQ ID NO: 3684725 - RNA, 23 nt, Human
uuugacuuaaugugauuacugcu

SEQ ID NO: 3684726 - RNA, 15 nt, Human
uugaucuggaaccca

SEQ ID NO: 3684727 - RNA, 22 nt, Human
uugaucuguugcaagccccucu

SEQ ID NO: 3684728 - RNA, 17 nt, Human
uugaucuuccucugcua

SEQ ID NO: 3684729 - RNA, 19 nt, Human
uugaucuuccucugcuaaa

SEQ ID NO: 3684730 - RNA, 15 nt, Human
uugaugacuggaauu

SEQ ID NO: 3684731 - RNA, 19 nt, Human
uugaugacuggcauuuuau

SEQ ID NO: 3684732 - RNA, 21 nt, Human
uugaugauacaaugaacacuu

SEQ ID NO: 3684733 - RNA, 22 nt, Human
uugaugcaauccuuacaaauga

SEQ ID NO: 3684734 - RNA, 14 nt, Human
uugaugcacagaga

SEQ ID NO: 3684735 - RNA, 12 nt, Human
uugaugcaugug

SEQ ID NO: 3684736 - RNA, 23 nt, Human
uugaugcauuaaaagaaaauaaa

SEQ ID NO: 3684737 - RNA, 18 nt, Human
uugaugcuggagagguua

SEQ ID NO: 3684738 - RNA, 21 nt, Human
uugaugggaugauugaagaaa

SEQ ID NO: 3684739 - RNA, 13 nt, Human
uugauggguucua

SEQ ID NO: 3684740 - RNA, 18 nt, Human
uugauguaaaaucuuguc

SEQ ID NO: 3684741 - RNA, 23 nt, Human
uugauguaaagauguucuggaua

SEQ ID NO: 3684742 - RNA, 19 nt, Human
uugauguacagucugucau

SEQ ID NO: 3684743 - RNA, 13 nt, Human
uugauguaucuga

SEQ ID NO: 3684744 - RNA, 12 nt, Human
uugaugucagca

SEQ ID NO: 3684745 - RNA, 16 nt, Human
uugaugugugucuagg

SEQ ID NO: 3684746 - RNA, 11 nt, Human
uugauguguuu

SEQ ID NO: 3684747 - RNA, 14 nt, Human
uugauguuccuucc

SEQ ID NO: 3684748 - RNA, 15 nt, Human
uugauguuuguggcc

SEQ ID NO: 3684749 - RNA, 19 nt, Human
uugauguuuguggccucag

SEQ ID NO: 3684750 - RNA, 14 nt, Human
uugauuaaggcagu

SEQ ID NO: 3684751 - RNA, 13 nt, Human
uugauuauaaagu

SEQ ID NO: 3684752 - RNA, 13 nt, Human
uugauuaugcaga

SEQ ID NO: 3684753 - RNA, 20 nt, Human
uugauuauuugcauguuaug

SEQ ID NO: 3684754 - RNA, 16 nt, Human
uugauucacauguuuu

SEQ ID NO: 3684755 - RNA, 20 nt, Human
uugauucacauguuuucaaa

SEQ ID NO: 3684756 - RNA, 15 nt, Human
uugauucagacagcu

SEQ ID NO: 3684757 - RNA, 16 nt, Human
uugauucagacagcug

SEQ ID NO: 3684758 - RNA, 23 nt, Human
uugauucagacagcugccuggga

SEQ ID NO: 3684759 - RNA, 14 nt, Human
uugauucagccugu

SEQ ID NO: 3684760 - RNA, 19 nt, Human
uugauucauaguaacuucu

SEQ ID NO: 3684761 - RNA, 23 nt, Human
uugauucgguauccccccaucuu

SEQ ID NO: 3684762 - RNA, 12 nt, Human
uugauucugcag

SEQ ID NO: 3684763 - RNA, 18 nt, Human
uugauucugcuugagaau

SEQ ID NO: 3684764 - RNA, 12 nt, Human
uugauucuuccu

SEQ ID NO: 3684765 - RNA, 14 nt, Human
uugauugauuugaa

SEQ ID NO: 3684766 - RNA, 13 nt, Human
uugauugcuaaau

SEQ ID NO: 3684767 - RNA, 20 nt, Human
uugauugcuaaauguaacag

SEQ ID NO: 3684768 - RNA, 13 nt, Human
uugauugcuuuuu

SEQ ID NO: 3684769 - RNA, 22 nt, Human
uugauugggcacaucauuucaa

SEQ ID NO: 3684770 - RNA, 17 nt, Human
uugauugucagcuacua

SEQ ID NO: 3684771 - RNA, 17 nt, Human
uugauuuaaacacacag

SEQ ID NO: 3684772 - RNA, 16 nt, Human
uugauuuaauaacaua

SEQ ID NO: 3684773 - RNA, 12 nt, Human
uugauuuaugca

SEQ ID NO: 3684774 - RNA, 13 nt, Human
uugauuuauuaac

SEQ ID NO: 3684775 - RNA, 20 nt, Human
uugauuucaaaguuuuguug

SEQ ID NO: 3684776 - RNA, 17 nt, Human
uugauuucccuucuucu

SEQ ID NO: 3684777 - RNA, 18 nt, Human
uugauuugaagaacaugu

SEQ ID NO: 3684778 - RNA, 13 nt, Human
uugauuugauuuu

SEQ ID NO: 3684779 - RNA, 14 nt, Human
uugauuugcauuga

SEQ ID NO: 3684780 - RNA, 19 nt, Human
uugauuugcauugaacaca

SEQ ID NO: 3684781 - RNA, 15 nt, Human
uugauuuuaaaaugu

SEQ ID NO: 3684782 - RNA, 22 nt, Human
uugauuuuaaaauguacaugua

SEQ ID NO: 3684783 - RNA, 14 nt, Human
uugauuuucuguug

SEQ ID NO: 3684784 - RNA, 18 nt, Human
uugauuuuuaccguuucu

SEQ ID NO: 3684785 - RNA, 15 nt, Human
uugauuuuugucuca

SEQ ID NO: 3684786 - RNA, 19 nt, Human
uugauuuuuuuuuuuaauc

SEQ ID NO: 3684787 - RNA, 20 nt, Human
uugcaaaaacuacaaccaau

SEQ ID NO: 3684788 - RNA, 13 nt, Human
uugcaaaauacau

SEQ ID NO: 3684789 - RNA, 14 nt, Human
uugcaaaauacaug

SEQ ID NO: 3684790 - RNA, 16 nt, Human
uugcaaaauacaugaa

SEQ ID NO: 3684791 - RNA, 17 nt, Human
uugcaaaauacaugaag

SEQ ID NO: 3684792 - RNA, 15 nt, Human
uugcaaaaucaguuu

SEQ ID NO: 3684793 - RNA, 16 nt, Human
uugcaaaaucaguuuu

SEQ ID NO: 3684794 - RNA, 21 nt, Human
uugcaaaaucaguuuuccucu

SEQ ID NO: 3684795 - RNA, 15 nt, Human
uugcaaaauuuccag

SEQ ID NO: 3684796 - RNA, 12 nt, Human
uugcaaacuuua

SEQ ID NO: 3684797 - RNA, 15 nt, Human
uugcaaagaaagaaa

SEQ ID NO: 3684798 - RNA, 12 nt, Human
uugcaaagcaaa

SEQ ID NO: 3684799 - RNA, 22 nt, Human
uugcaaaggagcucacuguggu

SEQ ID NO: 3684800 - RNA, 21 nt, Human
uugcaaaguauuguaaauuau

SEQ ID NO: 3684801 - RNA, 22 nt, Human
uugcaaauaaguguauuuugaa

SEQ ID NO: 3684802 - RNA, 17 nt, Human
uugcaaauauaaacauc

SEQ ID NO: 3684803 - RNA, 16 nt, Human
uugcaaaucaguguuu

SEQ ID NO: 3684804 - RNA, 16 nt, Human
uugcaaaucuugaaau

SEQ ID NO: 3684805 - RNA, 13 nt, Human
uugcaacaaaaua

SEQ ID NO: 3684806 - RNA, 14 nt, Human
uugcaaccgucugu

SEQ ID NO: 3684807 - RNA, 14 nt, Human
uugcaacguuuaca

SEQ ID NO: 3684808 - RNA, 14 nt, Human
uugcaagaaucagu

SEQ ID NO: 3684809 - RNA, 23 nt, Human
uugcaagaugugaauuauugaca

SEQ ID NO: 3684810 - RNA, 12 nt, Human
uugcaaggaagc

SEQ ID NO: 3684811 - RNA, 14 nt, Human
uugcaaggccgcug

SEQ ID NO: 3684812 - RNA, 17 nt, Human
uugcaaggccgcuguuc

SEQ ID NO: 3684813 - RNA, 22 nt, Human
uugcaagggccagaucuguuaa

SEQ ID NO: 3684814 - RNA, 17 nt, Human
uugcaagguuccacaga

SEQ ID NO: 3684815 - RNA, 19 nt, Human
uugcaagguuccacagagu

SEQ ID NO: 3684816 - RNA, 18 nt, Human
uugcaauaacagcugcaa

SEQ ID NO: 3684817 - RNA, 14 nt, Human
uugcaauaaugcag

SEQ ID NO: 3684818 - RNA, 22 nt, Human
uugcaauagaaauccaauugga

SEQ ID NO: 3684819 - RNA, 19 nt, Human
uugcaauaucgaucagaug

SEQ ID NO: 3684820 - RNA, 14 nt, Human
uugcaauggcagcc

SEQ ID NO: 3684821 - RNA, 19 nt, Human
uugcaauuaaacuuccaaa

SEQ ID NO: 3684822 - RNA, 20 nt, Human
uugcacaauauugaacuuuu

SEQ ID NO: 3684823 - RNA, 18 nt, Human
uugcacacaucaucugua

SEQ ID NO: 3684824 - RNA, 19 nt, Human
uugcacacaucaucuguaa

SEQ ID NO: 3684825 - RNA, 21 nt, Human
uugcacacuuuggcccagggu

SEQ ID NO: 3684826 - RNA, 14 nt, Human
uugcacacuuuggu

SEQ ID NO: 3684827 - RNA, 15 nt, Human
uugcacagaaguccu

SEQ ID NO: 3684828 - RNA, 18 nt, Human
uugcacagaaguccugua

SEQ ID NO: 3684829 - RNA, 18 nt, Human
uugcacagcaucucagcu

SEQ ID NO: 3684830 - RNA, 19 nt, Human
uugcacagcaucucagcuc

SEQ ID NO: 3684831 - RNA, 18 nt, Human
uugcacaggaugcuggcc

SEQ ID NO: 3684832 - RNA, 13 nt, Human
uugcacagggauu

SEQ ID NO: 3684833 - RNA, 14 nt, Human
uugcacauggauuc

SEQ ID NO: 3684834 - RNA, 21 nt, Human
uugcacaugucuuaaugaagu

SEQ ID NO: 3684835 - RNA, 22 nt, Human
uugcacaugucuuaaugaaguu

SEQ ID NO: 3684836 - RNA, 16 nt, Human
uugcacauguuuccuc

SEQ ID NO: 3684837 - RNA, 12 nt, Human
uugcacauuguu

SEQ ID NO: 3684838 - RNA, 23 nt, Human
uugcacauuguuguuuuuuuaau

SEQ ID NO: 3684839 - RNA, 14 nt, Human
uugcacauuuugau

SEQ ID NO: 3684840 - RNA, 18 nt, Human
uugcaccacugcacucca

SEQ ID NO: 3684841 - RNA, 21 nt, Human
uugcaccacugcacuccagcc

SEQ ID NO: 3684842 - RNA, 16 nt, Human
uugcacccagcccugg

SEQ ID NO: 3684843 - RNA, 22 nt, Human
uugcaccccaaagcuuuccugc

SEQ ID NO: 3684844 - RNA, 12 nt, Human
uugcaccccucc

SEQ ID NO: 3684845 - RNA, 16 nt, Human
uugcaccccucccauu

SEQ ID NO: 3684846 - RNA, 18 nt, Human
uugcaccuguccccaccc

SEQ ID NO: 3684847 - RNA, 20 nt, Human
uugcacgacgcccucucccc

SEQ ID NO: 3684848 - RNA, 14 nt, Human
uugcacggcugcug

SEQ ID NO: 3684849 - RNA, 15 nt, Human
uugcacguggccucu

SEQ ID NO: 3684850 - RNA, 15 nt, Human
uugcacuaaaguaug

SEQ ID NO: 3684851 - RNA, 15 nt, Human
uugcacuaucuuuca

SEQ ID NO: 3684852 - RNA, 18 nt, Human
uugcacucaaaucuuaag

SEQ ID NO: 3684853 - RNA, 11 nt, Human
uugcacugaag

SEQ ID NO: 3684854 - RNA, 21 nt, Human
uugcacugagggccacacuau

SEQ ID NO: 3684855 - RNA, 17 nt, Human
uugcacuugugauuauu

SEQ ID NO: 3684856 - RNA, 22 nt, Human
uugcacuuuuucuuaaucauuu

SEQ ID NO: 3684857 - RNA, 19 nt, Human
uugcagaaaagcaccugcc

SEQ ID NO: 3684858 - RNA, 22 nt, Human
uugcagaaacauuuugugguca

SEQ ID NO: 3684859 - RNA, 16 nt, Human
uugcagaacuguagcu

SEQ ID NO: 3684860 - RNA, 11 nt, Human
uugcagaacuu

SEQ ID NO: 3684861 - RNA, 13 nt, Human
uugcagaagaggg

SEQ ID NO: 3684862 - RNA, 13 nt, Human
uugcagaaguucu

SEQ ID NO: 3684863 - RNA, 20 nt, Human
uugcagacuagaauucuagu

SEQ ID NO: 3684864 - RNA, 18 nt, Human
uugcagagaagccuuggu

SEQ ID NO: 3684865 - RNA, 19 nt, Human
uugcagaugacaaaaauuc

SEQ ID NO: 3684866 - RNA, 17 nt, Human
uugcagcaauuaaaaau

SEQ ID NO: 3684867 - RNA, 22 nt, Human
uugcagcucccauucuaugugu

SEQ ID NO: 3684868 - RNA, 23 nt, Human
uugcagcucuccccuucucugua

SEQ ID NO: 3684869 - RNA, 13 nt, Human
uugcagcuguuuu

SEQ ID NO: 3684870 - RNA, 17 nt, Human
uugcagcuguuuuguug

SEQ ID NO: 3684871 - RNA, 18 nt, Human
uugcagcuguuuuguuga

SEQ ID NO: 3684872 - RNA, 18 nt, Human
uugcagcuuuauguucau

SEQ ID NO: 3684873 - RNA, 21 nt, Human
uugcagcuuuauguucauuug

SEQ ID NO: 3684874 - RNA, 23 nt, Human
uugcaggagcaguaucaugaagc

SEQ ID NO: 3684875 - RNA, 21 nt, Human
uugcaggcaugcaugugcuug

SEQ ID NO: 3684876 - RNA, 13 nt, Human
uugcagggcagcc

SEQ ID NO: 3684877 - RNA, 22 nt, Human
uauugaauuuuuccuaugcuau

SEQ ID NO: 3684878 - RNA, 21 nt, Human
uauugacaaaauguuauuucc

SEQ ID NO: 3684879 - RNA, 22 nt, Human
uauugacaaaauguuauuuccc

SEQ ID NO: 3684880 - RNA, 15 nt, Human
uauugacaaacucuc

SEQ ID NO: 3684881 - RNA, 21 nt, Human
uauugacaaccgagaagguuu

SEQ ID NO: 3684882 - RNA, 13 nt, Human
uauugacaauaaa

SEQ ID NO: 3684883 - RNA, 19 nt, Human
uauugacaauaaaauauua

SEQ ID NO: 3684884 - RNA, 21 nt, Human
uauugacaauaaaauauuauu

SEQ ID NO: 3684885 - RNA, 14 nt, Human
uauugacacugaac

SEQ ID NO: 3684886 - RNA, 12 nt, Human
uauugacaguug

SEQ ID NO: 3684887 - RNA, 17 nt, Human
uauugacaguugugcag

SEQ ID NO: 3684888 - RNA, 20 nt, Human
uauugacucuggguccuucc

SEQ ID NO: 3684889 - RNA, 17 nt, Human
uauugacuuguauauuu

SEQ ID NO: 3684890 - RNA, 17 nt, Human
uauugagacaaaaauua

SEQ ID NO: 3684891 - RNA, 16 nt, Human
uauugagagagaugug

SEQ ID NO: 3684892 - RNA, 22 nt, Human
uauugagagagauguguaauuu

SEQ ID NO: 3684893 - RNA, 17 nt, Human
uauugagauuguccuca

SEQ ID NO: 3684894 - RNA, 14 nt, Human
uauugagauuucuu

SEQ ID NO: 3684895 - RNA, 18 nt, Human
uauugagauuucuuaaau

SEQ ID NO: 3684896 - RNA, 19 nt, Human
uauugagcaauaugucagu

SEQ ID NO: 3684897 - RNA, 17 nt, Human
uauugagcagaauucau

SEQ ID NO: 3684898 - RNA, 19 nt, Human
uauugagcagaauucauuc

SEQ ID NO: 3684899 - RNA, 21 nt, Human
uauugagcagaauucauucau

SEQ ID NO: 3684900 - RNA, 19 nt, Human
uauugaggaaaaauaugug

SEQ ID NO: 3684901 - RNA, 23 nt, Human
uauugaggccaagaauauugcaa

SEQ ID NO: 3684902 - RNA, 15 nt, Human
uauugaggcuuugug

SEQ ID NO: 3684903 - RNA, 19 nt, Human
uauugaggcuuuguguugu

SEQ ID NO: 3684904 - RNA, 19 nt, Human
uauugaguuccaguugaag

SEQ ID NO: 3684905 - RNA, 19 nt, Human
uauugaguuuguagguaaa

SEQ ID NO: 3684906 - RNA, 21 nt, Human
uauugauaugcuuauacacuu

SEQ ID NO: 3684907 - RNA, 19 nt, Human
uauugaugugcaaaaauuu

SEQ ID NO: 3684908 - RNA, 14 nt, Human
uauugauugggaaa

SEQ ID NO: 3684909 - RNA, 20 nt, Human
uauugauugggaaaacauuu

SEQ ID NO: 3684910 - RNA, 14 nt, Human
uauugauuuaagcu

SEQ ID NO: 3684911 - RNA, 16 nt, Human
uauugcaaaauacaug

SEQ ID NO: 3684912 - RNA, 19 nt, Human
uauugcaaaauacaugaag

SEQ ID NO: 3684913 - RNA, 20 nt, Human
uauugcaaaauagcauuugu

SEQ ID NO: 3684914 - RNA, 22 nt, Human
uauugcaaagguuccaacugua

SEQ ID NO: 3684915 - RNA, 23 nt, Human
uauugcaaagguuccaacuguau

SEQ ID NO: 3684916 - RNA, 14 nt, Human
uauugcaauaaagu

SEQ ID NO: 3684917 - RNA, 16 nt, Human
uauugcaauaaaguau

SEQ ID NO: 3684918 - RNA, 12 nt, Human
uauugcacaugu

SEQ ID NO: 3684919 - RNA, 14 nt, Human
uauugcacaugucu

SEQ ID NO: 3684920 - RNA, 16 nt, Human
uauugcacaugucuua

SEQ ID NO: 3684921 - RNA, 13 nt, Human
uauugcacauugu

SEQ ID NO: 3684922 - RNA, 17 nt, Human
uauugcacauuguaaaa

SEQ ID NO: 3684923 - RNA, 14 nt, Human
uauugcacauuguu

SEQ ID NO: 3684924 - RNA, 15 nt, Human
uauugcacauuguuc

SEQ ID NO: 3684925 - RNA, 15 nt, Human
uauugcaguuauaga

SEQ ID NO: 3684926 - RNA, 22 nt, Human
uauugcaucuggguagcuguaa

SEQ ID NO: 3684927 - RNA, 18 nt, Human
uauugccaaaacccagcu

SEQ ID NO: 3684928 - RNA, 19 nt, Human
uauugccaaaacccagcug

SEQ ID NO: 3684929 - RNA, 20 nt, Human
uauugccaaaacccagcugc

SEQ ID NO: 3684930 - RNA, 21 nt, Human
uauugccaaaacccagcugca

SEQ ID NO: 3684931 - RNA, 17 nt, Human
uauugccaaacauuaau

SEQ ID NO: 3684932 - RNA, 13 nt, Human
uauugcccacgcu

SEQ ID NO: 3684933 - RNA, 14 nt, Human
uauugcccacgcug

SEQ ID NO: 3684934 - RNA, 20 nt, Human
uauugcccaggcuggucuug

SEQ ID NO: 3684935 - RNA, 20 nt, Human
uauugcccaugauauaacuu

SEQ ID NO: 3684936 - RNA, 20 nt, Human
uauugccuaagaauaaacau

SEQ ID NO: 3684937 - RNA, 16 nt, Human
uauugccuucucacca

SEQ ID NO: 3684938 - RNA, 20 nt, Human
uauugccuucucaccagcug

SEQ ID NO: 3684939 - RNA, 17 nt, Human
uauugccuucuuugaag

SEQ ID NO: 3684940 - RNA, 14 nt, Human
uauugcgucuuagc

SEQ ID NO: 3684941 - RNA, 16 nt, Human
uauugcuagagcuccu

SEQ ID NO: 3684942 - RNA, 20 nt, Human
uauugcuaguauuugaauua

SEQ ID NO: 3684943 - RNA, 20 nt, Human
uauugcugaagaaucuacuu

SEQ ID NO: 3684944 - RNA, 23 nt, Human
uauugcugauggugcaaugaccu

SEQ ID NO: 3684945 - RNA, 16 nt, Human
uauugcugauuuuaau

SEQ ID NO: 3684946 - RNA, 22 nt, Human
uauugcugcugguaauuuguau

SEQ ID NO: 3684947 - RNA, 11 nt, Human
uauugcugggg

SEQ ID NO: 3684948 - RNA, 16 nt, Human
uauugcuuaguaaaau

SEQ ID NO: 3684949 - RNA, 19 nt, Human
uauugcuuaguaaaauuua

SEQ ID NO: 3684950 - RNA, 15 nt, Human
uauugcuugcacaaa

SEQ ID NO: 3684951 - RNA, 16 nt, Human
uauugcuuuauaaaua

SEQ ID NO: 3684952 - RNA, 22 nt, Human
uauuggaaauuuguuauaauga

SEQ ID NO: 3684953 - RNA, 14 nt, Human
uauuggcaaagaug

SEQ ID NO: 3684954 - RNA, 20 nt, Human
uauuggccauaagcaacaau

SEQ ID NO: 3684955 - RNA, 23 nt, Human
uauuggcuaaauugaaaccugga

SEQ ID NO: 3684956 - RNA, 16 nt, Human
uauuggcuuuucugau

SEQ ID NO: 3684957 - RNA, 17 nt, Human
uauuggcuuuucugauc

SEQ ID NO: 3684958 - RNA, 21 nt, Human
uauuggcuuuucugauccagu

SEQ ID NO: 3684959 - RNA, 23 nt, Human
uauuggguagauauuuuuucuga

SEQ ID NO: 3684960 - RNA, 14 nt, Human
uauuggguucauua

SEQ ID NO: 3684961 - RNA, 20 nt, Human
uauuggguucauuauuggaa

SEQ ID NO: 3684962 - RNA, 18 nt, Human
uauugguaacauccuuuc

SEQ ID NO: 3684963 - RNA, 22 nt, Human
uauugguaacauccuuucuauu

SEQ ID NO: 3684964 - RNA, 17 nt, Human
uauugguauauccuuuu

SEQ ID NO: 3684965 - RNA, 19 nt, Human
uauugguauauccuuuucu

SEQ ID NO: 3684966 - RNA, 22 nt, Human
uauugguccagcuugcucuuca

SEQ ID NO: 3684967 - RNA, 17 nt, Human
uauugguggcuuuccuu

SEQ ID NO: 3684968 - RNA, 17 nt, Human
uauugguguaagguacu

SEQ ID NO: 3684969 - RNA, 14 nt, Human
uauugguuuuauga

SEQ ID NO: 3684970 - RNA, 13 nt, Human
uauuguaaauaca

SEQ ID NO: 3684971 - RNA, 17 nt, Human
uauuguaacagacauug

SEQ ID NO: 3684972 - RNA, 18 nt, Human
uauuguaacagacauugu

SEQ ID NO: 3684973 - RNA, 20 nt, Human
uauuguaacccugucuggau

SEQ ID NO: 3684974 - RNA, 16 nt, Human
uauuguaacuauguuu

SEQ ID NO: 3684975 - RNA, 19 nt, Human
uauuguaagaaauacugua

SEQ ID NO: 3684976 - RNA, 11 nt, Human
uauuguaauau

SEQ ID NO: 3684977 - RNA, 21 nt, Human
uauuguaaugagugaauugaa

SEQ ID NO: 3684978 - RNA, 15 nt, Human
uauuguacaaaguau

SEQ ID NO: 3684979 - RNA, 12 nt, Human
uauuguacacuu

SEQ ID NO: 3684980 - RNA, 12 nt, Human
uauuguacagaa

SEQ ID NO: 3684981 - RNA, 20 nt, Human
uauuguacagcuguuuaaga

SEQ ID NO: 3684982 - RNA, 14 nt, Human
uauuguacauaaaa

SEQ ID NO: 3684983 - RNA, 22 nt, Human
uauuguacauaaaagaauuuuu

SEQ ID NO: 3684984 - RNA, 13 nt, Human
uauuguaccucuc

SEQ ID NO: 3684985 - RNA, 16 nt, Human
uauuguauauuacaau

SEQ ID NO: 3684986 - RNA, 18 nt, Human
uauuguauuacuagaaga

SEQ ID NO: 3684987 - RNA, 15 nt, Human
uauuguauuuaugug

SEQ ID NO: 3684988 - RNA, 17 nt, Human
uauugucaaagugguga

SEQ ID NO: 3684989 - RNA, 22 nt, Human
uauugucaguaucuguaucucu

SEQ ID NO: 3684990 - RNA, 17 nt, Human
uauugugauuugacugu

SEQ ID NO: 3684991 - RNA, 14 nt, Human
uauugugcaaugug

SEQ ID NO: 3684992 - RNA, 17 nt, Human
uauugugcucagagaca

SEQ ID NO: 3684993 - RNA, 18 nt, Human
uauugugucuuuugcaug

SEQ ID NO: 3684994 - RNA, 19 nt, Human
uauuguguguuauuuaaau

SEQ ID NO: 3684995 - RNA, 14 nt, Human
uauuguguuuguca

SEQ ID NO: 3684996 - RNA, 16 nt, Human
uauuguguuugucauu

SEQ ID NO: 3684997 - RNA, 18 nt, Human
uauuguguuugucauuag

SEQ ID NO: 3684998 - RNA, 17 nt, Human
uauuguuaacucuuguc

SEQ ID NO: 3684999 - RNA, 20 nt, Human
uauuguuccaagacauuguc

SEQ ID NO: 3685000 - RNA, 14 nt, Human
uauuguuccuaagu

SEQ ID NO: 3685001 - RNA, 13 nt, Human
uauuguuguccuu

SEQ ID NO: 3685002 - RNA, 16 nt, Human
uauuguuguccuuuuc

SEQ ID NO: 3685003 - RNA, 18 nt, Human
uauuguuguccuuuucau

SEQ ID NO: 3685004 - RNA, 11 nt, Human
uauuguuuaaa

SEQ ID NO: 3685005 - RNA, 15 nt, Human
uauuguuuaaaauca

SEQ ID NO: 3685006 - RNA, 16 nt, Human
uauuguuuaaaaucau

SEQ ID NO: 3685007 - RNA, 16 nt, Human
uauuguuuaaaaugua

SEQ ID NO: 3685008 - RNA, 22 nt, Human
uauuguuuaaagcaacugucua

SEQ ID NO: 3685009 - RNA, 14 nt, Human
uauuguuuauguaa

SEQ ID NO: 3685010 - RNA, 24 nt, Human
uauuguuuauucuuuuuaaaguau

SEQ ID NO: 3685011 - RNA, 11 nt, Human
uauuguuucua

SEQ ID NO: 3685012 - RNA, 15 nt, Human
uauuguuucugcauu

SEQ ID NO: 3685013 - RNA, 21 nt, Human
uauuguuucuggucacuauau

SEQ ID NO: 3685014 - RNA, 20 nt, Human
uauuguuucuuuaagaaagu

SEQ ID NO: 3685015 - RNA, 14 nt, Human
uauuguuuuacaau

SEQ ID NO: 3685016 - RNA, 20 nt, Human
uauuguuuuacaauaguucu

SEQ ID NO: 3685017 - RNA, 16 nt, Human
uauuguuuugguuugc

SEQ ID NO: 3685018 - RNA, 22 nt, Human
uauuguuuuuccuuguauuuaa

SEQ ID NO: 3685019 - RNA, 16 nt, Human
uauuuaaaaaaaaagu

SEQ ID NO: 3685020 - RNA, 21 nt, Human
uauuuaaaaaacuaaaaacua

SEQ ID NO: 3685021 - RNA, 23 nt, Human
uauuuaaaaauaagucaacagua

SEQ ID NO: 3685022 - RNA, 16 nt, Human
uauuuaaaaauagaaa

SEQ ID NO: 3685023 - RNA, 18 nt, Human
uauuuaaaaauagaaaca

SEQ ID NO: 3685024 - RNA, 13 nt, Human
uauuuaaaacuug

SEQ ID NO: 3685025 - RNA, 23 nt, Human
uauuuaaaagaaagccucagaga

SEQ ID NO: 3685026 - RNA, 14 nt, Human
uuugacuuuaauuu

SEQ ID NO: 3685027 - RNA, 17 nt, Human
uuugacuuucuucugaa

SEQ ID NO: 3685028 - RNA, 13 nt, Human
uuugacuuuucug

SEQ ID NO: 3685029 - RNA, 14 nt, Human
uuugacuuuucugu

SEQ ID NO: 3685030 - RNA, 16 nt, Human
uuugacuuuucuguaa

SEQ ID NO: 3685031 - RNA, 17 nt, Human
uuugacuuuucuguaau

SEQ ID NO: 3685032 - RNA, 16 nt, Human
uuugagaaaauaaagc

SEQ ID NO: 3685033 - RNA, 13 nt, Human
uuugagaaaguca

SEQ ID NO: 3685034 - RNA, 18 nt, Human
uuugagaacaaagaugac

SEQ ID NO: 3685035 - RNA, 18 nt, Human
uuugagaacguaaagaac

SEQ ID NO: 3685036 - RNA, 14 nt, Human
uuugagaagaaaac

SEQ ID NO: 3685037 - RNA, 18 nt, Human
uuugagaagaaaacaucu

SEQ ID NO: 3685038 - RNA, 16 nt, Human
uuugagacaguuucuu

SEQ ID NO: 3685039 - RNA, 19 nt, Human
uuugagacaguuucuuagc

SEQ ID NO: 3685040 - RNA, 22 nt, Human
uuugagacaguuucuuagcuuu

SEQ ID NO: 3685041 - RNA, 16 nt, Human
uuugagaccagccugg

SEQ ID NO: 3685042 - RNA, 23 nt, Human
uuugagaccugaauagcucccag

SEQ ID NO: 3685043 - RNA, 13 nt, Human
uuugagaguucua

SEQ ID NO: 3685044 - RNA, 17 nt, Human
uuugagaucuaaaaaua

SEQ ID NO: 3685045 - RNA, 21 nt, Human
uuugagaucuaaaaauaacug

SEQ ID NO: 3685046 - RNA, 15 nt, Human
uuugagauguaaaaa

SEQ ID NO: 3685047 - RNA, 23 nt, Human
uuugagauuaagaaugccaggaa

SEQ ID NO: 3685048 - RNA, 20 nt, Human
uuugagauugccccaggucu

SEQ ID NO: 3685049 - RNA, 15 nt, Human
uuugagcaacuuucu

SEQ ID NO: 3685050 - RNA, 12 nt, Human
uuugagcugccu

SEQ ID NO: 3685051 - RNA, 14 nt, Human
uuugagcugccuuc

SEQ ID NO: 3685052 - RNA, 15 nt, Human
uuugagcuuaaucuu

SEQ ID NO: 3685053 - RNA, 19 nt, Human
uuugagcuuagugaaauua

SEQ ID NO: 3685054 - RNA, 18 nt, Human
uuugaggaaauuugcagc

SEQ ID NO: 3685055 - RNA, 21 nt, Human
uuugaggagcagcuucaguug

SEQ ID NO: 3685056 - RNA, 19 nt, Human
uuugaggagugguuuuucu

SEQ ID NO: 3685057 - RNA, 15 nt, Human
uuugaggauauauuu

SEQ ID NO: 3685058 - RNA, 23 nt, Human
uuugagggacaaauuuaaaacaa

SEQ ID NO: 3685059 - RNA, 23 nt, Human
uuugaggggaggaguuccacaga

SEQ ID NO: 3685060 - RNA, 11 nt, Human
uuugaggggcu

SEQ ID NO: 3685061 - RNA, 21 nt, Human
uuugaggguguauauuuucug

SEQ ID NO: 3685062 - RNA, 15 nt, Human
uuugagguaaagaua

SEQ ID NO: 3685063 - RNA, 17 nt, Human
uuugaggucuguucuuu

SEQ ID NO: 3685064 - RNA, 16 nt, Human
uuugagguggaagagg

SEQ ID NO: 3685065 - RNA, 21 nt, Human
uuugagugccuuacacaaugg

SEQ ID NO: 3685066 - RNA, 22 nt, Human
uuugaguggaguuacugaacag

SEQ ID NO: 3685067 - RNA, 18 nt, Human
uuugagugugugugugca

SEQ ID NO: 3685068 - RNA, 20 nt, Human
uuugauaaaguaguaaaaau

SEQ ID NO: 3685069 - RNA, 13 nt, Human
uuugauaaaguuu

SEQ ID NO: 3685070 - RNA, 18 nt, Human
uuugauaaaguuucucag

SEQ ID NO: 3685071 - RNA, 13 nt, Human
uuugauaaauagu

SEQ ID NO: 3685072 - RNA, 15 nt, Human
uuugauaacuguuua

SEQ ID NO: 3685073 - RNA, 18 nt, Human
uuugauaaucaacugggc

SEQ ID NO: 3685074 - RNA, 19 nt, Human
uuugauaauguuaaauuug

SEQ ID NO: 3685075 - RNA, 22 nt, Human
uuugauacagucaacaagccug

SEQ ID NO: 3685076 - RNA, 21 nt, Human
uuugauacaguuuucagaaaa

SEQ ID NO: 3685077 - RNA, 22 nt, Human
uuugauacaguuuucagaaaaa

SEQ ID NO: 3685078 - RNA, 16 nt, Human
uuugauaccccugggg

SEQ ID NO: 3685079 - RNA, 16 nt, Human
uuugauacuaagcauu

SEQ ID NO: 3685080 - RNA, 13 nt, Human
uuugauacuuaua

SEQ ID NO: 3685081 - RNA, 14 nt, Human
uuugauacuuauau

SEQ ID NO: 3685082 - RNA, 18 nt, Human
uuugauacuuauauuuuc

SEQ ID NO: 3685083 - RNA, 15 nt, Human
uuugauacuuguuca

SEQ ID NO: 3685084 - RNA, 21 nt, Human
uuugauagauuuucugcuacu

SEQ ID NO: 3685085 - RNA, 21 nt, Human
uuugauauaccaaauuaaaaa

SEQ ID NO: 3685086 - RNA, 20 nt, Human
uuugauaucacagucuaauu

SEQ ID NO: 3685087 - RNA, 23 nt, Human
uuugauauccaaagcugaauaca

SEQ ID NO: 3685088 - RNA, 19 nt, Human
uuugauaugaguauacaau

SEQ ID NO: 3685089 - RNA, 20 nt, Human
uuugauaugcauauuuguuu

SEQ ID NO: 3685090 - RNA, 17 nt, Human
uuugaucaguauaauuu

SEQ ID NO: 3685091 - RNA, 12 nt, Human
uuugaucaugaa

SEQ ID NO: 3685092 - RNA, 19 nt, Human
uuugaucaugaauaacuga

SEQ ID NO: 3685093 - RNA, 14 nt, Human
uuugaucucacauu

SEQ ID NO: 3685094 - RNA, 12 nt, Human
uuugaucuucaa

SEQ ID NO: 3685095 - RNA, 19 nt, Human
uuugaucuuccucugcuaa

SEQ ID NO: 3685096 - RNA, 20 nt, Human
uuugaucuuccucugcuaaa

SEQ ID NO: 3685097 - RNA, 15 nt, Human
uuugaugaguuguga

SEQ ID NO: 3685098 - RNA, 16 nt, Human
uuugaugcagcauuug

SEQ ID NO: 3685099 - RNA, 16 nt, Human
uuugaugcuggagagg

SEQ ID NO: 3685100 - RNA, 15 nt, Human
uuugaugcuguuuga

SEQ ID NO: 3685101 - RNA, 20 nt, Human
uuugauguaaagauguucug

SEQ ID NO: 3685102 - RNA, 14 nt, Human
uuugaugucagcag

SEQ ID NO: 3685103 - RNA, 17 nt, Human
uuugaugucagcaguug

SEQ ID NO: 3685104 - RNA, 21 nt, Human
uuugaugucagcaguugcugg

SEQ ID NO: 3685105 - RNA, 18 nt, Human
uuugaugucauguguucc

SEQ ID NO: 3685106 - RNA, 14 nt, Human
uuugaugugacaau

SEQ ID NO: 3685107 - RNA, 11 nt, Human
uuugauguuaa

SEQ ID NO: 3685108 - RNA, 17 nt, Human
uuugauguuccuuccag

SEQ ID NO: 3685109 - RNA, 23 nt, Human
uuugauguucuuucacccuuuuc

SEQ ID NO: 3685110 - RNA, 17 nt, Human
uuugauguuuguggccu

SEQ ID NO: 3685111 - RNA, 19 nt, Human
uuugauguuuguggccuca

SEQ ID NO: 3685112 - RNA, 21 nt, Human
uuugauuaaauucuugcaaag

SEQ ID NO: 3685113 - RNA, 23 nt, Human
uuugauuaaauucuugcaaagua

SEQ ID NO: 3685114 - RNA, 15 nt, Human
uuugauuaacaaaua

SEQ ID NO: 3685115 - RNA, 15 nt, Human
uuugauuaugacugu

SEQ ID NO: 3685116 - RNA, 13 nt, Human
uuugauucacaug

SEQ ID NO: 3685117 - RNA, 21 nt, Human
uuugauucagacagcugccug

SEQ ID NO: 3685118 - RNA, 15 nt, Human
uuugauucauaguaa

SEQ ID NO: 3685119 - RNA, 20 nt, Human
uuugauucauaguaacuucu

SEQ ID NO: 3685120 - RNA, 12 nt, Human
uuugauucuccu

SEQ ID NO: 3685121 - RNA, 21 nt, Human
uuugauucuccuucagcccuc

SEQ ID NO: 3685122 - RNA, 22 nt, Human
uuugauugagaguaacuuaagu

SEQ ID NO: 3685123 - RNA, 15 nt, Human
uuugauuuacagcaa

SEQ ID NO: 3685124 - RNA, 17 nt, Human
uuugauuuacagcaagu

SEQ ID NO: 3685125 - RNA, 20 nt, Human
uuugauuuccaaguaauaua

SEQ ID NO: 3685126 - RNA, 13 nt, Human
uuugauuucuauu

SEQ ID NO: 3685127 - RNA, 20 nt, Human
uuugcaaaaaauguuuuugg

SEQ ID NO: 3685128 - RNA, 12 nt, Human
uuugcaaaauuu

SEQ ID NO: 3685129 - RNA, 19 nt, Human
uuugcaaacccgaaaauaa

SEQ ID NO: 3685130 - RNA, 15 nt, Human
uuugcaaaggagcuc

SEQ ID NO: 3685131 - RNA, 11 nt, Human
uuugcaaagua

SEQ ID NO: 3685132 - RNA, 13 nt, Human
uuugcaaaguacu

SEQ ID NO: 3685133 - RNA, 14 nt, Human
uuugcaaaguacug

SEQ ID NO: 3685134 - RNA, 15 nt, Human
uuugcaaaguacugu

SEQ ID NO: 3685135 - RNA, 23 nt, Human
uuugcaaaguacuguaagaauaa

SEQ ID NO: 3685136 - RNA, 13 nt, Human
uuugcaaauaagu

SEQ ID NO: 3685137 - RNA, 14 nt, Human
uuugcaaccucgcu

SEQ ID NO: 3685138 - RNA, 21 nt, Human
uuugcaaggaagccacagcug

SEQ ID NO: 3685139 - RNA, 21 nt, Human
uuugcaaggugcauuuuuacu

SEQ ID NO: 3685140 - RNA, 16 nt, Human
uuugcaagugaagguu

SEQ ID NO: 3685141 - RNA, 16 nt, Human
uuugcaauaacagcug

SEQ ID NO: 3685142 - RNA, 19 nt, Human
uuugcaauaacagcugcaa

SEQ ID NO: 3685143 - RNA, 22 nt, Human
uuugcaauaaugcaguauggua

SEQ ID NO: 3685144 - RNA, 12 nt, Human
uuugcacaaaaa

SEQ ID NO: 3685145 - RNA, 22 nt, Human
uuugcacacuuuggcccagggu

SEQ ID NO: 3685146 - RNA, 16 nt, Human
uuugcacagcucuccg

SEQ ID NO: 3685147 - RNA, 12 nt, Human
uuugcacauuaa

SEQ ID NO: 3685148 - RNA, 13 nt, Human
uuugcacauuaaa

SEQ ID NO: 3685149 - RNA, 17 nt, Human
uuugcaccccaugcugu

SEQ ID NO: 3685150 - RNA, 16 nt, Human
uuugcaccccucccau

SEQ ID NO: 3685151 - RNA, 23 nt, Human
uuugcaccuguccccacccucca

SEQ ID NO: 3685152 - RNA, 17 nt, Human
uuugcaccuuucuaguu

SEQ ID NO: 3685153 - RNA, 20 nt, Human
uuugcaccuuucuaguugaa

SEQ ID NO: 3685154 - RNA, 20 nt, Human
uuugcacgacgcccucuccc

SEQ ID NO: 3685155 - RNA, 21 nt, Human
uuugcacgacgcccucucccc

SEQ ID NO: 3685156 - RNA, 20 nt, Human
uuugcacuaagauauuucca

SEQ ID NO: 3685157 - RNA, 14 nt, Human
uuugcacugagggc

SEQ ID NO: 3685158 - RNA, 18 nt, Human
uuugcacugauauaucau

SEQ ID NO: 3685159 - RNA, 21 nt, Human
uuugcacuugugauuauuuau

SEQ ID NO: 3685160 - RNA, 13 nt, Human
uuugcacuuuucu

SEQ ID NO: 3685161 - RNA, 20 nt, Human
uuugcagaaaagcaccugcc

SEQ ID NO: 3685162 - RNA, 22 nt, Human
uuugcagaaaagcaccugccga

SEQ ID NO: 3685163 - RNA, 21 nt, Human
uuugcagaggcuaugggaaga

SEQ ID NO: 3685164 - RNA, 16 nt, Human
uuugcagaugacaaaa

SEQ ID NO: 3685165 - RNA, 15 nt, Human
uuugcaggaaauccu

SEQ ID NO: 3685166 - RNA, 14 nt, Human
uuugcaguaacugu

SEQ ID NO: 3685167 - RNA, 18 nt, Human
uuugcauaacaauuccuc

SEQ ID NO: 3685168 - RNA, 17 nt, Human
uuugcauacauucuuca

SEQ ID NO: 3685169 - RNA, 18 nt, Human
uuugcauacauucuucaa

SEQ ID NO: 3685170 - RNA, 11 nt, Human
uuugcauaucc

SEQ ID NO: 3685171 - RNA, 15 nt, Human
uuugcauauguauga

SEQ ID NO: 3685172 - RNA, 20 nt, Human
uuugcaucguccccuccccc

SEQ ID NO: 3685173 - RNA, 22 nt, Human
uuugcaucugaaauaggaaaca

SEQ ID NO: 3685174 - RNA, 15 nt, Human
uuugcauguuauguu

SEQ ID NO: 3685175 - RNA, 14 nt, Human
uuugcauuaaauua

SEQ ID NO: 3685176 - RNA, 17 nt, Human
uugcaggguccucuucu

SEQ ID NO: 3685177 - RNA, 16 nt, Human
uugcagguucauggau

SEQ ID NO: 3685178 - RNA, 22 nt, Human
uugcaguaaacuuuuaauuaaa

SEQ ID NO: 3685179 - RNA, 13 nt, Human
uugcaguaacugu

SEQ ID NO: 3685180 - RNA, 15 nt, Human
uugcaguaacuguuu

SEQ ID NO: 3685181 - RNA, 16 nt, Human
uugcagugagcugaga

SEQ ID NO: 3685182 - RNA, 20 nt, Human
uugcaguguggugagaucau

SEQ ID NO: 3685183 - RNA, 13 nt, Human
uugcaguucaccu

SEQ ID NO: 3685184 - RNA, 13 nt, Human
uugcaguucuuga

SEQ ID NO: 3685185 - RNA, 19 nt, Human
uugcaguuuaucauucaag

SEQ ID NO: 3685186 - RNA, 15 nt, Human
uugcaguuuuucauu

SEQ ID NO: 3685187 - RNA, 12 nt, Human
uugcauaauaaa

SEQ ID NO: 3685188 - RNA, 13 nt, Human
uugcauacaaaca

SEQ ID NO: 3685189 - RNA, 14 nt, Human
uugcauacaaacaa

SEQ ID NO: 3685190 - RNA, 22 nt, Human
uugcauacauucuucaagaucc

SEQ ID NO: 3685191 - RNA, 16 nt, Human
uugcauacugagccaa

SEQ ID NO: 3685192 - RNA, 16 nt, Human
uugcauacuuuguauu

SEQ ID NO: 3685193 - RNA, 21 nt, Human
uugcauacuuuguauuuugau

SEQ ID NO: 3685194 - RNA, 18 nt, Human
uugcauagauucccugag

SEQ ID NO: 3685195 - RNA, 14 nt, Human
uugcauauaacuua

SEQ ID NO: 3685196 - RNA, 22 nt, Human
uugcauauaacuuauauuguaa

SEQ ID NO: 3685197 - RNA, 23 nt, Human
uugcauauaagggaaguaguuau

SEQ ID NO: 3685198 - RNA, 22 nt, Human
uugcauauauuucaugaauaca

SEQ ID NO: 3685199 - RNA, 22 nt, Human
uugcaucacuuaacggaccaaa

SEQ ID NO: 3685200 - RNA, 19 nt, Human
uugcaucagaaagcuuuau

SEQ ID NO: 3685201 - RNA, 22 nt, Human
uugcaucagaaaugucuggaga

SEQ ID NO: 3685202 - RNA, 18 nt, Human
uugcauccuuccuauaac

SEQ ID NO: 3685203 - RNA, 19 nt, Human
uugcaucguccccuccccc

SEQ ID NO: 3685204 - RNA, 18 nt, Human
uugcaucuagguaauuuu

SEQ ID NO: 3685205 - RNA, 18 nt, Human
uugcaucucaaaauuauu

SEQ ID NO: 3685206 - RNA, 19 nt, Human
uugcaucuggguagcugua

SEQ ID NO: 3685207 - RNA, 14 nt, Human
uugcaucuguauaa

SEQ ID NO: 3685208 - RNA, 16 nt, Human
uugcaugaagagaagc

SEQ ID NO: 3685209 - RNA, 15 nt, Human
uugcaugauguauuu

SEQ ID NO: 3685210 - RNA, 16 nt, Human
uugcaugcaugcaaau

SEQ ID NO: 3685211 - RNA, 23 nt, Human
uugcauggaaaucagccaaguuu

SEQ ID NO: 3685212 - RNA, 19 nt, Human
uugcauggcuccagaaaug

SEQ ID NO: 3685213 - RNA, 17 nt, Human
uugcaugggcuaaugaa

SEQ ID NO: 3685214 - RNA, 19 nt, Human
uugcaugguuuggagcuga

SEQ ID NO: 3685215 - RNA, 17 nt, Human
uugcauguaaaagccua

SEQ ID NO: 3685216 - RNA, 21 nt, Human
uugcauguaguaacacuaaua

SEQ ID NO: 3685217 - RNA, 23 nt, Human
uugcauguaucuucuaagaauuu

SEQ ID NO: 3685218 - RNA, 16 nt, Human
uugcauguuauguuua

SEQ ID NO: 3685219 - RNA, 15 nt, Human
uugcauuaaauuaca

SEQ ID NO: 3685220 - RNA, 13 nt, Human
uugcauuaaauuc

SEQ ID NO: 3685221 - RNA, 22 nt, Human
uugcauuaaauucacaaacuuu

SEQ ID NO: 3685222 - RNA, 14 nt, Human
uugcauuaugcaau

SEQ ID NO: 3685223 - RNA, 12 nt, Human
uugcauucaaau

SEQ ID NO: 3685224 - RNA, 18 nt, Human
uugcauucuauugccuuc

SEQ ID NO: 3685225 - RNA, 19 nt, Human
uugcauucuauugccuucu

SEQ ID NO: 3685226 - RNA, 20 nt, Human
uugcauucuauugccuucuu

SEQ ID NO: 3685227 - RNA, 14 nt, Human
uugcauugaacaca

SEQ ID NO: 3685228 - RNA, 23 nt, Human
uugcauugaacacaaacuguaaa

SEQ ID NO: 3685229 - RNA, 21 nt, Human
uugcauugaccgcgacuaauu

SEQ ID NO: 3685230 - RNA, 13 nt, Human
uugcauugucugu

SEQ ID NO: 3685231 - RNA, 15 nt, Human
uugcauuuaaaacag

SEQ ID NO: 3685232 - RNA, 15 nt, Human
uugcauuuauaugua

SEQ ID NO: 3685233 - RNA, 20 nt, Human
uugcauuuauauguaccgua

SEQ ID NO: 3685234 - RNA, 15 nt, Human
uugcauuugcucuuu

SEQ ID NO: 3685235 - RNA, 19 nt, Human
uugccaaaacccagcugca

SEQ ID NO: 3685236 - RNA, 19 nt, Human
uugccaaacauuaauguug

SEQ ID NO: 3685237 - RNA, 20 nt, Human
uugccaaacauuaauguuga

SEQ ID NO: 3685238 - RNA, 24 nt, Human
uugccaaacauuaauguugauuuc

SEQ ID NO: 3685239 - RNA, 21 nt, Human
uugccaaauaaaguuaaaagu

SEQ ID NO: 3685240 - RNA, 22 nt, Human
uugccaaauaaaguuaaaagua

SEQ ID NO: 3685241 - RNA, 17 nt, Human
uugccaaauauguccug

SEQ ID NO: 3685242 - RNA, 13 nt, Human
uugccaacauugc

SEQ ID NO: 3685243 - RNA, 18 nt, Human
uugccaaccuguaauaaa

SEQ ID NO: 3685244 - RNA, 19 nt, Human
uugccaaccuguaauaaau

SEQ ID NO: 3685245 - RNA, 20 nt, Human
uugccaagaacugaaaacau

SEQ ID NO: 3685246 - RNA, 13 nt, Human
uugccaagacaaa

SEQ ID NO: 3685247 - RNA, 15 nt, Human
uugccaagacaaauc

SEQ ID NO: 3685248 - RNA, 15 nt, Human
uugccaagagcccgu

SEQ ID NO: 3685249 - RNA, 16 nt, Human
uugccaaggcagaggc

SEQ ID NO: 3685250 - RNA, 18 nt, Human
uugccaauagugucaucc

SEQ ID NO: 3685251 - RNA, 15 nt, Human
uugccacaacccugu

SEQ ID NO: 3685252 - RNA, 18 nt, Human
uugccacagcuuuugcaa

SEQ ID NO: 3685253 - RNA, 18 nt, Human
uugccacaggacacaguc

SEQ ID NO: 3685254 - RNA, 11 nt, Human
uugccacaggc

SEQ ID NO: 3685255 - RNA, 18 nt, Human
uugccacaggccucccug

SEQ ID NO: 3685256 - RNA, 17 nt, Human
uugccacaguagaacug

SEQ ID NO: 3685257 - RNA, 18 nt, Human
uugccacaguagaacugu

SEQ ID NO: 3685258 - RNA, 21 nt, Human
uugccaccaacuggcccucuu

SEQ ID NO: 3685259 - RNA, 18 nt, Human
uugccaccccacccuccc

SEQ ID NO: 3685260 - RNA, 23 nt, Human
uugccaccccacccucccuggag

SEQ ID NO: 3685261 - RNA, 20 nt, Human
uugccaccucuaacagcacc

SEQ ID NO: 3685262 - RNA, 14 nt, Human
uugccacugauauu

SEQ ID NO: 3685263 - RNA, 18 nt, Human
uugccacugccucuuccu

SEQ ID NO: 3685264 - RNA, 19 nt, Human
uugccagagauccaaaaga

SEQ ID NO: 3685265 - RNA, 15 nt, Human
uugccagcccauuug

SEQ ID NO: 3685266 - RNA, 20 nt, Human
uugccagcccauuugggcag

SEQ ID NO: 3685267 - RNA, 19 nt, Human
uugccagcuuuuccucccu

SEQ ID NO: 3685268 - RNA, 23 nt, Human
uugccaggcuggagugcaguggc

SEQ ID NO: 3685269 - RNA, 19 nt, Human
uugccaguaacacaggcca

SEQ ID NO: 3685270 - RNA, 21 nt, Human
uugccagucuuuuguccugca

SEQ ID NO: 3685271 - RNA, 21 nt, Human
uugccagugucuuucuuuggu

SEQ ID NO: 3685272 - RNA, 17 nt, Human
uugccauagaguacacu

SEQ ID NO: 3685273 - RNA, 23 nt, Human
uugccauagaguacacugccugc

SEQ ID NO: 3685274 - RNA, 15 nt, Human
uugccauauugcaca

SEQ ID NO: 3685275 - RNA, 17 nt, Human
uugccauauugcacaug

SEQ ID NO: 3685276 - RNA, 23 nt, Human
uugccauauugcacaugucuuaa

SEQ ID NO: 3685277 - RNA, 14 nt, Human
uugccaucccuccc

SEQ ID NO: 3685278 - RNA, 15 nt, Human
uugccaucucugcuc

SEQ ID NO: 3685279 - RNA, 23 nt, Human
uugccaugacaacuucuaauugc

SEQ ID NO: 3685280 - RNA, 21 nt, Human
uugccaugggcuucacuguau

SEQ ID NO: 3685281 - RNA, 14 nt, Human
uugccauguguuuu

SEQ ID NO: 3685282 - RNA, 17 nt, Human
uugccauguuggccagg

SEQ ID NO: 3685283 - RNA, 21 nt, Human
uugccauguuggccaggcugg

SEQ ID NO: 3685284 - RNA, 16 nt, Human
uugccauuaaaaugua

SEQ ID NO: 3685285 - RNA, 21 nt, Human
uugccauuugauaccccuggg

SEQ ID NO: 3685286 - RNA, 17 nt, Human
uugcccaaaucugccua

SEQ ID NO: 3685287 - RNA, 18 nt, Human
uugcccaacaccagcccc

SEQ ID NO: 3685288 - RNA, 19 nt, Human
uugcccaacaccagccccu

SEQ ID NO: 3685289 - RNA, 20 nt, Human
uugcccaacaccagccccug

SEQ ID NO: 3685290 - RNA, 15 nt, Human
uugcccacuccugcu

SEQ ID NO: 3685291 - RNA, 22 nt, Human
uugcccagagaugccuccaccg

SEQ ID NO: 3685292 - RNA, 22 nt, Human
uugcccagcauuuuacugauuc

SEQ ID NO: 3685293 - RNA, 12 nt, Human
uugcccagccuc

SEQ ID NO: 3685294 - RNA, 15 nt, Human
uugcccagccuggau

SEQ ID NO: 3685295 - RNA, 16 nt, Human
uugcccaggcaggucu

SEQ ID NO: 3685296 - RNA, 18 nt, Human
uugcccaggcaggucuug

SEQ ID NO: 3685297 - RNA, 18 nt, Human
uugcccagggcucagccu

SEQ ID NO: 3685298 - RNA, 15 nt, Human
uugcccauccaucug

SEQ ID NO: 3685299 - RNA, 16 nt, Human
uugcccauccugacug

SEQ ID NO: 3685300 - RNA, 17 nt, Human
uugcccauccugacuga

SEQ ID NO: 3685301 - RNA, 15 nt, Human
uugcccaugauauaa

SEQ ID NO: 3685302 - RNA, 14 nt, Human
uugccccaucacug

SEQ ID NO: 3685303 - RNA, 13 nt, Human
uugcccccauuuc

SEQ ID NO: 3685304 - RNA, 12 nt, Human
uugccccccacc

SEQ ID NO: 3685305 - RNA, 19 nt, Human
uugccccccaccccagccu

SEQ ID NO: 3685306 - RNA, 22 nt, Human
uugcccccugcccguguacaua

SEQ ID NO: 3685307 - RNA, 13 nt, Human
uugcccugggaaa

SEQ ID NO: 3685308 - RNA, 16 nt, Human
uugcccuucacagugu

SEQ ID NO: 3685309 - RNA, 17 nt, Human
uugcccuucacaguguu

SEQ ID NO: 3685310 - RNA, 13 nt, Human
uugcccuucccug

SEQ ID NO: 3685311 - RNA, 14 nt, Human
uugcccuucccugu

SEQ ID NO: 3685312 - RNA, 18 nt, Human
uugcccuugcccugaccu

SEQ ID NO: 3685313 - RNA, 22 nt, Human
uugcccuuuacuugucuuucug

SEQ ID NO: 3685314 - RNA, 17 nt, Human
uugccgaggagccaggc

SEQ ID NO: 3685315 - RNA, 19 nt, Human
uugccgucuaccugagggg

SEQ ID NO: 3685316 - RNA, 19 nt, Human
uugccuaagaauaaacauu

SEQ ID NO: 3685317 - RNA, 23 nt, Human
uugccuaagaauaaacauuuguu

SEQ ID NO: 3685318 - RNA, 20 nt, Human
uugccuaagcauugccuggc

SEQ ID NO: 3685319 - RNA, 14 nt, Human
uugccuaaguauua

SEQ ID NO: 3685320 - RNA, 16 nt, Human
uugccuaaguauuaaa

SEQ ID NO: 3685321 - RNA, 18 nt, Human
uugccuaaguauuccuuu

SEQ ID NO: 3685322 - RNA, 22 nt, Human
uugccuaauacauuaaagcagu

SEQ ID NO: 3685323 - RNA, 23 nt, Human
uugccuaauacauuaaagcaguc

SEQ ID NO: 3685324 - RNA, 20 nt, Human
uugccuauaagccaaaauua

SEQ ID NO: 3685325 - RNA, 13 nt, Human
uauuuaaaagauu

SEQ ID NO: 3685326 - RNA, 15 nt, Human
uauuuaaaaguguca

SEQ ID NO: 3685327 - RNA, 23 nt, Human
uauuuaaaauagcaaaagaagaa

SEQ ID NO: 3685328 - RNA, 15 nt, Human
uauuuaaaauguaaa

SEQ ID NO: 3685329 - RNA, 24 nt, Human
uauuuaaacucuguugcaagugca

SEQ ID NO: 3685330 - RNA, 13 nt, Human
uauuuaaagcauu

SEQ ID NO: 3685331 - RNA, 18 nt, Human
uauuuaaauuacaauuuu

SEQ ID NO: 3685332 - RNA, 12 nt, Human
uauuuaacagaa

SEQ ID NO: 3685333 - RNA, 19 nt, Human
uauuuaacagaaauuguau

SEQ ID NO: 3685334 - RNA, 15 nt, Human
uauuuaacagcugaa

SEQ ID NO: 3685335 - RNA, 18 nt, Human
uauuuaaccucuaaauuc

SEQ ID NO: 3685336 - RNA, 11 nt, Human
uauuuaacuga

SEQ ID NO: 3685337 - RNA, 21 nt, Human
uauuuaacugccuuguguaca

SEQ ID NO: 3685338 - RNA, 22 nt, Human
uauuuaacuggugcacuuugua

SEQ ID NO: 3685339 - RNA, 13 nt, Human
uauuuaacuucug

SEQ ID NO: 3685340 - RNA, 20 nt, Human
uauuuaacuugagcuuuaaa

SEQ ID NO: 3685341 - RNA, 14 nt, Human
uauuuaagaaaaua

SEQ ID NO: 3685342 - RNA, 19 nt, Human
uauuuaagaaaauacaaua

SEQ ID NO: 3685343 - RNA, 20 nt, Human
uauuuaagaaaauacaauaa

SEQ ID NO: 3685344 - RNA, 22 nt, Human
uauuuaagaaaauacaauaaac

SEQ ID NO: 3685345 - RNA, 17 nt, Human
uauuuaagauaauuaua

SEQ ID NO: 3685346 - RNA, 13 nt, Human
uauuuaagaugug

SEQ ID NO: 3685347 - RNA, 17 nt, Human
uauuuaagcaaauacuu

SEQ ID NO: 3685348 - RNA, 17 nt, Human
uauuuaagcaacaucuu

SEQ ID NO: 3685349 - RNA, 18 nt, Human
uauuuaagccuaaagauu

SEQ ID NO: 3685350 - RNA, 21 nt, Human
uauuuaagccucauauuuaaa

SEQ ID NO: 3685351 - RNA, 16 nt, Human
uauuuaagcuuauguc

SEQ ID NO: 3685352 - RNA, 18 nt, Human
uauuuaagguagcuucag

SEQ ID NO: 3685353 - RNA, 16 nt, Human
uauuuaaguauucaag

SEQ ID NO: 3685354 - RNA, 10 nt, Human
uauuuaauaa

SEQ ID NO: 3685355 - RNA, 14 nt, Human
uauuuaauaacauu

SEQ ID NO: 3685356 - RNA, 15 nt, Human
uauuuaauaacauua

SEQ ID NO: 3685357 - RNA, 19 nt, Human
uauuuaauagcaaagaauu

SEQ ID NO: 3685358 - RNA, 20 nt, Human
uauuuaauagcaaagaauug

SEQ ID NO: 3685359 - RNA, 15 nt, Human
uauuuaaugaaagac

SEQ ID NO: 3685360 - RNA, 17 nt, Human
uauuuaaugcauuaaac

SEQ ID NO: 3685361 - RNA, 22 nt, Human
uauuuaaugcauuaaaccuguc

SEQ ID NO: 3685362 - RNA, 14 nt, Human
uauuuaauguugaa

SEQ ID NO: 3685363 - RNA, 15 nt, Human
uauuuaauguugaac

SEQ ID NO: 3685364 - RNA, 12 nt, Human
uauuuaauguuu

SEQ ID NO: 3685365 - RNA, 16 nt, Human
uauuuaauguuuuaaa

SEQ ID NO: 3685366 - RNA, 18 nt, Human
uauuuaauguuuuaaaug

SEQ ID NO: 3685367 - RNA, 21 nt, Human
uauuuaauguuuuaaauguac

SEQ ID NO: 3685368 - RNA, 16 nt, Human
uauuuaauuagugcua

SEQ ID NO: 3685369 - RNA, 23 nt, Human
uauuuaauuauuaacuacauuua

SEQ ID NO: 3685370 - RNA, 13 nt, Human
uauuuaauuguaa

SEQ ID NO: 3685371 - RNA, 14 nt, Human
uauuuaauuguaaa

SEQ ID NO: 3685372 - RNA, 15 nt, Human
uauuuaauuguaaac

SEQ ID NO: 3685373 - RNA, 23 nt, Human
uauuuaauuugaagguagaaugu

SEQ ID NO: 3685374 - RNA, 20 nt, Human
uauuuacaacacuuuaaugg

SEQ ID NO: 3685375 - RNA, 11 nt, Human
uauuuacaaga

SEQ ID NO: 3685376 - RNA, 16 nt, Human
uauuuacaauguauua

SEQ ID NO: 3685377 - RNA, 17 nt, Human
uauuuacaauguauuaa

SEQ ID NO: 3685378 - RNA, 21 nt, Human
uauuuacaugaauugcauuuu

SEQ ID NO: 3685379 - RNA, 17 nt, Human
uauuuaccccuccccua

SEQ ID NO: 3685380 - RNA, 14 nt, Human
uauuuaccucagcc

SEQ ID NO: 3685381 - RNA, 16 nt, Human
uauuuaccucagccug

SEQ ID NO: 3685382 - RNA, 17 nt, Human
uauuuaccucagccugg

SEQ ID NO: 3685383 - RNA, 14 nt, Human
uauuuacuaccuua

SEQ ID NO: 3685384 - RNA, 19 nt, Human
uauuuacuucguuuugguu

SEQ ID NO: 3685385 - RNA, 20 nt, Human
uauuuagacaagagauggga

SEQ ID NO: 3685386 - RNA, 21 nt, Human
uauuuagacucaucuuacugu

SEQ ID NO: 3685387 - RNA, 23 nt, Human
uauuuagaugauaaagagacagu

SEQ ID NO: 3685388 - RNA, 20 nt, Human
uauuuagaugcauauuacug

SEQ ID NO: 3685389 - RNA, 20 nt, Human
uauuuagauucacuuaacaa

SEQ ID NO: 3685390 - RNA, 15 nt, Human
uauuuaggaaguguu

SEQ ID NO: 3685391 - RNA, 17 nt, Human
uauuuagggaacugcuu

SEQ ID NO: 3685392 - RNA, 18 nt, Human
uauuuagggaacugcuug

SEQ ID NO: 3685393 - RNA, 14 nt, Human
uauuuagugcugca

SEQ ID NO: 3685394 - RNA, 19 nt, Human
uauuuaguguucauaaaua

SEQ ID NO: 3685395 - RNA, 14 nt, Human
uauuuauaaaacuu

SEQ ID NO: 3685396 - RNA, 16 nt, Human
uauuuauaaagaaugu

SEQ ID NO: 3685397 - RNA, 19 nt, Human
uauuuauaaauauauuuaa

SEQ ID NO: 3685398 - RNA, 21 nt, Human
uauuuauaacucaucauaaaa

SEQ ID NO: 3685399 - RNA, 17 nt, Human
uauuuauaagcagauuu

SEQ ID NO: 3685400 - RNA, 18 nt, Human
uauuuauaauacagaauc

SEQ ID NO: 3685401 - RNA, 20 nt, Human
uauuuauacaagauugaaaa

SEQ ID NO: 3685402 - RNA, 18 nt, Human
uauuuauagcaauccaug

SEQ ID NO: 3685403 - RNA, 14 nt, Human
uauuuauauauauu

SEQ ID NO: 3685404 - RNA, 16 nt, Human
uauuuauauauguauu

SEQ ID NO: 3685405 - RNA, 23 nt, Human
uauuuauauauguauuuauaaau

SEQ ID NO: 3685406 - RNA, 20 nt, Human
uauuuauauauugguaacau

SEQ ID NO: 3685407 - RNA, 18 nt, Human
uauuuauauauuuauaac

SEQ ID NO: 3685408 - RNA, 19 nt, Human
uauuuauauauuuauaacu

SEQ ID NO: 3685409 - RNA, 12 nt, Human
uauuuauaugua

SEQ ID NO: 3685410 - RNA, 16 nt, Human
uauuuauauguacugu

SEQ ID NO: 3685411 - RNA, 14 nt, Human
uauuuauauguaug

SEQ ID NO: 3685412 - RNA, 15 nt, Human
uauuuauauguaugu

SEQ ID NO: 3685413 - RNA, 19 nt, Human
uauuuauauguauguguuu

SEQ ID NO: 3685414 - RNA, 15 nt, Human
uauuuauauuuauug

SEQ ID NO: 3685415 - RNA, 13 nt, Human
uauuuaucacaua

SEQ ID NO: 3685416 - RNA, 15 nt, Human
uauuuaucagugaca

SEQ ID NO: 3685417 - RNA, 23 nt, Human
uauuuauccagaaaacugugauu

SEQ ID NO: 3685418 - RNA, 21 nt, Human
uauuuaucugauuaaguuguc

SEQ ID NO: 3685419 - RNA, 22 nt, Human
uauuuaucuguguuuuugaaau

SEQ ID NO: 3685420 - RNA, 12 nt, Human
uauuuaucuuua

SEQ ID NO: 3685421 - RNA, 20 nt, Human
uauuuaugaagaaaauacuu

SEQ ID NO: 3685422 - RNA, 21 nt, Human
uauuuaugaagaaaauacuua

SEQ ID NO: 3685423 - RNA, 15 nt, Human
uauuuaugaaguuua

SEQ ID NO: 3685424 - RNA, 13 nt, Human
uauuuauguaugg

SEQ ID NO: 3685425 - RNA, 13 nt, Human
uauuuauguauug

SEQ ID NO: 3685426 - RNA, 23 nt, Human
uauuuauuaaaugcccagccccu

SEQ ID NO: 3685427 - RNA, 13 nt, Human
uauuuauuaacag

SEQ ID NO: 3685428 - RNA, 14 nt, Human
uauuuauuacauaa

SEQ ID NO: 3685429 - RNA, 16 nt, Human
uauuuauuacauaauu

SEQ ID NO: 3685430 - RNA, 19 nt, Human
uauuuauuaugcuuuauug

SEQ ID NO: 3685431 - RNA, 13 nt, Human
uauuuauucaaua

SEQ ID NO: 3685432 - RNA, 16 nt, Human
uauuuauucaauaaag

SEQ ID NO: 3685433 - RNA, 19 nt, Human
uauuuauucaauaaaguau

SEQ ID NO: 3685434 - RNA, 12 nt, Human
uauuuauucauu

SEQ ID NO: 3685435 - RNA, 22 nt, Human
uauuuauucauuauuugucaaa

SEQ ID NO: 3685436 - RNA, 20 nt, Human
uauuuauugaaaugauuuca

SEQ ID NO: 3685437 - RNA, 12 nt, Human
uauuuauugacu

SEQ ID NO: 3685438 - RNA, 14 nt, Human
uauuuauugcuuua

SEQ ID NO: 3685439 - RNA, 11 nt, Human
uauuuauuuaa

SEQ ID NO: 3685440 - RNA, 16 nt, Human
uauuuauuuaaaagau

SEQ ID NO: 3685441 - RNA, 19 nt, Human
uauuuauuuaaaagauuca

SEQ ID NO: 3685442 - RNA, 13 nt, Human
uauuuauuuaaau

SEQ ID NO: 3685443 - RNA, 16 nt, Human
uauuuauuuacaaaug

SEQ ID NO: 3685444 - RNA, 13 nt, Human
uauuuauuuaugg

SEQ ID NO: 3685445 - RNA, 13 nt, Human
uauuuauuuaugu

SEQ ID NO: 3685446 - RNA, 14 nt, Human
uauuuauuuaugua

SEQ ID NO: 3685447 - RNA, 14 nt, Human
uauuuauuuuaaua

SEQ ID NO: 3685448 - RNA, 18 nt, Human
uauuuauuuuaauaaugu

SEQ ID NO: 3685449 - RNA, 16 nt, Human
uauuuauuuuccuaaa

SEQ ID NO: 3685450 - RNA, 20 nt, Human
uauuuauuuuccuaaagaga

SEQ ID NO: 3685451 - RNA, 18 nt, Human
uauuuauuuuccucccca

SEQ ID NO: 3685452 - RNA, 13 nt, Human
uauuuauuuugua

SEQ ID NO: 3685453 - RNA, 20 nt, Human
uauuuauuuuguaauuauga

SEQ ID NO: 3685454 - RNA, 20 nt, Human
uauuuauuuuuuuuaaguau

SEQ ID NO: 3685455 - RNA, 20 nt, Human
uauuuauuuuuuuuaauugu

SEQ ID NO: 3685456 - RNA, 21 nt, Human
uauuucaaaaauuuggaauuc

SEQ ID NO: 3685457 - RNA, 14 nt, Human
uauuucaagacauu

SEQ ID NO: 3685458 - RNA, 20 nt, Human
uauuucacuuuaguuuuuga

SEQ ID NO: 3685459 - RNA, 16 nt, Human
uauuucagaaguuuaa

SEQ ID NO: 3685460 - RNA, 23 nt, Human
uauuucagaaguuuaaauauuaa

SEQ ID NO: 3685461 - RNA, 13 nt, Human
uauuucagaugua

SEQ ID NO: 3685462 - RNA, 16 nt, Human
uauuucagauguaaug

SEQ ID NO: 3685463 - RNA, 19 nt, Human
uauuucagauguaauguuu

SEQ ID NO: 3685464 - RNA, 17 nt, Human
uauuucagauuuugaua

SEQ ID NO: 3685465 - RNA, 20 nt, Human
uauuucagauuuugauaacu

SEQ ID NO: 3685466 - RNA, 18 nt, Human
uauuucagcaaacuuguu

SEQ ID NO: 3685467 - RNA, 23 nt, Human
uauuucaguuauugucccuggcu

SEQ ID NO: 3685468 - RNA, 13 nt, Human
uauuucaucacaa

SEQ ID NO: 3685469 - RNA, 19 nt, Human
uauuucaucagaacagcug

SEQ ID NO: 3685470 - RNA, 19 nt, Human
uauuucaucauucacuuca

SEQ ID NO: 3685471 - RNA, 17 nt, Human
uauuucaugaaaauugu

SEQ ID NO: 3685472 - RNA, 20 nt, Human
uauuucaugaauacauugua

SEQ ID NO: 3685473 - RNA, 22 nt, Human
uauuucauucgggccccaccug

SEQ ID NO: 3685474 - RNA, 19 nt, Human
uauuuccacuaaaaauauu

SEQ ID NO: 3685475 - RNA, 18 nt, Human
uuugcauuaaauucacaa

SEQ ID NO: 3685476 - RNA, 14 nt, Human
uuugcauucaaauu

SEQ ID NO: 3685477 - RNA, 17 nt, Human
uuugcauucaaauuaag

SEQ ID NO: 3685478 - RNA, 16 nt, Human
uuugcauucuuauuca

SEQ ID NO: 3685479 - RNA, 16 nt, Human
uuugcauuuaaaacag

SEQ ID NO: 3685480 - RNA, 13 nt, Human
uuugcauuucaga

SEQ ID NO: 3685481 - RNA, 15 nt, Human
uuugccaagaccuuu

SEQ ID NO: 3685482 - RNA, 23 nt, Human
uuugccaagggcauaaauuauug

SEQ ID NO: 3685483 - RNA, 15 nt, Human
uuugccaauuugcac

SEQ ID NO: 3685484 - RNA, 19 nt, Human
uuugccacccucaugcugu

SEQ ID NO: 3685485 - RNA, 18 nt, Human
uuugccacuaauuuuagu

SEQ ID NO: 3685486 - RNA, 20 nt, Human
uuugccacuaauuuuaguau

SEQ ID NO: 3685487 - RNA, 22 nt, Human
uuugccacuaauuuuaguauuc

SEQ ID NO: 3685488 - RNA, 19 nt, Human
uuugccacugauauucaga

SEQ ID NO: 3685489 - RNA, 17 nt, Human
uuugccagcccauuugg

SEQ ID NO: 3685490 - RNA, 17 nt, Human
uuugccaggacaugcaa

SEQ ID NO: 3685491 - RNA, 16 nt, Human
uuugccagugggaacu

SEQ ID NO: 3685492 - RNA, 15 nt, Human
uuugccaucucugcu

SEQ ID NO: 3685493 - RNA, 18 nt, Human
uuugccaucucugcucca

SEQ ID NO: 3685494 - RNA, 22 nt, Human
uuugccaugacaacuucuaauu

SEQ ID NO: 3685495 - RNA, 14 nt, Human
uuugccaugggcuu

SEQ ID NO: 3685496 - RNA, 20 nt, Human
uuugccaugugcuucugcca

SEQ ID NO: 3685497 - RNA, 17 nt, Human
uuugccauugugaacca

SEQ ID NO: 3685498 - RNA, 14 nt, Human
uuugccauuugaua

SEQ ID NO: 3685499 - RNA, 14 nt, Human
uuugcccaacacca

SEQ ID NO: 3685500 - RNA, 16 nt, Human
uuugcccaacaccagc

SEQ ID NO: 3685501 - RNA, 16 nt, Human
uuugcccaaccucagc

SEQ ID NO: 3685502 - RNA, 15 nt, Human
uuugcccauuuacac

SEQ ID NO: 3685503 - RNA, 23 nt, Human
uuugcccccaaacccccauucug

SEQ ID NO: 3685504 - RNA, 14 nt, Human
uuugccccuuuaua

SEQ ID NO: 3685505 - RNA, 13 nt, Human
uuugcccucccau

SEQ ID NO: 3685506 - RNA, 17 nt, Human
uuugcccugcugcccuc

SEQ ID NO: 3685507 - RNA, 23 nt, Human
uuugcccugcugcccucccccuc

SEQ ID NO: 3685508 - RNA, 19 nt, Human
uuugcccugguuucacugg

SEQ ID NO: 3685509 - RNA, 18 nt, Human
uuugccggauacaaacug

SEQ ID NO: 3685510 - RNA, 15 nt, Human
uuugccguuauuaaa

SEQ ID NO: 3685511 - RNA, 13 nt, Human
uuugccucugccu

SEQ ID NO: 3685512 - RNA, 19 nt, Human
uuugccugccuggugugcc

SEQ ID NO: 3685513 - RNA, 12 nt, Human
uuugccuguaac

SEQ ID NO: 3685514 - RNA, 22 nt, Human
uuugccuguucaguuacagaaa

SEQ ID NO: 3685515 - RNA, 23 nt, Human
uuugccuguucaguuacagaaag

SEQ ID NO: 3685516 - RNA, 17 nt, Human
uuugccuuccuuucucc

SEQ ID NO: 3685517 - RNA, 22 nt, Human
uuugccuugcagaacugccauu

SEQ ID NO: 3685518 - RNA, 14 nt, Human
uuugcggacgggcu

SEQ ID NO: 3685519 - RNA, 14 nt, Human
uuugcuaaagacau

SEQ ID NO: 3685520 - RNA, 23 nt, Human
uuugcuaaguaaaucucuucugu

SEQ ID NO: 3685521 - RNA, 13 nt, Human
uuugcuaauuaaa

SEQ ID NO: 3685522 - RNA, 19 nt, Human
uuugcuaauuaaaaaguua

SEQ ID NO: 3685523 - RNA, 20 nt, Human
uuugcuaauuaacugaaaca

SEQ ID NO: 3685524 - RNA, 14 nt, Human
uuugcuacuaaguu

SEQ ID NO: 3685525 - RNA, 21 nt, Human
uuugcuacuguuguaagaauu

SEQ ID NO: 3685526 - RNA, 15 nt, Human
uuugcuagcaguaaa

SEQ ID NO: 3685527 - RNA, 13 nt, Human
uuugcuaguuuuu

SEQ ID NO: 3685528 - RNA, 20 nt, Human
uuugcuauugacaagucauu

SEQ ID NO: 3685529 - RNA, 16 nt, Human
uuugcucaccuggggu

SEQ ID NO: 3685530 - RNA, 12 nt, Human
uuugcucaugga

SEQ ID NO: 3685531 - RNA, 12 nt, Human
uuugcuccaccc

SEQ ID NO: 3685532 - RNA, 12 nt, Human
uuugcucugcca

SEQ ID NO: 3685533 - RNA, 13 nt, Human
uuugcucuucaga

SEQ ID NO: 3685534 - RNA, 18 nt, Human
uuugcucuucagaugcca

SEQ ID NO: 3685535 - RNA, 12 nt, Human
uuugcugagacu

SEQ ID NO: 3685536 - RNA, 14 nt, Human
uuugcugcugauaa

SEQ ID NO: 3685537 - RNA, 19 nt, Human
uuugcugggcaguuuuucu

SEQ ID NO: 3685538 - RNA, 19 nt, Human
uuugcuguacuagagaucu

SEQ ID NO: 3685539 - RNA, 21 nt, Human
uuugcuguagaagauggcacu

SEQ ID NO: 3685540 - RNA, 15 nt, Human
uuugcuuauuguucc

SEQ ID NO: 3685541 - RNA, 16 nt, Human
uuugcuuauuguucca

SEQ ID NO: 3685542 - RNA, 17 nt, Human
uuugcuuauuguuccaa

SEQ ID NO: 3685543 - RNA, 13 nt, Human
uuugcuucauaaa

SEQ ID NO: 3685544 - RNA, 20 nt, Human
uuugcuucaugugucccaga

SEQ ID NO: 3685545 - RNA, 22 nt, Human
uuugcuucuucccuuaaaauuu

SEQ ID NO: 3685546 - RNA, 14 nt, Human
uuugcuugaaagaa

SEQ ID NO: 3685547 - RNA, 16 nt, Human
uuugcuugaaagaaaa

SEQ ID NO: 3685548 - RNA, 14 nt, Human
uuugcuugaacaca

SEQ ID NO: 3685549 - RNA, 16 nt, Human
uuugcuugaacacagu

SEQ ID NO: 3685550 - RNA, 17 nt, Human
uuugcuugaacacagua

SEQ ID NO: 3685551 - RNA, 19 nt, Human
uuugcuugaacacaguauu

SEQ ID NO: 3685552 - RNA, 17 nt, Human
uuugcuugcaguagauu

SEQ ID NO: 3685553 - RNA, 20 nt, Human
uuugcuugcaguagauuuuc

SEQ ID NO: 3685554 - RNA, 23 nt, Human
uuugcuuguggcuccacacacac

SEQ ID NO: 3685555 - RNA, 23 nt, Human
uuugcuuuauggguuuggcuugu

SEQ ID NO: 3685556 - RNA, 15 nt, Human
uuugcuuugugauuu

SEQ ID NO: 3685557 - RNA, 21 nt, Human
uuuggaaaacgauuuaauuua

SEQ ID NO: 3685558 - RNA, 20 nt, Human
uuuggaaaaguggcguggga

SEQ ID NO: 3685559 - RNA, 12 nt, Human
uuuggaaaauaa

SEQ ID NO: 3685560 - RNA, 15 nt, Human
uuuggaaaaugcauu

SEQ ID NO: 3685561 - RNA, 20 nt, Human
uuuggaaacuaauaaaauau

SEQ ID NO: 3685562 - RNA, 16 nt, Human
uuuggaaagacuggac

SEQ ID NO: 3685563 - RNA, 22 nt, Human
uuuggaaaguacacucugcugu

SEQ ID NO: 3685564 - RNA, 23 nt, Human
uuuggaacaagaugguucuagca

SEQ ID NO: 3685565 - RNA, 20 nt, Human
uuuggaagaaaaaaaucuuc

SEQ ID NO: 3685566 - RNA, 22 nt, Human
uuuggaagaaaaaaaucuucuc

SEQ ID NO: 3685567 - RNA, 20 nt, Human
uuuggaagauccugugagga

SEQ ID NO: 3685568 - RNA, 15 nt, Human
uuuggaagcucuucu

SEQ ID NO: 3685569 - RNA, 13 nt, Human
uuuggaauaaagu

SEQ ID NO: 3685570 - RNA, 16 nt, Human
uuuggaauacauuucu

SEQ ID NO: 3685571 - RNA, 13 nt, Human
uuuggaauacuuu

SEQ ID NO: 3685572 - RNA, 18 nt, Human
uuuggaaucuagaagaaa

SEQ ID NO: 3685573 - RNA, 12 nt, Human
uuuggaaugcuu

SEQ ID NO: 3685574 - RNA, 11 nt, Human
uuuggaaugug

SEQ ID NO: 3685575 - RNA, 13 nt, Human
uuuggaauuagaa

SEQ ID NO: 3685576 - RNA, 22 nt, Human
uuuggaccaaaaaccaguauug

SEQ ID NO: 3685577 - RNA, 19 nt, Human
uuuggacccugaggcccag

SEQ ID NO: 3685578 - RNA, 19 nt, Human
uuuggaccuaaauggccuc

SEQ ID NO: 3685579 - RNA, 16 nt, Human
uuuggacuucuggggu

SEQ ID NO: 3685580 - RNA, 15 nt, Human
uuuggacuuuguaua

SEQ ID NO: 3685581 - RNA, 14 nt, Human
uuuggagagaaaua

SEQ ID NO: 3685582 - RNA, 15 nt, Human
uuuggagagaaauau

SEQ ID NO: 3685583 - RNA, 22 nt, Human
uuuggagagaaauauuuuaauu

SEQ ID NO: 3685584 - RNA, 20 nt, Human
uuuggagagggggccuggga

SEQ ID NO: 3685585 - RNA, 18 nt, Human
uuuggagcacucugaguu

SEQ ID NO: 3685586 - RNA, 20 nt, Human
uuuggaguccccucaccucc

SEQ ID NO: 3685587 - RNA, 19 nt, Human
uuuggaguguuauguauuu

SEQ ID NO: 3685588 - RNA, 22 nt, Human
uuuggaguguuauguauuuccu

SEQ ID NO: 3685589 - RNA, 16 nt, Human
uuuggauaauaaggaa

SEQ ID NO: 3685590 - RNA, 15 nt, Human
uuuggauauguaaaa

SEQ ID NO: 3685591 - RNA, 19 nt, Human
uuuggauauguaaaacauu

SEQ ID NO: 3685592 - RNA, 21 nt, Human
uuuggauauguaaaacauuua

SEQ ID NO: 3685593 - RNA, 17 nt, Human
uuuggaucuugaaugug

SEQ ID NO: 3685594 - RNA, 15 nt, Human
uuuggauguaauuua

SEQ ID NO: 3685595 - RNA, 19 nt, Human
uuuggauucuaaauacaug

SEQ ID NO: 3685596 - RNA, 20 nt, Human
uuuggauuggggucccucua

SEQ ID NO: 3685597 - RNA, 14 nt, Human
uuuggauuuuuaau

SEQ ID NO: 3685598 - RNA, 18 nt, Human
uuuggcaaacucuccacc

SEQ ID NO: 3685599 - RNA, 23 nt, Human
uuuggcaaggaaaggggagaagg

SEQ ID NO: 3685600 - RNA, 20 nt, Human
uuuggcauaacauaaaucug

SEQ ID NO: 3685601 - RNA, 16 nt, Human
uuuggcaucccugggc

SEQ ID NO: 3685602 - RNA, 18 nt, Human
uuuggcaucccugggccu

SEQ ID NO: 3685603 - RNA, 20 nt, Human
uuuggcaucuguuuaaagua

SEQ ID NO: 3685604 - RNA, 10 nt, Human
uuuggccaga

SEQ ID NO: 3685605 - RNA, 20 nt, Human
uuuggcccccgagcuggggg

SEQ ID NO: 3685606 - RNA, 21 nt, Human
uuuggcccuucuccuuuugaa

SEQ ID NO: 3685607 - RNA, 18 nt, Human
uuuggccucauuacuuua

SEQ ID NO: 3685608 - RNA, 17 nt, Human
uuuggcgcuauuacaaa

SEQ ID NO: 3685609 - RNA, 14 nt, Human
uuuggcgggccaag

SEQ ID NO: 3685610 - RNA, 17 nt, Human
uuuggcgggccaaggac

SEQ ID NO: 3685611 - RNA, 16 nt, Human
uuuggcuaguccuugu

SEQ ID NO: 3685612 - RNA, 15 nt, Human
uuuggcuccugccca

SEQ ID NO: 3685613 - RNA, 23 nt, Human
uuuggcucuccucagaagaaaga

SEQ ID NO: 3685614 - RNA, 12 nt, Human
uuuggcugcuga

SEQ ID NO: 3685615 - RNA, 19 nt, Human
uuuggcugugucuaaacug

SEQ ID NO: 3685616 - RNA, 23 nt, Human
uuugggacccugcuuuagagcua

SEQ ID NO: 3685617 - RNA, 21 nt, Human
uuugggagacaugugacauuu

SEQ ID NO: 3685618 - RNA, 16 nt, Human
uuugggagggaaaagg

SEQ ID NO: 3685619 - RNA, 12 nt, Human
uuugggaugucu

SEQ ID NO: 3685620 - RNA, 14 nt, Human
uuugggaugucuua

SEQ ID NO: 3685621 - RNA, 18 nt, Human
uuugggauuuaauuucca

SEQ ID NO: 3685622 - RNA, 20 nt, Human
uuugggcagaagggagaagg

SEQ ID NO: 3685623 - RNA, 21 nt, Human
uuugggcagcaauuuaaaugu

SEQ ID NO: 3685624 - RNA, 12 nt, Human
uuugggcccagg

SEQ ID NO: 3685625 - RNA, 15 nt, Human
uugccuccaggugca

SEQ ID NO: 3685626 - RNA, 20 nt, Human
uugccuccaggugcagaggu

SEQ ID NO: 3685627 - RNA, 18 nt, Human
uugccuccauggugccuc

SEQ ID NO: 3685628 - RNA, 20 nt, Human
uugccuccauggugccucug

SEQ ID NO: 3685629 - RNA, 20 nt, Human
uugccuccccauuucccauc

SEQ ID NO: 3685630 - RNA, 15 nt, Human
uugccucggcuccug

SEQ ID NO: 3685631 - RNA, 17 nt, Human
uugccucggcuccugcu

SEQ ID NO: 3685632 - RNA, 18 nt, Human
uugccucggcuccugcug

SEQ ID NO: 3685633 - RNA, 19 nt, Human
uugccucggcuccugcugc

SEQ ID NO: 3685634 - RNA, 22 nt, Human
uugccucggcuccugcugcacc

SEQ ID NO: 3685635 - RNA, 20 nt, Human
uugccucucgguugaaaccu

SEQ ID NO: 3685636 - RNA, 19 nt, Human
uugccucugagagcaucag

SEQ ID NO: 3685637 - RNA, 11 nt, Human
uugccucugcc

SEQ ID NO: 3685638 - RNA, 16 nt, Human
uugccucugccucuga

SEQ ID NO: 3685639 - RNA, 18 nt, Human
uugccucuguccccuucu

SEQ ID NO: 3685640 - RNA, 19 nt, Human
uugccucuguccccuucuc

SEQ ID NO: 3685641 - RNA, 12 nt, Human
uugccucugugc

SEQ ID NO: 3685642 - RNA, 20 nt, Human
uugccucuuuuaccugcugc

SEQ ID NO: 3685643 - RNA, 19 nt, Human
uugccugaacauccuuccu

SEQ ID NO: 3685644 - RNA, 20 nt, Human
uugccugaaguuggagugag

SEQ ID NO: 3685645 - RNA, 15 nt, Human
uugccugcagagaga

SEQ ID NO: 3685646 - RNA, 15 nt, Human
uugccugcagggcca

SEQ ID NO: 3685647 - RNA, 16 nt, Human
uugccugccuuuccau

SEQ ID NO: 3685648 - RNA, 21 nt, Human
uugccuguuucugauuugcug

SEQ ID NO: 3685649 - RNA, 13 nt, Human
uugccuuaaaaua

SEQ ID NO: 3685650 - RNA, 16 nt, Human
uugccuuaaagaaagu

SEQ ID NO: 3685651 - RNA, 21 nt, Human
uugccuuccacgcugucucca

SEQ ID NO: 3685652 - RNA, 20 nt, Human
uugccuuccauuuccccucu

SEQ ID NO: 3685653 - RNA, 15 nt, Human
uugccuuccuaagcc

SEQ ID NO: 3685654 - RNA, 17 nt, Human
uugccuucuacuuuuaa

SEQ ID NO: 3685655 - RNA, 17 nt, Human
uugccuugcagaacugc

SEQ ID NO: 3685656 - RNA, 23 nt, Human
uugccuuuagugaucacagcagc

SEQ ID NO: 3685657 - RNA, 18 nt, Human
uugccuuucgaggccuga

SEQ ID NO: 3685658 - RNA, 19 nt, Human
uugccuuucuguguuuauu

SEQ ID NO: 3685659 - RNA, 16 nt, Human
uugccuuugaauguua

SEQ ID NO: 3685660 - RNA, 18 nt, Human
uugccuuuucuagcccga

SEQ ID NO: 3685661 - RNA, 19 nt, Human
uugccuuuugcaaccagga

SEQ ID NO: 3685662 - RNA, 17 nt, Human
uugccuuuuucauuauu

SEQ ID NO: 3685663 - RNA, 18 nt, Human
uugcgacggagagaaaaa

SEQ ID NO: 3685664 - RNA, 19 nt, Human
uugcgauagagucucacug

SEQ ID NO: 3685665 - RNA, 19 nt, Human
uugcgcuccuggcccagcc

SEQ ID NO: 3685666 - RNA, 13 nt, Human
uugcgcuguugcg

SEQ ID NO: 3685667 - RNA, 15 nt, Human
uugcggggggaggga

SEQ ID NO: 3685668 - RNA, 16 nt, Human
uugcguaugucuguua

SEQ ID NO: 3685669 - RNA, 20 nt, Human
uugcguaugucuguuaccau

SEQ ID NO: 3685670 - RNA, 18 nt, Human
uugcguggacucugcaca

SEQ ID NO: 3685671 - RNA, 22 nt, Human
uugcguuccaugaugcugggau

SEQ ID NO: 3685672 - RNA, 21 nt, Human
uugcuaaaaauaguggccaga

SEQ ID NO: 3685673 - RNA, 13 nt, Human
uugcuaacagcaa

SEQ ID NO: 3685674 - RNA, 15 nt, Human
uugcuaacugaacuu

SEQ ID NO: 3685675 - RNA, 21 nt, Human
uugcuaacugaacuuugaaga

SEQ ID NO: 3685676 - RNA, 18 nt, Human
uugcuaagcauuccaacu

SEQ ID NO: 3685677 - RNA, 21 nt, Human
uugcuaaucaaagccaggguc

SEQ ID NO: 3685678 - RNA, 16 nt, Human
uugcuaaucagugucu

SEQ ID NO: 3685679 - RNA, 18 nt, Human
uugcuaaucagugucuca

SEQ ID NO: 3685680 - RNA, 13 nt, Human
uugcuaauguugc

SEQ ID NO: 3685681 - RNA, 14 nt, Human
uugcuaauguugcu

SEQ ID NO: 3685682 - RNA, 17 nt, Human
uugcuaauuuucucaaa

SEQ ID NO: 3685683 - RNA, 16 nt, Human
uugcuacauaauuauc

SEQ ID NO: 3685684 - RNA, 22 nt, Human
uugcuaccaguauuuagaagcc

SEQ ID NO: 3685685 - RNA, 21 nt, Human
uugcuacccugaguucaucca

SEQ ID NO: 3685686 - RNA, 20 nt, Human
uugcuacuacuuaccuacca

SEQ ID NO: 3685687 - RNA, 18 nt, Human
uugcuagagcuccucccu

SEQ ID NO: 3685688 - RNA, 23 nt, Human
uugcuagauaaaagcugaaguua

SEQ ID NO: 3685689 - RNA, 13 nt, Human
uugcuaguauuug

SEQ ID NO: 3685690 - RNA, 18 nt, Human
uugcuaucaacaauaaaa

SEQ ID NO: 3685691 - RNA, 14 nt, Human
uugggccagacaug

SEQ ID NO: 3685692 - RNA, 19 nt, Human
uugggcccacaccuccuuc

SEQ ID NO: 3685693 - RNA, 12 nt, Human
uugggcccagcu

SEQ ID NO: 3685694 - RNA, 17 nt, Human
uugggcccagcugggcu

SEQ ID NO: 3685695 - RNA, 22 nt, Human
uugggcccagcugggcucugcc

SEQ ID NO: 3685696 - RNA, 18 nt, Human
uugggccccagaggcugg

SEQ ID NO: 3685697 - RNA, 20 nt, Human
uugggcgccgugcugggcag

SEQ ID NO: 3685698 - RNA, 12 nt, Human
uugggcucccaa

SEQ ID NO: 3685699 - RNA, 19 nt, Human
uugggcuucagcugccagu

SEQ ID NO: 3685700 - RNA, 18 nt, Human
uugggcuugcuauucugu

SEQ ID NO: 3685701 - RNA, 23 nt, Human
uuggggaaacagcaucuccaagc

SEQ ID NO: 3685702 - RNA, 14 nt, Human
uuggggaagaccca

SEQ ID NO: 3685703 - RNA, 11 nt, Human
uuggggaagag

SEQ ID NO: 3685704 - RNA, 20 nt, Human
uuggggacacauguauuugg

SEQ ID NO: 3685705 - RNA, 18 nt, Human
uuggggaccagagcugcc

SEQ ID NO: 3685706 - RNA, 15 nt, Human
uuggggagguguuca

SEQ ID NO: 3685707 - RNA, 19 nt, Human
uuggggaguuaagaccugg

SEQ ID NO: 3685708 - RNA, 14 nt, Human
uuggggauauuuuu

SEQ ID NO: 3685709 - RNA, 15 nt, Human
uuggggauucuuaaa

SEQ ID NO: 3685710 - RNA, 15 nt, Human
uuggggcaaaaaucc

SEQ ID NO: 3685711 - RNA, 21 nt, Human
uuggggccaccaaagcugccc

SEQ ID NO: 3685712 - RNA, 14 nt, Human
uuggggcucccagc

SEQ ID NO: 3685713 - RNA, 22 nt, Human
uuggggcucccagccaggcccu

SEQ ID NO: 3685714 - RNA, 19 nt, Human
uugggggacguuucucauu

SEQ ID NO: 3685715 - RNA, 15 nt, Human
uugggggcucagcaa

SEQ ID NO: 3685716 - RNA, 16 nt, Human
uugggggcugugggga

SEQ ID NO: 3685717 - RNA, 17 nt, Human
uuggggggacucugagc

SEQ ID NO: 3685718 - RNA, 22 nt, Human
uuggggggcugaggugggagga

SEQ ID NO: 3685719 - RNA, 20 nt, Human
uuggggggguggccgcugag

SEQ ID NO: 3685720 - RNA, 16 nt, Human
uugggggucagugcug

SEQ ID NO: 3685721 - RNA, 20 nt, Human
uuggggguccuccuccaggg

SEQ ID NO: 3685722 - RNA, 17 nt, Human
uugggguacccacugcu

SEQ ID NO: 3685723 - RNA, 22 nt, Human
uugggguacccacugcucuggu

SEQ ID NO: 3685724 - RNA, 21 nt, Human
uugggguagcuagaggaacca

SEQ ID NO: 3685725 - RNA, 23 nt, Human
uuggggucaagaaacagccagca

SEQ ID NO: 3685726 - RNA, 16 nt, Human
uuggggucugccacca

SEQ ID NO: 3685727 - RNA, 17 nt, Human
uuggggucuggcagccu

SEQ ID NO: 3685728 - RNA, 20 nt, Human
uugggguggguauaaaagau

SEQ ID NO: 3685729 - RNA, 17 nt, Human
uuggguaaaauacuuuu

SEQ ID NO: 3685730 - RNA, 18 nt, Human
uuggguaccuauuuucau

SEQ ID NO: 3685731 - RNA, 23 nt, Human
uuggguagaaagagauacagagg

SEQ ID NO: 3685732 - RNA, 20 nt, Human
uuggguagcugccacuugaa

SEQ ID NO: 3685733 - RNA, 14 nt, Human
uuggguaggcggga

SEQ ID NO: 3685734 - RNA, 13 nt, Human
uuggguccaggag

SEQ ID NO: 3685735 - RNA, 18 nt, Human
uugggucuauuccagcuc

SEQ ID NO: 3685736 - RNA, 15 nt, Human
uugggugaucauuca

SEQ ID NO: 3685737 - RNA, 20 nt, Human
uugggugcaagagggagcac

SEQ ID NO: 3685738 - RNA, 15 nt, Human
uuggguggagaagcc

SEQ ID NO: 3685739 - RNA, 21 nt, Human
uuggguggggggcauugagua

SEQ ID NO: 3685740 - RNA, 17 nt, Human
uuggguggggggcuuca

SEQ ID NO: 3685741 - RNA, 21 nt, Human
uuggguggggggcuucauaca

SEQ ID NO: 3685742 - RNA, 23 nt, Human
uuggguguaacaggucuccucuu

SEQ ID NO: 3685743 - RNA, 15 nt, Human
uuggguguauugugc

SEQ ID NO: 3685744 - RNA, 16 nt, Human
uuggguguauugugcg

SEQ ID NO: 3685745 - RNA, 20 nt, Human
uugggugucuccuuaagcug

SEQ ID NO: 3685746 - RNA, 18 nt, Human
uuggguuagaccuacagg

SEQ ID NO: 3685747 - RNA, 13 nt, Human
uuggguucacagc

SEQ ID NO: 3685748 - RNA, 16 nt, Human
uuggguucaucugagc

SEQ ID NO: 3685749 - RNA, 17 nt, Human
uuggguucaugaugcag

SEQ ID NO: 3685750 - RNA, 12 nt, Human
uuggguuuauuu

SEQ ID NO: 3685751 - RNA, 15 nt, Human
uuggguuuuuuuccu

SEQ ID NO: 3685752 - RNA, 19 nt, Human
uugguaaaacucacuguga

SEQ ID NO: 3685753 - RNA, 20 nt, Human
uugguaaaacucacugugau

SEQ ID NO: 3685754 - RNA, 20 nt, Human
uugguaaaguccuuuucuug

SEQ ID NO: 3685755 - RNA, 21 nt, Human
uugguaaauuuccccaacagu

SEQ ID NO: 3685756 - RNA, 19 nt, Human
uugguaacacaaauuuuca

SEQ ID NO: 3685757 - RNA, 15 nt, Human
uugguaagcuuccag

SEQ ID NO: 3685758 - RNA, 13 nt, Human
uugguacaaaaau

SEQ ID NO: 3685759 - RNA, 14 nt, Human
uugguacaaaaaua

SEQ ID NO: 3685760 - RNA, 20 nt, Human
uugguacauggccaguguga

SEQ ID NO: 3685761 - RNA, 12 nt, Human
uugguaccagau

SEQ ID NO: 3685762 - RNA, 14 nt, Human
uugguaccagauaa

SEQ ID NO: 3685763 - RNA, 17 nt, Human
uugguaccuugcacaca

SEQ ID NO: 3685764 - RNA, 22 nt, Human
uugguacuacuagaugucuuua

SEQ ID NO: 3685765 - RNA, 17 nt, Human
uugguacuauaaaagcu

SEQ ID NO: 3685766 - RNA, 13 nt, Human
uugguacuguaau

SEQ ID NO: 3685767 - RNA, 17 nt, Human
uugguauauccuuuucu

SEQ ID NO: 3685768 - RNA, 18 nt, Human
uugguaucuguucuuuaa

SEQ ID NO: 3685769 - RNA, 12 nt, Human
uugguauuguau

SEQ ID NO: 3685770 - RNA, 13 nt, Human
uugguauuguauu

SEQ ID NO: 3685771 - RNA, 14 nt, Human
uugguauuguauuu

SEQ ID NO: 3685772 - RNA, 20 nt, Human
uugguauuuggauaucuguu

SEQ ID NO: 3685773 - RNA, 22 nt, Human
uuggucagaguaagcugcuuuu

SEQ ID NO: 3685774 - RNA, 14 nt, Human
uuggucaggcuggu

SEQ ID NO: 3685775 - RNA, 15 nt, Human
uugguccaggaaaug

SEQ ID NO: 3685776 - RNA, 22 nt, Human
uuggucccccuuccauggacuu

SEQ ID NO: 3685777 - RNA, 23 nt, Human
uuggucccgugcagcuucugucc

SEQ ID NO: 3685778 - RNA, 17 nt, Human
uugguccucuugccauc

SEQ ID NO: 3685779 - RNA, 13 nt, Human
uuggucguuuuuu

SEQ ID NO: 3685780 - RNA, 16 nt, Human
uuggucuguacugauu

SEQ ID NO: 3685781 - RNA, 15 nt, Human
uuggucugugagaug

SEQ ID NO: 3685782 - RNA, 16 nt, Human
uuggucugugagaugc

SEQ ID NO: 3685783 - RNA, 19 nt, Human
uuggucuuauuuauuauug

SEQ ID NO: 3685784 - RNA, 21 nt, Human
uuggugaacauugcaauagaa

SEQ ID NO: 3685785 - RNA, 17 nt, Human
uuggugaauuucacaag

SEQ ID NO: 3685786 - RNA, 20 nt, Human
uuggugauuccgcagugaga

SEQ ID NO: 3685787 - RNA, 16 nt, Human
uuggugcacagcacaa

SEQ ID NO: 3685788 - RNA, 22 nt, Human
uuggugcacagcacaaauuagu

SEQ ID NO: 3685789 - RNA, 15 nt, Human
uuggugcacagugau

SEQ ID NO: 3685790 - RNA, 21 nt, Human
uuggugcauagaacuggguaa

SEQ ID NO: 3685791 - RNA, 16 nt, Human
uuggugccuuuccugu

SEQ ID NO: 3685792 - RNA, 20 nt, Human
uuggugcgggcacaauaaau

SEQ ID NO: 3685793 - RNA, 19 nt, Human
uuggugcucauuuaaauau

SEQ ID NO: 3685794 - RNA, 17 nt, Human
uuggugcuuuuuauaaa

SEQ ID NO: 3685795 - RNA, 21 nt, Human
uuggugcuuuuuauaaaaaga

SEQ ID NO: 3685796 - RNA, 15 nt, Human
uugguggauguaaau

SEQ ID NO: 3685797 - RNA, 18 nt, Human
uugguggcucacgccugu

SEQ ID NO: 3685798 - RNA, 14 nt, Human
uugguggcuuuccu

SEQ ID NO: 3685799 - RNA, 18 nt, Human
uuggugggugaaaggaau

SEQ ID NO: 3685800 - RNA, 19 nt, Human
uuggugguuucagaaaugu

SEQ ID NO: 3685801 - RNA, 19 nt, Human
uuggugucgggcaugacac

SEQ ID NO: 3685802 - RNA, 14 nt, Human
uugguguuaaaaca

SEQ ID NO: 3685803 - RNA, 17 nt, Human
uugguuaaaaaaaagaa

SEQ ID NO: 3685804 - RNA, 22 nt, Human
uugguuaagcuuugacacugga

SEQ ID NO: 3685805 - RNA, 18 nt, Human
uugguuaauuuuuacaug

SEQ ID NO: 3685806 - RNA, 18 nt, Human
uugguuauacaugacacu

SEQ ID NO: 3685807 - RNA, 21 nt, Human
uugguuauacaugacacugaa

SEQ ID NO: 3685808 - RNA, 15 nt, Human
uugguucaaaugugu

SEQ ID NO: 3685809 - RNA, 14 nt, Human
uugguucauaaaug

SEQ ID NO: 3685810 - RNA, 15 nt, Human
uugguucauaaauga

SEQ ID NO: 3685811 - RNA, 18 nt, Human
uugguucaucaguguuaa

SEQ ID NO: 3685812 - RNA, 21 nt, Human
uugguuccaagucuuugcuau

SEQ ID NO: 3685813 - RNA, 18 nt, Human
uugguucccccacugauc

SEQ ID NO: 3685814 - RNA, 19 nt, Human
uugguucuaauagaacuca

SEQ ID NO: 3685815 - RNA, 20 nt, Human
uugguucuagcgcaguuuuu

SEQ ID NO: 3685816 - RNA, 15 nt, Human
ucaaaauagaaaagu

SEQ ID NO: 3685817 - RNA, 15 nt, Human
ucaaaauauguucuu

SEQ ID NO: 3685818 - RNA, 14 nt, Human
ucaaaauauugagc

SEQ ID NO: 3685819 - RNA, 20 nt, Human
ucaaaauauugagcagaauu

SEQ ID NO: 3685820 - RNA, 20 nt, Human
ucaaaauauuuaaaaauguc

SEQ ID NO: 3685821 - RNA, 23 nt, Human
ucaaaauauuuuuaaaagaucuu

SEQ ID NO: 3685822 - RNA, 16 nt, Human
ucaaaauccaaaaaga

SEQ ID NO: 3685823 - RNA, 16 nt, Human
ucaaaauccuuccaaa

SEQ ID NO: 3685824 - RNA, 18 nt, Human
ucaaaauccuuccaaaga

SEQ ID NO: 3685825 - RNA, 19 nt, Human
ucaaaauccuuccaaagaa

SEQ ID NO: 3685826 - RNA, 14 nt, Human
ucaaaaucucucca

SEQ ID NO: 3685827 - RNA, 14 nt, Human
ucaaaaugcucuua

SEQ ID NO: 3685828 - RNA, 19 nt, Human
ucaaaaugcucuuauuuca

SEQ ID NO: 3685829 - RNA, 22 nt, Human
ucaaaaugcucuuauuucauca

SEQ ID NO: 3685830 - RNA, 19 nt, Human
ucaaaaugcuuuuuauuuc

SEQ ID NO: 3685831 - RNA, 14 nt, Human
ucaaaauguauaua

SEQ ID NO: 3685832 - RNA, 20 nt, Human
ucaaaauguuaucuucucaa

SEQ ID NO: 3685833 - RNA, 15 nt, Human
ucaaaauuacauaua

SEQ ID NO: 3685834 - RNA, 24 nt, Human
ucaaaauuagugcuuuuuguguca

SEQ ID NO: 3685835 - RNA, 14 nt, Human
ucaaaauuauagga

SEQ ID NO: 3685836 - RNA, 17 nt, Human
ucaaaauucuaaaugua

SEQ ID NO: 3685837 - RNA, 23 nt, Human
ucaaaauuugcugccaaaugcgu

SEQ ID NO: 3685838 - RNA, 15 nt, Human
ucaaacaaagccaga

SEQ ID NO: 3685839 - RNA, 16 nt, Human
ucaaacaaagccagaa

SEQ ID NO: 3685840 - RNA, 17 nt, Human
ucaaacaacacuggugu

SEQ ID NO: 3685841 - RNA, 14 nt, Human
ucaaacacaaaugc

SEQ ID NO: 3685842 - RNA, 17 nt, Human
ucaaacacaaaugcagg

SEQ ID NO: 3685843 - RNA, 13 nt, Human
ucaaacacagaga

SEQ ID NO: 3685844 - RNA, 14 nt, Human
ucaaacacugcagg

SEQ ID NO: 3685845 - RNA, 19 nt, Human
ucaaacacuugugacuuuu

SEQ ID NO: 3685846 - RNA, 15 nt, Human
ucaaacaguagguug

SEQ ID NO: 3685847 - RNA, 21 nt, Human
ucaaacagucucaggaaauca

SEQ ID NO: 3685848 - RNA, 17 nt, Human
ucaaacauauauaacaa

SEQ ID NO: 3685849 - RNA, 17 nt, Human
ucaaacauuaguacuuu

SEQ ID NO: 3685850 - RNA, 20 nt, Human
ucaaacauuaguacuuuaua

SEQ ID NO: 3685851 - RNA, 15 nt, Human
ucaaacauuuucugg

SEQ ID NO: 3685852 - RNA, 22 nt, Human
ucaaaccaguauacaagauaag

SEQ ID NO: 3685853 - RNA, 15 nt, Human
ucaaaccauaaacuu

SEQ ID NO: 3685854 - RNA, 19 nt, Human
ucaaaccccgaccaccugc

SEQ ID NO: 3685855 - RNA, 23 nt, Human
ucaaaccccgaccaccugcccaa

SEQ ID NO: 3685856 - RNA, 15 nt, Human
ucaaaccccugaccu

SEQ ID NO: 3685857 - RNA, 15 nt, Human
ucaaacccuagccuu

SEQ ID NO: 3685858 - RNA, 17 nt, Human
ucaaacccuagccuugc

SEQ ID NO: 3685859 - RNA, 21 nt, Human
ucaaacccuagccuugcuugu

SEQ ID NO: 3685860 - RNA, 20 nt, Human
ucaaaccgcacucacccaug

SEQ ID NO: 3685861 - RNA, 21 nt, Human
ucaaacuaaaagacauuuguu

SEQ ID NO: 3685862 - RNA, 12 nt, Human
ucaaacuaacag

SEQ ID NO: 3685863 - RNA, 20 nt, Human
ucaaacuacuuugcugcuaa

SEQ ID NO: 3685864 - RNA, 21 nt, Human
ucaaacuaggggacaaagcaa

SEQ ID NO: 3685865 - RNA, 18 nt, Human
ucaaacucaaugcuuuau

SEQ ID NO: 3685866 - RNA, 22 nt, Human
ucaaacucuugaccucagguga

SEQ ID NO: 3685867 - RNA, 16 nt, Human
ucaaacuggggccucc

SEQ ID NO: 3685868 - RNA, 18 nt, Human
ucaaacugugaagcauuu

SEQ ID NO: 3685869 - RNA, 17 nt, Human
ucaaacuuacuauuuug

SEQ ID NO: 3685870 - RNA, 19 nt, Human
ucaaacuucuggcucccuc

SEQ ID NO: 3685871 - RNA, 22 nt, Human
ucaaacuuggauacuuggauuu

SEQ ID NO: 3685872 - RNA, 15 nt, Human
ucaaacuuuacuaug

SEQ ID NO: 3685873 - RNA, 22 nt, Human
ucaaagaaagaaaguuuagaag

SEQ ID NO: 3685874 - RNA, 15 nt, Human
ucaaagaaaguguau

SEQ ID NO: 3685875 - RNA, 16 nt, Human
ucaaagaaaguguauu

SEQ ID NO: 3685876 - RNA, 14 nt, Human
ucaaagaaauaucu

SEQ ID NO: 3685877 - RNA, 12 nt, Human
ucaaagaaaugc

SEQ ID NO: 3685878 - RNA, 19 nt, Human
ucaaagaaaugcugaugga

SEQ ID NO: 3685879 - RNA, 23 nt, Human
ucaaagaagguuuguguuuuucu

SEQ ID NO: 3685880 - RNA, 16 nt, Human
ucaaagaauaagaaaa

SEQ ID NO: 3685881 - RNA, 23 nt, Human
ucaaagaaucaccuaauuaauuu

SEQ ID NO: 3685882 - RNA, 17 nt, Human
ucaaagacauucugaca

SEQ ID NO: 3685883 - RNA, 21 nt, Human
ucaaagaccuuguguguaugu

SEQ ID NO: 3685884 - RNA, 16 nt, Human
ucaaagagaaaacuua

SEQ ID NO: 3685885 - RNA, 15 nt, Human
ucaaagagagaaaau

SEQ ID NO: 3685886 - RNA, 21 nt, Human
ucaaagaggcugaggcuggca

SEQ ID NO: 3685887 - RNA, 12 nt, Human
ucaaagagguuu

SEQ ID NO: 3685888 - RNA, 16 nt, Human
ucaaagagguuuuaaa

SEQ ID NO: 3685889 - RNA, 23 nt, Human
ucaaagagguuuuaaaaaaaucc

SEQ ID NO: 3685890 - RNA, 23 nt, Human
ucaaagcaaaugucuuccuggau

SEQ ID NO: 3685891 - RNA, 22 nt, Human
ucaaagcaagcauucagaagaa

SEQ ID NO: 3685892 - RNA, 15 nt, Human
ucaaagcaaugcauu

SEQ ID NO: 3685893 - RNA, 18 nt, Human
ucaaagcaaugcauuuug

SEQ ID NO: 3685894 - RNA, 12 nt, Human
ucaaagcaauug

SEQ ID NO: 3685895 - RNA, 12 nt, Human
ucaaagcauuua

SEQ ID NO: 3685896 - RNA, 15 nt, Human
ucaaagccagggucu

SEQ ID NO: 3685897 - RNA, 11 nt, Human
ucaaagcugcc

SEQ ID NO: 3685898 - RNA, 18 nt, Human
ucaaagcugcuuuauuca

SEQ ID NO: 3685899 - RNA, 17 nt, Human
ucaaagcuuccauucca

SEQ ID NO: 3685900 - RNA, 20 nt, Human
ucaaagcuugaagaucguua

SEQ ID NO: 3685901 - RNA, 22 nt, Human
ucaaagcuuggauuaaauacau

SEQ ID NO: 3685902 - RNA, 15 nt, Human
ucaaagcuuuuucca

SEQ ID NO: 3685903 - RNA, 19 nt, Human
ucaaaggcacagugaaggc

SEQ ID NO: 3685904 - RNA, 17 nt, Human
ucaaagggauaaagaaa

SEQ ID NO: 3685905 - RNA, 18 nt, Human
ucaaagggcccacaguga

SEQ ID NO: 3685906 - RNA, 16 nt, Human
ucaaagguucuagguu

SEQ ID NO: 3685907 - RNA, 20 nt, Human
ucaaagguucuagguuucaa

SEQ ID NO: 3685908 - RNA, 18 nt, Human
ucaaaguaggcaggacca

SEQ ID NO: 3685909 - RNA, 15 nt, Human
ucaaagucagaacaa

SEQ ID NO: 3685910 - RNA, 21 nt, Human
ucaaagucaugauguuuuuaa

SEQ ID NO: 3685911 - RNA, 22 nt, Human
ucaaagucaugauguuuuuaaa

SEQ ID NO: 3685912 - RNA, 13 nt, Human
ucaaagucauuaa

SEQ ID NO: 3685913 - RNA, 17 nt, Human
ucaaagucauuaaagac

SEQ ID NO: 3685914 - RNA, 21 nt, Human
ucaaagucugcucucauauaa

SEQ ID NO: 3685915 - RNA, 18 nt, Human
ucaaaguguuuucucuga

SEQ ID NO: 3685916 - RNA, 15 nt, Human
ucaaaguugaaaauu

SEQ ID NO: 3685917 - RNA, 15 nt, Human
ucaaaguugccuaaa

SEQ ID NO: 3685918 - RNA, 18 nt, Human
ucaaaguugccuaaaucc

SEQ ID NO: 3685919 - RNA, 19 nt, Human
ucaaaguugccuaaaucca

SEQ ID NO: 3685920 - RNA, 14 nt, Human
ucaaaguuuaauaa

SEQ ID NO: 3685921 - RNA, 18 nt, Human
ucaaaguuuugaaaagcu

SEQ ID NO: 3685922 - RNA, 19 nt, Human
ucaaaguuuugaaaagcua

SEQ ID NO: 3685923 - RNA, 20 nt, Human
ucaaaguuuugaaaagcuau

SEQ ID NO: 3685924 - RNA, 22 nt, Human
ucaaaguuuugaaaagcuauua

SEQ ID NO: 3685925 - RNA, 13 nt, Human
ucaaauaaacacu

SEQ ID NO: 3685926 - RNA, 12 nt, Human
ucaaauaagaaa

SEQ ID NO: 3685927 - RNA, 17 nt, Human
ucaaauaaguauuuaua

SEQ ID NO: 3685928 - RNA, 20 nt, Human
ucaaauaaguauuuauaaua

SEQ ID NO: 3685929 - RNA, 13 nt, Human
ucaaauacaucuu

SEQ ID NO: 3685930 - RNA, 21 nt, Human
ucaaauacauuuaaaacauua

SEQ ID NO: 3685931 - RNA, 23 nt, Human
ucaaauacgugggcauucaaaug

SEQ ID NO: 3685932 - RNA, 20 nt, Human
ucaaauaggcuauuaaaaaa

SEQ ID NO: 3685933 - RNA, 23 nt, Human
ucaaauaggcuauuaaaaaaguc

SEQ ID NO: 3685934 - RNA, 15 nt, Human
ucaaauaguugcaua

SEQ ID NO: 3685935 - RNA, 15 nt, Human
ucaaauauuagaugu

SEQ ID NO: 3685936 - RNA, 19 nt, Human
ucaaauauuagaugugauu

SEQ ID NO: 3685937 - RNA, 23 nt, Human
ucaaaucaggcuacuagaauucu

SEQ ID NO: 3685938 - RNA, 22 nt, Human
ucaaauccacccauauguuaaa

SEQ ID NO: 3685939 - RNA, 21 nt, Human
ucaaauccaggacccugccag

SEQ ID NO: 3685940 - RNA, 15 nt, Human
ucaaauccauccaga

SEQ ID NO: 3685941 - RNA, 15 nt, Human
ucaaauccuugaaga

SEQ ID NO: 3685942 - RNA, 16 nt, Human
ucaaaucuccaguauu

SEQ ID NO: 3685943 - RNA, 14 nt, Human
ucaaaucuuaagaa

SEQ ID NO: 3685944 - RNA, 23 nt, Human
ucaaaucuuggcaauauuccuua

SEQ ID NO: 3685945 - RNA, 15 nt, Human
ucaaaugaaauguau

SEQ ID NO: 3685946 - RNA, 21 nt, Human
ucaaaugaauaaugccuuugu

SEQ ID NO: 3685947 - RNA, 15 nt, Human
ucaaaugacccaaag

SEQ ID NO: 3685948 - RNA, 16 nt, Human
ucaaaugacccaaaga

SEQ ID NO: 3685949 - RNA, 21 nt, Human
ucaaaugacccaaagaccaau

SEQ ID NO: 3685950 - RNA, 15 nt, Human
ucaaaugagaaaaug

SEQ ID NO: 3685951 - RNA, 18 nt, Human
ucaaaugaugugccugcu

SEQ ID NO: 3685952 - RNA, 22 nt, Human
ucaaaugaugugccugcuucag

SEQ ID NO: 3685953 - RNA, 14 nt, Human
ucaaaugcucagac

SEQ ID NO: 3685954 - RNA, 19 nt, Human
ucaaaugcucagaccagcu

SEQ ID NO: 3685955 - RNA, 21 nt, Human
ucaaaugcucagaccagcucu

SEQ ID NO: 3685956 - RNA, 17 nt, Human
ucaaauggaagacacau

SEQ ID NO: 3685957 - RNA, 20 nt, Human
ucaaauggaagacacauuga

SEQ ID NO: 3685958 - RNA, 21 nt, Human
ucaaaugguaggcauuuccua

SEQ ID NO: 3685959 - RNA, 14 nt, Human
ucaaauguguuuug

SEQ ID NO: 3685960 - RNA, 14 nt, Human
ucaaauguucuaag

SEQ ID NO: 3685961 - RNA, 15 nt, Human
ucaaauguucuaagu

SEQ ID NO: 3685962 - RNA, 19 nt, Human
ucaaauguucuaaguuucu

SEQ ID NO: 3685963 - RNA, 14 nt, Human
ucaaauguuuaauc

SEQ ID NO: 3685964 - RNA, 20 nt, Human
ucaaauuaaaacagcugcau

SEQ ID NO: 3685965 - RNA, 21 nt, Human
uuuuaccuaccacagugucug

SEQ ID NO: 3685966 - RNA, 19 nt, Human
uuuuaccuagcuaauuauu

SEQ ID NO: 3685967 - RNA, 15 nt, Human
uuuuaccugcugcuu

SEQ ID NO: 3685968 - RNA, 21 nt, Human
uuuuaccugucacauugcauu

SEQ ID NO: 3685969 - RNA, 19 nt, Human
uuuuacguccaucucuugu

SEQ ID NO: 3685970 - RNA, 13 nt, Human
uuuuacuaaagaa

SEQ ID NO: 3685971 - RNA, 15 nt, Human
uuuuacuaauagaca

SEQ ID NO: 3685972 - RNA, 22 nt, Human
uuuuacuaccaaugccaagaua

SEQ ID NO: 3685973 - RNA, 14 nt, Human
uuuuacuacugugg

SEQ ID NO: 3685974 - RNA, 15 nt, Human
uuuuacuacugugga

SEQ ID NO: 3685975 - RNA, 15 nt, Human
uuuuacuagaacaca

SEQ ID NO: 3685976 - RNA, 15 nt, Human
uuuuacuccaguggu

SEQ ID NO: 3685977 - RNA, 16 nt, Human
uuuuacucugccuaca

SEQ ID NO: 3685978 - RNA, 15 nt, Human
uuuuacugguugcau

SEQ ID NO: 3685979 - RNA, 18 nt, Human
uuuuacugucuuaauuaa

SEQ ID NO: 3685980 - RNA, 22 nt, Human
uuuuacuugcauugaauauauu

SEQ ID NO: 3685981 - RNA, 19 nt, Human
uuuuacuuuuauaauaaaa

SEQ ID NO: 3685982 - RNA, 12 nt, Human
uuuuacuuuugu

SEQ ID NO: 3685983 - RNA, 12 nt, Human
uuuuacuuuuuu

SEQ ID NO: 3685984 - RNA, 16 nt, Human
uuuuagaaagcauuug

SEQ ID NO: 3685985 - RNA, 20 nt, Human
uuuuagaaagcauuugaaug

SEQ ID NO: 3685986 - RNA, 21 nt, Human
uuuuagaaagcauuugaaugc

SEQ ID NO: 3685987 - RNA, 22 nt, Human
uuuuagaaagcauuugaaugca

SEQ ID NO: 3685988 - RNA, 23 nt, Human
uuuuagaaagcauuugaaugcau

SEQ ID NO: 3685989 - RNA, 14 nt, Human
uuuuagaacagaaa

SEQ ID NO: 3685990 - RNA, 17 nt, Human
uuuuagaacagaaaaca

SEQ ID NO: 3685991 - RNA, 18 nt, Human
uuuuagaacagaaaacaa

SEQ ID NO: 3685992 - RNA, 20 nt, Human
uuuuagaauaagaauuugca

SEQ ID NO: 3685993 - RNA, 22 nt, Human
uuuuagacaaauacucaugugu

SEQ ID NO: 3685994 - RNA, 23 nt, Human
uuuuagacaaauacucaugugua

SEQ ID NO: 3685995 - RNA, 22 nt, Human
uuuuagacaaaucuaagggaaa

SEQ ID NO: 3685996 - RNA, 21 nt, Human
uuuuagacagucucacuuugu

SEQ ID NO: 3685997 - RNA, 21 nt, Human
uuuuagacccuauugcugcuu

SEQ ID NO: 3685998 - RNA, 12 nt, Human
uuuuagagaaaa

SEQ ID NO: 3685999 - RNA, 17 nt, Human
uuuuagagacuauggag

SEQ ID NO: 3686000 - RNA, 15 nt, Human
uuuuagaguaagaaa

SEQ ID NO: 3686001 - RNA, 23 nt, Human
uuuuagaguugauacuacaguuu

SEQ ID NO: 3686002 - RNA, 18 nt, Human
uuuuagauacuuugcuag

SEQ ID NO: 3686003 - RNA, 16 nt, Human
uuuuagaucaaauacu

SEQ ID NO: 3686004 - RNA, 20 nt, Human
uuuuagauugagaaaugugu

SEQ ID NO: 3686005 - RNA, 20 nt, Human
uuuuagcaguucugcaaaua

SEQ ID NO: 3686006 - RNA, 12 nt, Human
uuuuaggaaaug

SEQ ID NO: 3686007 - RNA, 18 nt, Human
uuuuaggaagcaagcuua

SEQ ID NO: 3686008 - RNA, 15 nt, Human
uuuuaggcaaguuuu

SEQ ID NO: 3686009 - RNA, 18 nt, Human
uuuuaggcagggauuuga

SEQ ID NO: 3686010 - RNA, 19 nt, Human
uuuuaggcagggauuugag

SEQ ID NO: 3686011 - RNA, 20 nt, Human
uuuuaggccaaaaaaaugua

SEQ ID NO: 3686012 - RNA, 22 nt, Human
uuuuagguguugauuuucuguu

SEQ ID NO: 3686013 - RNA, 12 nt, Human
uuuuagguucua

SEQ ID NO: 3686014 - RNA, 15 nt, Human
uuuuagguucuaaag

SEQ ID NO: 3686015 - RNA, 18 nt, Human
uuuuaguaaucuguacau

SEQ ID NO: 3686016 - RNA, 14 nt, Human
uuuuaguaauuucu

SEQ ID NO: 3686017 - RNA, 15 nt, Human
uuuuaguauucauuc

SEQ ID NO: 3686018 - RNA, 16 nt, Human
uuuuagucauuuugcu

SEQ ID NO: 3686019 - RNA, 18 nt, Human
uuuuagugauuuuaauaa

SEQ ID NO: 3686020 - RNA, 23 nt, Human
uuuuaguggacccugaaaugugu

SEQ ID NO: 3686021 - RNA, 16 nt, Human
uuuuaguucuuuggaa

SEQ ID NO: 3686022 - RNA, 12 nt, Human
uuuuaguugaau

SEQ ID NO: 3686023 - RNA, 18 nt, Human
uuuuaguuuuucauuaaa

SEQ ID NO: 3686024 - RNA, 21 nt, Human
uuuuauaaaaaaaaugaaaug

SEQ ID NO: 3686025 - RNA, 17 nt, Human
uuuuauaaaauuuugcu

SEQ ID NO: 3686026 - RNA, 12 nt, Human
uuuuauaaacuu

SEQ ID NO: 3686027 - RNA, 17 nt, Human
uuuuauaaacuuuaccu

SEQ ID NO: 3686028 - RNA, 12 nt, Human
uuuuauaaagug

SEQ ID NO: 3686029 - RNA, 20 nt, Human
uuuuauaaauauaagccuuu

SEQ ID NO: 3686030 - RNA, 12 nt, Human
uuuuauaaaucg

SEQ ID NO: 3686031 - RNA, 13 nt, Human
uuuuauaagaaaa

SEQ ID NO: 3686032 - RNA, 16 nt, Human
uuuuauaagaaaaacu

SEQ ID NO: 3686033 - RNA, 17 nt, Human
uuuuauaagaaaaacuu

SEQ ID NO: 3686034 - RNA, 19 nt, Human
uuuuauaauucucauuaaa

SEQ ID NO: 3686035 - RNA, 14 nt, Human
uuuuauaauuuugu

SEQ ID NO: 3686036 - RNA, 21 nt, Human
uuuuauaauuuugugaagcaa

SEQ ID NO: 3686037 - RNA, 14 nt, Human
uuuuauacaaaaua

SEQ ID NO: 3686038 - RNA, 14 nt, Human
uuuuauacaaaccu

SEQ ID NO: 3686039 - RNA, 13 nt, Human
uuuuauacacaua

SEQ ID NO: 3686040 - RNA, 15 nt, Human
uuuuauacaggggaa

SEQ ID NO: 3686041 - RNA, 19 nt, Human
uuuuauacucuuucuguau

SEQ ID NO: 3686042 - RNA, 12 nt, Human
uuuuauacugua

SEQ ID NO: 3686043 - RNA, 18 nt, Human
uuuuauacuuucccuacc

SEQ ID NO: 3686044 - RNA, 19 nt, Human
uuuuauagaaaaacaaauc

SEQ ID NO: 3686045 - RNA, 13 nt, Human
uuuuauagugugu

SEQ ID NO: 3686046 - RNA, 9 nt, Human
uuuuauaua

SEQ ID NO: 3686047 - RNA, 22 nt, Human
uuuuauauaauaaaguauucca

SEQ ID NO: 3686048 - RNA, 11 nt, Human
uuuuauauaua

SEQ ID NO: 3686049 - RNA, 20 nt, Human
uuuuauaucaauuuaaaaaa

SEQ ID NO: 3686050 - RNA, 21 nt, Human
uuuuauaucuggaaugagccu

SEQ ID NO: 3686051 - RNA, 16 nt, Human
uuuuauaucuguaugu

SEQ ID NO: 3686052 - RNA, 17 nt, Human
uuuuauaucuguaugua

SEQ ID NO: 3686053 - RNA, 17 nt, Human
uuuuauauuaaaauaag

SEQ ID NO: 3686054 - RNA, 17 nt, Human
uuuuauauuaauguacu

SEQ ID NO: 3686055 - RNA, 19 nt, Human
uuuuauauuacugacauuu

SEQ ID NO: 3686056 - RNA, 13 nt, Human
uuuuauauugaaa

SEQ ID NO: 3686057 - RNA, 14 nt, Human
uuuuauauugaaaa

SEQ ID NO: 3686058 - RNA, 22 nt, Human
uuuuauauugauaacagcacug

SEQ ID NO: 3686059 - RNA, 10 nt, Human
uuuuauauuu

SEQ ID NO: 3686060 - RNA, 13 nt, Human
uuuuauauuuacu

SEQ ID NO: 3686061 - RNA, 20 nt, Human
uuuuauauuuccuuuaugug

SEQ ID NO: 3686062 - RNA, 21 nt, Human
uuuuauauuuccuuuauguga

SEQ ID NO: 3686063 - RNA, 15 nt, Human
uuuuaucacauguau

SEQ ID NO: 3686064 - RNA, 15 nt, Human
uuuuaucccaaaguu

SEQ ID NO: 3686065 - RNA, 19 nt, Human
uuuuaucgucacugcuuaa

SEQ ID NO: 3686066 - RNA, 13 nt, Human
uuuuaucucagau

SEQ ID NO: 3686067 - RNA, 20 nt, Human
uuuuaucugaaaucaauuaa

SEQ ID NO: 3686068 - RNA, 13 nt, Human
uuuuaucuuuucu

SEQ ID NO: 3686069 - RNA, 20 nt, Human
uuuuaugacuucauuaauaa

SEQ ID NO: 3686070 - RNA, 11 nt, Human
uuuuaugagaa

SEQ ID NO: 3686071 - RNA, 12 nt, Human
uuuuaugagaaa

SEQ ID NO: 3686072 - RNA, 15 nt, Human
uuuuaugagaaaugu

SEQ ID NO: 3686073 - RNA, 16 nt, Human
uuuuaugagaaaugua

SEQ ID NO: 3686074 - RNA, 18 nt, Human
uuuuaugagcucauguag

SEQ ID NO: 3686075 - RNA, 21 nt, Human
uuuuaugagcucauguagcaa

SEQ ID NO: 3686076 - RNA, 22 nt, Human
uuuuaugagcucauguagcaau

SEQ ID NO: 3686077 - RNA, 21 nt, Human
uuuuaugaggagugaacauuu

SEQ ID NO: 3686078 - RNA, 15 nt, Human
uuuuaugauaucccu

SEQ ID NO: 3686079 - RNA, 20 nt, Human
uuuuaugaugacguacaagu

SEQ ID NO: 3686080 - RNA, 19 nt, Human
uuuuaugcucuuuuuuacu

SEQ ID NO: 3686081 - RNA, 22 nt, Human
uuuuaugcucuuuuuuacucau

SEQ ID NO: 3686082 - RNA, 19 nt, Human
uuuuauggagaccucuccu

SEQ ID NO: 3686083 - RNA, 22 nt, Human
uuuuauggcacuaguauuucua

SEQ ID NO: 3686084 - RNA, 19 nt, Human
uuuuauggcuuuugugcau

SEQ ID NO: 3686085 - RNA, 18 nt, Human
uuuuauggugccuaguau

SEQ ID NO: 3686086 - RNA, 23 nt, Human
uuuuauggugccuaguauugaca

SEQ ID NO: 3686087 - RNA, 13 nt, Human
uuuuauguugaca

SEQ ID NO: 3686088 - RNA, 15 nt, Human
uuuuauguuugaaua

SEQ ID NO: 3686089 - RNA, 22 nt, Human
uuuuauuaaaauauuucagguu

SEQ ID NO: 3686090 - RNA, 12 nt, Human
uuuuauuaagaa

SEQ ID NO: 3686091 - RNA, 13 nt, Human
uuuuauuaaucac

SEQ ID NO: 3686092 - RNA, 23 nt, Human
uuuuauuaaucacuguguauauu

SEQ ID NO: 3686093 - RNA, 14 nt, Human
uuuuauuaaugcac

SEQ ID NO: 3686094 - RNA, 13 nt, Human
uuuuauuaauuua

SEQ ID NO: 3686095 - RNA, 20 nt, Human
uuuuauuaguauuguugucc

SEQ ID NO: 3686096 - RNA, 22 nt, Human
uuuuauuaguauuguuguccuu

SEQ ID NO: 3686097 - RNA, 23 nt, Human
uuuuauuaguauuguuguccuuu

SEQ ID NO: 3686098 - RNA, 22 nt, Human
uuuuauuaugaaacuuguguaa

SEQ ID NO: 3686099 - RNA, 14 nt, Human
uuuuauuaugcaua

SEQ ID NO: 3686100 - RNA, 19 nt, Human
uuuuauuaugcauaacuga

SEQ ID NO: 3686101 - RNA, 14 nt, Human
uuuuauuauguaaa

SEQ ID NO: 3686102 - RNA, 13 nt, Human
uuuuauuauugug

SEQ ID NO: 3686103 - RNA, 14 nt, Human
uuuuauuauugugg

SEQ ID NO: 3686104 - RNA, 17 nt, Human
uuuuauuauuucuauua

SEQ ID NO: 3686105 - RNA, 21 nt, Human
uuuuauucagcucauggacuu

SEQ ID NO: 3686106 - RNA, 13 nt, Human
uuuuauucuugug

SEQ ID NO: 3686107 - RNA, 18 nt, Human
uuuuauucuugugaauau

SEQ ID NO: 3686108 - RNA, 16 nt, Human
uuuuauugacacagaa

SEQ ID NO: 3686109 - RNA, 18 nt, Human
uuuuauugacacagaaaa

SEQ ID NO: 3686110 - RNA, 16 nt, Human
uuuuauugccuucuca

SEQ ID NO: 3686111 - RNA, 22 nt, Human
uuuuauuguaacagacauuguu

SEQ ID NO: 3686112 - RNA, 23 nt, Human
uuuuauuucagauuuugauaacu

SEQ ID NO: 3686113 - RNA, 14 nt, Human
uuuuauuuccauca

SEQ ID NO: 3686114 - RNA, 21 nt, Human
uuuuauuucuacugucaaaug

SEQ ID NO: 3686115 - RNA, 18 nt, Human
uugguucuggacuaaaac

SEQ ID NO: 3686116 - RNA, 20 nt, Human
uugguucuggacuaaaacua

SEQ ID NO: 3686117 - RNA, 20 nt, Human
uugguugaaaauaaaaagau

SEQ ID NO: 3686118 - RNA, 16 nt, Human
uugguugaauaaacua

SEQ ID NO: 3686119 - RNA, 22 nt, Human
uugguugggaaugaggaaaauu

SEQ ID NO: 3686120 - RNA, 21 nt, Human
uugguugguaacucuguaauu

SEQ ID NO: 3686121 - RNA, 12 nt, Human
uugguugucaau

SEQ ID NO: 3686122 - RNA, 18 nt, Human
uugguugucaauauuaaa

SEQ ID NO: 3686123 - RNA, 22 nt, Human
uugguugucaauauuaaauaca

SEQ ID NO: 3686124 - RNA, 15 nt, Human
uugguugugucuuuu

SEQ ID NO: 3686125 - RNA, 17 nt, Human
uugguuuaaagaaagug

SEQ ID NO: 3686126 - RNA, 23 nt, Human
uugguuuaaagaaaguguauuug

SEQ ID NO: 3686127 - RNA, 13 nt, Human
uugguuuacauuu

SEQ ID NO: 3686128 - RNA, 20 nt, Human
uugguuuacauuuaaagcau

SEQ ID NO: 3686129 - RNA, 13 nt, Human
uugguuuacuuuc

SEQ ID NO: 3686130 - RNA, 15 nt, Human
uugguuuacuuucaa

SEQ ID NO: 3686131 - RNA, 18 nt, Human
uugguuugcagaugacaa

SEQ ID NO: 3686132 - RNA, 16 nt, Human
uugguuuuaaaauacu

SEQ ID NO: 3686133 - RNA, 12 nt, Human
uugguuuuauga

SEQ ID NO: 3686134 - RNA, 16 nt, Human
uugguuuuaugaugac

SEQ ID NO: 3686135 - RNA, 23 nt, Human
uugguuuuaugguuacuucuucu

SEQ ID NO: 3686136 - RNA, 13 nt, Human
uugguuuuccugu

SEQ ID NO: 3686137 - RNA, 15 nt, Human
uugguuuuccuguau

SEQ ID NO: 3686138 - RNA, 17 nt, Human
uugguuuuccuguggca

SEQ ID NO: 3686139 - RNA, 17 nt, Human
uugguuuugacuucaga

SEQ ID NO: 3686140 - RNA, 14 nt, Human
uugguuuugccauu

SEQ ID NO: 3686141 - RNA, 21 nt, Human
uugguuuugcuacauaauuau

SEQ ID NO: 3686142 - RNA, 14 nt, Human
uugguuuuguuccc

SEQ ID NO: 3686143 - RNA, 17 nt, Human
uugguuuuuaaagauuu

SEQ ID NO: 3686144 - RNA, 23 nt, Human
uugguuuuuacuuaacuguuuca

SEQ ID NO: 3686145 - RNA, 18 nt, Human
uuguaaaaaaaaaaaaca

SEQ ID NO: 3686146 - RNA, 20 nt, Human
uuguaaaaaaaaaugccuuu

SEQ ID NO: 3686147 - RNA, 23 nt, Human
uuguaaaaacagcauugcuuucu

SEQ ID NO: 3686148 - RNA, 12 nt, Human
uuguaaaaagaa

SEQ ID NO: 3686149 - RNA, 18 nt, Human
uuguaaaacaaaauuuga

SEQ ID NO: 3686150 - RNA, 20 nt, Human
uuguaaaaccugucaaugau

SEQ ID NO: 3686151 - RNA, 23 nt, Human
uuguaaaaccugucaaugauaca

SEQ ID NO: 3686152 - RNA, 15 nt, Human
uuguaaaagaaauca

SEQ ID NO: 3686153 - RNA, 18 nt, Human
uuguaaaagaaaucaugu

SEQ ID NO: 3686154 - RNA, 22 nt, Human
uuguaaaagaaaucauguccau

SEQ ID NO: 3686155 - RNA, 17 nt, Human
uuguaaaagcaacauca

SEQ ID NO: 3686156 - RNA, 20 nt, Human
uuguaaaagcaacaucagcu

SEQ ID NO: 3686157 - RNA, 18 nt, Human
uuguaaaauauagcugua

SEQ ID NO: 3686158 - RNA, 20 nt, Human
uuguaaaauauagcuguaca

SEQ ID NO: 3686159 - RNA, 19 nt, Human
uuguaaaaugacaaucaug

SEQ ID NO: 3686160 - RNA, 13 nt, Human
uuguaaaauggug

SEQ ID NO: 3686161 - RNA, 15 nt, Human
uuguaaaauguauua

SEQ ID NO: 3686162 - RNA, 18 nt, Human
uuguaaaauguauuaugu

SEQ ID NO: 3686163 - RNA, 17 nt, Human
uuguaaaauuauuucau

SEQ ID NO: 3686164 - RNA, 22 nt, Human
uuguaaacaaacuguguaacug

SEQ ID NO: 3686165 - RNA, 20 nt, Human
uuguaaacauuaguucuauu

SEQ ID NO: 3686166 - RNA, 22 nt, Human
uuguaaacauuaguucuauuuc

SEQ ID NO: 3686167 - RNA, 12 nt, Human
uuguaaacauuu

SEQ ID NO: 3686168 - RNA, 13 nt, Human
uuguaaacauuua

SEQ ID NO: 3686169 - RNA, 16 nt, Human
uuguaaacguuucagu

SEQ ID NO: 3686170 - RNA, 16 nt, Human
uuguaaacucaaaaua

SEQ ID NO: 3686171 - RNA, 23 nt, Human
uuguaaagaaaaauauuuaaugu

SEQ ID NO: 3686172 - RNA, 20 nt, Human
uuguaaagaaauuuacuaua

SEQ ID NO: 3686173 - RNA, 21 nt, Human
uuguaaagacugguuuucugc

SEQ ID NO: 3686174 - RNA, 16 nt, Human
uuguaaagauuucugu

SEQ ID NO: 3686175 - RNA, 16 nt, Human
uuguaaaguccccaga

SEQ ID NO: 3686176 - RNA, 22 nt, Human
uuguaaaguccccagagaaagc

SEQ ID NO: 3686177 - RNA, 18 nt, Human
uuguaaauaaaggaacca

SEQ ID NO: 3686178 - RNA, 21 nt, Human
uuguaaauaagagauuuggag

SEQ ID NO: 3686179 - RNA, 22 nt, Human
uuguaaauacaaguucuauuua

SEQ ID NO: 3686180 - RNA, 23 nt, Human
uuguaaauacaaguucuauuuaa

SEQ ID NO: 3686181 - RNA, 13 nt, Human
uuguaaauacacc

SEQ ID NO: 3686182 - RNA, 15 nt, Human
uuguaaauaccagga

SEQ ID NO: 3686183 - RNA, 18 nt, Human
uuguaaauaggauuuuua

SEQ ID NO: 3686184 - RNA, 17 nt, Human
uuguaaauaguauuuga

SEQ ID NO: 3686185 - RNA, 12 nt, Human
uuguaaauauaa

SEQ ID NO: 3686186 - RNA, 13 nt, Human
uuguaaauauaaa

SEQ ID NO: 3686187 - RNA, 17 nt, Human
uuguaaauauaaagacg

SEQ ID NO: 3686188 - RNA, 15 nt, Human
uuguaaauauauaaa

SEQ ID NO: 3686189 - RNA, 17 nt, Human
uuguaaauauauaaaua

SEQ ID NO: 3686190 - RNA, 14 nt, Human
uuguaaauauugug

SEQ ID NO: 3686191 - RNA, 21 nt, Human
uuguaaaugugguaaagaguu

SEQ ID NO: 3686192 - RNA, 22 nt, Human
uuguaaauguguuggacaaaug

SEQ ID NO: 3686193 - RNA, 19 nt, Human
uuguaaauguuauuucugc

SEQ ID NO: 3686194 - RNA, 22 nt, Human
uuguaaauuaaacauaaaacaa

SEQ ID NO: 3686195 - RNA, 16 nt, Human
uuguaaauuaaucuuu

SEQ ID NO: 3686196 - RNA, 14 nt, Human
uuguaaauuauauu

SEQ ID NO: 3686197 - RNA, 15 nt, Human
uuguaaauucugauu

SEQ ID NO: 3686198 - RNA, 15 nt, Human
uuguaaauuuagugu

SEQ ID NO: 3686199 - RNA, 16 nt, Human
uuguaaauuuaguguu

SEQ ID NO: 3686200 - RNA, 17 nt, Human
uuguaacagacauuguu

SEQ ID NO: 3686201 - RNA, 14 nt, Human
uuguaacccacuga

SEQ ID NO: 3686202 - RNA, 18 nt, Human
uuguaaccucagcucugg

SEQ ID NO: 3686203 - RNA, 19 nt, Human
uuguaaccucagcucuggg

SEQ ID NO: 3686204 - RNA, 20 nt, Human
uuguaaccucagcucuggga

SEQ ID NO: 3686205 - RNA, 16 nt, Human
uuguaacguugcugug

SEQ ID NO: 3686206 - RNA, 18 nt, Human
uuguaacuaaaauaauuu

SEQ ID NO: 3686207 - RNA, 23 nt, Human
uuguaacuaaaauaauuuuguaa

SEQ ID NO: 3686208 - RNA, 20 nt, Human
uuguaacuaggcucagagau

SEQ ID NO: 3686209 - RNA, 22 nt, Human
uuguaacuauguuuaaaguaau

SEQ ID NO: 3686210 - RNA, 14 nt, Human
uuguaacuccacca

SEQ ID NO: 3686211 - RNA, 13 nt, Human
uuguaacuuaugu

SEQ ID NO: 3686212 - RNA, 11 nt, Human
uuguaagaaau

SEQ ID NO: 3686213 - RNA, 13 nt, Human
uuguaagaaauac

SEQ ID NO: 3686214 - RNA, 13 nt, Human
uuguaagaaggca

SEQ ID NO: 3686215 - RNA, 24 nt, Human
uuguaagaaggcaauauuaaccua

SEQ ID NO: 3686216 - RNA, 20 nt, Human
uuguaagaguggaaccaaca

SEQ ID NO: 3686217 - RNA, 17 nt, Human
uuguaagaguguagaag

SEQ ID NO: 3686218 - RNA, 19 nt, Human
uuguaagaguguagaagca

SEQ ID NO: 3686219 - RNA, 22 nt, Human
uuguaagaguguagaagcauuc

SEQ ID NO: 3686220 - RNA, 15 nt, Human
uuguaagaugcuggg

SEQ ID NO: 3686221 - RNA, 17 nt, Human
uuguaagaugcuggguu

SEQ ID NO: 3686222 - RNA, 11 nt, Human
uuguaagauuu

SEQ ID NO: 3686223 - RNA, 14 nt, Human
uuguaagauuuuga

SEQ ID NO: 3686224 - RNA, 17 nt, Human
uuguaagcguauggcuu

SEQ ID NO: 3686225 - RNA, 22 nt, Human
uuguaagcguauggcuuuauuu

SEQ ID NO: 3686226 - RNA, 21 nt, Human
uuguaagugagagagacaaga

SEQ ID NO: 3686227 - RNA, 17 nt, Human
uuguaagugcuacauaa

SEQ ID NO: 3686228 - RNA, 14 nt, Human
uuguaaguuuaugu

SEQ ID NO: 3686229 - RNA, 23 nt, Human
uuguaauaaacccuuaacuggca

SEQ ID NO: 3686230 - RNA, 15 nt, Human
uuguaauaauaaaga

SEQ ID NO: 3686231 - RNA, 21 nt, Human
uuguaauauagaaaaaaacau

SEQ ID NO: 3686232 - RNA, 15 nt, Human
uuguaaucguuaugu

SEQ ID NO: 3686233 - RNA, 17 nt, Human
uuguaaucugaauaaag

SEQ ID NO: 3686234 - RNA, 14 nt, Human
uuguaauguaacug

SEQ ID NO: 3686235 - RNA, 14 nt, Human
uuguaaugucacca

SEQ ID NO: 3686236 - RNA, 15 nt, Human
uuguaauguuacuga

SEQ ID NO: 3686237 - RNA, 15 nt, Human
uuguaauuauggagu

SEQ ID NO: 3686238 - RNA, 17 nt, Human
uuguaauucuaaaugaa

SEQ ID NO: 3686239 - RNA, 12 nt, Human
uuguaauugcuu

SEQ ID NO: 3686240 - RNA, 19 nt, Human
uuguaauugcuuacauuuu

SEQ ID NO: 3686241 - RNA, 16 nt, Human
uuguaauuuaaaauaa

SEQ ID NO: 3686242 - RNA, 22 nt, Human
uuguaauuuaaacaggcccagc

SEQ ID NO: 3686243 - RNA, 12 nt, Human
uuguaauuuucu

SEQ ID NO: 3686244 - RNA, 19 nt, Human
uuguaauuuucuugaugac

SEQ ID NO: 3686245 - RNA, 16 nt, Human
uuguacaaaaaaaaag

SEQ ID NO: 3686246 - RNA, 15 nt, Human
uuguacaaaguauua

SEQ ID NO: 3686247 - RNA, 22 nt, Human
uuguacaaaguauuaagcauau

SEQ ID NO: 3686248 - RNA, 19 nt, Human
uuguacagaaucauugcuu

SEQ ID NO: 3686249 - RNA, 18 nt, Human
uuguacagacguaugcuu

SEQ ID NO: 3686250 - RNA, 11 nt, Human
uuguacaguuc

SEQ ID NO: 3686251 - RNA, 15 nt, Human
uuguacaguucaguu

SEQ ID NO: 3686252 - RNA, 11 nt, Human
uuguacaguuu

SEQ ID NO: 3686253 - RNA, 16 nt, Human
uuguacaguuuaaaau

SEQ ID NO: 3686254 - RNA, 15 nt, Human
uuguacaguuugcug

SEQ ID NO: 3686255 - RNA, 20 nt, Human
uuguacaguuugcuguacua

SEQ ID NO: 3686256 - RNA, 11 nt, Human
uuguacauaaa

SEQ ID NO: 3686257 - RNA, 18 nt, Human
uuguacauaaugcgugca

SEQ ID NO: 3686258 - RNA, 23 nt, Human
uuguacauacgauuuaagguauu

SEQ ID NO: 3686259 - RNA, 16 nt, Human
uuguacaucuggcuua

SEQ ID NO: 3686260 - RNA, 20 nt, Human
uuguacaucuggcuuauuuu

SEQ ID NO: 3686261 - RNA, 20 nt, Human
uuguacauguguagccugug

SEQ ID NO: 3686262 - RNA, 17 nt, Human
uuguacauuuaugauuu

SEQ ID NO: 3686263 - RNA, 15 nt, Human
uuguaccaacuuuua

SEQ ID NO: 3686264 - RNA, 15 nt, Human
uuguaccccccaacc

SEQ ID NO: 3686265 - RNA, 16 nt, Human
uuuuauuucuccuuuu

SEQ ID NO: 3686266 - RNA, 14 nt, Human
uuuuauuuuauguu

SEQ ID NO: 3686267 - RNA, 20 nt, Human
uuuuauuuucacccucugua

SEQ ID NO: 3686268 - RNA, 20 nt, Human
uuuuauuuugaaaagcuucu

SEQ ID NO: 3686269 - RNA, 16 nt, Human
uuuuauuuuguaauua

SEQ ID NO: 3686270 - RNA, 21 nt, Human
uuuuauuuuucucaugaugag

SEQ ID NO: 3686271 - RNA, 22 nt, Human
uuuucaaaaccagguccaauga

SEQ ID NO: 3686272 - RNA, 14 nt, Human
uuuucaaaagaaag

SEQ ID NO: 3686273 - RNA, 18 nt, Human
uuuucaaaagauaauauu

SEQ ID NO: 3686274 - RNA, 19 nt, Human
uuuucaaaauagaaaaguu

SEQ ID NO: 3686275 - RNA, 21 nt, Human
uuuucaaaccaguauacaaga

SEQ ID NO: 3686276 - RNA, 22 nt, Human
uuuucaaaccaguauacaagau

SEQ ID NO: 3686277 - RNA, 18 nt, Human
uuuucaaauggaguugga

SEQ ID NO: 3686278 - RNA, 19 nt, Human
uuuucaaauuguaucuagu

SEQ ID NO: 3686279 - RNA, 20 nt, Human
uuuucaacaaauaucuugug

SEQ ID NO: 3686280 - RNA, 18 nt, Human
uuuucaacagugaagaca

SEQ ID NO: 3686281 - RNA, 17 nt, Human
uuuucaaccucuagaau

SEQ ID NO: 3686282 - RNA, 19 nt, Human
uuuucaaccucuagaauuu

SEQ ID NO: 3686283 - RNA, 21 nt, Human
uuuucaacgcagcccugcuuu

SEQ ID NO: 3686284 - RNA, 15 nt, Human
uuuucaacuuugaau

SEQ ID NO: 3686285 - RNA, 18 nt, Human
uuuucaacuuugaauaaa

SEQ ID NO: 3686286 - RNA, 14 nt, Human
uuuucaagaaacug

SEQ ID NO: 3686287 - RNA, 18 nt, Human
uuuucaagcaucuccuga

SEQ ID NO: 3686288 - RNA, 21 nt, Human
uuuucaagcaucuccugagga

SEQ ID NO: 3686289 - RNA, 12 nt, Human
uuuucaaguauu

SEQ ID NO: 3686290 - RNA, 18 nt, Human
uuuucaauauauugaacu

SEQ ID NO: 3686291 - RNA, 16 nt, Human
uuuucaauauauuugu

SEQ ID NO: 3686292 - RNA, 11 nt, Human
uuuucaaugug

SEQ ID NO: 3686293 - RNA, 17 nt, Human
uuuucaauuaaacggau

SEQ ID NO: 3686294 - RNA, 21 nt, Human
uuuucaauuaaacggauuauu

SEQ ID NO: 3686295 - RNA, 22 nt, Human
uuuucaauuaaacggauuauuu

SEQ ID NO: 3686296 - RNA, 20 nt, Human
uuuucaauucaaaaauguac

SEQ ID NO: 3686297 - RNA, 23 nt, Human
uuuucacaggugugguguaauuu

SEQ ID NO: 3686298 - RNA, 16 nt, Human
uuuucacauaucuagu

SEQ ID NO: 3686299 - RNA, 15 nt, Human
uuuucacauccuuga

SEQ ID NO: 3686300 - RNA, 23 nt, Human
uuuucacaugaacauacuggcug

SEQ ID NO: 3686301 - RNA, 16 nt, Human
uuuucacauuggaaac

SEQ ID NO: 3686302 - RNA, 19 nt, Human
uuuucaccagauuugcuaa

SEQ ID NO: 3686303 - RNA, 17 nt, Human
uuuucacccuucuacuc

SEQ ID NO: 3686304 - RNA, 20 nt, Human
uuuucaccuuuucaggaaaa

SEQ ID NO: 3686305 - RNA, 15 nt, Human
uuuucacggaaguuu

SEQ ID NO: 3686306 - RNA, 19 nt, Human
uuuucacugcuggcugccu

SEQ ID NO: 3686307 - RNA, 14 nt, Human
uuuucacuuaugaa

SEQ ID NO: 3686308 - RNA, 17 nt, Human
uuuucagaaaaagaaau

SEQ ID NO: 3686309 - RNA, 15 nt, Human
uuuucagaaaauauu

SEQ ID NO: 3686310 - RNA, 22 nt, Human
uuuucagaaaauauuauguguu

SEQ ID NO: 3686311 - RNA, 18 nt, Human
uuuucagaaccucuuccc

SEQ ID NO: 3686312 - RNA, 13 nt, Human
uuuucagaaucug

SEQ ID NO: 3686313 - RNA, 17 nt, Human
uuuucagaaucugaaug

SEQ ID NO: 3686314 - RNA, 20 nt, Human
uuuucagaaucugaauguaa

SEQ ID NO: 3686315 - RNA, 11 nt, Human
uuuucagaccc

SEQ ID NO: 3686316 - RNA, 13 nt, Human
uuuucagaccgaa

SEQ ID NO: 3686317 - RNA, 14 nt, Human
uuuucagacucaga

SEQ ID NO: 3686318 - RNA, 21 nt, Human
uuuucagauauaaaagacuga

SEQ ID NO: 3686319 - RNA, 22 nt, Human
uuuucagauauaaaagacugac

SEQ ID NO: 3686320 - RNA, 11 nt, Human
uuuucagaugu

SEQ ID NO: 3686321 - RNA, 18 nt, Human
uuuucagaugugaaccau

SEQ ID NO: 3686322 - RNA, 18 nt, Human
uuuucagauuugcacaaa

SEQ ID NO: 3686323 - RNA, 18 nt, Human
uuuucagcgauguaugca

SEQ ID NO: 3686324 - RNA, 22 nt, Human
uuuucagcuaggaacaaaucuu

SEQ ID NO: 3686325 - RNA, 17 nt, Human
uuuucagcucucuguau

SEQ ID NO: 3686326 - RNA, 18 nt, Human
uuuucaggugcucaaaau

SEQ ID NO: 3686327 - RNA, 23 nt, Human
uuuucaguagggcuacaaaaccu

SEQ ID NO: 3686328 - RNA, 15 nt, Human
uuuucaguucaaagu

SEQ ID NO: 3686329 - RNA, 23 nt, Human
uuuucauaaauuauuugauuauu

SEQ ID NO: 3686330 - RNA, 17 nt, Human
uuuucauaagauauuuu

SEQ ID NO: 3686331 - RNA, 19 nt, Human
uuuucauaagauauuuuau

SEQ ID NO: 3686332 - RNA, 21 nt, Human
uuuucauacauuuucuaagaa

SEQ ID NO: 3686333 - RNA, 18 nt, Human
uuuucauacuuuuaccuu

SEQ ID NO: 3686334 - RNA, 19 nt, Human
uuuucauaguauccauauu

SEQ ID NO: 3686335 - RNA, 20 nt, Human
uuuucauaguauccauauuu

SEQ ID NO: 3686336 - RNA, 13 nt, Human
uuuucauauugug

SEQ ID NO: 3686337 - RNA, 19 nt, Human
uuuucauauugugccaaua

SEQ ID NO: 3686338 - RNA, 16 nt, Human
uuuucaucugggaaag

SEQ ID NO: 3686339 - RNA, 18 nt, Human
uuuucauggugaaaaugu

SEQ ID NO: 3686340 - RNA, 20 nt, Human
uuuucauuagcaaaaaaagu

SEQ ID NO: 3686341 - RNA, 17 nt, Human
uuuucauugauaugaaa

SEQ ID NO: 3686342 - RNA, 20 nt, Human
uuuucauuuaggugaggaag

SEQ ID NO: 3686343 - RNA, 13 nt, Human
uuuucauuuaucu

SEQ ID NO: 3686344 - RNA, 16 nt, Human
uuuucauuugccuauu

SEQ ID NO: 3686345 - RNA, 13 nt, Human
uuuucauuuucca

SEQ ID NO: 3686346 - RNA, 22 nt, Human
uuuucauuuucugcaagccugc

SEQ ID NO: 3686347 - RNA, 15 nt, Human
uuuuccaaaauaauu

SEQ ID NO: 3686348 - RNA, 21 nt, Human
uuuuccaacuuggcugcagga

SEQ ID NO: 3686349 - RNA, 18 nt, Human
uuuuccaagugugcauau

SEQ ID NO: 3686350 - RNA, 18 nt, Human
uuuuccaaucauuugacu

SEQ ID NO: 3686351 - RNA, 13 nt, Human
uuuuccagcuccu

SEQ ID NO: 3686352 - RNA, 21 nt, Human
uuuuccaggacuguuucaaac

SEQ ID NO: 3686353 - RNA, 20 nt, Human
uuuuccagggcaaucaaugu

SEQ ID NO: 3686354 - RNA, 16 nt, Human
uuuuccauauccuggu

SEQ ID NO: 3686355 - RNA, 14 nt, Human
uuuuccaucuaaaa

SEQ ID NO: 3686356 - RNA, 11 nt, Human
uuuuccaugaa

SEQ ID NO: 3686357 - RNA, 14 nt, Human
uuuuccaugaaaac

SEQ ID NO: 3686358 - RNA, 13 nt, Human
uuuucccaauaaa

SEQ ID NO: 3686359 - RNA, 20 nt, Human
uuuucccacugcacccccuc

SEQ ID NO: 3686360 - RNA, 20 nt, Human
uuuucccauuuaucuaaaua

SEQ ID NO: 3686361 - RNA, 19 nt, Human
uuuuccccccacucucccc

SEQ ID NO: 3686362 - RNA, 16 nt, Human
uuuucccccuuugugc

SEQ ID NO: 3686363 - RNA, 20 nt, Human
uuuuccccuaccaauauuag

SEQ ID NO: 3686364 - RNA, 16 nt, Human
uuuuccccuguccuga

SEQ ID NO: 3686365 - RNA, 15 nt, Human
uuuuccccuuuccug

SEQ ID NO: 3686366 - RNA, 16 nt, Human
uuuuccccuuuccugu

SEQ ID NO: 3686367 - RNA, 23 nt, Human
uuuucccgagcaaagucuaaagu

SEQ ID NO: 3686368 - RNA, 22 nt, Human
uuuucccuauuagagaagagau

SEQ ID NO: 3686369 - RNA, 20 nt, Human
uuuuccuaugcuauugacaa

SEQ ID NO: 3686370 - RNA, 16 nt, Human
uuuuccuccugagugc

SEQ ID NO: 3686371 - RNA, 18 nt, Human
uuuuccucgcuucuuuca

SEQ ID NO: 3686372 - RNA, 17 nt, Human
uuuuccucuuagaagaa

SEQ ID NO: 3686373 - RNA, 20 nt, Human
uuuuccugggacaucuucug

SEQ ID NO: 3686374 - RNA, 12 nt, Human
uuuuccuguccu

SEQ ID NO: 3686375 - RNA, 20 nt, Human
uuuuccuguccucuuucagc

SEQ ID NO: 3686376 - RNA, 21 nt, Human
uuuuccuguccucuuucagcu

SEQ ID NO: 3686377 - RNA, 13 nt, Human
uuuuccuguucua

SEQ ID NO: 3686378 - RNA, 19 nt, Human
uuuuccuuacauaaacauc

SEQ ID NO: 3686379 - RNA, 16 nt, Human
uuuuccuucaaaguuu

SEQ ID NO: 3686380 - RNA, 13 nt, Human
uuuuccuucaaga

SEQ ID NO: 3686381 - RNA, 14 nt, Human
uuuuccuucaagaa

SEQ ID NO: 3686382 - RNA, 19 nt, Human
uuuuccuucccuuuucugu

SEQ ID NO: 3686383 - RNA, 14 nt, Human
uuuuccuugaagcc

SEQ ID NO: 3686384 - RNA, 12 nt, Human
uuuuccuuuaaa

SEQ ID NO: 3686385 - RNA, 17 nt, Human
uuuuccuuugaauccuc

SEQ ID NO: 3686386 - RNA, 19 nt, Human
uuuuccuuuuuuauacaca

SEQ ID NO: 3686387 - RNA, 15 nt, Human
uuuucgaaaaucaaa

SEQ ID NO: 3686388 - RNA, 16 nt, Human
uuuucgaaaaucaaau

SEQ ID NO: 3686389 - RNA, 13 nt, Human
uuuucuaaaagcu

SEQ ID NO: 3686390 - RNA, 14 nt, Human
uuuucuaaagacuu

SEQ ID NO: 3686391 - RNA, 18 nt, Human
uuuucuaaaguaaaaaca

SEQ ID NO: 3686392 - RNA, 16 nt, Human
uuuucuaagaaacauu

SEQ ID NO: 3686393 - RNA, 18 nt, Human
uuuucuaagaaacauuua

SEQ ID NO: 3686394 - RNA, 15 nt, Human
uuuucuaagagaagu

SEQ ID NO: 3686395 - RNA, 19 nt, Human
uuuucuaagcaauuucuug

SEQ ID NO: 3686396 - RNA, 21 nt, Human
uuuucuaaugaggagagaaaa

SEQ ID NO: 3686397 - RNA, 15 nt, Human
uuuucuaaugugguu

SEQ ID NO: 3686398 - RNA, 21 nt, Human
uuuucuaaugugguuauuucu

SEQ ID NO: 3686399 - RNA, 16 nt, Human
uuuucuacaaguauuc

SEQ ID NO: 3686400 - RNA, 13 nt, Human
uuuucuacagugg

SEQ ID NO: 3686401 - RNA, 14 nt, Human
uuuucuacaguggu

SEQ ID NO: 3686402 - RNA, 16 nt, Human
uuuucuacccuagcca

SEQ ID NO: 3686403 - RNA, 20 nt, Human
uuuucuacucgaguuacaga

SEQ ID NO: 3686404 - RNA, 22 nt, Human
uuuucuacucgaguuacagaca

SEQ ID NO: 3686405 - RNA, 17 nt, Human
uuuucuacuuuuuuuaa

SEQ ID NO: 3686406 - RNA, 14 nt, Human
uuuucuagaauuau

SEQ ID NO: 3686407 - RNA, 15 nt, Human
uuuucuagaauuauu

SEQ ID NO: 3686408 - RNA, 22 nt, Human
uuuucuaguguaucaaaaugcu

SEQ ID NO: 3686409 - RNA, 23 nt, Human
uuuucuaguuugcucauacuaca

SEQ ID NO: 3686410 - RNA, 21 nt, Human
uuuucuauguacuaguacugu

SEQ ID NO: 3686411 - RNA, 14 nt, Human
uuuucuauuaaaag

SEQ ID NO: 3686412 - RNA, 21 nt, Human
uuuucuauuaaaagacucauc

SEQ ID NO: 3686413 - RNA, 19 nt, Human
uuuucuauuccuucuggcc

SEQ ID NO: 3686414 - RNA, 17 nt, Human
ucaaauuaauaaucuua

SEQ ID NO: 3686415 - RNA, 23 nt, Human
ucaaauuaaucuuucuuuaccug

SEQ ID NO: 3686416 - RNA, 15 nt, Human
ucaaauuaauugugu

SEQ ID NO: 3686417 - RNA, 16 nt, Human
ucaaauuaauugugug

SEQ ID NO: 3686418 - RNA, 15 nt, Human
ucaaauuagaagaca

SEQ ID NO: 3686419 - RNA, 17 nt, Human
ucaaauuagaagacauu

SEQ ID NO: 3686420 - RNA, 22 nt, Human
ucaaauuagaagacauuuauac

SEQ ID NO: 3686421 - RNA, 20 nt, Human
ucaaauucauuuuuuucacu

SEQ ID NO: 3686422 - RNA, 16 nt, Human
ucaaauucuucugaac

SEQ ID NO: 3686423 - RNA, 21 nt, Human
ucaaauucuucugaacucaaa

SEQ ID NO: 3686424 - RNA, 17 nt, Human
ucaaauuguaagcaugc

SEQ ID NO: 3686425 - RNA, 16 nt, Human
ucaaauuguaauuaau

SEQ ID NO: 3686426 - RNA, 14 nt, Human
ucaaauugugugaa

SEQ ID NO: 3686427 - RNA, 13 nt, Human
ucaaauuucuaaa

SEQ ID NO: 3686428 - RNA, 20 nt, Human
ucaaauuuguaggguuucua

SEQ ID NO: 3686429 - RNA, 23 nt, Human
ucaaauuuguaggguuucuaggu

SEQ ID NO: 3686430 - RNA, 22 nt, Human
ucaaauuugucugguuaaaaaa

SEQ ID NO: 3686431 - RNA, 14 nt, Human
ucaaauuuuuugac

SEQ ID NO: 3686432 - RNA, 12 nt, Human
ucaacaaacauu

SEQ ID NO: 3686433 - RNA, 18 nt, Human
ucaacaaagcacaguguu

SEQ ID NO: 3686434 - RNA, 21 nt, Human
ucaacaacauuccucaaaaug

SEQ ID NO: 3686435 - RNA, 15 nt, Human
ucaacaagaaauaau

SEQ ID NO: 3686436 - RNA, 17 nt, Human
ucaacaagaagaauuug

SEQ ID NO: 3686437 - RNA, 22 nt, Human
ucaacaagauuuccuugugcaa

SEQ ID NO: 3686438 - RNA, 16 nt, Human
ucaacaaggcuugcug

SEQ ID NO: 3686439 - RNA, 17 nt, Human
ucaacaagggagagacc

SEQ ID NO: 3686440 - RNA, 14 nt, Human
ucaacaauaaaaca

SEQ ID NO: 3686441 - RNA, 18 nt, Human
ucaacaauaaaauuuuuu

SEQ ID NO: 3686442 - RNA, 14 nt, Human
ucaacaauucuaaa

SEQ ID NO: 3686443 - RNA, 15 nt, Human
ucaacaauucuaaaa

SEQ ID NO: 3686444 - RNA, 14 nt, Human
ucaacaauuugggc

SEQ ID NO: 3686445 - RNA, 22 nt, Human
ucaacaccaugauuccuuuaac

SEQ ID NO: 3686446 - RNA, 23 nt, Human
ucaacacuuaaggguuuuagaaa

SEQ ID NO: 3686447 - RNA, 18 nt, Human
ucaacagaagcauuugua

SEQ ID NO: 3686448 - RNA, 21 nt, Human
ucaacagaagcauuuguauuu

SEQ ID NO: 3686449 - RNA, 22 nt, Human
ucaacagaaugaaaaaugaaag

SEQ ID NO: 3686450 - RNA, 16 nt, Human
ucaacagcuaugcugg

SEQ ID NO: 3686451 - RNA, 21 nt, Human
ucaacaggccucagggcuccu

SEQ ID NO: 3686452 - RNA, 13 nt, Human
ucaacaguaaacc

SEQ ID NO: 3686453 - RNA, 14 nt, Human
ucaacaguaaacca

SEQ ID NO: 3686454 - RNA, 14 nt, Human
ucaacaguguuuuc

SEQ ID NO: 3686455 - RNA, 22 nt, Human
ucaacaguuuuccuaugcuuug

SEQ ID NO: 3686456 - RNA, 23 nt, Human
ucaacauaacccacuugucacug

SEQ ID NO: 3686457 - RNA, 17 nt, Human
ucaacaucaauguucau

SEQ ID NO: 3686458 - RNA, 18 nt, Human
ucaacaucaauguucauu

SEQ ID NO: 3686459 - RNA, 19 nt, Human
ucaacaucaauguucauug

SEQ ID NO: 3686460 - RNA, 16 nt, Human
ucaacauccugccagc

SEQ ID NO: 3686461 - RNA, 17 nt, Human
ucaacauccugccagcc

SEQ ID NO: 3686462 - RNA, 18 nt, Human
ucaacauccugccagccc

SEQ ID NO: 3686463 - RNA, 12 nt, Human
ucaacaucuuuu

SEQ ID NO: 3686464 - RNA, 15 nt, Human
ucaacaucuuuuaca

SEQ ID NO: 3686465 - RNA, 22 nt, Human
ucaacauggcuacuugcuuuga

SEQ ID NO: 3686466 - RNA, 15 nt, Human
ucaacauguuacuga

SEQ ID NO: 3686467 - RNA, 21 nt, Human
ucaacauguuacugaccagca

SEQ ID NO: 3686468 - RNA, 14 nt, Human
ucaaccaaauggua

SEQ ID NO: 3686469 - RNA, 14 nt, Human
ucaaccagacagag

SEQ ID NO: 3686470 - RNA, 17 nt, Human
ucaaccagggauuguuu

SEQ ID NO: 3686471 - RNA, 22 nt, Human
ucaaccagguccagaugugcua

SEQ ID NO: 3686472 - RNA, 13 nt, Human
ucaaccauccugg

SEQ ID NO: 3686473 - RNA, 18 nt, Human
ucaaccauuccccauggg

SEQ ID NO: 3686474 - RNA, 15 nt, Human
ucaacccaggagcau

SEQ ID NO: 3686475 - RNA, 22 nt, Human
ucaaccccaccauaugaauugu

SEQ ID NO: 3686476 - RNA, 15 nt, Human
ucaaccccuccccuc

SEQ ID NO: 3686477 - RNA, 19 nt, Human
ucaaccccuccccuccauc

SEQ ID NO: 3686478 - RNA, 23 nt, Human
ucaaccccuccccuccaucccug

SEQ ID NO: 3686479 - RNA, 22 nt, Human
ucaacccuaaaaagcagagcuu

SEQ ID NO: 3686480 - RNA, 23 nt, Human
ucaacccuaaaaagcagagcuuu

SEQ ID NO: 3686481 - RNA, 19 nt, Human
ucaacccucaggggaaaac

SEQ ID NO: 3686482 - RNA, 18 nt, Human
ucaacccuuuugucugcc

SEQ ID NO: 3686483 - RNA, 13 nt, Human
ucaaccuaaccac

SEQ ID NO: 3686484 - RNA, 18 nt, Human
ucaaccuaccaccccuuc

SEQ ID NO: 3686485 - RNA, 22 nt, Human
ucaaccuaccaccccuuccugu

SEQ ID NO: 3686486 - RNA, 23 nt, Human
ucaaccuaccaccccuuccuguc

SEQ ID NO: 3686487 - RNA, 13 nt, Human
ucaaccuccugga

SEQ ID NO: 3686488 - RNA, 16 nt, Human
ucaaccuccugggcua

SEQ ID NO: 3686489 - RNA, 15 nt, Human
ucaaccuccugugga

SEQ ID NO: 3686490 - RNA, 19 nt, Human
ucaaccucuucuggcucaa

SEQ ID NO: 3686491 - RNA, 19 nt, Human
ucaaccuguaaauuauuuu

SEQ ID NO: 3686492 - RNA, 19 nt, Human
ucaaccuguucaucuugaa

SEQ ID NO: 3686493 - RNA, 19 nt, Human
ucaacgcuuaaaggugucu

SEQ ID NO: 3686494 - RNA, 20 nt, Human
ucaacgcuuaaaggugucuu

SEQ ID NO: 3686495 - RNA, 23 nt, Human
ucaacgcuuaaaggugucuuccu

SEQ ID NO: 3686496 - RNA, 15 nt, Human
ucaacguuaauaauu

SEQ ID NO: 3686497 - RNA, 20 nt, Human
ucaacguuguacuguaugug

SEQ ID NO: 3686498 - RNA, 17 nt, Human
ucaacguuucuucacuu

SEQ ID NO: 3686499 - RNA, 23 nt, Human
ucaacuaccucgcaucauugcag

SEQ ID NO: 3686500 - RNA, 17 nt, Human
ucaacuacuauucaaaa

SEQ ID NO: 3686501 - RNA, 16 nt, Human
ucaacucagacuaguu

SEQ ID NO: 3686502 - RNA, 20 nt, Human
ucaacucagacuaguuuagu

SEQ ID NO: 3686503 - RNA, 22 nt, Human
ucaacuccaaacugacucuuaa

SEQ ID NO: 3686504 - RNA, 21 nt, Human
ucaacucccugccccccagcc

SEQ ID NO: 3686505 - RNA, 20 nt, Human
ucaacucucuuauugccuca

SEQ ID NO: 3686506 - RNA, 23 nt, Human
ucaacucucuuauugccucacuu

SEQ ID NO: 3686507 - RNA, 14 nt, Human
ucaacucuuuguua

SEQ ID NO: 3686508 - RNA, 22 nt, Human
ucaacugaaaguguuuccuuca

SEQ ID NO: 3686509 - RNA, 19 nt, Human
ucaacugccaaaaugcucu

SEQ ID NO: 3686510 - RNA, 14 nt, Human
ucaacugccuacuc

SEQ ID NO: 3686511 - RNA, 16 nt, Human
ucaacugucuuccuca

SEQ ID NO: 3686512 - RNA, 12 nt, Human
ucaacuuaacau

SEQ ID NO: 3686513 - RNA, 20 nt, Human
ucaacuugcaaaaucaguuu

SEQ ID NO: 3686514 - RNA, 16 nt, Human
ucaacuuuuuauugcc

SEQ ID NO: 3686515 - RNA, 18 nt, Human
ucaacuuuuuauugccuu

SEQ ID NO: 3686516 - RNA, 20 nt, Human
ucaacuuuuuauugccuucu

SEQ ID NO: 3686517 - RNA, 23 nt, Human
ucaacuuuuuauugccuucucac

SEQ ID NO: 3686518 - RNA, 23 nt, Human
ucaagaaaaaauaaauggaaauc

SEQ ID NO: 3686519 - RNA, 18 nt, Human
ucaagaaacagccagcaa

SEQ ID NO: 3686520 - RNA, 20 nt, Human
ucaagaaacugaggaauuuu

SEQ ID NO: 3686521 - RNA, 22 nt, Human
ucaagaaacugaggaauuuucu

SEQ ID NO: 3686522 - RNA, 23 nt, Human
ucaagaaacugaggaauuuucuu

SEQ ID NO: 3686523 - RNA, 18 nt, Human
ucaagaaagccagucuua

SEQ ID NO: 3686524 - RNA, 21 nt, Human
ucaagaaauaaaaggaagcca

SEQ ID NO: 3686525 - RNA, 14 nt, Human
ucaagaaaugaaga

SEQ ID NO: 3686526 - RNA, 16 nt, Human
ucaagaaaugaagagc

SEQ ID NO: 3686527 - RNA, 21 nt, Human
ucaagaaaugaagagcuguug

SEQ ID NO: 3686528 - RNA, 22 nt, Human
ucaagaacacagcccugcuucu

SEQ ID NO: 3686529 - RNA, 15 nt, Human
ucaagaacuuguuua

SEQ ID NO: 3686530 - RNA, 16 nt, Human
ucaagaacuuguuuaa

SEQ ID NO: 3686531 - RNA, 23 nt, Human
ucaagaagcaggcuacacugaca

SEQ ID NO: 3686532 - RNA, 15 nt, Human
ucaagaagggcugca

SEQ ID NO: 3686533 - RNA, 18 nt, Human
ucaagaagggcugcauga

SEQ ID NO: 3686534 - RNA, 21 nt, Human
ucaagaauaaucacgcuuucc

SEQ ID NO: 3686535 - RNA, 14 nt, Human
ucaagacauagcau

SEQ ID NO: 3686536 - RNA, 20 nt, Human
ucaagacauagcauccaagu

SEQ ID NO: 3686537 - RNA, 20 nt, Human
ucaagacauuaaaucuauga

SEQ ID NO: 3686538 - RNA, 21 nt, Human
ucaagaccaaauggaaacaga

SEQ ID NO: 3686539 - RNA, 15 nt, Human
ucaagacuuccagag

SEQ ID NO: 3686540 - RNA, 19 nt, Human
ucaagagaguaauggguuu

SEQ ID NO: 3686541 - RNA, 19 nt, Human
ucaagagccuuaaaacauc

SEQ ID NO: 3686542 - RNA, 13 nt, Human
ucaagagcugccc

SEQ ID NO: 3686543 - RNA, 18 nt, Human
ucaagaggaaugaaaaaa

SEQ ID NO: 3686544 - RNA, 21 nt, Human
ucaagagggcacugguggccc

SEQ ID NO: 3686545 - RNA, 19 nt, Human
ucaagagugaauucccuca

SEQ ID NO: 3686546 - RNA, 19 nt, Human
ucaagauacugcuacugua

SEQ ID NO: 3686547 - RNA, 17 nt, Human
ucaagaucaaaaaggcu

SEQ ID NO: 3686548 - RNA, 23 nt, Human
ucaagaucaaaaaggcuuauaaa

SEQ ID NO: 3686549 - RNA, 24 nt, Human
ucaagaucaaaaaggcuuauaaaa

SEQ ID NO: 3686550 - RNA, 20 nt, Human
ucaagauguccuccuuguuc

SEQ ID NO: 3686551 - RNA, 13 nt, Human
ucaagauucagcu

SEQ ID NO: 3686552 - RNA, 15 nt, Human
ucaagauucagcuag

SEQ ID NO: 3686553 - RNA, 19 nt, Human
ucaagauuguuccugcuuu

SEQ ID NO: 3686554 - RNA, 19 nt, Human
ucaagauuuugaaugcuuc

SEQ ID NO: 3686555 - RNA, 16 nt, Human
ucaagcaauccuccug

SEQ ID NO: 3686556 - RNA, 14 nt, Human
ucaagcaccaggga

SEQ ID NO: 3686557 - RNA, 12 nt, Human
ucaagcacugau

SEQ ID NO: 3686558 - RNA, 13 nt, Human
ucaagcacugaua

SEQ ID NO: 3686559 - RNA, 17 nt, Human
ucaagcagauuggagaa

SEQ ID NO: 3686560 - RNA, 22 nt, Human
ucaagcagcgaccgcccccucc

SEQ ID NO: 3686561 - RNA, 16 nt, Human
ucaagcagguuagaga

SEQ ID NO: 3686562 - RNA, 21 nt, Human
uuguaccuguaggacucucau

SEQ ID NO: 3686563 - RNA, 23 nt, Human
uuguaccuuuuuuguuuuuucaa

SEQ ID NO: 3686564 - RNA, 16 nt, Human
uuguacgaagaguauu

SEQ ID NO: 3686565 - RNA, 23 nt, Human
uuguacgaagaguauuuuugaca

SEQ ID NO: 3686566 - RNA, 17 nt, Human
uuguacguuuaaagugu

SEQ ID NO: 3686567 - RNA, 13 nt, Human
uuguacuauuuaa

SEQ ID NO: 3686568 - RNA, 16 nt, Human
uuguacuauuuaacug

SEQ ID NO: 3686569 - RNA, 14 nt, Human
uuguacucaauuuu

SEQ ID NO: 3686570 - RNA, 17 nt, Human
uuguacuguuuaauguu

SEQ ID NO: 3686571 - RNA, 17 nt, Human
uuguacuuucuguuaaa

SEQ ID NO: 3686572 - RNA, 20 nt, Human
uuguagaacucacucugggc

SEQ ID NO: 3686573 - RNA, 17 nt, Human
uuguagaauguauugua

SEQ ID NO: 3686574 - RNA, 20 nt, Human
uuguagaauguauuguaccu

SEQ ID NO: 3686575 - RNA, 13 nt, Human
uuguagaauuguu

SEQ ID NO: 3686576 - RNA, 18 nt, Human
uuguagauacaaucagcu

SEQ ID NO: 3686577 - RNA, 18 nt, Human
uuguagcacugacagauu

SEQ ID NO: 3686578 - RNA, 22 nt, Human
uuguagcacugacagauuucca

SEQ ID NO: 3686579 - RNA, 15 nt, Human
uuguagcauccugga

SEQ ID NO: 3686580 - RNA, 12 nt, Human
uuguagccagcc

SEQ ID NO: 3686581 - RNA, 19 nt, Human
uuguagccuuuugacuuuc

SEQ ID NO: 3686582 - RNA, 18 nt, Human
uuguagcuggggcuuuga

SEQ ID NO: 3686583 - RNA, 17 nt, Human
uuguagcuuuaucaaag

SEQ ID NO: 3686584 - RNA, 21 nt, Human
uuguaggaaggucucauucuu

SEQ ID NO: 3686585 - RNA, 21 nt, Human
uuguaggggaggggcuccuuu

SEQ ID NO: 3686586 - RNA, 13 nt, Human
uuguaggguuucu

SEQ ID NO: 3686587 - RNA, 16 nt, Human
uuguagguacuuuugg

SEQ ID NO: 3686588 - RNA, 22 nt, Human
uuguagguacuuuuggaaucua

SEQ ID NO: 3686589 - RNA, 21 nt, Human
uuguaguagcguuuuuuaaau

SEQ ID NO: 3686590 - RNA, 20 nt, Human
uuguaguagucucauuacuu

SEQ ID NO: 3686591 - RNA, 19 nt, Human
uuguagugccacuguuguu

SEQ ID NO: 3686592 - RNA, 15 nt, Human
uuguaguucuuuaaa

SEQ ID NO: 3686593 - RNA, 17 nt, Human
uuguaguucuuuaaacu

SEQ ID NO: 3686594 - RNA, 16 nt, Human
uuguaguugaauauug

SEQ ID NO: 3686595 - RNA, 17 nt, Human
uuguaguuuaccucuuu

SEQ ID NO: 3686596 - RNA, 16 nt, Human
uuguauaaaaaaaaua

SEQ ID NO: 3686597 - RNA, 13 nt, Human
uuguauaaaauaa

SEQ ID NO: 3686598 - RNA, 19 nt, Human
uuguauaaauguauauaca

SEQ ID NO: 3686599 - RNA, 17 nt, Human
uuguauaacagguuauu

SEQ ID NO: 3686600 - RNA, 15 nt, Human
uuguauaauuguauc

SEQ ID NO: 3686601 - RNA, 17 nt, Human
uuguauaauuguaucgu

SEQ ID NO: 3686602 - RNA, 13 nt, Human
uuguauacaaaua

SEQ ID NO: 3686603 - RNA, 13 nt, Human
uuguauacaagua

SEQ ID NO: 3686604 - RNA, 16 nt, Human
uuguauacaaguacug

SEQ ID NO: 3686605 - RNA, 17 nt, Human
uuguauacaaguacugg

SEQ ID NO: 3686606 - RNA, 20 nt, Human
uuguauaccuuguaauuuga

SEQ ID NO: 3686607 - RNA, 20 nt, Human
uuguauacuuuaaauaauuu

SEQ ID NO: 3686608 - RNA, 20 nt, Human
uuguauagcaugaaauaaaa

SEQ ID NO: 3686609 - RNA, 14 nt, Human
uuguauaguaaagu

SEQ ID NO: 3686610 - RNA, 14 nt, Human
uuguauaguguaaa

SEQ ID NO: 3686611 - RNA, 15 nt, Human
uuguauaguguaaaa

SEQ ID NO: 3686612 - RNA, 13 nt, Human
uuguauaguuaac

SEQ ID NO: 3686613 - RNA, 18 nt, Human
uuguauaguuaacacacu

SEQ ID NO: 3686614 - RNA, 19 nt, Human
uuguauaguuauguaaaua

SEQ ID NO: 3686615 - RNA, 20 nt, Human
uuguauaguuauguaaauaa

SEQ ID NO: 3686616 - RNA, 11 nt, Human
uuguauauauc

SEQ ID NO: 3686617 - RNA, 19 nt, Human
uuguauauauuauuauaau

SEQ ID NO: 3686618 - RNA, 21 nt, Human
uuguauauuauggaagauuuu

SEQ ID NO: 3686619 - RNA, 16 nt, Human
uuguauauugguuuua

SEQ ID NO: 3686620 - RNA, 14 nt, Human
uuguauauuguaau

SEQ ID NO: 3686621 - RNA, 19 nt, Human
uuguauauugucagauauu

SEQ ID NO: 3686622 - RNA, 13 nt, Human
uuguauauugugu

SEQ ID NO: 3686623 - RNA, 18 nt, Human
uuguauauuuguacaaaa

SEQ ID NO: 3686624 - RNA, 16 nt, Human
uuguaucacaaaucuu

SEQ ID NO: 3686625 - RNA, 19 nt, Human
uuguaucacaaaucuuaac

SEQ ID NO: 3686626 - RNA, 22 nt, Human
uuguaucagaggccuauaauga

SEQ ID NO: 3686627 - RNA, 15 nt, Human
uuguaucguauagcu

SEQ ID NO: 3686628 - RNA, 17 nt, Human
uuguaucuagugcagcu

SEQ ID NO: 3686629 - RNA, 21 nt, Human
uuguaucuagugcagcugauu

SEQ ID NO: 3686630 - RNA, 21 nt, Human
uuguaucucugaagcauguuu

SEQ ID NO: 3686631 - RNA, 14 nt, Human
uuguaucucuuuug

SEQ ID NO: 3686632 - RNA, 21 nt, Human
uuguaucugcaggcagacacg

SEQ ID NO: 3686633 - RNA, 15 nt, Human
uuguaucuggaaaga

SEQ ID NO: 3686634 - RNA, 15 nt, Human
uuguaucugucuuuc

SEQ ID NO: 3686635 - RNA, 12 nt, Human
uuguaugaaaac

SEQ ID NO: 3686636 - RNA, 13 nt, Human
uuguaugaucugu

SEQ ID NO: 3686637 - RNA, 19 nt, Human
uuguaugaucugugccuuu

SEQ ID NO: 3686638 - RNA, 16 nt, Human
uuguaugauguguugu

SEQ ID NO: 3686639 - RNA, 18 nt, Human
uuguaugauguguuguga

SEQ ID NO: 3686640 - RNA, 21 nt, Human
uuguaugauguguugugauag

SEQ ID NO: 3686641 - RNA, 22 nt, Human
uuguaugcaagcaguuucaaua

SEQ ID NO: 3686642 - RNA, 20 nt, Human
uuguaugccuuuaaaucugu

SEQ ID NO: 3686643 - RNA, 16 nt, Human
uuguauguaaaugugc

SEQ ID NO: 3686644 - RNA, 16 nt, Human
uuguauuaaacucuuc

SEQ ID NO: 3686645 - RNA, 14 nt, Human
uuguauuaaagaca

SEQ ID NO: 3686646 - RNA, 16 nt, Human
uuguauuaaagacaga

SEQ ID NO: 3686647 - RNA, 14 nt, Human
uuguauuaacaaaa

SEQ ID NO: 3686648 - RNA, 14 nt, Human
uuguauuacaaauc

SEQ ID NO: 3686649 - RNA, 13 nt, Human
uuguauuacagau

SEQ ID NO: 3686650 - RNA, 16 nt, Human
uuguauuagauguucu

SEQ ID NO: 3686651 - RNA, 21 nt, Human
uuguauucaauuaaagaaaua

SEQ ID NO: 3686652 - RNA, 14 nt, Human
uuguauucagaguu

SEQ ID NO: 3686653 - RNA, 19 nt, Human
uuguauucucuccuguacc

SEQ ID NO: 3686654 - RNA, 16 nt, Human
uuguauucucugagcu

SEQ ID NO: 3686655 - RNA, 14 nt, Human
uuguauucugucuu

SEQ ID NO: 3686656 - RNA, 19 nt, Human
uuguauucuuugauguuaa

SEQ ID NO: 3686657 - RNA, 15 nt, Human
uuguauugcuguccu

SEQ ID NO: 3686658 - RNA, 20 nt, Human
uuguauuguuagauguuugu

SEQ ID NO: 3686659 - RNA, 13 nt, Human
uuguauuguugaa

SEQ ID NO: 3686660 - RNA, 18 nt, Human
uuguauuguugaaaaagu

SEQ ID NO: 3686661 - RNA, 13 nt, Human
uuguauuguuuuc

SEQ ID NO: 3686662 - RNA, 14 nt, Human
uuguauuguuuucu

SEQ ID NO: 3686663 - RNA, 18 nt, Human
uuguauuuaacagaaauu

SEQ ID NO: 3686664 - RNA, 22 nt, Human
uuguauuuaacagaaauuguau

SEQ ID NO: 3686665 - RNA, 15 nt, Human
uuguauuuauucaau

SEQ ID NO: 3686666 - RNA, 16 nt, Human
uuguauuuauucaaua

SEQ ID NO: 3686667 - RNA, 18 nt, Human
uuguauuuauuccauauu

SEQ ID NO: 3686668 - RNA, 14 nt, Human
uuguauuuauucuu

SEQ ID NO: 3686669 - RNA, 15 nt, Human
uuguauuuauuuagu

SEQ ID NO: 3686670 - RNA, 9 nt, Human
uuguauuuu

SEQ ID NO: 3686671 - RNA, 17 nt, Human
uuguauuuucaugaaaa

SEQ ID NO: 3686672 - RNA, 12 nt, Human
uuguauuuucca

SEQ ID NO: 3686673 - RNA, 16 nt, Human
uuguauuuuuguuguu

SEQ ID NO: 3686674 - RNA, 14 nt, Human
uugucaacauugug

SEQ ID NO: 3686675 - RNA, 15 nt, Human
uugucaacauuguga

SEQ ID NO: 3686676 - RNA, 22 nt, Human
uugucaagaauagcauuguaaa

SEQ ID NO: 3686677 - RNA, 20 nt, Human
uugucaauaaaauccauaca

SEQ ID NO: 3686678 - RNA, 20 nt, Human
uugucaaugcuggagaaaaa

SEQ ID NO: 3686679 - RNA, 16 nt, Human
uugucacaucagauaa

SEQ ID NO: 3686680 - RNA, 17 nt, Human
uugucaccagaucugau

SEQ ID NO: 3686681 - RNA, 13 nt, Human
uugucacgccaga

SEQ ID NO: 3686682 - RNA, 17 nt, Human
uugucacugagaagaug

SEQ ID NO: 3686683 - RNA, 14 nt, Human
uugucacugcuuca

SEQ ID NO: 3686684 - RNA, 14 nt, Human
uugucacuugcaug

SEQ ID NO: 3686685 - RNA, 21 nt, Human
uugucacuuuuuaugcuauuu

SEQ ID NO: 3686686 - RNA, 16 nt, Human
uugucacuuuuucuga

SEQ ID NO: 3686687 - RNA, 18 nt, Human
uugucagacauaaagcca

SEQ ID NO: 3686688 - RNA, 19 nt, Human
uugucagacauaaagccau

SEQ ID NO: 3686689 - RNA, 13 nt, Human
uugucauauguag

SEQ ID NO: 3686690 - RNA, 23 nt, Human
uugucauauguagccuucacaca

SEQ ID NO: 3686691 - RNA, 19 nt, Human
uugucaucuuucuucuauu

SEQ ID NO: 3686692 - RNA, 21 nt, Human
uugucaucuuucuucuauuuu

SEQ ID NO: 3686693 - RNA, 13 nt, Human
uugucauguggcu

SEQ ID NO: 3686694 - RNA, 13 nt, Human
uugucauguguau

SEQ ID NO: 3686695 - RNA, 15 nt, Human
uugucauuagccuga

SEQ ID NO: 3686696 - RNA, 18 nt, Human
uugucauuagccugagua

SEQ ID NO: 3686697 - RNA, 13 nt, Human
uugucauugcuuu

SEQ ID NO: 3686698 - RNA, 15 nt, Human
uugucauugcuuuac

SEQ ID NO: 3686699 - RNA, 18 nt, Human
uugucauugcuuuacugg

SEQ ID NO: 3686700 - RNA, 13 nt, Human
uugucauuuucau

SEQ ID NO: 3686701 - RNA, 14 nt, Human
uugucauuuucauu

SEQ ID NO: 3686702 - RNA, 21 nt, Human
uugucauuuugaagcuaauua

SEQ ID NO: 3686703 - RNA, 19 nt, Human
uugucauuuuuuuucuuug

SEQ ID NO: 3686704 - RNA, 13 nt, Human
uugucccacagcu

SEQ ID NO: 3686705 - RNA, 14 nt, Human
uugucccacagcuu

SEQ ID NO: 3686706 - RNA, 15 nt, Human
uuguccccacacucc

SEQ ID NO: 3686707 - RNA, 21 nt, Human
uuguccccuaagaguguuuaa

SEQ ID NO: 3686708 - RNA, 19 nt, Human
uugucccggauuuuuguua

SEQ ID NO: 3686709 - RNA, 16 nt, Human
uugucccucugcccca

SEQ ID NO: 3686710 - RNA, 17 nt, Human
uugucccucugccccau

SEQ ID NO: 3686711 - RNA, 20 nt, Human
uuguccuauuaguguuauau

SEQ ID NO: 3686712 - RNA, 15 nt, Human
uuguccuccccuugg

SEQ ID NO: 3686713 - RNA, 20 nt, Human
uuuucuauuccuucuggccu

SEQ ID NO: 3686714 - RNA, 18 nt, Human
uuuucuauuucacuggag

SEQ ID NO: 3686715 - RNA, 23 nt, Human
uuuucuauuucacuggagcacaa

SEQ ID NO: 3686716 - RNA, 16 nt, Human
uuuucuauuuuaauaa

SEQ ID NO: 3686717 - RNA, 15 nt, Human
uuuucucaaaagcau

SEQ ID NO: 3686718 - RNA, 22 nt, Human
uuuucucaaaagcauuuaucau

SEQ ID NO: 3686719 - RNA, 19 nt, Human
uuuucucaaaguuuugaaa

SEQ ID NO: 3686720 - RNA, 23 nt, Human
uuuucucaaaguuuugaaaagcu

SEQ ID NO: 3686721 - RNA, 12 nt, Human
uuuucucagcug

SEQ ID NO: 3686722 - RNA, 22 nt, Human
uuuucuccaauuuuuuuuuccu

SEQ ID NO: 3686723 - RNA, 12 nt, Human
uuuucuccagcu

SEQ ID NO: 3686724 - RNA, 13 nt, Human
uuuucuccagcuc

SEQ ID NO: 3686725 - RNA, 23 nt, Human
uuuucucccuggauuuuuaccag

SEQ ID NO: 3686726 - RNA, 17 nt, Human
uuuucucuaacucagaa

SEQ ID NO: 3686727 - RNA, 16 nt, Human
uuuucucuaggaaaua

SEQ ID NO: 3686728 - RNA, 10 nt, Human
uuuucucuca

SEQ ID NO: 3686729 - RNA, 15 nt, Human
uuuucucucaacacc

SEQ ID NO: 3686730 - RNA, 17 nt, Human
uuuucucugauacagaa

SEQ ID NO: 3686731 - RNA, 22 nt, Human
uuuucucugauacuuuuuugaa

SEQ ID NO: 3686732 - RNA, 16 nt, Human
uuuucucuuaucugug

SEQ ID NO: 3686733 - RNA, 13 nt, Human
uuuucucuucaua

SEQ ID NO: 3686734 - RNA, 22 nt, Human
uuuucucuugggcugagacugg

SEQ ID NO: 3686735 - RNA, 14 nt, Human
uuuucucuuucucc

SEQ ID NO: 3686736 - RNA, 17 nt, Human
uuuucucuuucucuccu

SEQ ID NO: 3686737 - RNA, 9 nt, Human
uuuucugaa

SEQ ID NO: 3686738 - RNA, 13 nt, Human
uuuucugaaacua

SEQ ID NO: 3686739 - RNA, 17 nt, Human
uuuucugaaucuucuga

SEQ ID NO: 3686740 - RNA, 13 nt, Human
uuuucugacuaau

SEQ ID NO: 3686741 - RNA, 22 nt, Human
uuuucugagcccgggcugccug

SEQ ID NO: 3686742 - RNA, 15 nt, Human
uuuucugagcgauua

SEQ ID NO: 3686743 - RNA, 19 nt, Human
uuuucugcacuauaugcaa

SEQ ID NO: 3686744 - RNA, 16 nt, Human
uuuucugcacugagca

SEQ ID NO: 3686745 - RNA, 20 nt, Human
uuuucugcacugagcagagu

SEQ ID NO: 3686746 - RNA, 12 nt, Human
uuuucugcccug

SEQ ID NO: 3686747 - RNA, 17 nt, Human
uuuucuggaauacauga

SEQ ID NO: 3686748 - RNA, 20 nt, Human
uuuucuggacucuggacuuu

SEQ ID NO: 3686749 - RNA, 11 nt, Human
uuuucuggcac

SEQ ID NO: 3686750 - RNA, 20 nt, Human
uuuucuggccaguguuuaaa

SEQ ID NO: 3686751 - RNA, 19 nt, Human
uuuucugguagauagaaau

SEQ ID NO: 3686752 - RNA, 20 nt, Human
uuuucugguagauagaaaua

SEQ ID NO: 3686753 - RNA, 14 nt, Human
uuuucugguucuaa

SEQ ID NO: 3686754 - RNA, 18 nt, Human
uuuucuguagucauuuac

SEQ ID NO: 3686755 - RNA, 17 nt, Human
uuuucuguauaaauguc

SEQ ID NO: 3686756 - RNA, 10 nt, Human
uuuucugugu

SEQ ID NO: 3686757 - RNA, 17 nt, Human
uuuucuguguguuccug

SEQ ID NO: 3686758 - RNA, 19 nt, Human
uuuucuguguguuccuggc

SEQ ID NO: 3686759 - RNA, 22 nt, Human
uuuucuguuaccucaacaagaa

SEQ ID NO: 3686760 - RNA, 14 nt, Human
uuuucuuaaaaagu

SEQ ID NO: 3686761 - RNA, 14 nt, Human
uuuucuuaaauaau

SEQ ID NO: 3686762 - RNA, 23 nt, Human
uuuucuuaaauaauaaagaucau

SEQ ID NO: 3686763 - RNA, 12 nt, Human
uuuucuuaacca

SEQ ID NO: 3686764 - RNA, 13 nt, Human
uuuucuuacauaa

SEQ ID NO: 3686765 - RNA, 17 nt, Human
uuuucuuacuccuccuc

SEQ ID NO: 3686766 - RNA, 12 nt, Human
uuuucuugauaa

SEQ ID NO: 3686767 - RNA, 14 nt, Human
uuuucuugauuuga

SEQ ID NO: 3686768 - RNA, 16 nt, Human
uuuucuugcaugguuu

SEQ ID NO: 3686769 - RNA, 21 nt, Human
uuuucuugccucuguccccuu

SEQ ID NO: 3686770 - RNA, 13 nt, Human
uuuucuugucuau

SEQ ID NO: 3686771 - RNA, 20 nt, Human
uuuucuugucuauaaagcau

SEQ ID NO: 3686772 - RNA, 14 nt, Human
uuuucuugugacag

SEQ ID NO: 3686773 - RNA, 22 nt, Human
uuuucuuguguguuuauuguca

SEQ ID NO: 3686774 - RNA, 15 nt, Human
uuuucuuguuuauca

SEQ ID NO: 3686775 - RNA, 19 nt, Human
uuuucuuguuuaucagcag

SEQ ID NO: 3686776 - RNA, 18 nt, Human
uuuucuuuaaagaaguug

SEQ ID NO: 3686777 - RNA, 15 nt, Human
uuuucuuuaaagaug

SEQ ID NO: 3686778 - RNA, 22 nt, Human
uuuucuuuacaaacaaaagcau

SEQ ID NO: 3686779 - RNA, 18 nt, Human
uuuucuuuagagaacuga

SEQ ID NO: 3686780 - RNA, 21 nt, Human
uuuucuuuagagaacugaaaa

SEQ ID NO: 3686781 - RNA, 19 nt, Human
uuuucuuuauaagaaagcc

SEQ ID NO: 3686782 - RNA, 14 nt, Human
uuuucuuuccuccu

SEQ ID NO: 3686783 - RNA, 12 nt, Human
uuuucuuugugu

SEQ ID NO: 3686784 - RNA, 15 nt, Human
uuuucuuuuaagaau

SEQ ID NO: 3686785 - RNA, 15 nt, Human
uuuucuuuuccauua

SEQ ID NO: 3686786 - RNA, 13 nt, Human
uuuucuuuucuau

SEQ ID NO: 3686787 - RNA, 21 nt, Human
uuuucuuuuguaagugcuaca

SEQ ID NO: 3686788 - RNA, 15 nt, Human
uuuucuuuuguuacu

SEQ ID NO: 3686789 - RNA, 23 nt, Human
uuuucuuuuuuaaauuaauaucu

SEQ ID NO: 3686790 - RNA, 14 nt, Human
uuuugaaaaaagcu

SEQ ID NO: 3686791 - RNA, 13 nt, Human
uuuugaaaaacug

SEQ ID NO: 3686792 - RNA, 18 nt, Human
uuuugaaaaauuccuauu

SEQ ID NO: 3686793 - RNA, 18 nt, Human
uuuugaaaacuacauuuu

SEQ ID NO: 3686794 - RNA, 15 nt, Human
uuuugaaaagcuauu

SEQ ID NO: 3686795 - RNA, 17 nt, Human
uuuugaaaagcuucuua

SEQ ID NO: 3686796 - RNA, 12 nt, Human
uuuugaaaaggc

SEQ ID NO: 3686797 - RNA, 11 nt, Human
uuuugaaaagu

SEQ ID NO: 3686798 - RNA, 20 nt, Human
uuuugaaaaguaauauuuau

SEQ ID NO: 3686799 - RNA, 22 nt, Human
uuuugaaaucaguaaacacugu

SEQ ID NO: 3686800 - RNA, 20 nt, Human
uuuugaaaucuguaucugua

SEQ ID NO: 3686801 - RNA, 11 nt, Human
uuuugaaauga

SEQ ID NO: 3686802 - RNA, 12 nt, Human
uuuugaaaugaa

SEQ ID NO: 3686803 - RNA, 17 nt, Human
uuuugaaauuaaccucu

SEQ ID NO: 3686804 - RNA, 21 nt, Human
uuuugaacuaauaaaagcaua

SEQ ID NO: 3686805 - RNA, 17 nt, Human
uuuugaacucuucucau

SEQ ID NO: 3686806 - RNA, 21 nt, Human
uuuugaagauucuauguuaau

SEQ ID NO: 3686807 - RNA, 13 nt, Human
uuuugaagcauag

SEQ ID NO: 3686808 - RNA, 21 nt, Human
uuuugaagcuaauuauuuuaa

SEQ ID NO: 3686809 - RNA, 22 nt, Human
uuuugaagcuaauuauuuuaau

SEQ ID NO: 3686810 - RNA, 14 nt, Human
uuuugaaguauuua

SEQ ID NO: 3686811 - RNA, 13 nt, Human
uuuugaagucuug

SEQ ID NO: 3686812 - RNA, 19 nt, Human
uuuugaagugagaaaauga

SEQ ID NO: 3686813 - RNA, 22 nt, Human
uuuugaaguguaggcagacaca

SEQ ID NO: 3686814 - RNA, 16 nt, Human
uuuugaaguuuacauu

SEQ ID NO: 3686815 - RNA, 17 nt, Human
uuuugaaguuuacauuu

SEQ ID NO: 3686816 - RNA, 13 nt, Human
uuuugaauguuau

SEQ ID NO: 3686817 - RNA, 14 nt, Human
uuuugaauguuauu

SEQ ID NO: 3686818 - RNA, 15 nt, Human
uuuugaauuguuaca

SEQ ID NO: 3686819 - RNA, 16 nt, Human
uuuugaauuguuacau

SEQ ID NO: 3686820 - RNA, 20 nt, Human
uuuugacaaggggcaguggu

SEQ ID NO: 3686821 - RNA, 12 nt, Human
uuuugacacuga

SEQ ID NO: 3686822 - RNA, 21 nt, Human
uuuugacacugaaauaaccgu

SEQ ID NO: 3686823 - RNA, 11 nt, Human
uuuugacagaa

SEQ ID NO: 3686824 - RNA, 15 nt, Human
uuuugacauaaaguu

SEQ ID NO: 3686825 - RNA, 15 nt, Human
uuuugacauggaaau

SEQ ID NO: 3686826 - RNA, 20 nt, Human
uuuugaccuucauuucaugu

SEQ ID NO: 3686827 - RNA, 21 nt, Human
uuuugaccuucauuucaugua

SEQ ID NO: 3686828 - RNA, 20 nt, Human
uuuugacggaugauuggauu

SEQ ID NO: 3686829 - RNA, 17 nt, Human
uuuugacuuaaagcaga

SEQ ID NO: 3686830 - RNA, 17 nt, Human
uuuugacuuaaugugau

SEQ ID NO: 3686831 - RNA, 18 nt, Human
uuuugacuuaaugugauu

SEQ ID NO: 3686832 - RNA, 18 nt, Human
uuuugagaacguaaagaa

SEQ ID NO: 3686833 - RNA, 23 nt, Human
uuuugagauauuaaugcccagac

SEQ ID NO: 3686834 - RNA, 14 nt, Human
uuuugagauguaaa

SEQ ID NO: 3686835 - RNA, 16 nt, Human
uuuugagcccuuguuu

SEQ ID NO: 3686836 - RNA, 13 nt, Human
uuuugaggcaaaa

SEQ ID NO: 3686837 - RNA, 23 nt, Human
uuuugaguagauauuacuuuauc

SEQ ID NO: 3686838 - RNA, 14 nt, Human
uuuugagugugugu

SEQ ID NO: 3686839 - RNA, 14 nt, Human
uuuugaguucuaca

SEQ ID NO: 3686840 - RNA, 13 nt, Human
uuuugauaacaau

SEQ ID NO: 3686841 - RNA, 15 nt, Human
uuuugauagcaaagc

SEQ ID NO: 3686842 - RNA, 22 nt, Human
uuuugauguuuguggccucaga

SEQ ID NO: 3686843 - RNA, 15 nt, Human
uuuugauuuaugcau

SEQ ID NO: 3686844 - RNA, 17 nt, Human
uuuugcaaagauuuaau

SEQ ID NO: 3686845 - RNA, 13 nt, Human
uuuugcaaauaua

SEQ ID NO: 3686846 - RNA, 17 nt, Human
uuuugcaaccucgcugg

SEQ ID NO: 3686847 - RNA, 20 nt, Human
uuuuucugcuuuagacuuga

SEQ ID NO: 3686848 - RNA, 11 nt, Human
uuuuucugugg

SEQ ID NO: 3686849 - RNA, 18 nt, Human
uuuuucuguuguaacuua

SEQ ID NO: 3686850 - RNA, 13 nt, Human
uuuuucuuaauca

SEQ ID NO: 3686851 - RNA, 16 nt, Human
uuuuucuucuguauuu

SEQ ID NO: 3686852 - RNA, 13 nt, Human
uuuuucuuguaau

SEQ ID NO: 3686853 - RNA, 22 nt, Human
uuuuucuugucuauaaagcauu

SEQ ID NO: 3686854 - RNA, 14 nt, Human
uuuuucuuuaagau

SEQ ID NO: 3686855 - RNA, 13 nt, Human
uuuuucuuuugua

SEQ ID NO: 3686856 - RNA, 17 nt, Human
uuuuugaaaaaagcuca

SEQ ID NO: 3686857 - RNA, 21 nt, Human
uuuuugaaaaagaaaacacuu

SEQ ID NO: 3686858 - RNA, 17 nt, Human
uuuuugaaaaagcgaaa

SEQ ID NO: 3686859 - RNA, 12 nt, Human
uuuuugaaaacc

SEQ ID NO: 3686860 - RNA, 11 nt, Human
uuuuugaaaug

SEQ ID NO: 3686861 - RNA, 16 nt, Human
uuuuugaaaugaaauu

SEQ ID NO: 3686862 - RNA, 19 nt, Human
uuuuugaacuaagaaacuu

SEQ ID NO: 3686863 - RNA, 20 nt, Human
uuuuugaacucuucucauua

SEQ ID NO: 3686864 - RNA, 15 nt, Human
uuuuugaagcuguau

SEQ ID NO: 3686865 - RNA, 11 nt, Human
uuuuugaagug

SEQ ID NO: 3686866 - RNA, 14 nt, Human
uuuuugaaguguug

SEQ ID NO: 3686867 - RNA, 13 nt, Human
uuuuugauacuaa

SEQ ID NO: 3686868 - RNA, 12 nt, Human
uuuuugauauau

SEQ ID NO: 3686869 - RNA, 16 nt, Human
uuuuugaucaaaaacu

SEQ ID NO: 3686870 - RNA, 18 nt, Human
uuuuugcaagugaagguu

SEQ ID NO: 3686871 - RNA, 19 nt, Human
uuuuugcaccccaugcugu

SEQ ID NO: 3686872 - RNA, 16 nt, Human
uuuuugcaguaacugu

SEQ ID NO: 3686873 - RNA, 21 nt, Human
uuuuugcauggcacuugcauc

SEQ ID NO: 3686874 - RNA, 14 nt, Human
uuuuugcucuaaaa

SEQ ID NO: 3686875 - RNA, 12 nt, Human
uuuuuggacuuc

SEQ ID NO: 3686876 - RNA, 19 nt, Human
uuuuuggaguguuauguau

SEQ ID NO: 3686877 - RNA, 23 nt, Human
uuuuuggcauaacauaaaucugu

SEQ ID NO: 3686878 - RNA, 15 nt, Human
uuuuugggaugucuu

SEQ ID NO: 3686879 - RNA, 21 nt, Human
uuuuugggggguuuucuugcc

SEQ ID NO: 3686880 - RNA, 12 nt, Human
uuuuugguacaa

SEQ ID NO: 3686881 - RNA, 15 nt, Human
uuuuugguauuugaa

SEQ ID NO: 3686882 - RNA, 22 nt, Human
uuuuugguguauagaaguuugu

SEQ ID NO: 3686883 - RNA, 14 nt, Human
uuuuugguugggaa

SEQ ID NO: 3686884 - RNA, 14 nt, Human
uuuuuguaaagugu

SEQ ID NO: 3686885 - RNA, 16 nt, Human
uuuuuguaaagugugg

SEQ ID NO: 3686886 - RNA, 13 nt, Human
uuuuuguaauuua

SEQ ID NO: 3686887 - RNA, 12 nt, Human
uuuuuguacaug

SEQ ID NO: 3686888 - RNA, 17 nt, Human
uuuuuguagcacugaca

SEQ ID NO: 3686889 - RNA, 20 nt, Human
uuuuuguagugaccuguuua

SEQ ID NO: 3686890 - RNA, 9 nt, Human
uuuuuguau

SEQ ID NO: 3686891 - RNA, 12 nt, Human
uuuuuguauguu

SEQ ID NO: 3686892 - RNA, 12 nt, Human
uuuuugucauca

SEQ ID NO: 3686893 - RNA, 22 nt, Human
uuuuuguguuuuguucuuuaaa

SEQ ID NO: 3686894 - RNA, 22 nt, Human
uuuuuguuccacaaguuaaaua

SEQ ID NO: 3686895 - RNA, 12 nt, Human
uuuuuguugaca

SEQ ID NO: 3686896 - RNA, 13 nt, Human
uuuuuguuugaug

SEQ ID NO: 3686897 - RNA, 11 nt, Human
uuuuuguuugg

SEQ ID NO: 3686898 - RNA, 15 nt, Human
uuuuuguuuguuucu

SEQ ID NO: 3686899 - RNA, 15 nt, Human
uuuuuguuuguuugu

SEQ ID NO: 3686900 - RNA, 14 nt, Human
uuuuuguuuuucug

SEQ ID NO: 3686901 - RNA, 23 nt, Human
uuuuuuaaaaaagaaacauuugg

SEQ ID NO: 3686902 - RNA, 13 nt, Human
uuuuuuaaaagaa

SEQ ID NO: 3686903 - RNA, 13 nt, Human
uuuuuuaaagaaa

SEQ ID NO: 3686904 - RNA, 17 nt, Human
uuuuuuaagaauaucug

SEQ ID NO: 3686905 - RNA, 18 nt, Human
uuuuuuaaucuacugcau

SEQ ID NO: 3686906 - RNA, 15 nt, Human
uuuuuuaaugugcug

SEQ ID NO: 3686907 - RNA, 16 nt, Human
uuuuuuaaugugcugu

SEQ ID NO: 3686908 - RNA, 12 nt, Human
uuuuuuaauuga

SEQ ID NO: 3686909 - RNA, 14 nt, Human
uuuaaagagagguu

SEQ ID NO: 3686910 - RNA, 13 nt, Human
uuuaaagagucua

SEQ ID NO: 3686911 - RNA, 20 nt, Human
uuuaaagcauugcuguuaug

SEQ ID NO: 3686912 - RNA, 18 nt, Human
uuuaaagcuuacucuguc

SEQ ID NO: 3686913 - RNA, 12 nt, Human
uuuaaagcuuuu

SEQ ID NO: 3686914 - RNA, 23 nt, Human
uuuaaaguaugaaucuaugccaa

SEQ ID NO: 3686915 - RNA, 15 nt, Human
uuuaaaguauuuucu

SEQ ID NO: 3686916 - RNA, 22 nt, Human
uuuaaagugacuaauggcauga

SEQ ID NO: 3686917 - RNA, 18 nt, Human
uuuaaagugauuaaacgu

SEQ ID NO: 3686918 - RNA, 14 nt, Human
uuuaaagugcaaaa

SEQ ID NO: 3686919 - RNA, 18 nt, Human
uuuaaaguguuucagcua

SEQ ID NO: 3686920 - RNA, 19 nt, Human
uuuaaaguguuucuguuau

SEQ ID NO: 3686921 - RNA, 13 nt, Human
uuuaaaguucugu

SEQ ID NO: 3686922 - RNA, 14 nt, Human
uuuaaauaaacuuu

SEQ ID NO: 3686923 - RNA, 13 nt, Human
uuuaaauaaagua

SEQ ID NO: 3686924 - RNA, 22 nt, Human
uuuaaauaaaguaucaugcauu

SEQ ID NO: 3686925 - RNA, 21 nt, Human
uuuaaauaauuuaacuacccu

SEQ ID NO: 3686926 - RNA, 20 nt, Human
uuuaaauacagucuuccauu

SEQ ID NO: 3686927 - RNA, 13 nt, Human
uuuaaauauaauu

SEQ ID NO: 3686928 - RNA, 18 nt, Human
uuuaaauauaugcuaagu

SEQ ID NO: 3686929 - RNA, 14 nt, Human
uuuaaauauuuucu

SEQ ID NO: 3686930 - RNA, 19 nt, Human
uuuaaauccugaagagcau

SEQ ID NO: 3686931 - RNA, 12 nt, Human
uuuaaaucuguu

SEQ ID NO: 3686932 - RNA, 23 nt, Human
uuuaaaugaacaagagaagcauu

SEQ ID NO: 3686933 - RNA, 14 nt, Human
uuuaaaugcugcuu

SEQ ID NO: 3686934 - RNA, 14 nt, Human
uuuaaauguauacu

SEQ ID NO: 3686935 - RNA, 18 nt, Human
uuuaaaugucuaauguau

SEQ ID NO: 3686936 - RNA, 14 nt, Human
uuuaaauguguaca

SEQ ID NO: 3686937 - RNA, 13 nt, Human
uuuaaauuacaau

SEQ ID NO: 3686938 - RNA, 15 nt, Human
uuuaaauuagaaaau

SEQ ID NO: 3686939 - RNA, 15 nt, Human
uuuaaauuauaagga

SEQ ID NO: 3686940 - RNA, 13 nt, Human
uuuaaauuguaau

SEQ ID NO: 3686941 - RNA, 21 nt, Human
uuuaaauuuucuucaguuggu

SEQ ID NO: 3686942 - RNA, 18 nt, Human
uuuaaauuuuuuuccuua

SEQ ID NO: 3686943 - RNA, 16 nt, Human
uuuaacaacagcuggu

SEQ ID NO: 3686944 - RNA, 20 nt, Human
uuuaacaagaagaugaaugg

SEQ ID NO: 3686945 - RNA, 11 nt, Human
uuuaacaaugc

SEQ ID NO: 3686946 - RNA, 18 nt, Human
uuuaacaaugcgaauggu

SEQ ID NO: 3686947 - RNA, 18 nt, Human
uuuaacagaaauguacag

SEQ ID NO: 3686948 - RNA, 20 nt, Human
uuuaacagcugaauuaucua

SEQ ID NO: 3686949 - RNA, 18 nt, Human
uuuaacaggaagaucuua

SEQ ID NO: 3686950 - RNA, 17 nt, Human
uuuaacauaagcuauuu

SEQ ID NO: 3686951 - RNA, 12 nt, Human
uuuaacauuccu

SEQ ID NO: 3686952 - RNA, 13 nt, Human
uuuaacauuugcc

SEQ ID NO: 3686953 - RNA, 16 nt, Human
uuuaacauuuuguucu

SEQ ID NO: 3686954 - RNA, 17 nt, Human
uuuaacauuuuguucuu

SEQ ID NO: 3686955 - RNA, 23 nt, Human
uuuaacauuuuguucuuacacau

SEQ ID NO: 3686956 - RNA, 17 nt, Human
uuuaaccaaacaauuau

SEQ ID NO: 3686957 - RNA, 15 nt, Human
uuuaaccaaagguga

SEQ ID NO: 3686958 - RNA, 15 nt, Human
uuuaaccaucugaua

SEQ ID NO: 3686959 - RNA, 20 nt, Human
uuuaaccauggcagggugcu

SEQ ID NO: 3686960 - RNA, 17 nt, Human
uuuaaccccccuguaca

SEQ ID NO: 3686961 - RNA, 16 nt, Human
uuuaaccccgucaaca

SEQ ID NO: 3686962 - RNA, 17 nt, Human
uuuaaccccgucaacaa

SEQ ID NO: 3686963 - RNA, 18 nt, Human
uuuaaccccgucaacaaa

SEQ ID NO: 3686964 - RNA, 21 nt, Human
uuuaaccccgucaacaaaucu

SEQ ID NO: 3686965 - RNA, 23 nt, Human
uuuaaccgguaagaguuucaguu

SEQ ID NO: 3686966 - RNA, 14 nt, Human
uuuaacuaaauuuu

SEQ ID NO: 3686967 - RNA, 17 nt, Human
uuuaacuacccuuaauu

SEQ ID NO: 3686968 - RNA, 15 nt, Human
uuuaacuagaauuua

SEQ ID NO: 3686969 - RNA, 24 nt, Human
uuuaacucaauauuuuccaugaaa

SEQ ID NO: 3686970 - RNA, 15 nt, Human
uuuaacucagaucac

SEQ ID NO: 3686971 - RNA, 18 nt, Human
uuuaacucaggacuccag

SEQ ID NO: 3686972 - RNA, 18 nt, Human
uuuaacuccccuguuuca

SEQ ID NO: 3686973 - RNA, 14 nt, Human
uuuaacucugucuu

SEQ ID NO: 3686974 - RNA, 14 nt, Human
uuuaacugacaagc

SEQ ID NO: 3686975 - RNA, 19 nt, Human
uuuaacugacaagccaucu

SEQ ID NO: 3686976 - RNA, 11 nt, Human
uuuaacugacu

SEQ ID NO: 3686977 - RNA, 23 nt, Human
uuuaacugacuauucuugaugua

SEQ ID NO: 3686978 - RNA, 12 nt, Human
uuuaacugccgu

SEQ ID NO: 3686979 - RNA, 14 nt, Human
uuuaacugccuugu

SEQ ID NO: 3686980 - RNA, 22 nt, Human
uuuaacuggugcacuuuguaaa

SEQ ID NO: 3686981 - RNA, 15 nt, Human
uuuaacuguggauau

SEQ ID NO: 3686982 - RNA, 18 nt, Human
uuuaacuguggauauugu

SEQ ID NO: 3686983 - RNA, 17 nt, Human
uuuaacuuaguuuugca

SEQ ID NO: 3686984 - RNA, 14 nt, Human
uuuaacuucuuucu

SEQ ID NO: 3686985 - RNA, 14 nt, Human
uuuaacuuuaccau

SEQ ID NO: 3686986 - RNA, 21 nt, Human
uuuaacuuuguuuuauuuuca

SEQ ID NO: 3686987 - RNA, 19 nt, Human
uuuaacuuuuuuucuucua

SEQ ID NO: 3686988 - RNA, 22 nt, Human
uuuaagaaaaaggaugcacaga

SEQ ID NO: 3686989 - RNA, 17 nt, Human
uuuaagaaaaguauuuu

SEQ ID NO: 3686990 - RNA, 20 nt, Human
uuuaagaaaaguauuuugaa

SEQ ID NO: 3686991 - RNA, 21 nt, Human
uuuaagaaaaguauuuugaag

SEQ ID NO: 3686992 - RNA, 22 nt, Human
uuuaagaaaaguauuuugaagu

SEQ ID NO: 3686993 - RNA, 11 nt, Human
uuuaagaaaau

SEQ ID NO: 3686994 - RNA, 13 nt, Human
uuuaagaaaauac

SEQ ID NO: 3686995 - RNA, 20 nt, Human
uuuaagaaaauacaauaaac

SEQ ID NO: 3686996 - RNA, 21 nt, Human
uuuaagaaaauacaauaaacu

SEQ ID NO: 3686997 - RNA, 22 nt, Human
uuuaagaaaauacaauaaacua

SEQ ID NO: 3686998 - RNA, 14 nt, Human
uuuaagaaauagaa

SEQ ID NO: 3686999 - RNA, 17 nt, Human
uuuaagaacuaaaaugu

SEQ ID NO: 3687000 - RNA, 21 nt, Human
uuuaagaauaucuguaauggu

SEQ ID NO: 3687001 - RNA, 17 nt, Human
uuuaagacacuuccguc

SEQ ID NO: 3687002 - RNA, 19 nt, Human
uuuaagacauuuuuggaag

SEQ ID NO: 3687003 - RNA, 16 nt, Human
uuuaagaccagccugg

SEQ ID NO: 3687004 - RNA, 16 nt, Human
uuuaagacuuugguua

SEQ ID NO: 3687005 - RNA, 14 nt, Human
uuuaagagagaaau

SEQ ID NO: 3687006 - RNA, 14 nt, Human
uuuaagaggcaggg

SEQ ID NO: 3687007 - RNA, 14 nt, Human
uuuaagagugaagu

SEQ ID NO: 3687008 - RNA, 18 nt, Human
uuuaagauaauaauauau

SEQ ID NO: 3687009 - RNA, 20 nt, Human
uuuaagauaauaguuuacau

SEQ ID NO: 3687010 - RNA, 22 nt, Human
uuuaagaugugucuucaauuug

SEQ ID NO: 3687011 - RNA, 18 nt, Human
uuuaagauuccuuuucuu

SEQ ID NO: 3687012 - RNA, 22 nt, Human
uuuaagauuccuuuucuuguuu

SEQ ID NO: 3687013 - RNA, 17 nt, Human
uuuaagauuuuucucaa

SEQ ID NO: 3687014 - RNA, 12 nt, Human
uuuaagcaaaua

SEQ ID NO: 3687015 - RNA, 16 nt, Human
uuuaagcaaguuaagu

SEQ ID NO: 3687016 - RNA, 20 nt, Human
uuuaagcacuacauaaacug

SEQ ID NO: 3687017 - RNA, 15 nt, Human
uuuaagcacucuuaa

SEQ ID NO: 3687018 - RNA, 17 nt, Human
uuuaagcagaauuggaa

SEQ ID NO: 3687019 - RNA, 18 nt, Human
uuuaagcagaauuggaaa

SEQ ID NO: 3687020 - RNA, 19 nt, Human
uuuaagcagaauuggaaaa

SEQ ID NO: 3687021 - RNA, 20 nt, Human
uuuaagcccaucaauuauag

SEQ ID NO: 3687022 - RNA, 13 nt, Human
uuuaagcucugag

SEQ ID NO: 3687023 - RNA, 14 nt, Human
uuuaagcucugagc

SEQ ID NO: 3687024 - RNA, 19 nt, Human
uuuaagcucugagcuguca

SEQ ID NO: 3687025 - RNA, 14 nt, Human
uuuaagcuguaaaa

SEQ ID NO: 3687026 - RNA, 11 nt, Human
uuuaagcuguu

SEQ ID NO: 3687027 - RNA, 12 nt, Human
uuuaagcuguuu

SEQ ID NO: 3687028 - RNA, 11 nt, Human
uuuaaggaaaa

SEQ ID NO: 3687029 - RNA, 14 nt, Human
uuuaaggaaaacua

SEQ ID NO: 3687030 - RNA, 18 nt, Human
uuuaaggacugacugagg

SEQ ID NO: 3687031 - RNA, 19 nt, Human
uuuaaggaugcuuguacau

SEQ ID NO: 3687032 - RNA, 18 nt, Human
uuuaaggcuaaaacuuaa

SEQ ID NO: 3687033 - RNA, 16 nt, Human
uuuaaggcuucaauuu

SEQ ID NO: 3687034 - RNA, 17 nt, Human
uuuaagggaaagaaaau

SEQ ID NO: 3687035 - RNA, 18 nt, Human
uuuaagggcaugccuugu

SEQ ID NO: 3687036 - RNA, 19 nt, Human
uuuaagggcaugccuugug

SEQ ID NO: 3687037 - RNA, 17 nt, Human
uuuaaggguuuguggaa

SEQ ID NO: 3687038 - RNA, 14 nt, Human
uuuaaggucuguuu

SEQ ID NO: 3687039 - RNA, 15 nt, Human
uuuaaggucuguuug

SEQ ID NO: 3687040 - RNA, 20 nt, Human
uuuaagguuauuuauuuaaa

SEQ ID NO: 3687041 - RNA, 21 nt, Human
uuuaagguuauuuauuuaaau

SEQ ID NO: 3687042 - RNA, 23 nt, Human
uuuaaguaauguggaagaaaaug

SEQ ID NO: 3687043 - RNA, 21 nt, Human
uuuaaguacuacacauuuuua

SEQ ID NO: 3687044 - RNA, 21 nt, Human
uuuaaguauugcaucuguaua

SEQ ID NO: 3687045 - RNA, 13 nt, Human
uuuaaguauuuag

SEQ ID NO: 3687046 - RNA, 15 nt, Human
uuuaaguauuuauau

SEQ ID NO: 3687047 - RNA, 16 nt, Human
uuuaagucccugucac

SEQ ID NO: 3687048 - RNA, 15 nt, Human
uuuaagugaaaaugg

SEQ ID NO: 3687049 - RNA, 17 nt, Human
uuuaagugaaaaugguc

SEQ ID NO: 3687050 - RNA, 15 nt, Human
uuuaagugcugcauu

SEQ ID NO: 3687051 - RNA, 16 nt, Human
uuuaagugcugcauuu

SEQ ID NO: 3687052 - RNA, 19 nt, Human
uuuaagugcugcauuuaaa

SEQ ID NO: 3687053 - RNA, 17 nt, Human
uuuaagugucucacuaa

SEQ ID NO: 3687054 - RNA, 18 nt, Human
uuuaaguuacacauuuuu

SEQ ID NO: 3687055 - RNA, 23 nt, Human
uuuaaguucuggaugcauuucuc

SEQ ID NO: 3687056 - RNA, 12 nt, Human
uuuaaguuugca

SEQ ID NO: 3687057 - RNA, 23 nt, Human
uuuaaguuugcacucaaaucuua

SEQ ID NO: 3687058 - RNA, 12 nt, Human
uuuaauaaaaga

SEQ ID NO: 3687059 - RNA, 22 nt, Human
uuuaauaaacacucuugaaaaa

SEQ ID NO: 3687060 - RNA, 12 nt, Human
uuuuuuaauuua

SEQ ID NO: 3687061 - RNA, 12 nt, Human
uuuuuuacuaau

SEQ ID NO: 3687062 - RNA, 23 nt, Human
uuuuuuagaaagcauuugaaugc

SEQ ID NO: 3687063 - RNA, 11 nt, Human
uuuuuuauaca

SEQ ID NO: 3687064 - RNA, 12 nt, Human
uuuuuuaucuuu

SEQ ID NO: 3687065 - RNA, 13 nt, Human
uuuuuuaucuuuu

SEQ ID NO: 3687066 - RNA, 16 nt, Human
uuuuuuaugcuaauca

SEQ ID NO: 3687067 - RNA, 14 nt, Human
uuuuuuauucuugu

SEQ ID NO: 3687068 - RNA, 19 nt, Human
uuuuuuauugcuaguauuu

SEQ ID NO: 3687069 - RNA, 22 nt, Human
uuuuuuccaucuuuacaaaacu

SEQ ID NO: 3687070 - RNA, 12 nt, Human
uuuuuuccuguu

SEQ ID NO: 3687071 - RNA, 15 nt, Human
uuuuuuccuguuucu

SEQ ID NO: 3687072 - RNA, 10 nt, Human
uuuuuuccuu

SEQ ID NO: 3687073 - RNA, 14 nt, Human
uuuuuuccuuacau

SEQ ID NO: 3687074 - RNA, 12 nt, Human
uuuuuucuaaga

SEQ ID NO: 3687075 - RNA, 11 nt, Human
uuuuuucuacc

SEQ ID NO: 3687076 - RNA, 13 nt, Human
uuuuuucuuacug

SEQ ID NO: 3687077 - RNA, 12 nt, Human
uuuuuucuucua

SEQ ID NO: 3687078 - RNA, 12 nt, Human
uuuuuugauaaa

SEQ ID NO: 3687079 - RNA, 17 nt, Human
uuuuuugcaguaacugu

SEQ ID NO: 3687080 - RNA, 21 nt, Human
uuuuuuggccaucugcuccug

SEQ ID NO: 3687081 - RNA, 16 nt, Human
uuuuuugggcagcaau

SEQ ID NO: 3687082 - RNA, 14 nt, Human
uuuuuuguaugaaa

SEQ ID NO: 3687083 - RNA, 13 nt, Human
uuuuuuguauuau

SEQ ID NO: 3687084 - RNA, 12 nt, Human
uuuuuugucaac

SEQ ID NO: 3687085 - RNA, 16 nt, Human
uuuuuuguuuguuucu

SEQ ID NO: 3687086 - RNA, 12 nt, Human
uuuuuuuaagug

SEQ ID NO: 3687087 - RNA, 13 nt, Human
uuuuuuuaaugug

SEQ ID NO: 3687088 - RNA, 10 nt, Human
uuuuuuucca

SEQ ID NO: 3687089 - RNA, 13 nt, Human
uuuuuuuccaauu

SEQ ID NO: 3687090 - RNA, 12 nt, Human
uuuuuuucuauu

SEQ ID NO: 3687091 - RNA, 12 nt, Human
uuuuuuucuuua

SEQ ID NO: 3687092 - RNA, 12 nt, Human
uuuuuuugagau

SEQ ID NO: 3687093 - RNA, 11 nt, Human
uuuuuuugcag

SEQ ID NO: 3687094 - RNA, 14 nt, Human
uuuuuuuguacgac

SEQ ID NO: 3687095 - RNA, 14 nt, Human
uuuuuuuuaaacua

SEQ ID NO: 3687096 - RNA, 11 nt, Human
uuuuuuuucau

SEQ ID NO: 3687097 - RNA, 13 nt, Human
uuuuuuuugacaa

SEQ ID NO: 3687098 - RNA, 13 nt, Human
uuuuuuuuuaaac

SEQ ID NO: 3687099 - RNA, 17 nt, Human
uuugcagaagagggugu

SEQ ID NO: 3687100 - RNA, 15 nt, Human
uuugcagaugacaaa

SEQ ID NO: 3687101 - RNA, 14 nt, Human
uuugcagcucagaa

SEQ ID NO: 3687102 - RNA, 12 nt, Human
uuugcaggcuca

SEQ ID NO: 3687103 - RNA, 22 nt, Human
uuugcaggucuuuaaaucauuu

SEQ ID NO: 3687104 - RNA, 12 nt, Human
uuugcaguaacu

SEQ ID NO: 3687105 - RNA, 19 nt, Human
uuugcagugcaguauagaa

SEQ ID NO: 3687106 - RNA, 20 nt, Human
uuugcauaacaauuccucua

SEQ ID NO: 3687107 - RNA, 19 nt, Human
uuugcauaacguauaaaag

SEQ ID NO: 3687108 - RNA, 21 nt, Human
uuugcauagauucccugagca

SEQ ID NO: 3687109 - RNA, 22 nt, Human
uuugcauaggugaucucauuua

SEQ ID NO: 3687110 - RNA, 23 nt, Human
uuugcauaguaccaaucauuuua

SEQ ID NO: 3687111 - RNA, 15 nt, Human
uuugcauauugcaua

SEQ ID NO: 3687112 - RNA, 13 nt, Human
uuugcaucucagu

SEQ ID NO: 3687113 - RNA, 20 nt, Human
uuugcaugcaugcaaaugag

SEQ ID NO: 3687114 - RNA, 18 nt, Human
uuugcauggcacuugcau

SEQ ID NO: 3687115 - RNA, 23 nt, Human
uuugcauggcacuugcaucugug

SEQ ID NO: 3687116 - RNA, 22 nt, Human
uuugcauggcuccagaaauguc

SEQ ID NO: 3687117 - RNA, 21 nt, Human
uuugcaugugaaaaucaaaua

SEQ ID NO: 3687118 - RNA, 14 nt, Human
uuugcauguuaugu

SEQ ID NO: 3687119 - RNA, 19 nt, Human
uuugcauuaaauuacagaa

SEQ ID NO: 3687120 - RNA, 12 nt, Human
uuugcauucaaa

SEQ ID NO: 3687121 - RNA, 15 nt, Human
uuugcauucaaauua

SEQ ID NO: 3687122 - RNA, 14 nt, Human
uuugcauuccuaca

SEQ ID NO: 3687123 - RNA, 14 nt, Human
uuugcauugucugu

SEQ ID NO: 3687124 - RNA, 19 nt, Human
uuugcauuuaaaacagaca

SEQ ID NO: 3687125 - RNA, 21 nt, Human
uuugcauuuaaaacagacacu

SEQ ID NO: 3687126 - RNA, 23 nt, Human
uuugcauuuaaaacagacacugg

SEQ ID NO: 3687127 - RNA, 15 nt, Human
uuugcauuucagaaa

SEQ ID NO: 3687128 - RNA, 14 nt, Human
uuugcauuuggaau

SEQ ID NO: 3687129 - RNA, 12 nt, Human
uuugcauuuguu

SEQ ID NO: 3687130 - RNA, 20 nt, Human
uuugcauuuguuuauguaau

SEQ ID NO: 3687131 - RNA, 23 nt, Human
uuugcauuuguuuauguaauuuc

SEQ ID NO: 3687132 - RNA, 13 nt, Human
uuugccacagcuu

SEQ ID NO: 3687133 - RNA, 21 nt, Human
uuugccacuaauuuuaguauu

SEQ ID NO: 3687134 - RNA, 21 nt, Human
uuugccagaacaguuuguaca

SEQ ID NO: 3687135 - RNA, 10 nt, Human
uuugccagcc

SEQ ID NO: 3687136 - RNA, 14 nt, Human
uuugccagcugcug

SEQ ID NO: 3687137 - RNA, 15 nt, Human
uuugccagugggaac

SEQ ID NO: 3687138 - RNA, 13 nt, Human
uuugccauacauc

SEQ ID NO: 3687139 - RNA, 18 nt, Human
uuugccauguuggccagg

SEQ ID NO: 3687140 - RNA, 22 nt, Human
uuugccauguuggccaggcugg

SEQ ID NO: 3687141 - RNA, 12 nt, Human
uuugccauuuga

SEQ ID NO: 3687142 - RNA, 16 nt, Human
uuugccauuugauacc

SEQ ID NO: 3687143 - RNA, 17 nt, Human
uuugcccaaccucagca

SEQ ID NO: 3687144 - RNA, 18 nt, Human
uuugcccagaaagaagau

SEQ ID NO: 3687145 - RNA, 18 nt, Human
uuugcccauuuacacuuu

SEQ ID NO: 3687146 - RNA, 19 nt, Human
uuugcccauuuacacuuuu

SEQ ID NO: 3687147 - RNA, 19 nt, Human
uuugcccugguagggcagu

SEQ ID NO: 3687148 - RNA, 12 nt, Human
uuugcccuuuga

SEQ ID NO: 3687149 - RNA, 14 nt, Human
uuugccucaaauaa

SEQ ID NO: 3687150 - RNA, 23 nt, Human
uuugccucaaauaaaaagugcuu

SEQ ID NO: 3687151 - RNA, 20 nt, Human
uuugccucuuuucucugugc

SEQ ID NO: 3687152 - RNA, 18 nt, Human
uuugccugguuuugucuu

SEQ ID NO: 3687153 - RNA, 16 nt, Human
uuugccuugcagaacu

SEQ ID NO: 3687154 - RNA, 17 nt, Human
uuugccuugcagaacug

SEQ ID NO: 3687155 - RNA, 12 nt, Human
uuugccuuuaaa

SEQ ID NO: 3687156 - RNA, 12 nt, Human
uuugccuuuugc

SEQ ID NO: 3687157 - RNA, 19 nt, Human
uuugccuuuugcaaacuuu

SEQ ID NO: 3687158 - RNA, 17 nt, Human
uuugcgugcccggggca

SEQ ID NO: 3687159 - RNA, 19 nt, Human
uuugcgugggagugugugc

SEQ ID NO: 3687160 - RNA, 15 nt, Human
uuugcuaaagacaug

SEQ ID NO: 3687161 - RNA, 21 nt, Human
uuugcuaauuuuuauuaauuu

SEQ ID NO: 3687162 - RNA, 21 nt, Human
uuugcuagacucuagacaaga

SEQ ID NO: 3687163 - RNA, 23 nt, Human
uuugcucacacgggguauuuuag

SEQ ID NO: 3687164 - RNA, 17 nt, Human
uuugcucagaacacauu

SEQ ID NO: 3687165 - RNA, 13 nt, Human
uuugcucauauuu

SEQ ID NO: 3687166 - RNA, 11 nt, Human
uuugcucaugg

SEQ ID NO: 3687167 - RNA, 23 nt, Human
uuugcuccccuuccccuuccuuc

SEQ ID NO: 3687168 - RNA, 15 nt, Human
uuugcucuaaaauau

SEQ ID NO: 3687169 - RNA, 18 nt, Human
uuugcucuucaagaaauc

SEQ ID NO: 3687170 - RNA, 20 nt, Human
uuugcucuucaagaaaucug

SEQ ID NO: 3687171 - RNA, 20 nt, Human
uuugcucuucagaugccacu

SEQ ID NO: 3687172 - RNA, 17 nt, Human
uuugcucuugucccacg

SEQ ID NO: 3687173 - RNA, 23 nt, Human
uuugcugacaaccauuaaaguca

SEQ ID NO: 3687174 - RNA, 19 nt, Human
uuugcugacccuccccaaa

SEQ ID NO: 3687175 - RNA, 19 nt, Human
uuugcugccaaaugcguau

SEQ ID NO: 3687176 - RNA, 13 nt, Human
uuugcugcucuuc

SEQ ID NO: 3687177 - RNA, 22 nt, Human
uuugcuggggccgaaagaacag

SEQ ID NO: 3687178 - RNA, 12 nt, Human
uuugcuguaaga

SEQ ID NO: 3687179 - RNA, 19 nt, Human
uuugcuguaagaugucugu

SEQ ID NO: 3687180 - RNA, 18 nt, Human
uuugcuguauauuuguga

SEQ ID NO: 3687181 - RNA, 14 nt, Human
uuugcugugaacaa

SEQ ID NO: 3687182 - RNA, 16 nt, Human
uuugcuuagaaaagaa

SEQ ID NO: 3687183 - RNA, 20 nt, Human
uuugcuucauaaaugaagca

SEQ ID NO: 3687184 - RNA, 21 nt, Human
uuugcuugcaguagauuuucu

SEQ ID NO: 3687185 - RNA, 21 nt, Human
uuugcuugcucauaugcaugu

SEQ ID NO: 3687186 - RNA, 23 nt, Human
uuugcuugcuuugaaguagcucu

SEQ ID NO: 3687187 - RNA, 17 nt, Human
uuugcuuguuauauuaa

SEQ ID NO: 3687188 - RNA, 23 nt, Human
uuugcuuuaauauaaaugcaaau

SEQ ID NO: 3687189 - RNA, 15 nt, Human
uuugcuuugcccagc

SEQ ID NO: 3687190 - RNA, 19 nt, Human
uuugcuuuuuaguuuugcu

SEQ ID NO: 3687191 - RNA, 12 nt, Human
uuugcuuuuucu

SEQ ID NO: 3687192 - RNA, 14 nt, Human
uuugcuuuuugcua

SEQ ID NO: 3687193 - RNA, 21 nt, Human
uuuggaaacuaauaaaauauu

SEQ ID NO: 3687194 - RNA, 16 nt, Human
uuuggaaaggaaugca

SEQ ID NO: 3687195 - RNA, 17 nt, Human
uuuggaaaggaaugcaa

SEQ ID NO: 3687196 - RNA, 18 nt, Human
uuuggaaaggaaugcaaa

SEQ ID NO: 3687197 - RNA, 19 nt, Human
uuuggaaaggaaugcaaag

SEQ ID NO: 3687198 - RNA, 13 nt, Human
uuuggaaaguaca

SEQ ID NO: 3687199 - RNA, 11 nt, Human
uuuggaaaucc

SEQ ID NO: 3687200 - RNA, 13 nt, Human
uuuggaaccuugu

SEQ ID NO: 3687201 - RNA, 14 nt, Human
uuuggaaccuuguu

SEQ ID NO: 3687202 - RNA, 19 nt, Human
uuuggaaguuuagcucuga

SEQ ID NO: 3687203 - RNA, 16 nt, Human
uuuggaaucuagaaga

SEQ ID NO: 3687204 - RNA, 17 nt, Human
uuuggaaucuagaagaa

SEQ ID NO: 3687205 - RNA, 21 nt, Human
uuuggaaucuagaagaaauga

SEQ ID NO: 3687206 - RNA, 23 nt, Human
uuuggaaucuagaagaaaugaaa

SEQ ID NO: 3687207 - RNA, 22 nt, Human
uuuggaaucuucucuuugacaa

SEQ ID NO: 3687208 - RNA, 22 nt, Human
uuuggaauuuuccuccuuucuc

SEQ ID NO: 3687209 - RNA, 21 nt, Human
uuuggaauuuugugcccccau

SEQ ID NO: 3687210 - RNA, 22 nt, Human
uuuggaauuuuugcuugacuuc

SEQ ID NO: 3687211 - RNA, 16 nt, Human
uuuggacacacacagc

SEQ ID NO: 3687212 - RNA, 20 nt, Human
uuuggacacauuuaaggugu

SEQ ID NO: 3687213 - RNA, 18 nt, Human
uuuggaccaaaaaccagu

SEQ ID NO: 3687214 - RNA, 21 nt, Human
uuuggaccaaaaaccaguauu

SEQ ID NO: 3687215 - RNA, 24 nt, Human
uuuggaccaaaaaccaguauugua

SEQ ID NO: 3687216 - RNA, 17 nt, Human
uuuggaccauuuuccug

SEQ ID NO: 3687217 - RNA, 17 nt, Human
uuuggaccccagcuggg

SEQ ID NO: 3687218 - RNA, 13 nt, Human
uuuggacccugag

SEQ ID NO: 3687219 - RNA, 16 nt, Human
uuuggaccuaauccaa

SEQ ID NO: 3687220 - RNA, 19 nt, Human
uuuggagacucuguggggc

SEQ ID NO: 3687221 - RNA, 19 nt, Human
uuuggagagaaauauuuua

SEQ ID NO: 3687222 - RNA, 22 nt, Human
uuuggaggcuggaguaaucaga

SEQ ID NO: 3687223 - RNA, 18 nt, Human
uuuggagggaagcucuug

SEQ ID NO: 3687224 - RNA, 21 nt, Human
uuuggauaucuguuagaugcu

SEQ ID NO: 3687225 - RNA, 15 nt, Human
uuuggauucuaaaua

SEQ ID NO: 3687226 - RNA, 18 nt, Human
uuuggauucuuauguagc

SEQ ID NO: 3687227 - RNA, 23 nt, Human
uuuggauugacaguaacuugguu

SEQ ID NO: 3687228 - RNA, 18 nt, Human
uuuggauugacucugcau

SEQ ID NO: 3687229 - RNA, 22 nt, Human
uuuggauuggacaaaaugacuu

SEQ ID NO: 3687230 - RNA, 14 nt, Human
uuuggauuugacau

SEQ ID NO: 3687231 - RNA, 16 nt, Human
uuuggauuugacauug

SEQ ID NO: 3687232 - RNA, 22 nt, Human
uuuggcaggggcagaaaacucu

SEQ ID NO: 3687233 - RNA, 23 nt, Human
uuuggccaaugcaccuaaagaaa

SEQ ID NO: 3687234 - RNA, 17 nt, Human
uuuggccaucugcuccu

SEQ ID NO: 3687235 - RNA, 19 nt, Human
uuuggcccaaucucugcca

SEQ ID NO: 3687236 - RNA, 17 nt, Human
uuuggccugcacuaauu

SEQ ID NO: 3687237 - RNA, 13 nt, Human
uuuggcuccugcc

SEQ ID NO: 3687238 - RNA, 22 nt, Human
uuuggcugaaauucuccuggag

SEQ ID NO: 3687239 - RNA, 13 nt, Human
uuuggcugcugaa

SEQ ID NO: 3687240 - RNA, 22 nt, Human
uuugggaaaaaaacauacacaa

SEQ ID NO: 3687241 - RNA, 12 nt, Human
uuugggaagggg

SEQ ID NO: 3687242 - RNA, 22 nt, Human
uuugggaagugaagacuggaag

SEQ ID NO: 3687243 - RNA, 17 nt, Human
uuugggaaguuaaaggg

SEQ ID NO: 3687244 - RNA, 17 nt, Human
uuugggaauauuugaau

SEQ ID NO: 3687245 - RNA, 16 nt, Human
uuugggagacauguga

SEQ ID NO: 3687246 - RNA, 14 nt, Human
uuugggagagacuu

SEQ ID NO: 3687247 - RNA, 17 nt, Human
uuugggaggcugaggcg

SEQ ID NO: 3687248 - RNA, 17 nt, Human
uuugggaggcugaggug

SEQ ID NO: 3687249 - RNA, 15 nt, Human
uuugggaguuuuuau

SEQ ID NO: 3687250 - RNA, 23 nt, Human
uuugggaguuuuuaugagaaacu

SEQ ID NO: 3687251 - RNA, 19 nt, Human
uuugggauagagaauguuc

SEQ ID NO: 3687252 - RNA, 22 nt, Human
uuugggaugucuuauuuuuaga

SEQ ID NO: 3687253 - RNA, 17 nt, Human
uuugggcagagaggcug

SEQ ID NO: 3687254 - RNA, 11 nt, Human
uuugggcaugu

SEQ ID NO: 3687255 - RNA, 15 nt, Human
uuugggcccagggac

SEQ ID NO: 3687256 - RNA, 12 nt, Human
uuugggcccugc

SEQ ID NO: 3687257 - RNA, 14 nt, Human
uuugggcugaaugu

SEQ ID NO: 3687258 - RNA, 17 nt, Human
uuuggggaaaccuagag

SEQ ID NO: 3687259 - RNA, 13 nt, Human
uuuggggaagaac

SEQ ID NO: 3687260 - RNA, 18 nt, Human
uuuggggcagaaaggacu

SEQ ID NO: 3687261 - RNA, 13 nt, Human
uuuggggccggga

SEQ ID NO: 3687262 - RNA, 15 nt, Human
uuuggggcuugauga

SEQ ID NO: 3687263 - RNA, 17 nt, Human
uuugggggaaacuuccu

SEQ ID NO: 3687264 - RNA, 20 nt, Human
uuugggggucaggcagccag

SEQ ID NO: 3687265 - RNA, 22 nt, Human
uuugggguacccacugcucugg

SEQ ID NO: 3687266 - RNA, 21 nt, Human
uuugggguugcaucagaaaug

SEQ ID NO: 3687267 - RNA, 23 nt, Human
uuuggguggggggcauugaguau

SEQ ID NO: 3687268 - RNA, 15 nt, Human
uuuggguuaaaaaaa

SEQ ID NO: 3687269 - RNA, 14 nt, Human
uuuggguucugccu

SEQ ID NO: 3687270 - RNA, 15 nt, Human
uuuggguucugccug

SEQ ID NO: 3687271 - RNA, 16 nt, Human
uuuggguucugccugc

SEQ ID NO: 3687272 - RNA, 18 nt, Human
uuuggguuuuuuuccuuu

SEQ ID NO: 3687273 - RNA, 20 nt, Human
uuugguaaaauacuucuuga

SEQ ID NO: 3687274 - RNA, 21 nt, Human
uuugguagcugggaaagcaua

SEQ ID NO: 3687275 - RNA, 19 nt, Human
uuugguaucuguucuuuaa

SEQ ID NO: 3687276 - RNA, 18 nt, Human
uuugguccacuuuuccag

SEQ ID NO: 3687277 - RNA, 19 nt, Human
uuugguccacuuuuccagu

SEQ ID NO: 3687278 - RNA, 22 nt, Human
uuuggugaacauugcaauagaa

SEQ ID NO: 3687279 - RNA, 14 nt, Human
uuuggugagaaccu

SEQ ID NO: 3687280 - RNA, 15 nt, Human
uuuggugcaaaguau

SEQ ID NO: 3687281 - RNA, 17 nt, Human
uuuggugcauagaacug

SEQ ID NO: 3687282 - RNA, 22 nt, Human
uuuggugcauagaacuggguaa

SEQ ID NO: 3687283 - RNA, 12 nt, Human
uuuggugccuuu

SEQ ID NO: 3687284 - RNA, 20 nt, Human
uuugguggagauaaagauuu

SEQ ID NO: 3687285 - RNA, 16 nt, Human
uuugguggauguaaau

SEQ ID NO: 3687286 - RNA, 15 nt, Human
uuugguggcuuugca

SEQ ID NO: 3687287 - RNA, 16 nt, Human
uuuggugucuuucucu

SEQ ID NO: 3687288 - RNA, 12 nt, Human
uuugguguguuc

SEQ ID NO: 3687289 - RNA, 14 nt, Human
uuugguguguuccc

SEQ ID NO: 3687290 - RNA, 18 nt, Human
uuugguuaaaaaaaagaa

SEQ ID NO: 3687291 - RNA, 16 nt, Human
uuugguuaagcuuuga

SEQ ID NO: 3687292 - RNA, 18 nt, Human
uuugguuaagucuguuuu

SEQ ID NO: 3687293 - RNA, 22 nt, Human
uuugguuaaguuggcuucuguu

SEQ ID NO: 3687294 - RNA, 13 nt, Human
uuugguuauagug

SEQ ID NO: 3687295 - RNA, 14 nt, Human
uuugguuauuuuac

SEQ ID NO: 3687296 - RNA, 15 nt, Human
uuugguuccucucug

SEQ ID NO: 3687297 - RNA, 16 nt, Human
uuugguuccucucugg

SEQ ID NO: 3687298 - RNA, 21 nt, Human
uuugguucuuaguucucacug

SEQ ID NO: 3687299 - RNA, 21 nt, Human
uuugguuuauauuuuuucagu

SEQ ID NO: 3687300 - RNA, 21 nt, Human
uuugguuucccaagagcuacg

SEQ ID NO: 3687301 - RNA, 23 nt, Human
uuugguuuuaaaauacuguagau

SEQ ID NO: 3687302 - RNA, 12 nt, Human
uuugguuuuguu

SEQ ID NO: 3687303 - RNA, 14 nt, Human
uuugguuuuguucc

SEQ ID NO: 3687304 - RNA, 21 nt, Human
uuugguuuuguuccccuccuc

SEQ ID NO: 3687305 - RNA, 14 nt, Human
uuuguaaaaaucuu

SEQ ID NO: 3687306 - RNA, 22 nt, Human
uuuguaaaaaucuuuugaagca

SEQ ID NO: 3687307 - RNA, 14 nt, Human
uuuguaaaaaugua

SEQ ID NO: 3687308 - RNA, 15 nt, Human
uuuguaaagaaaaau

SEQ ID NO: 3687309 - RNA, 18 nt, Human
uuuguaaagaaauuuacu

SEQ ID NO: 3687310 - RNA, 21 nt, Human
uuuguaaaggugaaaaaagcu

SEQ ID NO: 3687311 - RNA, 17 nt, Human
uuuguaaaguguggucc

SEQ ID NO: 3687312 - RNA, 17 nt, Human
uuuguaaauaagagauu

SEQ ID NO: 3687313 - RNA, 12 nt, Human
uuuguaaauguu

SEQ ID NO: 3687314 - RNA, 15 nt, Human
uuuguaaauucugau

SEQ ID NO: 3687315 - RNA, 13 nt, Human
uuuguaaauuguc

SEQ ID NO: 3687316 - RNA, 17 nt, Human
uuuguaaauuuauguga

SEQ ID NO: 3687317 - RNA, 15 nt, Human
uuuguaaccucagcu

SEQ ID NO: 3687318 - RNA, 19 nt, Human
uuuguaaccucagcucugg

SEQ ID NO: 3687319 - RNA, 19 nt, Human
uuuguaagaacuaaagaag

SEQ ID NO: 3687320 - RNA, 18 nt, Human
uuuguaagaguguagaag

SEQ ID NO: 3687321 - RNA, 21 nt, Human
uuuguaagugcuacauaaauu

SEQ ID NO: 3687322 - RNA, 16 nt, Human
uuuguaaguugaagca

SEQ ID NO: 3687323 - RNA, 21 nt, Human
uuuguaaguuuaugucuaaag

SEQ ID NO: 3687324 - RNA, 14 nt, Human
uuuguaauaaagua

SEQ ID NO: 3687325 - RNA, 24 nt, Human
uuuguaauuaaauuaugguauuaa

SEQ ID NO: 3687326 - RNA, 15 nt, Human
uuuguaauuuucuug

SEQ ID NO: 3687327 - RNA, 17 nt, Human
uuuguacaagauuguca

SEQ ID NO: 3687328 - RNA, 14 nt, Human
uuuguacagagugc

SEQ ID NO: 3687329 - RNA, 19 nt, Human
uuuguacauauguaaaaua

SEQ ID NO: 3687330 - RNA, 19 nt, Human
uuuguacaucuggcuuauu

SEQ ID NO: 3687331 - RNA, 20 nt, Human
uuuguacaugccauugaaaa

SEQ ID NO: 3687332 - RNA, 11 nt, Human
uuuguacaugu

SEQ ID NO: 3687333 - RNA, 18 nt, Human
uuuguacauuugggaguu

SEQ ID NO: 3687334 - RNA, 19 nt, Human
uuuguaccagugaauuuuu

SEQ ID NO: 3687335 - RNA, 22 nt, Human
uuuguaccagugaauuuuugca

SEQ ID NO: 3687336 - RNA, 14 nt, Human
uuuguaccauggug

SEQ ID NO: 3687337 - RNA, 19 nt, Human
uuuguaccauuuuaaaguu

SEQ ID NO: 3687338 - RNA, 19 nt, Human
uuuguaccccccaaccccu

SEQ ID NO: 3687339 - RNA, 20 nt, Human
uuuguaccccccaaccccug

SEQ ID NO: 3687340 - RNA, 16 nt, Human
uuuguacugaauuuuu

SEQ ID NO: 3687341 - RNA, 18 nt, Human
uuuguacuguuuaauguu

SEQ ID NO: 3687342 - RNA, 12 nt, Human
uuuguacuuucu

SEQ ID NO: 3687343 - RNA, 15 nt, Human
uuuguacuuucuguu

SEQ ID NO: 3687344 - RNA, 16 nt, Human
uuuguacuuucuguua

SEQ ID NO: 3687345 - RNA, 17 nt, Human
uuuguacuuucuguuaa

SEQ ID NO: 3687346 - RNA, 17 nt, Human
uuuguagaagucacauu

SEQ ID NO: 3687347 - RNA, 13 nt, Human
uuuguagagccag

SEQ ID NO: 3687348 - RNA, 23 nt, Human
uuuguaggggucaaagaaaugcu

SEQ ID NO: 3687349 - RNA, 16 nt, Human
uuuguaggguuucuag

SEQ ID NO: 3687350 - RNA, 20 nt, Human
uuuguagguaaaauguauuu

SEQ ID NO: 3687351 - RNA, 16 nt, Human
uuuguagguacuuuug

SEQ ID NO: 3687352 - RNA, 22 nt, Human
uuuguagugauuuuuaugccac

SEQ ID NO: 3687353 - RNA, 23 nt, Human
uuuguaguggaaacauuuauauu

SEQ ID NO: 3687354 - RNA, 19 nt, Human
uuuguaguguuggagaaga

SEQ ID NO: 3687355 - RNA, 12 nt, Human
uuuguaguuuuu

SEQ ID NO: 3687356 - RNA, 14 nt, Human
uuuguauaaaagug

SEQ ID NO: 3687357 - RNA, 17 nt, Human
uuuguauaaaauaauuu

SEQ ID NO: 3687358 - RNA, 19 nt, Human
uuuguauaacuucuuaaaa

SEQ ID NO: 3687359 - RNA, 13 nt, Human
uuuguauaauugg

SEQ ID NO: 3687360 - RNA, 18 nt, Human
uuuguauaauuguaucgu

SEQ ID NO: 3687361 - RNA, 19 nt, Human
uuuguauacaaauauauug

SEQ ID NO: 3687362 - RNA, 22 nt, Human
uuuguauacaaauauauuguua

SEQ ID NO: 3687363 - RNA, 19 nt, Human
uuuguauacauccugggua

SEQ ID NO: 3687364 - RNA, 20 nt, Human
uuuguauacauccuggguaa

SEQ ID NO: 3687365 - RNA, 20 nt, Human
uuuguauacuuuaaauaauu

SEQ ID NO: 3687366 - RNA, 11 nt, Human
uuuguauagaa

SEQ ID NO: 3687367 - RNA, 14 nt, Human
uuuguauaguuaug

SEQ ID NO: 3687368 - RNA, 17 nt, Human
uuuguauaguuauguaa

SEQ ID NO: 3687369 - RNA, 19 nt, Human
uuuguauaguuauguaaau

SEQ ID NO: 3687370 - RNA, 16 nt, Human
uuuguauauuauuucu

SEQ ID NO: 3687371 - RNA, 18 nt, Human
uuuguauauugguuuuau

SEQ ID NO: 3687372 - RNA, 22 nt, Human
uuuguaucugcaggcagacacg

SEQ ID NO: 3687373 - RNA, 13 nt, Human
uuuguaugaaaac

SEQ ID NO: 3687374 - RNA, 16 nt, Human
uuuguaugcacuuugu

SEQ ID NO: 3687375 - RNA, 14 nt, Human
uuuguauguaaaug

SEQ ID NO: 3687376 - RNA, 12 nt, Human
uuuguaugugug

SEQ ID NO: 3687377 - RNA, 12 nt, Human
uuuguauguuuu

SEQ ID NO: 3687378 - RNA, 17 nt, Human
uuuguauucugucuuca

SEQ ID NO: 3687379 - RNA, 22 nt, Human
uuuguauugaaagcuuuuguua

SEQ ID NO: 3687380 - RNA, 22 nt, Human
uuuguauuguccuauuaguguu

SEQ ID NO: 3687381 - RNA, 13 nt, Human
uuuguauuuauuc

SEQ ID NO: 3687382 - RNA, 13 nt, Human
uuuguauuuucau

SEQ ID NO: 3687383 - RNA, 21 nt, Human
uuuguauuuucaugaaaauac

SEQ ID NO: 3687384 - RNA, 17 nt, Human
uuuguauuuuguuuaaa

SEQ ID NO: 3687385 - RNA, 14 nt, Human
uuuguauuuuuagu

SEQ ID NO: 3687386 - RNA, 17 nt, Human
uuugucaaacuguagaa

SEQ ID NO: 3687387 - RNA, 16 nt, Human
uuugucaacauuguga

SEQ ID NO: 3687388 - RNA, 17 nt, Human
uuugucaccagaacaca

SEQ ID NO: 3687389 - RNA, 14 nt, Human
uuugucacuuuuuc

SEQ ID NO: 3687390 - RNA, 15 nt, Human
uuugucacuuuuucu

SEQ ID NO: 3687391 - RNA, 13 nt, Human
uuugucauaucaa

SEQ ID NO: 3687392 - RNA, 21 nt, Human
uuugucaugaauucuuaugcu

SEQ ID NO: 3687393 - RNA, 20 nt, Human
uuugucauuagccugaguag

SEQ ID NO: 3687394 - RNA, 14 nt, Human
uuugucauuuucau

SEQ ID NO: 3687395 - RNA, 16 nt, Human
uuugucauuuucauua

SEQ ID NO: 3687396 - RNA, 12 nt, Human
uuugucauuuug

SEQ ID NO: 3687397 - RNA, 16 nt, Human
uuuguccauuuguaaa

SEQ ID NO: 3687398 - RNA, 17 nt, Human
uuugucccccaacuuga

SEQ ID NO: 3687399 - RNA, 13 nt, Human
uuugucccuucua

SEQ ID NO: 3687400 - RNA, 18 nt, Human
uuuguccuccugcugcca

SEQ ID NO: 3687401 - RNA, 18 nt, Human
uuuguccugcaucaucuu

SEQ ID NO: 3687402 - RNA, 16 nt, Human
uuugucgaauuuuuau

SEQ ID NO: 3687403 - RNA, 19 nt, Human
uuugucgcucaugugugca

SEQ ID NO: 3687404 - RNA, 21 nt, Human
uuugucgggcaccagccagcg

SEQ ID NO: 3687405 - RNA, 15 nt, Human
uuugucuaaaaugcc

SEQ ID NO: 3687406 - RNA, 21 nt, Human
uuugucuacguuuaguuuccg

SEQ ID NO: 3687407 - RNA, 12 nt, Human
uuugucucagau

SEQ ID NO: 3687408 - RNA, 14 nt, Human
uuugucucauccca

SEQ ID NO: 3687409 - RNA, 12 nt, Human
uuugucuccucu

SEQ ID NO: 3687410 - RNA, 16 nt, Human
uuugucucuccuuuuc

SEQ ID NO: 3687411 - RNA, 21 nt, Human
uuugucugccccaaguuuugu

SEQ ID NO: 3687412 - RNA, 13 nt, Human
uuugucugguuaa

SEQ ID NO: 3687413 - RNA, 13 nt, Human
uuugucugucgug

SEQ ID NO: 3687414 - RNA, 18 nt, Human
uuugucuguuuguuucaa

SEQ ID NO: 3687415 - RNA, 15 nt, Human
uuugucuucucccca

SEQ ID NO: 3687416 - RNA, 21 nt, Human
uuugucuuguguuucuuuagu

SEQ ID NO: 3687417 - RNA, 12 nt, Human
uuugugaaauuu

SEQ ID NO: 3687418 - RNA, 18 nt, Human
uuugugaaauuuuucaua

SEQ ID NO: 3687419 - RNA, 14 nt, Human
uuugugaagcccug

SEQ ID NO: 3687420 - RNA, 17 nt, Human
uuugugaauggauugga

SEQ ID NO: 3687421 - RNA, 23 nt, Human
uuugugaauggauuggauuauuu

SEQ ID NO: 3687422 - RNA, 15 nt, Human
uuugugaauuaggcu

SEQ ID NO: 3687423 - RNA, 20 nt, Human
uuugugacuauauagagaug

SEQ ID NO: 3687424 - RNA, 22 nt, Human
uuugugagaaacaucucaauaa

SEQ ID NO: 3687425 - RNA, 18 nt, Human
uuugugaggaagccgcug

SEQ ID NO: 3687426 - RNA, 15 nt, Human
uuugugaguuuguuu

SEQ ID NO: 3687427 - RNA, 16 nt, Human
uuugugauacaaugcu

SEQ ID NO: 3687428 - RNA, 20 nt, Human
uuugugauaugcacaaugua

SEQ ID NO: 3687429 - RNA, 19 nt, Human
uuugugauauggagcccug

SEQ ID NO: 3687430 - RNA, 14 nt, Human
uuugugauucuucc

SEQ ID NO: 3687431 - RNA, 13 nt, Human
uuugugccagccg

SEQ ID NO: 3687432 - RNA, 20 nt, Human
uuugugccuggcuucuuucu

SEQ ID NO: 3687433 - RNA, 20 nt, Human
uuugugcuauaguauuugau

SEQ ID NO: 3687434 - RNA, 23 nt, Human
uuugugcuaucagacuguaggau

SEQ ID NO: 3687435 - RNA, 17 nt, Human
uuuguggaugucuuccu

SEQ ID NO: 3687436 - RNA, 11 nt, Human
uuuguggccaa

SEQ ID NO: 3687437 - RNA, 17 nt, Human
uuugugggaauuuaaga

SEQ ID NO: 3687438 - RNA, 11 nt, Human
uuuguggggag

SEQ ID NO: 3687439 - RNA, 15 nt, Human
uuugugguuuggaau

SEQ ID NO: 3687440 - RNA, 12 nt, Human
uuuguguaaauu

SEQ ID NO: 3687441 - RNA, 21 nt, Human
uuuguguaaauuauugaugaa

SEQ ID NO: 3687442 - RNA, 15 nt, Human
uuuguguaauaaagu

SEQ ID NO: 3687443 - RNA, 17 nt, Human
ucauaacagugccauug

SEQ ID NO: 3687444 - RNA, 18 nt, Human
ucauaacggaucagaaau

SEQ ID NO: 3687445 - RNA, 21 nt, Human
ucauaacggaucagaaauaca

SEQ ID NO: 3687446 - RNA, 21 nt, Human
ucauaacuuauugcugauuuu

SEQ ID NO: 3687447 - RNA, 13 nt, Human
ucauaagcacacu

SEQ ID NO: 3687448 - RNA, 18 nt, Human
ucauaagccaauuuuucu

SEQ ID NO: 3687449 - RNA, 22 nt, Human
ucauaagccaauuuuucugcac

SEQ ID NO: 3687450 - RNA, 23 nt, Human
ucauaagccaauuuuucugcacu

SEQ ID NO: 3687451 - RNA, 12 nt, Human
ucauaaugacuu

SEQ ID NO: 3687452 - RNA, 14 nt, Human
ucauaaugugaagu

SEQ ID NO: 3687453 - RNA, 18 nt, Human
ucauaaugugaaguguua

SEQ ID NO: 3687454 - RNA, 19 nt, Human
ucauaaugugaaguguuaa

SEQ ID NO: 3687455 - RNA, 20 nt, Human
ucauaauuccuacagcacua

SEQ ID NO: 3687456 - RNA, 15 nt, Human
ucauaauuuauacag

SEQ ID NO: 3687457 - RNA, 16 nt, Human
ucauaauuuguuucca

SEQ ID NO: 3687458 - RNA, 23 nt, Human
ucauacaaugacaaguaugauga

SEQ ID NO: 3687459 - RNA, 16 nt, Human
ucauacagagaaguca

SEQ ID NO: 3687460 - RNA, 23 nt, Human
ucauacagagaagucacagggca

SEQ ID NO: 3687461 - RNA, 15 nt, Human
ucauacauuguacga

SEQ ID NO: 3687462 - RNA, 14 nt, Human
ucauacauuuucua

SEQ ID NO: 3687463 - RNA, 15 nt, Human
ucauaccaaugaaaa

SEQ ID NO: 3687464 - RNA, 14 nt, Human
ucauacccaccccc

SEQ ID NO: 3687465 - RNA, 21 nt, Human
ucauacccacccccacccaag

SEQ ID NO: 3687466 - RNA, 15 nt, Human
ucauaccuaaguacu

SEQ ID NO: 3687467 - RNA, 19 nt, Human
ucauaccuaaguacuguaa

SEQ ID NO: 3687468 - RNA, 20 nt, Human
ucauaccuaaguacuguaau

SEQ ID NO: 3687469 - RNA, 15 nt, Human
ucauaccuacaugua

SEQ ID NO: 3687470 - RNA, 21 nt, Human
ucauacuacauugaguagaca

SEQ ID NO: 3687471 - RNA, 17 nt, Human
ucauacuccuaugcuuu

SEQ ID NO: 3687472 - RNA, 13 nt, Human
ucauacugaagau

SEQ ID NO: 3687473 - RNA, 15 nt, Human
ucauacugauguguu

SEQ ID NO: 3687474 - RNA, 19 nt, Human
ucauacugugcuggagcca

SEQ ID NO: 3687475 - RNA, 20 nt, Human
ucauacugugcuggagccac

SEQ ID NO: 3687476 - RNA, 14 nt, Human
ucauacuuaaaaau

SEQ ID NO: 3687477 - RNA, 16 nt, Human
ucauacuuaaaaauuu

SEQ ID NO: 3687478 - RNA, 19 nt, Human
ucauacuuaaaaauuuauu

SEQ ID NO: 3687479 - RNA, 12 nt, Human
ucauacuugaac

SEQ ID NO: 3687480 - RNA, 13 nt, Human
ucauagaaauucu

SEQ ID NO: 3687481 - RNA, 16 nt, Human
ucauagaauagcaugu

SEQ ID NO: 3687482 - RNA, 21 nt, Human
ucauagaauagcauguuguag

SEQ ID NO: 3687483 - RNA, 13 nt, Human
ucauagagacuug

SEQ ID NO: 3687484 - RNA, 14 nt, Human
ucauagagauuugu

SEQ ID NO: 3687485 - RNA, 11 nt, Human
ucauagcagcu

SEQ ID NO: 3687486 - RNA, 14 nt, Human
ucauagcauuaacu

SEQ ID NO: 3687487 - RNA, 22 nt, Human
ucauagcauugucuauuuuucu

SEQ ID NO: 3687488 - RNA, 18 nt, Human
ucauagcccagaucagcu

SEQ ID NO: 3687489 - RNA, 14 nt, Human
ucauagcccaguag

SEQ ID NO: 3687490 - RNA, 21 nt, Human
ucauagcccucacccuggggc

SEQ ID NO: 3687491 - RNA, 17 nt, Human
ucauagcugagauuccu

SEQ ID NO: 3687492 - RNA, 21 nt, Human
ucauagcugguuccugcuaga

SEQ ID NO: 3687493 - RNA, 15 nt, Human
ucauaggaaguuagc

SEQ ID NO: 3687494 - RNA, 21 nt, Human
ucauaggcaccuuuuacugug

SEQ ID NO: 3687495 - RNA, 17 nt, Human
ucauagggucucuucag

SEQ ID NO: 3687496 - RNA, 18 nt, Human
ucauagggucucuucagg

SEQ ID NO: 3687497 - RNA, 20 nt, Human
ucauagggucucuucagguu

SEQ ID NO: 3687498 - RNA, 21 nt, Human
ucauagggucucuucagguuc

SEQ ID NO: 3687499 - RNA, 15 nt, Human
ucauagguugagcaa

SEQ ID NO: 3687500 - RNA, 16 nt, Human
ucauaguaacuucuua

SEQ ID NO: 3687501 - RNA, 20 nt, Human
ucauaguacucuuuguagca

SEQ ID NO: 3687502 - RNA, 22 nt, Human
ucauaguacucuuuguagcaaa

SEQ ID NO: 3687503 - RNA, 14 nt, Human
ucauaguaguuuuu

SEQ ID NO: 3687504 - RNA, 17 nt, Human
ucauaguauccauauuu

SEQ ID NO: 3687505 - RNA, 24 nt, Human
ucauaguauccauauuuuauuacu

SEQ ID NO: 3687506 - RNA, 21 nt, Human
ucauaguaugguggcuggguu

SEQ ID NO: 3687507 - RNA, 18 nt, Human
ucauaguucagaauuuag

SEQ ID NO: 3687508 - RNA, 20 nt, Human
ucauauaaacuuuuuaaaga

SEQ ID NO: 3687509 - RNA, 13 nt, Human
ucauauaaaguau

SEQ ID NO: 3687510 - RNA, 16 nt, Human
ucauauaaaguaucau

SEQ ID NO: 3687511 - RNA, 13 nt, Human
ucauauaaauaga

SEQ ID NO: 3687512 - RNA, 14 nt, Human
ucauauaaauagaa

SEQ ID NO: 3687513 - RNA, 18 nt, Human
ucauauaaauagaaugua

SEQ ID NO: 3687514 - RNA, 16 nt, Human
ucauauaauaaaugua

SEQ ID NO: 3687515 - RNA, 17 nt, Human
ucauauauaucacccag

SEQ ID NO: 3687516 - RNA, 17 nt, Human
ucauauauuaaacaucc

SEQ ID NO: 3687517 - RNA, 14 nt, Human
ucauaucauccaca

SEQ ID NO: 3687518 - RNA, 12 nt, Human
ucauaucauuuc

SEQ ID NO: 3687519 - RNA, 19 nt, Human
ucauaucuuaauauauuuc

SEQ ID NO: 3687520 - RNA, 11 nt, Human
ucauaugaaaa

SEQ ID NO: 3687521 - RNA, 16 nt, Human
ucauaugaaaggugcc

SEQ ID NO: 3687522 - RNA, 17 nt, Human
ucauauggcccaguguc

SEQ ID NO: 3687523 - RNA, 12 nt, Human
ucauaugugauc

SEQ ID NO: 3687524 - RNA, 23 nt, Human
ucauaugugaucugucuuguaau

SEQ ID NO: 3687525 - RNA, 15 nt, Human
ucauauguugcucag

SEQ ID NO: 3687526 - RNA, 18 nt, Human
ucauauguugcucagucu

SEQ ID NO: 3687527 - RNA, 18 nt, Human
ucauauuagacuucuguu

SEQ ID NO: 3687528 - RNA, 18 nt, Human
ucauauuggaaaaaucac

SEQ ID NO: 3687529 - RNA, 21 nt, Human
ucauauugguauauccuuuuc

SEQ ID NO: 3687530 - RNA, 14 nt, Human
ucauauugugccaa

SEQ ID NO: 3687531 - RNA, 12 nt, Human
ucauauuuaaag

SEQ ID NO: 3687532 - RNA, 15 nt, Human
ucauauuuacuucuu

SEQ ID NO: 3687533 - RNA, 21 nt, Human
ucauauuucccaugauuucau

SEQ ID NO: 3687534 - RNA, 20 nt, Human
ucauauuugaggaguguuaa

SEQ ID NO: 3687535 - RNA, 17 nt, Human
ucauauuuuaauuucaa

SEQ ID NO: 3687536 - RNA, 12 nt, Human
ucauauuuugau

SEQ ID NO: 3687537 - RNA, 14 nt, Human
ucauauuuugauua

SEQ ID NO: 3687538 - RNA, 19 nt, Human
ucauauuuugauuauugua

SEQ ID NO: 3687539 - RNA, 23 nt, Human
ucauauuuuguauauaucugcuu

SEQ ID NO: 3687540 - RNA, 22 nt, Human
ucauauuuuucauagcuaaaaa

SEQ ID NO: 3687541 - RNA, 19 nt, Human
ucaucaacaagauuuccuu

SEQ ID NO: 3687542 - RNA, 13 nt, Human
ucaucaacugaau

SEQ ID NO: 3687543 - RNA, 11 nt, Human
ucaucaagacu

SEQ ID NO: 3687544 - RNA, 19 nt, Human
ucaucaagacuggaaggug

SEQ ID NO: 3687545 - RNA, 13 nt, Human
ucaucaagagaau

SEQ ID NO: 3687546 - RNA, 21 nt, Human
ucaucaagagaauuuggggcu

SEQ ID NO: 3687547 - RNA, 21 nt, Human
ucaucaaggcacugccugaug

SEQ ID NO: 3687548 - RNA, 21 nt, Human
ucaucaagggugcgucuggga

SEQ ID NO: 3687549 - RNA, 14 nt, Human
ucaucaaucauugu

SEQ ID NO: 3687550 - RNA, 16 nt, Human
ucaucaaucauuguac

SEQ ID NO: 3687551 - RNA, 15 nt, Human
ucaucacaagaacac

SEQ ID NO: 3687552 - RNA, 12 nt, Human
ucaucacacaca

SEQ ID NO: 3687553 - RNA, 13 nt, Human
ucaucacacacau

SEQ ID NO: 3687554 - RNA, 14 nt, Human
ucaucacacacaug

SEQ ID NO: 3687555 - RNA, 15 nt, Human
ucaucacagggauuu

SEQ ID NO: 3687556 - RNA, 23 nt, Human
ucaucacauuucuaugccaaaca

SEQ ID NO: 3687557 - RNA, 19 nt, Human
ucaucaccaacgucugugc

SEQ ID NO: 3687558 - RNA, 20 nt, Human
ucaucaccaacgucugugcc

SEQ ID NO: 3687559 - RNA, 15 nt, Human
ucaucacuccccucc

SEQ ID NO: 3687560 - RNA, 17 nt, Human
ucaucacuguggcuguc

SEQ ID NO: 3687561 - RNA, 21 nt, Human
ucaucacuuugaccuaaauua

SEQ ID NO: 3687562 - RNA, 15 nt, Human
ucaucacuuuucagu

SEQ ID NO: 3687563 - RNA, 19 nt, Human
ucaucagaaaggaaaaaca

SEQ ID NO: 3687564 - RNA, 13 nt, Human
ucaucagaagugg

SEQ ID NO: 3687565 - RNA, 22 nt, Human
ucaucagauggaaauauuuuga

SEQ ID NO: 3687566 - RNA, 16 nt, Human
ucaucagccaccaucc

SEQ ID NO: 3687567 - RNA, 18 nt, Human
ucaucagccaccauccua

SEQ ID NO: 3687568 - RNA, 16 nt, Human
ucaucagggccugggg

SEQ ID NO: 3687569 - RNA, 17 nt, Human
ucaucaggggccugcag

SEQ ID NO: 3687570 - RNA, 16 nt, Human
ucaucaguauugaagc

SEQ ID NO: 3687571 - RNA, 16 nt, Human
ucaucaguguuaaaaa

SEQ ID NO: 3687572 - RNA, 11 nt, Human
ucaucaucagg

SEQ ID NO: 3687573 - RNA, 13 nt, Human
ucaucaucagggc

SEQ ID NO: 3687574 - RNA, 14 nt, Human
ucaucauccuaagc

SEQ ID NO: 3687575 - RNA, 18 nt, Human
ucaucaugaguucugcug

SEQ ID NO: 3687576 - RNA, 15 nt, Human
ucaucauucccucuc

SEQ ID NO: 3687577 - RNA, 13 nt, Human
ucaucauucucug

SEQ ID NO: 3687578 - RNA, 19 nt, Human
ucauccaauccucacuggg

SEQ ID NO: 3687579 - RNA, 19 nt, Human
ucauccacauuguuuuaaa

SEQ ID NO: 3687580 - RNA, 14 nt, Human
ucauccaccccauc

SEQ ID NO: 3687581 - RNA, 16 nt, Human
ucauccaccccauccc

SEQ ID NO: 3687582 - RNA, 22 nt, Human
ucauccacuagugcaaaucaua

SEQ ID NO: 3687583 - RNA, 19 nt, Human
ucauccacugugccaugug

SEQ ID NO: 3687584 - RNA, 19 nt, Human
ucauccagacucagagcuc

SEQ ID NO: 3687585 - RNA, 21 nt, Human
ucauccagggcucugaccagu

SEQ ID NO: 3687586 - RNA, 18 nt, Human
ucaucccacgcacuccau

SEQ ID NO: 3687587 - RNA, 12 nt, Human
ucaucccacucc

SEQ ID NO: 3687588 - RNA, 14 nt, Human
ucaucccauuccag

SEQ ID NO: 3687589 - RNA, 18 nt, Human
ucaucccauucugcguca

SEQ ID NO: 3687590 - RNA, 20 nt, Human
ucauccccaccugucuucaa

SEQ ID NO: 3687591 - RNA, 14 nt, Human
ucauccccaccuug

SEQ ID NO: 3687592 - RNA, 21 nt, Human
ucaucccuaugggauucagug

SEQ ID NO: 3687593 - RNA, 21 nt, Human
ucaucccuucucuuccaggca

SEQ ID NO: 3687594 - RNA, 23 nt, Human
uuuguguaauauuacuuuaacau

SEQ ID NO: 3687595 - RNA, 14 nt, Human
uuuguguacagugu

SEQ ID NO: 3687596 - RNA, 14 nt, Human
uuuguguacuuuua

SEQ ID NO: 3687597 - RNA, 18 nt, Human
uuuguguccuccaggagc

SEQ ID NO: 3687598 - RNA, 20 nt, Human
uuugugugaccaacuguguu

SEQ ID NO: 3687599 - RNA, 14 nt, Human
uuugugugagagac

SEQ ID NO: 3687600 - RNA, 14 nt, Human
uuugugugcucucc

SEQ ID NO: 3687601 - RNA, 20 nt, Human
uuuguguggagucauuucug

SEQ ID NO: 3687602 - RNA, 16 nt, Human
uuuguguguauuugcu

SEQ ID NO: 3687603 - RNA, 18 nt, Human
uuuguguguugucuugaa

SEQ ID NO: 3687604 - RNA, 19 nt, Human
uuuguguguugucuugaaa

SEQ ID NO: 3687605 - RNA, 12 nt, Human
uuuguguuagag

SEQ ID NO: 3687606 - RNA, 13 nt, Human
uuuguguucuguu

SEQ ID NO: 3687607 - RNA, 19 nt, Human
uuuguguucuguuuguuaa

SEQ ID NO: 3687608 - RNA, 14 nt, Human
uuuguguuguuuga

SEQ ID NO: 3687609 - RNA, 22 nt, Human
uuuguguuuauucuugaugaaa

SEQ ID NO: 3687610 - RNA, 22 nt, Human
uuuguguuucagccauguauuu

SEQ ID NO: 3687611 - RNA, 21 nt, Human
uuuguguuugguuuacauuua

SEQ ID NO: 3687612 - RNA, 13 nt, Human
uuuguuaaaaucu

SEQ ID NO: 3687613 - RNA, 22 nt, Human
uuuguuaaaauuaucaauaucu

SEQ ID NO: 3687614 - RNA, 18 nt, Human
uuuguuaagguccugaaa

SEQ ID NO: 3687615 - RNA, 17 nt, Human
uuuguuaauaaagugca

SEQ ID NO: 3687616 - RNA, 21 nt, Human
uuuguuaauuuagaaaacuuu

SEQ ID NO: 3687617 - RNA, 20 nt, Human
uuuguuaauuuggaccauuu

SEQ ID NO: 3687618 - RNA, 17 nt, Human
uuuguuaccuuaaaacu

SEQ ID NO: 3687619 - RNA, 16 nt, Human
uuuguuacucuuggga

SEQ ID NO: 3687620 - RNA, 17 nt, Human
uuuguuacuguucuugc

SEQ ID NO: 3687621 - RNA, 20 nt, Human
uuuguuacuguucuugcugc

SEQ ID NO: 3687622 - RNA, 21 nt, Human
uuuguuacuguucuugcugcu

SEQ ID NO: 3687623 - RNA, 22 nt, Human
uuuguuacuguucuugcugcua

SEQ ID NO: 3687624 - RNA, 22 nt, Human
uuuguuaggauuuucacauucu

SEQ ID NO: 3687625 - RNA, 15 nt, Human
uuuguuaguuccugu

SEQ ID NO: 3687626 - RNA, 19 nt, Human
uuuguuauuuguacaguuc

SEQ ID NO: 3687627 - RNA, 17 nt, Human
uuuguucaaguuuuggg

SEQ ID NO: 3687628 - RNA, 15 nt, Human
uuuguucauguuugg

SEQ ID NO: 3687629 - RNA, 17 nt, Human
uuuguuccccacuggag

SEQ ID NO: 3687630 - RNA, 18 nt, Human
uuuguuccccuccuccac

SEQ ID NO: 3687631 - RNA, 13 nt, Human
uuuguucucuggg

SEQ ID NO: 3687632 - RNA, 13 nt, Human
uuuguucucuguc

SEQ ID NO: 3687633 - RNA, 19 nt, Human
uuuguucuuacacauacag

SEQ ID NO: 3687634 - RNA, 18 nt, Human
uuuguucuucagagauca

SEQ ID NO: 3687635 - RNA, 14 nt, Human
uuuguucuuuuuau

SEQ ID NO: 3687636 - RNA, 16 nt, Human
uuuguugaaagaaagu

SEQ ID NO: 3687637 - RNA, 16 nt, Human
uuuguugacauucuga

SEQ ID NO: 3687638 - RNA, 19 nt, Human
uuuguugacauucugaaug

SEQ ID NO: 3687639 - RNA, 16 nt, Human
uuuguugcaagaugug

SEQ ID NO: 3687640 - RNA, 19 nt, Human
uuuguugcaagaugugaau

SEQ ID NO: 3687641 - RNA, 14 nt, Human
uuuguugcuguuuu

SEQ ID NO: 3687642 - RNA, 20 nt, Human
uuuguugguuuuuaaagauu

SEQ ID NO: 3687643 - RNA, 12 nt, Human
uuuguuguaaaa

SEQ ID NO: 3687644 - RNA, 15 nt, Human
uuuguuguaaaaaga

SEQ ID NO: 3687645 - RNA, 15 nt, Human
uuuguuguaaagagu

SEQ ID NO: 3687646 - RNA, 16 nt, Human
uuuguuguaaagaguu

SEQ ID NO: 3687647 - RNA, 16 nt, Human
uuuguugucagcugaa

SEQ ID NO: 3687648 - RNA, 20 nt, Human
uuuguuuaaaaaguaauaaa

SEQ ID NO: 3687649 - RNA, 19 nt, Human
uuuguuuaauggacacuuu

SEQ ID NO: 3687650 - RNA, 12 nt, Human
uuuguuuacaca

SEQ ID NO: 3687651 - RNA, 21 nt, Human
uuuguuuaugguaaaaaauuu

SEQ ID NO: 3687652 - RNA, 15 nt, Human
uuuguuuauguaauu

SEQ ID NO: 3687653 - RNA, 21 nt, Human
uuuguuucaagaaccuggaaa

SEQ ID NO: 3687654 - RNA, 17 nt, Human
uuuguuuccucuguuca

SEQ ID NO: 3687655 - RNA, 15 nt, Human
uuuguuucuaccucc

SEQ ID NO: 3687656 - RNA, 16 nt, Human
uuuguuucugaaaauu

SEQ ID NO: 3687657 - RNA, 14 nt, Human
uuuguuucugaaag

SEQ ID NO: 3687658 - RNA, 17 nt, Human
uuuguuucugagaaaag

SEQ ID NO: 3687659 - RNA, 12 nt, Human
uuuguuucugua

SEQ ID NO: 3687660 - RNA, 16 nt, Human
uuuguuucuuccaaag

SEQ ID NO: 3687661 - RNA, 22 nt, Human
uuuguuucuuugaauuuucauu

SEQ ID NO: 3687662 - RNA, 15 nt, Human
uuuguuugguauugu

SEQ ID NO: 3687663 - RNA, 12 nt, Human
uuuguuugugcu

SEQ ID NO: 3687664 - RNA, 13 nt, Human
uuuguuuguucuu

SEQ ID NO: 3687665 - RNA, 13 nt, Human
uuuguuuucuuug

SEQ ID NO: 3687666 - RNA, 18 nt, Human
uuuguuuugcuuuuucug

SEQ ID NO: 3687667 - RNA, 13 nt, Human
uuuguuuuguguc

SEQ ID NO: 3687668 - RNA, 20 nt, Human
uuuguuuuuaaacuguacag

SEQ ID NO: 3687669 - RNA, 15 nt, Human
uuuuauuccacaucu

SEQ ID NO: 3687670 - RNA, 23 nt, Human
uuuuauuccugcccugcuguuua

SEQ ID NO: 3687671 - RNA, 18 nt, Human
uuuuauuccuguauguug

SEQ ID NO: 3687672 - RNA, 13 nt, Human
uuuuauucuuuuu

SEQ ID NO: 3687673 - RNA, 12 nt, Human
uuuuauugccuu

SEQ ID NO: 3687674 - RNA, 13 nt, Human
uuuuauugccuuc

SEQ ID NO: 3687675 - RNA, 22 nt, Human
uuuuauugccuucucaccagcu

SEQ ID NO: 3687676 - RNA, 23 nt, Human
uuuuauugccuucucaccagcug

SEQ ID NO: 3687677 - RNA, 12 nt, Human
uuuuauugcuag

SEQ ID NO: 3687678 - RNA, 23 nt, Human
uuuuauugcuaguauuugaauua

SEQ ID NO: 3687679 - RNA, 16 nt, Human
uuuuauuguaacagac

SEQ ID NO: 3687680 - RNA, 21 nt, Human
uuuuauuguaacagacauugu

SEQ ID NO: 3687681 - RNA, 20 nt, Human
uuuuauuguauaaacuauca

SEQ ID NO: 3687682 - RNA, 13 nt, Human
uuuuauuguugua

SEQ ID NO: 3687683 - RNA, 20 nt, Human
uuuuauuguuuaaagcaacu

SEQ ID NO: 3687684 - RNA, 12 nt, Human
uuuuauuguuuu

SEQ ID NO: 3687685 - RNA, 15 nt, Human
uuuuauuguuuucua

SEQ ID NO: 3687686 - RNA, 13 nt, Human
uuuuauuuaaaaa

SEQ ID NO: 3687687 - RNA, 14 nt, Human
uuuuauuuauaugu

SEQ ID NO: 3687688 - RNA, 14 nt, Human
uuuuauuucaaugu

SEQ ID NO: 3687689 - RNA, 14 nt, Human
uuuuauuucauugg

SEQ ID NO: 3687690 - RNA, 18 nt, Human
uuuuauuuccuaugaugu

SEQ ID NO: 3687691 - RNA, 15 nt, Human
uuuuauuugcaugug

SEQ ID NO: 3687692 - RNA, 16 nt, Human
uuuuauuuuacuuuua

SEQ ID NO: 3687693 - RNA, 14 nt, Human
uuuuauuuugccaa

SEQ ID NO: 3687694 - RNA, 20 nt, Human
uuuuauuuuguaauuauugu

SEQ ID NO: 3687695 - RNA, 18 nt, Human
uuuuauuuuuagacagag

SEQ ID NO: 3687696 - RNA, 13 nt, Human
uuuuauuuuucua

SEQ ID NO: 3687697 - RNA, 16 nt, Human
uuuuauuuuuuauaca

SEQ ID NO: 3687698 - RNA, 14 nt, Human
uuuucaaaagauaa

SEQ ID NO: 3687699 - RNA, 15 nt, Human
uuuucaaaagauaau

SEQ ID NO: 3687700 - RNA, 20 nt, Human
uuuucaaaauagaaaaguua

SEQ ID NO: 3687701 - RNA, 21 nt, Human
uuuucaaaauuguuacaaauu

SEQ ID NO: 3687702 - RNA, 14 nt, Human
uuuucaaauuguau

SEQ ID NO: 3687703 - RNA, 19 nt, Human
uuuucaaccccacccuguu

SEQ ID NO: 3687704 - RNA, 13 nt, Human
uuuucaacugcca

SEQ ID NO: 3687705 - RNA, 23 nt, Human
uuuucaacugccaaaaugcucua

SEQ ID NO: 3687706 - RNA, 15 nt, Human
uuuucaagaaacuga

SEQ ID NO: 3687707 - RNA, 15 nt, Human
uuuucaagcagcauc

SEQ ID NO: 3687708 - RNA, 13 nt, Human
uuuucaaggaagg

SEQ ID NO: 3687709 - RNA, 18 nt, Human
uuuucaaggcuuauauuc

SEQ ID NO: 3687710 - RNA, 17 nt, Human
uuuucaaguauuuaagc

SEQ ID NO: 3687711 - RNA, 20 nt, Human
uuuucaaguauuuaagccua

SEQ ID NO: 3687712 - RNA, 16 nt, Human
uuuucaauagccacua

SEQ ID NO: 3687713 - RNA, 15 nt, Human
uuuucaauauauuga

SEQ ID NO: 3687714 - RNA, 21 nt, Human
uuuucaauauauugaacuuuu

SEQ ID NO: 3687715 - RNA, 24 nt, Human
uuuucaaucucguauagaagucuu

SEQ ID NO: 3687716 - RNA, 13 nt, Human
uuuucaaugugau

SEQ ID NO: 3687717 - RNA, 12 nt, Human
uuuucaauuaaa

SEQ ID NO: 3687718 - RNA, 16 nt, Human
uuuucaauuaaacgga

SEQ ID NO: 3687719 - RNA, 17 nt, Human
uuuucaauucaaaaaug

SEQ ID NO: 3687720 - RNA, 14 nt, Human
uuuucaauuuugca

SEQ ID NO: 3687721 - RNA, 18 nt, Human
uuuucaauuuugcaugcu

SEQ ID NO: 3687722 - RNA, 20 nt, Human
uuuucacaaugucaguauuu

SEQ ID NO: 3687723 - RNA, 22 nt, Human
uuuucacauucuuauaaauaug

SEQ ID NO: 3687724 - RNA, 23 nt, Human
uuuucacauucuuauaaauauga

SEQ ID NO: 3687725 - RNA, 12 nt, Human
uuuucacauuuu

SEQ ID NO: 3687726 - RNA, 23 nt, Human
uuuucaccuggaagcauuuguuu

SEQ ID NO: 3687727 - RNA, 23 nt, Human
uuuucaccuguuuuuaagcuguu

SEQ ID NO: 3687728 - RNA, 23 nt, Human
uuuucacucuaagucauguaugu

SEQ ID NO: 3687729 - RNA, 21 nt, Human
uuuucacuggaguuacauuaa

SEQ ID NO: 3687730 - RNA, 18 nt, Human
uuuucagaaaaagaaaug

SEQ ID NO: 3687731 - RNA, 15 nt, Human
uuuucagaaauaugu

SEQ ID NO: 3687732 - RNA, 11 nt, Human
uuuucagaccg

SEQ ID NO: 3687733 - RNA, 16 nt, Human
uuuucagacucagacu

SEQ ID NO: 3687734 - RNA, 18 nt, Human
uuuucagacugcuuuaaa

SEQ ID NO: 3687735 - RNA, 19 nt, Human
uuuucagauauaaaagacu

SEQ ID NO: 3687736 - RNA, 18 nt, Human
uuuucagauucaggcauu

SEQ ID NO: 3687737 - RNA, 13 nt, Human
uuuucagauuugc

SEQ ID NO: 3687738 - RNA, 19 nt, Human
uuuucagcaaacucuuuuc

SEQ ID NO: 3687739 - RNA, 19 nt, Human
uuuucagcccauauuucau

SEQ ID NO: 3687740 - RNA, 23 nt, Human
uuuucagcuaggaacaaaucuuc

SEQ ID NO: 3687741 - RNA, 17 nt, Human
uuuucaggagcgcaaga

SEQ ID NO: 3687742 - RNA, 22 nt, Human
uuuucaggagcgcaagauagau

SEQ ID NO: 3687743 - RNA, 20 nt, Human
uuuucaggcuagauguaugu

SEQ ID NO: 3687744 - RNA, 22 nt, Human
uuuucagggcuggcuccugauc

SEQ ID NO: 3687745 - RNA, 21 nt, Human
uuuucaggugcucaaaaugca

SEQ ID NO: 3687746 - RNA, 16 nt, Human
uuuucaguauuuugga

SEQ ID NO: 3687747 - RNA, 15 nt, Human
uuuucagucauauaa

SEQ ID NO: 3687748 - RNA, 13 nt, Human
uuuucaguuacuu

SEQ ID NO: 3687749 - RNA, 23 nt, Human
uuuucaguucaaagucaugaugu

SEQ ID NO: 3687750 - RNA, 24 nt, Human
uuuucaguucaaagucaugauguu

SEQ ID NO: 3687751 - RNA, 12 nt, Human
uuuucaguuuuc

SEQ ID NO: 3687752 - RNA, 14 nt, Human
uuuucauaaacaag

SEQ ID NO: 3687753 - RNA, 12 nt, Human
uuuucauaauaa

SEQ ID NO: 3687754 - RNA, 16 nt, Human
uuuucauaggaagaca

SEQ ID NO: 3687755 - RNA, 17 nt, Human
uuuucauaggucugaaa

SEQ ID NO: 3687756 - RNA, 13 nt, Human
uuuucauaucauu

SEQ ID NO: 3687757 - RNA, 19 nt, Human
uuuucauauuuuaauuuca

SEQ ID NO: 3687758 - RNA, 13 nt, Human
uuuucauccuaaa

SEQ ID NO: 3687759 - RNA, 15 nt, Human
uuuucaucuguuguu

SEQ ID NO: 3687760 - RNA, 21 nt, Human
uuuucaucuucaguugucucu

SEQ ID NO: 3687761 - RNA, 21 nt, Human
uuuucaucuucucuggcgaca

SEQ ID NO: 3687762 - RNA, 13 nt, Human
uuuucaugaaaau

SEQ ID NO: 3687763 - RNA, 21 nt, Human
uuuucaugauuuugaaaucau

SEQ ID NO: 3687764 - RNA, 16 nt, Human
uuuucaugcuuuauca

SEQ ID NO: 3687765 - RNA, 21 nt, Human
uuuucauggugaaaauguacu

SEQ ID NO: 3687766 - RNA, 12 nt, Human
uuuucauguuuu

SEQ ID NO: 3687767 - RNA, 19 nt, Human
uuuucauguuuuaacaaaa

SEQ ID NO: 3687768 - RNA, 23 nt, Human
uuuucauuagcaaaaaaaguugu

SEQ ID NO: 3687769 - RNA, 15 nt, Human
uuuucauuauuuuau

SEQ ID NO: 3687770 - RNA, 21 nt, Human
uuuucauucagguauuuguaa

SEQ ID NO: 3687771 - RNA, 17 nt, Human
uuuucauuccuaaagaa

SEQ ID NO: 3687772 - RNA, 13 nt, Human
uuuucauuugccu

SEQ ID NO: 3687773 - RNA, 15 nt, Human
uuuucauuugccuau

SEQ ID NO: 3687774 - RNA, 16 nt, Human
uuuucauuuucugcaa

SEQ ID NO: 3687775 - RNA, 21 nt, Human
uuuuccaaaaaaauacugcca

SEQ ID NO: 3687776 - RNA, 19 nt, Human
uuuuccaaaacaaaaagau

SEQ ID NO: 3687777 - RNA, 11 nt, Human
uuuuccaaaug

SEQ ID NO: 3687778 - RNA, 22 nt, Human
uuuuccaaauguaauaaacuuu

SEQ ID NO: 3687779 - RNA, 18 nt, Human
uuuuccaacuacuaauag

SEQ ID NO: 3687780 - RNA, 22 nt, Human
uuuuccacaagauucccagaga

SEQ ID NO: 3687781 - RNA, 13 nt, Human
uuuuccacuacug

SEQ ID NO: 3687782 - RNA, 13 nt, Human
uuuuccaggcugg

SEQ ID NO: 3687783 - RNA, 17 nt, Human
uuuuccaggcuucugcu

SEQ ID NO: 3687784 - RNA, 14 nt, Human
uuuuccauaaagaa

SEQ ID NO: 3687785 - RNA, 15 nt, Human
uuuuccaucuaaaaa

SEQ ID NO: 3687786 - RNA, 19 nt, Human
uuuuccaugaaaaugcaac

SEQ ID NO: 3687787 - RNA, 21 nt, Human
uuuuccauggcaggaaggcuu

SEQ ID NO: 3687788 - RNA, 14 nt, Human
uuuuccauguaucu

SEQ ID NO: 3687789 - RNA, 18 nt, Human
uuuuccauuaugcuguag

SEQ ID NO: 3687790 - RNA, 17 nt, Human
uuuuccauuguuugaaa

SEQ ID NO: 3687791 - RNA, 21 nt, Human
uuuucccaauagcacuuucau

SEQ ID NO: 3687792 - RNA, 17 nt, Human
uuuucccacuccaagcc

SEQ ID NO: 3687793 - RNA, 18 nt, Human
uuuucccagcuacaccuu

SEQ ID NO: 3687794 - RNA, 19 nt, Human
uuuucccagcuacaccuuu

SEQ ID NO: 3687795 - RNA, 15 nt, Human
uuuucccauuuguaa

SEQ ID NO: 3687796 - RNA, 16 nt, Human
uuuucccccaaagugg

SEQ ID NO: 3687797 - RNA, 18 nt, Human
uuuuccccccacucuccc

SEQ ID NO: 3687798 - RNA, 19 nt, Human
uuuuccccggucccuugag

SEQ ID NO: 3687799 - RNA, 12 nt, Human
uuuuccccuccc

SEQ ID NO: 3687800 - RNA, 22 nt, Human
uuuucccucuuuggcuccccug

SEQ ID NO: 3687801 - RNA, 15 nt, Human
uuuucccucuuuucu

SEQ ID NO: 3687802 - RNA, 22 nt, Human
uuuucccugaaguuauguguau

SEQ ID NO: 3687803 - RNA, 14 nt, Human
uuuucccuuugccu

SEQ ID NO: 3687804 - RNA, 18 nt, Human
uuuuccgcauucuuugua

SEQ ID NO: 3687805 - RNA, 15 nt, Human
uuuuccuaaauguau

SEQ ID NO: 3687806 - RNA, 17 nt, Human
uuuuccuaucauguuaa

SEQ ID NO: 3687807 - RNA, 13 nt, Human
uuuuccucccuca

SEQ ID NO: 3687808 - RNA, 20 nt, Human
uuuuccucccuucugcuacu

SEQ ID NO: 3687809 - RNA, 21 nt, Human
uuuuccucccuucugcuacug

SEQ ID NO: 3687810 - RNA, 22 nt, Human
uuuuccucccuuggguucugau

SEQ ID NO: 3687811 - RNA, 21 nt, Human
uuuuccucgcuucuuucaagg

SEQ ID NO: 3687812 - RNA, 13 nt, Human
uuuuccugaaaac

SEQ ID NO: 3687813 - RNA, 13 nt, Human
uuuuccuguccuc

SEQ ID NO: 3687814 - RNA, 22 nt, Human
uuuuccuguccucuuucagcuc

SEQ ID NO: 3687815 - RNA, 12 nt, Human
uuuuccugugga

SEQ ID NO: 3687816 - RNA, 18 nt, Human
uuuuccuguuucugaaaa

SEQ ID NO: 3687817 - RNA, 15 nt, Human
uuuuccuugaagccg

SEQ ID NO: 3687818 - RNA, 21 nt, Human
uuuuccuuuaaaaaaauuuaa

SEQ ID NO: 3687819 - RNA, 14 nt, Human
uuuucgaaaaucaa

SEQ ID NO: 3687820 - RNA, 21 nt, Human
uuuucggaggccccacugaug

SEQ ID NO: 3687821 - RNA, 18 nt, Human
uuuucuaaacguaagcac

SEQ ID NO: 3687822 - RNA, 23 nt, Human
uuuucuaaacguaagcacuguuu

SEQ ID NO: 3687823 - RNA, 12 nt, Human
uuuucuaaagua

SEQ ID NO: 3687824 - RNA, 15 nt, Human
uuuucuaaauuuauc

SEQ ID NO: 3687825 - RNA, 13 nt, Human
uuuucuaagagaa

SEQ ID NO: 3687826 - RNA, 13 nt, Human
uuuucuacaguua

SEQ ID NO: 3687827 - RNA, 16 nt, Human
uuuucuacauuauugc

SEQ ID NO: 3687828 - RNA, 13 nt, Human
uuuucuacucgag

SEQ ID NO: 3687829 - RNA, 23 nt, Human
uuuucuacucgaguuacagacaa

SEQ ID NO: 3687830 - RNA, 18 nt, Human
uuuucuagacuuucuguu

SEQ ID NO: 3687831 - RNA, 19 nt, Human
uuuucuagauacaauaaau

SEQ ID NO: 3687832 - RNA, 12 nt, Human
uuuucuagugua

SEQ ID NO: 3687833 - RNA, 13 nt, Human
uuuucuaguguau

SEQ ID NO: 3687834 - RNA, 17 nt, Human
uuuucuaguguaucaaa

SEQ ID NO: 3687835 - RNA, 12 nt, Human
uuuucuauguac

SEQ ID NO: 3687836 - RNA, 18 nt, Human
uuuucuauguacuaguac

SEQ ID NO: 3687837 - RNA, 13 nt, Human
uuuucuauuaaaa

SEQ ID NO: 3687838 - RNA, 18 nt, Human
uuuucuauuaaaagacuc

SEQ ID NO: 3687839 - RNA, 19 nt, Human
uuuucuauuaaaagacuca

SEQ ID NO: 3687840 - RNA, 19 nt, Human
uuuucuauuauggaaaacu

SEQ ID NO: 3687841 - RNA, 23 nt, Human
uuuucuauuauggaaaacugugu

SEQ ID NO: 3687842 - RNA, 17 nt, Human
uuuucuauuuaugccuu

SEQ ID NO: 3687843 - RNA, 20 nt, Human
uuuucucaaaguuuugaaaa

SEQ ID NO: 3687844 - RNA, 22 nt, Human
uuuucucccuggauuuuuacca

SEQ ID NO: 3687845 - RNA, 13 nt, Human
uuuucuccuccca

SEQ ID NO: 3687846 - RNA, 19 nt, Human
uuuucuccucccaggaacu

SEQ ID NO: 3687847 - RNA, 18 nt, Human
uuuucucuguacuuuuca

SEQ ID NO: 3687848 - RNA, 14 nt, Human
uuuucucuucauau

SEQ ID NO: 3687849 - RNA, 12 nt, Human
uuuucucuuucu

SEQ ID NO: 3687850 - RNA, 14 nt, Human
uuuucugaaguugu

SEQ ID NO: 3687851 - RNA, 16 nt, Human
uuuucugaaucuucug

SEQ ID NO: 3687852 - RNA, 15 nt, Human
uuuucugagaaagac

SEQ ID NO: 3687853 - RNA, 18 nt, Human
uuuucugagaaagacuau

SEQ ID NO: 3687854 - RNA, 11 nt, Human
uuuucugauua

SEQ ID NO: 3687855 - RNA, 18 nt, Human
uuuucugauuagcuuugu

SEQ ID NO: 3687856 - RNA, 21 nt, Human
uuuucugauuguaacguugcu

SEQ ID NO: 3687857 - RNA, 16 nt, Human
uuuucugcaagccugc

SEQ ID NO: 3687858 - RNA, 13 nt, Human
uuuucugcacuau

SEQ ID NO: 3687859 - RNA, 22 nt, Human
uuuucugcuuuagacuugaaaa

SEQ ID NO: 3687860 - RNA, 21 nt, Human
uuuucuggguaggacuuuggu

SEQ ID NO: 3687861 - RNA, 15 nt, Human
uuuucugguucuaac

SEQ ID NO: 3687862 - RNA, 16 nt, Human
uuuucuguagucauuu

SEQ ID NO: 3687863 - RNA, 20 nt, Human
uuuucugucagaugagaaca

SEQ ID NO: 3687864 - RNA, 15 nt, Human
uuuucugucucugcc

SEQ ID NO: 3687865 - RNA, 17 nt, Human
uuuucugugccugaaua

SEQ ID NO: 3687866 - RNA, 15 nt, Human
uuuucuguguaacca

SEQ ID NO: 3687867 - RNA, 21 nt, Human
uuuucuguguaaccauuuuau

SEQ ID NO: 3687868 - RNA, 16 nt, Human
uuuucuguguguuccu

SEQ ID NO: 3687869 - RNA, 23 nt, Human
uuuucuguuacuuuguuuuuuaa

SEQ ID NO: 3687870 - RNA, 21 nt, Human
uuuucuuaaccagaucauugu

SEQ ID NO: 3687871 - RNA, 17 nt, Human
uuuucuuaaccaucuuu

SEQ ID NO: 3687872 - RNA, 16 nt, Human
uuuucuuacuccuccu

SEQ ID NO: 3687873 - RNA, 13 nt, Human
uuuucuucaucaa

SEQ ID NO: 3687874 - RNA, 14 nt, Human
uuuucuucucccuc

SEQ ID NO: 3687875 - RNA, 16 nt, Human
uuuucuugauaauuuu

SEQ ID NO: 3687876 - RNA, 14 nt, Human
uuuucuugcauuga

SEQ ID NO: 3687877 - RNA, 18 nt, Human
uuuucuugccucuguccc

SEQ ID NO: 3687878 - RNA, 11 nt, Human
uuuucuuguau

SEQ ID NO: 3687879 - RNA, 15 nt, Human
uuuucuuuagagaac

SEQ ID NO: 3687880 - RNA, 17 nt, Human
uuuucuuuagagaacug

SEQ ID NO: 3687881 - RNA, 16 nt, Human
uuuucuuucagccaag

SEQ ID NO: 3687882 - RNA, 12 nt, Human
uuuucuuugcaa

SEQ ID NO: 3687883 - RNA, 20 nt, Human
uuuucuuugccaucucugcu

SEQ ID NO: 3687884 - RNA, 15 nt, Human
uuuucuuuguaucau

SEQ ID NO: 3687885 - RNA, 19 nt, Human
uuuucuuuguguagcuuug

SEQ ID NO: 3687886 - RNA, 15 nt, Human
uuuucuuuuaauuuu

SEQ ID NO: 3687887 - RNA, 17 nt, Human
uuuucuuuuguuacugu

SEQ ID NO: 3687888 - RNA, 18 nt, Human
uuuucuuuuguuacuguu

SEQ ID NO: 3687889 - RNA, 23 nt, Human
uuuucuuuuuacauaacugccuu

SEQ ID NO: 3687890 - RNA, 22 nt, Human
uuuucuuuuuuuuuaaguucuu

SEQ ID NO: 3687891 - RNA, 20 nt, Human
uuuugaaaagcagacauuuu

SEQ ID NO: 3687892 - RNA, 17 nt, Human
uuuugaaagucuguccu

SEQ ID NO: 3687893 - RNA, 16 nt, Human
uuuugaaaugaaauuu

SEQ ID NO: 3687894 - RNA, 21 nt, Human
uuuugaaaugaaauuuaaaca

SEQ ID NO: 3687895 - RNA, 22 nt, Human
uuuugaaaugugguuuuccuga

SEQ ID NO: 3687896 - RNA, 18 nt, Human
uuuugaacuaagaaacuu

SEQ ID NO: 3687897 - RNA, 14 nt, Human
uuuugaaggcaaaa

SEQ ID NO: 3687898 - RNA, 16 nt, Human
uuuugaagucuuguau

SEQ ID NO: 3687899 - RNA, 10 nt, Human
uuuugaagug

SEQ ID NO: 3687900 - RNA, 18 nt, Human
uuuugaagugagaaaaug

SEQ ID NO: 3687901 - RNA, 15 nt, Human
uuuugaaguuuacau

SEQ ID NO: 3687902 - RNA, 15 nt, Human
uuuugaauaaaaacu

SEQ ID NO: 3687903 - RNA, 21 nt, Human
uuuugaauaccauuaaaacug

SEQ ID NO: 3687904 - RNA, 19 nt, Human
uuuugacacuauaucugua

SEQ ID NO: 3687905 - RNA, 13 nt, Human
uuuugacacugaa

SEQ ID NO: 3687906 - RNA, 14 nt, Human
uuuugacacugaaa

SEQ ID NO: 3687907 - RNA, 18 nt, Human
uuuugacacugaaaguuu

SEQ ID NO: 3687908 - RNA, 19 nt, Human
uuuugacaguguugaaaau

SEQ ID NO: 3687909 - RNA, 24 nt, Human
uuuugacaguguugaaaauguuca

SEQ ID NO: 3687910 - RNA, 15 nt, Human
uuuugacggaugauu

SEQ ID NO: 3687911 - RNA, 22 nt, Human
uuuugacuagggauucaggcug

SEQ ID NO: 3687912 - RNA, 11 nt, Human
uuuugagaaag

SEQ ID NO: 3687913 - RNA, 17 nt, Human
uuuugagacagaaucuc

SEQ ID NO: 3687914 - RNA, 12 nt, Human
uuuugagauauu

SEQ ID NO: 3687915 - RNA, 13 nt, Human
uuuugagauauua

SEQ ID NO: 3687916 - RNA, 16 nt, Human
uuuugagcaacuuucu

SEQ ID NO: 3687917 - RNA, 14 nt, Human
uuuugagcaugggu

SEQ ID NO: 3687918 - RNA, 23 nt, Human
uuuugagguaaagauauggagaa

SEQ ID NO: 3687919 - RNA, 19 nt, Human
uuuugaguagauauuacuu

SEQ ID NO: 3687920 - RNA, 22 nt, Human
uuuugaguagauauuacuuuau

SEQ ID NO: 3687921 - RNA, 23 nt, Human
uuuugagucuuuuuuuuuuaagu

SEQ ID NO: 3687922 - RNA, 23 nt, Human
uuuugauaaaguaguaaaaauua

SEQ ID NO: 3687923 - RNA, 19 nt, Human
uuuugauaaaguuucucag

SEQ ID NO: 3687924 - RNA, 21 nt, Human
uuuugauaaaguuucucagau

SEQ ID NO: 3687925 - RNA, 13 nt, Human
uuuugauaacugu

SEQ ID NO: 3687926 - RNA, 18 nt, Human
uuuugauaauaauauugu

SEQ ID NO: 3687927 - RNA, 15 nt, Human
uccaaccccaacucc

SEQ ID NO: 3687928 - RNA, 18 nt, Human
uccaaccccaacuccagu

SEQ ID NO: 3687929 - RNA, 17 nt, Human
uccaaccccccagcacu

SEQ ID NO: 3687930 - RNA, 19 nt, Human
uccaaccccccagcacuga

SEQ ID NO: 3687931 - RNA, 18 nt, Human
uccaaccccucgcccagu

SEQ ID NO: 3687932 - RNA, 22 nt, Human
uccaacccgucuggcccaccag

SEQ ID NO: 3687933 - RNA, 13 nt, Human
uccaacccuagca

SEQ ID NO: 3687934 - RNA, 15 nt, Human
uccaacccuagcaaa

SEQ ID NO: 3687935 - RNA, 16 nt, Human
uccaacccucaucacc

SEQ ID NO: 3687936 - RNA, 21 nt, Human
uccaaccuaaccugugucugc

SEQ ID NO: 3687937 - RNA, 14 nt, Human
uccaaccuggacaa

SEQ ID NO: 3687938 - RNA, 13 nt, Human
uccaacguuugga

SEQ ID NO: 3687939 - RNA, 19 nt, Human
uccaacuccaacauccacu

SEQ ID NO: 3687940 - RNA, 12 nt, Human
uccaacuccagc

SEQ ID NO: 3687941 - RNA, 13 nt, Human
uccaacuccagca

SEQ ID NO: 3687942 - RNA, 13 nt, Human
uccaacuccagga

SEQ ID NO: 3687943 - RNA, 12 nt, Human
uccaacuccagu

SEQ ID NO: 3687944 - RNA, 18 nt, Human
uccaacucccuuaaaaua

SEQ ID NO: 3687945 - RNA, 19 nt, Human
uccaacucgaaucugugug

SEQ ID NO: 3687946 - RNA, 23 nt, Human
uccaacugagaaguaccuuauca

SEQ ID NO: 3687947 - RNA, 21 nt, Human
uccaacuggauuauaaauaaa

SEQ ID NO: 3687948 - RNA, 20 nt, Human
uccaacuguauauauuccca

SEQ ID NO: 3687949 - RNA, 18 nt, Human
uccaacuguguucauuag

SEQ ID NO: 3687950 - RNA, 18 nt, Human
uccaacuuauguuuuuaa

SEQ ID NO: 3687951 - RNA, 20 nt, Human
uccaacuuauguuuuuaaau

SEQ ID NO: 3687952 - RNA, 15 nt, Human
uccaagaagcccagg

SEQ ID NO: 3687953 - RNA, 22 nt, Human
uccaagaagcccaggaaaggcu

SEQ ID NO: 3687954 - RNA, 23 nt, Human
uccaagaauagcaucuguacaaa

SEQ ID NO: 3687955 - RNA, 21 nt, Human
uccaagaauccacauuucuaa

SEQ ID NO: 3687956 - RNA, 22 nt, Human
uccaagaauccacauuucuaaa

SEQ ID NO: 3687957 - RNA, 12 nt, Human
uccaagaaucua

SEQ ID NO: 3687958 - RNA, 19 nt, Human
uccaagaaucuaucugcuu

SEQ ID NO: 3687959 - RNA, 15 nt, Human
uccaagaaugcugaa

SEQ ID NO: 3687960 - RNA, 14 nt, Human
uccaagaauuucua

SEQ ID NO: 3687961 - RNA, 15 nt, Human
uccaagacacugugg

SEQ ID NO: 3687962 - RNA, 17 nt, Human
uccaagacaugucuguu

SEQ ID NO: 3687963 - RNA, 11 nt, Human
uccaagacauu

SEQ ID NO: 3687964 - RNA, 15 nt, Human
uccaagacauuguca

SEQ ID NO: 3687965 - RNA, 20 nt, Human
uccaagaccuucuccuucac

SEQ ID NO: 3687966 - RNA, 23 nt, Human
uccaagacucuagaguccaaggu

SEQ ID NO: 3687967 - RNA, 13 nt, Human
uccaagagccuga

SEQ ID NO: 3687968 - RNA, 14 nt, Human
uccaagagccugag

SEQ ID NO: 3687969 - RNA, 15 nt, Human
uccaagagucuaaag

SEQ ID NO: 3687970 - RNA, 17 nt, Human
uccaagagucugaugau

SEQ ID NO: 3687971 - RNA, 18 nt, Human
uccaagauaccuaaaaga

SEQ ID NO: 3687972 - RNA, 16 nt, Human
uccaagauucuagaug

SEQ ID NO: 3687973 - RNA, 17 nt, Human
uccaagauucuagauga

SEQ ID NO: 3687974 - RNA, 18 nt, Human
uccaagauucuagaugau

SEQ ID NO: 3687975 - RNA, 17 nt, Human
uccaagcaaaugugaau

SEQ ID NO: 3687976 - RNA, 19 nt, Human
uccaagcaaauguuacaua

SEQ ID NO: 3687977 - RNA, 19 nt, Human
uccaagcagcuuagaguug

SEQ ID NO: 3687978 - RNA, 22 nt, Human
uccaagcagcuuagaguuggcc

SEQ ID NO: 3687979 - RNA, 17 nt, Human
uccaagccacugagcaa

SEQ ID NO: 3687980 - RNA, 15 nt, Human
uccaagccuccacag

SEQ ID NO: 3687981 - RNA, 23 nt, Human
uccaagcgaggucaacagagaag

SEQ ID NO: 3687982 - RNA, 22 nt, Human
uccaagcuaagcacugccacug

SEQ ID NO: 3687983 - RNA, 18 nt, Human
uccaagcuccaucuccac

SEQ ID NO: 3687984 - RNA, 14 nt, Human
uccaagcucccagg

SEQ ID NO: 3687985 - RNA, 12 nt, Human
uccaagcucccu

SEQ ID NO: 3687986 - RNA, 14 nt, Human
uccaagcucccugc

SEQ ID NO: 3687987 - RNA, 22 nt, Human
uccaagcugggagauucaaggg

SEQ ID NO: 3687988 - RNA, 12 nt, Human
uccaagcuucca

SEQ ID NO: 3687989 - RNA, 19 nt, Human
uccaaggaaaccacagcug

SEQ ID NO: 3687990 - RNA, 20 nt, Human
uccaaggagaaacagagaca

SEQ ID NO: 3687991 - RNA, 23 nt, Human
uccaaggagcugagaauagaagg

SEQ ID NO: 3687992 - RNA, 18 nt, Human
uccaaggccaggccuugg

SEQ ID NO: 3687993 - RNA, 21 nt, Human
uccaagggcuucugcacccuc

SEQ ID NO: 3687994 - RNA, 14 nt, Human
uccaaggggcaaau

SEQ ID NO: 3687995 - RNA, 18 nt, Human
uccaaggguacuaaggaa

SEQ ID NO: 3687996 - RNA, 16 nt, Human
uccaagguggggugga

SEQ ID NO: 3687997 - RNA, 13 nt, Human
uccaagguuuaaa

SEQ ID NO: 3687998 - RNA, 19 nt, Human
uccaagucuuugcuauugu

SEQ ID NO: 3687999 - RNA, 17 nt, Human
uccaagugccagaggug

SEQ ID NO: 3688000 - RNA, 22 nt, Human
uccaaguggccuccgucacuac

SEQ ID NO: 3688001 - RNA, 15 nt, Human
uccaagugugcauau

SEQ ID NO: 3688002 - RNA, 13 nt, Human
uccaagugugugu

SEQ ID NO: 3688003 - RNA, 14 nt, Human
uccaagugugugug

SEQ ID NO: 3688004 - RNA, 16 nt, Human
uccaaguuaaauguag

SEQ ID NO: 3688005 - RNA, 16 nt, Human
uccaaguuggacuggg

SEQ ID NO: 3688006 - RNA, 21 nt, Human
uccaaguuuacucaacccucu

SEQ ID NO: 3688007 - RNA, 13 nt, Human
uccaauaaacagg

SEQ ID NO: 3688008 - RNA, 14 nt, Human
uccaauaaacagga

SEQ ID NO: 3688009 - RNA, 23 nt, Human
uccaauaagacacucaaauauga

SEQ ID NO: 3688010 - RNA, 20 nt, Human
uccaaucagagaccaggccc

SEQ ID NO: 3688011 - RNA, 21 nt, Human
uccaaucagagaccaggcccu

SEQ ID NO: 3688012 - RNA, 17 nt, Human
uccaaucagaucuuuau

SEQ ID NO: 3688013 - RNA, 18 nt, Human
uccaaucccaccaacccu

SEQ ID NO: 3688014 - RNA, 16 nt, Human
uccaauccucacuggg

SEQ ID NO: 3688015 - RNA, 13 nt, Human
uccaauccugccc

SEQ ID NO: 3688016 - RNA, 17 nt, Human
uccaaucucaaggaauc

SEQ ID NO: 3688017 - RNA, 14 nt, Human
uccaaucuuguuuc

SEQ ID NO: 3688018 - RNA, 18 nt, Human
uccaaucuuguuuccaaa

SEQ ID NO: 3688019 - RNA, 13 nt, Human
uccaaugagcuuu

SEQ ID NO: 3688020 - RNA, 14 nt, Human
uccaaugagcuuuc

SEQ ID NO: 3688021 - RNA, 20 nt, Human
uccaaugagcuuucugaaca

SEQ ID NO: 3688022 - RNA, 20 nt, Human
uccaaugccacauacuugca

SEQ ID NO: 3688023 - RNA, 21 nt, Human
uccaaugccucuugucuuccu

SEQ ID NO: 3688024 - RNA, 21 nt, Human
uccaaugucuuuuuaagcuua

SEQ ID NO: 3688025 - RNA, 18 nt, Human
uccaauguggcaaggaaa

SEQ ID NO: 3688026 - RNA, 15 nt, Human
uccaauuaaggauuu

SEQ ID NO: 3688027 - RNA, 16 nt, Human
uccaauuaguuuccuu

SEQ ID NO: 3688028 - RNA, 20 nt, Human
uccaauuaguuuccuuuuua

SEQ ID NO: 3688029 - RNA, 23 nt, Human
uccaauuauuugacuuuaauuua

SEQ ID NO: 3688030 - RNA, 16 nt, Human
uccaauuguugacagu

SEQ ID NO: 3688031 - RNA, 17 nt, Human
uccaauuuacauacucu

SEQ ID NO: 3688032 - RNA, 18 nt, Human
uccaauuuacauacucug

SEQ ID NO: 3688033 - RNA, 23 nt, Human
uccaauuuuaauuuaguaaaugu

SEQ ID NO: 3688034 - RNA, 14 nt, Human
uccaauuuucugga

SEQ ID NO: 3688035 - RNA, 22 nt, Human
uccaauuuucuggaauacauga

SEQ ID NO: 3688036 - RNA, 15 nt, Human
uccacaagagcccag

SEQ ID NO: 3688037 - RNA, 19 nt, Human
uccacaagagcccaggccu

SEQ ID NO: 3688038 - RNA, 20 nt, Human
uccacaagagcccaggccuc

SEQ ID NO: 3688039 - RNA, 16 nt, Human
uccacaagauucccag

SEQ ID NO: 3688040 - RNA, 17 nt, Human
uccacaaguuaaauaaa

SEQ ID NO: 3688041 - RNA, 19 nt, Human
uccacacaagggaaggaca

SEQ ID NO: 3688042 - RNA, 13 nt, Human
uccacacacacaa

SEQ ID NO: 3688043 - RNA, 13 nt, Human
uccacacacagag

SEQ ID NO: 3688044 - RNA, 19 nt, Human
uccacacacagaggaagag

SEQ ID NO: 3688045 - RNA, 17 nt, Human
uccacacacauaauggc

SEQ ID NO: 3688046 - RNA, 16 nt, Human
uccacacagaaugcaa

SEQ ID NO: 3688047 - RNA, 19 nt, Human
uccacacagugcucaaggc

SEQ ID NO: 3688048 - RNA, 16 nt, Human
uccacacccgugagaa

SEQ ID NO: 3688049 - RNA, 18 nt, Human
uccacacccucucccagg

SEQ ID NO: 3688050 - RNA, 20 nt, Human
uccacaccucacucugcuac

SEQ ID NO: 3688051 - RNA, 23 nt, Human
uccacacucaccucuaaaacagu

SEQ ID NO: 3688052 - RNA, 14 nt, Human
uccacacugcacaa

SEQ ID NO: 3688053 - RNA, 20 nt, Human
uccacagaaacauuuucauu

SEQ ID NO: 3688054 - RNA, 22 nt, Human
uccacagacggaaggguaaaca

SEQ ID NO: 3688055 - RNA, 23 nt, Human
uccacagacggaaggguaaacaa

SEQ ID NO: 3688056 - RNA, 18 nt, Human
uccacagaguaagacauu

SEQ ID NO: 3688057 - RNA, 17 nt, Human
uccacagauuguuucua

SEQ ID NO: 3688058 - RNA, 22 nt, Human
uccacagauuguuucuauacaa

SEQ ID NO: 3688059 - RNA, 20 nt, Human
uccacagcaaccccaggcug

SEQ ID NO: 3688060 - RNA, 14 nt, Human
uccacagccgcagc

SEQ ID NO: 3688061 - RNA, 15 nt, Human
uccacagccugcaag

SEQ ID NO: 3688062 - RNA, 14 nt, Human
uccacagcuaccuc

SEQ ID NO: 3688063 - RNA, 12 nt, Human
uccacagcuucc

SEQ ID NO: 3688064 - RNA, 13 nt, Human
uccacagcuuccu

SEQ ID NO: 3688065 - RNA, 14 nt, Human
uccacagcuuccug

SEQ ID NO: 3688066 - RNA, 13 nt, Human
uccacaggaagug

SEQ ID NO: 3688067 - RNA, 16 nt, Human
uccacaggcuucugag

SEQ ID NO: 3688068 - RNA, 18 nt, Human
uccacagggucccacagc

SEQ ID NO: 3688069 - RNA, 14 nt, Human
uccacaggucuaga

SEQ ID NO: 3688070 - RNA, 15 nt, Human
uccacaggucuagac

SEQ ID NO: 3688071 - RNA, 15 nt, Human
uccacaggucucaga

SEQ ID NO: 3688072 - RNA, 19 nt, Human
uccacagucucccccaccc

SEQ ID NO: 3688073 - RNA, 19 nt, Human
uccacaguugccaccaccu

SEQ ID NO: 3688074 - RNA, 14 nt, Human
uccacaucccggga

SEQ ID NO: 3688075 - RNA, 22 nt, Human
uccacauccuuucuaaacaaga

SEQ ID NO: 3688076 - RNA, 12 nt, Human
uccacaucugcc

SEQ ID NO: 3688077 - RNA, 20 nt, Human
uuuugauaauaauauuguuu

SEQ ID NO: 3688078 - RNA, 15 nt, Human
uuuugauaguugugu

SEQ ID NO: 3688079 - RNA, 19 nt, Human
uuuugauaugcauauuugu

SEQ ID NO: 3688080 - RNA, 19 nt, Human
uuuugaucuucaacaaauu

SEQ ID NO: 3688081 - RNA, 16 nt, Human
uuuugaugaguuguga

SEQ ID NO: 3688082 - RNA, 17 nt, Human
uuuugaugcagcauuug

SEQ ID NO: 3688083 - RNA, 20 nt, Human
uuuugauguuuguggccuca

SEQ ID NO: 3688084 - RNA, 12 nt, Human
uuuugauuaugu

SEQ ID NO: 3688085 - RNA, 22 nt, Human
uuuugauuauuuuuuuuuucuu

SEQ ID NO: 3688086 - RNA, 22 nt, Human
uuuugauuuaauaacauaacaa

SEQ ID NO: 3688087 - RNA, 20 nt, Human
uuuugauuuguacugaaaaa

SEQ ID NO: 3688088 - RNA, 21 nt, Human
uuuugauuuguacugaaaaau

SEQ ID NO: 3688089 - RNA, 19 nt, Human
uuuugcaaauauaaacauc

SEQ ID NO: 3688090 - RNA, 20 nt, Human
uuuugcaaauauaaacaucu

SEQ ID NO: 3688091 - RNA, 21 nt, Human
uuuugcaaccaggaacagcaa

SEQ ID NO: 3688092 - RNA, 18 nt, Human
uuuugcaauaaugcagua

SEQ ID NO: 3688093 - RNA, 16 nt, Human
ucagcgugcuuagccu

SEQ ID NO: 3688094 - RNA, 18 nt, Human
ucagcgugcuuagccucc

SEQ ID NO: 3688095 - RNA, 23 nt, Human
ucagcguggagggguaggggcug

SEQ ID NO: 3688096 - RNA, 17 nt, Human
ucagcguggccuuguuc

SEQ ID NO: 3688097 - RNA, 14 nt, Human
ucagcguuuugcaa

SEQ ID NO: 3688098 - RNA, 15 nt, Human
ucagcuaaagaaguu

SEQ ID NO: 3688099 - RNA, 18 nt, Human
ucagcuaaagaaguuuga

SEQ ID NO: 3688100 - RNA, 18 nt, Human
ucagcuaaagcccaaccu

SEQ ID NO: 3688101 - RNA, 22 nt, Human
ucagcuaagggaagacauuucu

SEQ ID NO: 3688102 - RNA, 14 nt, Human
ucagcuacugauuu

SEQ ID NO: 3688103 - RNA, 16 nt, Human
ucagcuaggaacaaau

SEQ ID NO: 3688104 - RNA, 20 nt, Human
ucagcuauuuacugccaaag

SEQ ID NO: 3688105 - RNA, 16 nt, Human
ucagcucaaugcaguu

SEQ ID NO: 3688106 - RNA, 21 nt, Human
ucagcucacgcuucacaguga

SEQ ID NO: 3688107 - RNA, 12 nt, Human
ucagcuccagcc

SEQ ID NO: 3688108 - RNA, 22 nt, Human
ucagcuccagccccuuuccaaa

SEQ ID NO: 3688109 - RNA, 12 nt, Human
ucagcuccagcu

SEQ ID NO: 3688110 - RNA, 14 nt, Human
ucagcuccagcuca

SEQ ID NO: 3688111 - RNA, 18 nt, Human
ucagcuccagcucaccag

SEQ ID NO: 3688112 - RNA, 13 nt, Human
ucagcuccagcug

SEQ ID NO: 3688113 - RNA, 16 nt, Human
ucagcucccacaagcc

SEQ ID NO: 3688114 - RNA, 19 nt, Human
ucagcucccauuucuacuc

SEQ ID NO: 3688115 - RNA, 18 nt, Human
ucagcucccccugucccc

SEQ ID NO: 3688116 - RNA, 22 nt, Human
ucagcuccccucggagaagagc

SEQ ID NO: 3688117 - RNA, 15 nt, Human
ucagcuccuuccugg

SEQ ID NO: 3688118 - RNA, 18 nt, Human
ucagcucggggagccuua

SEQ ID NO: 3688119 - RNA, 14 nt, Human
ucagcucucugccc

SEQ ID NO: 3688120 - RNA, 15 nt, Human
ucagcucucugcccu

SEQ ID NO: 3688121 - RNA, 21 nt, Human
ucagcucucugcccuguguac

SEQ ID NO: 3688122 - RNA, 14 nt, Human
ucagcucugaaaga

SEQ ID NO: 3688123 - RNA, 23 nt, Human
ucagcucugcaagaauugaagca

SEQ ID NO: 3688124 - RNA, 11 nt, Human
ucagcucuggg

SEQ ID NO: 3688125 - RNA, 19 nt, Human
ucagcucuucaucugccca

SEQ ID NO: 3688126 - RNA, 20 nt, Human
ucagcucuucaucugcccaa

SEQ ID NO: 3688127 - RNA, 22 nt, Human
ucagcucuucuccauccuacca

SEQ ID NO: 3688128 - RNA, 22 nt, Human
ucagcucuucugacuuaagugu

SEQ ID NO: 3688129 - RNA, 19 nt, Human
ucagcucuuggcuccacug

SEQ ID NO: 3688130 - RNA, 15 nt, Human
ucagcugaaccuggg

SEQ ID NO: 3688131 - RNA, 22 nt, Human
ucagcugaaugccuccuguggg

SEQ ID NO: 3688132 - RNA, 22 nt, Human
ucagcugcaagguacucuggug

SEQ ID NO: 3688133 - RNA, 16 nt, Human
ucagcugcccccgcuc

SEQ ID NO: 3688134 - RNA, 22 nt, Human
ucagcugcucagcaaccuuuca

SEQ ID NO: 3688135 - RNA, 16 nt, Human
ucagcugcugaaacaa

SEQ ID NO: 3688136 - RNA, 17 nt, Human
ucagcugcuuuguuacc

SEQ ID NO: 3688137 - RNA, 23 nt, Human
ucagcuguaagaagagacuggga

SEQ ID NO: 3688138 - RNA, 19 nt, Human
ucagcuguccucccuccac

SEQ ID NO: 3688139 - RNA, 15 nt, Human
ucagcugucuuuugg

SEQ ID NO: 3688140 - RNA, 21 nt, Human
ucagcugugaacauggacucu

SEQ ID NO: 3688141 - RNA, 17 nt, Human
ucagcuuaaaauaaaca

SEQ ID NO: 3688142 - RNA, 18 nt, Human
ucagcuuaaaauaaacag

SEQ ID NO: 3688143 - RNA, 18 nt, Human
ucagcuuaggggcugcug

SEQ ID NO: 3688144 - RNA, 20 nt, Human
ucagcuuaucucuuuuauau

SEQ ID NO: 3688145 - RNA, 23 nt, Human
ucagcuucagaauggcauuguac

SEQ ID NO: 3688146 - RNA, 19 nt, Human
ucagcuuccuacccacacc

SEQ ID NO: 3688147 - RNA, 23 nt, Human
ucagcuuccuacccacaccucug

SEQ ID NO: 3688148 - RNA, 21 nt, Human
ucagcuucguuuauuuucaag

SEQ ID NO: 3688149 - RNA, 16 nt, Human
ucagcuucugcugggc

SEQ ID NO: 3688150 - RNA, 19 nt, Human
ucagcuucugcugggcugg

SEQ ID NO: 3688151 - RNA, 17 nt, Human
ucagcuugcacauuugg

SEQ ID NO: 3688152 - RNA, 15 nt, Human
ucagcuugcugcccu

SEQ ID NO: 3688153 - RNA, 20 nt, Human
ucagcuuguaaauagcucag

SEQ ID NO: 3688154 - RNA, 16 nt, Human
ucagcuuucaaagcau

SEQ ID NO: 3688155 - RNA, 17 nt, Human
ucagcuuucaaagcauu

SEQ ID NO: 3688156 - RNA, 15 nt, Human
ucagcuuugagaagc

SEQ ID NO: 3688157 - RNA, 15 nt, Human
ucagcuuugccuucc

SEQ ID NO: 3688158 - RNA, 16 nt, Human
ucagcuuuugcuucau

SEQ ID NO: 3688159 - RNA, 22 nt, Human
ucaggaaaacugacagaggagg

SEQ ID NO: 3688160 - RNA, 17 nt, Human
ucaggaaaagccucugu

SEQ ID NO: 3688161 - RNA, 19 nt, Human
ucaggaaaagccucugugu

SEQ ID NO: 3688162 - RNA, 14 nt, Human
ucaggaaaaggccu

SEQ ID NO: 3688163 - RNA, 19 nt, Human
ucaggaaaaggccuggggu

SEQ ID NO: 3688164 - RNA, 23 nt, Human
ucaggaaagaauagaaagaaagu

SEQ ID NO: 3688165 - RNA, 15 nt, Human
ucaggaaaggaauca

SEQ ID NO: 3688166 - RNA, 20 nt, Human
ucaggaaauauauaugugug

SEQ ID NO: 3688167 - RNA, 23 nt, Human
ucaggaaaucaaauaugcaaagc

SEQ ID NO: 3688168 - RNA, 14 nt, Human
ucaggaacagaagg

SEQ ID NO: 3688169 - RNA, 16 nt, Human
ucaggaacagaaggau

SEQ ID NO: 3688170 - RNA, 18 nt, Human
ucaggaacguuuagcuga

SEQ ID NO: 3688171 - RNA, 23 nt, Human
ucaggaagaaaucacagaaucau

SEQ ID NO: 3688172 - RNA, 13 nt, Human
ucaggaagaacac

SEQ ID NO: 3688173 - RNA, 16 nt, Human
ucaggaagagaaggag

SEQ ID NO: 3688174 - RNA, 12 nt, Human
ucaggaagcuca

SEQ ID NO: 3688175 - RNA, 18 nt, Human
ucaggaaggaugagcauu

SEQ ID NO: 3688176 - RNA, 18 nt, Human
ucaggaauauuuuccaaa

SEQ ID NO: 3688177 - RNA, 22 nt, Human
ucaggaaucaucaggaacguuu

SEQ ID NO: 3688178 - RNA, 18 nt, Human
ucaggaauucuuggagaa

SEQ ID NO: 3688179 - RNA, 20 nt, Human
ucaggaauugcccauuguuu

SEQ ID NO: 3688180 - RNA, 14 nt, Human
ucaggacagaugcc

SEQ ID NO: 3688181 - RNA, 15 nt, Human
ucaggacagaugcca

SEQ ID NO: 3688182 - RNA, 20 nt, Human
ucaggaccaaagcuuucaug

SEQ ID NO: 3688183 - RNA, 19 nt, Human
ucaggacccucgcuggccc

SEQ ID NO: 3688184 - RNA, 20 nt, Human
ucaggaccuccaagccacug

SEQ ID NO: 3688185 - RNA, 21 nt, Human
ucaggaccugggaccuccccu

SEQ ID NO: 3688186 - RNA, 23 nt, Human
ucaggaccugggaccuccccuga

SEQ ID NO: 3688187 - RNA, 14 nt, Human
ucaggaccuuuuga

SEQ ID NO: 3688188 - RNA, 18 nt, Human
ucaggagcacaggcagcu

SEQ ID NO: 3688189 - RNA, 10 nt, Human
ucaggagcag

SEQ ID NO: 3688190 - RNA, 11 nt, Human
ucaggagcccu

SEQ ID NO: 3688191 - RNA, 23 nt, Human
ucaggagcccugggaggcucugg

SEQ ID NO: 3688192 - RNA, 14 nt, Human
ucaggagccuguga

SEQ ID NO: 3688193 - RNA, 22 nt, Human
ucaggagcuccauacacacgcu

SEQ ID NO: 3688194 - RNA, 19 nt, Human
ucaggaggaauacugaaca

SEQ ID NO: 3688195 - RNA, 17 nt, Human
ucaggaggcaggaccuu

SEQ ID NO: 3688196 - RNA, 13 nt, Human
ucaggaggcugag

SEQ ID NO: 3688197 - RNA, 20 nt, Human
ucaggaggcugaggcagaag

SEQ ID NO: 3688198 - RNA, 14 nt, Human
ucaggaggcuggag

SEQ ID NO: 3688199 - RNA, 13 nt, Human
ucaggagggauug

SEQ ID NO: 3688200 - RNA, 12 nt, Human
ucaggaguuccu

SEQ ID NO: 3688201 - RNA, 16 nt, Human
ucaggauacaugugcc

SEQ ID NO: 3688202 - RNA, 18 nt, Human
ucaggauacucugucaga

SEQ ID NO: 3688203 - RNA, 17 nt, Human
ucaggaucaagaaagug

SEQ ID NO: 3688204 - RNA, 16 nt, Human
ucaggaugaacccagg

SEQ ID NO: 3688205 - RNA, 18 nt, Human
ucaggaugagggaaaaga

SEQ ID NO: 3688206 - RNA, 15 nt, Human
ucaggaugcccaggg

SEQ ID NO: 3688207 - RNA, 16 nt, Human
ucaggaugcccagggc

SEQ ID NO: 3688208 - RNA, 23 nt, Human
ucaggauugcgagagaugugugu

SEQ ID NO: 3688209 - RNA, 20 nt, Human
ucaggauuuaaaaacuggaa

SEQ ID NO: 3688210 - RNA, 21 nt, Human
ucaggauuuaaaaacuggaac

SEQ ID NO: 3688211 - RNA, 17 nt, Human
ucaggcaaggucuggcc

SEQ ID NO: 3688212 - RNA, 18 nt, Human
ucaggcaaggucuggccu

SEQ ID NO: 3688213 - RNA, 14 nt, Human
ucaggcacagguca

SEQ ID NO: 3688214 - RNA, 21 nt, Human
ucaggcacuagccuuuggcuc

SEQ ID NO: 3688215 - RNA, 18 nt, Human
ucaggcaggugggaugga

SEQ ID NO: 3688216 - RNA, 15 nt, Human
ucaggcauaggccug

SEQ ID NO: 3688217 - RNA, 16 nt, Human
ucaggcauaggccugg

SEQ ID NO: 3688218 - RNA, 17 nt, Human
ucaggcauaggccuggg

SEQ ID NO: 3688219 - RNA, 15 nt, Human
ucaggcaugccugug

SEQ ID NO: 3688220 - RNA, 16 nt, Human
ucaggcaugccugugu

SEQ ID NO: 3688221 - RNA, 22 nt, Human
ucaggcauuuucccccuuggcu

SEQ ID NO: 3688222 - RNA, 23 nt, Human
ucaggccaaacucaccugccccu

SEQ ID NO: 3688223 - RNA, 17 nt, Human
ucaggccaccugccccc

SEQ ID NO: 3688224 - RNA, 21 nt, Human
ucaggccaccugcccccuucu

SEQ ID NO: 3688225 - RNA, 14 nt, Human
ucaggccagagcca

SEQ ID NO: 3688226 - RNA, 13 nt, Human
ucaggccagcugc

SEQ ID NO: 3688227 - RNA, 15 nt, Human
ucaggccagcugcuu

SEQ ID NO: 3688228 - RNA, 15 nt, Human
ucaggccaggcccuc

SEQ ID NO: 3688229 - RNA, 16 nt, Human
ucaggccaggcccucu

SEQ ID NO: 3688230 - RNA, 18 nt, Human
ucaggccaggcccucugc

SEQ ID NO: 3688231 - RNA, 20 nt, Human
ucaggccaggcccucugccc

SEQ ID NO: 3688232 - RNA, 16 nt, Human
ucaggccaggugcagu

SEQ ID NO: 3688233 - RNA, 21 nt, Human
ucaggccauauuaucaauguu

SEQ ID NO: 3688234 - RNA, 21 nt, Human
ucaccaguguccccuccacug

SEQ ID NO: 3688235 - RNA, 19 nt, Human
ucaccaugauggggcccua

SEQ ID NO: 3688236 - RNA, 17 nt, Human
ucaccauguaaaacaaa

SEQ ID NO: 3688237 - RNA, 21 nt, Human
ucaccauguaaaacaaaaaac

SEQ ID NO: 3688238 - RNA, 23 nt, Human
ucaccauguaaaacaaaaaacaa

SEQ ID NO: 3688239 - RNA, 21 nt, Human
ucaccauguaagcacucugga

SEQ ID NO: 3688240 - RNA, 13 nt, Human
ucaccauguauuu

SEQ ID NO: 3688241 - RNA, 19 nt, Human
ucaccauguauuuuguaaa

SEQ ID NO: 3688242 - RNA, 17 nt, Human
ucaccauguuagccagg

SEQ ID NO: 3688243 - RNA, 21 nt, Human
ucaccauguuagccaggcugg

SEQ ID NO: 3688244 - RNA, 15 nt, Human
ucaccauguuggcca

SEQ ID NO: 3688245 - RNA, 21 nt, Human
ucaccauguuggccaggcugg

SEQ ID NO: 3688246 - RNA, 22 nt, Human
ucaccauguuggccaggcuggu

SEQ ID NO: 3688247 - RNA, 15 nt, Human
ucaccauuauaauga

SEQ ID NO: 3688248 - RNA, 22 nt, Human
ucaccauuugauuauguagcaa

SEQ ID NO: 3688249 - RNA, 20 nt, Human
ucaccauuuggauccugugu

SEQ ID NO: 3688250 - RNA, 21 nt, Human
ucacccaacaaucccaaggcc

SEQ ID NO: 3688251 - RNA, 13 nt, Human
ucacccaacgcuc

SEQ ID NO: 3688252 - RNA, 19 nt, Human
ucacccaagcaaggccaaa

SEQ ID NO: 3688253 - RNA, 17 nt, Human
ucacccacagaaagaga

SEQ ID NO: 3688254 - RNA, 12 nt, Human
ucacccacaggg

SEQ ID NO: 3688255 - RNA, 14 nt, Human
ucacccacagggcu

SEQ ID NO: 3688256 - RNA, 19 nt, Human
ucacccagacauaaaggaa

SEQ ID NO: 3688257 - RNA, 17 nt, Human
ucacccagcuaaucugu

SEQ ID NO: 3688258 - RNA, 19 nt, Human
ucacccaggcuggacugca

SEQ ID NO: 3688259 - RNA, 13 nt, Human
ucacccaguccug

SEQ ID NO: 3688260 - RNA, 17 nt, Human
ucacccaugaagacagg

SEQ ID NO: 3688261 - RNA, 20 nt, Human
ucacccaugcaagcagagga

SEQ ID NO: 3688262 - RNA, 12 nt, Human
ucacccaugugc

SEQ ID NO: 3688263 - RNA, 22 nt, Human
ucaccccaccccaccccaccuc

SEQ ID NO: 3688264 - RNA, 12 nt, Human
ucaccccagagc

SEQ ID NO: 3688265 - RNA, 14 nt, Human
ucaccccagcccca

SEQ ID NO: 3688266 - RNA, 12 nt, Human
ucaccccagggc

SEQ ID NO: 3688267 - RNA, 15 nt, Human
ucaccccagggccug

SEQ ID NO: 3688268 - RNA, 21 nt, Human
ucaccccaguggccacucagc

SEQ ID NO: 3688269 - RNA, 13 nt, Human
ucacccccaaggg

SEQ ID NO: 3688270 - RNA, 19 nt, Human
ucacccccucccaccccca

SEQ ID NO: 3688271 - RNA, 22 nt, Human
ucacccccuucuccauccacau

SEQ ID NO: 3688272 - RNA, 16 nt, Human
ucaccccggcaggccc

SEQ ID NO: 3688273 - RNA, 19 nt, Human
ucaccccggcaggcccugc

SEQ ID NO: 3688274 - RNA, 20 nt, Human
ucaccccggcaggcccugca

SEQ ID NO: 3688275 - RNA, 22 nt, Human
ucaccccggcaggcccugcagu

SEQ ID NO: 3688276 - RNA, 17 nt, Human
ucaccccggccaccugc

SEQ ID NO: 3688277 - RNA, 18 nt, Human
ucaccccggccaccugcg

SEQ ID NO: 3688278 - RNA, 22 nt, Human
ucaccccggccaccugcggugc

SEQ ID NO: 3688279 - RNA, 17 nt, Human
ucaccccguuacagcuc

SEQ ID NO: 3688280 - RNA, 17 nt, Human
ucaccccuccacccuug

SEQ ID NO: 3688281 - RNA, 13 nt, Human
ucaccccuccagg

SEQ ID NO: 3688282 - RNA, 14 nt, Human
ucaccccuccagga

SEQ ID NO: 3688283 - RNA, 17 nt, Human
ucaccccucccuuucuc

SEQ ID NO: 3688284 - RNA, 20 nt, Human
ucaccccucccuuucucccc

SEQ ID NO: 3688285 - RNA, 22 nt, Human
ucaccccugguucucaucuuuc

SEQ ID NO: 3688286 - RNA, 13 nt, Human
ucaccccuguccu

SEQ ID NO: 3688287 - RNA, 20 nt, Human
ucaccccuguccucacugcu

SEQ ID NO: 3688288 - RNA, 15 nt, Human
ucacccguccagacc

SEQ ID NO: 3688289 - RNA, 19 nt, Human
ucacccuaccaacuuuacu

SEQ ID NO: 3688290 - RNA, 17 nt, Human
ucacccuaccugugccu

SEQ ID NO: 3688291 - RNA, 15 nt, Human
ucacccuagcccucu

SEQ ID NO: 3688292 - RNA, 23 nt, Human
ucacccugauuuaggagaagcca

SEQ ID NO: 3688293 - RNA, 15 nt, Human
ucacccuuugcugug

SEQ ID NO: 3688294 - RNA, 12 nt, Human
ucacccuuuucu

SEQ ID NO: 3688295 - RNA, 20 nt, Human
ucaccgagaguagccgagag

SEQ ID NO: 3688296 - RNA, 19 nt, Human
ucaccgcagucgucgcaca

SEQ ID NO: 3688297 - RNA, 23 nt, Human
ucaccgcagucgucgcacagucu

SEQ ID NO: 3688298 - RNA, 15 nt, Human
ucaccgcccaucagg

SEQ ID NO: 3688299 - RNA, 19 nt, Human
ucaccgcuucccuccugcc

SEQ ID NO: 3688300 - RNA, 14 nt, Human
ucaccggagcuuuc

SEQ ID NO: 3688301 - RNA, 18 nt, Human
ucaccggggugguuuagu

SEQ ID NO: 3688302 - RNA, 21 nt, Human
ucaccguggauucgcuugagu

SEQ ID NO: 3688303 - RNA, 19 nt, Human
ucaccgugggcucccugac

SEQ ID NO: 3688304 - RNA, 19 nt, Human
ucaccuaagucucugugaa

SEQ ID NO: 3688305 - RNA, 14 nt, Human
ucaccuaauguuua

SEQ ID NO: 3688306 - RNA, 17 nt, Human
ucaccuaauuaauuuca

SEQ ID NO: 3688307 - RNA, 14 nt, Human
ucaccuagaaacuu

SEQ ID NO: 3688308 - RNA, 18 nt, Human
ucaccuagagccagacca

SEQ ID NO: 3688309 - RNA, 15 nt, Human
ucaccuaggaagccu

SEQ ID NO: 3688310 - RNA, 20 nt, Human
ucaccuauuuccauucaaca

SEQ ID NO: 3688311 - RNA, 14 nt, Human
ucaccucacucagc

SEQ ID NO: 3688312 - RNA, 15 nt, Human
ucaccucacucagca

SEQ ID NO: 3688313 - RNA, 18 nt, Human
ucaccucacucagcacca

SEQ ID NO: 3688314 - RNA, 23 nt, Human
ucaccucacucagcaccacucaa

SEQ ID NO: 3688315 - RNA, 18 nt, Human
ucaccucagauggcagcu

SEQ ID NO: 3688316 - RNA, 20 nt, Human
ucaccucagauggcagcuuu

SEQ ID NO: 3688317 - RNA, 15 nt, Human
ucaccuccccuccuu

SEQ ID NO: 3688318 - RNA, 17 nt, Human
ucaccuccugcugggca

SEQ ID NO: 3688319 - RNA, 16 nt, Human
ucaccucuaacacgca

SEQ ID NO: 3688320 - RNA, 23 nt, Human
ucaccucuagguccccauacucc

SEQ ID NO: 3688321 - RNA, 15 nt, Human
ucaccucucccuugg

SEQ ID NO: 3688322 - RNA, 13 nt, Human
ucaccucuguaau

SEQ ID NO: 3688323 - RNA, 19 nt, Human
ucaccugaagacucauucu

SEQ ID NO: 3688324 - RNA, 16 nt, Human
ucaccugccccaacuc

SEQ ID NO: 3688325 - RNA, 16 nt, Human
ucaccugcuggccccu

SEQ ID NO: 3688326 - RNA, 21 nt, Human
ucaccugcuggccccucaccu

SEQ ID NO: 3688327 - RNA, 19 nt, Human
ucaccuggaagcauuuguu

SEQ ID NO: 3688328 - RNA, 16 nt, Human
ucaccuggcccugcuu

SEQ ID NO: 3688329 - RNA, 23 nt, Human
ucaccuggcccugcuuccugcuu

SEQ ID NO: 3688330 - RNA, 20 nt, Human
ucaccugggcaccuggggag

SEQ ID NO: 3688331 - RNA, 16 nt, Human
ucaccuggggcugcug

SEQ ID NO: 3688332 - RNA, 14 nt, Human
ucaccuguaaaacu

SEQ ID NO: 3688333 - RNA, 19 nt, Human
ucaccuguaaaccugaguc

SEQ ID NO: 3688334 - RNA, 17 nt, Human
ucaccuguacucuuccg

SEQ ID NO: 3688335 - RNA, 19 nt, Human
ucaccugucuugccuuuuu

SEQ ID NO: 3688336 - RNA, 18 nt, Human
ucaccuguugcuuacaau

SEQ ID NO: 3688337 - RNA, 19 nt, Human
ucaccuguugcuuacaauu

SEQ ID NO: 3688338 - RNA, 19 nt, Human
ucaccuguuuuuaagcugu

SEQ ID NO: 3688339 - RNA, 22 nt, Human
ucaccuguuuuuaagcuguuuc

SEQ ID NO: 3688340 - RNA, 16 nt, Human
ucaccuuagaccacca

SEQ ID NO: 3688341 - RNA, 20 nt, Human
ucaccuuagaccaccaagcc

SEQ ID NO: 3688342 - RNA, 22 nt, Human
ucaccuuagaccaccaagccuu

SEQ ID NO: 3688343 - RNA, 15 nt, Human
ucaccuuaggcaggg

SEQ ID NO: 3688344 - RNA, 18 nt, Human
ucaccuucaccuucaucc

SEQ ID NO: 3688345 - RNA, 22 nt, Human
ucaccuucguuuacuaugccug

SEQ ID NO: 3688346 - RNA, 20 nt, Human
ucaccuucuagucuuggcca

SEQ ID NO: 3688347 - RNA, 19 nt, Human
ucaccuuggcaccagacac

SEQ ID NO: 3688348 - RNA, 17 nt, Human
ucaccuugguuccuggg

SEQ ID NO: 3688349 - RNA, 14 nt, Human
ucaccuuucccauc

SEQ ID NO: 3688350 - RNA, 17 nt, Human
ucaccuuucccuaaaga

SEQ ID NO: 3688351 - RNA, 14 nt, Human
ucaccuuuguguau

SEQ ID NO: 3688352 - RNA, 16 nt, Human
ucaccuuuguguauuu

SEQ ID NO: 3688353 - RNA, 19 nt, Human
ucaccuuuuaaauccuguu

SEQ ID NO: 3688354 - RNA, 15 nt, Human
ucaccuuuucaggaa

SEQ ID NO: 3688355 - RNA, 17 nt, Human
ucaccuuuucaggaaaa

SEQ ID NO: 3688356 - RNA, 14 nt, Human
ucaccuuuucuugc

SEQ ID NO: 3688357 - RNA, 21 nt, Human
ucacgauugucaucaggagaa

SEQ ID NO: 3688358 - RNA, 14 nt, Human
ucacgcaccugggu

SEQ ID NO: 3688359 - RNA, 16 nt, Human
ucacgcaugcaguguu

SEQ ID NO: 3688360 - RNA, 13 nt, Human
ucacgccacugca

SEQ ID NO: 3688361 - RNA, 16 nt, Human
ucacgccacugcacuc

SEQ ID NO: 3688362 - RNA, 17 nt, Human
ucacgccacugcacucc

SEQ ID NO: 3688363 - RNA, 21 nt, Human
ucacgccuaugaucccagcac

SEQ ID NO: 3688364 - RNA, 19 nt, Human
ucacgccuguaaucccagc

SEQ ID NO: 3688365 - RNA, 21 nt, Human
ucacgccuguaaucccagcag

SEQ ID NO: 3688366 - RNA, 19 nt, Human
ucacgccuguaauccuagc

SEQ ID NO: 3688367 - RNA, 13 nt, Human
ucacgccugugca

SEQ ID NO: 3688368 - RNA, 16 nt, Human
ucacgccugugcagug

SEQ ID NO: 3688369 - RNA, 12 nt, Human
ucacgcuccccg

SEQ ID NO: 3688370 - RNA, 16 nt, Human
ucacgcuccuuucuga

SEQ ID NO: 3688371 - RNA, 14 nt, Human
ucacgcuuuccuga

SEQ ID NO: 3688372 - RNA, 15 nt, Human
ucacgcuuuccugaa

SEQ ID NO: 3688373 - RNA, 16 nt, Human
ucacgcuuuccugaau

SEQ ID NO: 3688374 - RNA, 22 nt, Human
ucacgcuuuccugaauccaaac

SEQ ID NO: 3688375 - RNA, 17 nt, Human
ucacggaagagccuugc

SEQ ID NO: 3688376 - RNA, 15 nt, Human
ucacggaaguuuuca

SEQ ID NO: 3688377 - RNA, 19 nt, Human
ucacggccacacagcugcc

SEQ ID NO: 3688378 - RNA, 20 nt, Human
ucacggccacacagcugccg

SEQ ID NO: 3688379 - RNA, 20 nt, Human
ucacggcucacugcagccuc

SEQ ID NO: 3688380 - RNA, 19 nt, Human
ucacggcugcgcacugugu

SEQ ID NO: 3688381 - RNA, 18 nt, Human
ucacgggcaguagcugug

SEQ ID NO: 3688382 - RNA, 19 nt, Human
ucacguaaagcuagaaaug

SEQ ID NO: 3688383 - RNA, 15 nt, Human
uuuaccacccccaca

SEQ ID NO: 3688384 - RNA, 13 nt, Human
uuuaccagaaagc

SEQ ID NO: 3688385 - RNA, 14 nt, Human
uuuaccagcuuuua

SEQ ID NO: 3688386 - RNA, 20 nt, Human
uuuaccaguuaauuacucag

SEQ ID NO: 3688387 - RNA, 16 nt, Human
uuuacccaccuagaac

SEQ ID NO: 3688388 - RNA, 17 nt, Human
uuuacccauauccccuc

SEQ ID NO: 3688389 - RNA, 21 nt, Human
uuuacccauauccccucuccc

SEQ ID NO: 3688390 - RNA, 15 nt, Human
uuuacccuauaucua

SEQ ID NO: 3688391 - RNA, 17 nt, Human
uuuacccuggccccucu

SEQ ID NO: 3688392 - RNA, 20 nt, Human
uuuacccuggccccucuccc

SEQ ID NO: 3688393 - RNA, 19 nt, Human
uuuaccuaccacagugucu

SEQ ID NO: 3688394 - RNA, 19 nt, Human
uuuaccucucugucaugug

SEQ ID NO: 3688395 - RNA, 13 nt, Human
uuuaccugagacc

SEQ ID NO: 3688396 - RNA, 16 nt, Human
uuuaccugagaccagu

SEQ ID NO: 3688397 - RNA, 21 nt, Human
uuuaccuggcuuauuuaauau

SEQ ID NO: 3688398 - RNA, 15 nt, Human
uuuaccugugaaaua

SEQ ID NO: 3688399 - RNA, 14 nt, Human
uuuaccuuuuuuau

SEQ ID NO: 3688400 - RNA, 17 nt, Human
uuuacggacacccccuc

SEQ ID NO: 3688401 - RNA, 15 nt, Human
uuuacuaaaauggac

SEQ ID NO: 3688402 - RNA, 15 nt, Human
uuuacuaagaugaca

SEQ ID NO: 3688403 - RNA, 16 nt, Human
uuuacuaagaugacau

SEQ ID NO: 3688404 - RNA, 21 nt, Human
uuuacuaagaugacauugcua

SEQ ID NO: 3688405 - RNA, 22 nt, Human
uuuacuaagccacaagaaauuu

SEQ ID NO: 3688406 - RNA, 18 nt, Human
uuuacuaauagacaauuu

SEQ ID NO: 3688407 - RNA, 19 nt, Human
uuuacuaauuuucuagauu

SEQ ID NO: 3688408 - RNA, 18 nt, Human
uuuacuagggaucccuca

SEQ ID NO: 3688409 - RNA, 15 nt, Human
uuuacucauugaaau

SEQ ID NO: 3688410 - RNA, 19 nt, Human
uuuacucauugaaauguca

SEQ ID NO: 3688411 - RNA, 21 nt, Human
uuuacuccaguggugaagaaa

SEQ ID NO: 3688412 - RNA, 12 nt, Human
uuuacuccccuu

SEQ ID NO: 3688413 - RNA, 13 nt, Human
uuuacuccccuug

SEQ ID NO: 3688414 - RNA, 18 nt, Human
uuuacuccccuugagcug

SEQ ID NO: 3688415 - RNA, 13 nt, Human
uuuacugaacaau

SEQ ID NO: 3688416 - RNA, 18 nt, Human
uuuacugcauucuucuga

SEQ ID NO: 3688417 - RNA, 12 nt, Human
uuuacugccacu

SEQ ID NO: 3688418 - RNA, 17 nt, Human
uuuacugccugaauaaa

SEQ ID NO: 3688419 - RNA, 23 nt, Human
uuuacugucuauuaauauucagg

SEQ ID NO: 3688420 - RNA, 21 nt, Human
uuuacugucuuaauuaaguaa

SEQ ID NO: 3688421 - RNA, 14 nt, Human
uuuacuguuuguua

SEQ ID NO: 3688422 - RNA, 13 nt, Human
uuuacuucuuaua

SEQ ID NO: 3688423 - RNA, 17 nt, Human
uuuacuucuuauacauu

SEQ ID NO: 3688424 - RNA, 18 nt, Human
uuuacuugccauuacuca

SEQ ID NO: 3688425 - RNA, 18 nt, Human
uuuacuuuaaacuugucu

SEQ ID NO: 3688426 - RNA, 20 nt, Human
uuuacuuuagaagcacagua

SEQ ID NO: 3688427 - RNA, 20 nt, Human
uuuacuuucccuugcuuuuc

SEQ ID NO: 3688428 - RNA, 12 nt, Human
uuuacuuuggcc

SEQ ID NO: 3688429 - RNA, 18 nt, Human
uuuacuuuuaaacaguga

SEQ ID NO: 3688430 - RNA, 16 nt, Human
uuuacuuuuaaauguc

SEQ ID NO: 3688431 - RNA, 15 nt, Human
uuuacuuuuuggaaa

SEQ ID NO: 3688432 - RNA, 20 nt, Human
uuuagaaaaagaacaugcag

SEQ ID NO: 3688433 - RNA, 21 nt, Human
uuuagaaaaagaacaugcagu

SEQ ID NO: 3688434 - RNA, 12 nt, Human
uuuagaaacaca

SEQ ID NO: 3688435 - RNA, 16 nt, Human
uuuagaaacuuaucuu

SEQ ID NO: 3688436 - RNA, 19 nt, Human
uuuagaaacuuaucuuaca

SEQ ID NO: 3688437 - RNA, 23 nt, Human
uuuagaaagaagcccaauauuau

SEQ ID NO: 3688438 - RNA, 15 nt, Human
uuuagaaagauaauu

SEQ ID NO: 3688439 - RNA, 22 nt, Human
uuuagaaagcauuugaaugcau

SEQ ID NO: 3688440 - RNA, 20 nt, Human
uuuagaaauaaaccuuaaua

SEQ ID NO: 3688441 - RNA, 22 nt, Human
uuuagaaauacugcaagaaaau

SEQ ID NO: 3688442 - RNA, 16 nt, Human
uuuagaaaucauuuug

SEQ ID NO: 3688443 - RNA, 18 nt, Human
uuuagaaaucauuuugca

SEQ ID NO: 3688444 - RNA, 17 nt, Human
uuuagaacaauuuucuu

SEQ ID NO: 3688445 - RNA, 17 nt, Human
uuuagaagaaguguguc

SEQ ID NO: 3688446 - RNA, 15 nt, Human
uuuagaagugcauuu

SEQ ID NO: 3688447 - RNA, 18 nt, Human
uuuagaagugucauguuu

SEQ ID NO: 3688448 - RNA, 23 nt, Human
uuuagaauaaauucccaacuucu

SEQ ID NO: 3688449 - RNA, 15 nt, Human
uuuagaauaagaauu

SEQ ID NO: 3688450 - RNA, 19 nt, Human
uuuagaauaagaauuugca

SEQ ID NO: 3688451 - RNA, 21 nt, Human
uuuagaauaagaauuugcaua

SEQ ID NO: 3688452 - RNA, 14 nt, Human
uuuagaaucccagc

SEQ ID NO: 3688453 - RNA, 11 nt, Human
uuuagaauuga

SEQ ID NO: 3688454 - RNA, 16 nt, Human
uuuagacaaauacuca

SEQ ID NO: 3688455 - RNA, 21 nt, Human
uuuagacaaauacucaugugu

SEQ ID NO: 3688456 - RNA, 23 nt, Human
uuuagacaaauacucauguguau

SEQ ID NO: 3688457 - RNA, 16 nt, Human
uuuagacaccuucauu

SEQ ID NO: 3688458 - RNA, 16 nt, Human
uuuagacagucucacu

SEQ ID NO: 3688459 - RNA, 20 nt, Human
uuuagacagucucacuuugu

SEQ ID NO: 3688460 - RNA, 18 nt, Human
uuuagaccaaggaacaaa

SEQ ID NO: 3688461 - RNA, 22 nt, Human
uuuagacccuauugcugcuuga

SEQ ID NO: 3688462 - RNA, 22 nt, Human
uuuagacuugaaaagagacagg

SEQ ID NO: 3688463 - RNA, 15 nt, Human
uuuagagaggaaaag

SEQ ID NO: 3688464 - RNA, 21 nt, Human
uuuagagauaagaguuggcug

SEQ ID NO: 3688465 - RNA, 21 nt, Human
uuuagagaugaauuaaauuua

SEQ ID NO: 3688466 - RNA, 19 nt, Human
uuuagaguaagaaauuuca

SEQ ID NO: 3688467 - RNA, 18 nt, Human
uuuagaguagcaugagag

SEQ ID NO: 3688468 - RNA, 16 nt, Human
uuuagaguuagacugu

SEQ ID NO: 3688469 - RNA, 18 nt, Human
uuuagaguuagacuguug

SEQ ID NO: 3688470 - RNA, 13 nt, Human
uuuagauaauaca

SEQ ID NO: 3688471 - RNA, 19 nt, Human
uuuagauagcagccuggcu

SEQ ID NO: 3688472 - RNA, 13 nt, Human
uuuagauagcccu

SEQ ID NO: 3688473 - RNA, 14 nt, Human
uuuagauagcccug

SEQ ID NO: 3688474 - RNA, 18 nt, Human
uuuagauagcccuguccu

SEQ ID NO: 3688475 - RNA, 20 nt, Human
uuuagauagcccuguccugg

SEQ ID NO: 3688476 - RNA, 22 nt, Human
uuuagauagcccuguccuggug

SEQ ID NO: 3688477 - RNA, 16 nt, Human
uuuagaucaaauacuu

SEQ ID NO: 3688478 - RNA, 17 nt, Human
uuuagaucaaauacuuu

SEQ ID NO: 3688479 - RNA, 18 nt, Human
uuuagaugaaugucaguu

SEQ ID NO: 3688480 - RNA, 14 nt, Human
uuuagaugguuaca

SEQ ID NO: 3688481 - RNA, 17 nt, Human
uuuagaugguuacacug

SEQ ID NO: 3688482 - RNA, 18 nt, Human
uuuagaugguuacacugu

SEQ ID NO: 3688483 - RNA, 22 nt, Human
uuuagauugaaaacuuuucuca

SEQ ID NO: 3688484 - RNA, 18 nt, Human
uuuagauugagaaaugug

SEQ ID NO: 3688485 - RNA, 23 nt, Human
uuuagcaauuuaauauuuugcac

SEQ ID NO: 3688486 - RNA, 13 nt, Human
uuuagcaccccca

SEQ ID NO: 3688487 - RNA, 18 nt, Human
uuuagcacguuuaaaguu

SEQ ID NO: 3688488 - RNA, 19 nt, Human
uuuagcacguuuaaaguuc

SEQ ID NO: 3688489 - RNA, 22 nt, Human
uuuagcacguuuaaaguucugu

SEQ ID NO: 3688490 - RNA, 14 nt, Human
uuuagcaguucugc

SEQ ID NO: 3688491 - RNA, 16 nt, Human
uuuagcauaaaauuuu

SEQ ID NO: 3688492 - RNA, 20 nt, Human
uuuagcauuguagugcuuug

SEQ ID NO: 3688493 - RNA, 18 nt, Human
uuuagccaaacccuuguc

SEQ ID NO: 3688494 - RNA, 16 nt, Human
uuuagcccugaacauu

SEQ ID NO: 3688495 - RNA, 23 nt, Human
uuuagcuacuauauaugugauga

SEQ ID NO: 3688496 - RNA, 21 nt, Human
uuuagcuaggauuugaacacu

SEQ ID NO: 3688497 - RNA, 15 nt, Human
uuuagcugacaaaau

SEQ ID NO: 3688498 - RNA, 23 nt, Human
uuuagcugaugaacuuauucugu

SEQ ID NO: 3688499 - RNA, 13 nt, Human
uuuaggaaaauca

SEQ ID NO: 3688500 - RNA, 10 nt, Human
uuuaggaaau

SEQ ID NO: 3688501 - RNA, 22 nt, Human
uuuaggaaguugacuuauagua

SEQ ID NO: 3688502 - RNA, 18 nt, Human
uuuaggaauccuuuggug

SEQ ID NO: 3688503 - RNA, 21 nt, Human
uuuaggacacauuuagaugca

SEQ ID NO: 3688504 - RNA, 13 nt, Human
uuuaggagcagug

SEQ ID NO: 3688505 - RNA, 20 nt, Human
uuuaggcacucuuaaaugau

SEQ ID NO: 3688506 - RNA, 22 nt, Human
uuuaggcacucuuaaaugaucu

SEQ ID NO: 3688507 - RNA, 16 nt, Human
uuuagggaacaauuug

SEQ ID NO: 3688508 - RNA, 15 nt, Human
uuuagggaguauucu

SEQ ID NO: 3688509 - RNA, 13 nt, Human
uuuagggcagcuu

SEQ ID NO: 3688510 - RNA, 20 nt, Human
uuuagggcuguaaaaugcau

SEQ ID NO: 3688511 - RNA, 22 nt, Human
uuuaggguacuaaauuuaaauu

SEQ ID NO: 3688512 - RNA, 17 nt, Human
uuuagguacuauucuga

SEQ ID NO: 3688513 - RNA, 19 nt, Human
uuuaggucucuuccccucu

SEQ ID NO: 3688514 - RNA, 14 nt, Human
uuuaggucuuugua

SEQ ID NO: 3688515 - RNA, 21 nt, Human
uuuaggugaauuaauuaaaca

SEQ ID NO: 3688516 - RNA, 22 nt, Human
uuuagguguugauuuucuguug

SEQ ID NO: 3688517 - RNA, 11 nt, Human
uuuagguucua

SEQ ID NO: 3688518 - RNA, 12 nt, Human
uuuagguucuaa

SEQ ID NO: 3688519 - RNA, 14 nt, Human
uuuagguucuaaag

SEQ ID NO: 3688520 - RNA, 17 nt, Human
uuuaguaaucuguacau

SEQ ID NO: 3688521 - RNA, 13 nt, Human
uuuaguaauuucu

SEQ ID NO: 3688522 - RNA, 23 nt, Human
uuuaguagauauuaccaguuuuc

SEQ ID NO: 3688523 - RNA, 22 nt, Human
uuuaguagcagugauugucuua

SEQ ID NO: 3688524 - RNA, 21 nt, Human
uuuaguaugacgcugauacau

SEQ ID NO: 3688525 - RNA, 13 nt, Human
uuuaguauucauu

SEQ ID NO: 3688526 - RNA, 15 nt, Human
uuuaguauucauucu

SEQ ID NO: 3688527 - RNA, 14 nt, Human
uuuagucuugucuc

SEQ ID NO: 3688528 - RNA, 13 nt, Human
uuuagugcugcau

SEQ ID NO: 3688529 - RNA, 15 nt, Human
uuuaguggaaaauag

SEQ ID NO: 3688530 - RNA, 16 nt, Human
uuuaguguaaaaauga

SEQ ID NO: 3688531 - RNA, 18 nt, Human
uuuaguguaaaaaugaga

SEQ ID NO: 3688532 - RNA, 17 nt, Human
ucagauguuaaaauaaa

SEQ ID NO: 3688533 - RNA, 20 nt, Human
ucagauguuaaaauaaaugg

SEQ ID NO: 3688534 - RNA, 18 nt, Human
ucagauguugaauucuuu

SEQ ID NO: 3688535 - RNA, 16 nt, Human
ucagauguuuaaaaca

SEQ ID NO: 3688536 - RNA, 14 nt, Human
ucagauucccagag

SEQ ID NO: 3688537 - RNA, 19 nt, Human
ucagauucccagagcaaaa

SEQ ID NO: 3688538 - RNA, 22 nt, Human
ucagauucccagagcaaaauaa

SEQ ID NO: 3688539 - RNA, 22 nt, Human
ucagauugcaugugacucugaa

SEQ ID NO: 3688540 - RNA, 18 nt, Human
ucagauuguggaauguug

SEQ ID NO: 3688541 - RNA, 15 nt, Human
ucagauuuccagucu

SEQ ID NO: 3688542 - RNA, 12 nt, Human
ucagauuugaac

SEQ ID NO: 3688543 - RNA, 15 nt, Human
ucagauuugcacaaa

SEQ ID NO: 3688544 - RNA, 14 nt, Human
ucagauuuuauuau

SEQ ID NO: 3688545 - RNA, 15 nt, Human
ucagauuuuauuaug

SEQ ID NO: 3688546 - RNA, 16 nt, Human
ucagauuuuauuaugu

SEQ ID NO: 3688547 - RNA, 23 nt, Human
ucagauuuuauuauguaaauccc

SEQ ID NO: 3688548 - RNA, 15 nt, Human
ucagcaaacaggauc

SEQ ID NO: 3688549 - RNA, 13 nt, Human
ucagcaaaccauu

SEQ ID NO: 3688550 - RNA, 20 nt, Human
ucagcaaaccauuuuuaaag

SEQ ID NO: 3688551 - RNA, 15 nt, Human
ucagcaaacucuuuu

SEQ ID NO: 3688552 - RNA, 18 nt, Human
ucagcaagauaaacauua

SEQ ID NO: 3688553 - RNA, 16 nt, Human
ucagcaaggccaccuc

SEQ ID NO: 3688554 - RNA, 19 nt, Human
ucagcaaggcgcuaacuug

SEQ ID NO: 3688555 - RNA, 20 nt, Human
ucagcaaggggcucugcccu

SEQ ID NO: 3688556 - RNA, 19 nt, Human
ucagcacaaggccaucugg

SEQ ID NO: 3688557 - RNA, 18 nt, Human
ucagcacauauuuucugu

SEQ ID NO: 3688558 - RNA, 14 nt, Human
ucagcaccacccua

SEQ ID NO: 3688559 - RNA, 15 nt, Human
ucagcaccacucaag

SEQ ID NO: 3688560 - RNA, 20 nt, Human
ucagcaccacucaagaccaa

SEQ ID NO: 3688561 - RNA, 21 nt, Human
ucagcaccacucaagaccaaa

SEQ ID NO: 3688562 - RNA, 14 nt, Human
ucagcacccccuuc

SEQ ID NO: 3688563 - RNA, 17 nt, Human
ucagcaccccugucucu

SEQ ID NO: 3688564 - RNA, 15 nt, Human
ucagcaccccuucca

SEQ ID NO: 3688565 - RNA, 20 nt, Human
ucagcaccuacaguguacag

SEQ ID NO: 3688566 - RNA, 18 nt, Human
ucagcacgauuucuguuu

SEQ ID NO: 3688567 - RNA, 14 nt, Human
ucagcacuagccaa

SEQ ID NO: 3688568 - RNA, 14 nt, Human
ucagcacugaaaau

SEQ ID NO: 3688569 - RNA, 14 nt, Human
ucagcacuuggccc

SEQ ID NO: 3688570 - RNA, 23 nt, Human
ucagcacuugggggaucuguugu

SEQ ID NO: 3688571 - RNA, 21 nt, Human
ucagcacuugucucauuuuaa

SEQ ID NO: 3688572 - RNA, 11 nt, Human
ucagcagagug

SEQ ID NO: 3688573 - RNA, 16 nt, Human
ucagcagagugcuuua

SEQ ID NO: 3688574 - RNA, 18 nt, Human
ucagcagcaaauuuucag

SEQ ID NO: 3688575 - RNA, 17 nt, Human
ucagcagcccuccucac

SEQ ID NO: 3688576 - RNA, 18 nt, Human
ucagcagcccuccucacc

SEQ ID NO: 3688577 - RNA, 21 nt, Human
ucagcagccgccuuaagcuga

SEQ ID NO: 3688578 - RNA, 22 nt, Human
ucagcagccgccuuaagcugau

SEQ ID NO: 3688579 - RNA, 17 nt, Human
ucagcagcuagaaaaca

SEQ ID NO: 3688580 - RNA, 16 nt, Human
ucagcaggcagccuug

SEQ ID NO: 3688581 - RNA, 13 nt, Human
ucagcaguugcug

SEQ ID NO: 3688582 - RNA, 16 nt, Human
ucagcaguugcuggua

SEQ ID NO: 3688583 - RNA, 23 nt, Human
ucagcaguugcugguaaaaugaa

SEQ ID NO: 3688584 - RNA, 22 nt, Human
ucagcauauuuguauaguugcu

SEQ ID NO: 3688585 - RNA, 15 nt, Human
ucagcauccuggcac

SEQ ID NO: 3688586 - RNA, 21 nt, Human
ucagcauccuggcacccggcc

SEQ ID NO: 3688587 - RNA, 23 nt, Human
ucagcaucugaccucuaccuuca

SEQ ID NO: 3688588 - RNA, 14 nt, Human
ucagcaucugugau

SEQ ID NO: 3688589 - RNA, 17 nt, Human
ucagcaucugugauggg

SEQ ID NO: 3688590 - RNA, 18 nt, Human
ucagcaugaaaaugugug

SEQ ID NO: 3688591 - RNA, 18 nt, Human
ucagcaugaauuuguaau

SEQ ID NO: 3688592 - RNA, 15 nt, Human
ucagcaugcaauaca

SEQ ID NO: 3688593 - RNA, 12 nt, Human
ucagcaugucua

SEQ ID NO: 3688594 - RNA, 16 nt, Human
ucagcaugucuauuca

SEQ ID NO: 3688595 - RNA, 20 nt, Human
ucagcauuaccucuuuggaa

SEQ ID NO: 3688596 - RNA, 17 nt, Human
ucagcauuagugggaaa

SEQ ID NO: 3688597 - RNA, 23 nt, Human
ucagcauuagugggaaaaagugg

SEQ ID NO: 3688598 - RNA, 19 nt, Human
ucagcauuuccacaccaag

SEQ ID NO: 3688599 - RNA, 19 nt, Human
ucagcauuucuuuucuggc

SEQ ID NO: 3688600 - RNA, 23 nt, Human
ucagccaagguuuuauaaggcug

SEQ ID NO: 3688601 - RNA, 14 nt, Human
ucagccaaguuuua

SEQ ID NO: 3688602 - RNA, 15 nt, Human
ucagccaaguuuuau

SEQ ID NO: 3688603 - RNA, 17 nt, Human
ucagccacacccaggca

SEQ ID NO: 3688604 - RNA, 21 nt, Human
ucagccagaagccacccaaag

SEQ ID NO: 3688605 - RNA, 14 nt, Human
ucagccagagaagc

SEQ ID NO: 3688606 - RNA, 14 nt, Human
ucagccagcacuug

SEQ ID NO: 3688607 - RNA, 15 nt, Human
ucagccagccccauc

SEQ ID NO: 3688608 - RNA, 12 nt, Human
ucagccagcugc

SEQ ID NO: 3688609 - RNA, 22 nt, Human
ucagccagcugcccuaaauaac

SEQ ID NO: 3688610 - RNA, 12 nt, Human
ucagccaggagc

SEQ ID NO: 3688611 - RNA, 13 nt, Human
ucagccaggagcu

SEQ ID NO: 3688612 - RNA, 13 nt, Human
ucagccagggcca

SEQ ID NO: 3688613 - RNA, 14 nt, Human
ucagccagggccag

SEQ ID NO: 3688614 - RNA, 16 nt, Human
ucagccagggccaggg

SEQ ID NO: 3688615 - RNA, 23 nt, Human
ucagccaugaggaguugcuguuu

SEQ ID NO: 3688616 - RNA, 14 nt, Human
ucagcccacccccc

SEQ ID NO: 3688617 - RNA, 13 nt, Human
ucagcccagaaga

SEQ ID NO: 3688618 - RNA, 15 nt, Human
ucagcccagaagaaa

SEQ ID NO: 3688619 - RNA, 15 nt, Human
ucagccccaccccag

SEQ ID NO: 3688620 - RNA, 20 nt, Human
ucagccccaccccagguccu

SEQ ID NO: 3688621 - RNA, 16 nt, Human
ucagccccagcccagc

SEQ ID NO: 3688622 - RNA, 22 nt, Human
ucagccccagcccagcccagcu

SEQ ID NO: 3688623 - RNA, 13 nt, Human
ucagcccccagcc

SEQ ID NO: 3688624 - RNA, 16 nt, Human
ucagcccccugcuuca

SEQ ID NO: 3688625 - RNA, 16 nt, Human
ucagccccgagcuguc

SEQ ID NO: 3688626 - RNA, 13 nt, Human
ucagccccuagga

SEQ ID NO: 3688627 - RNA, 22 nt, Human
ucagccccuaggaguauauuuc

SEQ ID NO: 3688628 - RNA, 16 nt, Human
ucagccccuccucugc

SEQ ID NO: 3688629 - RNA, 17 nt, Human
ucagccccuccucugcc

SEQ ID NO: 3688630 - RNA, 19 nt, Human
ucagccccuccucugccac

SEQ ID NO: 3688631 - RNA, 21 nt, Human
ucagccccuccucugccaccu

SEQ ID NO: 3688632 - RNA, 21 nt, Human
ucagccccucuugccccccac

SEQ ID NO: 3688633 - RNA, 22 nt, Human
ucagccccucuugccccccacc

SEQ ID NO: 3688634 - RNA, 23 nt, Human
ucagccccucuugccccccaccc

SEQ ID NO: 3688635 - RNA, 23 nt, Human
ucagcccuaggguggagagccac

SEQ ID NO: 3688636 - RNA, 18 nt, Human
ucagcccucacacacccu

SEQ ID NO: 3688637 - RNA, 13 nt, Human
ucagcccucagaa

SEQ ID NO: 3688638 - RNA, 14 nt, Human
ucagcccucccugc

SEQ ID NO: 3688639 - RNA, 16 nt, Human
ucagcccucccugccc

SEQ ID NO: 3688640 - RNA, 17 nt, Human
ucagcccucccugcccc

SEQ ID NO: 3688641 - RNA, 16 nt, Human
ucagcccugacccugu

SEQ ID NO: 3688642 - RNA, 13 nt, Human
ucagcccugaggu

SEQ ID NO: 3688643 - RNA, 15 nt, Human
ucagcccugcaccau

SEQ ID NO: 3688644 - RNA, 19 nt, Human
ucagcccuggaggugccag

SEQ ID NO: 3688645 - RNA, 21 nt, Human
ucagcccuggaggugccagca

SEQ ID NO: 3688646 - RNA, 21 nt, Human
ucagcccugggccccaccacc

SEQ ID NO: 3688647 - RNA, 22 nt, Human
ucagcccugggccccaccaccu

SEQ ID NO: 3688648 - RNA, 23 nt, Human
ucagcccugggccccaccaccua

SEQ ID NO: 3688649 - RNA, 20 nt, Human
ucagccgagccgggccuggg

SEQ ID NO: 3688650 - RNA, 21 nt, Human
ucagccggcguggcaaauaua

SEQ ID NO: 3688651 - RNA, 23 nt, Human
ucagccguguaaccauggaccca

SEQ ID NO: 3688652 - RNA, 13 nt, Human
ucagccuaagaga

SEQ ID NO: 3688653 - RNA, 18 nt, Human
ucagccuagccgaccuca

SEQ ID NO: 3688654 - RNA, 21 nt, Human
ucagccuagccgaccucagcc

SEQ ID NO: 3688655 - RNA, 15 nt, Human
ucagccuccagccuc

SEQ ID NO: 3688656 - RNA, 14 nt, Human
ucagccucccaaag

SEQ ID NO: 3688657 - RNA, 22 nt, Human
ucagccucccaaagugcuggga

SEQ ID NO: 3688658 - RNA, 21 nt, Human
ucagccucccgaauagcuggg

SEQ ID NO: 3688659 - RNA, 17 nt, Human
ucagccucucucccagu

SEQ ID NO: 3688660 - RNA, 21 nt, Human
ucagccucucucccagucuac

SEQ ID NO: 3688661 - RNA, 12 nt, Human
ucagccucuuaa

SEQ ID NO: 3688662 - RNA, 18 nt, Human
ucagccugaggcugagac

SEQ ID NO: 3688663 - RNA, 18 nt, Human
ucagccugcuccagcugu

SEQ ID NO: 3688664 - RNA, 16 nt, Human
ucagccuggccagaca

SEQ ID NO: 3688665 - RNA, 18 nt, Human
ucagccuggccagacaca

SEQ ID NO: 3688666 - RNA, 20 nt, Human
ucagccuggccagacacagg

SEQ ID NO: 3688667 - RNA, 12 nt, Human
ucagccugggca

SEQ ID NO: 3688668 - RNA, 16 nt, Human
ucagccugucucuucc

SEQ ID NO: 3688669 - RNA, 17 nt, Human
ucagccugugcugcccg

SEQ ID NO: 3688670 - RNA, 15 nt, Human
ucagccuuacauuug

SEQ ID NO: 3688671 - RNA, 18 nt, Human
ucagccuuacauuuguga

SEQ ID NO: 3688672 - RNA, 19 nt, Human
ucagccuucuuuuucugga

SEQ ID NO: 3688673 - RNA, 19 nt, Human
ucagcgacuccguuggcca

SEQ ID NO: 3688674 - RNA, 18 nt, Human
ucagcgauguaugcagcu

SEQ ID NO: 3688675 - RNA, 16 nt, Human
ucagcggggacagcuc

SEQ ID NO: 3688676 - RNA, 17 nt, Human
ucagcggggacagcucc

SEQ ID NO: 3688677 - RNA, 18 nt, Human
ucagcggggacagcuccu

SEQ ID NO: 3688678 - RNA, 20 nt, Human
ucagcggggacagcuccuuc

SEQ ID NO: 3688679 - RNA, 21 nt, Human
ucagcggggacagcuccuucu

SEQ ID NO: 3688680 - RNA, 23 nt, Human
ucagcggggacagcuccuucugu

SEQ ID NO: 3688681 - RNA, 16 nt, Human
uuucccucagaaaaug

SEQ ID NO: 3688682 - RNA, 11 nt, Human
uuucccuccuu

SEQ ID NO: 3688683 - RNA, 13 nt, Human
uuucccugaccuc

SEQ ID NO: 3688684 - RNA, 12 nt, Human
uuucccugugcu

SEQ ID NO: 3688685 - RNA, 19 nt, Human
uuucccuucaguacccucu

SEQ ID NO: 3688686 - RNA, 14 nt, Human
uuucccuuccaguu

SEQ ID NO: 3688687 - RNA, 13 nt, Human
uuucccuuccucu

SEQ ID NO: 3688688 - RNA, 19 nt, Human
uuucccuuccuuccucucc

SEQ ID NO: 3688689 - RNA, 16 nt, Human
uuucccuucuugcauc

SEQ ID NO: 3688690 - RNA, 17 nt, Human
uuucccuugcuuccccu

SEQ ID NO: 3688691 - RNA, 20 nt, Human
uuucccuugcuuuucccucu

SEQ ID NO: 3688692 - RNA, 20 nt, Human
uuucccuuguagcuccuccc

SEQ ID NO: 3688693 - RNA, 21 nt, Human
uuucccuuuagcuguguuauu

SEQ ID NO: 3688694 - RNA, 23 nt, Human
uuucccuuugagguugcuuuguu

SEQ ID NO: 3688695 - RNA, 17 nt, Human
uuuccgccacaucccuc

SEQ ID NO: 3688696 - RNA, 22 nt, Human
uuuccguaaaaaugauuucagu

SEQ ID NO: 3688697 - RNA, 16 nt, Human
uuuccguuugcuuuug

SEQ ID NO: 3688698 - RNA, 15 nt, Human
uuuccuaaaagugua

SEQ ID NO: 3688699 - RNA, 13 nt, Human
uuuccuaaaugua

SEQ ID NO: 3688700 - RNA, 13 nt, Human
uuuccuaaauguu

SEQ ID NO: 3688701 - RNA, 23 nt, Human
uuuccuaacaaaagaugaaagca

SEQ ID NO: 3688702 - RNA, 23 nt, Human
uuuccuaauaaaguucuguacuc

SEQ ID NO: 3688703 - RNA, 12 nt, Human
uuuccuaauacu

SEQ ID NO: 3688704 - RNA, 22 nt, Human
uuuccuaaucagaaauuuuuau

SEQ ID NO: 3688705 - RNA, 20 nt, Human
uuuccuacuuuuccuucccu

SEQ ID NO: 3688706 - RNA, 21 nt, Human
uuuccuagcacacacuuuugg

SEQ ID NO: 3688707 - RNA, 17 nt, Human
uuuccuagcccucucac

SEQ ID NO: 3688708 - RNA, 23 nt, Human
uuuccuagcccucucacauuuau

SEQ ID NO: 3688709 - RNA, 14 nt, Human
uuuccuauaccauu

SEQ ID NO: 3688710 - RNA, 21 nt, Human
uuuccucaggcugcuggagga

SEQ ID NO: 3688711 - RNA, 12 nt, Human
uuuccucccuuc

SEQ ID NO: 3688712 - RNA, 13 nt, Human
uuuccucccuucu

SEQ ID NO: 3688713 - RNA, 14 nt, Human
uuuccucccuucug

SEQ ID NO: 3688714 - RNA, 22 nt, Human
uuuccuccugaggcuuuggauu

SEQ ID NO: 3688715 - RNA, 17 nt, Human
uuuccuccuuuaucaca

SEQ ID NO: 3688716 - RNA, 13 nt, Human
uuuccucugcuuu

SEQ ID NO: 3688717 - RNA, 21 nt, Human
uuuccugaaacaacuuggaaa

SEQ ID NO: 3688718 - RNA, 18 nt, Human
uuuccugaaccaugugga

SEQ ID NO: 3688719 - RNA, 20 nt, Human
uuuccugagaccacagagag

SEQ ID NO: 3688720 - RNA, 12 nt, Human
uuuccugcccug

SEQ ID NO: 3688721 - RNA, 13 nt, Human
uuuccugcccugg

SEQ ID NO: 3688722 - RNA, 17 nt, Human
uuuccugcccuuccuca

SEQ ID NO: 3688723 - RNA, 17 nt, Human
uuuccugccuucuucuu

SEQ ID NO: 3688724 - RNA, 12 nt, Human
uuuccugcuuca

SEQ ID NO: 3688725 - RNA, 20 nt, Human
uuuccuggaauugccagcug

SEQ ID NO: 3688726 - RNA, 16 nt, Human
uuuccuggacacucag

SEQ ID NO: 3688727 - RNA, 20 nt, Human
uuuccuggacauccucuucu

SEQ ID NO: 3688728 - RNA, 21 nt, Human
uuuccuggacauccucuucug

SEQ ID NO: 3688729 - RNA, 21 nt, Human
uuuccuggcacuggaccccag

SEQ ID NO: 3688730 - RNA, 22 nt, Human
uuuccuggugccaauuucaagu

SEQ ID NO: 3688731 - RNA, 23 nt, Human
uuuccuguauuuguucccaagag

SEQ ID NO: 3688732 - RNA, 20 nt, Human
uuuccuguccucuuucagcu

SEQ ID NO: 3688733 - RNA, 12 nt, Human
uuuccuguugaa

SEQ ID NO: 3688734 - RNA, 16 nt, Human
uuuccuguuucugaaa

SEQ ID NO: 3688735 - RNA, 20 nt, Human
uuuccuguuucugaaaagaa

SEQ ID NO: 3688736 - RNA, 13 nt, Human
uuuccuuaaucca

SEQ ID NO: 3688737 - RNA, 16 nt, Human
uuuccuuaauccagcu

SEQ ID NO: 3688738 - RNA, 16 nt, Human
uuuccuuacauaaaca

SEQ ID NO: 3688739 - RNA, 18 nt, Human
uuuccuuacauaaacauc

SEQ ID NO: 3688740 - RNA, 19 nt, Human
uuuccuucaagccagcaac

SEQ ID NO: 3688741 - RNA, 11 nt, Human
uuuccuucagu

SEQ ID NO: 3688742 - RNA, 12 nt, Human
uuuccuucagug

SEQ ID NO: 3688743 - RNA, 22 nt, Human
uuuccuucagugccuuauggaa

SEQ ID NO: 3688744 - RNA, 23 nt, Human
uuuccuucauucaacccaccugc

SEQ ID NO: 3688745 - RNA, 16 nt, Human
uuuccuucccucaaag

SEQ ID NO: 3688746 - RNA, 16 nt, Human
uuuccuucuugccuuc

SEQ ID NO: 3688747 - RNA, 20 nt, Human
uuuccuugaggggagccagg

SEQ ID NO: 3688748 - RNA, 19 nt, Human
uuuccuuguccccacacuc

SEQ ID NO: 3688749 - RNA, 21 nt, Human
uuuccuuguccccacacuccu

SEQ ID NO: 3688750 - RNA, 16 nt, Human
uuuccuuguuuaucag

SEQ ID NO: 3688751 - RNA, 21 nt, Human
uuuccuuuaaaaaaauuuaag

SEQ ID NO: 3688752 - RNA, 22 nt, Human
uuuccuuuaaaaaaauuuaagu

SEQ ID NO: 3688753 - RNA, 21 nt, Human
uuuccuuuaacugacaagcca

SEQ ID NO: 3688754 - RNA, 15 nt, Human
uuuccuuuaugugaa

SEQ ID NO: 3688755 - RNA, 19 nt, Human
uuuccuuuaugugaauuuu

SEQ ID NO: 3688756 - RNA, 13 nt, Human
uuuccuuugcucu

SEQ ID NO: 3688757 - RNA, 12 nt, Human
uuuccuuuggag

SEQ ID NO: 3688758 - RNA, 23 nt, Human
uuuccuuugucaucauuguauau

SEQ ID NO: 3688759 - RNA, 16 nt, Human
uuuccuuuuucugauu

SEQ ID NO: 3688760 - RNA, 17 nt, Human
uuuccuuuuugacacug

SEQ ID NO: 3688761 - RNA, 18 nt, Human
uuuccuuuuugacacuga

SEQ ID NO: 3688762 - RNA, 19 nt, Human
uuuccuuuuugacacugaa

SEQ ID NO: 3688763 - RNA, 16 nt, Human
uuuccuuuuuuaaaaa

SEQ ID NO: 3688764 - RNA, 13 nt, Human
uuuccuuuuuuau

SEQ ID NO: 3688765 - RNA, 20 nt, Human
uuuccuuuuuucccauaaga

SEQ ID NO: 3688766 - RNA, 17 nt, Human
uuuccuuuuuuguuauu

SEQ ID NO: 3688767 - RNA, 20 nt, Human
uuucgaagucauuaaacugg

SEQ ID NO: 3688768 - RNA, 15 nt, Human
uuucgacuugcauuu

SEQ ID NO: 3688769 - RNA, 13 nt, Human
uuucgaggccuga

SEQ ID NO: 3688770 - RNA, 18 nt, Human
uuucgcaggauucuuccu

SEQ ID NO: 3688771 - RNA, 17 nt, Human
uuucggauuuuuuccaa

SEQ ID NO: 3688772 - RNA, 20 nt, Human
uuucguccacagcuuccugu

SEQ ID NO: 3688773 - RNA, 18 nt, Human
uuucguuaacauugacca

SEQ ID NO: 3688774 - RNA, 19 nt, Human
uuucguuaacauugaccaa

SEQ ID NO: 3688775 - RNA, 14 nt, Human
uuucguuucuguau

SEQ ID NO: 3688776 - RNA, 14 nt, Human
uuucguuuguuugu

SEQ ID NO: 3688777 - RNA, 20 nt, Human
uuucuaaaaagauuagcaag

SEQ ID NO: 3688778 - RNA, 20 nt, Human
uuucuaaaaagucagauguu

SEQ ID NO: 3688779 - RNA, 12 nt, Human
uuucuaaaacua

SEQ ID NO: 3688780 - RNA, 13 nt, Human
uuucuaaaagcuu

SEQ ID NO: 3688781 - RNA, 15 nt, Human
uuucuaaacagagau

SEQ ID NO: 3688782 - RNA, 20 nt, Human
uuucuaaacuggagacugug

SEQ ID NO: 3688783 - RNA, 18 nt, Human
uuucuaaagccuuaaguc

SEQ ID NO: 3688784 - RNA, 17 nt, Human
uuucuaaagcugccagc

SEQ ID NO: 3688785 - RNA, 21 nt, Human
uuucuaaaggaguuuauguuc

SEQ ID NO: 3688786 - RNA, 19 nt, Human
uuucuaaaggccucuuccu

SEQ ID NO: 3688787 - RNA, 21 nt, Human
uuucuaaaggcuaccuuugua

SEQ ID NO: 3688788 - RNA, 17 nt, Human
uuucuaaaguaaaaaca

SEQ ID NO: 3688789 - RNA, 22 nt, Human
uuucuaaaguaaaaacaaagaa

SEQ ID NO: 3688790 - RNA, 16 nt, Human
uuucuaaaucuccaaa

SEQ ID NO: 3688791 - RNA, 19 nt, Human
uuucuaaaucuccaaaaua

SEQ ID NO: 3688792 - RNA, 20 nt, Human
uuucuaaccaagaggcuggu

SEQ ID NO: 3688793 - RNA, 14 nt, Human
uuucuaaccuugaa

SEQ ID NO: 3688794 - RNA, 17 nt, Human
uuucuaaccuugaaugc

SEQ ID NO: 3688795 - RNA, 19 nt, Human
uuucuaaccuugaaugcug

SEQ ID NO: 3688796 - RNA, 20 nt, Human
uuucuaaccuugaaugcugc

SEQ ID NO: 3688797 - RNA, 18 nt, Human
uuucuaacuacaaagguu

SEQ ID NO: 3688798 - RNA, 20 nt, Human
uuucuaacucugauguaaau

SEQ ID NO: 3688799 - RNA, 21 nt, Human
uuucuaacucugauguaaaug

SEQ ID NO: 3688800 - RNA, 14 nt, Human
uuucuaagaaacau

SEQ ID NO: 3688801 - RNA, 17 nt, Human
uuucuaagaaacauuua

SEQ ID NO: 3688802 - RNA, 14 nt, Human
uuucuaagauucua

SEQ ID NO: 3688803 - RNA, 20 nt, Human
uuucuaagguaacaagauga

SEQ ID NO: 3688804 - RNA, 20 nt, Human
uuucuaauggaaugguuugg

SEQ ID NO: 3688805 - RNA, 13 nt, Human
uuucuaauguggu

SEQ ID NO: 3688806 - RNA, 15 nt, Human
uuucuaauuaaccuu

SEQ ID NO: 3688807 - RNA, 16 nt, Human
uuucuaauugcuuauu

SEQ ID NO: 3688808 - RNA, 16 nt, Human
uuucuaauuugcugcu

SEQ ID NO: 3688809 - RNA, 14 nt, Human
uuucuacagcaaau

SEQ ID NO: 3688810 - RNA, 15 nt, Human
uuucuacauuauugc

SEQ ID NO: 3688811 - RNA, 17 nt, Human
uuucuacauuauugcuu

SEQ ID NO: 3688812 - RNA, 20 nt, Human
uuucuacauuauugcuuauu

SEQ ID NO: 3688813 - RNA, 21 nt, Human
uuucuacccaacggcccugca

SEQ ID NO: 3688814 - RNA, 22 nt, Human
uuucuacccagcgagcccuggu

SEQ ID NO: 3688815 - RNA, 15 nt, Human
uuucuacccuagcca

SEQ ID NO: 3688816 - RNA, 20 nt, Human
uuucuacccuagccauuccu

SEQ ID NO: 3688817 - RNA, 13 nt, Human
uuucuaccuccca

SEQ ID NO: 3688818 - RNA, 13 nt, Human
uuucuacucauuu

SEQ ID NO: 3688819 - RNA, 17 nt, Human
uuucuacucauuuuaau

SEQ ID NO: 3688820 - RNA, 16 nt, Human
uuucuacuuuuaaaga

SEQ ID NO: 3688821 - RNA, 20 nt, Human
uuucuagaacaucccugcca

SEQ ID NO: 3688822 - RNA, 22 nt, Human
uuucuagaacaucccugccagc

SEQ ID NO: 3688823 - RNA, 15 nt, Human
uuucuagacuuucug

SEQ ID NO: 3688824 - RNA, 16 nt, Human
uuucuagacuuucugu

SEQ ID NO: 3688825 - RNA, 16 nt, Human
uuucuagauuaagaua

SEQ ID NO: 3688826 - RNA, 19 nt, Human
uuucuagcuagaaauauga

SEQ ID NO: 3688827 - RNA, 21 nt, Human
uuucuagcuguugagcuguuu

SEQ ID NO: 3688828 - RNA, 17 nt, Human
uuucuaguggucuuugu

SEQ ID NO: 3688829 - RNA, 21 nt, Human
uuucuaguggucuuuguaaga

SEQ ID NO: 3688830 - RNA, 21 nt, Human
ucuagauuacccccucauugu

SEQ ID NO: 3688831 - RNA, 22 nt, Human
ucuagauucaaagguucuaggu

SEQ ID NO: 3688832 - RNA, 19 nt, Human
ucuagauuccauuggucca

SEQ ID NO: 3688833 - RNA, 21 nt, Human
ucuagauuccauugguccaag

SEQ ID NO: 3688834 - RNA, 22 nt, Human
ucuagauuccauugguccaaga

SEQ ID NO: 3688835 - RNA, 23 nt, Human
ucuagauuccauugguccaagau

SEQ ID NO: 3688836 - RNA, 16 nt, Human
ucuagcaaauguuaug

SEQ ID NO: 3688837 - RNA, 22 nt, Human
ucuagcacaauuugcacuaaau

SEQ ID NO: 3688838 - RNA, 14 nt, Human
ucuagcacuuccuu

SEQ ID NO: 3688839 - RNA, 19 nt, Human
ucuagcaugccaacaagaa

SEQ ID NO: 3688840 - RNA, 18 nt, Human
ucuagcauggcauauuuu

SEQ ID NO: 3688841 - RNA, 13 nt, Human
ucuagccagagga

SEQ ID NO: 3688842 - RNA, 11 nt, Human
ucuagccugca

SEQ ID NO: 3688843 - RNA, 20 nt, Human
ucuagccugcacuuugaugu

SEQ ID NO: 3688844 - RNA, 12 nt, Human
ucuagccugggc

SEQ ID NO: 3688845 - RNA, 20 nt, Human
ucuagcuaauggaaaaugau

SEQ ID NO: 3688846 - RNA, 15 nt, Human
ucuagcuaugcugua

SEQ ID NO: 3688847 - RNA, 15 nt, Human
ucuagcucucuaggc

SEQ ID NO: 3688848 - RNA, 16 nt, Human
ucuagcucucuaggcc

SEQ ID NO: 3688849 - RNA, 10 nt, Human
ucuagcugaa

SEQ ID NO: 3688850 - RNA, 21 nt, Human
ucuagcugggggugggccagg

SEQ ID NO: 3688851 - RNA, 16 nt, Human
ucuaggaaaauauuuu

SEQ ID NO: 3688852 - RNA, 23 nt, Human
ucuaggacacaguuccugggaac

SEQ ID NO: 3688853 - RNA, 15 nt, Human
ucuaggaccuguguc

SEQ ID NO: 3688854 - RNA, 13 nt, Human
ucuaggagaggag

SEQ ID NO: 3688855 - RNA, 20 nt, Human
ucuaggagcugggaggaaaa

SEQ ID NO: 3688856 - RNA, 21 nt, Human
ucuaggagcugggaggaaaag

SEQ ID NO: 3688857 - RNA, 15 nt, Human
ucuaggcucugccuu

SEQ ID NO: 3688858 - RNA, 12 nt, Human
ucuaggcugggg

SEQ ID NO: 3688859 - RNA, 12 nt, Human
ucuagggaaaaa

SEQ ID NO: 3688860 - RNA, 19 nt, Human
ucuagggaaggccaccugc

SEQ ID NO: 3688861 - RNA, 20 nt, Human
ucuagggaaggccaccugca

SEQ ID NO: 3688862 - RNA, 15 nt, Human
ucuagggaccccucc

SEQ ID NO: 3688863 - RNA, 17 nt, Human
ucuagggaccccuccuc

SEQ ID NO: 3688864 - RNA, 20 nt, Human
ucuagggaccccuccucccu

SEQ ID NO: 3688865 - RNA, 20 nt, Human
ucuaggguacauggugcugg

SEQ ID NO: 3688866 - RNA, 17 nt, Human
ucuagguaggaaaugug

SEQ ID NO: 3688867 - RNA, 18 nt, Human
ucuaggucaguacccacc

SEQ ID NO: 3688868 - RNA, 21 nt, Human
ucuaggucaguacccaccuga

SEQ ID NO: 3688869 - RNA, 20 nt, Human
ucuagguuuaacucagauca

SEQ ID NO: 3688870 - RNA, 19 nt, Human
ucuagguuucaaagaugcu

SEQ ID NO: 3688871 - RNA, 17 nt, Human
ucuaguaauaaagacuc

SEQ ID NO: 3688872 - RNA, 14 nt, Human
ucuaguaauauauu

SEQ ID NO: 3688873 - RNA, 16 nt, Human
ucuaguacacuuuuau

SEQ ID NO: 3688874 - RNA, 14 nt, Human
ucuaguacugugaa

SEQ ID NO: 3688875 - RNA, 15 nt, Human
ucuaguacugugaau

SEQ ID NO: 3688876 - RNA, 17 nt, Human
ucuaguacuugaaaaag

SEQ ID NO: 3688877 - RNA, 18 nt, Human
ucuaguagcugaaaugca

SEQ ID NO: 3688878 - RNA, 22 nt, Human
ucuaguauuuauggguggauuu

SEQ ID NO: 3688879 - RNA, 16 nt, Human
ucuaguccuauucuau

SEQ ID NO: 3688880 - RNA, 19 nt, Human
ucuaguccuauucuauugc

SEQ ID NO: 3688881 - RNA, 19 nt, Human
ucuagugagcagucaggaa

SEQ ID NO: 3688882 - RNA, 22 nt, Human
ucuagugagcagucaggaaaga

SEQ ID NO: 3688883 - RNA, 17 nt, Human
ucuagugcagcugaaau

SEQ ID NO: 3688884 - RNA, 19 nt, Human
ucuagugcagcugauuuua

SEQ ID NO: 3688885 - RNA, 19 nt, Human
ucuagugggacagcccaga

SEQ ID NO: 3688886 - RNA, 17 nt, Human
ucuaguggucuuuguaa

SEQ ID NO: 3688887 - RNA, 18 nt, Human
ucuaguggucuuuguaag

SEQ ID NO: 3688888 - RNA, 21 nt, Human
ucuaguggucuuuguaagagu

SEQ ID NO: 3688889 - RNA, 17 nt, Human
ucuaguguuugauuguc

SEQ ID NO: 3688890 - RNA, 14 nt, Human
ucuaguucauugaa

SEQ ID NO: 3688891 - RNA, 17 nt, Human
ucuaguuccccuguuua

SEQ ID NO: 3688892 - RNA, 15 nt, Human
ucuaguucugccagg

SEQ ID NO: 3688893 - RNA, 19 nt, Human
ucuaguugaaaauaaagug

SEQ ID NO: 3688894 - RNA, 19 nt, Human
ucuaguuucucuuagaaaa

SEQ ID NO: 3688895 - RNA, 14 nt, Human
ucuaguuucuugug

SEQ ID NO: 3688896 - RNA, 23 nt, Human
ucuaguuugauuaaauucuugca

SEQ ID NO: 3688897 - RNA, 13 nt, Human
ucuaguuugcauu

SEQ ID NO: 3688898 - RNA, 18 nt, Human
ucuaguuuucaguuugua

SEQ ID NO: 3688899 - RNA, 12 nt, Human
ucuauaaaacuc

SEQ ID NO: 3688900 - RNA, 13 nt, Human
ucuauaaaccgaa

SEQ ID NO: 3688901 - RNA, 14 nt, Human
ucuauaaacuauaa

SEQ ID NO: 3688902 - RNA, 20 nt, Human
ucuauaaagcauuuaacccc

SEQ ID NO: 3688903 - RNA, 22 nt, Human
ucuauaaagcgauauacagaug

SEQ ID NO: 3688904 - RNA, 16 nt, Human
ucuauaaauuguccgu

SEQ ID NO: 3688905 - RNA, 20 nt, Human
ucuauaaucccagcacuuug

SEQ ID NO: 3688906 - RNA, 16 nt, Human
ucuauaauuuaccuaa

SEQ ID NO: 3688907 - RNA, 11 nt, Human
ucuauacaaau

SEQ ID NO: 3688908 - RNA, 15 nt, Human
ucuauacauaucuuu

SEQ ID NO: 3688909 - RNA, 18 nt, Human
ucuauacauaucuuuauu

SEQ ID NO: 3688910 - RNA, 14 nt, Human
ucuauaccaauaaa

SEQ ID NO: 3688911 - RNA, 17 nt, Human
ucuauaccaauaaagug

SEQ ID NO: 3688912 - RNA, 16 nt, Human
ucuauagaaaguguuc

SEQ ID NO: 3688913 - RNA, 23 nt, Human
ucuauagaaaguguucuguuaca

SEQ ID NO: 3688914 - RNA, 17 nt, Human
ucuauagcaucacuuaa

SEQ ID NO: 3688915 - RNA, 20 nt, Human
ucuauaggaacauaugaaaa

SEQ ID NO: 3688916 - RNA, 14 nt, Human
ucuauaguucuaga

SEQ ID NO: 3688917 - RNA, 15 nt, Human
ucuauaguucuagac

SEQ ID NO: 3688918 - RNA, 12 nt, Human
ucuauauaaaau

SEQ ID NO: 3688919 - RNA, 14 nt, Human
ucuauauaaaauaa

SEQ ID NO: 3688920 - RNA, 15 nt, Human
ucuauauaaaauaac

SEQ ID NO: 3688921 - RNA, 21 nt, Human
ucuauauaguaccuuugcucu

SEQ ID NO: 3688922 - RNA, 14 nt, Human
ucuauauauaauuc

SEQ ID NO: 3688923 - RNA, 18 nt, Human
ucuauauauaauucugua

SEQ ID NO: 3688924 - RNA, 21 nt, Human
ucuauauauaauucuguacau

SEQ ID NO: 3688925 - RNA, 23 nt, Human
ucuauauauaauucuguacauag

SEQ ID NO: 3688926 - RNA, 12 nt, Human
ucuauaugaauu

SEQ ID NO: 3688927 - RNA, 18 nt, Human
ucuauauguacuugucaa

SEQ ID NO: 3688928 - RNA, 23 nt, Human
ucuauauguacuugucaaagaag

SEQ ID NO: 3688929 - RNA, 13 nt, Human
ucuauauuuuaca

SEQ ID NO: 3688930 - RNA, 13 nt, Human
ucuauauuuucau

SEQ ID NO: 3688931 - RNA, 19 nt, Human
ucuaucaaccccagacacu

SEQ ID NO: 3688932 - RNA, 21 nt, Human
ucuaucaaccccagacacugg

SEQ ID NO: 3688933 - RNA, 23 nt, Human
ucuaucaacuuuaaucaaguugu

SEQ ID NO: 3688934 - RNA, 15 nt, Human
ucuaucaaguauuau

SEQ ID NO: 3688935 - RNA, 22 nt, Human
ucuaucaaguauuauaccuuuu

SEQ ID NO: 3688936 - RNA, 18 nt, Human
ucuaucaagucaaucauu

SEQ ID NO: 3688937 - RNA, 13 nt, Human
ucuaucauuuaau

SEQ ID NO: 3688938 - RNA, 16 nt, Human
ucuaucauuuaauaau

SEQ ID NO: 3688939 - RNA, 22 nt, Human
ucuaucauuuaauaauauacuu

SEQ ID NO: 3688940 - RNA, 16 nt, Human
ucuaucauuuuuguac

SEQ ID NO: 3688941 - RNA, 18 nt, Human
ucuauccaaaucugaaga

SEQ ID NO: 3688942 - RNA, 17 nt, Human
ucuauccacagagaguc

SEQ ID NO: 3688943 - RNA, 12 nt, Human
ucuaucucaucu

SEQ ID NO: 3688944 - RNA, 12 nt, Human
ucuaucucucaa

SEQ ID NO: 3688945 - RNA, 12 nt, Human
ucuaucugggcc

SEQ ID NO: 3688946 - RNA, 17 nt, Human
ucuaucugggccugggc

SEQ ID NO: 3688947 - RNA, 18 nt, Human
ucuaucugggccugggcu

SEQ ID NO: 3688948 - RNA, 20 nt, Human
ucuaucuugcucuguaaucu

SEQ ID NO: 3688949 - RNA, 22 nt, Human
ucuaucuuugagcgcccacuag

SEQ ID NO: 3688950 - RNA, 18 nt, Human
ucuaucuuuuguuuccuu

SEQ ID NO: 3688951 - RNA, 17 nt, Human
ucuaugaaguauauaau

SEQ ID NO: 3688952 - RNA, 15 nt, Human
ucuaugagucuagau

SEQ ID NO: 3688953 - RNA, 22 nt, Human
ucuaugauucguguaauuacuu

SEQ ID NO: 3688954 - RNA, 14 nt, Human
ucuaugcauuuucu

SEQ ID NO: 3688955 - RNA, 21 nt, Human
ucuaugccaaagaucacuugu

SEQ ID NO: 3688956 - RNA, 12 nt, Human
ucuaugcucucg

SEQ ID NO: 3688957 - RNA, 15 nt, Human
ucuaugcugcuuuua

SEQ ID NO: 3688958 - RNA, 13 nt, Human
ucuaugcuuucca

SEQ ID NO: 3688959 - RNA, 12 nt, Human
ucuaugggacuc

SEQ ID NO: 3688960 - RNA, 19 nt, Human
ucuaugggacucaaugcac

SEQ ID NO: 3688961 - RNA, 13 nt, Human
ucuaugguaaaga

SEQ ID NO: 3688962 - RNA, 22 nt, Human
ucuaugguaaagauauuauuca

SEQ ID NO: 3688963 - RNA, 20 nt, Human
ucuaugguuaugaaagaaua

SEQ ID NO: 3688964 - RNA, 20 nt, Human
ucuauguacuaguacugugu

SEQ ID NO: 3688965 - RNA, 14 nt, Human
ucuauguaggaaaa

SEQ ID NO: 3688966 - RNA, 18 nt, Human
ucuauguaggaaaaaaau

SEQ ID NO: 3688967 - RNA, 22 nt, Human
ucuauguuuacaaauggacaua

SEQ ID NO: 3688968 - RNA, 12 nt, Human
ucuauuaaaaga

SEQ ID NO: 3688969 - RNA, 17 nt, Human
ucuauuaaaagacucau

SEQ ID NO: 3688970 - RNA, 22 nt, Human
ucuauuaaagugcuaagguucu

SEQ ID NO: 3688971 - RNA, 22 nt, Human
ucuauuaauauauguauuauuu

SEQ ID NO: 3688972 - RNA, 16 nt, Human
ucuauuaauauucagg

SEQ ID NO: 3688973 - RNA, 19 nt, Human
ucuauuagacuuuagaaau

SEQ ID NO: 3688974 - RNA, 18 nt, Human
ucuauuagcuuacugauu

SEQ ID NO: 3688975 - RNA, 23 nt, Human
ucuauuaugaaugugaagccuuc

SEQ ID NO: 3688976 - RNA, 17 nt, Human
ucuauuauggaaaacug

SEQ ID NO: 3688977 - RNA, 15 nt, Human
ucuauuccaauaaac

SEQ ID NO: 3688978 - RNA, 12 nt, Human
ucuauuccagcu

SEQ ID NO: 3688979 - RNA, 18 nt, Human
ucuauucgccacacagua

SEQ ID NO: 3688980 - RNA, 22 nt, Human
ucguuuaccuucaaacuuuagg

SEQ ID NO: 3688981 - RNA, 21 nt, Human
ucguuucaaaaacacaguguu

SEQ ID NO: 3688982 - RNA, 12 nt, Human
ucguuucuguau

SEQ ID NO: 3688983 - RNA, 15 nt, Human
ucguuuguguucugu

SEQ ID NO: 3688984 - RNA, 10 nt, Human
ucguuuguuu

SEQ ID NO: 3688985 - RNA, 20 nt, Human
ucguuuguuuguuuguuuaa

SEQ ID NO: 3688986 - RNA, 22 nt, Human
ucguuuucaaaauuguuacaaa

SEQ ID NO: 3688987 - RNA, 18 nt, Human
ucguuuuuauauuaaugu

SEQ ID NO: 3688988 - RNA, 14 nt, Human
ucguuuuuuacaaa

SEQ ID NO: 3688989 - RNA, 20 nt, Human
ucguuuuuuuuuuguuuguu

SEQ ID NO: 3688990 - RNA, 18 nt, Human
ucuaaaaagauuagcaag

SEQ ID NO: 3688991 - RNA, 19 nt, Human
ucuaaaaauauacauguuu

SEQ ID NO: 3688992 - RNA, 15 nt, Human
ucuaaaacaauaaaa

SEQ ID NO: 3688993 - RNA, 11 nt, Human
ucuaaaagaaa

SEQ ID NO: 3688994 - RNA, 17 nt, Human
ucuaaaagauccuuuuu

SEQ ID NO: 3688995 - RNA, 12 nt, Human
ucuaaaagcacc

SEQ ID NO: 3688996 - RNA, 14 nt, Human
ucuaaaaucaugaa

SEQ ID NO: 3688997 - RNA, 19 nt, Human
ucuaaaaucuuauaguucu

SEQ ID NO: 3688998 - RNA, 19 nt, Human
ucuaaaaugugauguucua

SEQ ID NO: 3688999 - RNA, 18 nt, Human
ucuaaaauuauaaaugac

SEQ ID NO: 3689000 - RNA, 19 nt, Human
ucuaaacaagauuuuaaag

SEQ ID NO: 3689001 - RNA, 13 nt, Human
ucuaaacauuaau

SEQ ID NO: 3689002 - RNA, 17 nt, Human
ucuaaacauuaaucaau

SEQ ID NO: 3689003 - RNA, 19 nt, Human
ucuaaacguaagcacuguu

SEQ ID NO: 3689004 - RNA, 18 nt, Human
uccuaccugcccuggaac

SEQ ID NO: 3689005 - RNA, 18 nt, Human
uccuacucccagacaccc

SEQ ID NO: 3689006 - RNA, 16 nt, Human
uccuacucggcucugc

SEQ ID NO: 3689007 - RNA, 22 nt, Human
uccuacucucacacugguucuc

SEQ ID NO: 3689008 - RNA, 14 nt, Human
uccuacucuguguc

SEQ ID NO: 3689009 - RNA, 23 nt, Human
uccuacucuucucucugcucuga

SEQ ID NO: 3689010 - RNA, 17 nt, Human
ucgcuucccccauagcc

SEQ ID NO: 3689011 - RNA, 19 nt, Human
ucgcuucccugaaagacug

SEQ ID NO: 3689012 - RNA, 14 nt, Human
ucgcuucucuguga

SEQ ID NO: 3689013 - RNA, 15 nt, Human
ucgcuucuugccucu

SEQ ID NO: 3689014 - RNA, 21 nt, Human
ucgcuucuugccucugugcug

SEQ ID NO: 3689015 - RNA, 21 nt, Human
ucgcuugugcagaaaacauug

SEQ ID NO: 3689016 - RNA, 23 nt, Human
ucgcuugugcagaaaacauuguu

SEQ ID NO: 3689017 - RNA, 19 nt, Human
ucgcuuuauuggcugagau

SEQ ID NO: 3689018 - RNA, 15 nt, Human
ucggaaaacaugcua

SEQ ID NO: 3689019 - RNA, 19 nt, Human
ucggaacccaagcuuagaa

SEQ ID NO: 3689020 - RNA, 20 nt, Human
ucggaacccaagcuuagaac

SEQ ID NO: 3689021 - RNA, 16 nt, Human
ucggaaccgcucaccu

SEQ ID NO: 3689022 - RNA, 19 nt, Human
ucggaaccgcucaccuaga

SEQ ID NO: 3689023 - RNA, 22 nt, Human
ucggaaccgcucaccuagagcc

SEQ ID NO: 3689024 - RNA, 13 nt, Human
ucggaagcagugc

SEQ ID NO: 3689025 - RNA, 15 nt, Human
ucggaagcagugccu

SEQ ID NO: 3689026 - RNA, 22 nt, Human
ucggaagcagugccuuccauaa

SEQ ID NO: 3689027 - RNA, 23 nt, Human
ucggaagcagugccuuccauaau

SEQ ID NO: 3689028 - RNA, 19 nt, Human
ucggaaggcuggcugggca

SEQ ID NO: 3689029 - RNA, 14 nt, Human
ucggagaagagcug

SEQ ID NO: 3689030 - RNA, 15 nt, Human
ucggagacagugauc

SEQ ID NO: 3689031 - RNA, 21 nt, Human
ucggagcaucccggaggaaau

SEQ ID NO: 3689032 - RNA, 23 nt, Human
ucggagcaucccggaggaaaucu

SEQ ID NO: 3689033 - RNA, 15 nt, Human
ucggagcccugucuc

SEQ ID NO: 3689034 - RNA, 12 nt, Human
ucggaggaagcc

SEQ ID NO: 3689035 - RNA, 17 nt, Human
ucggaguaucugggaac

SEQ ID NO: 3689036 - RNA, 13 nt, Human
ucggaguucuucu

SEQ ID NO: 3689037 - RNA, 18 nt, Human
ucggauaguugcuauuuu

SEQ ID NO: 3689038 - RNA, 20 nt, Human
ucggaucuggggcucuggga

SEQ ID NO: 3689039 - RNA, 10 nt, Human
ucggauuaga

SEQ ID NO: 3689040 - RNA, 16 nt, Human
ucggauuuggggugga

SEQ ID NO: 3689041 - RNA, 16 nt, Human
ucggcauuucaaaugu

SEQ ID NO: 3689042 - RNA, 23 nt, Human
ucggcccacagcucccaccccac

SEQ ID NO: 3689043 - RNA, 19 nt, Human
ucggccccaccagugccuc

SEQ ID NO: 3689044 - RNA, 22 nt, Human
ucggccuagggcccccacaguu

SEQ ID NO: 3689045 - RNA, 16 nt, Human
ucggccuccauccuga

SEQ ID NO: 3689046 - RNA, 17 nt, Human
ucggccuccauccugag

SEQ ID NO: 3689047 - RNA, 21 nt, Human
ucggccucuaaccccaggccc

SEQ ID NO: 3689048 - RNA, 16 nt, Human
ucggccugcccccacc

SEQ ID NO: 3689049 - RNA, 18 nt, Human
ucggcguggcccaaggcu

SEQ ID NO: 3689050 - RNA, 18 nt, Human
ucggcucacugcauccuc

SEQ ID NO: 3689051 - RNA, 22 nt, Human
ucggcuccaguccccagaacuc

SEQ ID NO: 3689052 - RNA, 14 nt, Human
ucggcucccuggag

SEQ ID NO: 3689053 - RNA, 16 nt, Human
ucggcuccugcugcac

SEQ ID NO: 3689054 - RNA, 17 nt, Human
ucggcuccugcugcacc

SEQ ID NO: 3689055 - RNA, 21 nt, Human
ucggcucugcaguccuacuca

SEQ ID NO: 3689056 - RNA, 14 nt, Human
ucggcucugggugg

SEQ ID NO: 3689057 - RNA, 13 nt, Human
ucggcuggcuccc

SEQ ID NO: 3689058 - RNA, 19 nt, Human
ucggcuggcuccccugcag

SEQ ID NO: 3689059 - RNA, 17 nt, Human
ucggcuuuucucagcug

SEQ ID NO: 3689060 - RNA, 12 nt, Human
ucgggaagagag

SEQ ID NO: 3689061 - RNA, 23 nt, Human
ucgggaagagaggaguucaauga

SEQ ID NO: 3689062 - RNA, 20 nt, Human
ucgggacaccugcccugccc

SEQ ID NO: 3689063 - RNA, 16 nt, Human
ucgggagcagugucuu

SEQ ID NO: 3689064 - RNA, 19 nt, Human
ucgggaggucgaggcagga

SEQ ID NO: 3689065 - RNA, 15 nt, Human
ucgggcaccagccag

SEQ ID NO: 3689066 - RNA, 16 nt, Human
ucgggcaccagccagc

SEQ ID NO: 3689067 - RNA, 21 nt, Human
ucgggcagcacaaguguaaug

SEQ ID NO: 3689068 - RNA, 19 nt, Human
ucgggcaggggcuggaggg

SEQ ID NO: 3689069 - RNA, 13 nt, Human
ucgggccccaccu

SEQ ID NO: 3689070 - RNA, 15 nt, Human
ucgggccccaccugc

SEQ ID NO: 3689071 - RNA, 13 nt, Human
ucgggcccuuccc

SEQ ID NO: 3689072 - RNA, 17 nt, Human
ucgggcucagcucuggc

SEQ ID NO: 3689073 - RNA, 14 nt, Human
ucgggcuccugugc

SEQ ID NO: 3689074 - RNA, 12 nt, Human
ucgggcugugcc

SEQ ID NO: 3689075 - RNA, 15 nt, Human
ucgggcugugcccgg

SEQ ID NO: 3689076 - RNA, 15 nt, Human
ucggggaacuccugg

SEQ ID NO: 3689077 - RNA, 16 nt, Human
ucggggaacuccugga

SEQ ID NO: 3689078 - RNA, 19 nt, Human
ucggggagaggcugaggac

SEQ ID NO: 3689079 - RNA, 20 nt, Human
ucggggagccgggagccuga

SEQ ID NO: 3689080 - RNA, 16 nt, Human
ucggggugcacaggag

SEQ ID NO: 3689081 - RNA, 19 nt, Human
ucggggugcacaggagggg

SEQ ID NO: 3689082 - RNA, 22 nt, Human
ucggguuuuauuguuuaaaauc

SEQ ID NO: 3689083 - RNA, 21 nt, Human
ucgguaaguugaauggccugc

SEQ ID NO: 3689084 - RNA, 15 nt, Human
ucgguacccaccaca

SEQ ID NO: 3689085 - RNA, 16 nt, Human
ucgguagguucagcca

SEQ ID NO: 3689086 - RNA, 20 nt, Human
ucgguauccccccaucuugc

SEQ ID NO: 3689087 - RNA, 13 nt, Human
ucgguccuggugc

SEQ ID NO: 3689088 - RNA, 14 nt, Human
ucggucugugcccc

SEQ ID NO: 3689089 - RNA, 17 nt, Human
ucggugccaucagugcc

SEQ ID NO: 3689090 - RNA, 15 nt, Human
ucgguuccacguccc

SEQ ID NO: 3689091 - RNA, 20 nt, Human
ucguaaccagccagauccuc

SEQ ID NO: 3689092 - RNA, 15 nt, Human
ucguacauaauacug

SEQ ID NO: 3689093 - RNA, 22 nt, Human
ucguagcuuucccaaauaaacu

SEQ ID NO: 3689094 - RNA, 21 nt, Human
ucguauaacacaauaugaaua

SEQ ID NO: 3689095 - RNA, 16 nt, Human
ucguauagaagucuuc

SEQ ID NO: 3689096 - RNA, 17 nt, Human
ucguauagaagucuuca

SEQ ID NO: 3689097 - RNA, 18 nt, Human
ucgucacuaauacacagu

SEQ ID NO: 3689098 - RNA, 23 nt, Human
ucgucacugcuuaacuucacaua

SEQ ID NO: 3689099 - RNA, 12 nt, Human
ucguccagggag

SEQ ID NO: 3689100 - RNA, 17 nt, Human
ucguccucccccugcca

SEQ ID NO: 3689101 - RNA, 18 nt, Human
ucguccucccccugccag

SEQ ID NO: 3689102 - RNA, 15 nt, Human
ucguccuuacuccug

SEQ ID NO: 3689103 - RNA, 14 nt, Human
ucgucgcacagucu

SEQ ID NO: 3689104 - RNA, 19 nt, Human
ucgucggggggacagcucc

SEQ ID NO: 3689105 - RNA, 21 nt, Human
ucgucuccagccccuucucag

SEQ ID NO: 3689106 - RNA, 15 nt, Human
ucgucuuccgucucc

SEQ ID NO: 3689107 - RNA, 15 nt, Human
ucgucuucuuggcca

SEQ ID NO: 3689108 - RNA, 16 nt, Human
ucgugaaaacacauuu

SEQ ID NO: 3689109 - RNA, 14 nt, Human
ucgugaacaucccc

SEQ ID NO: 3689110 - RNA, 19 nt, Human
ucgugaacauccccuccca

SEQ ID NO: 3689111 - RNA, 15 nt, Human
ucgugaagaagccug

SEQ ID NO: 3689112 - RNA, 21 nt, Human
ucgugaccugcuaggccagag

SEQ ID NO: 3689113 - RNA, 17 nt, Human
ucgugacgcugaauaaa

SEQ ID NO: 3689114 - RNA, 19 nt, Human
ucgugagucauuuaaaugu

SEQ ID NO: 3689115 - RNA, 22 nt, Human
ucgugcauuggaagaccccacc

SEQ ID NO: 3689116 - RNA, 22 nt, Human
ucgugccaccccgagggcugag

SEQ ID NO: 3689117 - RNA, 13 nt, Human
ucgugccuguguc

SEQ ID NO: 3689118 - RNA, 15 nt, Human
ucgugccugugucca

SEQ ID NO: 3689119 - RNA, 18 nt, Human
ucgugcuaaauuuucagu

SEQ ID NO: 3689120 - RNA, 16 nt, Human
ucgugcuacugcacuc

SEQ ID NO: 3689121 - RNA, 14 nt, Human
ucgugcuuuaagug

SEQ ID NO: 3689122 - RNA, 24 nt, Human
ucguggaaagggugcugcuucccu

SEQ ID NO: 3689123 - RNA, 21 nt, Human
ucguggaacaguuaccucugc

SEQ ID NO: 3689124 - RNA, 17 nt, Human
ucguggacacacacaga

SEQ ID NO: 3689125 - RNA, 12 nt, Human
ucguggacaccu

SEQ ID NO: 3689126 - RNA, 13 nt, Human
ucguggacaccug

SEQ ID NO: 3689127 - RNA, 14 nt, Human
ucguggacaccugc

SEQ ID NO: 3689128 - RNA, 15 nt, Human
ucguggacaccugcc

SEQ ID NO: 3689129 - RNA, 16 nt, Human
ucguggacaccugccc

SEQ ID NO: 3689130 - RNA, 17 nt, Human
ucguggacaccugcccu

SEQ ID NO: 3689131 - RNA, 18 nt, Human
ucguggacaccugcccug

SEQ ID NO: 3689132 - RNA, 21 nt, Human
ucguggagacagggcauuuga

SEQ ID NO: 3689133 - RNA, 18 nt, Human
ucguggagagcuaggagc

SEQ ID NO: 3689134 - RNA, 16 nt, Human
ucguggagaugucuuc

SEQ ID NO: 3689135 - RNA, 20 nt, Human
ucguggcagauaaucagccu

SEQ ID NO: 3689136 - RNA, 21 nt, Human
ucguggcagauaaucagccuc

SEQ ID NO: 3689137 - RNA, 23 nt, Human
ucguggcagauaaucagccucuu

SEQ ID NO: 3689138 - RNA, 14 nt, Human
ucguggccagcccg

SEQ ID NO: 3689139 - RNA, 15 nt, Human
ucguggccagcccgg

SEQ ID NO: 3689140 - RNA, 22 nt, Human
ucgugggacagucaccucaugg

SEQ ID NO: 3689141 - RNA, 22 nt, Human
ucguggguguguguagccaagg

SEQ ID NO: 3689142 - RNA, 14 nt, Human
ucgugguaggacug

SEQ ID NO: 3689143 - RNA, 15 nt, Human
ucgugguaggacugu

SEQ ID NO: 3689144 - RNA, 20 nt, Human
ucgugguaggacuguagaaa

SEQ ID NO: 3689145 - RNA, 22 nt, Human
ucgugguccccaacagcgacau

SEQ ID NO: 3689146 - RNA, 22 nt, Human
ucguggugaucaauuaaaugua

SEQ ID NO: 3689147 - RNA, 20 nt, Human
ucguguaauuacuuaucccu

SEQ ID NO: 3689148 - RNA, 15 nt, Human
ucguguauccugggg

SEQ ID NO: 3689149 - RNA, 17 nt, Human
ucgugugcaacagacaa

SEQ ID NO: 3689150 - RNA, 12 nt, Human
ucguuaacauug

SEQ ID NO: 3689151 - RNA, 14 nt, Human
ucguuaacauugac

SEQ ID NO: 3689152 - RNA, 15 nt, Human
ucguuaacuguguau

SEQ ID NO: 3689153 - RNA, 18 nt, Human
ucguuaggauacugccuc

SEQ ID NO: 3689154 - RNA, 14 nt, Human
ucguuaucuaauag

SEQ ID NO: 3689155 - RNA, 21 nt, Human
ucguucuguacuguuacuggg

SEQ ID NO: 3689156 - RNA, 21 nt, Human
ucguucuguuuacaucaguuu

SEQ ID NO: 3689157 - RNA, 15 nt, Human
ucguucuuguucugu

SEQ ID NO: 3689158 - RNA, 18 nt, Human
ucguuuaaugaaugcuua

SEQ ID NO: 3689159 - RNA, 20 nt, Human
ucguuuaaugaaugcuuaaa

SEQ ID NO: 3689160 - RNA, 16 nt, Human
uccuacuggucucucu

SEQ ID NO: 3689161 - RNA, 14 nt, Human
uccuacuuccccuu

SEQ ID NO: 3689162 - RNA, 18 nt, Human
uccuacuuuacauaugcu

SEQ ID NO: 3689163 - RNA, 17 nt, Human
uccuacuuuuccuuccc

SEQ ID NO: 3689164 - RNA, 21 nt, Human
uccuagaaauuccccacccug

SEQ ID NO: 3689165 - RNA, 22 nt, Human
uccuagaaauuccccacccuga

SEQ ID NO: 3689166 - RNA, 20 nt, Human
uccuagaaguuacugaaugc

SEQ ID NO: 3689167 - RNA, 21 nt, Human
uccuagaaguuacugaaugca

SEQ ID NO: 3689168 - RNA, 18 nt, Human
uccuagaauguuucauuu

SEQ ID NO: 3689169 - RNA, 22 nt, Human
uccuagagaaaacuugaauuca

SEQ ID NO: 3689170 - RNA, 19 nt, Human
uccuagagacagaagcagg

SEQ ID NO: 3689171 - RNA, 14 nt, Human
uccuagaggaccug

SEQ ID NO: 3689172 - RNA, 20 nt, Human
uccuagagggaggggccuag

SEQ ID NO: 3689173 - RNA, 12 nt, Human
uccuagcacaga

SEQ ID NO: 3689174 - RNA, 15 nt, Human
uccuagcagagagac

SEQ ID NO: 3689175 - RNA, 20 nt, Human
uccuagccacccaccacacu

SEQ ID NO: 3689176 - RNA, 17 nt, Human
uccuagccacucaggag

SEQ ID NO: 3689177 - RNA, 20 nt, Human
uccuagccuuauccucugau

SEQ ID NO: 3689178 - RNA, 14 nt, Human
uccuagcugcacag

SEQ ID NO: 3689179 - RNA, 21 nt, Human
uccuagcuggagaggagcccu

SEQ ID NO: 3689180 - RNA, 15 nt, Human
uccuagcugugugca

SEQ ID NO: 3689181 - RNA, 18 nt, Human
uccuaggagguaaugacc

SEQ ID NO: 3689182 - RNA, 19 nt, Human
uccuaggcauucuggaccu

SEQ ID NO: 3689183 - RNA, 13 nt, Human
uccuaggcauuug

SEQ ID NO: 3689184 - RNA, 23 nt, Human
uccuaggccucaacuccucccau

SEQ ID NO: 3689185 - RNA, 20 nt, Human
uccuagggaaaaguucauag

SEQ ID NO: 3689186 - RNA, 17 nt, Human
uccuagggccuggguuu

SEQ ID NO: 3689187 - RNA, 19 nt, Human
uccuaguaagcaucuacuu

SEQ ID NO: 3689188 - RNA, 17 nt, Human
uccuagucauucuuccc

SEQ ID NO: 3689189 - RNA, 23 nt, Human
uccuagugaaagaggcagcuuga

SEQ ID NO: 3689190 - RNA, 22 nt, Human
uccuagugcuuuccuuuuuuaa

SEQ ID NO: 3689191 - RNA, 19 nt, Human
uccuaguucaucccuucuc

SEQ ID NO: 3689192 - RNA, 20 nt, Human
uccuaguucaucccuucucu

SEQ ID NO: 3689193 - RNA, 21 nt, Human
uccuaguuccaccaucaagcc

SEQ ID NO: 3689194 - RNA, 13 nt, Human
uccuaguucuaga

SEQ ID NO: 3689195 - RNA, 22 nt, Human
uccuaguucuagaaaaacaggc

SEQ ID NO: 3689196 - RNA, 17 nt, Human
uccuaguucuguagaaa

SEQ ID NO: 3689197 - RNA, 19 nt, Human
uccuaguucuguagaaaug

SEQ ID NO: 3689198 - RNA, 14 nt, Human
uccuaguuggugag

SEQ ID NO: 3689199 - RNA, 15 nt, Human
uccuaguuugaccuc

SEQ ID NO: 3689200 - RNA, 23 nt, Human
uccuaguuugaccucacagugac

SEQ ID NO: 3689201 - RNA, 20 nt, Human
uccuaguuuucuccucccag

SEQ ID NO: 3689202 - RNA, 15 nt, Human
uccuauaaucuguca

SEQ ID NO: 3689203 - RNA, 20 nt, Human
uccuauaauucccuaucuuu

SEQ ID NO: 3689204 - RNA, 23 nt, Human
uccuauaauuuugauagugggac

SEQ ID NO: 3689205 - RNA, 20 nt, Human
uccuauaccauuuccguaau

SEQ ID NO: 3689206 - RNA, 18 nt, Human
uccuauauaguuuauuga

SEQ ID NO: 3689207 - RNA, 16 nt, Human
uccuauauauuucuau

SEQ ID NO: 3689208 - RNA, 18 nt, Human
uccuauauuguuuucagu

SEQ ID NO: 3689209 - RNA, 23 nt, Human
uccuauauuguuuucaguguaca

SEQ ID NO: 3689210 - RNA, 20 nt, Human
uccuaucaagccaguacgug

SEQ ID NO: 3689211 - RNA, 12 nt, Human
uccuaucccauc

SEQ ID NO: 3689212 - RNA, 17 nt, Human
uccuaucuaucuuccaa

SEQ ID NO: 3689213 - RNA, 19 nt, Human
uccuaucuccagcggcccu

SEQ ID NO: 3689214 - RNA, 20 nt, Human
uccuaucugggcuuccugga

SEQ ID NO: 3689215 - RNA, 13 nt, Human
uccuaucuguguu

SEQ ID NO: 3689216 - RNA, 12 nt, Human
uccuaugaugua

SEQ ID NO: 3689217 - RNA, 12 nt, Human
uccuaugcaaua

SEQ ID NO: 3689218 - RNA, 13 nt, Human
uccuaugcaauaa

SEQ ID NO: 3689219 - RNA, 16 nt, Human
uccuaugcaauaaaau

SEQ ID NO: 3689220 - RNA, 22 nt, Human
uccuaugcaugguuucagcacu

SEQ ID NO: 3689221 - RNA, 13 nt, Human
uccuaugcuuuga

SEQ ID NO: 3689222 - RNA, 20 nt, Human
uccuaugcuuugaaacagaa

SEQ ID NO: 3689223 - RNA, 20 nt, Human
uccuauggcuggccacugca

SEQ ID NO: 3689224 - RNA, 21 nt, Human
uccuaugugauuuuaacucug

SEQ ID NO: 3689225 - RNA, 13 nt, Human
uccuauuaguguu

SEQ ID NO: 3689226 - RNA, 17 nt, Human
uccuauucaaauuccua

SEQ ID NO: 3689227 - RNA, 18 nt, Human
uccuauucuauaaaacuc

SEQ ID NO: 3689228 - RNA, 17 nt, Human
uccuauucucaccagga

SEQ ID NO: 3689229 - RNA, 16 nt, Human
uccuauucucgggcug

SEQ ID NO: 3689230 - RNA, 14 nt, Human
uccuauugcaaagg

SEQ ID NO: 3689231 - RNA, 15 nt, Human
uccuauuuagacaug

SEQ ID NO: 3689232 - RNA, 13 nt, Human
uccuauuucagaa

SEQ ID NO: 3689233 - RNA, 18 nt, Human
uccuauuucuagggcugg

SEQ ID NO: 3689234 - RNA, 14 nt, Human
uccuauuuguuuuc

SEQ ID NO: 3689235 - RNA, 17 nt, Human
uccucaaaaugggagau

SEQ ID NO: 3689236 - RNA, 18 nt, Human
uccucaaagaaaguguau

SEQ ID NO: 3689237 - RNA, 19 nt, Human
uccucaaauuuuuugacuu

SEQ ID NO: 3689238 - RNA, 15 nt, Human
uccucaacaguguuu

SEQ ID NO: 3689239 - RNA, 22 nt, Human
uccucaaccccuccccuccauc

SEQ ID NO: 3689240 - RNA, 23 nt, Human
uccucaacucaccuaauguuuau

SEQ ID NO: 3689241 - RNA, 18 nt, Human
uccucaaggggccauccu

SEQ ID NO: 3689242 - RNA, 12 nt, Human
uccucaauccag

SEQ ID NO: 3689243 - RNA, 16 nt, Human
uccucacacuuacugu

SEQ ID NO: 3689244 - RNA, 20 nt, Human
uccucacaggugucuccaua

SEQ ID NO: 3689245 - RNA, 12 nt, Human
uccucacauagc

SEQ ID NO: 3689246 - RNA, 20 nt, Human
uccucacccccagcuuugcu

SEQ ID NO: 3689247 - RNA, 13 nt, Human
uccucaccccugu

SEQ ID NO: 3689248 - RNA, 22 nt, Human
uccucacccugauuucuugcuu

SEQ ID NO: 3689249 - RNA, 20 nt, Human
uccucaccucuggacuggcu

SEQ ID NO: 3689250 - RNA, 23 nt, Human
uccucaccucuggacuggcuaga

SEQ ID NO: 3689251 - RNA, 19 nt, Human
uccucaccuuuucccgggg

SEQ ID NO: 3689252 - RNA, 12 nt, Human
uccucacuccca

SEQ ID NO: 3689253 - RNA, 15 nt, Human
uccucacugcucccu

SEQ ID NO: 3689254 - RNA, 21 nt, Human
uccucacugcucccugaagcc

SEQ ID NO: 3689255 - RNA, 23 nt, Human
uccucacugcucccugaagccag

SEQ ID NO: 3689256 - RNA, 14 nt, Human
uccucacugggugg

SEQ ID NO: 3689257 - RNA, 21 nt, Human
uccucacuuccauacagcucu

SEQ ID NO: 3689258 - RNA, 22 nt, Human
uccucacuuccauacagcucua

SEQ ID NO: 3689259 - RNA, 16 nt, Human
uccucagacucuaaga

SEQ ID NO: 3689260 - RNA, 17 nt, Human
uccucagacucuaagaa

SEQ ID NO: 3689261 - RNA, 15 nt, Human
uccucagacugcuca

SEQ ID NO: 3689262 - RNA, 19 nt, Human
uccucagaucauccagaag

SEQ ID NO: 3689263 - RNA, 13 nt, Human
uccucagaugcuc

SEQ ID NO: 3689264 - RNA, 19 nt, Human
uccucagcauuucuuuucu

SEQ ID NO: 3689265 - RNA, 10 nt, Human
uccucagcca

SEQ ID NO: 3689266 - RNA, 11 nt, Human
uccucagcccc

SEQ ID NO: 3689267 - RNA, 16 nt, Human
uccucaggcacacagc

SEQ ID NO: 3689268 - RNA, 13 nt, Human
uccucaggcugcu

SEQ ID NO: 3689269 - RNA, 16 nt, Human
uccucagggacagaga

SEQ ID NO: 3689270 - RNA, 21 nt, Human
uccucagggagcagggaaggc

SEQ ID NO: 3689271 - RNA, 17 nt, Human
uccucagggcagccucc

SEQ ID NO: 3689272 - RNA, 13 nt, Human
uccucagguggcc

SEQ ID NO: 3689273 - RNA, 22 nt, Human
uccucagguggccagccuggau

SEQ ID NO: 3689274 - RNA, 18 nt, Human
uccucagguggccaugcc

SEQ ID NO: 3689275 - RNA, 19 nt, Human
uccucagugcauuugugcu

SEQ ID NO: 3689276 - RNA, 20 nt, Human
uccucaguuuaauccuucua

SEQ ID NO: 3689277 - RNA, 23 nt, Human
uccucauacccacccccacccaa

SEQ ID NO: 3689278 - RNA, 17 nt, Human
uccucauccaccccauc

SEQ ID NO: 3689279 - RNA, 14 nt, Human
uccucaucccgugu

SEQ ID NO: 3689280 - RNA, 20 nt, Human
uccucaucugggggagugga

SEQ ID NO: 3689281 - RNA, 14 nt, Human
uccucaugaaugua

SEQ ID NO: 3689282 - RNA, 20 nt, Human
uccucaugaauguaaauuug

SEQ ID NO: 3689283 - RNA, 21 nt, Human
uccucaugaauguaaauuugu

SEQ ID NO: 3689284 - RNA, 13 nt, Human
uccucuggggcuc

SEQ ID NO: 3689285 - RNA, 17 nt, Human
uccucuguacagagccc

SEQ ID NO: 3689286 - RNA, 18 nt, Human
uccucuguacagagccca

SEQ ID NO: 3689287 - RNA, 19 nt, Human
uccucuguacagagcccac

SEQ ID NO: 3689288 - RNA, 23 nt, Human
uccucuguacagagcccacgccc

SEQ ID NO: 3689289 - RNA, 19 nt, Human
uccucugucagucacagcc

SEQ ID NO: 3689290 - RNA, 22 nt, Human
uccucugucagucacagccacc

SEQ ID NO: 3689291 - RNA, 17 nt, Human
uccucuguccaggcacu

SEQ ID NO: 3689292 - RNA, 12 nt, Human
uccucugugaag

SEQ ID NO: 3689293 - RNA, 20 nt, Human
uccucugugaccaaugucuu

SEQ ID NO: 3689294 - RNA, 13 nt, Human
uccucuguggugu

SEQ ID NO: 3689295 - RNA, 22 nt, Human
uccucuguggugucugccuguu

SEQ ID NO: 3689296 - RNA, 15 nt, Human
uccucuuagaagaau

SEQ ID NO: 3689297 - RNA, 13 nt, Human
uccucuuauuugc

SEQ ID NO: 3689298 - RNA, 13 nt, Human
uccucuuccccag

SEQ ID NO: 3689299 - RNA, 14 nt, Human
uccucuuccccaga

SEQ ID NO: 3689300 - RNA, 16 nt, Human
uccucuuccccuugcc

SEQ ID NO: 3689301 - RNA, 18 nt, Human
uccucuucggcccucaga

SEQ ID NO: 3689302 - RNA, 22 nt, Human
uccucuucuacucacuuuuccc

SEQ ID NO: 3689303 - RNA, 17 nt, Human
uccucuucugcaucuug

SEQ ID NO: 3689304 - RNA, 23 nt, Human
uccucuucugcuuaggagagacc

SEQ ID NO: 3689305 - RNA, 17 nt, Human
uccucuucugggccuga

SEQ ID NO: 3689306 - RNA, 14 nt, Human
uccucuugccaucu

SEQ ID NO: 3689307 - RNA, 12 nt, Human
uccucuuguaaa

SEQ ID NO: 3689308 - RNA, 18 nt, Human
uccucuuguaaauaaagc

SEQ ID NO: 3689309 - RNA, 19 nt, Human
uccucuuguaaauaaagcc

SEQ ID NO: 3689310 - RNA, 21 nt, Human
uccucuuguaaauaaagcccu

SEQ ID NO: 3689311 - RNA, 18 nt, Human
uccucuuuaaaacaaaac

SEQ ID NO: 3689312 - RNA, 20 nt, Human
uccucuuuagaguuagacug

SEQ ID NO: 3689313 - RNA, 17 nt, Human
uccucuuucagaaaaca

SEQ ID NO: 3689314 - RNA, 21 nt, Human
uccucuuucagaaaacagaaa

SEQ ID NO: 3689315 - RNA, 14 nt, Human
uccucuuucagcuc

SEQ ID NO: 3689316 - RNA, 17 nt, Human
uccucuuucagcuccug

SEQ ID NO: 3689317 - RNA, 13 nt, Human
uccucuuucucuc

SEQ ID NO: 3689318 - RNA, 16 nt, Human
uccucuuucucucccc

SEQ ID NO: 3689319 - RNA, 14 nt, Human
uccucuuugcaugg

SEQ ID NO: 3689320 - RNA, 16 nt, Human
uccucuuugcuuugcu

SEQ ID NO: 3689321 - RNA, 22 nt, Human
uccucuuuggucuacacugugc

SEQ ID NO: 3689322 - RNA, 23 nt, Human
uccucuuuggucuacacugugcu

SEQ ID NO: 3689323 - RNA, 15 nt, Human
uccucuuuucucugc

SEQ ID NO: 3689324 - RNA, 21 nt, Human
uccucuuuugugcugcuucuc

SEQ ID NO: 3689325 - RNA, 20 nt, Human
uccucuuuuguuguuucuua

SEQ ID NO: 3689326 - RNA, 21 nt, Human
uccugaaaagguuuaugaaaa

SEQ ID NO: 3689327 - RNA, 23 nt, Human
uccugaaaagguuuaugaaaaag

SEQ ID NO: 3689328 - RNA, 17 nt, Human
uccugaaacaacuugga

SEQ ID NO: 3689329 - RNA, 22 nt, Human
uccugaaacgcuccuuugugug

SEQ ID NO: 3689330 - RNA, 16 nt, Human
uccugaaacuauauuu

SEQ ID NO: 3689331 - RNA, 21 nt, Human
uccugaaagaaacaguuaacu

SEQ ID NO: 3689332 - RNA, 16 nt, Human
uccugaaagacaauau

SEQ ID NO: 3689333 - RNA, 14 nt, Human
uccugaaauuucag

SEQ ID NO: 3689334 - RNA, 20 nt, Human
uccugaacagcauggcacuc

SEQ ID NO: 3689335 - RNA, 14 nt, Human
uccugaaccaugug

SEQ ID NO: 3689336 - RNA, 22 nt, Human
uccugaaccauguggauaacuu

SEQ ID NO: 3689337 - RNA, 16 nt, Human
uccugaaccgcacagc

SEQ ID NO: 3689338 - RNA, 19 nt, Human
uccugaaccgcacagcuca

SEQ ID NO: 3689339 - RNA, 20 nt, Human
uccugaaccgcacagcucag

SEQ ID NO: 3689340 - RNA, 20 nt, Human
uccugaagaggcgggccagc

SEQ ID NO: 3689341 - RNA, 21 nt, Human
uccugaagaggcgggccagcc

SEQ ID NO: 3689342 - RNA, 23 nt, Human
uccugaagaggcgggccagccag

SEQ ID NO: 3689343 - RNA, 13 nt, Human
uccugaagcugag

SEQ ID NO: 3689344 - RNA, 17 nt, Human
uccugaaggccugaggu

SEQ ID NO: 3689345 - RNA, 14 nt, Human
uccugaaugaaaua

SEQ ID NO: 3689346 - RNA, 17 nt, Human
uccugacacaccugcag

SEQ ID NO: 3689347 - RNA, 22 nt, Human
uccugacacaccugcagccucc

SEQ ID NO: 3689348 - RNA, 17 nt, Human
uccugacacugcuggag

SEQ ID NO: 3689349 - RNA, 17 nt, Human
uccugacagaaggugcc

SEQ ID NO: 3689350 - RNA, 21 nt, Human
uccugacaucacagcagccuc

SEQ ID NO: 3689351 - RNA, 13 nt, Human
uccugacccaggc

SEQ ID NO: 3689352 - RNA, 15 nt, Human
uccugacccaggccg

SEQ ID NO: 3689353 - RNA, 17 nt, Human
uccugacccaggccgca

SEQ ID NO: 3689354 - RNA, 19 nt, Human
uccugacccaggccgcagc

SEQ ID NO: 3689355 - RNA, 16 nt, Human
uccugacccauugcug

SEQ ID NO: 3689356 - RNA, 17 nt, Human
uccugacccauugcugu

SEQ ID NO: 3689357 - RNA, 21 nt, Human
uccugaccccaaguuauccac

SEQ ID NO: 3689358 - RNA, 16 nt, Human
uccugaccucagguga

SEQ ID NO: 3689359 - RNA, 16 nt, Human
uccugaccuccgccau

SEQ ID NO: 3689360 - RNA, 20 nt, Human
uccugaccuccgccauccac

SEQ ID NO: 3689361 - RNA, 16 nt, Human
uccugaccugaggcuc

SEQ ID NO: 3689362 - RNA, 20 nt, Human
uccugaccugucucaccaug

SEQ ID NO: 3689363 - RNA, 22 nt, Human
uccugacgaaacuggccccgga

SEQ ID NO: 3689364 - RNA, 20 nt, Human
uccugacgucugaagcuuga

SEQ ID NO: 3689365 - RNA, 19 nt, Human
uccugacucaacauguuac

SEQ ID NO: 3689366 - RNA, 15 nt, Human
uccugacucucuccu

SEQ ID NO: 3689367 - RNA, 22 nt, Human
uccugacucugcccccugcugg

SEQ ID NO: 3689368 - RNA, 19 nt, Human
uccugacuucaggggcugc

SEQ ID NO: 3689369 - RNA, 16 nt, Human
uccugagaaagcucaa

SEQ ID NO: 3689370 - RNA, 23 nt, Human
uccugagaauaagaaaguuucac

SEQ ID NO: 3689371 - RNA, 16 nt, Human
uccugagaccacagag

SEQ ID NO: 3689372 - RNA, 16 nt, Human
uccugagcacugccag

SEQ ID NO: 3689373 - RNA, 20 nt, Human
uccugagcacugccaggagg

SEQ ID NO: 3689374 - RNA, 21 nt, Human
uccugagcacugccaggaggg

SEQ ID NO: 3689375 - RNA, 23 nt, Human
uccugagcacugccaggagggac

SEQ ID NO: 3689376 - RNA, 18 nt, Human
uccugagccagauuucac

SEQ ID NO: 3689377 - RNA, 16 nt, Human
uccugagccccaggga

SEQ ID NO: 3689378 - RNA, 13 nt, Human
uccugagccccca

SEQ ID NO: 3689379 - RNA, 18 nt, Human
uccugagcccccagcuuc

SEQ ID NO: 3689380 - RNA, 13 nt, Human
uccugagccccgc

SEQ ID NO: 3689381 - RNA, 18 nt, Human
uccugagccccgcccucu

SEQ ID NO: 3689382 - RNA, 12 nt, Human
uccugagcucag

SEQ ID NO: 3689383 - RNA, 19 nt, Human
uccugaggacagcuguccu

SEQ ID NO: 3689384 - RNA, 17 nt, Human
uccugaggcuccacuug

SEQ ID NO: 3689385 - RNA, 17 nt, Human
uccugaggcugggcucc

SEQ ID NO: 3689386 - RNA, 18 nt, Human
uccugaggcuuuggauuu

SEQ ID NO: 3689387 - RNA, 17 nt, Human
uccugagggaggaccug

SEQ ID NO: 3689388 - RNA, 19 nt, Human
uccugaggggcaucugccc

SEQ ID NO: 3689389 - RNA, 17 nt, Human
uccugaggguccccacc

SEQ ID NO: 3689390 - RNA, 23 nt, Human
uccugaggugaugaagacagccc

SEQ ID NO: 3689391 - RNA, 17 nt, Human
uccugaguggccaggga

SEQ ID NO: 3689392 - RNA, 15 nt, Human
uccugaguggugcca

SEQ ID NO: 3689393 - RNA, 15 nt, Human
uccugauaaagcaca

SEQ ID NO: 3689394 - RNA, 21 nt, Human
uccugauaaagcacagcugua

SEQ ID NO: 3689395 - RNA, 17 nt, Human
uccugauaauaauugau

SEQ ID NO: 3689396 - RNA, 15 nt, Human
uccugaugacccagg

SEQ ID NO: 3689397 - RNA, 17 nt, Human
uccugaugacccaggcu

SEQ ID NO: 3689398 - RNA, 20 nt, Human
uccugaugcuucuucagaga

SEQ ID NO: 3689399 - RNA, 21 nt, Human
uccugaugcuucuucagagac

SEQ ID NO: 3689400 - RNA, 23 nt, Human
uccugaugguacaggaaagcuca

SEQ ID NO: 3689401 - RNA, 20 nt, Human
uccugauuauuuaucacaua

SEQ ID NO: 3689402 - RNA, 17 nt, Human
uccugcaaaauuuuaua

SEQ ID NO: 3689403 - RNA, 22 nt, Human
uccugcaaugaagucucugaag

SEQ ID NO: 3689404 - RNA, 14 nt, Human
uccugcacacgcuc

SEQ ID NO: 3689405 - RNA, 21 nt, Human
uccugcacacgcuccuuccuc

SEQ ID NO: 3689406 - RNA, 22 nt, Human
uccugcacacgcuccuuccucu

SEQ ID NO: 3689407 - RNA, 20 nt, Human
uccugcaccggggccugggc

SEQ ID NO: 3689408 - RNA, 16 nt, Human
uccugcacugacucug

SEQ ID NO: 3689409 - RNA, 21 nt, Human
uccugcacuuacuugcuuauu

SEQ ID NO: 3689410 - RNA, 22 nt, Human
uccugcagcaaacacuccaccc

SEQ ID NO: 3689411 - RNA, 12 nt, Human
uccugcagcaug

SEQ ID NO: 3689412 - RNA, 12 nt, Human
uccugcagccuc

SEQ ID NO: 3689413 - RNA, 18 nt, Human
uccugcagccuccuccug

SEQ ID NO: 3689414 - RNA, 13 nt, Human
uccugcagccugc

SEQ ID NO: 3689415 - RNA, 14 nt, Human
uccugcagccugga

SEQ ID NO: 3689416 - RNA, 12 nt, Human
uccugcaggcag

SEQ ID NO: 3689417 - RNA, 15 nt, Human
uccugcaggcagcca

SEQ ID NO: 3689418 - RNA, 16 nt, Human
uccugcaggcagccag

SEQ ID NO: 3689419 - RNA, 20 nt, Human
uccugcaggcagccaggcca

SEQ ID NO: 3689420 - RNA, 22 nt, Human
uccugcaggcagccaggccaca

SEQ ID NO: 3689421 - RNA, 22 nt, Human
uccugcaggcaggaacaaacag

SEQ ID NO: 3689422 - RNA, 17 nt, Human
uccugcaggccaggcca

SEQ ID NO: 3689423 - RNA, 21 nt, Human
uccugcagucuggcugagccc

SEQ ID NO: 3689424 - RNA, 16 nt, Human
uccugcauucacccag

SEQ ID NO: 3689425 - RNA, 11 nt, Human
uccugccaaaa

SEQ ID NO: 3689426 - RNA, 20 nt, Human
uccugccacauuagaacuuc

SEQ ID NO: 3689427 - RNA, 16 nt, Human
uccugccacccuguag

SEQ ID NO: 3689428 - RNA, 20 nt, Human
uccugccaccuggggcaguc

SEQ ID NO: 3689429 - RNA, 13 nt, Human
uccugcccaggag

SEQ ID NO: 3689430 - RNA, 23 nt, Human
uccugcccaggagagccagcccu

SEQ ID NO: 3689431 - RNA, 21 nt, Human
uccugcccagucccccaaccc

SEQ ID NO: 3689432 - RNA, 13 nt, Human
uccugcccagugu

SEQ ID NO: 3689433 - RNA, 14 nt, Human
uccugcccaguguu

SEQ ID NO: 3689434 - RNA, 17 nt, Human
uccugcccaguguuguu

SEQ ID NO: 3689435 - RNA, 22 nt, Human
uccugcccaguguuguuuguaa

SEQ ID NO: 3689436 - RNA, 15 nt, Human
uccugcccccacacc

SEQ ID NO: 3689437 - RNA, 17 nt, Human
uccugccccucuuucuc

SEQ ID NO: 3689438 - RNA, 18 nt, Human
uccugccccugagcccau

SEQ ID NO: 3689439 - RNA, 18 nt, Human
uccugcccuguuguguau

SEQ ID NO: 3689440 - RNA, 17 nt, Human
uccugcccuuaccugcc

SEQ ID NO: 3689441 - RNA, 16 nt, Human
uccugcccuuccucag

SEQ ID NO: 3689442 - RNA, 17 nt, Human
uccugcccuuccucagu

SEQ ID NO: 3689443 - RNA, 16 nt, Human
uccugccgcagagcug

SEQ ID NO: 3689444 - RNA, 23 nt, Human
uccugccgcccgagguggcugcc

SEQ ID NO: 3689445 - RNA, 19 nt, Human
uccugccggagaggaagag

SEQ ID NO: 3689446 - RNA, 23 nt, Human
uccugccggagaggaagagacac

SEQ ID NO: 3689447 - RNA, 17 nt, Human
uccugccggcuccuugg

SEQ ID NO: 3689448 - RNA, 11 nt, Human
uccugccuacu

SEQ ID NO: 3689449 - RNA, 15 nt, Human
uccugccucagccuc

SEQ ID NO: 3689450 - RNA, 16 nt, Human
uccugccucagccucc

SEQ ID NO: 3689451 - RNA, 17 nt, Human
uccugccucagccuccc

SEQ ID NO: 3689452 - RNA, 21 nt, Human
uccugccucgaacuggcugca

SEQ ID NO: 3689453 - RNA, 14 nt, Human
uccugccugccccu

SEQ ID NO: 3689454 - RNA, 16 nt, Human
uccugccuggccaggc

SEQ ID NO: 3689455 - RNA, 20 nt, Human
uccugccugucugccccagc

SEQ ID NO: 3689456 - RNA, 12 nt, Human
uccugccugugg

SEQ ID NO: 3689457 - RNA, 13 nt, Human
uccugccuguggc

SEQ ID NO: 3689458 - RNA, 18 nt, Human
uccugccuguggccauga

SEQ ID NO: 3689459 - RNA, 18 nt, Human
uccugccuuagagccagg

SEQ ID NO: 3689460 - RNA, 14 nt, Human
uccugccuuccucc

SEQ ID NO: 3689461 - RNA, 17 nt, Human
uccugccuucuguccug

SEQ ID NO: 3689462 - RNA, 19 nt, Human
uccugccuuggccucccaa

SEQ ID NO: 3689463 - RNA, 14 nt, Human
uccugcgaggcuau

SEQ ID NO: 3689464 - RNA, 19 nt, Human
uccugcggagugaagaggg

SEQ ID NO: 3689465 - RNA, 22 nt, Human
uccugcggagugaagaggggca

SEQ ID NO: 3689466 - RNA, 23 nt, Human
uccugcgggcuuuuccccggucc

SEQ ID NO: 3689467 - RNA, 15 nt, Human
uccugcguccuccuc

SEQ ID NO: 3689468 - RNA, 20 nt, Human
uccugcuacaacuucagcag

SEQ ID NO: 3689469 - RNA, 21 nt, Human
uccugcuacaacuucagcagu

SEQ ID NO: 3689470 - RNA, 23 nt, Human
uccugcuaccucccuugccuuuc

SEQ ID NO: 3689471 - RNA, 15 nt, Human
uccugcuagaaaugg

SEQ ID NO: 3689472 - RNA, 15 nt, Human
uccugcucauauugu

SEQ ID NO: 3689473 - RNA, 16 nt, Human
uccugcucauauugug

SEQ ID NO: 3689474 - RNA, 13 nt, Human
uccugcuccacag

SEQ ID NO: 3689475 - RNA, 16 nt, Human
uccugcuccacagugu

SEQ ID NO: 3689476 - RNA, 18 nt, Human
uccugcucucuacccagc

SEQ ID NO: 3689477 - RNA, 21 nt, Human
uccugcucucuacccagccca

SEQ ID NO: 3689478 - RNA, 24 nt, Human
uccugcucucuacccagcccaucu

SEQ ID NO: 3689479 - RNA, 11 nt, Human
uccugcucugc

SEQ ID NO: 3689480 - RNA, 12 nt, Human
uccugcucugcu

SEQ ID NO: 3689481 - RNA, 19 nt, Human
uccugcugcaccaacccag

SEQ ID NO: 3689482 - RNA, 13 nt, Human
uccugcugccagu

SEQ ID NO: 3689483 - RNA, 17 nt, Human
uccugcugcucccucag

SEQ ID NO: 3689484 - RNA, 20 nt, Human
uccugcugcucccucagacu

SEQ ID NO: 3689485 - RNA, 20 nt, Human
uccugcugcugucugggugc

SEQ ID NO: 3689486 - RNA, 19 nt, Human
uccuggaaccuugcugucc

SEQ ID NO: 3689487 - RNA, 21 nt, Human
uccuggaaccuugcuguccug

SEQ ID NO: 3689488 - RNA, 22 nt, Human
uccuggaaccuugcuguccuga

SEQ ID NO: 3689489 - RNA, 18 nt, Human
uccuggaagccagcuuuc

SEQ ID NO: 3689490 - RNA, 21 nt, Human
uccuggaagcuguguccuugc

SEQ ID NO: 3689491 - RNA, 22 nt, Human
uccuggaauaucuccgucaacu

SEQ ID NO: 3689492 - RNA, 20 nt, Human
uccuggaauugccagcugac

SEQ ID NO: 3689493 - RNA, 11 nt, Human
uccuggacagc

SEQ ID NO: 3689494 - RNA, 13 nt, Human
uccuggacagcug

SEQ ID NO: 3689495 - RNA, 16 nt, Human
uccuggacagcugugc

SEQ ID NO: 3689496 - RNA, 22 nt, Human
uccuggacauccucuucugcuu

SEQ ID NO: 3689497 - RNA, 21 nt, Human
uccuggacaugaagauucuuu

SEQ ID NO: 3689498 - RNA, 16 nt, Human
uccuggagaagccucg

SEQ ID NO: 3689499 - RNA, 14 nt, Human
uccuggagcagaag

SEQ ID NO: 3689500 - RNA, 18 nt, Human
uccuggagcagaccaccc

SEQ ID NO: 3689501 - RNA, 22 nt, Human
uccuggagcccagaggagggca

SEQ ID NO: 3689502 - RNA, 15 nt, Human
uccuggagcccgagg

SEQ ID NO: 3689503 - RNA, 20 nt, Human
uccuggagcccgaggcacca

SEQ ID NO: 3689504 - RNA, 13 nt, Human
uccuggaggccca

SEQ ID NO: 3689505 - RNA, 17 nt, Human
uccuggauguuuggaaa

SEQ ID NO: 3689506 - RNA, 17 nt, Human
uccuggcaauagucaaa

SEQ ID NO: 3689507 - RNA, 22 nt, Human
uccuggcaauaguguguucuga

SEQ ID NO: 3689508 - RNA, 23 nt, Human
uccuggcacccggccccugcugg

SEQ ID NO: 3689509 - RNA, 13 nt, Human
uccuggcacugcu

SEQ ID NO: 3689510 - RNA, 18 nt, Human
uccuggcacuggacccca

SEQ ID NO: 3689511 - RNA, 15 nt, Human
uccuggcagcccaga

SEQ ID NO: 3689512 - RNA, 17 nt, Human
uccuggcagcccagaga

SEQ ID NO: 3689513 - RNA, 19 nt, Human
uccuggcagcccagagacu

SEQ ID NO: 3689514 - RNA, 14 nt, Human
uccuggccauccca

SEQ ID NO: 3689515 - RNA, 20 nt, Human
uccuggccaucccacaagug

SEQ ID NO: 3689516 - RNA, 17 nt, Human
uccuggcccagccuuug

SEQ ID NO: 3689517 - RNA, 15 nt, Human
uccuggcccagggca

SEQ ID NO: 3689518 - RNA, 13 nt, Human
uccuggcccauca

SEQ ID NO: 3689519 - RNA, 17 nt, Human
uccuggcccaucagugu

SEQ ID NO: 3689520 - RNA, 13 nt, Human
uccuggcccucug

SEQ ID NO: 3689521 - RNA, 14 nt, Human
uccuggccgccugg

SEQ ID NO: 3689522 - RNA, 14 nt, Human
uccuggccuauccg

SEQ ID NO: 3689523 - RNA, 15 nt, Human
uccuggccucagacu

SEQ ID NO: 3689524 - RNA, 17 nt, Human
uccuggccugagaguca

SEQ ID NO: 3689525 - RNA, 16 nt, Human
uccuggccuggcuucu

SEQ ID NO: 3689526 - RNA, 13 nt, Human
uccuggcucagcc

SEQ ID NO: 3689527 - RNA, 12 nt, Human
uccuggcugcgg

SEQ ID NO: 3689528 - RNA, 13 nt, Human
uccuggcuucagg

SEQ ID NO: 3689529 - RNA, 20 nt, Human
uccuggcuucccauccccag

SEQ ID NO: 3689530 - RNA, 22 nt, Human
uccuggcuucccauccccagcg

SEQ ID NO: 3689531 - RNA, 23 nt, Human
uccuggcuuuuuaacuccccugu

SEQ ID NO: 3689532 - RNA, 18 nt, Human
uccugggagaaccucagg

SEQ ID NO: 3689533 - RNA, 23 nt, Human
uccugggagaaccucaggcuucc

SEQ ID NO: 3689534 - RNA, 13 nt, Human
uccugggaugugg

SEQ ID NO: 3689535 - RNA, 15 nt, Human
uccugggcacacgcu

SEQ ID NO: 3689536 - RNA, 18 nt, Human
uccugggcacacgcugcu

SEQ ID NO: 3689537 - RNA, 19 nt, Human
uccugggcacacgcugcuc

SEQ ID NO: 3689538 - RNA, 21 nt, Human
uccugggcacacgcugcucug

SEQ ID NO: 3689539 - RNA, 23 nt, Human
uccugggcacacgcugcucugcc

SEQ ID NO: 3689540 - RNA, 12 nt, Human
uccugggcagcu

SEQ ID NO: 3689541 - RNA, 17 nt, Human
uccugggcagcugccuc

SEQ ID NO: 3689542 - RNA, 18 nt, Human
uccugggcagcugccucc

SEQ ID NO: 3689543 - RNA, 14 nt, Human
uccugggccccucc

SEQ ID NO: 3689544 - RNA, 15 nt, Human
uccugggccccuccc

SEQ ID NO: 3689545 - RNA, 20 nt, Human
uccugggccccucccuaccu

SEQ ID NO: 3689546 - RNA, 22 nt, Human
uccugggccccucccuaccuca

SEQ ID NO: 3689547 - RNA, 17 nt, Human
uccugggcccucucugc

SEQ ID NO: 3689548 - RNA, 21 nt, Human
uccugggcccucucugcucug

SEQ ID NO: 3689549 - RNA, 23 nt, Human
uccugggcccucucugcucugcg

SEQ ID NO: 3689550 - RNA, 15 nt, Human
uccugggccugcaga

SEQ ID NO: 3689551 - RNA, 16 nt, Human
uccugggcucaagcaa

SEQ ID NO: 3689552 - RNA, 13 nt, Human
uccugggcucagg

SEQ ID NO: 3689553 - RNA, 23 nt, Human
uccugggcuuuuguuuugcuuuu

SEQ ID NO: 3689554 - RNA, 14 nt, Human
uccuggggccaggc

SEQ ID NO: 3689555 - RNA, 15 nt, Human
uccuggggccaggcc

SEQ ID NO: 3689556 - RNA, 17 nt, Human
uccuggggcgcgugagg

SEQ ID NO: 3689557 - RNA, 15 nt, Human
uccuggggcucccuu

SEQ ID NO: 3689558 - RNA, 22 nt, Human
uccuggggguucuuucuuccuc

SEQ ID NO: 3689559 - RNA, 17 nt, Human
uccuggguggcuacucu

SEQ ID NO: 3689560 - RNA, 22 nt, Human
uccuggguggcuacucugugcc

SEQ ID NO: 3689561 - RNA, 22 nt, Human
uccuggguggucugcaggcagg

SEQ ID NO: 3689562 - RNA, 23 nt, Human
uccuggguuuucuuaaccaucuu

SEQ ID NO: 3689563 - RNA, 17 nt, Human
uccuggguuuuguauuc

SEQ ID NO: 3689564 - RNA, 22 nt, Human
uccuggguuuuguauucucuga

SEQ ID NO: 3689565 - RNA, 23 nt, Human
uccuggguuuuguauucucugag

SEQ ID NO: 3689566 - RNA, 18 nt, Human
uccugguacccagccauc

SEQ ID NO: 3689567 - RNA, 20 nt, Human
uccuggucaccuaggaagcc

SEQ ID NO: 3689568 - RNA, 23 nt, Human
uccugguccuaggcuggaaggag

SEQ ID NO: 3689569 - RNA, 14 nt, Human
uccuggucgaaagu

SEQ ID NO: 3689570 - RNA, 21 nt, Human
uccuggugccaauuucaaguu

SEQ ID NO: 3689571 - RNA, 16 nt, Human
uccuggugcucucugc

SEQ ID NO: 3689572 - RNA, 20 nt, Human
uccuggugcucucugccacu

SEQ ID NO: 3689573 - RNA, 12 nt, Human
uccuggugcugg

SEQ ID NO: 3689574 - RNA, 14 nt, Human
uccuggugcuggag

SEQ ID NO: 3689575 - RNA, 16 nt, Human
uccugguggggcagcu

SEQ ID NO: 3689576 - RNA, 22 nt, Human
uccugguggguccaggggcccc

SEQ ID NO: 3689577 - RNA, 19 nt, Human
uccuggugguauuuucaau

SEQ ID NO: 3689578 - RNA, 21 nt, Human
uccuggugguauuuucaauag

SEQ ID NO: 3689579 - RNA, 19 nt, Human
uccuggugucaccccagag

SEQ ID NO: 3689580 - RNA, 22 nt, Human
uccuggugucaccccagagcca

SEQ ID NO: 3689581 - RNA, 14 nt, Human
uccuggugucacuu

SEQ ID NO: 3689582 - RNA, 21 nt, Human
uccugguucccguuucuccac

SEQ ID NO: 3689583 - RNA, 23 nt, Human
uccugguucccguuucuccaccu

SEQ ID NO: 3689584 - RNA, 23 nt, Human
uccuguaacacaagccacagaag

SEQ ID NO: 3689585 - RNA, 19 nt, Human
uccuguaacuguuacagua

SEQ ID NO: 3689586 - RNA, 21 nt, Human
uccuguaacuguuacaguaau

SEQ ID NO: 3689587 - RNA, 16 nt, Human
uccuguaagccaaaga

SEQ ID NO: 3689588 - RNA, 17 nt, Human
uccuguaagccaaagaa

SEQ ID NO: 3689589 - RNA, 13 nt, Human
uccuguaauuccu

SEQ ID NO: 3689590 - RNA, 16 nt, Human
uccuguaauuccuacc

SEQ ID NO: 3689591 - RNA, 21 nt, Human
uccuguaauuccuaccucccu

SEQ ID NO: 3689592 - RNA, 21 nt, Human
uccuguacacugaauauuuau

SEQ ID NO: 3689593 - RNA, 20 nt, Human
uccuguacauugugggaugu

SEQ ID NO: 3689594 - RNA, 20 nt, Human
uccuguaccucuugagccuu

SEQ ID NO: 3689595 - RNA, 21 nt, Human
uccuguagagguuuuguuguu

SEQ ID NO: 3689596 - RNA, 21 nt, Human
uccuguagcaucuucuggagu

SEQ ID NO: 3689597 - RNA, 16 nt, Human
uccuguagcucucccu

SEQ ID NO: 3689598 - RNA, 21 nt, Human
uccuguaggaagguacuguau

SEQ ID NO: 3689599 - RNA, 19 nt, Human
uccuguaugaaagauugug

SEQ ID NO: 3689600 - RNA, 14 nt, Human
uccuguaugucugu

SEQ ID NO: 3689601 - RNA, 16 nt, Human
uccuguaugucuguca

SEQ ID NO: 3689602 - RNA, 16 nt, Human
uccuguauucagacag

SEQ ID NO: 3689603 - RNA, 17 nt, Human
uccuguauucagacaga

SEQ ID NO: 3689604 - RNA, 21 nt, Human
uccuguauucagacagaugag

SEQ ID NO: 3689605 - RNA, 20 nt, Human
uccuguauuuguucccaaga

SEQ ID NO: 3689606 - RNA, 22 nt, Human
uccugucaucaucauggccagc

SEQ ID NO: 3689607 - RNA, 18 nt, Human
uccuguccaaccuaaccc

SEQ ID NO: 3689608 - RNA, 20 nt, Human
uccuguccaaccuaaccccu

SEQ ID NO: 3689609 - RNA, 19 nt, Human
uccuguccacacccagcuc

SEQ ID NO: 3689610 - RNA, 16 nt, Human
uccuguccagcuccaa

SEQ ID NO: 3689611 - RNA, 17 nt, Human
uccuguccagcuccaac

SEQ ID NO: 3689612 - RNA, 10 nt, Human
uccuguccca

SEQ ID NO: 3689613 - RNA, 20 nt, Human
uccuguccccaucugucggc

SEQ ID NO: 3689614 - RNA, 18 nt, Human
uccugucccuucucuuaa

SEQ ID NO: 3689615 - RNA, 15 nt, Human
uccuguccgcccucu

SEQ ID NO: 3689616 - RNA, 17 nt, Human
uccuguccucccucacc

SEQ ID NO: 3689617 - RNA, 18 nt, Human
uccuguccucuuucagcu

SEQ ID NO: 3689618 - RNA, 21 nt, Human
uccuguccucuuucagcuccu

SEQ ID NO: 3689619 - RNA, 22 nt, Human
uccuguccuucucucaccuccu

SEQ ID NO: 3689620 - RNA, 17 nt, Human
uccugucgauuagacug

SEQ ID NO: 3689621 - RNA, 21 nt, Human
uccugucgauuagacuggaca

SEQ ID NO: 3689622 - RNA, 22 nt, Human
uccugucgauuagacuggacag

SEQ ID NO: 3689623 - RNA, 16 nt, Human
uccugucuccccucug

SEQ ID NO: 3689624 - RNA, 17 nt, Human
uccugucuccccucugc

SEQ ID NO: 3689625 - RNA, 14 nt, Human
uccugucugccagc

SEQ ID NO: 3689626 - RNA, 14 nt, Human
uccugucuuauccu

SEQ ID NO: 3689627 - RNA, 11 nt, Human
uccugucuucc

SEQ ID NO: 3689628 - RNA, 12 nt, Human
uccugucuuccc

SEQ ID NO: 3689629 - RNA, 12 nt, Human
uccugucuucug

SEQ ID NO: 3689630 - RNA, 17 nt, Human
uccugucuucugcuuug

SEQ ID NO: 3689631 - RNA, 19 nt, Human
uccugucuucugcuuuguu

SEQ ID NO: 3689632 - RNA, 16 nt, Human
uccugugaaugccacu

SEQ ID NO: 3689633 - RNA, 20 nt, Human
uccugugaaugccacugccu

SEQ ID NO: 3689634 - RNA, 15 nt, Human
uccugugacauguaa

SEQ ID NO: 3689635 - RNA, 15 nt, Human
uccugugagaugugu

SEQ ID NO: 3689636 - RNA, 22 nt, Human
uccugugagauguguaucagug

SEQ ID NO: 3689637 - RNA, 17 nt, Human
uccugugagguuuccca

SEQ ID NO: 3689638 - RNA, 22 nt, Human
uccugugauagaguucuuuuaa

SEQ ID NO: 3689639 - RNA, 21 nt, Human
uccugugauccacccaacccu

SEQ ID NO: 3689640 - RNA, 20 nt, Human
uccugugcaugggugaaggg

SEQ ID NO: 3689641 - RNA, 17 nt, Human
uccugugcccacauccc

SEQ ID NO: 3689642 - RNA, 15 nt, Human
uccugugcucagccc

SEQ ID NO: 3689643 - RNA, 17 nt, Human
uccuguggaacccagca

SEQ ID NO: 3689644 - RNA, 15 nt, Human
uccuguggcaggcag

SEQ ID NO: 3689645 - RNA, 21 nt, Human
uccuguggcaggcagcgccaa

SEQ ID NO: 3689646 - RNA, 19 nt, Human
uccuguggccugccaguca

SEQ ID NO: 3689647 - RNA, 12 nt, Human
uccuguggcucc

SEQ ID NO: 3689648 - RNA, 15 nt, Human
uccuguggggaaagg

SEQ ID NO: 3689649 - RNA, 22 nt, Human
uccugugggggaagagcacagc

SEQ ID NO: 3689650 - RNA, 18 nt, Human
uccuguguaaucauuucu

SEQ ID NO: 3689651 - RNA, 13 nt, Human
uccuguguacugu

SEQ ID NO: 3689652 - RNA, 15 nt, Human
uccuguguacugugu

SEQ ID NO: 3689653 - RNA, 16 nt, Human
uccugugucaguuuau

SEQ ID NO: 3689654 - RNA, 12 nt, Human
uccuguguccug

SEQ ID NO: 3689655 - RNA, 23 nt, Human
uccugugucuugcaauggcagcc

SEQ ID NO: 3689656 - RNA, 15 nt, Human
uccugugugcaguga

SEQ ID NO: 3689657 - RNA, 21 nt, Human
uccugugugguuuaguguaaa

SEQ ID NO: 3689658 - RNA, 18 nt, Human
uccuguguguacucuguc

SEQ ID NO: 3689659 - RNA, 22 nt, Human
uccuguguguccaaaacugccu

SEQ ID NO: 3689660 - RNA, 13 nt, Human
uccugugugugcg

SEQ ID NO: 3689661 - RNA, 22 nt, Human
uccuguguguuaagcucugcua

SEQ ID NO: 3689662 - RNA, 19 nt, Human
uccuguguuucuagggaaa

SEQ ID NO: 3689663 - RNA, 14 nt, Human
uccuguguuuguga

SEQ ID NO: 3689664 - RNA, 20 nt, Human
uccuguguuuuuucugccac

SEQ ID NO: 3689665 - RNA, 23 nt, Human
uccuguuagcuccucacuguggu

SEQ ID NO: 3689666 - RNA, 22 nt, Human
uccuguuagguauuagaaagug

SEQ ID NO: 3689667 - RNA, 15 nt, Human
uccuguucagcauuc

SEQ ID NO: 3689668 - RNA, 18 nt, Human
uccuguucagcauucuua

SEQ ID NO: 3689669 - RNA, 18 nt, Human
uccuguucaguaauaaaa

SEQ ID NO: 3689670 - RNA, 12 nt, Human
uccuguucugaa

SEQ ID NO: 3689671 - RNA, 22 nt, Human
uccuguugaaaagccauguuua

SEQ ID NO: 3689672 - RNA, 20 nt, Human
uccuguugcacccagcccug

SEQ ID NO: 3689673 - RNA, 18 nt, Human
uccuguuuccuagcugug

SEQ ID NO: 3689674 - RNA, 19 nt, Human
uccuguuucugaaaagaaa

SEQ ID NO: 3689675 - RNA, 23 nt, Human
uccuguuugggaagagcuuagaa

SEQ ID NO: 3689676 - RNA, 18 nt, Human
uccuguuugggccccucu

SEQ ID NO: 3689677 - RNA, 18 nt, Human
uccuuaaaauguaagauu

SEQ ID NO: 3689678 - RNA, 23 nt, Human
uccuuaaacagggcaucuccagg

SEQ ID NO: 3689679 - RNA, 14 nt, Human
uccuuaaacugugu

SEQ ID NO: 3689680 - RNA, 15 nt, Human
uccuuaaacugugug

SEQ ID NO: 3689681 - RNA, 16 nt, Human
uccuuaaacugugugg

SEQ ID NO: 3689682 - RNA, 17 nt, Human
uccuuaaacugugugga

SEQ ID NO: 3689683 - RNA, 17 nt, Human
uccuuaaagaguguggc

SEQ ID NO: 3689684 - RNA, 19 nt, Human
uccuuaaaucuuaauguuc

SEQ ID NO: 3689685 - RNA, 13 nt, Human
uccuuaagagauu

SEQ ID NO: 3689686 - RNA, 21 nt, Human
uccuuaaguauaucauguaaa

SEQ ID NO: 3689687 - RNA, 15 nt, Human
uccuuacaaaugauu

SEQ ID NO: 3689688 - RNA, 15 nt, Human
uccuuacauaaacau

SEQ ID NO: 3689689 - RNA, 18 nt, Human
uccuuaccagcagagcac

SEQ ID NO: 3689690 - RNA, 21 nt, Human
uccuuaccagcagagcaccuu

SEQ ID NO: 3689691 - RNA, 22 nt, Human
uccuuaccgugggcacugaagg

SEQ ID NO: 3689692 - RNA, 20 nt, Human
uccuuaccuuuuuauuugca

SEQ ID NO: 3689693 - RNA, 22 nt, Human
uccuuacuccugugggagccuc

SEQ ID NO: 3689694 - RNA, 15 nt, Human
uccuuacuuuuaagg

SEQ ID NO: 3689695 - RNA, 20 nt, Human
uccuuagaacauuuuaauuc

SEQ ID NO: 3689696 - RNA, 18 nt, Human
uccuuagacucuuuuccu

SEQ ID NO: 3689697 - RNA, 19 nt, Human
uccuuagagacaucaaaau

SEQ ID NO: 3689698 - RNA, 17 nt, Human
uccuuagaucuggcaug

SEQ ID NO: 3689699 - RNA, 18 nt, Human
uccuuagaucuggcaugu

SEQ ID NO: 3689700 - RNA, 16 nt, Human
uccuuagcaacagccg

SEQ ID NO: 3689701 - RNA, 23 nt, Human
uccuuagccuggaccucugacag

SEQ ID NO: 3689702 - RNA, 18 nt, Human
uccuuagcuuagaccuca

SEQ ID NO: 3689703 - RNA, 17 nt, Human
uccuuaggccucugaga

SEQ ID NO: 3689704 - RNA, 15 nt, Human
uccuuagucuucuca

SEQ ID NO: 3689705 - RNA, 15 nt, Human
uccuuaucaaaggac

SEQ ID NO: 3689706 - RNA, 17 nt, Human
uccuuaucgaaacucau

SEQ ID NO: 3689707 - RNA, 15 nt, Human
uccuuaucuagcugc

SEQ ID NO: 3689708 - RNA, 23 nt, Human
uccuuaugccacccccgcuggag

SEQ ID NO: 3689709 - RNA, 17 nt, Human
uccuuaugcuugggccu

SEQ ID NO: 3689710 - RNA, 20 nt, Human
uccuuauuuggcgugacccg

SEQ ID NO: 3689711 - RNA, 13 nt, Human
uccuucaaagucu

SEQ ID NO: 3689712 - RNA, 19 nt, Human
uccuucaacaaggcuugcu

SEQ ID NO: 3689713 - RNA, 23 nt, Human
uccuucaagaacucugggcugcu

SEQ ID NO: 3689714 - RNA, 15 nt, Human
uccuucaagccagca

SEQ ID NO: 3689715 - RNA, 18 nt, Human
uccuucaaguuagcucag

SEQ ID NO: 3689716 - RNA, 15 nt, Human
uccuucaauuccaua

SEQ ID NO: 3689717 - RNA, 18 nt, Human
uccuucacagaugggugc

SEQ ID NO: 3689718 - RNA, 19 nt, Human
uccuucacagaugggugcu

SEQ ID NO: 3689719 - RNA, 12 nt, Human
uccuucacuguu

SEQ ID NO: 3689720 - RNA, 15 nt, Human
uccuucacuguuuca

SEQ ID NO: 3689721 - RNA, 23 nt, Human
uccuucagagagcagugcuuuug

SEQ ID NO: 3689722 - RNA, 14 nt, Human
uccuucagauauuu

SEQ ID NO: 3689723 - RNA, 15 nt, Human
uccuucagauauuuu

SEQ ID NO: 3689724 - RNA, 18 nt, Human
uccuucagggugaugcca

SEQ ID NO: 3689725 - RNA, 14 nt, Human
uccuucagugccuu

SEQ ID NO: 3689726 - RNA, 22 nt, Human
uccuucaucaugaguucugcug

SEQ ID NO: 3689727 - RNA, 19 nt, Human
uccuucaugacagccucca

SEQ ID NO: 3689728 - RNA, 14 nt, Human
uccuucauuuccuc

SEQ ID NO: 3689729 - RNA, 22 nt, Human
uccccuccuaccccucccagcu

SEQ ID NO: 3689730 - RNA, 16 nt, Human
uccccuccucuccccu

SEQ ID NO: 3689731 - RNA, 15 nt, Human
uccccuccucugcuu

SEQ ID NO: 3689732 - RNA, 24 nt, Human
uccccuccucugcuugccaucccu

SEQ ID NO: 3689733 - RNA, 12 nt, Human
uccccuccuugc

SEQ ID NO: 3689734 - RNA, 20 nt, Human
uccccuccuugccuccugug

SEQ ID NO: 3689735 - RNA, 21 nt, Human
uccccuccuugccuccugugu

SEQ ID NO: 3689736 - RNA, 17 nt, Human
uccccucuauuuagcau

SEQ ID NO: 3689737 - RNA, 16 nt, Human
uccccucuccuuccug

SEQ ID NO: 3689738 - RNA, 15 nt, Human
uccccucugaaaguu

SEQ ID NO: 3689739 - RNA, 15 nt, Human
uccccucugcugcug

SEQ ID NO: 3689740 - RNA, 14 nt, Human
uccccucugcuggc

SEQ ID NO: 3689741 - RNA, 18 nt, Human
uccccucuucccuucaac

SEQ ID NO: 3689742 - RNA, 12 nt, Human
uccccucuuccu

SEQ ID NO: 3689743 - RNA, 23 nt, Human
uccccucuuccuacccugccucc

SEQ ID NO: 3689744 - RNA, 21 nt, Human
uccccucuugccccaaccccc

SEQ ID NO: 3689745 - RNA, 12 nt, Human
uccccugacagg

SEQ ID NO: 3689746 - RNA, 12 nt, Human
uccccugaggcu

SEQ ID NO: 3689747 - RNA, 14 nt, Human
uccccugcacugga

SEQ ID NO: 3689748 - RNA, 22 nt, Human
uccccugcacuguaaaaugugg

SEQ ID NO: 3689749 - RNA, 18 nt, Human
uccccugcagcccuggcc

SEQ ID NO: 3689750 - RNA, 14 nt, Human
uccccugcaggcug

SEQ ID NO: 3689751 - RNA, 20 nt, Human
uccccugcaggcugagugca

SEQ ID NO: 3689752 - RNA, 14 nt, Human
uccccugccaccag

SEQ ID NO: 3689753 - RNA, 16 nt, Human
uccccugccaccaggc

SEQ ID NO: 3689754 - RNA, 13 nt, Human
uccccugccauuu

SEQ ID NO: 3689755 - RNA, 12 nt, Human
uccccugccccc

SEQ ID NO: 3689756 - RNA, 23 nt, Human
uccccugcccccagaccuuuuau

SEQ ID NO: 3689757 - RNA, 20 nt, Human
uccccugcccccaggacugg

SEQ ID NO: 3689758 - RNA, 16 nt, Human
uccccugcccccugca

SEQ ID NO: 3689759 - RNA, 18 nt, Human
uccccugcccccugcagg

SEQ ID NO: 3689760 - RNA, 23 nt, Human
uccccugcccccugcaggaagga

SEQ ID NO: 3689761 - RNA, 19 nt, Human
uccccugccccuuccuuua

SEQ ID NO: 3689762 - RNA, 12 nt, Human
uccccugcccug

SEQ ID NO: 3689763 - RNA, 16 nt, Human
uccccugcccugcugc

SEQ ID NO: 3689764 - RNA, 13 nt, Human
uccccugcccugg

SEQ ID NO: 3689765 - RNA, 15 nt, Human
uccccugcccugguc

SEQ ID NO: 3689766 - RNA, 13 nt, Human
uccccugccucca

SEQ ID NO: 3689767 - RNA, 18 nt, Human
uccccugccugcccuggu

SEQ ID NO: 3689768 - RNA, 13 nt, Human
uccccugcuaccc

SEQ ID NO: 3689769 - RNA, 18 nt, Human
uccccugcugcaggggcu

SEQ ID NO: 3689770 - RNA, 23 nt, Human
uccccugcugcaggggcucugga

SEQ ID NO: 3689771 - RNA, 14 nt, Human
uccccugcugggug

SEQ ID NO: 3689772 - RNA, 20 nt, Human
uccccuggaacugucucuca

SEQ ID NO: 3689773 - RNA, 20 nt, Human
uccccuggaagcagugccca

SEQ ID NO: 3689774 - RNA, 17 nt, Human
uccccuggacugggagg

SEQ ID NO: 3689775 - RNA, 15 nt, Human
uccccuggcacuggc

SEQ ID NO: 3689776 - RNA, 22 nt, Human
uccccuguagagugggagcuga

SEQ ID NO: 3689777 - RNA, 14 nt, Human
uccccugugcaguc

SEQ ID NO: 3689778 - RNA, 20 nt, Human
uccccuguggggaucucagg

SEQ ID NO: 3689779 - RNA, 12 nt, Human
uccccuguguca

SEQ ID NO: 3689780 - RNA, 17 nt, Human
uccccuguuccccucuc

SEQ ID NO: 3689781 - RNA, 18 nt, Human
uccccuguuccccucucc

SEQ ID NO: 3689782 - RNA, 20 nt, Human
uccccuguuccccucucccu

SEQ ID NO: 3689783 - RNA, 15 nt, Human
uccccuguuuauuca

SEQ ID NO: 3689784 - RNA, 18 nt, Human
uccccuguuuguuucuga

SEQ ID NO: 3689785 - RNA, 21 nt, Human
uccccuguuuguuucugaaag

SEQ ID NO: 3689786 - RNA, 20 nt, Human
uccccuuauccucccuguaa

SEQ ID NO: 3689787 - RNA, 22 nt, Human
uccccuuauccucccuguaacu

SEQ ID NO: 3689788 - RNA, 18 nt, Human
uccccuuccacugagggc

SEQ ID NO: 3689789 - RNA, 19 nt, Human
uccccuuccaucccagagg

SEQ ID NO: 3689790 - RNA, 12 nt, Human
uccccuucccag

SEQ ID NO: 3689791 - RNA, 18 nt, Human
uccccuucccgugaccug

SEQ ID NO: 3689792 - RNA, 16 nt, Human
uccccuuccuaccacc

SEQ ID NO: 3689793 - RNA, 11 nt, Human
uccccuuccuu

SEQ ID NO: 3689794 - RNA, 22 nt, Human
uccccuucgcguauuucaggau

SEQ ID NO: 3689795 - RNA, 14 nt, Human
uccccuucuccccu

SEQ ID NO: 3689796 - RNA, 18 nt, Human
uccccuucuccccugcac

SEQ ID NO: 3689797 - RNA, 13 nt, Human
uccccuucucugu

SEQ ID NO: 3689798 - RNA, 16 nt, Human
uccccuucugaaucag

SEQ ID NO: 3689799 - RNA, 15 nt, Human
uccccuugagcugag

SEQ ID NO: 3689800 - RNA, 21 nt, Human
uccccuugaggucucagcccc

SEQ ID NO: 3689801 - RNA, 17 nt, Human
uccccuugccagcugcu

SEQ ID NO: 3689802 - RNA, 15 nt, Human
uccccuugcccaggg

SEQ ID NO: 3689803 - RNA, 17 nt, Human
uccccuugcccagggcu

SEQ ID NO: 3689804 - RNA, 24 nt, Human
uccccuugcccagggcucagccug

SEQ ID NO: 3689805 - RNA, 18 nt, Human
uccccuugcccuugcccu

SEQ ID NO: 3689806 - RNA, 23 nt, Human
uccccuugcccuugcccugaccu

SEQ ID NO: 3689807 - RNA, 12 nt, Human
uccccuugccug

SEQ ID NO: 3689808 - RNA, 17 nt, Human
uccccuuuauguacagg

SEQ ID NO: 3689809 - RNA, 12 nt, Human
uccccuuuccug

SEQ ID NO: 3689810 - RNA, 21 nt, Human
uccccuuuucuuuucuacccu

SEQ ID NO: 3689811 - RNA, 21 nt, Human
ucccgaagaauggagaggaac

SEQ ID NO: 3689812 - RNA, 20 nt, Human
ucccgaauagcugggacuac

SEQ ID NO: 3689813 - RNA, 15 nt, Human
ucccgagcuccucuu

SEQ ID NO: 3689814 - RNA, 18 nt, Human
ucccgaguacagucugua

SEQ ID NO: 3689815 - RNA, 17 nt, Human
ucccgaguagcugggac

SEQ ID NO: 3689816 - RNA, 21 nt, Human
ucccgaguagcugggauuaca

SEQ ID NO: 3689817 - RNA, 16 nt, Human
ucccgagucugggaca

SEQ ID NO: 3689818 - RNA, 15 nt, Human
ucccgauuguaacuc

SEQ ID NO: 3689819 - RNA, 22 nt, Human
ucccgcaaacccccuuugugcu

SEQ ID NO: 3689820 - RNA, 22 nt, Human
ucccgccccccacacuucccug

SEQ ID NO: 3689821 - RNA, 21 nt, Human
ucccgccucuucuucuucaga

SEQ ID NO: 3689822 - RNA, 21 nt, Human
ucccgcgcuccccgcgccccg

SEQ ID NO: 3689823 - RNA, 13 nt, Human
ucccgcucagccc

SEQ ID NO: 3689824 - RNA, 20 nt, Human
ucccgcucagcccucccugc

SEQ ID NO: 3689825 - RNA, 14 nt, Human
ucccggaggaaauc

SEQ ID NO: 3689826 - RNA, 16 nt, Human
ucccggagggcccuga

SEQ ID NO: 3689827 - RNA, 15 nt, Human
ucccggcucuguggg

SEQ ID NO: 3689828 - RNA, 18 nt, Human
ucccggcugcccuuucug

SEQ ID NO: 3689829 - RNA, 21 nt, Human
ucccgggacucacuggcagcc

SEQ ID NO: 3689830 - RNA, 15 nt, Human
ucccgggccagggcu

SEQ ID NO: 3689831 - RNA, 13 nt, Human
ucccgggcccucc

SEQ ID NO: 3689832 - RNA, 15 nt, Human
ucccgggcccucccu

SEQ ID NO: 3689833 - RNA, 18 nt, Human
ucccgggcccucccuugg

SEQ ID NO: 3689834 - RNA, 16 nt, Human
ucccggggccagcacu

SEQ ID NO: 3689835 - RNA, 15 nt, Human
ucccggguccuuggc

SEQ ID NO: 3689836 - RNA, 18 nt, Human
ucccgucccauauccugc

SEQ ID NO: 3689837 - RNA, 16 nt, Human
ucccguggaacguuuu

SEQ ID NO: 3689838 - RNA, 17 nt, Human
ucccguggccccagccu

SEQ ID NO: 3689839 - RNA, 19 nt, Human
ucccguggccccagccugg

SEQ ID NO: 3689840 - RNA, 21 nt, Human
ucccguggccccagccuggcc

SEQ ID NO: 3689841 - RNA, 23 nt, Human
ucccguggccccagccuggccca

SEQ ID NO: 3689842 - RNA, 16 nt, Human
ucccguuuuccccaug

SEQ ID NO: 3689843 - RNA, 18 nt, Human
ucccuaaaaacacagaca

SEQ ID NO: 3689844 - RNA, 16 nt, Human
ucccuaaaauacauuu

SEQ ID NO: 3689845 - RNA, 18 nt, Human
ucccuaaagaaaaaaaau

SEQ ID NO: 3689846 - RNA, 16 nt, Human
ucccuaacacuuaccc

SEQ ID NO: 3689847 - RNA, 17 nt, Human
ucccuaagccagccugg

SEQ ID NO: 3689848 - RNA, 14 nt, Human
ucccuaagccagcu

SEQ ID NO: 3689849 - RNA, 11 nt, Human
ucccuaauaaa

SEQ ID NO: 3689850 - RNA, 12 nt, Human
ucccuaauaaag

SEQ ID NO: 3689851 - RNA, 14 nt, Human
ucccuaauguguuu

SEQ ID NO: 3689852 - RNA, 13 nt, Human
ucccuacauuaaa

SEQ ID NO: 3689853 - RNA, 20 nt, Human
ucccuacccccuaagagcca

SEQ ID NO: 3689854 - RNA, 19 nt, Human
ucccuacccuaaccaaguu

SEQ ID NO: 3689855 - RNA, 15 nt, Human
ucccuaccucaggca

SEQ ID NO: 3689856 - RNA, 17 nt, Human
ucccuaccucaggcagg

SEQ ID NO: 3689857 - RNA, 19 nt, Human
ucccuaccuugaaagaaga

SEQ ID NO: 3689858 - RNA, 18 nt, Human
ucccuacugaagcccuug

SEQ ID NO: 3689859 - RNA, 16 nt, Human
ucccuacuuccuguga

SEQ ID NO: 3689860 - RNA, 17 nt, Human
ucccuacuuccugugac

SEQ ID NO: 3689861 - RNA, 22 nt, Human
ucccuagaaaacaaugcaaaac

SEQ ID NO: 3689862 - RNA, 20 nt, Human
ucccuagacuuuaggcuuuc

SEQ ID NO: 3689863 - RNA, 22 nt, Human
ucccuagacuuuaggcuuucag

SEQ ID NO: 3689864 - RNA, 15 nt, Human
ucccuagcagugaac

SEQ ID NO: 3689865 - RNA, 16 nt, Human
ucccuagccagcacuu

SEQ ID NO: 3689866 - RNA, 20 nt, Human
ucccuagccagcacuuguau

SEQ ID NO: 3689867 - RNA, 22 nt, Human
ucccuagccagcacuuguauau

SEQ ID NO: 3689868 - RNA, 23 nt, Human
ucccuagguguuuuguucaccau

SEQ ID NO: 3689869 - RNA, 16 nt, Human
ucccuaguaaaaauac

SEQ ID NO: 3689870 - RNA, 18 nt, Human
ucccuagucuucaagcag

SEQ ID NO: 3689871 - RNA, 20 nt, Human
ucccuagugacccggaggcc

SEQ ID NO: 3689872 - RNA, 17 nt, Human
ucccuauacugcuugga

SEQ ID NO: 3689873 - RNA, 20 nt, Human
ucccuaucacugaagcuuuu

SEQ ID NO: 3689874 - RNA, 21 nt, Human
ucccuaucacugaagcuuuuu

SEQ ID NO: 3689875 - RNA, 16 nt, Human
ucccuauccaaucaau

SEQ ID NO: 3689876 - RNA, 16 nt, Human
ucccuauuagagaaga

SEQ ID NO: 3689877 - RNA, 22 nt, Human
ucccuauuuuucucuccugucc

SEQ ID NO: 3689878 - RNA, 20 nt, Human
ucccucaaagcuuccauucc

SEQ ID NO: 3689879 - RNA, 22 nt, Human
ucccucaaagcuuccauuccac

SEQ ID NO: 3689880 - RNA, 13 nt, Human
ucccucaaaugac

SEQ ID NO: 3689881 - RNA, 14 nt, Human
ucccucacaagugg

SEQ ID NO: 3689882 - RNA, 22 nt, Human
ucccucacccacuuuggccucc

SEQ ID NO: 3689883 - RNA, 12 nt, Human
ucccucacccau

SEQ ID NO: 3689884 - RNA, 15 nt, Human
ucccucacccccucc

SEQ ID NO: 3689885 - RNA, 17 nt, Human
ucccucacccugagccc

SEQ ID NO: 3689886 - RNA, 21 nt, Human
ucccucacccugagccccuuc

SEQ ID NO: 3689887 - RNA, 13 nt, Human
ucccucaccugua

SEQ ID NO: 3689888 - RNA, 14 nt, Human
ucccucaccuguag

SEQ ID NO: 3689889 - RNA, 21 nt, Human
ucccucaccuuggcaccagac

SEQ ID NO: 3689890 - RNA, 22 nt, Human
ucccucacucgucucccccaac

SEQ ID NO: 3689891 - RNA, 15 nt, Human
ucccucagaaaauga

SEQ ID NO: 3689892 - RNA, 12 nt, Human
ucccucagacug

SEQ ID NO: 3689893 - RNA, 17 nt, Human
ucccucagccccucuug

SEQ ID NO: 3689894 - RNA, 22 nt, Human
ucccucauccucauacccaccc

SEQ ID NO: 3689895 - RNA, 16 nt, Human
ucccucaucugucccu

SEQ ID NO: 3689896 - RNA, 15 nt, Human
ucccucauuucagga

SEQ ID NO: 3689897 - RNA, 15 nt, Human
ucccuccaccccagg

SEQ ID NO: 3689898 - RNA, 17 nt, Human
ucccuccaccccaggac

SEQ ID NO: 3689899 - RNA, 18 nt, Human
ucccuccaccccaggacg

SEQ ID NO: 3689900 - RNA, 13 nt, Human
ucccuccaucccc

SEQ ID NO: 3689901 - RNA, 15 nt, Human
ucccucccaccucug

SEQ ID NO: 3689902 - RNA, 14 nt, Human
ucccucccaggacu

SEQ ID NO: 3689903 - RNA, 12 nt, Human
ucccuccccccc

SEQ ID NO: 3689904 - RNA, 16 nt, Human
ucccucccccccaugc

SEQ ID NO: 3689905 - RNA, 21 nt, Human
ucccucccccccaugcacugu

SEQ ID NO: 3689906 - RNA, 16 nt, Human
ucccuccccugcccuc

SEQ ID NO: 3689907 - RNA, 17 nt, Human
ucccuccccugcccugg

SEQ ID NO: 3689908 - RNA, 14 nt, Human
ucccuccccuucuc

SEQ ID NO: 3689909 - RNA, 14 nt, Human
ucccuccccuugcc

SEQ ID NO: 3689910 - RNA, 15 nt, Human
ucccuccccuugccu

SEQ ID NO: 3689911 - RNA, 20 nt, Human
ucccucccggcaugggaaag

SEQ ID NO: 3689912 - RNA, 22 nt, Human
ucccucccggcaugggaaagcc

SEQ ID NO: 3689913 - RNA, 17 nt, Human
ucccucccuccaccucc

SEQ ID NO: 3689914 - RNA, 15 nt, Human
ucccucccucuuucc

SEQ ID NO: 3689915 - RNA, 13 nt, Human
ucccucccuuggg

SEQ ID NO: 3689916 - RNA, 14 nt, Human
ucccuccgccccca

SEQ ID NO: 3689917 - RNA, 19 nt, Human
ucccuccgcccccagguag

SEQ ID NO: 3689918 - RNA, 20 nt, Human
ucccuccgcggcgggcccug

SEQ ID NO: 3689919 - RNA, 19 nt, Human
ucccuccggcuugaccugu

SEQ ID NO: 3689920 - RNA, 15 nt, Human
ucccuccgggaccug

SEQ ID NO: 3689921 - RNA, 18 nt, Human
ucccuccgggucuuccua

SEQ ID NO: 3689922 - RNA, 15 nt, Human
ucccuccucuguccc

SEQ ID NO: 3689923 - RNA, 21 nt, Human
ucccuccugccgacuccuggg

SEQ ID NO: 3689924 - RNA, 21 nt, Human
ucccuccuggugucaccccag

SEQ ID NO: 3689925 - RNA, 19 nt, Human
ucccucgcugcacaaauac

SEQ ID NO: 3689926 - RNA, 17 nt, Human
ucccucuaaugagacug

SEQ ID NO: 3689927 - RNA, 15 nt, Human
ucccucuacauggac

SEQ ID NO: 3689928 - RNA, 20 nt, Human
ucccucuaggcucugccuuc

SEQ ID NO: 3689929 - RNA, 15 nt, Human
ucccucuccagcagg

SEQ ID NO: 3689930 - RNA, 12 nt, Human
ucccucucccag

SEQ ID NO: 3689931 - RNA, 14 nt, Human
ucccucucccaggc

SEQ ID NO: 3689932 - RNA, 16 nt, Human
ucccucucccaggccc

SEQ ID NO: 3689933 - RNA, 20 nt, Human
ucccucucccaggccccaug

SEQ ID NO: 3689934 - RNA, 22 nt, Human
ucccucucggaaggcuggcugg

SEQ ID NO: 3689935 - RNA, 23 nt, Human
ucccucucggaaggcuggcuggg

SEQ ID NO: 3689936 - RNA, 13 nt, Human
ucccucucucuga

SEQ ID NO: 3689937 - RNA, 15 nt, Human
ucccucucucugacu

SEQ ID NO: 3689938 - RNA, 16 nt, Human
ucccucucucuggaaa

SEQ ID NO: 3689939 - RNA, 16 nt, Human
ucccucucucuucugc

SEQ ID NO: 3689940 - RNA, 19 nt, Human
ucccucucucuucugcucc

SEQ ID NO: 3689941 - RNA, 13 nt, Human
ucccucucuggag

SEQ ID NO: 3689942 - RNA, 13 nt, Human
ucccucugaccug

SEQ ID NO: 3689943 - RNA, 13 nt, Human
ucccucugcccca

SEQ ID NO: 3689944 - RNA, 13 nt, Human
ucccucugccggc

SEQ ID NO: 3689945 - RNA, 16 nt, Human
ucccucugccuguccc

SEQ ID NO: 3689946 - RNA, 20 nt, Human
ucccucugccugucccucuc

SEQ ID NO: 3689947 - RNA, 12 nt, Human
ucccucugcuca

SEQ ID NO: 3689948 - RNA, 14 nt, Human
ucccucugguccca

SEQ ID NO: 3689949 - RNA, 15 nt, Human
ucccucuucacuccc

SEQ ID NO: 3689950 - RNA, 19 nt, Human
ucccucuucucaagugccu

SEQ ID NO: 3689951 - RNA, 16 nt, Human
ucccucuucuuucaga

SEQ ID NO: 3689952 - RNA, 17 nt, Human
ucccucuuggucuuccc

SEQ ID NO: 3689953 - RNA, 13 nt, Human
ucccucuuguuuu

SEQ ID NO: 3689954 - RNA, 21 nt, Human
ucccucuuguuuuguuugucu

SEQ ID NO: 3689955 - RNA, 23 nt, Human
ucccucuuuggcuccccuguacc

SEQ ID NO: 3689956 - RNA, 15 nt, Human
ucccugaaaacccag

SEQ ID NO: 3689957 - RNA, 19 nt, Human
ucccugaaaacccagagag

SEQ ID NO: 3689958 - RNA, 20 nt, Human
ucccugaaaacccagagagg

SEQ ID NO: 3689959 - RNA, 21 nt, Human
ucccugaaacacgaaacuugu

SEQ ID NO: 3689960 - RNA, 14 nt, Human
ucccugaacuggga

SEQ ID NO: 3689961 - RNA, 17 nt, Human
ucccugaacugggaccu

SEQ ID NO: 3689962 - RNA, 15 nt, Human
ucccugaagccagcc

SEQ ID NO: 3689963 - RNA, 20 nt, Human
ucccugaaggaaccaaagcg

SEQ ID NO: 3689964 - RNA, 17 nt, Human
ucccugaaggccccgcc

SEQ ID NO: 3689965 - RNA, 21 nt, Human
ucccugaaggccccgcccagg

SEQ ID NO: 3689966 - RNA, 22 nt, Human
ucccugacacugcggggcuugg

SEQ ID NO: 3689967 - RNA, 23 nt, Human
ucccugacacugcggggcuuggc

SEQ ID NO: 3689968 - RNA, 14 nt, Human
ucccugacccugca

SEQ ID NO: 3689969 - RNA, 14 nt, Human
ucccugacucauuc

SEQ ID NO: 3689970 - RNA, 19 nt, Human
ucccugacucauucugaag

SEQ ID NO: 3689971 - RNA, 12 nt, Human
ucccugacuggg

SEQ ID NO: 3689972 - RNA, 15 nt, Human
ucccugacugggagu

SEQ ID NO: 3689973 - RNA, 23 nt, Human
ucccugacugggggcagacaugg

SEQ ID NO: 3689974 - RNA, 15 nt, Human
ucccugagacaggga

SEQ ID NO: 3689975 - RNA, 11 nt, Human
ucccugagcag

SEQ ID NO: 3689976 - RNA, 23 nt, Human
ucccugagcuagaacccucuguu

SEQ ID NO: 3689977 - RNA, 20 nt, Human
ucccugaggacugauuucag

SEQ ID NO: 3689978 - RNA, 14 nt, Human
ucccugaggauggg

SEQ ID NO: 3689979 - RNA, 23 nt, Human
ucccugaggaugggucagagcua

SEQ ID NO: 3689980 - RNA, 11 nt, Human
ucccugaggca

SEQ ID NO: 3689981 - RNA, 21 nt, Human
ucccugaggcagguccccaga

SEQ ID NO: 3689982 - RNA, 20 nt, Human
ucccugaggcuggacuccag

SEQ ID NO: 3689983 - RNA, 16 nt, Human
ucccugagucaccagg

SEQ ID NO: 3689984 - RNA, 14 nt, Human
ucccugauaaauau

SEQ ID NO: 3689985 - RNA, 17 nt, Human
ucccugaucccuuccac

SEQ ID NO: 3689986 - RNA, 16 nt, Human
ucccugauugaccugc

SEQ ID NO: 3689987 - RNA, 20 nt, Human
ucccugauugaccugcuccg

SEQ ID NO: 3689988 - RNA, 18 nt, Human
ucccugcacaagccaggg

SEQ ID NO: 3689989 - RNA, 20 nt, Human
ucccugcacagugacuucug

SEQ ID NO: 3689990 - RNA, 21 nt, Human
ucccugcacuaaagccagccu

SEQ ID NO: 3689991 - RNA, 23 nt, Human
ucccugcacuaaagccagccuga

SEQ ID NO: 3689992 - RNA, 20 nt, Human
ucccugcacuugcagacucu

SEQ ID NO: 3689993 - RNA, 23 nt, Human
ucccugcagaugccacccuagcc

SEQ ID NO: 3689994 - RNA, 21 nt, Human
ucccugcaucugaccagcagc

SEQ ID NO: 3689995 - RNA, 21 nt, Human
ucccugcauggcauccuccag

SEQ ID NO: 3689996 - RNA, 12 nt, Human
ucccugccagag

SEQ ID NO: 3689997 - RNA, 15 nt, Human
ucccugccagcaccc

SEQ ID NO: 3689998 - RNA, 18 nt, Human
ucccugccagcaccccca

SEQ ID NO: 3689999 - RNA, 12 nt, Human
ucccugcccagg

SEQ ID NO: 3690000 - RNA, 13 nt, Human
ucccugcccaggc

SEQ ID NO: 3690001 - RNA, 19 nt, Human
ucccugcccaggccggcca

SEQ ID NO: 3690002 - RNA, 17 nt, Human
ucccugcccccuccccu

SEQ ID NO: 3690003 - RNA, 20 nt, Human
ucccugccccucccuucaac

SEQ ID NO: 3690004 - RNA, 15 nt, Human
ucccugcccucaucu

SEQ ID NO: 3690005 - RNA, 16 nt, Human
ucccugccucaggccu

SEQ ID NO: 3690006 - RNA, 18 nt, Human
ucccugccuccugccggc

SEQ ID NO: 3690007 - RNA, 17 nt, Human
ucccugccucucaucaa

SEQ ID NO: 3690008 - RNA, 12 nt, Human
ucccugccuggc

SEQ ID NO: 3690009 - RNA, 15 nt, Human
ucccugccuggucac

SEQ ID NO: 3690010 - RNA, 15 nt, Human
ucccugcgccuuucc

SEQ ID NO: 3690011 - RNA, 18 nt, Human
ucccugcugcuccuagga

SEQ ID NO: 3690012 - RNA, 13 nt, Human
ucccugcuguccc

SEQ ID NO: 3690013 - RNA, 14 nt, Human
ucccugcuuccagg

SEQ ID NO: 3690014 - RNA, 23 nt, Human
ucccuggaaaccuuccacccagu

SEQ ID NO: 3690015 - RNA, 13 nt, Human
ucccuggaaggug

SEQ ID NO: 3690016 - RNA, 19 nt, Human
ucccuggagccagacucug

SEQ ID NO: 3690017 - RNA, 11 nt, Human
ucccuggagug

SEQ ID NO: 3690018 - RNA, 22 nt, Human
ucccuggaguguggcugaggag

SEQ ID NO: 3690019 - RNA, 19 nt, Human
ucccuggaucuaccuggag

SEQ ID NO: 3690020 - RNA, 21 nt, Human
ucccuggaucuaccuggaggg

SEQ ID NO: 3690021 - RNA, 22 nt, Human
ucccuggaucuaccuggaggga

SEQ ID NO: 3690022 - RNA, 20 nt, Human
ucccuggauuuuuaccaguc

SEQ ID NO: 3690023 - RNA, 14 nt, Human
ucccuggccaucuc

SEQ ID NO: 3690024 - RNA, 16 nt, Human
ucccuggccaucucug

SEQ ID NO: 3690025 - RNA, 15 nt, Human
ucccuggccuuucau

SEQ ID NO: 3690026 - RNA, 21 nt, Human
ucccuggcgcaggugggcugg

SEQ ID NO: 3690027 - RNA, 12 nt, Human
ucccuggcuccc

SEQ ID NO: 3690028 - RNA, 17 nt, Human
ucccuggcucccuccuc

SEQ ID NO: 3690029 - RNA, 15 nt, Human
ucccuggcucucaga

SEQ ID NO: 3690030 - RNA, 17 nt, Human
ucauugcuucuucugag

SEQ ID NO: 3690031 - RNA, 15 nt, Human
ucauugcuuuacugg

SEQ ID NO: 3690032 - RNA, 21 nt, Human
ucauuggaaauuuagcauugu

SEQ ID NO: 3690033 - RNA, 18 nt, Human
ucauuggaacaacugaua

SEQ ID NO: 3690034 - RNA, 21 nt, Human
ucauuguaaacaaacucuuga

SEQ ID NO: 3690035 - RNA, 13 nt, Human
ucauuguaaucac

SEQ ID NO: 3690036 - RNA, 19 nt, Human
ucauuguacaguuuguuua

SEQ ID NO: 3690037 - RNA, 15 nt, Human
ucauuguauauaugu

SEQ ID NO: 3690038 - RNA, 18 nt, Human
ucauuguaugauguguug

SEQ ID NO: 3690039 - RNA, 15 nt, Human
ucauuguccagagcu

SEQ ID NO: 3690040 - RNA, 20 nt, Human
ucauugucccucuucacucc

SEQ ID NO: 3690041 - RNA, 22 nt, Human
ucauugucucucacagauguga

SEQ ID NO: 3690042 - RNA, 23 nt, Human
ucauugucugugaagugagaccu

SEQ ID NO: 3690043 - RNA, 22 nt, Human
ucauugugguuauuuuuauaca

SEQ ID NO: 3690044 - RNA, 23 nt, Human
ucauugugguuauuuuuauacag

SEQ ID NO: 3690045 - RNA, 20 nt, Human
ucauuguguuaccuguagau

SEQ ID NO: 3690046 - RNA, 17 nt, Human
ucauuguucaauuccca

SEQ ID NO: 3690047 - RNA, 12 nt, Human
ucauuguuuuga

SEQ ID NO: 3690048 - RNA, 23 nt, Human
ucauuuaaaaaaaaaauuuguuu

SEQ ID NO: 3690049 - RNA, 22 nt, Human
ucauuuaaaaagguuuaaaacu

SEQ ID NO: 3690050 - RNA, 13 nt, Human
ucauuuaaaauga

SEQ ID NO: 3690051 - RNA, 20 nt, Human
ucauuuaauaauauacuugu

SEQ ID NO: 3690052 - RNA, 22 nt, Human
ucauuuacuaaacauaugauuu

SEQ ID NO: 3690053 - RNA, 16 nt, Human
ucauuuagaacuugca

SEQ ID NO: 3690054 - RNA, 22 nt, Human
ucauuuagaacuugcagcugau

SEQ ID NO: 3690055 - RNA, 12 nt, Human
ucauuuaucuau

SEQ ID NO: 3690056 - RNA, 21 nt, Human
ucauuuaucuauaauuuaccu

SEQ ID NO: 3690057 - RNA, 16 nt, Human
ucauuuauuuuaagca

SEQ ID NO: 3690058 - RNA, 19 nt, Human
ucauuucacauuaaugguc

SEQ ID NO: 3690059 - RNA, 16 nt, Human
ucauuucaccccuccc

SEQ ID NO: 3690060 - RNA, 18 nt, Human
ucauuucaccugcugcuu

SEQ ID NO: 3690061 - RNA, 21 nt, Human
ucauuucagaaguuaguuugu

SEQ ID NO: 3690062 - RNA, 15 nt, Human
ucauuucaggagcag

SEQ ID NO: 3690063 - RNA, 12 nt, Human
ucauuucaggau

SEQ ID NO: 3690064 - RNA, 18 nt, Human
ucauuucauccuuucacu

SEQ ID NO: 3690065 - RNA, 17 nt, Human
ucauuucaucucauuua

SEQ ID NO: 3690066 - RNA, 20 nt, Human
ucauuucauguccuguguca

SEQ ID NO: 3690067 - RNA, 23 nt, Human
ucauuucauguccugugucaguu

SEQ ID NO: 3690068 - RNA, 13 nt, Human
ucauuucauucca

SEQ ID NO: 3690069 - RNA, 15 nt, Human
ucauuucauuccauu

SEQ ID NO: 3690070 - RNA, 16 nt, Human
ucauuucauuccauug

SEQ ID NO: 3690071 - RNA, 16 nt, Human
ucauuucauuccuaac

SEQ ID NO: 3690072 - RNA, 15 nt, Human
ucauuucauuuccua

SEQ ID NO: 3690073 - RNA, 12 nt, Human
ucauuuccaugu

SEQ ID NO: 3690074 - RNA, 13 nt, Human
ucauuuccugccc

SEQ ID NO: 3690075 - RNA, 23 nt, Human
ucauuuccugcccuuccucaguu

SEQ ID NO: 3690076 - RNA, 17 nt, Human
ucauuucuaaaagaaua

SEQ ID NO: 3690077 - RNA, 15 nt, Human
ucauuucuacuguga

SEQ ID NO: 3690078 - RNA, 23 nt, Human
ucauuucucacuguguacauaau

SEQ ID NO: 3690079 - RNA, 13 nt, Human
ucauuucuugggc

SEQ ID NO: 3690080 - RNA, 23 nt, Human
ucauuucuuuuugggagagacuu

SEQ ID NO: 3690081 - RNA, 16 nt, Human
ucauuugagucucuua

SEQ ID NO: 3690082 - RNA, 19 nt, Human
ucauuugcccuuaaggaca

SEQ ID NO: 3690083 - RNA, 13 nt, Human
ucauuugcuuuuu

SEQ ID NO: 3690084 - RNA, 22 nt, Human
ucauuuggaggaaaaaaagcau

SEQ ID NO: 3690085 - RNA, 16 nt, Human
ucauuuguaugucaaa

SEQ ID NO: 3690086 - RNA, 21 nt, Human
ucauuuguggugauauagaau

SEQ ID NO: 3690087 - RNA, 19 nt, Human
ucauuuguuauucuuaaga

SEQ ID NO: 3690088 - RNA, 16 nt, Human
ucauuuguugugaugu

SEQ ID NO: 3690089 - RNA, 12 nt, Human
ucauuuguuuaa

SEQ ID NO: 3690090 - RNA, 17 nt, Human
ucauuuguuuaaaaagg

SEQ ID NO: 3690091 - RNA, 15 nt, Human
ucauuuguuuuucuc

SEQ ID NO: 3690092 - RNA, 13 nt, Human
ucauuuuaaaaag

SEQ ID NO: 3690093 - RNA, 12 nt, Human
ucauuuuaaugu

SEQ ID NO: 3690094 - RNA, 17 nt, Human
ucauuuuaauguaaaga

SEQ ID NO: 3690095 - RNA, 16 nt, Human
ucauuuuacaguaucu

SEQ ID NO: 3690096 - RNA, 19 nt, Human
ucauuuuacaguuacuuuu

SEQ ID NO: 3690097 - RNA, 18 nt, Human
ucauuuuacccuuggcuc

SEQ ID NO: 3690098 - RNA, 17 nt, Human
ucauuuuauaugucaaa

SEQ ID NO: 3690099 - RNA, 18 nt, Human
ucauuuuauaugucaaag

SEQ ID NO: 3690100 - RNA, 21 nt, Human
ucauuuuauaugucaaagcag

SEQ ID NO: 3690101 - RNA, 16 nt, Human
ucauuuuauauugaaa

SEQ ID NO: 3690102 - RNA, 17 nt, Human
ucauuuuauauugaaaa

SEQ ID NO: 3690103 - RNA, 22 nt, Human
ucauuuucaagacugaauucca

SEQ ID NO: 3690104 - RNA, 11 nt, Human
ucauuuucauu

SEQ ID NO: 3690105 - RNA, 19 nt, Human
ucauuuuccccccacucuc

SEQ ID NO: 3690106 - RNA, 23 nt, Human
ucauuuucuagauacaauaaauu

SEQ ID NO: 3690107 - RNA, 13 nt, Human
ucauuuucucuuu

SEQ ID NO: 3690108 - RNA, 21 nt, Human
ucauuuucugccuaucuucuu

SEQ ID NO: 3690109 - RNA, 21 nt, Human
ucauuuucuuaucuucugcaa

SEQ ID NO: 3690110 - RNA, 16 nt, Human
ucauuuucuuuuuuaa

SEQ ID NO: 3690111 - RNA, 16 nt, Human
ucauuuugaaauuguu

SEQ ID NO: 3690112 - RNA, 16 nt, Human
ucauuuugaagcuaau

SEQ ID NO: 3690113 - RNA, 18 nt, Human
ucauuuugaagcuaauua

SEQ ID NO: 3690114 - RNA, 12 nt, Human
ucauuuugaggg

SEQ ID NO: 3690115 - RNA, 17 nt, Human
ucauuuugcauucaaau

SEQ ID NO: 3690116 - RNA, 13 nt, Human
ucauuuuuauagc

SEQ ID NO: 3690117 - RNA, 15 nt, Human
ucauuuuuccguaaa

SEQ ID NO: 3690118 - RNA, 21 nt, Human
ucauuuuugaaacugcauuug

SEQ ID NO: 3690119 - RNA, 16 nt, Human
ucauuuuuuaaaaaag

SEQ ID NO: 3690120 - RNA, 23 nt, Human
ucauuuuuuccuguuugggaaga

SEQ ID NO: 3690121 - RNA, 18 nt, Human
ucauuuuuuuccaggcug

SEQ ID NO: 3690122 - RNA, 19 nt, Human
uccaaaaagauuuucagaa

SEQ ID NO: 3690123 - RNA, 20 nt, Human
uccaaaaagauuuucagaaa

SEQ ID NO: 3690124 - RNA, 13 nt, Human
uccaaaaauuauu

SEQ ID NO: 3690125 - RNA, 21 nt, Human
uccaaaaccgccagcucuguu

SEQ ID NO: 3690126 - RNA, 15 nt, Human
uccaaaacuccugcc

SEQ ID NO: 3690127 - RNA, 14 nt, Human
uccaaaagaaaaac

SEQ ID NO: 3690128 - RNA, 21 nt, Human
uccaaaagaagcccccagcua

SEQ ID NO: 3690129 - RNA, 19 nt, Human
uccaaaagauugcugaaau

SEQ ID NO: 3690130 - RNA, 15 nt, Human
uccaaaauaauuuua

SEQ ID NO: 3690131 - RNA, 18 nt, Human
uccaaaaucuugaucagu

SEQ ID NO: 3690132 - RNA, 15 nt, Human
uccaaaaugugccua

SEQ ID NO: 3690133 - RNA, 19 nt, Human
uccaaaauguguauuucuu

SEQ ID NO: 3690134 - RNA, 15 nt, Human
uccaaaauuuuucaa

SEQ ID NO: 3690135 - RNA, 14 nt, Human
uccaaacacaggca

SEQ ID NO: 3690136 - RNA, 19 nt, Human
uccaaacauguauuuaugu

SEQ ID NO: 3690137 - RNA, 22 nt, Human
uccaaaccacuuuuugcagcuu

SEQ ID NO: 3690138 - RNA, 21 nt, Human
uccaaaccuccuguuagcugu

SEQ ID NO: 3690139 - RNA, 22 nt, Human
uccaaaccuucacacacagacu

SEQ ID NO: 3690140 - RNA, 19 nt, Human
uccaaacuaccuuccaguu

SEQ ID NO: 3690141 - RNA, 19 nt, Human
uccaaacucuucccucucu

SEQ ID NO: 3690142 - RNA, 18 nt, Human
uccaaacuuggauuuuug

SEQ ID NO: 3690143 - RNA, 22 nt, Human
uccaaacuuggauuuuugacuc

SEQ ID NO: 3690144 - RNA, 14 nt, Human
uccaaagaaaugua

SEQ ID NO: 3690145 - RNA, 12 nt, Human
uccaaagaaugu

SEQ ID NO: 3690146 - RNA, 19 nt, Human
uccaaagaggcugccccuc

SEQ ID NO: 3690147 - RNA, 23 nt, Human
uccaaagaguagaauugcauuga

SEQ ID NO: 3690148 - RNA, 19 nt, Human
uccaaagcacauugaaaga

SEQ ID NO: 3690149 - RNA, 17 nt, Human
uccaaagccaaugugaa

SEQ ID NO: 3690150 - RNA, 15 nt, Human
uccaaagcuuuccug

SEQ ID NO: 3690151 - RNA, 23 nt, Human
uccaaaggaaucuccaguuuuca

SEQ ID NO: 3690152 - RNA, 15 nt, Human
uccaaaggaggcugg

SEQ ID NO: 3690153 - RNA, 17 nt, Human
uccaaagucucuaauuc

SEQ ID NO: 3690154 - RNA, 18 nt, Human
uccaaagucucuaauucu

SEQ ID NO: 3690155 - RNA, 16 nt, Human
uccaaauaauaaaguc

SEQ ID NO: 3690156 - RNA, 20 nt, Human
uccaaaugaauguugucugu

SEQ ID NO: 3690157 - RNA, 16 nt, Human
uccaaaugcaauuuga

SEQ ID NO: 3690158 - RNA, 19 nt, Human
uccaaaugcccagcuuaaa

SEQ ID NO: 3690159 - RNA, 21 nt, Human
uccaaauggagaagcugcagg

SEQ ID NO: 3690160 - RNA, 20 nt, Human
uccaaauguccuccagaagc

SEQ ID NO: 3690161 - RNA, 22 nt, Human
uccaaauguccuccagaagccu

SEQ ID NO: 3690162 - RNA, 15 nt, Human
uccaaauuauuucuu

SEQ ID NO: 3690163 - RNA, 13 nt, Human
uccaaauucacaa

SEQ ID NO: 3690164 - RNA, 14 nt, Human
uccaaauugugcuu

SEQ ID NO: 3690165 - RNA, 21 nt, Human
uccaaauuuuuuuuuaaagca

SEQ ID NO: 3690166 - RNA, 18 nt, Human
uccaacaaaggguuuuaa

SEQ ID NO: 3690167 - RNA, 15 nt, Human
uccaacacaaggcuc

SEQ ID NO: 3690168 - RNA, 23 nt, Human
uccaacacaaggcuccaagaccu

SEQ ID NO: 3690169 - RNA, 17 nt, Human
uccaacaccaagcacag

SEQ ID NO: 3690170 - RNA, 17 nt, Human
uccaacaccacagacac

SEQ ID NO: 3690171 - RNA, 18 nt, Human
uccaacaccacagacaca

SEQ ID NO: 3690172 - RNA, 17 nt, Human
uccaacagaagaacugu

SEQ ID NO: 3690173 - RNA, 16 nt, Human
uccaacaggagcuggg

SEQ ID NO: 3690174 - RNA, 14 nt, Human
uccaaccagaccug

SEQ ID NO: 3690175 - RNA, 15 nt, Human
uccaaccagaccugg

SEQ ID NO: 3690176 - RNA, 17 nt, Human
uccaaccagaccuggaa

SEQ ID NO: 3690177 - RNA, 16 nt, Human
uccaaccauuuucauu

SEQ ID NO: 3690178 - RNA, 14 nt, Human
uccaaccccaacuc

SEQ ID NO: 3690179 - RNA, 14 nt, Human
uccagacuuccuug

SEQ ID NO: 3690180 - RNA, 14 nt, Human
uccagagacuggga

SEQ ID NO: 3690181 - RNA, 19 nt, Human
uccagagagagaagugccc

SEQ ID NO: 3690182 - RNA, 21 nt, Human
uccagagagagaagugccccu

SEQ ID NO: 3690183 - RNA, 23 nt, Human
uccagagagagaagugccccugc

SEQ ID NO: 3690184 - RNA, 18 nt, Human
uccagagaguccucugga

SEQ ID NO: 3690185 - RNA, 20 nt, Human
uccagagcggaggcugugug

SEQ ID NO: 3690186 - RNA, 13 nt, Human
uccagagcugcca

SEQ ID NO: 3690187 - RNA, 20 nt, Human
uccagaggcuauuauuuuca

SEQ ID NO: 3690188 - RNA, 12 nt, Human
uccagagggcac

SEQ ID NO: 3690189 - RNA, 18 nt, Human
uccagagucccugccugg

SEQ ID NO: 3690190 - RNA, 19 nt, Human
uccagagucccugccugga

SEQ ID NO: 3690191 - RNA, 20 nt, Human
uccagagucccugccuggac

SEQ ID NO: 3690192 - RNA, 15 nt, Human
uccagaucacugcca

SEQ ID NO: 3690193 - RNA, 16 nt, Human
uccagaucacugccac

SEQ ID NO: 3690194 - RNA, 17 nt, Human
uccagauccucucuggg

SEQ ID NO: 3690195 - RNA, 20 nt, Human
uccagauccucucuggggcu

SEQ ID NO: 3690196 - RNA, 14 nt, Human
uccagauccuggaa

SEQ ID NO: 3690197 - RNA, 17 nt, Human
uccagauccuggaaauc

SEQ ID NO: 3690198 - RNA, 15 nt, Human
uccagaucugcaccg

SEQ ID NO: 3690199 - RNA, 15 nt, Human
uccagaugcagggca

SEQ ID NO: 3690200 - RNA, 18 nt, Human
uccagaugcagggcaguc

SEQ ID NO: 3690201 - RNA, 17 nt, Human
uccagauggucauccag

SEQ ID NO: 3690202 - RNA, 18 nt, Human
uccagauggucauccaga

SEQ ID NO: 3690203 - RNA, 17 nt, Human
uccagaugugaugcuug

SEQ ID NO: 3690204 - RNA, 23 nt, Human
uccagauuaucuauuugugugug

SEQ ID NO: 3690205 - RNA, 12 nt, Human
uccagauuuuua

SEQ ID NO: 3690206 - RNA, 20 nt, Human
uccagcaacacagccugggc

SEQ ID NO: 3690207 - RNA, 21 nt, Human
uccagcaauucuccugccuca

SEQ ID NO: 3690208 - RNA, 14 nt, Human
uccagcaccacacu

SEQ ID NO: 3690209 - RNA, 14 nt, Human
uccagcaccuugug

SEQ ID NO: 3690210 - RNA, 22 nt, Human
uccagcagauuuccagccuucu

SEQ ID NO: 3690211 - RNA, 15 nt, Human
uccagcaggcccaug

SEQ ID NO: 3690212 - RNA, 23 nt, Human
uccagcagucucugccuugccuu

SEQ ID NO: 3690213 - RNA, 15 nt, Human
uccagcauucccagg

SEQ ID NO: 3690214 - RNA, 16 nt, Human
uccagccaaccccugu

SEQ ID NO: 3690215 - RNA, 14 nt, Human
uccagccagcgccu

SEQ ID NO: 3690216 - RNA, 21 nt, Human
uccagccagcgccucccucca

SEQ ID NO: 3690217 - RNA, 20 nt, Human
uccagccaucaagagacuga

SEQ ID NO: 3690218 - RNA, 11 nt, Human
uccagcccauc

SEQ ID NO: 3690219 - RNA, 18 nt, Human
uccagcccaucucggagc

SEQ ID NO: 3690220 - RNA, 19 nt, Human
uccagcccaucucggagca

SEQ ID NO: 3690221 - RNA, 12 nt, Human
uccagcccauug

SEQ ID NO: 3690222 - RNA, 23 nt, Human
uccagccccucuggucgcuccug

SEQ ID NO: 3690223 - RNA, 21 nt, Human
uccagccccucuuggagaagu

SEQ ID NO: 3690224 - RNA, 12 nt, Human
uccagccccugg

SEQ ID NO: 3690225 - RNA, 17 nt, Human
uccagccccuucucaga

SEQ ID NO: 3690226 - RNA, 18 nt, Human
uccagccccuucucagaa

SEQ ID NO: 3690227 - RNA, 15 nt, Human
uccagccccuuucca

SEQ ID NO: 3690228 - RNA, 16 nt, Human
uccagccccuuuccaa

SEQ ID NO: 3690229 - RNA, 17 nt, Human
uccagccccuuuccaaa

SEQ ID NO: 3690230 - RNA, 18 nt, Human
uccagccccuuuccaaaa

SEQ ID NO: 3690231 - RNA, 14 nt, Human
uccagcccgggagc

SEQ ID NO: 3690232 - RNA, 18 nt, Human
uccagcccgggagccuag

SEQ ID NO: 3690233 - RNA, 19 nt, Human
uccagcccuggcugaagga

SEQ ID NO: 3690234 - RNA, 21 nt, Human
uccagccgccauugccaccag

SEQ ID NO: 3690235 - RNA, 23 nt, Human
uccagccgccauugccaccagga

SEQ ID NO: 3690236 - RNA, 12 nt, Human
uccagccuagag

SEQ ID NO: 3690237 - RNA, 15 nt, Human
uccagccucuccccu

SEQ ID NO: 3690238 - RNA, 12 nt, Human
uccagccucugu

SEQ ID NO: 3690239 - RNA, 21 nt, Human
uccagccucuguuccccuagu

SEQ ID NO: 3690240 - RNA, 11 nt, Human
uccagccugac

SEQ ID NO: 3690241 - RNA, 13 nt, Human
uccagccugagca

SEQ ID NO: 3690242 - RNA, 20 nt, Human
uccagccugagcgacaguga

SEQ ID NO: 3690243 - RNA, 13 nt, Human
uccagccuggacc

SEQ ID NO: 3690244 - RNA, 19 nt, Human
uccagccuggacccccagc

SEQ ID NO: 3690245 - RNA, 14 nt, Human
uccagccuggagau

SEQ ID NO: 3690246 - RNA, 13 nt, Human
uccagccuggcuc

SEQ ID NO: 3690247 - RNA, 13 nt, Human
uccagccugggug

SEQ ID NO: 3690248 - RNA, 20 nt, Human
uccagcuauaacaguaggga

SEQ ID NO: 3690249 - RNA, 14 nt, Human
uccagcucaccagc

SEQ ID NO: 3690250 - RNA, 18 nt, Human
uccagcucaccagcccca

SEQ ID NO: 3690251 - RNA, 21 nt, Human
uccagcucaccccccacacuc

SEQ ID NO: 3690252 - RNA, 16 nt, Human
uccagcucagaaccca

SEQ ID NO: 3690253 - RNA, 17 nt, Human
uccagcucagaacccag

SEQ ID NO: 3690254 - RNA, 21 nt, Human
uccagcucagaacccagggcu

SEQ ID NO: 3690255 - RNA, 16 nt, Human
uccagcucauucauuu

SEQ ID NO: 3690256 - RNA, 18 nt, Human
uccagcuccaaccugcaa

SEQ ID NO: 3690257 - RNA, 19 nt, Human
uccagcuccaaccugcaaa

SEQ ID NO: 3690258 - RNA, 22 nt, Human
uccagcuccaagaccuguuggu

SEQ ID NO: 3690259 - RNA, 20 nt, Human
uccagcucuggaggggaggg

SEQ ID NO: 3690260 - RNA, 15 nt, Human
uccagcucuggcaug

SEQ ID NO: 3690261 - RNA, 14 nt, Human
uccagcugacuaaa

SEQ ID NO: 3690262 - RNA, 14 nt, Human
uccagcugcaccag

SEQ ID NO: 3690263 - RNA, 16 nt, Human
uccagcugcaccagag

SEQ ID NO: 3690264 - RNA, 22 nt, Human
uccagcugccccggccccuccc

SEQ ID NO: 3690265 - RNA, 17 nt, Human
uccagcugccuauugau

SEQ ID NO: 3690266 - RNA, 12 nt, Human
uccagcuggccu

SEQ ID NO: 3690267 - RNA, 13 nt, Human
uccagcuggccug

SEQ ID NO: 3690268 - RNA, 19 nt, Human
uccagcuggguuggaaaac

SEQ ID NO: 3690269 - RNA, 16 nt, Human
uccagcugucccccca

SEQ ID NO: 3690270 - RNA, 19 nt, Human
uccagcuucugguacucuc

SEQ ID NO: 3690271 - RNA, 15 nt, Human
uccagcuugcucuuc

SEQ ID NO: 3690272 - RNA, 19 nt, Human
uccagcuugcucuucagug

SEQ ID NO: 3690273 - RNA, 17 nt, Human
uccagcuuguggagccc

SEQ ID NO: 3690274 - RNA, 23 nt, Human
uccagcuuguggagccccacacu

SEQ ID NO: 3690275 - RNA, 17 nt, Human
uccagcuuuccuguauu

SEQ ID NO: 3690276 - RNA, 23 nt, Human
uccaggaaaaaggacaggcagaa

SEQ ID NO: 3690277 - RNA, 17 nt, Human
uccaggaaaugugcaca

SEQ ID NO: 3690278 - RNA, 20 nt, Human
uccaggaaggcggggcuuca

SEQ ID NO: 3690279 - RNA, 15 nt, Human
uccaggacccugcca

SEQ ID NO: 3690280 - RNA, 18 nt, Human
uccaggacccugccaggc

SEQ ID NO: 3690281 - RNA, 21 nt, Human
uccaggacccugccaggcaca

SEQ ID NO: 3690282 - RNA, 22 nt, Human
uccaggacccugccaggcacag

SEQ ID NO: 3690283 - RNA, 22 nt, Human
uccaggacuguuucaaacaugc

SEQ ID NO: 3690284 - RNA, 13 nt, Human
uccaggagaggag

SEQ ID NO: 3690285 - RNA, 14 nt, Human
uccaggagcagcca

SEQ ID NO: 3690286 - RNA, 18 nt, Human
uccaggagcagccacauu

SEQ ID NO: 3690287 - RNA, 22 nt, Human
uccaggagcagccacauuccug

SEQ ID NO: 3690288 - RNA, 13 nt, Human
uccaggagccugg

SEQ ID NO: 3690289 - RNA, 15 nt, Human
uccaggagccugugc

SEQ ID NO: 3690290 - RNA, 18 nt, Human
uccaggagccugugccuc

SEQ ID NO: 3690291 - RNA, 20 nt, Human
uccaggagcuccaguguccu

SEQ ID NO: 3690292 - RNA, 24 nt, Human
uccaggagcuccaguguccugagc

SEQ ID NO: 3690293 - RNA, 22 nt, Human
uccaggaugcuaacaucuaaaa

SEQ ID NO: 3690294 - RNA, 15 nt, Human
uccaggauuccucuu

SEQ ID NO: 3690295 - RNA, 19 nt, Human
uccaggauugaagagcauu

SEQ ID NO: 3690296 - RNA, 15 nt, Human
uccaggcaccaucuc

SEQ ID NO: 3690297 - RNA, 15 nt, Human
uccaggcacccuucu

SEQ ID NO: 3690298 - RNA, 11 nt, Human
uccaugaaaac

SEQ ID NO: 3690299 - RNA, 19 nt, Human
uccaugaaaacguuuuauu

SEQ ID NO: 3690300 - RNA, 12 nt, Human
uccaugaaaaug

SEQ ID NO: 3690301 - RNA, 17 nt, Human
uccaugaaagaacuuaa

SEQ ID NO: 3690302 - RNA, 23 nt, Human
uccaugaagaccacauccacaca

SEQ ID NO: 3690303 - RNA, 13 nt, Human
uccaugaagaugu

SEQ ID NO: 3690304 - RNA, 18 nt, Human
uccaugaaucgcuucucu

SEQ ID NO: 3690305 - RNA, 12 nt, Human
uccaugaaugua

SEQ ID NO: 3690306 - RNA, 13 nt, Human
uccaugaauguau

SEQ ID NO: 3690307 - RNA, 14 nt, Human
uccaugaauguauc

SEQ ID NO: 3690308 - RNA, 20 nt, Human
uccaugacaggccugaagau

SEQ ID NO: 3690309 - RNA, 15 nt, Human
uccaugacaucaaga

SEQ ID NO: 3690310 - RNA, 13 nt, Human
uccaugacugcuu

SEQ ID NO: 3690311 - RNA, 20 nt, Human
uccaugacugcuugcccuaa

SEQ ID NO: 3690312 - RNA, 16 nt, Human
uccaugaguccccugu

SEQ ID NO: 3690313 - RNA, 17 nt, Human
uccaugaguccccuguu

SEQ ID NO: 3690314 - RNA, 16 nt, Human
uccaugaugauaguug

SEQ ID NO: 3690315 - RNA, 13 nt, Human
uccaugcaccaaa

SEQ ID NO: 3690316 - RNA, 16 nt, Human
uccaugccugagggug

SEQ ID NO: 3690317 - RNA, 21 nt, Human
uccaugccugaggguggagac

SEQ ID NO: 3690318 - RNA, 21 nt, Human
uccaugcguguuucugacucu

SEQ ID NO: 3690319 - RNA, 13 nt, Human
uccaugcuccuca

SEQ ID NO: 3690320 - RNA, 15 nt, Human
uccauggaaugcuug

SEQ ID NO: 3690321 - RNA, 22 nt, Human
uccauggaaugcuugaaaaaug

SEQ ID NO: 3690322 - RNA, 20 nt, Human
uccauggcuuccuccucccu

SEQ ID NO: 3690323 - RNA, 15 nt, Human
uccaugggcagagcc

SEQ ID NO: 3690324 - RNA, 17 nt, Human
uccaugggcagagccca

SEQ ID NO: 3690325 - RNA, 23 nt, Human
uccaugggcagagcccaagggaa

SEQ ID NO: 3690326 - RNA, 20 nt, Human
uccaugggccauaugaaaag

SEQ ID NO: 3690327 - RNA, 15 nt, Human
uccauggugccucug

SEQ ID NO: 3690328 - RNA, 22 nt, Human
uccauguaacugccuagaaaca

SEQ ID NO: 3690329 - RNA, 13 nt, Human
uccauguacugua

SEQ ID NO: 3690330 - RNA, 16 nt, Human
uccauguagaagccac

SEQ ID NO: 3690331 - RNA, 19 nt, Human
uccauguagccuuuaauau

SEQ ID NO: 3690332 - RNA, 15 nt, Human
uccauguaugcauaa

SEQ ID NO: 3690333 - RNA, 20 nt, Human
uccaugucaagauucagcua

SEQ ID NO: 3690334 - RNA, 23 nt, Human
uccaugucaagauucagcuagug

SEQ ID NO: 3690335 - RNA, 23 nt, Human
uccaugucgccucugcauucagg

SEQ ID NO: 3690336 - RNA, 14 nt, Human
uccaugucggccuc

SEQ ID NO: 3690337 - RNA, 21 nt, Human
uccaugugaggguuuucagca

SEQ ID NO: 3690338 - RNA, 14 nt, Human
uccaugugcccagu

SEQ ID NO: 3690339 - RNA, 16 nt, Human
uccaugugcccaguua

SEQ ID NO: 3690340 - RNA, 19 nt, Human
uccaugugcccccucuacc

SEQ ID NO: 3690341 - RNA, 22 nt, Human
uccauguggagaaaggagugaa

SEQ ID NO: 3690342 - RNA, 13 nt, Human
uccauguuuguaa

SEQ ID NO: 3690343 - RNA, 16 nt, Human
uccauguuuguaaaac

SEQ ID NO: 3690344 - RNA, 19 nt, Human
uccauguuuguaaaacuac

SEQ ID NO: 3690345 - RNA, 20 nt, Human
uccauuaacuuagcaugugu

SEQ ID NO: 3690346 - RNA, 13 nt, Human
uccauuaauuuaa

SEQ ID NO: 3690347 - RNA, 15 nt, Human
uccauuaauuuaaau

SEQ ID NO: 3690348 - RNA, 19 nt, Human
uccauuaauuuaaaugauu

SEQ ID NO: 3690349 - RNA, 21 nt, Human
uccauuaauuuaaaugauuua

SEQ ID NO: 3690350 - RNA, 22 nt, Human
uccauuaauuuaaaugauuuaa

SEQ ID NO: 3690351 - RNA, 15 nt, Human
uccauuaggccagca

SEQ ID NO: 3690352 - RNA, 14 nt, Human
uccauuauuuauau

SEQ ID NO: 3690353 - RNA, 22 nt, Human
uccauucacaguucuuugggcc

SEQ ID NO: 3690354 - RNA, 22 nt, Human
uccauuccacacagaaugcaac

SEQ ID NO: 3690355 - RNA, 13 nt, Human
uccauuccucagg

SEQ ID NO: 3690356 - RNA, 18 nt, Human
uccauucucacagguccc

SEQ ID NO: 3690357 - RNA, 15 nt, Human
uccauucucccaggu

SEQ ID NO: 3690358 - RNA, 20 nt, Human
uccauucugcuccuucccca

SEQ ID NO: 3690359 - RNA, 13 nt, Human
uccauucuggaag

SEQ ID NO: 3690360 - RNA, 14 nt, Human
uccauucuggaagu

SEQ ID NO: 3690361 - RNA, 19 nt, Human
uccauucuuucugauaacu

SEQ ID NO: 3690362 - RNA, 21 nt, Human
uccauugaagccgacucuggc

SEQ ID NO: 3690363 - RNA, 22 nt, Human
uccauugaagccgacucuggcc

SEQ ID NO: 3690364 - RNA, 15 nt, Human
uccauugacauguac

SEQ ID NO: 3690365 - RNA, 18 nt, Human
uccauugccuagcucuuu

SEQ ID NO: 3690366 - RNA, 15 nt, Human
uccauugguccaaga

SEQ ID NO: 3690367 - RNA, 18 nt, Human
uccauugguccaagauuc

SEQ ID NO: 3690368 - RNA, 19 nt, Human
uccauugguccaagauucc

SEQ ID NO: 3690369 - RNA, 14 nt, Human
uccauugugugagu

SEQ ID NO: 3690370 - RNA, 14 nt, Human
uccauuguuugaaa

SEQ ID NO: 3690371 - RNA, 23 nt, Human
uccauuuaauggggugcaccugu

SEQ ID NO: 3690372 - RNA, 22 nt, Human
uccauuuacaaacuacuugauu

SEQ ID NO: 3690373 - RNA, 17 nt, Human
uccauuuacuuaagacu

SEQ ID NO: 3690374 - RNA, 19 nt, Human
uccauuuacuuaagacuua

SEQ ID NO: 3690375 - RNA, 14 nt, Human
uccauuuauauaug

SEQ ID NO: 3690376 - RNA, 19 nt, Human
uccauuuauauaugaaaac

SEQ ID NO: 3690377 - RNA, 14 nt, Human
uccauuucacuggc

SEQ ID NO: 3690378 - RNA, 23 nt, Human
uccauuucaucuauuucugagaa

SEQ ID NO: 3690379 - RNA, 14 nt, Human
uccauuucuaauua

SEQ ID NO: 3690380 - RNA, 12 nt, Human
uccauuucucuc

SEQ ID NO: 3690381 - RNA, 12 nt, Human
uccauuugagaa

SEQ ID NO: 3690382 - RNA, 13 nt, Human
uccauuugagaaa

SEQ ID NO: 3690383 - RNA, 12 nt, Human
uccauuugagga

SEQ ID NO: 3690384 - RNA, 16 nt, Human
uccauuugcauuuguu

SEQ ID NO: 3690385 - RNA, 20 nt, Human
uccauuuggaaaucuuuaaa

SEQ ID NO: 3690386 - RNA, 13 nt, Human
uccauuuguaauu

SEQ ID NO: 3690387 - RNA, 21 nt, Human
uccauuuguaauuaaauuaug

SEQ ID NO: 3690388 - RNA, 19 nt, Human
uccauuuguuaucugggaa

SEQ ID NO: 3690389 - RNA, 17 nt, Human
uccauuuucccccacua

SEQ ID NO: 3690390 - RNA, 20 nt, Human
uccauuuuggugucuuucuc

SEQ ID NO: 3690391 - RNA, 22 nt, Human
uccauuuuggugucuuucucuu

SEQ ID NO: 3690392 - RNA, 14 nt, Human
uccauuuugugaag

SEQ ID NO: 3690393 - RNA, 15 nt, Human
uccauuuugugaagc

SEQ ID NO: 3690394 - RNA, 19 nt, Human
uccauuuugugaagcccug

SEQ ID NO: 3690395 - RNA, 14 nt, Human
ucccaaaaaacuac

SEQ ID NO: 3690396 - RNA, 22 nt, Human
ucccaaaauuguuuugagcuuu

SEQ ID NO: 3690397 - RNA, 13 nt, Human
ucccaaagagcug

SEQ ID NO: 3690398 - RNA, 15 nt, Human
ucccaaagagcugcc

SEQ ID NO: 3690399 - RNA, 16 nt, Human
ucccaaagagcugccu

SEQ ID NO: 3690400 - RNA, 18 nt, Human
ucccaaagcagugcaugc

SEQ ID NO: 3690401 - RNA, 21 nt, Human
ucccaaagcagugcaugcugu

SEQ ID NO: 3690402 - RNA, 22 nt, Human
ucccaaagccuugugucuacag

SEQ ID NO: 3690403 - RNA, 23 nt, Human
ucccaaagugcugagauuacagg

SEQ ID NO: 3690404 - RNA, 16 nt, Human
ucccaaagugcuggga

SEQ ID NO: 3690405 - RNA, 17 nt, Human
ucccaaauuugauugau

SEQ ID NO: 3690406 - RNA, 19 nt, Human
ucccaaauuugauugauuu

SEQ ID NO: 3690407 - RNA, 21 nt, Human
ucccaacacaaggugggcagg

SEQ ID NO: 3690408 - RNA, 19 nt, Human
ucccaacaggaggacaauu

SEQ ID NO: 3690409 - RNA, 21 nt, Human
ucccaacaggaggacaauuca

SEQ ID NO: 3690410 - RNA, 22 nt, Human
ucccaacaggaggacaauucau

SEQ ID NO: 3690411 - RNA, 15 nt, Human
ucccaaccaggcacc

SEQ ID NO: 3690412 - RNA, 17 nt, Human
ucccaaccagugccaag

SEQ ID NO: 3690413 - RNA, 18 nt, Human
ucccaaccagugccaagg

SEQ ID NO: 3690414 - RNA, 15 nt, Human
ucccaacucacccca

SEQ ID NO: 3690415 - RNA, 17 nt, Human
ucccaacuccuauaauu

SEQ ID NO: 3690416 - RNA, 14 nt, Human
ucccaacucuagcu

SEQ ID NO: 3690417 - RNA, 16 nt, Human
ucccaacucuagcugg

SEQ ID NO: 3690418 - RNA, 17 nt, Human
ucccaagaacagcaggc

SEQ ID NO: 3690419 - RNA, 18 nt, Human
ucccaagaacagcaggcc

SEQ ID NO: 3690420 - RNA, 20 nt, Human
ucccaagaaugcaagauuuc

SEQ ID NO: 3690421 - RNA, 22 nt, Human
ucccaagagcaucaugccucug

SEQ ID NO: 3690422 - RNA, 21 nt, Human
ucccaagcaccugggauuaca

SEQ ID NO: 3690423 - RNA, 13 nt, Human
ucccaagccuccu

SEQ ID NO: 3690424 - RNA, 13 nt, Human
ucccaagcucugc

SEQ ID NO: 3690425 - RNA, 17 nt, Human
ucccaagcucugcuccu

SEQ ID NO: 3690426 - RNA, 12 nt, Human
ucccaagcugga

SEQ ID NO: 3690427 - RNA, 14 nt, Human
ucccaagcugggcc

SEQ ID NO: 3690428 - RNA, 19 nt, Human
ucccaagcugggccccagc

SEQ ID NO: 3690429 - RNA, 13 nt, Human
ucccaaggaaagc

SEQ ID NO: 3690430 - RNA, 18 nt, Human
ucccaaggagaacaaaua

SEQ ID NO: 3690431 - RNA, 19 nt, Human
ucccaaggagaacaaauau

SEQ ID NO: 3690432 - RNA, 18 nt, Human
ucccaaggcucugagcaa

SEQ ID NO: 3690433 - RNA, 21 nt, Human
ucccaagggauggugcccugu

SEQ ID NO: 3690434 - RNA, 15 nt, Human
ucccaagggcugccg

SEQ ID NO: 3690435 - RNA, 17 nt, Human
ucccaaggggccugagc

SEQ ID NO: 3690436 - RNA, 20 nt, Human
ucccaagguuggagcccagg

SEQ ID NO: 3690437 - RNA, 19 nt, Human
ucccaaguagaaucucagu

SEQ ID NO: 3690438 - RNA, 15 nt, Human
ucccaagucuacaga

SEQ ID NO: 3690439 - RNA, 13 nt, Human
ucccaagugccaa

SEQ ID NO: 3690440 - RNA, 23 nt, Human
ucccaagugccaaagaagcagac

SEQ ID NO: 3690441 - RNA, 12 nt, Human
ucccaaguggug

SEQ ID NO: 3690442 - RNA, 18 nt, Human
ucccaaguggugccuaaa

SEQ ID NO: 3690443 - RNA, 16 nt, Human
ucccaaguugugcuug

SEQ ID NO: 3690444 - RNA, 18 nt, Human
ucccaauagcacuuucau

SEQ ID NO: 3690445 - RNA, 20 nt, Human
ucccaauagcacuuucauug

SEQ ID NO: 3690446 - RNA, 17 nt, Human
ucccaauaggcagacug

SEQ ID NO: 3690447 - RNA, 13 nt, Human
ucccaaucagcac

SEQ ID NO: 3690448 - RNA, 18 nt, Human
ucccaaucagcacugaaa

SEQ ID NO: 3690449 - RNA, 14 nt, Human
ucccaaugcacauc

SEQ ID NO: 3690450 - RNA, 14 nt, Human
ucccaaugguguuu

SEQ ID NO: 3690451 - RNA, 16 nt, Human
ucccaaugguguuuuu

SEQ ID NO: 3690452 - RNA, 18 nt, Human
ucccaauuucagacuccc

SEQ ID NO: 3690453 - RNA, 16 nt, Human
ucccacaaaggagagc

SEQ ID NO: 3690454 - RNA, 14 nt, Human
ucccacaagccuga

SEQ ID NO: 3690455 - RNA, 15 nt, Human
ucccacaagccugag

SEQ ID NO: 3690456 - RNA, 16 nt, Human
ucccacaagccugagg

SEQ ID NO: 3690457 - RNA, 14 nt, Human
ucccacaaguggug

SEQ ID NO: 3690458 - RNA, 16 nt, Human
ucccacaagugguggu

SEQ ID NO: 3690459 - RNA, 22 nt, Human
ucccacaaucuuaaggggcagc

SEQ ID NO: 3690460 - RNA, 23 nt, Human
ucccacaaucuuaaggggcagcu

SEQ ID NO: 3690461 - RNA, 11 nt, Human
ucccacacagg

SEQ ID NO: 3690462 - RNA, 12 nt, Human
ucccacacccaa

SEQ ID NO: 3690463 - RNA, 13 nt, Human
ucccacaccccaa

SEQ ID NO: 3690464 - RNA, 18 nt, Human
ucccacaccguguaaacc

SEQ ID NO: 3690465 - RNA, 16 nt, Human
ucccacaccuccacag

SEQ ID NO: 3690466 - RNA, 18 nt, Human
ucccacaccuccacaguu

SEQ ID NO: 3690467 - RNA, 15 nt, Human
ucccacaggcccuuc

SEQ ID NO: 3690468 - RNA, 17 nt, Human
ucccacaggcccuuccu

SEQ ID NO: 3690469 - RNA, 22 nt, Human
ucccacaggcccuuccucucca

SEQ ID NO: 3690470 - RNA, 21 nt, Human
ucccacagugcugggauuaca

SEQ ID NO: 3690471 - RNA, 13 nt, Human
ucccacaucccug

SEQ ID NO: 3690472 - RNA, 14 nt, Human
ucccacaucccugg

SEQ ID NO: 3690473 - RNA, 15 nt, Human
ucccacaucccuggg

SEQ ID NO: 3690474 - RNA, 17 nt, Human
ucccacaucccugggcc

SEQ ID NO: 3690475 - RNA, 18 nt, Human
ucccacaucccugggccu

SEQ ID NO: 3690476 - RNA, 22 nt, Human
ucccacaucccugggccugcug

SEQ ID NO: 3690477 - RNA, 19 nt, Human
ucccacaugggcccaggcc

SEQ ID NO: 3690478 - RNA, 22 nt, Human
ucccacaugggcccaggccuca

SEQ ID NO: 3690479 - RNA, 15 nt, Human
ucccacauuaaagaa

SEQ ID NO: 3690480 - RNA, 19 nt, Human
ucccacauuaaagaagacc

SEQ ID NO: 3690481 - RNA, 17 nt, Human
ucccaccacagcaggug

SEQ ID NO: 3690482 - RNA, 22 nt, Human
ucccaccaggcugcucagggcu

SEQ ID NO: 3690483 - RNA, 19 nt, Human
ucccacccaccgccacaau

SEQ ID NO: 3690484 - RNA, 15 nt, Human
ucccacccagccugg

SEQ ID NO: 3690485 - RNA, 20 nt, Human
ucccaccccaaccugcucuc

SEQ ID NO: 3690486 - RNA, 21 nt, Human
ucccaccccaaccugcucucc

SEQ ID NO: 3690487 - RNA, 23 nt, Human
ucccaccccaaccugcucuccuc

SEQ ID NO: 3690488 - RNA, 11 nt, Human
ucccaccccac

SEQ ID NO: 3690489 - RNA, 15 nt, Human
ucccaccccacacac

SEQ ID NO: 3690490 - RNA, 15 nt, Human
ucccaccccauccuc

SEQ ID NO: 3690491 - RNA, 18 nt, Human
ucccaccccauccuccag

SEQ ID NO: 3690492 - RNA, 20 nt, Human
ucccaccccauuuucugugg

SEQ ID NO: 3690493 - RNA, 18 nt, Human
ucccacccccacccccag

SEQ ID NO: 3690494 - RNA, 13 nt, Human
ucccacccccagc

SEQ ID NO: 3690495 - RNA, 14 nt, Human
ucccacccccagcc

SEQ ID NO: 3690496 - RNA, 17 nt, Human
ucccacccccagccccg

SEQ ID NO: 3690497 - RNA, 19 nt, Human
ucccacccccuucucugcu

SEQ ID NO: 3690498 - RNA, 20 nt, Human
ucccacccccuucucugcuc

SEQ ID NO: 3690499 - RNA, 19 nt, Human
ucccaccccucccucuguc

SEQ ID NO: 3690500 - RNA, 16 nt, Human
ucccacccgaugcugc

SEQ ID NO: 3690501 - RNA, 20 nt, Human
ucccacccuguaccucaucc

SEQ ID NO: 3690502 - RNA, 18 nt, Human
ucccaccgguugcuucug

SEQ ID NO: 3690503 - RNA, 17 nt, Human
ucccaccuccagcccgg

SEQ ID NO: 3690504 - RNA, 23 nt, Human
ucccaccugacacaccaggcgcu

SEQ ID NO: 3690505 - RNA, 20 nt, Human
ucccaccugcaucuggggcc

SEQ ID NO: 3690506 - RNA, 13 nt, Human
ucccaccuuggcu

SEQ ID NO: 3690507 - RNA, 19 nt, Human
ucccaccuuggcugcaggg

SEQ ID NO: 3690508 - RNA, 21 nt, Human
ucccaccuuggcugcagggag

SEQ ID NO: 3690509 - RNA, 20 nt, Human
ucccaccuuucgggccaugu

SEQ ID NO: 3690510 - RNA, 20 nt, Human
ucccacggaaaaugccaauc

SEQ ID NO: 3690511 - RNA, 18 nt, Human
ucccacgggaccuggggc

SEQ ID NO: 3690512 - RNA, 15 nt, Human
ucccacgugucuucc

SEQ ID NO: 3690513 - RNA, 15 nt, Human
ucccacuaucugggu

SEQ ID NO: 3690514 - RNA, 20 nt, Human
ucccacuaucugggugcaug

SEQ ID NO: 3690515 - RNA, 13 nt, Human
ucccacucacccc

SEQ ID NO: 3690516 - RNA, 14 nt, Human
ucccacuccaagcc

SEQ ID NO: 3690517 - RNA, 18 nt, Human
ucccacuccaagccagca

SEQ ID NO: 3690518 - RNA, 16 nt, Human
ucccacucuccuaggc

SEQ ID NO: 3690519 - RNA, 13 nt, Human
ucccacucuucuc

SEQ ID NO: 3690520 - RNA, 20 nt, Human
ucccacugcacccccuccug

SEQ ID NO: 3690521 - RNA, 16 nt, Human
ucccacugccucaggu

SEQ ID NO: 3690522 - RNA, 22 nt, Human
ucccacugggguccagggagca

SEQ ID NO: 3690523 - RNA, 18 nt, Human
ucccacuuaaaaauuaaa

SEQ ID NO: 3690524 - RNA, 17 nt, Human
ucccacuucaaaacaaa

SEQ ID NO: 3690525 - RNA, 16 nt, Human
ucccacuucccacccu

SEQ ID NO: 3690526 - RNA, 15 nt, Human
ucccacuugccccug

SEQ ID NO: 3690527 - RNA, 17 nt, Human
ucccacuuggaggccuu

SEQ ID NO: 3690528 - RNA, 19 nt, Human
ucccagaaaaaguaacuca

SEQ ID NO: 3690529 - RNA, 20 nt, Human
ucccagaacacacuccauca

SEQ ID NO: 3690530 - RNA, 18 nt, Human
ucccagaaucaaagcaau

SEQ ID NO: 3690531 - RNA, 16 nt, Human
ucccagaaucccagcc

SEQ ID NO: 3690532 - RNA, 20 nt, Human
ucccagacuacuauuuucuu

SEQ ID NO: 3690533 - RNA, 13 nt, Human
ucccagacuugcu

SEQ ID NO: 3690534 - RNA, 19 nt, Human
ucccagagcaccugcuguc

SEQ ID NO: 3690535 - RNA, 22 nt, Human
ucccagagcugguggacccagg

SEQ ID NO: 3690536 - RNA, 20 nt, Human
ucccagaggagccaccaguu

SEQ ID NO: 3690537 - RNA, 16 nt, Human
ucccagaggcugcccc

SEQ ID NO: 3690538 - RNA, 17 nt, Human
ucccagagguccagccc

SEQ ID NO: 3690539 - RNA, 18 nt, Human
ucccagagguccagccca

SEQ ID NO: 3690540 - RNA, 22 nt, Human
ucccagagguccagcccaucuc

SEQ ID NO: 3690541 - RNA, 16 nt, Human
ucccagauaaugugaa

SEQ ID NO: 3690542 - RNA, 18 nt, Human
ucccagauacuugggggg

SEQ ID NO: 3690543 - RNA, 18 nt, Human
ucccagauuggcucacac

SEQ ID NO: 3690544 - RNA, 19 nt, Human
ucccagauuggcucacacu

SEQ ID NO: 3690545 - RNA, 22 nt, Human
ucccagauuggcucacacugag

SEQ ID NO: 3690546 - RNA, 23 nt, Human
ucccagauuggcucacacugaga

SEQ ID NO: 3690547 - RNA, 19 nt, Human
ucccagcacuuugggaggc

SEQ ID NO: 3690548 - RNA, 18 nt, Human
ucccagcagcccuaagga

SEQ ID NO: 3690549 - RNA, 21 nt, Human
ucccagcagcccuaaggaucu

SEQ ID NO: 3690550 - RNA, 20 nt, Human
ucccagcaugcugagauuac

SEQ ID NO: 3690551 - RNA, 17 nt, Human
ucccagccagcaguuca

SEQ ID NO: 3690552 - RNA, 16 nt, Human
ucccagcccaauccag

SEQ ID NO: 3690553 - RNA, 15 nt, Human
ucccagcccccugac

SEQ ID NO: 3690554 - RNA, 21 nt, Human
ucccagccuuggcaucuagag

SEQ ID NO: 3690555 - RNA, 22 nt, Human
ucccagcggcuggugcagggcc

SEQ ID NO: 3690556 - RNA, 17 nt, Human
ucccagcuacucaggag

SEQ ID NO: 3690557 - RNA, 17 nt, Human
ucccagcuacuugggaa

SEQ ID NO: 3690558 - RNA, 17 nt, Human
ucccagcucuacccugc

SEQ ID NO: 3690559 - RNA, 19 nt, Human
ucccagcucuacccugcau

SEQ ID NO: 3690560 - RNA, 23 nt, Human
ucccagcucucccucuggcccug

SEQ ID NO: 3690561 - RNA, 18 nt, Human
ucccagcugacaguccuc

SEQ ID NO: 3690562 - RNA, 20 nt, Human
ucccagcugacaguccucuc

SEQ ID NO: 3690563 - RNA, 22 nt, Human
ucccagcugacaguccucucca

SEQ ID NO: 3690564 - RNA, 13 nt, Human
ucccagcugcccc

SEQ ID NO: 3690565 - RNA, 14 nt, Human
ucccagcugccccu

SEQ ID NO: 3690566 - RNA, 16 nt, Human
ucccagcugccccucc

SEQ ID NO: 3690567 - RNA, 17 nt, Human
ucccagcugccccuccc

SEQ ID NO: 3690568 - RNA, 22 nt, Human
ucccagcugccccucccugcca

SEQ ID NO: 3690569 - RNA, 17 nt, Human
ucccagcugugcucugg

SEQ ID NO: 3690570 - RNA, 20 nt, Human
ucccagcugugcucuggaca

SEQ ID NO: 3690571 - RNA, 20 nt, Human
ucccaggaaagaagcauuuc

SEQ ID NO: 3690572 - RNA, 23 nt, Human
ucccaggaacaaucgauggccuu

SEQ ID NO: 3690573 - RNA, 11 nt, Human
ucccaggaacu

SEQ ID NO: 3690574 - RNA, 16 nt, Human
ucccaggaacugggcc

SEQ ID NO: 3690575 - RNA, 23 nt, Human
ucccaggacaccacacccagccu

SEQ ID NO: 3690576 - RNA, 24 nt, Human
ucccaggaccacaggcucaggcag

SEQ ID NO: 3690577 - RNA, 19 nt, Human
ucccaggacccugaagggg

SEQ ID NO: 3690578 - RNA, 19 nt, Human
ucccaggacccuggaccca

SEQ ID NO: 3690579 - RNA, 13 nt, Human
ucccaggagccug

SEQ ID NO: 3690580 - RNA, 22 nt, Human
ucccaggaugagcaucccagga

SEQ ID NO: 3690581 - RNA, 18 nt, Human
ucccaggaugcugggugg

SEQ ID NO: 3690582 - RNA, 18 nt, Human
ucccaggcaaauaaaauu

SEQ ID NO: 3690583 - RNA, 17 nt, Human
ucccaggcaaggcugug

SEQ ID NO: 3690584 - RNA, 15 nt, Human
ucccaggccaggcuc

SEQ ID NO: 3690585 - RNA, 18 nt, Human
ucccaggccaguaaggga

SEQ ID NO: 3690586 - RNA, 17 nt, Human
ucccaggccccuggagg

SEQ ID NO: 3690587 - RNA, 19 nt, Human
ucccaggccccuggaggcu

SEQ ID NO: 3690588 - RNA, 16 nt, Human
ucccaggcgccccuuc

SEQ ID NO: 3690589 - RNA, 20 nt, Human
ucccaggcgccccuuccccc

SEQ ID NO: 3690590 - RNA, 21 nt, Human
ucccaggcucucaacagggga

SEQ ID NO: 3690591 - RNA, 16 nt, Human
ucccaggcugagccuc

SEQ ID NO: 3690592 - RNA, 15 nt, Human
ucccaggcuucaccc

SEQ ID NO: 3690593 - RNA, 18 nt, Human
ucccagggaagugcucug

SEQ ID NO: 3690594 - RNA, 22 nt, Human
ucccagggccagggcccugcag

SEQ ID NO: 3690595 - RNA, 23 nt, Human
ucccagggccagggcccugcaga

SEQ ID NO: 3690596 - RNA, 20 nt, Human
uaagccacuuaaaauguuca

SEQ ID NO: 3690597 - RNA, 14 nt, Human
uaagccacuugaaa

SEQ ID NO: 3690598 - RNA, 13 nt, Human
uaagccagacauc

SEQ ID NO: 3690599 - RNA, 15 nt, Human
uaagccagcugcccc

SEQ ID NO: 3690600 - RNA, 13 nt, Human
uaagccaugagaa

SEQ ID NO: 3690601 - RNA, 17 nt, Human
uaagccaugagaauguu

SEQ ID NO: 3690602 - RNA, 13 nt, Human
uaagcccuggcag

SEQ ID NO: 3690603 - RNA, 13 nt, Human
uaagcccuggccc

SEQ ID NO: 3690604 - RNA, 16 nt, Human
uaagcccugucgagac

SEQ ID NO: 3690605 - RNA, 18 nt, Human
uaagccucaaauuugaac

SEQ ID NO: 3690606 - RNA, 16 nt, Human
uaagccucauauuuaa

SEQ ID NO: 3690607 - RNA, 17 nt, Human
uaagccucauauuuaaa

SEQ ID NO: 3690608 - RNA, 20 nt, Human
uaagccucauauuuaaagac

SEQ ID NO: 3690609 - RNA, 14 nt, Human
uaagccuccauuua

SEQ ID NO: 3690610 - RNA, 17 nt, Human
uaagccuccauuuaguu

SEQ ID NO: 3690611 - RNA, 20 nt, Human
uaagccuccauuuaguucuu

SEQ ID NO: 3690612 - RNA, 14 nt, Human
uaagccuguggcug

SEQ ID NO: 3690613 - RNA, 17 nt, Human
uaagccuuuggaaacag

SEQ ID NO: 3690614 - RNA, 21 nt, Human
uaagccuuuguugaacuguua

SEQ ID NO: 3690615 - RNA, 20 nt, Human
uaagccuuuuauacugauua

SEQ ID NO: 3690616 - RNA, 23 nt, Human
uaagcgaauguguacaaagugua

SEQ ID NO: 3690617 - RNA, 22 nt, Human
uaagcgcuagaggaagcagcca

SEQ ID NO: 3690618 - RNA, 20 nt, Human
uaagcggcucaagcccagga

SEQ ID NO: 3690619 - RNA, 15 nt, Human
uaagcguauggcuuu

SEQ ID NO: 3690620 - RNA, 16 nt, Human
uaagcguauggcuuua

SEQ ID NO: 3690621 - RNA, 22 nt, Human
uaagcguauggcuuuauuuuuu

SEQ ID NO: 3690622 - RNA, 18 nt, Human
uaagcuagaagaagugag

SEQ ID NO: 3690623 - RNA, 20 nt, Human
uaagcuaggaaaagaaaucu

SEQ ID NO: 3690624 - RNA, 14 nt, Human
uaagcuauucagua

SEQ ID NO: 3690625 - RNA, 21 nt, Human
uaagcuauucaguaauaacuc

SEQ ID NO: 3690626 - RNA, 15 nt, Human
uaagcuauuugaugu

SEQ ID NO: 3690627 - RNA, 22 nt, Human
uaagcuauuugauguaauacuu

SEQ ID NO: 3690628 - RNA, 17 nt, Human
uaagcuauuuuucuaac

SEQ ID NO: 3690629 - RNA, 15 nt, Human
uaagcucagaaucca

SEQ ID NO: 3690630 - RNA, 22 nt, Human
uaagcucccagggccugucuca

SEQ ID NO: 3690631 - RNA, 10 nt, Human
uaagcucuga

SEQ ID NO: 3690632 - RNA, 12 nt, Human
uaagcucugagc

SEQ ID NO: 3690633 - RNA, 13 nt, Human
uaagcucuggcuu

SEQ ID NO: 3690634 - RNA, 10 nt, Human
uaagcugcaa

SEQ ID NO: 3690635 - RNA, 15 nt, Human
uaagcuguaaaaaga

SEQ ID NO: 3690636 - RNA, 22 nt, Human
uaagcuguuccuguucaguaau

SEQ ID NO: 3690637 - RNA, 21 nt, Human
uaagcuguuuauuuuauauua

SEQ ID NO: 3690638 - RNA, 22 nt, Human
uaagcuguuugguuuuaaaaua

SEQ ID NO: 3690639 - RNA, 16 nt, Human
uaagcuuaugucagac

SEQ ID NO: 3690640 - RNA, 22 nt, Human
uaagcuuccaggcugcauagaa

SEQ ID NO: 3690641 - RNA, 19 nt, Human
uaagcuuugccagcugcug

SEQ ID NO: 3690642 - RNA, 22 nt, Human
uaagcuuugccagcugcugcug

SEQ ID NO: 3690643 - RNA, 21 nt, Human
uaagcuuuggacccaaggaaa

SEQ ID NO: 3690644 - RNA, 13 nt, Human
uaagcuuuuugga

SEQ ID NO: 3690645 - RNA, 21 nt, Human
uaaggaaaaguuuaauauuaa

SEQ ID NO: 3690646 - RNA, 11 nt, Human
uaaggaaacaa

SEQ ID NO: 3690647 - RNA, 15 nt, Human
uaaggaaacucuuau

SEQ ID NO: 3690648 - RNA, 20 nt, Human
uaaggaaacucuuaucucag

SEQ ID NO: 3690649 - RNA, 16 nt, Human
uaaggaaagcaauaaa

SEQ ID NO: 3690650 - RNA, 21 nt, Human
uaaggaaagcaauaaaugaau

SEQ ID NO: 3690651 - RNA, 19 nt, Human
uaaggaaaucaacuugcuu

SEQ ID NO: 3690652 - RNA, 20 nt, Human
uaaggaaaucaacuugcuua

SEQ ID NO: 3690653 - RNA, 15 nt, Human
uaaggaaccuuccuu

SEQ ID NO: 3690654 - RNA, 13 nt, Human
uaaggaagaaaaa

SEQ ID NO: 3690655 - RNA, 14 nt, Human
uaaggaagaaaaau

SEQ ID NO: 3690656 - RNA, 20 nt, Human
uaaggaauaugggagaaaua

SEQ ID NO: 3690657 - RNA, 19 nt, Human
uaaggaaucuuucugcuuu

SEQ ID NO: 3690658 - RNA, 14 nt, Human
uaaggacacacuaa

SEQ ID NO: 3690659 - RNA, 14 nt, Human
uaaggacaggcagg

SEQ ID NO: 3690660 - RNA, 21 nt, Human
uaaggaccguggcccugcccu

SEQ ID NO: 3690661 - RNA, 15 nt, Human
uaaggaccugaaauu

SEQ ID NO: 3690662 - RNA, 16 nt, Human
uaaggaccuuaagaca

SEQ ID NO: 3690663 - RNA, 18 nt, Human
uaaggacugacugaggca

SEQ ID NO: 3690664 - RNA, 14 nt, Human
uaaggacugcaugg

SEQ ID NO: 3690665 - RNA, 21 nt, Human
uaaggacugcaugguaauuua

SEQ ID NO: 3690666 - RNA, 14 nt, Human
uaaggacuuccuga

SEQ ID NO: 3690667 - RNA, 15 nt, Human
uaaggacuucuuuaa

SEQ ID NO: 3690668 - RNA, 15 nt, Human
uaaggacuuguuaga

SEQ ID NO: 3690669 - RNA, 22 nt, Human
uaaggagaaucauguuucuuug

SEQ ID NO: 3690670 - RNA, 22 nt, Human
uaaggaggggaaaaaaauguug

SEQ ID NO: 3690671 - RNA, 22 nt, Human
uaaggauaaaucauaaagucag

SEQ ID NO: 3690672 - RNA, 16 nt, Human
uaaggauacaggcugg

SEQ ID NO: 3690673 - RNA, 18 nt, Human
uaaggauccggaaagaag

SEQ ID NO: 3690674 - RNA, 16 nt, Human
uaaggaucucucagga

SEQ ID NO: 3690675 - RNA, 20 nt, Human
uaaggaugcuuguacauaau

SEQ ID NO: 3690676 - RNA, 13 nt, Human
uaaggauguagcu

SEQ ID NO: 3690677 - RNA, 22 nt, Human
uaaggauguagcuuuucaccuu

SEQ ID NO: 3690678 - RNA, 17 nt, Human
uaaggaugucacagggc

SEQ ID NO: 3690679 - RNA, 20 nt, Human
uaaggaugucacagggccaa

SEQ ID NO: 3690680 - RNA, 16 nt, Human
uaaggauguucuagca

SEQ ID NO: 3690681 - RNA, 17 nt, Human
uaaggauuuuaugcuuu

SEQ ID NO: 3690682 - RNA, 19 nt, Human
uaaggauuuuaugcuuuaa

SEQ ID NO: 3690683 - RNA, 22 nt, Human
uaaggauuuuaugcuuuaaaca

SEQ ID NO: 3690684 - RNA, 17 nt, Human
uaaggauuuuucucuua

SEQ ID NO: 3690685 - RNA, 20 nt, Human
uaaggcaacaaaagaagccc

SEQ ID NO: 3690686 - RNA, 17 nt, Human
uaaggcguggagcugcc

SEQ ID NO: 3690687 - RNA, 19 nt, Human
uaaggcucuaugagucuag

SEQ ID NO: 3690688 - RNA, 15 nt, Human
uaaggcucugagagu

SEQ ID NO: 3690689 - RNA, 11 nt, Human
uaagggaaaaa

SEQ ID NO: 3690690 - RNA, 17 nt, Human
uaagggaaaaauauaua

SEQ ID NO: 3690691 - RNA, 17 nt, Human
uaagggaaaagggaaca

SEQ ID NO: 3690692 - RNA, 14 nt, Human
uaagggaaauagaa

SEQ ID NO: 3690693 - RNA, 19 nt, Human
uaagggaagacauuucuuu

SEQ ID NO: 3690694 - RNA, 22 nt, Human
uaagggaaguaguuaucauguu

SEQ ID NO: 3690695 - RNA, 17 nt, Human
uaagggacugauguuug

SEQ ID NO: 3690696 - RNA, 18 nt, Human
uaagggacugauguuugu

SEQ ID NO: 3690697 - RNA, 14 nt, Human
uaagggagaaaaaa

SEQ ID NO: 3690698 - RNA, 13 nt, Human
uaagggcagaguc

SEQ ID NO: 3690699 - RNA, 15 nt, Human
uaagggcaugccuug

SEQ ID NO: 3690700 - RNA, 16 nt, Human
uaagggcccaggucag

SEQ ID NO: 3690701 - RNA, 22 nt, Human
uaagggcuggucucugcugaag

SEQ ID NO: 3690702 - RNA, 16 nt, Human
uaaggggaagaaugaa

SEQ ID NO: 3690703 - RNA, 22 nt, Human
uaaggggaauuaacaauugcca

SEQ ID NO: 3690704 - RNA, 13 nt, Human
uaagggguggggc

SEQ ID NO: 3690705 - RNA, 23 nt, Human
uaagggguuugccauuugauacc

SEQ ID NO: 3690706 - RNA, 16 nt, Human
uaagggugacaaaugg

SEQ ID NO: 3690707 - RNA, 20 nt, Human
uaaggguuaguuuacaauca

SEQ ID NO: 3690708 - RNA, 13 nt, Human
uaaggguuuuaga

SEQ ID NO: 3690709 - RNA, 19 nt, Human
uaagguacaagaagcauuu

SEQ ID NO: 3690710 - RNA, 17 nt, Human
uaagguccgguguucua

SEQ ID NO: 3690711 - RNA, 21 nt, Human
uaagguccgguguucuaagau

SEQ ID NO: 3690712 - RNA, 16 nt, Human
uaagguccugaaagua

SEQ ID NO: 3690713 - RNA, 13 nt, Human
uaaggucuguuug

SEQ ID NO: 3690714 - RNA, 19 nt, Human
uaaggugaaggugaaucua

SEQ ID NO: 3690715 - RNA, 15 nt, Human
uaaggugaggccugu

SEQ ID NO: 3690716 - RNA, 18 nt, Human
uaaggugauauauuuaaa

SEQ ID NO: 3690717 - RNA, 13 nt, Human
uaagguguagcca

SEQ ID NO: 3690718 - RNA, 16 nt, Human
uaagguguuugaaaau

SEQ ID NO: 3690719 - RNA, 18 nt, Human
uaagguguuugaaaauag

SEQ ID NO: 3690720 - RNA, 17 nt, Human
uaagguguuuucugugu

SEQ ID NO: 3690721 - RNA, 18 nt, Human
uaagguguuuucugugua

SEQ ID NO: 3690722 - RNA, 19 nt, Human
uaaguaaaaccacagcagu

SEQ ID NO: 3690723 - RNA, 14 nt, Human
uaaguaaacuaaug

SEQ ID NO: 3690724 - RNA, 13 nt, Human
uaaguaaacugcc

SEQ ID NO: 3690725 - RNA, 12 nt, Human
uaaguaaaguga

SEQ ID NO: 3690726 - RNA, 16 nt, Human
uaaguaaauacaauuu

SEQ ID NO: 3690727 - RNA, 16 nt, Human
uaaguaaaucucuucu

SEQ ID NO: 3690728 - RNA, 12 nt, Human
uaaguaagaaaa

SEQ ID NO: 3690729 - RNA, 14 nt, Human
uaaguaaucaauaa

SEQ ID NO: 3690730 - RNA, 18 nt, Human
uaaguaaucaauaaagaa

SEQ ID NO: 3690731 - RNA, 19 nt, Human
uaaguaaugauaacuggaa

SEQ ID NO: 3690732 - RNA, 15 nt, Human
uaaguaauguggaag

SEQ ID NO: 3690733 - RNA, 21 nt, Human
uaaguaauuaucgggaacagu

SEQ ID NO: 3690734 - RNA, 12 nt, Human
uaaguaauuaug

SEQ ID NO: 3690735 - RNA, 18 nt, Human
uaaguacacaauaagcaa

SEQ ID NO: 3690736 - RNA, 15 nt, Human
uuacaggcaccgaga

SEQ ID NO: 3690737 - RNA, 24 nt, Human
uuacaggcgugagccaccgugccu

SEQ ID NO: 3690738 - RNA, 17 nt, Human
uuacagggagccuccug

SEQ ID NO: 3690739 - RNA, 20 nt, Human
uuacagggagccuccugccc

SEQ ID NO: 3690740 - RNA, 13 nt, Human
uuacaggugauua

SEQ ID NO: 3690741 - RNA, 16 nt, Human
uuacaguaaauaaauu

SEQ ID NO: 3690742 - RNA, 17 nt, Human
uuacaguaaauaaauug

SEQ ID NO: 3690743 - RNA, 22 nt, Human
uuacaguaaauaaauuguuuga

SEQ ID NO: 3690744 - RNA, 18 nt, Human
uuacaguaaugucauaaa

SEQ ID NO: 3690745 - RNA, 16 nt, Human
uuacaguauaauuaac

SEQ ID NO: 3690746 - RNA, 19 nt, Human
uuacaguauaauuaacaug

SEQ ID NO: 3690747 - RNA, 19 nt, Human
uuacaguccaaaauacugu

SEQ ID NO: 3690748 - RNA, 16 nt, Human
uuacaguccuucaaaa

SEQ ID NO: 3690749 - RNA, 15 nt, Human
uuacagucuauuuga

SEQ ID NO: 3690750 - RNA, 17 nt, Human
uuacagugaaaauguaa

SEQ ID NO: 3690751 - RNA, 17 nt, Human
uuacagugccuaaaaua

SEQ ID NO: 3690752 - RNA, 13 nt, Human
uuacaguguuccg

SEQ ID NO: 3690753 - RNA, 19 nt, Human
uuacaguuacuuuuccuug

SEQ ID NO: 3690754 - RNA, 22 nt, Human
uuacaguucugugguuucaugu

SEQ ID NO: 3690755 - RNA, 14 nt, Human
uuacauaaacauca

SEQ ID NO: 3690756 - RNA, 14 nt, Human
uuacauaaauaaau

SEQ ID NO: 3690757 - RNA, 20 nt, Human
uuacauaagauaaaugugcu

SEQ ID NO: 3690758 - RNA, 21 nt, Human
uuacauaaucuguacaaugaa

SEQ ID NO: 3690759 - RNA, 20 nt, Human
uuacauaauucacucugagu

SEQ ID NO: 3690760 - RNA, 13 nt, Human
uuacauagucuga

SEQ ID NO: 3690761 - RNA, 21 nt, Human
uuacauaguguaggcuuuacu

SEQ ID NO: 3690762 - RNA, 13 nt, Human
uuacaucauuucu

SEQ ID NO: 3690763 - RNA, 14 nt, Human
uuacaucauuuuug

SEQ ID NO: 3690764 - RNA, 20 nt, Human
uuacaucauuuuuguaucua

SEQ ID NO: 3690765 - RNA, 13 nt, Human
uuacauccuuaaa

SEQ ID NO: 3690766 - RNA, 14 nt, Human
uuacaucuguuuua

SEQ ID NO: 3690767 - RNA, 19 nt, Human
uuacaucuguuuuaaauuu

SEQ ID NO: 3690768 - RNA, 13 nt, Human
uuacaugaaguau

SEQ ID NO: 3690769 - RNA, 20 nt, Human
uuacaugaaguauuuuuuca

SEQ ID NO: 3690770 - RNA, 22 nt, Human
uuacaugaggacucuauucuuu

SEQ ID NO: 3690771 - RNA, 16 nt, Human
uuacaugauucauuuu

SEQ ID NO: 3690772 - RNA, 17 nt, Human
uuacaugauucauuuua

SEQ ID NO: 3690773 - RNA, 22 nt, Human
uuacaugcaauuuauuaaaaug

SEQ ID NO: 3690774 - RNA, 15 nt, Human
uuacaugcauacuuc

SEQ ID NO: 3690775 - RNA, 22 nt, Human
uuacaugcauuacugcaugcac

SEQ ID NO: 3690776 - RNA, 15 nt, Human
uuacauguaauuuga

SEQ ID NO: 3690777 - RNA, 16 nt, Human
uuacauguuuauaaau

SEQ ID NO: 3690778 - RNA, 13 nt, Human
uuacauguuugca

SEQ ID NO: 3690779 - RNA, 22 nt, Human
uuacauguuuucuuugcuuuaa

SEQ ID NO: 3690780 - RNA, 16 nt, Human
uuacauuaauguuaau

SEQ ID NO: 3690781 - RNA, 13 nt, Human
uuacauucaguug

SEQ ID NO: 3690782 - RNA, 18 nt, Human
uuacauuccuugauaaug

SEQ ID NO: 3690783 - RNA, 16 nt, Human
uuacauucucuaauaa

SEQ ID NO: 3690784 - RNA, 20 nt, Human
uuacauugcuggucuuguaa

SEQ ID NO: 3690785 - RNA, 21 nt, Human
uuacauuuaaagcauugcugu

SEQ ID NO: 3690786 - RNA, 20 nt, Human
uuacauuuacaaacugaaga

SEQ ID NO: 3690787 - RNA, 19 nt, Human
uuacauuuguaauuuaagg

SEQ ID NO: 3690788 - RNA, 14 nt, Human
uuacauuuguauaa

SEQ ID NO: 3690789 - RNA, 19 nt, Human
uuacauuuguauuuuucca

SEQ ID NO: 3690790 - RNA, 17 nt, Human
uuacauuuuuaagugcu

SEQ ID NO: 3690791 - RNA, 23 nt, Human
uuacauuuuuaagugcugcauuu

SEQ ID NO: 3690792 - RNA, 15 nt, Human
uuacauuuuuacaau

SEQ ID NO: 3690793 - RNA, 15 nt, Human
uuacauuuuuauuua

SEQ ID NO: 3690794 - RNA, 17 nt, Human
uuacauuuuuauuuaug

SEQ ID NO: 3690795 - RNA, 22 nt, Human
uuacauuuuuauuuaugaaguu

SEQ ID NO: 3690796 - RNA, 21 nt, Human
uuaccaaaaauaaauauaucu

SEQ ID NO: 3690797 - RNA, 16 nt, Human
uuaccaaaaauuuugu

SEQ ID NO: 3690798 - RNA, 20 nt, Human
uuaccaaacagcaaaccaag

SEQ ID NO: 3690799 - RNA, 23 nt, Human
uuaccaaagaugaaugaagcaaa

SEQ ID NO: 3690800 - RNA, 15 nt, Human
uuaccaaauaaagua

SEQ ID NO: 3690801 - RNA, 20 nt, Human
uuaccaaccuguuaccuacu

SEQ ID NO: 3690802 - RNA, 13 nt, Human
uuaccaagaagcc

SEQ ID NO: 3690803 - RNA, 16 nt, Human
uuaccaaguuauauaa

SEQ ID NO: 3690804 - RNA, 17 nt, Human
uuaccaaguuauauaaa

SEQ ID NO: 3690805 - RNA, 20 nt, Human
uuaccaauaggcaaauuaau

SEQ ID NO: 3690806 - RNA, 22 nt, Human
uuaccaauugaaguaaaaugug

SEQ ID NO: 3690807 - RNA, 13 nt, Human
uuaccacccccac

SEQ ID NO: 3690808 - RNA, 15 nt, Human
uuaccacccccacac

SEQ ID NO: 3690809 - RNA, 12 nt, Human
uuaccacucagg

SEQ ID NO: 3690810 - RNA, 14 nt, Human
uuaccacucaggca

SEQ ID NO: 3690811 - RNA, 21 nt, Human
uuaccacugaagauagaagaa

SEQ ID NO: 3690812 - RNA, 22 nt, Human
uuaccagagguugugcacuguu

SEQ ID NO: 3690813 - RNA, 18 nt, Human
uuaccagauaaugcuacu

SEQ ID NO: 3690814 - RNA, 24 nt, Human
uuaccagauuuuuacacauguauc

SEQ ID NO: 3690815 - RNA, 14 nt, Human
uuaccagcagagca

SEQ ID NO: 3690816 - RNA, 20 nt, Human
uuaccagccuccguauuuca

SEQ ID NO: 3690817 - RNA, 16 nt, Human
uuaccagcuuuuaacc

SEQ ID NO: 3690818 - RNA, 19 nt, Human
uuaccagcuuuuaaccauc

SEQ ID NO: 3690819 - RNA, 21 nt, Human
uuaccaggcaccaaaagaagu

SEQ ID NO: 3690820 - RNA, 16 nt, Human
uuaccaguaaagugua

SEQ ID NO: 3690821 - RNA, 22 nt, Human
uuaccaguaaaguguaacauau

SEQ ID NO: 3690822 - RNA, 23 nt, Human
uuaccagucuuuaaaggcccagc

SEQ ID NO: 3690823 - RNA, 17 nt, Human
uuaccagugccuuaaac

SEQ ID NO: 3690824 - RNA, 18 nt, Human
uuaccagugccuuaaacu

SEQ ID NO: 3690825 - RNA, 16 nt, Human
uuaccaguuaauuacu

SEQ ID NO: 3690826 - RNA, 19 nt, Human
uuaccaguugccuuuuauc

SEQ ID NO: 3690827 - RNA, 19 nt, Human
uuaccauggaguuaacauc

SEQ ID NO: 3690828 - RNA, 13 nt, Human
uuaccauucacaa

SEQ ID NO: 3690829 - RNA, 14 nt, Human
uuaccauucacaau

SEQ ID NO: 3690830 - RNA, 17 nt, Human
uuaccauucacaauaaa

SEQ ID NO: 3690831 - RNA, 18 nt, Human
uuaccauuggaaauuuca

SEQ ID NO: 3690832 - RNA, 14 nt, Human
uuaccauuuacaug

SEQ ID NO: 3690833 - RNA, 13 nt, Human
uuaccauuuguaa

SEQ ID NO: 3690834 - RNA, 14 nt, Human
uuaccauuuuucau

SEQ ID NO: 3690835 - RNA, 12 nt, Human
uuacccaagcaa

SEQ ID NO: 3690836 - RNA, 20 nt, Human
uuacccaagcaaaaucaugg

SEQ ID NO: 3690837 - RNA, 17 nt, Human
uuacccaauaagauaca

SEQ ID NO: 3690838 - RNA, 16 nt, Human
uuacccacacacagau

SEQ ID NO: 3690839 - RNA, 20 nt, Human
uuacccaggguggagugcag

SEQ ID NO: 3690840 - RNA, 18 nt, Human
uuacccauauccccucuc

SEQ ID NO: 3690841 - RNA, 17 nt, Human
uuacccauuuguucaua

SEQ ID NO: 3690842 - RNA, 19 nt, Human
uuacccauuuguucauauu

SEQ ID NO: 3690843 - RNA, 16 nt, Human
uuaccccuuagccucc

SEQ ID NO: 3690844 - RNA, 22 nt, Human
uuacccucaggcauaggccugg

SEQ ID NO: 3690845 - RNA, 18 nt, Human
uuacccuccuagcuuucc

SEQ ID NO: 3690846 - RNA, 16 nt, Human
uuacccuccuguaaau

SEQ ID NO: 3690847 - RNA, 22 nt, Human
uuacccugcgauuuugccugug

SEQ ID NO: 3690848 - RNA, 12 nt, Human
uuacccugggaa

SEQ ID NO: 3690849 - RNA, 23 nt, Human
uuacccuguacauauguaaacau

SEQ ID NO: 3690850 - RNA, 17 nt, Human
uuacccuucugugccca

SEQ ID NO: 3690851 - RNA, 20 nt, Human
uuacccuucugugcccagcu

SEQ ID NO: 3690852 - RNA, 16 nt, Human
uuacccuuuagacugu

SEQ ID NO: 3690853 - RNA, 18 nt, Human
uuaccgcguuguaaaaua

SEQ ID NO: 3690854 - RNA, 14 nt, Human
uuaccguuucuucc

SEQ ID NO: 3690855 - RNA, 16 nt, Human
uuaccuaaacagauau

SEQ ID NO: 3690856 - RNA, 19 nt, Human
uuaccuaaacagauauaaa

SEQ ID NO: 3690857 - RNA, 16 nt, Human
uuaccuaaaguauuuu

SEQ ID NO: 3690858 - RNA, 18 nt, Human
uuaccuaagauuacaaau

SEQ ID NO: 3690859 - RNA, 20 nt, Human
uuaccuaagugacauuugua

SEQ ID NO: 3690860 - RNA, 21 nt, Human
uuaccuaagugacauuuguag

SEQ ID NO: 3690861 - RNA, 17 nt, Human
uuaccuaccacaguguc

SEQ ID NO: 3690862 - RNA, 18 nt, Human
uuaccuaccacagugucu

SEQ ID NO: 3690863 - RNA, 19 nt, Human
uuaccuagugaaacuuuuc

SEQ ID NO: 3690864 - RNA, 13 nt, Human
uuaccucagccug

SEQ ID NO: 3690865 - RNA, 22 nt, Human
uuaccuccaacagaacuaaaug

SEQ ID NO: 3690866 - RNA, 19 nt, Human
uuaccuccugagaaaaaag

SEQ ID NO: 3690867 - RNA, 15 nt, Human
uuaccuccugcccag

SEQ ID NO: 3690868 - RNA, 21 nt, Human
uuaccucugauaccucaaccc

SEQ ID NO: 3690869 - RNA, 12 nt, Human
uuaccucuuuaa

SEQ ID NO: 3690870 - RNA, 13 nt, Human
uuaccucuuugga

SEQ ID NO: 3690871 - RNA, 18 nt, Human
uuaccugaaaacacugug

SEQ ID NO: 3690872 - RNA, 17 nt, Human
uuaccugaccucuugcu

SEQ ID NO: 3690873 - RNA, 17 nt, Human
uuaccugaucaaugaca

SEQ ID NO: 3690874 - RNA, 19 nt, Human
uuaccugaucaaugacaga

SEQ ID NO: 3690875 - RNA, 23 nt, Human
uuaccugaucaaugacagagccu

SEQ ID NO: 3690876 - RNA, 14 nt, Human
uuaccugcaggcug

SEQ ID NO: 3690877 - RNA, 15 nt, Human
uuaccugcugcuucu

SEQ ID NO: 3690878 - RNA, 16 nt, Human
uuaccuggaaucaaau

SEQ ID NO: 3690879 - RNA, 15 nt, Human
uuaccuggauguucu

SEQ ID NO: 3690880 - RNA, 18 nt, Human
uuaccuguauacagugca

SEQ ID NO: 3690881 - RNA, 11 nt, Human
uuaccugucac

SEQ ID NO: 3690882 - RNA, 18 nt, Human
uuaccugucacauugcau

SEQ ID NO: 3690883 - RNA, 22 nt, Human
uuaccugucacauugcauucua

SEQ ID NO: 3690884 - RNA, 13 nt, Human
uuaccugugaaau

SEQ ID NO: 3690885 - RNA, 14 nt, Human
ugucccugugccua

SEQ ID NO: 3690886 - RNA, 19 nt, Human
ugucccuuacgugaguccu

SEQ ID NO: 3690887 - RNA, 17 nt, Human
ugucccuucacauaguu

SEQ ID NO: 3690888 - RNA, 18 nt, Human
ugucccuucacauaguuu

SEQ ID NO: 3690889 - RNA, 18 nt, Human
ugucccuugaugcacaga

SEQ ID NO: 3690890 - RNA, 14 nt, Human
ugucccuugcugua

SEQ ID NO: 3690891 - RNA, 20 nt, Human
ugucccuuucugugugaaga

SEQ ID NO: 3690892 - RNA, 16 nt, Human
ugucccuuucuuggcc

SEQ ID NO: 3690893 - RNA, 13 nt, Human
uguccgagcuuug

SEQ ID NO: 3690894 - RNA, 15 nt, Human
uguccgauuuuucca

SEQ ID NO: 3690895 - RNA, 17 nt, Human
uguccgcccucuucccc

SEQ ID NO: 3690896 - RNA, 23 nt, Human
uguccgcugggugguacccucug

SEQ ID NO: 3690897 - RNA, 16 nt, Human
uguccuaaggacacac

SEQ ID NO: 3690898 - RNA, 15 nt, Human
uguccuaauggugau

SEQ ID NO: 3690899 - RNA, 18 nt, Human
uguccuaauggugaugca

SEQ ID NO: 3690900 - RNA, 12 nt, Human
uguccuacagaa

SEQ ID NO: 3690901 - RNA, 16 nt, Human
uguccuacccacccuc

SEQ ID NO: 3690902 - RNA, 20 nt, Human
uguccuacccacccuccuuu

SEQ ID NO: 3690903 - RNA, 12 nt, Human
uguccuacucug

SEQ ID NO: 3690904 - RNA, 15 nt, Human
uguccuagcacagau

SEQ ID NO: 3690905 - RNA, 19 nt, Human
uguccuaucuaucuuccaa

SEQ ID NO: 3690906 - RNA, 12 nt, Human
uguccuaugcaa

SEQ ID NO: 3690907 - RNA, 22 nt, Human
uguccuaugugugacucuaaau

SEQ ID NO: 3690908 - RNA, 17 nt, Human
uguccuauuaguguuau

SEQ ID NO: 3690909 - RNA, 13 nt, Human
uguccucaccaug

SEQ ID NO: 3690910 - RNA, 20 nt, Human
uguccucacggugccuuuuu

SEQ ID NO: 3690911 - RNA, 20 nt, Human
uguccucagccuugccagag

SEQ ID NO: 3690912 - RNA, 21 nt, Human
uguccucagccuugccagaga

SEQ ID NO: 3690913 - RNA, 22 nt, Human
uguccucagccuugccagagau

SEQ ID NO: 3690914 - RNA, 12 nt, Human
uguccucaggga

SEQ ID NO: 3690915 - RNA, 19 nt, Human
uguccucagggagcaggga

SEQ ID NO: 3690916 - RNA, 19 nt, Human
uguccucagguggccaugc

SEQ ID NO: 3690917 - RNA, 18 nt, Human
uguccuccagaagccucu

SEQ ID NO: 3690918 - RNA, 22 nt, Human
uguccuccagaagccucuggcu

SEQ ID NO: 3690919 - RNA, 16 nt, Human
uguccuccaggagcuu

SEQ ID NO: 3690920 - RNA, 18 nt, Human
uguccucccagcuccuca

SEQ ID NO: 3690921 - RNA, 17 nt, Human
uguccucccauccccug

SEQ ID NO: 3690922 - RNA, 18 nt, Human
uguccuccccucaaggac

SEQ ID NO: 3690923 - RNA, 17 nt, Human
uguccucccgagcuccu

SEQ ID NO: 3690924 - RNA, 21 nt, Human
uguccuccucggaucaccgag

SEQ ID NO: 3690925 - RNA, 21 nt, Human
uguccuccugguggguccagg

SEQ ID NO: 3690926 - RNA, 22 nt, Human
uguccucuccccuccagccuuu

SEQ ID NO: 3690927 - RNA, 19 nt, Human
uguccucucuggcugggga

SEQ ID NO: 3690928 - RNA, 17 nt, Human
uguccucuuucagaaaa

SEQ ID NO: 3690929 - RNA, 15 nt, Human
uguccucuuucagcu

SEQ ID NO: 3690930 - RNA, 16 nt, Human
uguccucuuucagcuc

SEQ ID NO: 3690931 - RNA, 17 nt, Human
uguccucuuucagcucc

SEQ ID NO: 3690932 - RNA, 18 nt, Human
uguccucuuucagcuccu

SEQ ID NO: 3690933 - RNA, 22 nt, Human
uguccucuuuuguuguuucuua

SEQ ID NO: 3690934 - RNA, 23 nt, Human
uguccugaaaauuguuucaagaa

SEQ ID NO: 3690935 - RNA, 22 nt, Human
uguccugaaacgcuccuuugug

SEQ ID NO: 3690936 - RNA, 18 nt, Human
uguccugaaggccugagg

SEQ ID NO: 3690937 - RNA, 17 nt, Human
uguccugaccacccucc

SEQ ID NO: 3690938 - RNA, 23 nt, Human
uguccugaccacccuccccucuc

SEQ ID NO: 3690939 - RNA, 14 nt, Human
uguccugagcccca

SEQ ID NO: 3690940 - RNA, 18 nt, Human
uguccugagccccaggga

SEQ ID NO: 3690941 - RNA, 21 nt, Human
uguccugagccccagggagag

SEQ ID NO: 3690942 - RNA, 14 nt, Human
uguccugagcucag

SEQ ID NO: 3690943 - RNA, 15 nt, Human
uguccugagcucagc

SEQ ID NO: 3690944 - RNA, 17 nt, Human
uguccugagcucagcgu

SEQ ID NO: 3690945 - RNA, 18 nt, Human
uguccugauggucagcuc

SEQ ID NO: 3690946 - RNA, 19 nt, Human
uguccugauggucagcucc

SEQ ID NO: 3690947 - RNA, 18 nt, Human
uguccugcaccggggccu

SEQ ID NO: 3690948 - RNA, 18 nt, Human
uguccugccacccagccc

SEQ ID NO: 3690949 - RNA, 22 nt, Human
uguccugccacccagccccagc

SEQ ID NO: 3690950 - RNA, 22 nt, Human
uguccugccugcaauauuugaa

SEQ ID NO: 3690951 - RNA, 17 nt, Human
uguccugcuccacagug

SEQ ID NO: 3690952 - RNA, 15 nt, Human
uguccugcuucugaa

SEQ ID NO: 3690953 - RNA, 17 nt, Human
uguccugggccugcaga

SEQ ID NO: 3690954 - RNA, 13 nt, Human
uguccuggugcuc

SEQ ID NO: 3690955 - RNA, 16 nt, Human
uguccuggugcucucu

SEQ ID NO: 3690956 - RNA, 13 nt, Human
uguccugguggua

SEQ ID NO: 3690957 - RNA, 18 nt, Human
uguccuggugguauuuuc

SEQ ID NO: 3690958 - RNA, 19 nt, Human
uguccuggugguauuuuca

SEQ ID NO: 3690959 - RNA, 20 nt, Human
uguccuggugguauuuucaa

SEQ ID NO: 3690960 - RNA, 21 nt, Human
uguccuggugucacuuacugu

SEQ ID NO: 3690961 - RNA, 15 nt, Human
uguccugguucccgu

SEQ ID NO: 3690962 - RNA, 15 nt, Human
uguccuguaaacacu

SEQ ID NO: 3690963 - RNA, 20 nt, Human
uguccuguaacuguuacagu

SEQ ID NO: 3690964 - RNA, 24 nt, Human
uguccuguaguugcguggacucug

SEQ ID NO: 3690965 - RNA, 15 nt, Human
uguccugucaucauc

SEQ ID NO: 3690966 - RNA, 11 nt, Human
uguccuguccu

SEQ ID NO: 3690967 - RNA, 13 nt, Human
uguccuguccugc

SEQ ID NO: 3690968 - RNA, 15 nt, Human
uguccuguccugcuc

SEQ ID NO: 3690969 - RNA, 19 nt, Human
uguccugugagguuuccca

SEQ ID NO: 3690970 - RNA, 16 nt, Human
uguccugugucaguuu

SEQ ID NO: 3690971 - RNA, 18 nt, Human
uguccugugucaguuuau

SEQ ID NO: 3690972 - RNA, 20 nt, Human
uguccuuacccaucugcacc

SEQ ID NO: 3690973 - RNA, 12 nt, Human
uguccuuagaac

SEQ ID NO: 3690974 - RNA, 18 nt, Human
uguccuuagaacauuuua

SEQ ID NO: 3690975 - RNA, 23 nt, Human
uguccuuagccuggaccucugac

SEQ ID NO: 3690976 - RNA, 16 nt, Human
uguccuugcaccugca

SEQ ID NO: 3690977 - RNA, 12 nt, Human
uguccuuuccuu

SEQ ID NO: 3690978 - RNA, 14 nt, Human
uguccuuucuagag

SEQ ID NO: 3690979 - RNA, 22 nt, Human
uguccuuuucauaggucugaaa

SEQ ID NO: 3690980 - RNA, 16 nt, Human
uguccuuuugucuucu

SEQ ID NO: 3690981 - RNA, 17 nt, Human
uguccuuuuuguuauua

SEQ ID NO: 3690982 - RNA, 18 nt, Human
ugucgauuagacuggaca

SEQ ID NO: 3690983 - RNA, 15 nt, Human
ugucgcccagucugg

SEQ ID NO: 3690984 - RNA, 13 nt, Human
ugucgccucugca

SEQ ID NO: 3690985 - RNA, 14 nt, Human
ugucgccucugcau

SEQ ID NO: 3690986 - RNA, 12 nt, Human
ugucgcugcuuc

SEQ ID NO: 3690987 - RNA, 18 nt, Human
ugucgcuuucccuuggau

SEQ ID NO: 3690988 - RNA, 16 nt, Human
ugucggaggaaagaca

SEQ ID NO: 3690989 - RNA, 19 nt, Human
ugucggaggaaagacaaca

SEQ ID NO: 3690990 - RNA, 21 nt, Human
ugucggccccaccagugccuc

SEQ ID NO: 3690991 - RNA, 12 nt, Human
ugucggccucua

SEQ ID NO: 3690992 - RNA, 14 nt, Human
ugucggccucuaac

SEQ ID NO: 3690993 - RNA, 23 nt, Human
ugucggccucuaaccccaggccc

SEQ ID NO: 3690994 - RNA, 12 nt, Human
ugucgggcauga

SEQ ID NO: 3690995 - RNA, 21 nt, Human
ugucgggcccuucuugcugcc

SEQ ID NO: 3690996 - RNA, 22 nt, Human
ugucguaguuacucucaggcau

SEQ ID NO: 3690997 - RNA, 23 nt, Human
ugucgugagugucucuugucuaa

SEQ ID NO: 3690998 - RNA, 17 nt, Human
ugucguuaaaaacagau

SEQ ID NO: 3690999 - RNA, 20 nt, Human
ugucguugacuuuagggacu

SEQ ID NO: 3691000 - RNA, 14 nt, Human
ugucuaaaaaacaa

SEQ ID NO: 3691001 - RNA, 15 nt, Human
ugucuaaaaaccaga

SEQ ID NO: 3691002 - RNA, 17 nt, Human
ugucuaaaacaauaaaa

SEQ ID NO: 3691003 - RNA, 20 nt, Human
ugucuaaacaaugcugauuu

SEQ ID NO: 3691004 - RNA, 19 nt, Human
ugucuaaagagcuuuaguc

SEQ ID NO: 3691005 - RNA, 19 nt, Human
ugucuaaaguguauuuuca

SEQ ID NO: 3691006 - RNA, 23 nt, Human
ugucuaaaguguauuuucagagc

SEQ ID NO: 3691007 - RNA, 18 nt, Human
ugucuaacucagaauuau

SEQ ID NO: 3691008 - RNA, 19 nt, Human
ugucuaagaaacauuggaa

SEQ ID NO: 3691009 - RNA, 23 nt, Human
ugucuaagaaauugaauacuuug

SEQ ID NO: 3691010 - RNA, 14 nt, Human
ugucuaagauagua

SEQ ID NO: 3691011 - RNA, 14 nt, Human
ugucuaagauucua

SEQ ID NO: 3691012 - RNA, 18 nt, Human
ugucuaagauucuagauc

SEQ ID NO: 3691013 - RNA, 22 nt, Human
ugucuaaggucacacaguauua

SEQ ID NO: 3691014 - RNA, 13 nt, Human
ugucuaauguauu

SEQ ID NO: 3691015 - RNA, 17 nt, Human
ugucuaauguauuuuau

SEQ ID NO: 3691016 - RNA, 18 nt, Human
ugucuaauguauuuuauu

SEQ ID NO: 3691017 - RNA, 19 nt, Human
ugucuaauguauuuuauug

SEQ ID NO: 3691018 - RNA, 18 nt, Human
ugucuaauuaaaacacuu

SEQ ID NO: 3691019 - RNA, 21 nt, Human
ugucuacaaauauaagauuuu

SEQ ID NO: 3691020 - RNA, 17 nt, Human
ugucuacacuaagagag

SEQ ID NO: 3691021 - RNA, 19 nt, Human
ugucuacagagaaccugga

SEQ ID NO: 3691022 - RNA, 20 nt, Human
ugucuacauaugaucugucu

SEQ ID NO: 3691023 - RNA, 14 nt, Human
ugucuagagaggga

SEQ ID NO: 3691024 - RNA, 18 nt, Human
ugucuagcacuuccuugc

SEQ ID NO: 3691025 - RNA, 17 nt, Human
ugucuagcaugccaaca

SEQ ID NO: 3691026 - RNA, 20 nt, Human
ugucuagcaugccaacaaga

SEQ ID NO: 3691027 - RNA, 23 nt, Human
ugucuaguuguuugauucagaca

SEQ ID NO: 3691028 - RNA, 16 nt, Human
ugucuauaaaagaaac

SEQ ID NO: 3691029 - RNA, 12 nt, Human
ugucuauaaagc

SEQ ID NO: 3691030 - RNA, 16 nt, Human
ugucuaugggacucaa

SEQ ID NO: 3691031 - RNA, 18 nt, Human
ugucuauuaccuguuagu

SEQ ID NO: 3691032 - RNA, 14 nt, Human
ugucuauucagcuu

SEQ ID NO: 3691033 - RNA, 13 nt, Human
ugucuauuucugc

SEQ ID NO: 3691034 - RNA, 21 nt, Human
uaaguacagagaagccaucac

SEQ ID NO: 3691035 - RNA, 14 nt, Human
uaaguacuguaaua

SEQ ID NO: 3691036 - RNA, 16 nt, Human
uaaguagauaagcaga

SEQ ID NO: 3691037 - RNA, 12 nt, Human
uaaguagauuuc

SEQ ID NO: 3691038 - RNA, 16 nt, Human
uaaguaucugacaucu

SEQ ID NO: 3691039 - RNA, 17 nt, Human
uaaguaucuucauguau

SEQ ID NO: 3691040 - RNA, 20 nt, Human
uaaguauguguaaaauguga

SEQ ID NO: 3691041 - RNA, 17 nt, Human
uaaguauuaaaacauug

SEQ ID NO: 3691042 - RNA, 18 nt, Human
uaaguauuaaaacauugg

SEQ ID NO: 3691043 - RNA, 17 nt, Human
uaaguauuaugucucuu

SEQ ID NO: 3691044 - RNA, 21 nt, Human
uaaguauuaugucucuucuga

SEQ ID NO: 3691045 - RNA, 14 nt, Human
uaaguauucaagaa

SEQ ID NO: 3691046 - RNA, 20 nt, Human
uaaguauucuuauuuaauga

SEQ ID NO: 3691047 - RNA, 18 nt, Human
uaaguauugcaucuguau

SEQ ID NO: 3691048 - RNA, 20 nt, Human
uaaguauugcaucuguauaa

SEQ ID NO: 3691049 - RNA, 19 nt, Human
uaaguauuuauauauuuau

SEQ ID NO: 3691050 - RNA, 20 nt, Human
uaaguauuucagaugcuuua

SEQ ID NO: 3691051 - RNA, 13 nt, Human
uaaguauuuggaa

SEQ ID NO: 3691052 - RNA, 15 nt, Human
uaagucaacaguaaa

SEQ ID NO: 3691053 - RNA, 12 nt, Human
uaagucaguguu

SEQ ID NO: 3691054 - RNA, 13 nt, Human
uaagucaguguug

SEQ ID NO: 3691055 - RNA, 15 nt, Human
uaagucaguguugag

SEQ ID NO: 3691056 - RNA, 17 nt, Human
uaagucaguguugagau

SEQ ID NO: 3691057 - RNA, 14 nt, Human
uaagucauguaugu

SEQ ID NO: 3691058 - RNA, 15 nt, Human
uaagucccugccccc

SEQ ID NO: 3691059 - RNA, 22 nt, Human
uaagucccugcccccuccccuu

SEQ ID NO: 3691060 - RNA, 16 nt, Human
uaagucccugucaccu

SEQ ID NO: 3691061 - RNA, 17 nt, Human
uaaguccuuuaugugga

SEQ ID NO: 3691062 - RNA, 20 nt, Human
uaaguccuuuauguggaaaa

SEQ ID NO: 3691063 - RNA, 13 nt, Human
uaagucucaacug

SEQ ID NO: 3691064 - RNA, 16 nt, Human
uaagucucaagguagg

SEQ ID NO: 3691065 - RNA, 17 nt, Human
uaagucucuuuuuuaca

SEQ ID NO: 3691066 - RNA, 18 nt, Human
uaagucucuuuuuuacaa

SEQ ID NO: 3691067 - RNA, 13 nt, Human
uaagucuguuuua

SEQ ID NO: 3691068 - RNA, 16 nt, Human
uaagucuguuuuauga

SEQ ID NO: 3691069 - RNA, 20 nt, Human
uaagucuguuuuaugacuuc

SEQ ID NO: 3691070 - RNA, 14 nt, Human
uaagucuuucaugg

SEQ ID NO: 3691071 - RNA, 13 nt, Human
uaagugaaauaag

SEQ ID NO: 3691072 - RNA, 14 nt, Human
uaagugaaauuuau

SEQ ID NO: 3691073 - RNA, 18 nt, Human
uaagugaacacccaugaa

SEQ ID NO: 3691074 - RNA, 14 nt, Human
uaagugcccucucc

SEQ ID NO: 3691075 - RNA, 14 nt, Human
uaagugccuuccau

SEQ ID NO: 3691076 - RNA, 14 nt, Human
uaagugcugcauuu

SEQ ID NO: 3691077 - RNA, 12 nt, Human
uaagugcuguau

SEQ ID NO: 3691078 - RNA, 14 nt, Human
uaagugcuguauaa

SEQ ID NO: 3691079 - RNA, 18 nt, Human
uaagugcuguauaaaauc

SEQ ID NO: 3691080 - RNA, 19 nt, Human
uaagugcuguauaaaauca

SEQ ID NO: 3691081 - RNA, 20 nt, Human
uaagugcuguauaaaaucag

SEQ ID NO: 3691082 - RNA, 15 nt, Human
uaagugcuuuguaau

SEQ ID NO: 3691083 - RNA, 17 nt, Human
uaaguggaggcacuuua

SEQ ID NO: 3691084 - RNA, 15 nt, Human
uaagugggcccaccc

SEQ ID NO: 3691085 - RNA, 18 nt, Human
uaagugggcccacccggu

SEQ ID NO: 3691086 - RNA, 20 nt, Human
uaagugguacuaacuuuccu

SEQ ID NO: 3691087 - RNA, 15 nt, Human
uaaguggugugugua

SEQ ID NO: 3691088 - RNA, 14 nt, Human
uaaguguacauaug

SEQ ID NO: 3691089 - RNA, 13 nt, Human
uaaguguauuuuu

SEQ ID NO: 3691090 - RNA, 20 nt, Human
uaaguguauuuuucaauaaa

SEQ ID NO: 3691091 - RNA, 20 nt, Human
uaagugugugguagaaacaa

SEQ ID NO: 3691092 - RNA, 21 nt, Human
uaagugugugguagaaacaaa

SEQ ID NO: 3691093 - RNA, 17 nt, Human
uaaguguguguuuuuca

SEQ ID NO: 3691094 - RNA, 16 nt, Human
uaaguuaauaaauaag

SEQ ID NO: 3691095 - RNA, 16 nt, Human
uaaguuaauguauaua

SEQ ID NO: 3691096 - RNA, 21 nt, Human
uaaguuaauguauauaaaaau

SEQ ID NO: 3691097 - RNA, 15 nt, Human
uaaguuacaauguuu

SEQ ID NO: 3691098 - RNA, 12 nt, Human
uaaguuauugca

SEQ ID NO: 3691099 - RNA, 16 nt, Human
uaaguuauugcaguuu

SEQ ID NO: 3691100 - RNA, 20 nt, Human
uaaguuauuucuuguuuguu

SEQ ID NO: 3691101 - RNA, 20 nt, Human
uaaguucaaauucuucugaa

SEQ ID NO: 3691102 - RNA, 13 nt, Human
uaaguucacauua

SEQ ID NO: 3691103 - RNA, 16 nt, Human
uaaguucacauuagaa

SEQ ID NO: 3691104 - RNA, 12 nt, Human
uaaguucauaca

SEQ ID NO: 3691105 - RNA, 14 nt, Human
uaaguucauacauu

SEQ ID NO: 3691106 - RNA, 15 nt, Human
uaaguuccacugagc

SEQ ID NO: 3691107 - RNA, 23 nt, Human
uaaguucuggaugcauuucucug

SEQ ID NO: 3691108 - RNA, 22 nt, Human
uaaguugagauaguuuucaucc

SEQ ID NO: 3691109 - RNA, 15 nt, Human
uaaguugaggcauuu

SEQ ID NO: 3691110 - RNA, 12 nt, Human
uaaguugaguau

SEQ ID NO: 3691111 - RNA, 12 nt, Human
uaaguugcugau

SEQ ID NO: 3691112 - RNA, 13 nt, Human
uaaguuggaaaca

SEQ ID NO: 3691113 - RNA, 13 nt, Human
uaaguugggcuug

SEQ ID NO: 3691114 - RNA, 22 nt, Human
uaaguugggcuugcuauucugu

SEQ ID NO: 3691115 - RNA, 20 nt, Human
uaaguuuaugucuaaagagc

SEQ ID NO: 3691116 - RNA, 19 nt, Human
uaaguuucaggugacaugu

SEQ ID NO: 3691117 - RNA, 15 nt, Human
uaaguuucuaagauu

SEQ ID NO: 3691118 - RNA, 19 nt, Human
uaaguuucuaagauucuaa

SEQ ID NO: 3691119 - RNA, 20 nt, Human
uaaguuucuaagauucuaaa

SEQ ID NO: 3691120 - RNA, 14 nt, Human
uaaguuucucagcu

SEQ ID NO: 3691121 - RNA, 17 nt, Human
uaaguuucucugcagaa

SEQ ID NO: 3691122 - RNA, 16 nt, Human
uaaguuugauuucauu

SEQ ID NO: 3691123 - RNA, 12 nt, Human
uaaguuugcacu

SEQ ID NO: 3691124 - RNA, 18 nt, Human
uaaguuuuuuuuuaaaaa

SEQ ID NO: 3691125 - RNA, 19 nt, Human
uaauaaaaaauggaaagaa

SEQ ID NO: 3691126 - RNA, 21 nt, Human
uaauaaaaaauggaaagaauc

SEQ ID NO: 3691127 - RNA, 15 nt, Human
uaauaaaaagacaac

SEQ ID NO: 3691128 - RNA, 13 nt, Human
uaauaaaaagauu

SEQ ID NO: 3691129 - RNA, 12 nt, Human
uaauaaaaaggu

SEQ ID NO: 3691130 - RNA, 15 nt, Human
uaauaaaaaggugac

SEQ ID NO: 3691131 - RNA, 15 nt, Human
uaauaaaaauaauuu

SEQ ID NO: 3691132 - RNA, 12 nt, Human
uaauaaaagaaa

SEQ ID NO: 3691133 - RNA, 13 nt, Human
uaauaaaagaaaa

SEQ ID NO: 3691134 - RNA, 20 nt, Human
uaauaaaaggaaaagcaaau

SEQ ID NO: 3691135 - RNA, 19 nt, Human
uaauaaaauaauucuaaag

SEQ ID NO: 3691136 - RNA, 17 nt, Human
uaauaaaauaucauuca

SEQ ID NO: 3691137 - RNA, 12 nt, Human
uaauaaaauauu

SEQ ID NO: 3691138 - RNA, 13 nt, Human
uaauaaaauauuu

SEQ ID NO: 3691139 - RNA, 14 nt, Human
uaauaaaauauuuu

SEQ ID NO: 3691140 - RNA, 20 nt, Human
uaauaaaauauuuucugugu

SEQ ID NO: 3691141 - RNA, 21 nt, Human
uaauaaaauauuuucugugug

SEQ ID NO: 3691142 - RNA, 22 nt, Human
uaauaaaauauuuucugugugu

SEQ ID NO: 3691143 - RNA, 12 nt, Human
uaauaaacucau

SEQ ID NO: 3691144 - RNA, 20 nt, Human
uaauaaacuguccucuuuca

SEQ ID NO: 3691145 - RNA, 14 nt, Human
uaauaaacuguguu

SEQ ID NO: 3691146 - RNA, 15 nt, Human
uaauaaacuguguuu

SEQ ID NO: 3691147 - RNA, 17 nt, Human
uaauaaagaucauguaa

SEQ ID NO: 3691148 - RNA, 17 nt, Human
uaauaaagcgaaaaacu

SEQ ID NO: 3691149 - RNA, 20 nt, Human
uaauaaagcgaaaaacucaa

SEQ ID NO: 3691150 - RNA, 11 nt, Human
uaauaaagcug

SEQ ID NO: 3691151 - RNA, 12 nt, Human
uaauaaagcugu

SEQ ID NO: 3691152 - RNA, 16 nt, Human
uaauaaaggacuguaa

SEQ ID NO: 3691153 - RNA, 13 nt, Human
uaauaaaguauuc

SEQ ID NO: 3691154 - RNA, 18 nt, Human
uaauaaaguuuuuuucca

SEQ ID NO: 3691155 - RNA, 14 nt, Human
uaauaaauauauac

SEQ ID NO: 3691156 - RNA, 19 nt, Human
uaauaaauauuuuugccau

SEQ ID NO: 3691157 - RNA, 19 nt, Human
uaauaaaugaaugucacuu

SEQ ID NO: 3691158 - RNA, 14 nt, Human
uaauaaaugcccuc

SEQ ID NO: 3691159 - RNA, 19 nt, Human
uaauaaauguacauuaauu

SEQ ID NO: 3691160 - RNA, 21 nt, Human
uaauaaauugcaugcugcuuu

SEQ ID NO: 3691161 - RNA, 23 nt, Human
uaauaaauugcaugcugcuuuaa

SEQ ID NO: 3691162 - RNA, 13 nt, Human
uaauaacauaaca

SEQ ID NO: 3691163 - RNA, 21 nt, Human
uaauaacauuaccuuacugug

SEQ ID NO: 3691164 - RNA, 14 nt, Human
uaauaaccagacac

SEQ ID NO: 3691165 - RNA, 21 nt, Human
uaauaacugugaaguuuacau

SEQ ID NO: 3691166 - RNA, 17 nt, Human
uaauaagacauaacguu

SEQ ID NO: 3691167 - RNA, 20 nt, Human
uaauaagacauaacguuuuu

SEQ ID NO: 3691168 - RNA, 16 nt, Human
uaauaagcacuguaaa

SEQ ID NO: 3691169 - RNA, 16 nt, Human
uaauaagcuaguugaa

SEQ ID NO: 3691170 - RNA, 17 nt, Human
uaauaagggaaaaauca

SEQ ID NO: 3691171 - RNA, 15 nt, Human
uaauaagguugaaca

SEQ ID NO: 3691172 - RNA, 13 nt, Human
uaauaagguuuua

SEQ ID NO: 3691173 - RNA, 15 nt, Human
uaauaauaaauaguu

SEQ ID NO: 3691174 - RNA, 14 nt, Human
uaauaauaccucaa

SEQ ID NO: 3691175 - RNA, 13 nt, Human
uaauaauauacuu

SEQ ID NO: 3691176 - RNA, 19 nt, Human
uaauaauauacuuguggac

SEQ ID NO: 3691177 - RNA, 14 nt, Human
uaauaauauuguuu

SEQ ID NO: 3691178 - RNA, 20 nt, Human
uaauaaucuuauuagggaga

SEQ ID NO: 3691179 - RNA, 15 nt, Human
uaauaaucuuguuuc

SEQ ID NO: 3691180 - RNA, 20 nt, Human
uaauaaucuuguuucugaaa

SEQ ID NO: 3691181 - RNA, 16 nt, Human
uaauaauggcaucaau

SEQ ID NO: 3691182 - RNA, 22 nt, Human
uaauaauguuaaccaaggaaau

SEQ ID NO: 3691183 - RNA, 15 nt, Human
uaauaauguuuaaua

SEQ ID NO: 3691184 - RNA, 19 nt, Human
uaauaauuauaugcuauuu

SEQ ID NO: 3691185 - RNA, 23 nt, Human
uaauaauuauaugcuauuucuau

SEQ ID NO: 3691186 - RNA, 12 nt, Human
uuaccuguggau

SEQ ID NO: 3691187 - RNA, 13 nt, Human
uuaccuguggaua

SEQ ID NO: 3691188 - RNA, 20 nt, Human
uuaccuguggauauuuguau

SEQ ID NO: 3691189 - RNA, 13 nt, Human
uuaccugugugcu

SEQ ID NO: 3691190 - RNA, 23 nt, Human
uuaccuguuuucgcaccuaccau

SEQ ID NO: 3691191 - RNA, 19 nt, Human
uuaccuuagauuagcucug

SEQ ID NO: 3691192 - RNA, 18 nt, Human
uuaccuuauaguuacugu

SEQ ID NO: 3691193 - RNA, 20 nt, Human
uuaccuuugacaaagguaaa

SEQ ID NO: 3691194 - RNA, 20 nt, Human
uuaccuuuuuuauacauaaa

SEQ ID NO: 3691195 - RNA, 15 nt, Human
uuaccuuuuuugaua

SEQ ID NO: 3691196 - RNA, 23 nt, Human
uuacgaaaaaaugguagcauuuu

SEQ ID NO: 3691197 - RNA, 20 nt, Human
uuacgaaguucaagaucaaa

SEQ ID NO: 3691198 - RNA, 17 nt, Human
uuacgaauauuuucagu

SEQ ID NO: 3691199 - RNA, 18 nt, Human
uuacgauaaggaagaaac

SEQ ID NO: 3691200 - RNA, 18 nt, Human
uuacggcccuggccuugg

SEQ ID NO: 3691201 - RNA, 14 nt, Human
uuacggguaccuga

SEQ ID NO: 3691202 - RNA, 21 nt, Human
uuacguaguguagauuuguuu

SEQ ID NO: 3691203 - RNA, 22 nt, Human
uuacguaugucugguucucaau

SEQ ID NO: 3691204 - RNA, 12 nt, Human
uuacgugagcca

SEQ ID NO: 3691205 - RNA, 13 nt, Human
uuacgugaguccu

SEQ ID NO: 3691206 - RNA, 14 nt, Human
uuacgugaguccug

SEQ ID NO: 3691207 - RNA, 18 nt, Human
uuacuaaaauggacugug

SEQ ID NO: 3691208 - RNA, 13 nt, Human
uuacuaaacauuu

SEQ ID NO: 3691209 - RNA, 21 nt, Human
uuacuaaacauuuuguuauug

SEQ ID NO: 3691210 - RNA, 11 nt, Human
uuacuaaagaa

SEQ ID NO: 3691211 - RNA, 15 nt, Human
uuacuaacuaaacuc

SEQ ID NO: 3691212 - RNA, 17 nt, Human
uuacuaacuucuaaaac

SEQ ID NO: 3691213 - RNA, 22 nt, Human
uuacuaagccacaagaaauuug

SEQ ID NO: 3691214 - RNA, 22 nt, Human
uuacuaagcuuugccagcugcu

SEQ ID NO: 3691215 - RNA, 20 nt, Human
uuacuaaggaagauuacuca

SEQ ID NO: 3691216 - RNA, 13 nt, Human
uuacuaaguuuuu

SEQ ID NO: 3691217 - RNA, 14 nt, Human
uuacuaaguuuuua

SEQ ID NO: 3691218 - RNA, 18 nt, Human
uuacuacagccuuaauau

SEQ ID NO: 3691219 - RNA, 13 nt, Human
uuacuacugugga

SEQ ID NO: 3691220 - RNA, 13 nt, Human
uuacuagaacaca

SEQ ID NO: 3691221 - RNA, 20 nt, Human
uuacuagcaccugccaggga

SEQ ID NO: 3691222 - RNA, 19 nt, Human
uuacuagguaacuucauau

SEQ ID NO: 3691223 - RNA, 15 nt, Human
uuacuauagcaaagu

SEQ ID NO: 3691224 - RNA, 22 nt, Human
uuacuauagcaaaguaguacuu

SEQ ID NO: 3691225 - RNA, 14 nt, Human
uuacuauauauaua

SEQ ID NO: 3691226 - RNA, 21 nt, Human
uuacuaucaugucaaacguga

SEQ ID NO: 3691227 - RNA, 19 nt, Human
uuacuauuaagcaguaaaa

SEQ ID NO: 3691228 - RNA, 21 nt, Human
uuacuauuuucuacaauuaau

SEQ ID NO: 3691229 - RNA, 15 nt, Human
uuacucaaugugugc

SEQ ID NO: 3691230 - RNA, 23 nt, Human
uuacucagaauucucuaguuuga

SEQ ID NO: 3691231 - RNA, 19 nt, Human
uuacucagggcuccuccca

SEQ ID NO: 3691232 - RNA, 20 nt, Human
uuacucagggcuccucccag

SEQ ID NO: 3691233 - RNA, 17 nt, Human
uuacucaugaucuugug

SEQ ID NO: 3691234 - RNA, 16 nt, Human
uuacucauugaaaugu

SEQ ID NO: 3691235 - RNA, 21 nt, Human
uuacucauuuuuuuaauuuau

SEQ ID NO: 3691236 - RNA, 23 nt, Human
uuacuccauauauauauaugugu

SEQ ID NO: 3691237 - RNA, 12 nt, Human
uuacucuaagau

SEQ ID NO: 3691238 - RNA, 21 nt, Human
uuacucuaugccccaaauaua

SEQ ID NO: 3691239 - RNA, 16 nt, Human
uuacucuccaaccugg

SEQ ID NO: 3691240 - RNA, 23 nt, Human
uuacucucuugcaccaaauuauc

SEQ ID NO: 3691241 - RNA, 13 nt, Human
uuacucugaaggg

SEQ ID NO: 3691242 - RNA, 22 nt, Human
uuacucugaagggcaucaugca

SEQ ID NO: 3691243 - RNA, 16 nt, Human
uuacucuuguaagauu

SEQ ID NO: 3691244 - RNA, 12 nt, Human
uuacugaaugca

SEQ ID NO: 3691245 - RNA, 12 nt, Human
uuacugaccagc

SEQ ID NO: 3691246 - RNA, 20 nt, Human
uuacugaccucaccuaggaa

SEQ ID NO: 3691247 - RNA, 18 nt, Human
uuacugagcuucucugug

SEQ ID NO: 3691248 - RNA, 19 nt, Human
uuacugagcuucucuguga

SEQ ID NO: 3691249 - RNA, 14 nt, Human
uuacugauaauuuu

SEQ ID NO: 3691250 - RNA, 22 nt, Human
uuacugauagggauacaugcuc

SEQ ID NO: 3691251 - RNA, 23 nt, Human
uuacugauauauuuuacaauuuu

SEQ ID NO: 3691252 - RNA, 17 nt, Human
uuacugaucaugcauug

SEQ ID NO: 3691253 - RNA, 21 nt, Human
uuacugaucaugcauuguuga

SEQ ID NO: 3691254 - RNA, 18 nt, Human
uuacugcaaaugucauca

SEQ ID NO: 3691255 - RNA, 15 nt, Human
uuacugcagcuuugu

SEQ ID NO: 3691256 - RNA, 11 nt, Human
uuacugccuug

SEQ ID NO: 3691257 - RNA, 20 nt, Human
uuacugcuaaguauuuccca

SEQ ID NO: 3691258 - RNA, 21 nt, Human
uuacugcuaaguauuucccag

SEQ ID NO: 3691259 - RNA, 14 nt, Human
uuacugcucugaga

SEQ ID NO: 3691260 - RNA, 17 nt, Human
uuacuggacaaagaauu

SEQ ID NO: 3691261 - RNA, 13 nt, Human
uuacuggccuuuu

SEQ ID NO: 3691262 - RNA, 23 nt, Human
uuacuggcguggauuaaacuuau

SEQ ID NO: 3691263 - RNA, 16 nt, Human
uuacuggcuucucuug

SEQ ID NO: 3691264 - RNA, 24 nt, Human
uuacugguaggaacuugagaacuu

SEQ ID NO: 3691265 - RNA, 14 nt, Human
uuacugguccaaaa

SEQ ID NO: 3691266 - RNA, 15 nt, Human
uuacugguccaaaag

SEQ ID NO: 3691267 - RNA, 14 nt, Human
uuacugguugcaug

SEQ ID NO: 3691268 - RNA, 18 nt, Human
uuacugguugcauggaaa

SEQ ID NO: 3691269 - RNA, 19 nt, Human
uuacugguugcauggaaau

SEQ ID NO: 3691270 - RNA, 22 nt, Human
uuacuguacaugaaaacacauu

SEQ ID NO: 3691271 - RNA, 13 nt, Human
uuacuguaccugu

SEQ ID NO: 3691272 - RNA, 16 nt, Human
uuacuguagccucaga

SEQ ID NO: 3691273 - RNA, 21 nt, Human
uuacuguagccucagaugauu

SEQ ID NO: 3691274 - RNA, 23 nt, Human
uuacugucaaggcugcuuagaau

SEQ ID NO: 3691275 - RNA, 13 nt, Human
uuacugucaauaa

SEQ ID NO: 3691276 - RNA, 19 nt, Human
uuacugucuauuaauauuc

SEQ ID NO: 3691277 - RNA, 12 nt, Human
uuacugucuuaa

SEQ ID NO: 3691278 - RNA, 13 nt, Human
uuacugucuuaau

SEQ ID NO: 3691279 - RNA, 19 nt, Human
uuacugucuuuuuucuaaa

SEQ ID NO: 3691280 - RNA, 14 nt, Human
uuacuguggaggaa

SEQ ID NO: 3691281 - RNA, 18 nt, Human
uuacuguggaggaaggau

SEQ ID NO: 3691282 - RNA, 16 nt, Human
uuacuguguaauuagu

SEQ ID NO: 3691283 - RNA, 20 nt, Human
uuacuguguaauuagugcca

SEQ ID NO: 3691284 - RNA, 13 nt, Human
uuacugugucuuu

SEQ ID NO: 3691285 - RNA, 23 nt, Human
uuacuguucauuugauuuguaca

SEQ ID NO: 3691286 - RNA, 12 nt, Human
uuacuguucuug

SEQ ID NO: 3691287 - RNA, 13 nt, Human
uuacuguucuugc

SEQ ID NO: 3691288 - RNA, 17 nt, Human
uuacuguucuugcugcu

SEQ ID NO: 3691289 - RNA, 19 nt, Human
uuacuguucuugcugcuag

SEQ ID NO: 3691290 - RNA, 22 nt, Human
uuacuguucuugcugcuagaac

SEQ ID NO: 3691291 - RNA, 15 nt, Human
uuacuguuuauuucu

SEQ ID NO: 3691292 - RNA, 16 nt, Human
uuacuguuuauuucug

SEQ ID NO: 3691293 - RNA, 15 nt, Human
uuacuguuuguuaug

SEQ ID NO: 3691294 - RNA, 22 nt, Human
uuacuuaaagauuuaucaaauc

SEQ ID NO: 3691295 - RNA, 16 nt, Human
uuacuuaaucaaaacu

SEQ ID NO: 3691296 - RNA, 15 nt, Human
uuacuuagaggaaau

SEQ ID NO: 3691297 - RNA, 13 nt, Human
uuacuuaguauug

SEQ ID NO: 3691298 - RNA, 19 nt, Human
uuacuuaguauugcaaagu

SEQ ID NO: 3691299 - RNA, 17 nt, Human
uuacuuaucccugccca

SEQ ID NO: 3691300 - RNA, 19 nt, Human
uuacuucacuuuaauucuc

SEQ ID NO: 3691301 - RNA, 14 nt, Human
uuacuuccaugaau

SEQ ID NO: 3691302 - RNA, 15 nt, Human
uuacuuccaugaauu

SEQ ID NO: 3691303 - RNA, 12 nt, Human
uuacuucugcua

SEQ ID NO: 3691304 - RNA, 23 nt, Human
uuacuucuuauacauuugauaaa

SEQ ID NO: 3691305 - RNA, 13 nt, Human
uuacuucuucucu

SEQ ID NO: 3691306 - RNA, 18 nt, Human
uuacuugaauaguauugu

SEQ ID NO: 3691307 - RNA, 14 nt, Human
uuacuugaccuccu

SEQ ID NO: 3691308 - RNA, 17 nt, Human
uuacuuggaaauauuaa

SEQ ID NO: 3691309 - RNA, 13 nt, Human
uuacuuguaaaua

SEQ ID NO: 3691310 - RNA, 23 nt, Human
uuacuuguaaauauaaagacguu

SEQ ID NO: 3691311 - RNA, 17 nt, Human
uuacuuguugccuauaa

SEQ ID NO: 3691312 - RNA, 16 nt, Human
uuacuuuaaacuuguc

SEQ ID NO: 3691313 - RNA, 20 nt, Human
uuacuuuacugccugaauaa

SEQ ID NO: 3691314 - RNA, 16 nt, Human
uuacuuuauguuacua

SEQ ID NO: 3691315 - RNA, 19 nt, Human
uuacuuuccaauucuccuu

SEQ ID NO: 3691316 - RNA, 11 nt, Human
uuacuuucccu

SEQ ID NO: 3691317 - RNA, 17 nt, Human
uuacuuucccuugcuuu

SEQ ID NO: 3691318 - RNA, 14 nt, Human
uuacuuuccucuga

SEQ ID NO: 3691319 - RNA, 13 nt, Human
uuacuuugcugag

SEQ ID NO: 3691320 - RNA, 14 nt, Human
uuacuuuguaaauu

SEQ ID NO: 3691321 - RNA, 23 nt, Human
uuacuuuguaaauucugauuucu

SEQ ID NO: 3691322 - RNA, 19 nt, Human
uuacuuuuaaacuguguac

SEQ ID NO: 3691323 - RNA, 21 nt, Human
uuacuuuuauuugcaacauuu

SEQ ID NO: 3691324 - RNA, 23 nt, Human
uuacuuuuauuugcaacauuuac

SEQ ID NO: 3691325 - RNA, 21 nt, Human
uuacuuuucauauuugcacua

SEQ ID NO: 3691326 - RNA, 14 nt, Human
uuacuuuugcugua

SEQ ID NO: 3691327 - RNA, 14 nt, Human
uuacuuuuuaaaau

SEQ ID NO: 3691328 - RNA, 15 nt, Human
uuagaaaaaaauuac

SEQ ID NO: 3691329 - RNA, 23 nt, Human
uuagaaaaaaguuuacaacauaa

SEQ ID NO: 3691330 - RNA, 21 nt, Human
uuagaaaaagaacaugcaguu

SEQ ID NO: 3691331 - RNA, 23 nt, Human
uuagaaaaccagcucagcacugc

SEQ ID NO: 3691332 - RNA, 14 nt, Human
uuagaaaacuuuaa

SEQ ID NO: 3691333 - RNA, 15 nt, Human
uuagaaaacuuuguu

SEQ ID NO: 3691334 - RNA, 12 nt, Human
uuagaaaaggca

SEQ ID NO: 3691335 - RNA, 22 nt, Human
uuagaaaaggugauaaaaucau

SEQ ID NO: 3691336 - RNA, 17 nt, Human
ugucucaagagggcacu

SEQ ID NO: 3691337 - RNA, 23 nt, Human
ugucucaagagggcacugguggc

SEQ ID NO: 3691338 - RNA, 19 nt, Human
ugucucaaugcucauaacg

SEQ ID NO: 3691339 - RNA, 17 nt, Human
ugucucacuaaagcaug

SEQ ID NO: 3691340 - RNA, 20 nt, Human
ugucucacuaaagcaugaaa

SEQ ID NO: 3691341 - RNA, 14 nt, Human
ugucucacugagca

SEQ ID NO: 3691342 - RNA, 20 nt, Human
ugucucacugagcacuguuu

SEQ ID NO: 3691343 - RNA, 16 nt, Human
ugucucagauuuuauu

SEQ ID NO: 3691344 - RNA, 20 nt, Human
ugucucagauuuuauuaugu

SEQ ID NO: 3691345 - RNA, 13 nt, Human
ugucucaggcugc

SEQ ID NO: 3691346 - RNA, 22 nt, Human
ugucucaguccaugaagaugua

SEQ ID NO: 3691347 - RNA, 16 nt, Human
ugucucaguuggaaau

SEQ ID NO: 3691348 - RNA, 17 nt, Human
ugucucauccaucauca

SEQ ID NO: 3691349 - RNA, 14 nt, Human
ugucucauccuccu

SEQ ID NO: 3691350 - RNA, 18 nt, Human
ugucucauccuccuggaa

SEQ ID NO: 3691351 - RNA, 20 nt, Human
ugucucaugugugcucuucu

SEQ ID NO: 3691352 - RNA, 23 nt, Human
ugucucauuuuaauguaaagauu

SEQ ID NO: 3691353 - RNA, 14 nt, Human
ugucuccacugugc

SEQ ID NO: 3691354 - RNA, 14 nt, Human
ugucuccagacccc

SEQ ID NO: 3691355 - RNA, 16 nt, Human
ugucuccagaccccca

SEQ ID NO: 3691356 - RNA, 23 nt, Human
ugucuccccuguuccccucuccc

SEQ ID NO: 3691357 - RNA, 24 nt, Human
ugucucccgccccccacacuuccc

SEQ ID NO: 3691358 - RNA, 23 nt, Human
ugucucccuauaaugcuggagcg

SEQ ID NO: 3691359 - RNA, 14 nt, Human
ugucucccuggccc

SEQ ID NO: 3691360 - RNA, 16 nt, Human
ugucuccuacugagga

SEQ ID NO: 3691361 - RNA, 22 nt, Human
ugucuccuauauauuucuauua

SEQ ID NO: 3691362 - RNA, 21 nt, Human
ugucuccucuauccugggcuu

SEQ ID NO: 3691363 - RNA, 11 nt, Human
ugucuccuggc

SEQ ID NO: 3691364 - RNA, 18 nt, Human
ugucucgagcgcccugca

SEQ ID NO: 3691365 - RNA, 19 nt, Human
ugucucgagcgcccugcag

SEQ ID NO: 3691366 - RNA, 20 nt, Human
ugucucgugguaggacugua

SEQ ID NO: 3691367 - RNA, 21 nt, Human
ugucucgugguaggacuguag

SEQ ID NO: 3691368 - RNA, 19 nt, Human
ugucucuagccacuuuggu

SEQ ID NO: 3691369 - RNA, 13 nt, Human
ugucucucagaau

SEQ ID NO: 3691370 - RNA, 20 nt, Human
ugucucuccuuuucuuuugu

SEQ ID NO: 3691371 - RNA, 22 nt, Human
ugucucuccuuuucuuuuguua

SEQ ID NO: 3691372 - RNA, 18 nt, Human
ugucucucuucucagagu

SEQ ID NO: 3691373 - RNA, 16 nt, Human
ugucucugaagcguga

SEQ ID NO: 3691374 - RNA, 13 nt, Human
ugucucugagagu

SEQ ID NO: 3691375 - RNA, 17 nt, Human
ugucucugccucccuca

SEQ ID NO: 3691376 - RNA, 22 nt, Human
ugucucugccucccucacccug

SEQ ID NO: 3691377 - RNA, 13 nt, Human
ugucucuggccug

SEQ ID NO: 3691378 - RNA, 16 nt, Human
ugucucugucauggua

SEQ ID NO: 3691379 - RNA, 13 nt, Human
ugucucuuccaua

SEQ ID NO: 3691380 - RNA, 13 nt, Human
ugucucuugaaaa

SEQ ID NO: 3691381 - RNA, 15 nt, Human
ugucucuugaaaaau

SEQ ID NO: 3691382 - RNA, 14 nt, Human
ugucucuugaguuu

SEQ ID NO: 3691383 - RNA, 19 nt, Human
ugucucuugguccugcugc

SEQ ID NO: 3691384 - RNA, 23 nt, Human
ugucucuuuggcgaccuccuuuc

SEQ ID NO: 3691385 - RNA, 17 nt, Human
ugucucuuuuuuaaguu

SEQ ID NO: 3691386 - RNA, 12 nt, Human
ugucugaaaaau

SEQ ID NO: 3691387 - RNA, 18 nt, Human
ugucugaacuugcauugu

SEQ ID NO: 3691388 - RNA, 17 nt, Human
ugucugaaggacacuuc

SEQ ID NO: 3691389 - RNA, 19 nt, Human
ugucugaaggacacuuccu

SEQ ID NO: 3691390 - RNA, 23 nt, Human
ugucugaaggacacuuccugccu

SEQ ID NO: 3691391 - RNA, 18 nt, Human
ugucugaagucacugcac

SEQ ID NO: 3691392 - RNA, 19 nt, Human
ugucugaagucacugcaca

SEQ ID NO: 3691393 - RNA, 22 nt, Human
ugucugaaucgagugagacaaa

SEQ ID NO: 3691394 - RNA, 20 nt, Human
ugucugagacagaaucucag

SEQ ID NO: 3691395 - RNA, 18 nt, Human
ugucugagcccucaaagu

SEQ ID NO: 3691396 - RNA, 20 nt, Human
ugucugagcccucaaaguga

SEQ ID NO: 3691397 - RNA, 14 nt, Human
ugucugagugaacc

SEQ ID NO: 3691398 - RNA, 15 nt, Human
ugucugagugaaccu

SEQ ID NO: 3691399 - RNA, 20 nt, Human
ugucugagugaaccuguaua

SEQ ID NO: 3691400 - RNA, 21 nt, Human
ugucugagugaaccuguauaa

SEQ ID NO: 3691401 - RNA, 21 nt, Human
ugucugauuggcuuguagaau

SEQ ID NO: 3691402 - RNA, 23 nt, Human
ugucugauuggcuuguagaauug

SEQ ID NO: 3691403 - RNA, 21 nt, Human
ugucugcacaccuugaaucug

SEQ ID NO: 3691404 - RNA, 15 nt, Human
ugucugcacccaggg

SEQ ID NO: 3691405 - RNA, 18 nt, Human
ugucugcaggauugauua

SEQ ID NO: 3691406 - RNA, 13 nt, Human
ugucugcauuucg

SEQ ID NO: 3691407 - RNA, 15 nt, Human
ugucugccaaccuaa

SEQ ID NO: 3691408 - RNA, 16 nt, Human
ugucugccaauuuuug

SEQ ID NO: 3691409 - RNA, 18 nt, Human
ugucugccacauuaacua

SEQ ID NO: 3691410 - RNA, 18 nt, Human
ugucugccagccagcagc

SEQ ID NO: 3691411 - RNA, 19 nt, Human
ugucugccccagcccagau

SEQ ID NO: 3691412 - RNA, 14 nt, Human
ugucugccucuuag

SEQ ID NO: 3691413 - RNA, 15 nt, Human
ugucugcgaaguccu

SEQ ID NO: 3691414 - RNA, 23 nt, Human
ugucugcgaaguccuauggaaac

SEQ ID NO: 3691415 - RNA, 17 nt, Human
ugucugcuccagcucug

SEQ ID NO: 3691416 - RNA, 23 nt, Human
ugucugcuggucacuucuucugu

SEQ ID NO: 3691417 - RNA, 15 nt, Human
ugucuggaauugugg

SEQ ID NO: 3691418 - RNA, 12 nt, Human
ugucuggagacc

SEQ ID NO: 3691419 - RNA, 13 nt, Human
ugucuggagacca

SEQ ID NO: 3691420 - RNA, 17 nt, Human
ugucuggagaccaccag

SEQ ID NO: 3691421 - RNA, 20 nt, Human
ugucuggaucaguaaaauua

SEQ ID NO: 3691422 - RNA, 21 nt, Human
ugucuggaucaguaaaauuau

SEQ ID NO: 3691423 - RNA, 15 nt, Human
ugucuggcaaugcca

SEQ ID NO: 3691424 - RNA, 22 nt, Human
ugucuggcaaugccacagcccu

SEQ ID NO: 3691425 - RNA, 20 nt, Human
ugucuggcacagccugcacu

SEQ ID NO: 3691426 - RNA, 19 nt, Human
ugucuggcugaggauuuca

SEQ ID NO: 3691427 - RNA, 14 nt, Human
ugucuggcugcaga

SEQ ID NO: 3691428 - RNA, 21 nt, Human
ugucuggggagcgggucugcu

SEQ ID NO: 3691429 - RNA, 14 nt, Human
ugucuggggcagaa

SEQ ID NO: 3691430 - RNA, 20 nt, Human
ugucugggugcuacugggga

SEQ ID NO: 3691431 - RNA, 16 nt, Human
ugucuggguuugagaa

SEQ ID NO: 3691432 - RNA, 14 nt, Human
ugucugguggcccc

SEQ ID NO: 3691433 - RNA, 14 nt, Human
ugucugguuaaaaa

SEQ ID NO: 3691434 - RNA, 16 nt, Human
ugucugguuuuaacaa

SEQ ID NO: 3691435 - RNA, 12 nt, Human
ugucuguaaaua

SEQ ID NO: 3691436 - RNA, 21 nt, Human
ugucuguaaaucuaacauuau

SEQ ID NO: 3691437 - RNA, 13 nt, Human
ugucuguacacgu

SEQ ID NO: 3691438 - RNA, 19 nt, Human
ugucuguacacguguccug

SEQ ID NO: 3691439 - RNA, 14 nt, Human
ugucuguauuucau

SEQ ID NO: 3691440 - RNA, 20 nt, Human
ugucuguauuucauguggcu

SEQ ID NO: 3691441 - RNA, 21 nt, Human
ugucugucccgggguccugug

SEQ ID NO: 3691442 - RNA, 14 nt, Human
ugucuguccuuuau

SEQ ID NO: 3691443 - RNA, 14 nt, Human
ugucugucuggcac

SEQ ID NO: 3691444 - RNA, 16 nt, Human
ugucugucugguccau

SEQ ID NO: 3691445 - RNA, 15 nt, Human
ugucugucuguccca

SEQ ID NO: 3691446 - RNA, 15 nt, Human
ugucugucugucugu

SEQ ID NO: 3691447 - RNA, 15 nt, Human
ugucugugucagccu

SEQ ID NO: 3691448 - RNA, 20 nt, Human
ugucuguguuuugaaagaau

SEQ ID NO: 3691449 - RNA, 11 nt, Human
ugucuguuaca

SEQ ID NO: 3691450 - RNA, 17 nt, Human
ugucuguuacacuggag

SEQ ID NO: 3691451 - RNA, 19 nt, Human
ugucuguuaccaugucacu

SEQ ID NO: 3691452 - RNA, 15 nt, Human
ugucuguucuacaua

SEQ ID NO: 3691453 - RNA, 16 nt, Human
ugucuguuguauucau

SEQ ID NO: 3691454 - RNA, 15 nt, Human
ugucuguuuaagaaa

SEQ ID NO: 3691455 - RNA, 13 nt, Human
ugucuguuuguuu

SEQ ID NO: 3691456 - RNA, 23 nt, Human
ugucuguuuguuucaagaaccug

SEQ ID NO: 3691457 - RNA, 16 nt, Human
ugucuguuuuaaaaac

SEQ ID NO: 3691458 - RNA, 14 nt, Human
ugucuuaaauaaaa

SEQ ID NO: 3691459 - RNA, 20 nt, Human
ugucuuaaauaaaagaaaug

SEQ ID NO: 3691460 - RNA, 15 nt, Human
ugucuuaaugaaguu

SEQ ID NO: 3691461 - RNA, 19 nt, Human
ugucuuaaugaaguuugaa

SEQ ID NO: 3691462 - RNA, 22 nt, Human
ugucuuaaugaaguuugaaugu

SEQ ID NO: 3691463 - RNA, 16 nt, Human
ugucuuaauggaugaa

SEQ ID NO: 3691464 - RNA, 13 nt, Human
ugucuuaauuaag

SEQ ID NO: 3691465 - RNA, 16 nt, Human
ugucuuaauuaaguaa

SEQ ID NO: 3691466 - RNA, 18 nt, Human
ugucuuaauuaaguaaac

SEQ ID NO: 3691467 - RNA, 22 nt, Human
ugucuuaauuaaguaaacuaau

SEQ ID NO: 3691468 - RNA, 15 nt, Human
ugucuuaauuauuau

SEQ ID NO: 3691469 - RNA, 18 nt, Human
ugucuuaauuuucuuuca

SEQ ID NO: 3691470 - RNA, 14 nt, Human
ugucuuauauagca

SEQ ID NO: 3691471 - RNA, 17 nt, Human
ugucuuauuuuuagaug

SEQ ID NO: 3691472 - RNA, 13 nt, Human
ugucuucaccuga

SEQ ID NO: 3691473 - RNA, 24 nt, Human
ugucuucaccugauucaacuaaaa

SEQ ID NO: 3691474 - RNA, 22 nt, Human
ugucuucagccucuccaggcac

SEQ ID NO: 3691475 - RNA, 15 nt, Human
ugucuucauaaagua

SEQ ID NO: 3691476 - RNA, 21 nt, Human
ugucuucauccuuagcaacag

SEQ ID NO: 3691477 - RNA, 15 nt, Human
ugucuucauguacau

SEQ ID NO: 3691478 - RNA, 13 nt, Human
ugucuuccauaau

SEQ ID NO: 3691479 - RNA, 17 nt, Human
ugucuuccauaauguau

SEQ ID NO: 3691480 - RNA, 16 nt, Human
ugucuuccauguaucu

SEQ ID NO: 3691481 - RNA, 18 nt, Human
ugucuuccauuccauugu

SEQ ID NO: 3691482 - RNA, 22 nt, Human
ugucuucccaggguagcccgcc

SEQ ID NO: 3691483 - RNA, 16 nt, Human
ugucuuccuauuucag

SEQ ID NO: 3691484 - RNA, 22 nt, Human
ugucuuccucaaaauaaagaag

SEQ ID NO: 3691485 - RNA, 14 nt, Human
uuagaaaccuuaau

SEQ ID NO: 3691486 - RNA, 13 nt, Human
uuagaaacuggaa

SEQ ID NO: 3691487 - RNA, 22 nt, Human
uuagaaagaagcccaauauuau

SEQ ID NO: 3691488 - RNA, 12 nt, Human
uuagaaagcauu

SEQ ID NO: 3691489 - RNA, 13 nt, Human
uuagaaagcauuu

SEQ ID NO: 3691490 - RNA, 21 nt, Human
uuagaaagcauuugaaugcau

SEQ ID NO: 3691491 - RNA, 23 nt, Human
uuagaaagcauuugaaugcauuu

SEQ ID NO: 3691492 - RNA, 22 nt, Human
uuagaaagcugacauugccaaa

SEQ ID NO: 3691493 - RNA, 17 nt, Human
uuagaaauaaagcaucu

SEQ ID NO: 3691494 - RNA, 16 nt, Human
uuagaaauaacagaag

SEQ ID NO: 3691495 - RNA, 14 nt, Human
uuagaaauauaauu

SEQ ID NO: 3691496 - RNA, 22 nt, Human
uuagaaauauuuuaaaaucagc

SEQ ID NO: 3691497 - RNA, 18 nt, Human
uuagaaaugaccaauauu

SEQ ID NO: 3691498 - RNA, 17 nt, Human
uuagaacacuauuuuca

SEQ ID NO: 3691499 - RNA, 20 nt, Human
uuagaacacugguuuaaagg

SEQ ID NO: 3691500 - RNA, 16 nt, Human
uuagaacagaaaacaa

SEQ ID NO: 3691501 - RNA, 22 nt, Human
uuagaacaggcaagugaagaaa

SEQ ID NO: 3691502 - RNA, 13 nt, Human
uuagaacagguuu

SEQ ID NO: 3691503 - RNA, 12 nt, Human
uuagaacauuuu

SEQ ID NO: 3691504 - RNA, 18 nt, Human
uuagaacauuuuaauuca

SEQ ID NO: 3691505 - RNA, 16 nt, Human
uuagaagaaguguguc

SEQ ID NO: 3691506 - RNA, 18 nt, Human
uuagaagauauuagucuu

SEQ ID NO: 3691507 - RNA, 13 nt, Human
uuagaagccugca

SEQ ID NO: 3691508 - RNA, 16 nt, Human
uuagaagucacacagu

SEQ ID NO: 3691509 - RNA, 17 nt, Human
uuagaagugcauuucug

SEQ ID NO: 3691510 - RNA, 17 nt, Human
uuagaagugucauguuu

SEQ ID NO: 3691511 - RNA, 16 nt, Human
uuagaauaaauuccca

SEQ ID NO: 3691512 - RNA, 19 nt, Human
uuagaauaagaauuugcau

SEQ ID NO: 3691513 - RNA, 21 nt, Human
uuagaaucagccuugaaacau

SEQ ID NO: 3691514 - RNA, 22 nt, Human
uuagaauccaaacuuggauuuu

SEQ ID NO: 3691515 - RNA, 23 nt, Human
uuagaaucccuguguuaauuuaa

SEQ ID NO: 3691516 - RNA, 23 nt, Human
uuagaaucuauuuucuauguacu

SEQ ID NO: 3691517 - RNA, 12 nt, Human
uuagaaugaaaa

SEQ ID NO: 3691518 - RNA, 13 nt, Human
uuagaauguugaa

SEQ ID NO: 3691519 - RNA, 13 nt, Human
uuagaauuaaaaa

SEQ ID NO: 3691520 - RNA, 17 nt, Human
uuagaauuaccauuugu

SEQ ID NO: 3691521 - RNA, 23 nt, Human
uuagaauuaguggcacuugcuuu

SEQ ID NO: 3691522 - RNA, 12 nt, Human
uuagaauuauuu

SEQ ID NO: 3691523 - RNA, 15 nt, Human
uuagaauuauuuaaa

SEQ ID NO: 3691524 - RNA, 16 nt, Human
uuagaauuauuuaaac

SEQ ID NO: 3691525 - RNA, 18 nt, Human
uuagaauuccuucagggu

SEQ ID NO: 3691526 - RNA, 17 nt, Human
uuagaauucuguauaga

SEQ ID NO: 3691527 - RNA, 18 nt, Human
uuagaauugaagguuuuu

SEQ ID NO: 3691528 - RNA, 19 nt, Human
uuagaauuuugugaaacag

SEQ ID NO: 3691529 - RNA, 20 nt, Human
uuagacaaauacucaugugu

SEQ ID NO: 3691530 - RNA, 21 nt, Human
uuagacaaauacucaugugua

SEQ ID NO: 3691531 - RNA, 17 nt, Human
uuagacaccuucauuuu

SEQ ID NO: 3691532 - RNA, 22 nt, Human
uuagacagaacaccuaugcaaa

SEQ ID NO: 3691533 - RNA, 13 nt, Human
uuagacagagucu

SEQ ID NO: 3691534 - RNA, 13 nt, Human
uuagaccaaggaa

SEQ ID NO: 3691535 - RNA, 15 nt, Human
uuagaccacaaauag

SEQ ID NO: 3691536 - RNA, 16 nt, Human
uuagaccaccaagccu

SEQ ID NO: 3691537 - RNA, 21 nt, Human
uuagacucaucaaucaaauaa

SEQ ID NO: 3691538 - RNA, 19 nt, Human
uuagacucaucuuacugua

SEQ ID NO: 3691539 - RNA, 21 nt, Human
uuagacucaugguguguuaca

SEQ ID NO: 3691540 - RNA, 13 nt, Human
uuagacuccuccu

SEQ ID NO: 3691541 - RNA, 17 nt, Human
uuagacucuuuuccuuc

SEQ ID NO: 3691542 - RNA, 16 nt, Human
uuagacugccagcucu

SEQ ID NO: 3691543 - RNA, 15 nt, Human
uuagacuggacagcu

SEQ ID NO: 3691544 - RNA, 16 nt, Human
uuagacuggacagcuu

SEQ ID NO: 3691545 - RNA, 20 nt, Human
uuagacuguagccuggauau

SEQ ID NO: 3691546 - RNA, 23 nt, Human
uuagacuguaggaagaguagcau

SEQ ID NO: 3691547 - RNA, 15 nt, Human
uuagacuuacuauua

SEQ ID NO: 3691548 - RNA, 14 nt, Human
uuagacuucuguuu

SEQ ID NO: 3691549 - RNA, 15 nt, Human
uuagacuucuguuuu

SEQ ID NO: 3691550 - RNA, 19 nt, Human
uuagacuucuguuuucaau

SEQ ID NO: 3691551 - RNA, 20 nt, Human
uuagacuugaaaagagacag

SEQ ID NO: 3691552 - RNA, 22 nt, Human
uuagacuuuaacauaagcuauu

SEQ ID NO: 3691553 - RNA, 13 nt, Human
uuagagaaaacua

SEQ ID NO: 3691554 - RNA, 18 nt, Human
uuagagaguguugaaacg

SEQ ID NO: 3691555 - RNA, 15 nt, Human
uuagagauaagaguu

SEQ ID NO: 3691556 - RNA, 21 nt, Human
uuagagcagaugaccccuccc

SEQ ID NO: 3691557 - RNA, 15 nt, Human
uuagagcauugccau

SEQ ID NO: 3691558 - RNA, 16 nt, Human
uuagagccaggcacac

SEQ ID NO: 3691559 - RNA, 22 nt, Human
uuagagccaggcacacacugug

SEQ ID NO: 3691560 - RNA, 14 nt, Human
uuagagccucccuc

SEQ ID NO: 3691561 - RNA, 19 nt, Human
uuagaggaaaaaaaugacu

SEQ ID NO: 3691562 - RNA, 18 nt, Human
uuagagggaggagaauga

SEQ ID NO: 3691563 - RNA, 18 nt, Human
uuagagggagguguuuaa

SEQ ID NO: 3691564 - RNA, 20 nt, Human
uuagagguuuuaaagugauu

SEQ ID NO: 3691565 - RNA, 22 nt, Human
uuagagucaacuacacaaagca

SEQ ID NO: 3691566 - RNA, 20 nt, Human
uuagaguccuaguuuuccua

SEQ ID NO: 3691567 - RNA, 13 nt, Human
uuagagugucuua

SEQ ID NO: 3691568 - RNA, 12 nt, Human
uuagaguuagac

SEQ ID NO: 3691569 - RNA, 13 nt, Human
uuagaguuagacu

SEQ ID NO: 3691570 - RNA, 13 nt, Human
uuagaguuucugu

SEQ ID NO: 3691571 - RNA, 17 nt, Human
uuagaguuucuguuuga

SEQ ID NO: 3691572 - RNA, 15 nt, Human
uuagauaaauauuga

SEQ ID NO: 3691573 - RNA, 15 nt, Human
uuagaucauaguuuu

SEQ ID NO: 3691574 - RNA, 19 nt, Human
uuagaugcauauuacugua

SEQ ID NO: 3691575 - RNA, 16 nt, Human
uuagauggauucucca

SEQ ID NO: 3691576 - RNA, 15 nt, Human
uuagaugugagaaaa

SEQ ID NO: 3691577 - RNA, 13 nt, Human
uuagaugugauuu

SEQ ID NO: 3691578 - RNA, 20 nt, Human
uuagaugugauuuaauagug

SEQ ID NO: 3691579 - RNA, 21 nt, Human
uuagaugugauuuaauagugu

SEQ ID NO: 3691580 - RNA, 16 nt, Human
uuagaugugcugcuuu

SEQ ID NO: 3691581 - RNA, 20 nt, Human
uuagauguucucuaucauuu

SEQ ID NO: 3691582 - RNA, 22 nt, Human
uuagauguucucuaucauuuaa

SEQ ID NO: 3691583 - RNA, 19 nt, Human
uuagauguugccauguguu

SEQ ID NO: 3691584 - RNA, 14 nt, Human
uuagauuagcucug

SEQ ID NO: 3691585 - RNA, 14 nt, Human
uuagauuauugaaa

SEQ ID NO: 3691586 - RNA, 20 nt, Human
uuagauucucugugucuaag

SEQ ID NO: 3691587 - RNA, 22 nt, Human
uuagauucucugugucuaagau

SEQ ID NO: 3691588 - RNA, 19 nt, Human
uuagauugagaaaugugua

SEQ ID NO: 3691589 - RNA, 13 nt, Human
uuagauuguaaac

SEQ ID NO: 3691590 - RNA, 10 nt, Human
uuagauuuca

SEQ ID NO: 3691591 - RNA, 21 nt, Human
uuagauuucucacacucuaac

SEQ ID NO: 3691592 - RNA, 16 nt, Human
uuagauuugccauaga

SEQ ID NO: 3691593 - RNA, 13 nt, Human
uuagauuuuaauc

SEQ ID NO: 3691594 - RNA, 20 nt, Human
uuagauuuucugguucuaac

SEQ ID NO: 3691595 - RNA, 14 nt, Human
uuagcaaaaaaagu

SEQ ID NO: 3691596 - RNA, 16 nt, Human
uuagcaaaaaaaguug

SEQ ID NO: 3691597 - RNA, 13 nt, Human
uuagcaaagaguu

SEQ ID NO: 3691598 - RNA, 20 nt, Human
uuagcaaagaguuaauauau

SEQ ID NO: 3691599 - RNA, 18 nt, Human
uuagcaaauucuguuuuu

SEQ ID NO: 3691600 - RNA, 17 nt, Human
uuagcacaaaaaaaauu

SEQ ID NO: 3691601 - RNA, 20 nt, Human
uuagcacagauuuuaauugu

SEQ ID NO: 3691602 - RNA, 21 nt, Human
uuagcacuguugauguaucug

SEQ ID NO: 3691603 - RNA, 12 nt, Human
uuagcagacagg

SEQ ID NO: 3691604 - RNA, 20 nt, Human
uuagcaggagaggagagcca

SEQ ID NO: 3691605 - RNA, 19 nt, Human
uuagcaggccaaggucuga

SEQ ID NO: 3691606 - RNA, 16 nt, Human
uuagcaguaaaauagc

SEQ ID NO: 3691607 - RNA, 17 nt, Human
uuagcagugauuuuuau

SEQ ID NO: 3691608 - RNA, 21 nt, Human
uuagcaguucugcaaauagaa

SEQ ID NO: 3691609 - RNA, 21 nt, Human
uuagcaugacaagccccaggc

SEQ ID NO: 3691610 - RNA, 15 nt, Human
uuagcaugcacaaag

SEQ ID NO: 3691611 - RNA, 20 nt, Human
uuagcauuuucugcaucucc

SEQ ID NO: 3691612 - RNA, 13 nt, Human
uuagccacaaaau

SEQ ID NO: 3691613 - RNA, 17 nt, Human
uuagccagauuugucuu

SEQ ID NO: 3691614 - RNA, 15 nt, Human
uuagccaguaauccu

SEQ ID NO: 3691615 - RNA, 14 nt, Human
uuagccccauaauu

SEQ ID NO: 3691616 - RNA, 13 nt, Human
uuagcccccaccc

SEQ ID NO: 3691617 - RNA, 15 nt, Human
uuagcccugaacauu

SEQ ID NO: 3691618 - RNA, 15 nt, Human
uuagccuaagauaua

SEQ ID NO: 3691619 - RNA, 16 nt, Human
uuagccuaagauauac

SEQ ID NO: 3691620 - RNA, 15 nt, Human
uuagccucccugaaa

SEQ ID NO: 3691621 - RNA, 12 nt, Human
uuagccuggagc

SEQ ID NO: 3691622 - RNA, 23 nt, Human
uuagccuggagcaccuuuccuuc

SEQ ID NO: 3691623 - RNA, 22 nt, Human
uuagccuguggcaguaaagaga

SEQ ID NO: 3691624 - RNA, 15 nt, Human
uuagcuaauaaaaag

SEQ ID NO: 3691625 - RNA, 12 nt, Human
uuagcucagccc

SEQ ID NO: 3691626 - RNA, 13 nt, Human
uuagcucagcccc

SEQ ID NO: 3691627 - RNA, 20 nt, Human
uuagcucccuguucuugggu

SEQ ID NO: 3691628 - RNA, 13 nt, Human
uuagcucugagaa

SEQ ID NO: 3691629 - RNA, 19 nt, Human
uuagcucuggaccagccug

SEQ ID NO: 3691630 - RNA, 15 nt, Human
uuagcugacaaaaua

SEQ ID NO: 3691631 - RNA, 18 nt, Human
uuagcugacaaaauacuu

SEQ ID NO: 3691632 - RNA, 10 nt, Human
uuagcugagc

SEQ ID NO: 3691633 - RNA, 13 nt, Human
uuagcugcagaac

SEQ ID NO: 3691634 - RNA, 12 nt, Human
uuagcugcuucu

SEQ ID NO: 3691635 - RNA, 20 nt, Human
uuagcugcuucuauguuuca

SEQ ID NO: 3691636 - RNA, 22 nt, Human
uaauaauuuagacuucaagcau

SEQ ID NO: 3691637 - RNA, 16 nt, Human
uaauaauuucuaaugu

SEQ ID NO: 3691638 - RNA, 20 nt, Human
uaauaauuuuuaagaaauaa

SEQ ID NO: 3691639 - RNA, 15 nt, Human
uaauacaaacuauau

SEQ ID NO: 3691640 - RNA, 22 nt, Human
uaauacaacauguagcugaguu

SEQ ID NO: 3691641 - RNA, 14 nt, Human
uaauacaagguaua

SEQ ID NO: 3691642 - RNA, 19 nt, Human
uaauacaagguauaauaaa

SEQ ID NO: 3691643 - RNA, 15 nt, Human
uaauacacacaguua

SEQ ID NO: 3691644 - RNA, 14 nt, Human
uaauacaccacuac

SEQ ID NO: 3691645 - RNA, 16 nt, Human
uaauacaccacuacau

SEQ ID NO: 3691646 - RNA, 21 nt, Human
uaauacaccacuacauucugu

SEQ ID NO: 3691647 - RNA, 23 nt, Human
uaauacaccacuacauucuguua

SEQ ID NO: 3691648 - RNA, 18 nt, Human
uaauacacuugcccugcu

SEQ ID NO: 3691649 - RNA, 22 nt, Human
uaauacagcaacaauuuaugaa

SEQ ID NO: 3691650 - RNA, 22 nt, Human
uaauacaggauuauuuugauua

SEQ ID NO: 3691651 - RNA, 18 nt, Human
uaauacauuaaagcaguc

SEQ ID NO: 3691652 - RNA, 16 nt, Human
uaauacauuauauuuc

SEQ ID NO: 3691653 - RNA, 21 nt, Human
uaauaccucuaauaguauaaa

SEQ ID NO: 3691654 - RNA, 15 nt, Human
uaauaccucugugug

SEQ ID NO: 3691655 - RNA, 22 nt, Human
uaauacgcaggcaucugauuug

SEQ ID NO: 3691656 - RNA, 13 nt, Human
uaauacuaaaaua

SEQ ID NO: 3691657 - RNA, 18 nt, Human
uaauacuaaaauaugucu

SEQ ID NO: 3691658 - RNA, 12 nt, Human
uaauacuauauu

SEQ ID NO: 3691659 - RNA, 16 nt, Human
uaauacucaaaugagu

SEQ ID NO: 3691660 - RNA, 21 nt, Human
uaauacucaaaugaguaacau

SEQ ID NO: 3691661 - RNA, 13 nt, Human
uaauacucuauuu

SEQ ID NO: 3691662 - RNA, 19 nt, Human
uaauacugaaccacuugua

SEQ ID NO: 3691663 - RNA, 21 nt, Human
uaauacugaaccacuuguaga

SEQ ID NO: 3691664 - RNA, 22 nt, Human
uaauacugaaccacuuguagau

SEQ ID NO: 3691665 - RNA, 14 nt, Human
uaauacugcugaga

SEQ ID NO: 3691666 - RNA, 23 nt, Human
uaauacugcugagauacauacag

SEQ ID NO: 3691667 - RNA, 13 nt, Human
uaauacuguuauu

SEQ ID NO: 3691668 - RNA, 17 nt, Human
uaauacuguuauucuuu

SEQ ID NO: 3691669 - RNA, 18 nt, Human
uaauacuugcuuuggaaa

SEQ ID NO: 3691670 - RNA, 20 nt, Human
uaauacuuuuuuauuuuguu

SEQ ID NO: 3691671 - RNA, 15 nt, Human
uaauagaaaacugaa

SEQ ID NO: 3691672 - RNA, 19 nt, Human
uaauagaaaacugaaaauc

SEQ ID NO: 3691673 - RNA, 12 nt, Human
uaauagaagaac

SEQ ID NO: 3691674 - RNA, 21 nt, Human
uaauagaagaacauccaagga

SEQ ID NO: 3691675 - RNA, 22 nt, Human
uaauagacuguaacuuccaaau

SEQ ID NO: 3691676 - RNA, 14 nt, Human
uaauagauguuuga

SEQ ID NO: 3691677 - RNA, 16 nt, Human
uaauagauguuugaua

SEQ ID NO: 3691678 - RNA, 22 nt, Human
uaauagcggguuacuuucacau

SEQ ID NO: 3691679 - RNA, 11 nt, Human
uaauagcugua

SEQ ID NO: 3691680 - RNA, 21 nt, Human
uaauagcuuuuauuguauaaa

SEQ ID NO: 3691681 - RNA, 18 nt, Human
uaauaggcucugccugac

SEQ ID NO: 3691682 - RNA, 18 nt, Human
uaauagggaaaauucuaa

SEQ ID NO: 3691683 - RNA, 15 nt, Human
uaauagggaauauau

SEQ ID NO: 3691684 - RNA, 14 nt, Human
uaauagguuuggac

SEQ ID NO: 3691685 - RNA, 19 nt, Human
uaauagguuuggacaaaau

SEQ ID NO: 3691686 - RNA, 18 nt, Human
uaauaguaauuuguaaag

SEQ ID NO: 3691687 - RNA, 21 nt, Human
uaauaguaauuuguaaaguug

SEQ ID NO: 3691688 - RNA, 14 nt, Human
uaauaguauaaacc

SEQ ID NO: 3691689 - RNA, 21 nt, Human
uaauagugcuuaaaaaucauu

SEQ ID NO: 3691690 - RNA, 21 nt, Human
uaauaguguuaaucaauuuaa

SEQ ID NO: 3691691 - RNA, 19 nt, Human
uaauaguuuacauguagua

SEQ ID NO: 3691692 - RNA, 21 nt, Human
uaauauaaaaagcuuccauga

SEQ ID NO: 3691693 - RNA, 21 nt, Human
uaauauaaaguaguccuguga

SEQ ID NO: 3691694 - RNA, 14 nt, Human
uaauauaaaugcaa

SEQ ID NO: 3691695 - RNA, 16 nt, Human
uaauauaaaugcaaau

SEQ ID NO: 3691696 - RNA, 16 nt, Human
uaauauaacugccuua

SEQ ID NO: 3691697 - RNA, 21 nt, Human
uaauauaacugccuuaaaacu

SEQ ID NO: 3691698 - RNA, 23 nt, Human
uaauauaacugccuuaaaacuuu

SEQ ID NO: 3691699 - RNA, 18 nt, Human
uaauauaauggaagagaa

SEQ ID NO: 3691700 - RNA, 21 nt, Human
uaauauaccagcuuguaugca

SEQ ID NO: 3691701 - RNA, 13 nt, Human
uaauauacuugug

SEQ ID NO: 3691702 - RNA, 15 nt, Human
uaauauacuugugga

SEQ ID NO: 3691703 - RNA, 12 nt, Human
uaauauagaaaa

SEQ ID NO: 3691704 - RNA, 23 nt, Human
uaauauagaaaaaaacauucuau

SEQ ID NO: 3691705 - RNA, 17 nt, Human
uaauauauaucugcugu

SEQ ID NO: 3691706 - RNA, 14 nt, Human
uaauauauuuccau

SEQ ID NO: 3691707 - RNA, 17 nt, Human
uaauaucacucauuaau

SEQ ID NO: 3691708 - RNA, 21 nt, Human
uaauaucacucauuaauuaac

SEQ ID NO: 3691709 - RNA, 22 nt, Human
uaauauccaggucaacagaaug

SEQ ID NO: 3691710 - RNA, 15 nt, Human
uaauauccuaaacau

SEQ ID NO: 3691711 - RNA, 17 nt, Human
uaauauccuaaacauca

SEQ ID NO: 3691712 - RNA, 16 nt, Human
uaauaucuaaaguuau

SEQ ID NO: 3691713 - RNA, 12 nt, Human
uaauaugagaau

SEQ ID NO: 3691714 - RNA, 15 nt, Human
uaauaugaugacugu

SEQ ID NO: 3691715 - RNA, 16 nt, Human
uaauaugcacacauuu

SEQ ID NO: 3691716 - RNA, 18 nt, Human
uaauauggcaaaaauggc

SEQ ID NO: 3691717 - RNA, 21 nt, Human
uaauauggcuaugcuuaaaag

SEQ ID NO: 3691718 - RNA, 19 nt, Human
uaauauguauuuuauguau

SEQ ID NO: 3691719 - RNA, 21 nt, Human
uaauauguauuuuauguaugu

SEQ ID NO: 3691720 - RNA, 20 nt, Human
uaauauguucuuuuaaauga

SEQ ID NO: 3691721 - RNA, 12 nt, Human
uaauauuaaaag

SEQ ID NO: 3691722 - RNA, 18 nt, Human
uaauauuaaaagucacaa

SEQ ID NO: 3691723 - RNA, 15 nt, Human
uaauauuaaagccau

SEQ ID NO: 3691724 - RNA, 20 nt, Human
uaauauuaaggaagacaaug

SEQ ID NO: 3691725 - RNA, 16 nt, Human
uaauauucauuguaua

SEQ ID NO: 3691726 - RNA, 14 nt, Human
uaauauucugcuau

SEQ ID NO: 3691727 - RNA, 14 nt, Human
uaauauucuuucaa

SEQ ID NO: 3691728 - RNA, 17 nt, Human
uaauauucuuucaauaa

SEQ ID NO: 3691729 - RNA, 20 nt, Human
uaauauucuuucaauaacga

SEQ ID NO: 3691730 - RNA, 20 nt, Human
uaauauugaaaauugaaaag

SEQ ID NO: 3691731 - RNA, 19 nt, Human
uaauauugagaaagaaacu

SEQ ID NO: 3691732 - RNA, 16 nt, Human
uaauauuguggugcca

SEQ ID NO: 3691733 - RNA, 18 nt, Human
uaauauuguuguauaauu

SEQ ID NO: 3691734 - RNA, 21 nt, Human
uaauauuguuguauaauuucg

SEQ ID NO: 3691735 - RNA, 23 nt, Human
uaauauuguuuuucuuucuacaa

SEQ ID NO: 3691736 - RNA, 21 nt, Human
uaauauuuaaacagcaguguu

SEQ ID NO: 3691737 - RNA, 20 nt, Human
uaauauuuacaauguauuaa

SEQ ID NO: 3691738 - RNA, 16 nt, Human
uaauauuuauuaaauu

SEQ ID NO: 3691739 - RNA, 17 nt, Human
uaauauuuauuaaauuu

SEQ ID NO: 3691740 - RNA, 15 nt, Human
uaauauuuauugcuu

SEQ ID NO: 3691741 - RNA, 18 nt, Human
uaauauuuauugcuuuau

SEQ ID NO: 3691742 - RNA, 20 nt, Human
uaauauuuauugcuuuauaa

SEQ ID NO: 3691743 - RNA, 18 nt, Human
uaauauuucuucaaauau

SEQ ID NO: 3691744 - RNA, 16 nt, Human
uaauauuuuacauaca

SEQ ID NO: 3691745 - RNA, 21 nt, Human
uaauauuuuccuccugagugc

SEQ ID NO: 3691746 - RNA, 14 nt, Human
uaauauuuuuaauu

SEQ ID NO: 3691747 - RNA, 23 nt, Human
uaaucaacauggcuacuugcuuu

SEQ ID NO: 3691748 - RNA, 18 nt, Human
uaaucaacugaaaguguu

SEQ ID NO: 3691749 - RNA, 14 nt, Human
uaaucaagagccuu

SEQ ID NO: 3691750 - RNA, 19 nt, Human
uaaucaagagccuuaaaac

SEQ ID NO: 3691751 - RNA, 20 nt, Human
uaaucaagagccuuaaaaca

SEQ ID NO: 3691752 - RNA, 14 nt, Human
uaaucaagccucug

SEQ ID NO: 3691753 - RNA, 17 nt, Human
uaaucaaugaauauuga

SEQ ID NO: 3691754 - RNA, 19 nt, Human
uaaucaaugaauauugaag

SEQ ID NO: 3691755 - RNA, 14 nt, Human
uuauccauaaaaaa

SEQ ID NO: 3691756 - RNA, 17 nt, Human
uuauccauauugaguca

SEQ ID NO: 3691757 - RNA, 19 nt, Human
uuauccauauugagucaaa

SEQ ID NO: 3691758 - RNA, 14 nt, Human
uuauccauuuguaa

SEQ ID NO: 3691759 - RNA, 15 nt, Human
uuauccauuuguaau

SEQ ID NO: 3691760 - RNA, 17 nt, Human
uuaucccaagaaugcaa

SEQ ID NO: 3691761 - RNA, 22 nt, Human
uuaucccacggaaaaugccaau

SEQ ID NO: 3691762 - RNA, 13 nt, Human
uuaucccucucca

SEQ ID NO: 3691763 - RNA, 23 nt, Human
uuaucccuuccuuuuagccuagu

SEQ ID NO: 3691764 - RNA, 20 nt, Human
uuauccuagcacaugcuuca

SEQ ID NO: 3691765 - RNA, 21 nt, Human
uuauccuagcacaugcuucaa

SEQ ID NO: 3691766 - RNA, 13 nt, Human
uuauccuauuuca

SEQ ID NO: 3691767 - RNA, 18 nt, Human
uuauccucccuguaacuu

SEQ ID NO: 3691768 - RNA, 14 nt, Human
uuauccucugaucu

SEQ ID NO: 3691769 - RNA, 15 nt, Human
uuauccucugaucuc

SEQ ID NO: 3691770 - RNA, 16 nt, Human
uuauccucugguuuaa

SEQ ID NO: 3691771 - RNA, 17 nt, Human
uuauccucuuuagaguu

SEQ ID NO: 3691772 - RNA, 19 nt, Human
uuaucgcccuggcaggcag

SEQ ID NO: 3691773 - RNA, 16 nt, Human
uuaucgggaacagugu

SEQ ID NO: 3691774 - RNA, 23 nt, Human
uuaucgggaacaguguuucccau

SEQ ID NO: 3691775 - RNA, 18 nt, Human
uuaucgggagcagugucu

SEQ ID NO: 3691776 - RNA, 19 nt, Human
uuaucgggagcagugucuu

SEQ ID NO: 3691777 - RNA, 23 nt, Human
uuaucgggagcagugucuuccau

SEQ ID NO: 3691778 - RNA, 21 nt, Human
uuaucuaaaagaaaugucuau

SEQ ID NO: 3691779 - RNA, 15 nt, Human
uuaucuaagaauaca

SEQ ID NO: 3691780 - RNA, 17 nt, Human
uuaucuaagaauacagc

SEQ ID NO: 3691781 - RNA, 19 nt, Human
uuaucuaauaccucugugu

SEQ ID NO: 3691782 - RNA, 20 nt, Human
uuaucuaauaccucugugug

SEQ ID NO: 3691783 - RNA, 18 nt, Human
uuaucuaaucaugaaacu

SEQ ID NO: 3691784 - RNA, 22 nt, Human
uuaucuaaucaugaaacucccu

SEQ ID NO: 3691785 - RNA, 16 nt, Human
uuaucuaauuuauaaa

SEQ ID NO: 3691786 - RNA, 14 nt, Human
uuaucuaccaacuu

SEQ ID NO: 3691787 - RNA, 20 nt, Human
uuaucuacuuccaaacuaau

SEQ ID NO: 3691788 - RNA, 16 nt, Human
uuaucuagauacugua

SEQ ID NO: 3691789 - RNA, 17 nt, Human
uuaucuagauguaaauu

SEQ ID NO: 3691790 - RNA, 22 nt, Human
uuaucuauaauuuaccuaagau

SEQ ID NO: 3691791 - RNA, 18 nt, Human
uuaucuauagcuaaguac

SEQ ID NO: 3691792 - RNA, 16 nt, Human
uuaucuauauaaaaua

SEQ ID NO: 3691793 - RNA, 20 nt, Human
uuaucuauucugagaaaaca

SEQ ID NO: 3691794 - RNA, 15 nt, Human
uuaucuauuguaaga

SEQ ID NO: 3691795 - RNA, 16 nt, Human
uuaucuauuguaagau

SEQ ID NO: 3691796 - RNA, 18 nt, Human
uuaucuauuguaagauaa

SEQ ID NO: 3691797 - RNA, 22 nt, Human
uuaucuauuuguauauauacau

SEQ ID NO: 3691798 - RNA, 22 nt, Human
uuaucucagucaugcauaaaua

SEQ ID NO: 3691799 - RNA, 20 nt, Human
uuaucugaauuuuuaaacaa

SEQ ID NO: 3691800 - RNA, 21 nt, Human
uuaucugaauuuuuaaacaag

SEQ ID NO: 3691801 - RNA, 18 nt, Human
uuaucugagcugagccag

SEQ ID NO: 3691802 - RNA, 18 nt, Human
uuaucugcaagugaggug

SEQ ID NO: 3691803 - RNA, 12 nt, Human
uuaucugggcuu

SEQ ID NO: 3691804 - RNA, 19 nt, Human
uuaucugugcgugaaacac

SEQ ID NO: 3691805 - RNA, 18 nt, Human
uuaucuguguuuuugaaa

SEQ ID NO: 3691806 - RNA, 15 nt, Human
uuaucuguucuuuug

SEQ ID NO: 3691807 - RNA, 22 nt, Human
uuaucuguuuccugacauuguc

SEQ ID NO: 3691808 - RNA, 16 nt, Human
uuaucuuacaaagugu

SEQ ID NO: 3691809 - RNA, 17 nt, Human
uuaucuuacaaagugua

SEQ ID NO: 3691810 - RNA, 21 nt, Human
uuaucuucugcucuuucuucu

SEQ ID NO: 3691811 - RNA, 14 nt, Human
uuaucuugaauaau

SEQ ID NO: 3691812 - RNA, 16 nt, Human
uuaucuugauacauuc

SEQ ID NO: 3691813 - RNA, 18 nt, Human
uuaucuugauacauucaa

SEQ ID NO: 3691814 - RNA, 19 nt, Human
uuaucuuggccuuacugua

SEQ ID NO: 3691815 - RNA, 14 nt, Human
uuaucuugggacug

SEQ ID NO: 3691816 - RNA, 16 nt, Human
uuaucuugucucuggg

SEQ ID NO: 3691817 - RNA, 17 nt, Human
uuaugaaaaagaagaau

SEQ ID NO: 3691818 - RNA, 19 nt, Human
uuaugaaaaagaagaaucu

SEQ ID NO: 3691819 - RNA, 13 nt, Human
uuaugaaaauaau

SEQ ID NO: 3691820 - RNA, 13 nt, Human
uuaugaaacuugu

SEQ ID NO: 3691821 - RNA, 16 nt, Human
uuaugaaacuugugua

SEQ ID NO: 3691822 - RNA, 18 nt, Human
uuaugaaacuuguguaaa

SEQ ID NO: 3691823 - RNA, 19 nt, Human
uuaugaaacuuguguaaau

SEQ ID NO: 3691824 - RNA, 17 nt, Human
uuaugaaacuuuuggaa

SEQ ID NO: 3691825 - RNA, 15 nt, Human
uuaugaacugcaugu

SEQ ID NO: 3691826 - RNA, 18 nt, Human
uuaugaagaaaaaauaca

SEQ ID NO: 3691827 - RNA, 16 nt, Human
uguggacuuuguucac

SEQ ID NO: 3691828 - RNA, 13 nt, Human
uguggagacugcu

SEQ ID NO: 3691829 - RNA, 18 nt, Human
uguggagacugcuccuga

SEQ ID NO: 3691830 - RNA, 17 nt, Human
uguggagagggaaugug

SEQ ID NO: 3691831 - RNA, 20 nt, Human
uguggagagggaaugugaaa

SEQ ID NO: 3691832 - RNA, 19 nt, Human
uguggagagugcaacagua

SEQ ID NO: 3691833 - RNA, 12 nt, Human
uguggagccagg

SEQ ID NO: 3691834 - RNA, 19 nt, Human
uguggagcccgcaccccca

SEQ ID NO: 3691835 - RNA, 19 nt, Human
uguggagccgaggccuacc

SEQ ID NO: 3691836 - RNA, 15 nt, Human
uguggagcucagccc

SEQ ID NO: 3691837 - RNA, 19 nt, Human
uguggaggcagugucauuu

SEQ ID NO: 3691838 - RNA, 19 nt, Human
uguggagggcacauuccuu

SEQ ID NO: 3691839 - RNA, 22 nt, Human
uguggagucagccucgcaggcc

SEQ ID NO: 3691840 - RNA, 16 nt, Human
uguggaguggggcagu

SEQ ID NO: 3691841 - RNA, 17 nt, Human
uguggaguucaucuuga

SEQ ID NO: 3691842 - RNA, 16 nt, Human
uguggauaacaaagau

SEQ ID NO: 3691843 - RNA, 17 nt, Human
uguggauaacaaagaua

SEQ ID NO: 3691844 - RNA, 18 nt, Human
uguggauaacaaagauau

SEQ ID NO: 3691845 - RNA, 14 nt, Human
uguggaucagagau

SEQ ID NO: 3691846 - RNA, 22 nt, Human
uguggauucugaggcccugccc

SEQ ID NO: 3691847 - RNA, 20 nt, Human
uguggauuuaacagaaaugu

SEQ ID NO: 3691848 - RNA, 14 nt, Human
uguggauuucaguu

SEQ ID NO: 3691849 - RNA, 23 nt, Human
uguggcaaaauguuacagaaucu

SEQ ID NO: 3691850 - RNA, 14 nt, Human
uguggcacauucuu

SEQ ID NO: 3691851 - RNA, 14 nt, Human
uguggcagagagag

SEQ ID NO: 3691852 - RNA, 15 nt, Human
uguggcagagagaga

SEQ ID NO: 3691853 - RNA, 22 nt, Human
uguggcagagagagagaaagag

SEQ ID NO: 3691854 - RNA, 23 nt, Human
uguggcaggcagcgccaagcaac

SEQ ID NO: 3691855 - RNA, 21 nt, Human
uguggcagggguuagagcagg

SEQ ID NO: 3691856 - RNA, 22 nt, Human
uguggcaguaaagagaaacuuu

SEQ ID NO: 3691857 - RNA, 19 nt, Human
uguggcagucccuuauaau

SEQ ID NO: 3691858 - RNA, 16 nt, Human
uguggcagugguuuug

SEQ ID NO: 3691859 - RNA, 23 nt, Human
uguggcauaaauugcaucacugu

SEQ ID NO: 3691860 - RNA, 16 nt, Human
uguggcauccagaguc

SEQ ID NO: 3691861 - RNA, 15 nt, Human
uguggccaaggagcu

SEQ ID NO: 3691862 - RNA, 18 nt, Human
uguggccaaggagcugcu

SEQ ID NO: 3691863 - RNA, 16 nt, Human
uguggccacuucuguc

SEQ ID NO: 3691864 - RNA, 11 nt, Human
uguggccagga

SEQ ID NO: 3691865 - RNA, 21 nt, Human
uguggccaugacccugccucu

SEQ ID NO: 3691866 - RNA, 23 nt, Human
uguggccaugacccugccucucc

SEQ ID NO: 3691867 - RNA, 22 nt, Human
uguggccaugguccccaagacc

SEQ ID NO: 3691868 - RNA, 13 nt, Human
uguggccccaccc

SEQ ID NO: 3691869 - RNA, 12 nt, Human
uguggcccuggc

SEQ ID NO: 3691870 - RNA, 14 nt, Human
uguggcccuggccu

SEQ ID NO: 3691871 - RNA, 14 nt, Human
uguggcccuguccu

SEQ ID NO: 3691872 - RNA, 11 nt, Human
uguggccucag

SEQ ID NO: 3691873 - RNA, 17 nt, Human
uguggccuuugcgcucc

SEQ ID NO: 3691874 - RNA, 22 nt, Human
uguggcgagccauuugucccaa

SEQ ID NO: 3691875 - RNA, 19 nt, Human
uguggcgccgucuccaggg

SEQ ID NO: 3691876 - RNA, 23 nt, Human
uguggcgccgucuccaggggcug

SEQ ID NO: 3691877 - RNA, 21 nt, Human
uguggcuaaaugccuaauaaa

SEQ ID NO: 3691878 - RNA, 22 nt, Human
uguggcuauuaaaacucuuuua

SEQ ID NO: 3691879 - RNA, 13 nt, Human
uguggcuccccuc

SEQ ID NO: 3691880 - RNA, 17 nt, Human
uguggcuccuaucugug

SEQ ID NO: 3691881 - RNA, 18 nt, Human
uguggcuccuaucugugu

SEQ ID NO: 3691882 - RNA, 19 nt, Human
uguggcuccuaucuguguu

SEQ ID NO: 3691883 - RNA, 14 nt, Human
uguggcuccuuccc

SEQ ID NO: 3691884 - RNA, 21 nt, Human
uguggcugaggaggccuccau

SEQ ID NO: 3691885 - RNA, 14 nt, Human
uguggcugcagcag

SEQ ID NO: 3691886 - RNA, 19 nt, Human
uguggcuugcuagcuaugu

SEQ ID NO: 3691887 - RNA, 17 nt, Human
uguggcuuucagagccu

SEQ ID NO: 3691888 - RNA, 21 nt, Human
ugugggaaaaaaaugaaugag

SEQ ID NO: 3691889 - RNA, 23 nt, Human
ugugggaacgagaggggaagagu

SEQ ID NO: 3691890 - RNA, 12 nt, Human
ugugggaagggg

SEQ ID NO: 3691891 - RNA, 19 nt, Human
ugugggaaugcggcaagaa

SEQ ID NO: 3691892 - RNA, 13 nt, Human
ugugggacuguac

SEQ ID NO: 3691893 - RNA, 19 nt, Human
ugugggacuguacacacuu

SEQ ID NO: 3691894 - RNA, 13 nt, Human
ugugggagggagc

SEQ ID NO: 3691895 - RNA, 15 nt, Human
ugugggaguguguaa

SEQ ID NO: 3691896 - RNA, 17 nt, Human
ugugggauauugaaugu

SEQ ID NO: 3691897 - RNA, 19 nt, Human
ugugggauguucagcacug

SEQ ID NO: 3691898 - RNA, 18 nt, Human
ugugggauuaugggucac

SEQ ID NO: 3691899 - RNA, 15 nt, Human
ugugggcaaaagagu

SEQ ID NO: 3691900 - RNA, 14 nt, Human
ugugggcacuggcc

SEQ ID NO: 3691901 - RNA, 16 nt, Human
ugugggcacuggccca

SEQ ID NO: 3691902 - RNA, 21 nt, Human
ugugggcauuucuugcgagcc

SEQ ID NO: 3691903 - RNA, 14 nt, Human
ugugggccugggcu

SEQ ID NO: 3691904 - RNA, 21 nt, Human
ugugggcgugagaccugcccc

SEQ ID NO: 3691905 - RNA, 13 nt, Human
ugugggcugcacu

SEQ ID NO: 3691906 - RNA, 21 nt, Human
ugugggcugcacucugugccc

SEQ ID NO: 3691907 - RNA, 14 nt, Human
ugugggcugugagu

SEQ ID NO: 3691908 - RNA, 16 nt, Human
ugugggcuugaccagg

SEQ ID NO: 3691909 - RNA, 13 nt, Human
uguggggaaaggg

SEQ ID NO: 3691910 - RNA, 23 nt, Human
uguggggaaccaauugcuuuguc

SEQ ID NO: 3691911 - RNA, 23 nt, Human
uguggggccaugccuccucagga

SEQ ID NO: 3691912 - RNA, 14 nt, Human
uguggggccuggga

SEQ ID NO: 3691913 - RNA, 12 nt, Human
uguggggccuug

SEQ ID NO: 3691914 - RNA, 18 nt, Human
uguggggcuuggcgugga

SEQ ID NO: 3691915 - RNA, 23 nt, Human
ugugggggaagagcacagcccuc

SEQ ID NO: 3691916 - RNA, 15 nt, Human
ugugggggacuguaa

SEQ ID NO: 3691917 - RNA, 20 nt, Human
uguggggugacgggacucag

SEQ ID NO: 3691918 - RNA, 16 nt, Human
ugugggucugugugug

SEQ ID NO: 3691919 - RNA, 20 nt, Human
ugugggucugugugugugua

SEQ ID NO: 3691920 - RNA, 15 nt, Human
ugugggucuuccagg

SEQ ID NO: 3691921 - RNA, 22 nt, Human
uguggguggauauaaauauaua

SEQ ID NO: 3691922 - RNA, 13 nt, Human
uguggguguccug

SEQ ID NO: 3691923 - RNA, 21 nt, Human
uguggguguccugccugucug

SEQ ID NO: 3691924 - RNA, 15 nt, Human
uguggguuccacaga

SEQ ID NO: 3691925 - RNA, 16 nt, Human
uguggguuccacagac

SEQ ID NO: 3691926 - RNA, 16 nt, Human
ugugguaaaugccaca

SEQ ID NO: 3691927 - RNA, 14 nt, Human
ugugguacagagaa

SEQ ID NO: 3691928 - RNA, 21 nt, Human
ugugguacagagaagccagcu

SEQ ID NO: 3691929 - RNA, 16 nt, Human
ugugguacaugguguu

SEQ ID NO: 3691930 - RNA, 18 nt, Human
ugugguagggggugucuc

SEQ ID NO: 3691931 - RNA, 17 nt, Human
ugugguaguuaauaaaa

SEQ ID NO: 3691932 - RNA, 19 nt, Human
ugugguauugaauauugug

SEQ ID NO: 3691933 - RNA, 22 nt, Human
uguggucaacauuucucauguu

SEQ ID NO: 3691934 - RNA, 23 nt, Human
uguggucacagcggaggugugga

SEQ ID NO: 3691935 - RNA, 13 nt, Human
ugugguccaaaua

SEQ ID NO: 3691936 - RNA, 15 nt, Human
uguggucucaggaua

SEQ ID NO: 3691937 - RNA, 17 nt, Human
uguggucuccuuggaaa

SEQ ID NO: 3691938 - RNA, 13 nt, Human
uguggugaugaaa

SEQ ID NO: 3691939 - RNA, 15 nt, Human
ugugguggccucagc

SEQ ID NO: 3691940 - RNA, 22 nt, Human
ugugguggguucuuuggaagga

SEQ ID NO: 3691941 - RNA, 14 nt, Human
uguggugguuguga

SEQ ID NO: 3691942 - RNA, 20 nt, Human
ugugguguaauuuauaaaau

SEQ ID NO: 3691943 - RNA, 23 nt, Human
uguggugugucccccucugucca

SEQ ID NO: 3691944 - RNA, 16 nt, Human
ugugguguugaggcuu

SEQ ID NO: 3691945 - RNA, 21 nt, Human
ugugguguuuccugcaggcca

SEQ ID NO: 3691946 - RNA, 20 nt, Human
ugugguuaaugccauggaca

SEQ ID NO: 3691947 - RNA, 17 nt, Human
ugugguuauuucucuga

SEQ ID NO: 3691948 - RNA, 14 nt, Human
ugugguuuauauau

SEQ ID NO: 3691949 - RNA, 12 nt, Human
ugugguuucauu

SEQ ID NO: 3691950 - RNA, 18 nt, Human
ugugguuugguuccucuc

SEQ ID NO: 3691951 - RNA, 21 nt, Human
ugugguuugguuccucucugg

SEQ ID NO: 3691952 - RNA, 14 nt, Human
ugugguuuuaugga

SEQ ID NO: 3691953 - RNA, 16 nt, Human
ugugguuuuccccucc

SEQ ID NO: 3691954 - RNA, 18 nt, Human
ugugguuuucuguuucua

SEQ ID NO: 3691955 - RNA, 21 nt, Human
ugugguuuucuuuugccauga

SEQ ID NO: 3691956 - RNA, 17 nt, Human
uguguaaaauguaaugc

SEQ ID NO: 3691957 - RNA, 17 nt, Human
uguguaaaguuagucua

SEQ ID NO: 3691958 - RNA, 21 nt, Human
uguguaacaauuuuaaugcua

SEQ ID NO: 3691959 - RNA, 12 nt, Human
uguguaacacag

SEQ ID NO: 3691960 - RNA, 15 nt, Human
uguguaaccauuuua

SEQ ID NO: 3691961 - RNA, 19 nt, Human
uguguaaccucuucaccuu

SEQ ID NO: 3691962 - RNA, 18 nt, Human
uguguaacugcccaaagc

SEQ ID NO: 3691963 - RNA, 21 nt, Human
uguguaacugcccaaagcagc

SEQ ID NO: 3691964 - RNA, 14 nt, Human
uguguaagagaaug

SEQ ID NO: 3691965 - RNA, 12 nt, Human
uguguaagauuu

SEQ ID NO: 3691966 - RNA, 18 nt, Human
uguguaauaaaguguuuu

SEQ ID NO: 3691967 - RNA, 18 nt, Human
uguguaauagaaaacuga

SEQ ID NO: 3691968 - RNA, 13 nt, Human
uguguaauauuac

SEQ ID NO: 3691969 - RNA, 19 nt, Human
uguguaaucaauaaacgau

SEQ ID NO: 3691970 - RNA, 22 nt, Human
uguguaaucauuucuugggccc

SEQ ID NO: 3691971 - RNA, 23 nt, Human
uguguaaucauuucuugggcccu

SEQ ID NO: 3691972 - RNA, 14 nt, Human
uguguaauuuuucu

SEQ ID NO: 3691973 - RNA, 17 nt, Human
uguguaauuuuucugua

SEQ ID NO: 3691974 - RNA, 19 nt, Human
uguguaauuuuucuguaua

SEQ ID NO: 3691975 - RNA, 17 nt, Human
uguguacaccucuggau

SEQ ID NO: 3691976 - RNA, 21 nt, Human
uuaugaagaaaaauuugaaaa

SEQ ID NO: 3691977 - RNA, 13 nt, Human
uuaugaagaaaau

SEQ ID NO: 3691978 - RNA, 13 nt, Human
uuaugaagagcua

SEQ ID NO: 3691979 - RNA, 20 nt, Human
uuaugaagugcgugaaugua

SEQ ID NO: 3691980 - RNA, 19 nt, Human
uuaugaauauuuacguuuu

SEQ ID NO: 3691981 - RNA, 14 nt, Human
uuaugaaucuuucc

SEQ ID NO: 3691982 - RNA, 14 nt, Human
uuaugaauuacauu

SEQ ID NO: 3691983 - RNA, 21 nt, Human
uuaugaauuacauuuguauaa

SEQ ID NO: 3691984 - RNA, 23 nt, Human
uuaugacaaugacugugcuacug

SEQ ID NO: 3691985 - RNA, 13 nt, Human
uuaugacaguaau

SEQ ID NO: 3691986 - RNA, 18 nt, Human
uuaugacaucacuuguac

SEQ ID NO: 3691987 - RNA, 23 nt, Human
uuaugacaucacuuguacaaaau

SEQ ID NO: 3691988 - RNA, 16 nt, Human
uuaugacuauguaaac

SEQ ID NO: 3691989 - RNA, 15 nt, Human
uuaugacugccaaga

SEQ ID NO: 3691990 - RNA, 21 nt, Human
uuaugagaaacuggcaaagca

SEQ ID NO: 3691991 - RNA, 13 nt, Human
uuaugagaaacuu

SEQ ID NO: 3691992 - RNA, 16 nt, Human
uuaugagauacuuugc

SEQ ID NO: 3691993 - RNA, 19 nt, Human
uuaugaggguccucuacuu

SEQ ID NO: 3691994 - RNA, 15 nt, Human
uuaugaguuuuugau

SEQ ID NO: 3691995 - RNA, 18 nt, Human
uuaugauaauagauucuc

SEQ ID NO: 3691996 - RNA, 12 nt, Human
uuaugauagauu

SEQ ID NO: 3691997 - RNA, 21 nt, Human
uuaugauauuuuuuuaagucu

SEQ ID NO: 3691998 - RNA, 19 nt, Human
uuaugaucaccauguauuu

SEQ ID NO: 3691999 - RNA, 15 nt, Human
uuaugaugacguaca

SEQ ID NO: 3692000 - RNA, 22 nt, Human
uuaugaugacguacaaguaguu

SEQ ID NO: 3692001 - RNA, 20 nt, Human
uuaugaugguuuuaaacuuu

SEQ ID NO: 3692002 - RNA, 22 nt, Human
uuaugauuaaguaaugauaacu

SEQ ID NO: 3692003 - RNA, 14 nt, Human
uuaugauuagcuuu

SEQ ID NO: 3692004 - RNA, 21 nt, Human
uuaugauugccuuuuuauaac

SEQ ID NO: 3692005 - RNA, 15 nt, Human
uuaugauuuaauaaa

SEQ ID NO: 3692006 - RNA, 19 nt, Human
uuaugauuuucauaacuua

SEQ ID NO: 3692007 - RNA, 16 nt, Human
uuaugauuuuuaaaga

SEQ ID NO: 3692008 - RNA, 19 nt, Human
uuaugauuuuuuuuucaua

SEQ ID NO: 3692009 - RNA, 20 nt, Human
uuaugcaagggacugugugu

SEQ ID NO: 3692010 - RNA, 20 nt, Human
uuaugcaauuagguuuuucc

SEQ ID NO: 3692011 - RNA, 17 nt, Human
uuaugcauaacugacaa

SEQ ID NO: 3692012 - RNA, 17 nt, Human
uuaugcauguuuguugu

SEQ ID NO: 3692013 - RNA, 23 nt, Human
uuaugccacccccgcuggaggau

SEQ ID NO: 3692014 - RNA, 17 nt, Human
uuaugcccagcguuuga

SEQ ID NO: 3692015 - RNA, 16 nt, Human
uuaugcggucuaggga

SEQ ID NO: 3692016 - RNA, 15 nt, Human
uuaugcuaagaauuu

SEQ ID NO: 3692017 - RNA, 16 nt, Human
uuaugcuaagaauuuu

SEQ ID NO: 3692018 - RNA, 19 nt, Human
uuaugcucucacuguuugu

SEQ ID NO: 3692019 - RNA, 18 nt, Human
uuaugcucuuaauugcca

SEQ ID NO: 3692020 - RNA, 21 nt, Human
uuaugcucuuuuuuacucauu

SEQ ID NO: 3692021 - RNA, 13 nt, Human
uuaugcugaaaca

SEQ ID NO: 3692022 - RNA, 15 nt, Human
uuaugcugauuuauu

SEQ ID NO: 3692023 - RNA, 18 nt, Human
uuaugcuguaaaagcaag

SEQ ID NO: 3692024 - RNA, 12 nt, Human
uuaugcuuuugg

SEQ ID NO: 3692025 - RNA, 17 nt, Human
uuauggaaaaauaaaac

SEQ ID NO: 3692026 - RNA, 16 nt, Human
uuauggaacacucuga

SEQ ID NO: 3692027 - RNA, 23 nt, Human
uuauggaagauaguuuucuccuu

SEQ ID NO: 3692028 - RNA, 20 nt, Human
uuauggaauugauuugcauu

SEQ ID NO: 3692029 - RNA, 17 nt, Human
uuauggccacagcccau

SEQ ID NO: 3692030 - RNA, 16 nt, Human
uuauggccgggcaggg

SEQ ID NO: 3692031 - RNA, 18 nt, Human
uuauggccucagcugccu

SEQ ID NO: 3692032 - RNA, 17 nt, Human
uuauggcuauaggugcu

SEQ ID NO: 3692033 - RNA, 19 nt, Human
uuauggcuuuugugcauua

SEQ ID NO: 3692034 - RNA, 17 nt, Human
uuaugggaaucaagauu

SEQ ID NO: 3692035 - RNA, 22 nt, Human
uuaugggcauugacaaaucugu

SEQ ID NO: 3692036 - RNA, 22 nt, Human
uuaugggcuggguucuacccag

SEQ ID NO: 3692037 - RNA, 16 nt, Human
uuaugguaaucauauu

SEQ ID NO: 3692038 - RNA, 18 nt, Human
uuaugguaaucauauuag

SEQ ID NO: 3692039 - RNA, 19 nt, Human
uuaugguagaaaaauuuca

SEQ ID NO: 3692040 - RNA, 22 nt, Human
uuauggucaaucccaaaaguca

SEQ ID NO: 3692041 - RNA, 21 nt, Human
uuaugguccuaaaagcaaaau

SEQ ID NO: 3692042 - RNA, 13 nt, Human
uuaugguguuucu

SEQ ID NO: 3692043 - RNA, 14 nt, Human
uuaugguuacuucu

SEQ ID NO: 3692044 - RNA, 20 nt, Human
uuaugguuacuucuucucuu

SEQ ID NO: 3692045 - RNA, 11 nt, Human
uuaugguuuug

SEQ ID NO: 3692046 - RNA, 17 nt, Human
uuaugguuuugugaugu

SEQ ID NO: 3692047 - RNA, 22 nt, Human
uuauguaaacaaaucuuuccau

SEQ ID NO: 3692048 - RNA, 12 nt, Human
uuauguaaauaa

SEQ ID NO: 3692049 - RNA, 15 nt, Human
uuauguaaauaauuc

SEQ ID NO: 3692050 - RNA, 20 nt, Human
uuauguaaauguuuguuaaa

SEQ ID NO: 3692051 - RNA, 22 nt, Human
uuauguaaauuaucaggcaaau

SEQ ID NO: 3692052 - RNA, 21 nt, Human
uuauguaauaaugugaaucau

SEQ ID NO: 3692053 - RNA, 18 nt, Human
uuauguagcucuuuguca

SEQ ID NO: 3692054 - RNA, 11 nt, Human
uuauguaguuu

SEQ ID NO: 3692055 - RNA, 21 nt, Human
uuauguaguuuuuauauguug

SEQ ID NO: 3692056 - RNA, 17 nt, Human
uuaugucccuucacaua

SEQ ID NO: 3692057 - RNA, 21 nt, Human
uuaugucugcugaauaauaaa

SEQ ID NO: 3692058 - RNA, 14 nt, Human
uuaugucuguuuaa

SEQ ID NO: 3692059 - RNA, 16 nt, Human
uuaugucuguuuaaga

SEQ ID NO: 3692060 - RNA, 21 nt, Human
uuaugucuuuuauauuuguau

SEQ ID NO: 3692061 - RNA, 13 nt, Human
uuaugugaaacau

SEQ ID NO: 3692062 - RNA, 11 nt, Human
uuaugugaauu

SEQ ID NO: 3692063 - RNA, 19 nt, Human
uuaugugaauuuuuaagcu

SEQ ID NO: 3692064 - RNA, 19 nt, Human
uuaugugacauuuuacauu

SEQ ID NO: 3692065 - RNA, 20 nt, Human
uuaugugacauuuuacauua

SEQ ID NO: 3692066 - RNA, 13 nt, Human
uuaugugagagaa

SEQ ID NO: 3692067 - RNA, 22 nt, Human
uuaugugccagauuuaugcaua

SEQ ID NO: 3692068 - RNA, 16 nt, Human
uuaugugguuuuagau

SEQ ID NO: 3692069 - RNA, 19 nt, Human
uuaugugguuuuagauuuu

SEQ ID NO: 3692070 - RNA, 15 nt, Human
uuauguguaaauaca

SEQ ID NO: 3692071 - RNA, 22 nt, Human
uuauguguaguugucucucuuc

SEQ ID NO: 3692072 - RNA, 19 nt, Human
uuaugugugaggagcugcu

SEQ ID NO: 3692073 - RNA, 18 nt, Human
uuaugugugcaugugugu

SEQ ID NO: 3692074 - RNA, 20 nt, Human
uuaugugugcauguguguau

SEQ ID NO: 3692075 - RNA, 12 nt, Human
uuauguguguau

SEQ ID NO: 3692076 - RNA, 10 nt, Human
uuauguuaaa

SEQ ID NO: 3692077 - RNA, 12 nt, Human
uuauguuaaaau

SEQ ID NO: 3692078 - RNA, 13 nt, Human
uuauguuaaacua

SEQ ID NO: 3692079 - RNA, 18 nt, Human
uuauguuauugaaaaaaa

SEQ ID NO: 3692080 - RNA, 20 nt, Human
uuauguuauuuauauauugg

SEQ ID NO: 3692081 - RNA, 13 nt, Human
uuauguugacauu

SEQ ID NO: 3692082 - RNA, 14 nt, Human
uuauguugacauuu

SEQ ID NO: 3692083 - RNA, 17 nt, Human
uuauguugcauagaaua

SEQ ID NO: 3692084 - RNA, 15 nt, Human
uuauguuguuagaga

SEQ ID NO: 3692085 - RNA, 22 nt, Human
uuauguuuucgaaaaucaaaug

SEQ ID NO: 3692086 - RNA, 23 nt, Human
uuauguuuugguccacuuuucca

SEQ ID NO: 3692087 - RNA, 19 nt, Human
uuauguuuuguuucugaaa

SEQ ID NO: 3692088 - RNA, 19 nt, Human
uuauuaaaaugauuguaaa

SEQ ID NO: 3692089 - RNA, 13 nt, Human
uuauuaaaauugu

SEQ ID NO: 3692090 - RNA, 10 nt, Human
uuauuaaagg

SEQ ID NO: 3692091 - RNA, 12 nt, Human
uuauuaaauaaa

SEQ ID NO: 3692092 - RNA, 20 nt, Human
uuauuaaauacaaaacuucc

SEQ ID NO: 3692093 - RNA, 19 nt, Human
uuauuaaaugcccagcccc

SEQ ID NO: 3692094 - RNA, 12 nt, Human
uuauuaaaugua

SEQ ID NO: 3692095 - RNA, 20 nt, Human
uuauuaaauuuuuuuguaug

SEQ ID NO: 3692096 - RNA, 19 nt, Human
uuauuaacaaauuauguua

SEQ ID NO: 3692097 - RNA, 17 nt, Human
uuauuaacuuaauaauc

SEQ ID NO: 3692098 - RNA, 19 nt, Human
uuauuaacuuaauaaucaa

SEQ ID NO: 3692099 - RNA, 23 nt, Human
uuauuaagauggauucucagaua

SEQ ID NO: 3692100 - RNA, 22 nt, Human
uuauuaaguucucaaugugaaa

SEQ ID NO: 3692101 - RNA, 14 nt, Human
uuauuaaucacugu

SEQ ID NO: 3692102 - RNA, 11 nt, Human
uuauuaaugca

SEQ ID NO: 3692103 - RNA, 13 nt, Human
uuauuaaugcuuu

SEQ ID NO: 3692104 - RNA, 17 nt, Human
uuauuaauguuuucaaa

SEQ ID NO: 3692105 - RNA, 18 nt, Human
uuauuaauuuuuaaggau

SEQ ID NO: 3692106 - RNA, 12 nt, Human
uuauuacaauuu

SEQ ID NO: 3692107 - RNA, 23 nt, Human
uuauuacagggcauucaaauggg

SEQ ID NO: 3692108 - RNA, 13 nt, Human
uuauuacaguguu

SEQ ID NO: 3692109 - RNA, 15 nt, Human
uuauuacauccuugu

SEQ ID NO: 3692110 - RNA, 17 nt, Human
uuauuacauccuugugg

SEQ ID NO: 3692111 - RNA, 19 nt, Human
uuauuacauccuuguggca

SEQ ID NO: 3692112 - RNA, 12 nt, Human
uuauuacaucuu

SEQ ID NO: 3692113 - RNA, 19 nt, Human
uuauuacccccuccuucag

SEQ ID NO: 3692114 - RNA, 13 nt, Human
uuauuaccucuga

SEQ ID NO: 3692115 - RNA, 23 nt, Human
uuauuacguaugucugguucuca

SEQ ID NO: 3692116 - RNA, 18 nt, Human
uuauuacuguaagaaaau

SEQ ID NO: 3692117 - RNA, 17 nt, Human
uuauuacuuccaugaau

SEQ ID NO: 3692118 - RNA, 18 nt, Human
uuauuacuuguaaauaua

SEQ ID NO: 3692119 - RNA, 20 nt, Human
uuauuacuuguaaauauaaa

SEQ ID NO: 3692120 - RNA, 20 nt, Human
uuauuacuuguugcaaaggu

SEQ ID NO: 3692121 - RNA, 19 nt, Human
uuauuagaaaaauauuaua

SEQ ID NO: 3692122 - RNA, 21 nt, Human
uuauuagaaucaaacauuuug

SEQ ID NO: 3692123 - RNA, 22 nt, Human
uuauuagccagguaaugugaau

SEQ ID NO: 3692124 - RNA, 20 nt, Human
uuauuagggagaaaauucaa

SEQ ID NO: 3692125 - RNA, 20 nt, Human
uuauuaguaaaugcuuauca

SEQ ID NO: 3692126 - RNA, 19 nt, Human
uaauuguguuuacauuuua

SEQ ID NO: 3692127 - RNA, 20 nt, Human
uaauuguuaagauaugaugu

SEQ ID NO: 3692128 - RNA, 14 nt, Human
uaauuguuccuuuu

SEQ ID NO: 3692129 - RNA, 14 nt, Human
uaauuguugaaauu

SEQ ID NO: 3692130 - RNA, 18 nt, Human
uaauuguugaaauuuugc

SEQ ID NO: 3692131 - RNA, 18 nt, Human
uaauuguuguucuguuaa

SEQ ID NO: 3692132 - RNA, 20 nt, Human
uaauuguuguucuguuaacu

SEQ ID NO: 3692133 - RNA, 23 nt, Human
uaauuguuguucuguuaacugaa

SEQ ID NO: 3692134 - RNA, 14 nt, Human
uaauuguuguuucu

SEQ ID NO: 3692135 - RNA, 15 nt, Human
uaauuguuguuucuu

SEQ ID NO: 3692136 - RNA, 19 nt, Human
uaauuguuguuucuuucua

SEQ ID NO: 3692137 - RNA, 22 nt, Human
uaauuguuguuucuuucuagug

SEQ ID NO: 3692138 - RNA, 18 nt, Human
uaauuguuguuuguaugu

SEQ ID NO: 3692139 - RNA, 23 nt, Human
uaauuguuguuuguauguauaau

SEQ ID NO: 3692140 - RNA, 14 nt, Human
uaauuuaaaaauau

SEQ ID NO: 3692141 - RNA, 15 nt, Human
uaauuuaaaauugug

SEQ ID NO: 3692142 - RNA, 19 nt, Human
uaauuuaaacaccuccuca

SEQ ID NO: 3692143 - RNA, 14 nt, Human
uaauuuaaacaggc

SEQ ID NO: 3692144 - RNA, 19 nt, Human
uaauuuaaacaggcccagc

SEQ ID NO: 3692145 - RNA, 19 nt, Human
uaauuuaaagccacaacca

SEQ ID NO: 3692146 - RNA, 16 nt, Human
uaauuuaaaugaaaga

SEQ ID NO: 3692147 - RNA, 16 nt, Human
uaauuuaacccagcuc

SEQ ID NO: 3692148 - RNA, 11 nt, Human
uaauuuaacuu

SEQ ID NO: 3692149 - RNA, 20 nt, Human
uaauuuacuuguuuuggaug

SEQ ID NO: 3692150 - RNA, 16 nt, Human
uaauuuagaaaacuuu

SEQ ID NO: 3692151 - RNA, 14 nt, Human
uaauuuagaaauca

SEQ ID NO: 3692152 - RNA, 21 nt, Human
uaauuuagacuucaagcaugg

SEQ ID NO: 3692153 - RNA, 15 nt, Human
uaauuuaguaaaugu

SEQ ID NO: 3692154 - RNA, 21 nt, Human
uaauuuagugaucuuagcaua

SEQ ID NO: 3692155 - RNA, 17 nt, Human
uaauuuaguuguuucua

SEQ ID NO: 3692156 - RNA, 16 nt, Human
uaauuuauaaaaaggu

SEQ ID NO: 3692157 - RNA, 21 nt, Human
uaauuuauaaaagaauaaaau

SEQ ID NO: 3692158 - RNA, 12 nt, Human
uaauuuauagua

SEQ ID NO: 3692159 - RNA, 20 nt, Human
uaauuuaucuaaauuaaagc

SEQ ID NO: 3692160 - RNA, 23 nt, Human
uaauuuaucuugucucugggcuu

SEQ ID NO: 3692161 - RNA, 20 nt, Human
uaauuuaugaguuuuugaua

SEQ ID NO: 3692162 - RNA, 18 nt, Human
uaauuuauuauugaaauu

SEQ ID NO: 3692163 - RNA, 17 nt, Human
uaauuuauuuauuaaga

SEQ ID NO: 3692164 - RNA, 19 nt, Human
uaauuuauuuauuaagaug

SEQ ID NO: 3692165 - RNA, 19 nt, Human
uaauuuauuuccacuaaaa

SEQ ID NO: 3692166 - RNA, 19 nt, Human
uaauuucaaaaauauaacu

SEQ ID NO: 3692167 - RNA, 20 nt, Human
uaauuucaaaaauauaacuu

SEQ ID NO: 3692168 - RNA, 21 nt, Human
uaauuucaaaaauauaacuua

SEQ ID NO: 3692169 - RNA, 15 nt, Human
uaauuucaaaaugcu

SEQ ID NO: 3692170 - RNA, 20 nt, Human
uaauuucaaaaugcuuuuua

SEQ ID NO: 3692171 - RNA, 22 nt, Human
uaauuucaggaggaauacugaa

SEQ ID NO: 3692172 - RNA, 23 nt, Human
uaauuucaggaggaauacugaac

SEQ ID NO: 3692173 - RNA, 23 nt, Human
uaauuucaguccuguaguuuuau

SEQ ID NO: 3692174 - RNA, 20 nt, Human
uaauuucauguaaaacagaa

SEQ ID NO: 3692175 - RNA, 16 nt, Human
uaauuuccauuuacuu

SEQ ID NO: 3692176 - RNA, 10 nt, Human
uaauuuccuu

SEQ ID NO: 3692177 - RNA, 17 nt, Human
uaauuuccuuaaagcaa

SEQ ID NO: 3692178 - RNA, 11 nt, Human
uaauuuccuuu

SEQ ID NO: 3692179 - RNA, 13 nt, Human
uaauuuccuuuuu

SEQ ID NO: 3692180 - RNA, 19 nt, Human
uaauuuccuuuuugacacu

SEQ ID NO: 3692181 - RNA, 20 nt, Human
uaauuuccuuuuugacacug

SEQ ID NO: 3692182 - RNA, 21 nt, Human
uaauuuccuuuuugacacuga

SEQ ID NO: 3692183 - RNA, 22 nt, Human
uaauuuccuuuuugacacugaa

SEQ ID NO: 3692184 - RNA, 17 nt, Human
uaauuucgagauuugua

SEQ ID NO: 3692185 - RNA, 15 nt, Human
uaauuucuucaaaau

SEQ ID NO: 3692186 - RNA, 15 nt, Human
uaauuucuucucaaa

SEQ ID NO: 3692187 - RNA, 12 nt, Human
uaauuucuuugc

SEQ ID NO: 3692188 - RNA, 16 nt, Human
uaauuucuuugccugu

SEQ ID NO: 3692189 - RNA, 14 nt, Human
uaauuugaagauug

SEQ ID NO: 3692190 - RNA, 15 nt, Human
uaauuugagagaaau

SEQ ID NO: 3692191 - RNA, 22 nt, Human
uaauuugauaguauugugcaua

SEQ ID NO: 3692192 - RNA, 22 nt, Human
uaauuugauaucacagucuaau

SEQ ID NO: 3692193 - RNA, 18 nt, Human
uaauuugaugaaagcuga

SEQ ID NO: 3692194 - RNA, 20 nt, Human
uaauuugaugaaagcugauu

SEQ ID NO: 3692195 - RNA, 17 nt, Human
uaauuugauuaacaaau

SEQ ID NO: 3692196 - RNA, 23 nt, Human
uaauuugccaaaauaaugucuug

SEQ ID NO: 3692197 - RNA, 13 nt, Human
uaauuugcugcug

SEQ ID NO: 3692198 - RNA, 11 nt, Human
uaauuuggaaa

SEQ ID NO: 3692199 - RNA, 19 nt, Human
uaauuuggaaacuaauaaa

SEQ ID NO: 3692200 - RNA, 21 nt, Human
uaauuuggaaacuaauaaaau

SEQ ID NO: 3692201 - RNA, 21 nt, Human
uaauuuggagcacaaaauuca

SEQ ID NO: 3692202 - RNA, 18 nt, Human
uaauuugguuuucacauu

SEQ ID NO: 3692203 - RNA, 12 nt, Human
uaauuuguaaag

SEQ ID NO: 3692204 - RNA, 15 nt, Human
uaauuuguaagaaua

SEQ ID NO: 3692205 - RNA, 21 nt, Human
uaauuuguacauauguaaaau

SEQ ID NO: 3692206 - RNA, 20 nt, Human
uaauuuguaguguuggagaa

SEQ ID NO: 3692207 - RNA, 23 nt, Human
uaauuuguaguguuggagaagaa

SEQ ID NO: 3692208 - RNA, 17 nt, Human
uaauuuguuuuggauau

SEQ ID NO: 3692209 - RNA, 14 nt, Human
uaauuuuaaacaaa

SEQ ID NO: 3692210 - RNA, 13 nt, Human
uaauuuuaaauuc

SEQ ID NO: 3692211 - RNA, 21 nt, Human
uaauuuuacauguuuauaaau

SEQ ID NO: 3692212 - RNA, 19 nt, Human
uaauuuuaggcacccaucc

SEQ ID NO: 3692213 - RNA, 19 nt, Human
uaauuuuaguuuuucauua

SEQ ID NO: 3692214 - RNA, 21 nt, Human
uaauuuuaguuuuucauuaaa

SEQ ID NO: 3692215 - RNA, 16 nt, Human
uaauuuuauucaagaa

SEQ ID NO: 3692216 - RNA, 19 nt, Human
uaauuuuauuuuaaaauuu

SEQ ID NO: 3692217 - RNA, 21 nt, Human
uaauuuucuagauuuucuacu

SEQ ID NO: 3692218 - RNA, 18 nt, Human
uaauuuucucaaaagcau

SEQ ID NO: 3692219 - RNA, 22 nt, Human
uaauuuucucaaaagcauuuau

SEQ ID NO: 3692220 - RNA, 12 nt, Human
uaauuuucugaa

SEQ ID NO: 3692221 - RNA, 12 nt, Human
uaauuuucuuga

SEQ ID NO: 3692222 - RNA, 13 nt, Human
uaauuuucuugau

SEQ ID NO: 3692223 - RNA, 14 nt, Human
uaauuuucuugaug

SEQ ID NO: 3692224 - RNA, 15 nt, Human
uaauuuugcauaaaa

SEQ ID NO: 3692225 - RNA, 12 nt, Human
uaauuuuggaau

SEQ ID NO: 3692226 - RNA, 22 nt, Human
uaauuuugguuguauucuuuga

SEQ ID NO: 3692227 - RNA, 19 nt, Human
uaauuuuguaaaggugaaa

SEQ ID NO: 3692228 - RNA, 12 nt, Human
uaauuuuguaau

SEQ ID NO: 3692229 - RNA, 13 nt, Human
uaauuuuguguaa

SEQ ID NO: 3692230 - RNA, 19 nt, Human
uaauuuuuaaaugcaguua

SEQ ID NO: 3692231 - RNA, 19 nt, Human
uaauuuuuaaugaugacaa

SEQ ID NO: 3692232 - RNA, 16 nt, Human
uaauuuuuacagaauu

SEQ ID NO: 3692233 - RNA, 14 nt, Human
uaauuuuuacccua

SEQ ID NO: 3692234 - RNA, 16 nt, Human
uaauuuuuauauuuaa

SEQ ID NO: 3692235 - RNA, 13 nt, Human
uaauuuuuauuca

SEQ ID NO: 3692236 - RNA, 23 nt, Human
uaauuuuuauuuuugcugagacu

SEQ ID NO: 3692237 - RNA, 14 nt, Human
uaauuuuucuguau

SEQ ID NO: 3692238 - RNA, 15 nt, Human
uaauuuuucuguaua

SEQ ID NO: 3692239 - RNA, 18 nt, Human
uaauuuuugcuuuuagaa

SEQ ID NO: 3692240 - RNA, 19 nt, Human
uaauuuuuuagagagcugu

SEQ ID NO: 3692241 - RNA, 18 nt, Human
uaauuuuuugguacaaaa

SEQ ID NO: 3692242 - RNA, 16 nt, Human
uaauuuuuuguaaugu

SEQ ID NO: 3692243 - RNA, 18 nt, Human
uaauuuuuuuauuguuua

SEQ ID NO: 3692244 - RNA, 20 nt, Human
uaauuuuuuuauuguuuaaa

SEQ ID NO: 3692245 - RNA, 16 nt, Human
uaauuuuuuucaauau

SEQ ID NO: 3692246 - RNA, 22 nt, Human
uaauuuuuuucaauauuuauua

SEQ ID NO: 3692247 - RNA, 13 nt, Human
uaauuuuuuuuaa

SEQ ID NO: 3692248 - RNA, 20 nt, Human
uaauuuuuuuuaaaauagaa

SEQ ID NO: 3692249 - RNA, 22 nt, Human
uaauuuuuuuuuuccuuuuaaa

SEQ ID NO: 3692250 - RNA, 21 nt, Human
uacaaaaaaaaaaaaaaauua

SEQ ID NO: 3692251 - RNA, 20 nt, Human
uacaaaaaaaaaguuuuauu

SEQ ID NO: 3692252 - RNA, 14 nt, Human
uacaaaaacacagc

SEQ ID NO: 3692253 - RNA, 18 nt, Human
uacaaaaacacagcaagg

SEQ ID NO: 3692254 - RNA, 13 nt, Human
uacaaaaacacuu

SEQ ID NO: 3692255 - RNA, 23 nt, Human
uacaaaaacacuucguucgcaga

SEQ ID NO: 3692256 - RNA, 12 nt, Human
uacaaaaauaaa

SEQ ID NO: 3692257 - RNA, 22 nt, Human
uacaaaaauaaacuauaaaaca

SEQ ID NO: 3692258 - RNA, 17 nt, Human
uacaaaaauauaaaaua

SEQ ID NO: 3692259 - RNA, 22 nt, Human
uacaaaaauuugccaggcgugg

SEQ ID NO: 3692260 - RNA, 17 nt, Human
uacaaaacaaacucauu

SEQ ID NO: 3692261 - RNA, 16 nt, Human
uacaaaacauuaaacu

SEQ ID NO: 3692262 - RNA, 19 nt, Human
uacaaaaccacuggaaagu

SEQ ID NO: 3692263 - RNA, 19 nt, Human
uacaaaaccugauguuaaa

SEQ ID NO: 3692264 - RNA, 20 nt, Human
uacaaaacgcgcagaugugc

SEQ ID NO: 3692265 - RNA, 12 nt, Human
uacaaaacuucc

SEQ ID NO: 3692266 - RNA, 13 nt, Human
uacaaaauaaaaa

SEQ ID NO: 3692267 - RNA, 19 nt, Human
uacaaaauaaacaaauaac

SEQ ID NO: 3692268 - RNA, 20 nt, Human
uacaaaauaaaguuacauug

SEQ ID NO: 3692269 - RNA, 10 nt, Human
uacaaaauca

SEQ ID NO: 3692270 - RNA, 14 nt, Human
uacaaaauguaacu

SEQ ID NO: 3692271 - RNA, 23 nt, Human
uacaaaauuaagcaaauguuaaa

SEQ ID NO: 3692272 - RNA, 15 nt, Human
uacaaacaagcauau

SEQ ID NO: 3692273 - RNA, 19 nt, Human
uacaaacaagcauauaaaa

SEQ ID NO: 3692274 - RNA, 20 nt, Human
uacaaacaagcauauaaaau

SEQ ID NO: 3692275 - RNA, 19 nt, Human
uguguacaguguguaaagu

SEQ ID NO: 3692276 - RNA, 20 nt, Human
uguguacauaacucuguaaa

SEQ ID NO: 3692277 - RNA, 20 nt, Human
uguguacaucccauguaaca

SEQ ID NO: 3692278 - RNA, 23 nt, Human
uguguacaucccauguaacagaa

SEQ ID NO: 3692279 - RNA, 24 nt, Human
uguguacaucccauguaacagaaa

SEQ ID NO: 3692280 - RNA, 19 nt, Human
uguguacauggcagaguuu

SEQ ID NO: 3692281 - RNA, 15 nt, Human
uguguacccaaacgu

SEQ ID NO: 3692282 - RNA, 15 nt, Human
uguguacguggagag

SEQ ID NO: 3692283 - RNA, 16 nt, Human
uguguacguggagagg

SEQ ID NO: 3692284 - RNA, 20 nt, Human
uguguacucuggccucuguc

SEQ ID NO: 3692285 - RNA, 14 nt, Human
uguguacucugucc

SEQ ID NO: 3692286 - RNA, 17 nt, Human
uguguacuguaaagaau

SEQ ID NO: 3692287 - RNA, 14 nt, Human
uguguacuguguca

SEQ ID NO: 3692288 - RNA, 12 nt, Human
uguguacuuuua

SEQ ID NO: 3692289 - RNA, 15 nt, Human
uguguacuuuuaaga

SEQ ID NO: 3692290 - RNA, 23 nt, Human
uguguagacgaagggggcaucug

SEQ ID NO: 3692291 - RNA, 13 nt, Human
uguguagaguuaa

SEQ ID NO: 3692292 - RNA, 16 nt, Human
uguguagaguuaagaa

SEQ ID NO: 3692293 - RNA, 19 nt, Human
uguguagcauacuggcuuc

SEQ ID NO: 3692294 - RNA, 14 nt, Human
uguguagccugugc

SEQ ID NO: 3692295 - RNA, 16 nt, Human
uguguagccugugcau

SEQ ID NO: 3692296 - RNA, 23 nt, Human
uguguagccugugcauguauguc

SEQ ID NO: 3692297 - RNA, 18 nt, Human
uguguagcugcaaaaaua

SEQ ID NO: 3692298 - RNA, 16 nt, Human
uguguagggcgggagg

SEQ ID NO: 3692299 - RNA, 21 nt, Human
uguguauaaaaauaaaaaaga

SEQ ID NO: 3692300 - RNA, 14 nt, Human
uguguauaaacaag

SEQ ID NO: 3692301 - RNA, 22 nt, Human
uguguauaaacaagaaaaauaa

SEQ ID NO: 3692302 - RNA, 21 nt, Human
uguguauagaugcaagauauu

SEQ ID NO: 3692303 - RNA, 15 nt, Human
uguguauauauacau

SEQ ID NO: 3692304 - RNA, 23 nt, Human
uguguauauauguguauauauac

SEQ ID NO: 3692305 - RNA, 22 nt, Human
uguguauauauuuugugugaaa

SEQ ID NO: 3692306 - RNA, 13 nt, Human
uguguauauggua

SEQ ID NO: 3692307 - RNA, 15 nt, Human
uguguauauuauuug

SEQ ID NO: 3692308 - RNA, 18 nt, Human
uguguauccauuaucaug

SEQ ID NO: 3692309 - RNA, 22 nt, Human
uguguauccauuaucaugugua

SEQ ID NO: 3692310 - RNA, 22 nt, Human
uguguaugugaguauucucauu

SEQ ID NO: 3692311 - RNA, 14 nt, Human
uguguaugugcgug

SEQ ID NO: 3692312 - RNA, 13 nt, Human
uguguaugugggg

SEQ ID NO: 3692313 - RNA, 23 nt, Human
uguguaugugggggucugugugu

SEQ ID NO: 3692314 - RNA, 13 nt, Human
uguguauuguucc

SEQ ID NO: 3692315 - RNA, 13 nt, Human
uguguauuguugu

SEQ ID NO: 3692316 - RNA, 18 nt, Human
uguguauuuaacagggag

SEQ ID NO: 3692317 - RNA, 20 nt, Human
uguguauuuaacagggaggg

SEQ ID NO: 3692318 - RNA, 17 nt, Human
uguguauuuaauuguaa

SEQ ID NO: 3692319 - RNA, 18 nt, Human
uguguauuuaauuguaaa

SEQ ID NO: 3692320 - RNA, 19 nt, Human
uguguauuuaauuguaaac

SEQ ID NO: 3692321 - RNA, 20 nt, Human
uguguauuuaauuguaaacu

SEQ ID NO: 3692322 - RNA, 22 nt, Human
uguguauuuaauuguaaacugu

SEQ ID NO: 3692323 - RNA, 19 nt, Human
uguguauuuccagugcaau

SEQ ID NO: 3692324 - RNA, 14 nt, Human
ugugucaauccaga

SEQ ID NO: 3692325 - RNA, 16 nt, Human
ugugucacaaagaauu

SEQ ID NO: 3692326 - RNA, 13 nt, Human
ugugucacuggcu

SEQ ID NO: 3692327 - RNA, 22 nt, Human
ugugucacuggcugccuccacu

SEQ ID NO: 3692328 - RNA, 15 nt, Human
ugugucacuugugcu

SEQ ID NO: 3692329 - RNA, 19 nt, Human
ugugucaguggggcucucu

SEQ ID NO: 3692330 - RNA, 21 nt, Human
ugugucaguggggcucucuga

SEQ ID NO: 3692331 - RNA, 20 nt, Human
ugugucaguuuauguuuugg

SEQ ID NO: 3692332 - RNA, 14 nt, Human
ugugucaguuuuca

SEQ ID NO: 3692333 - RNA, 15 nt, Human
ugugucaguuuucau

SEQ ID NO: 3692334 - RNA, 21 nt, Human
uguguccaaaaccgccagcuc

SEQ ID NO: 3692335 - RNA, 15 nt, Human
uguguccaacuccag

SEQ ID NO: 3692336 - RNA, 19 nt, Human
uguguccaagugugugugc

SEQ ID NO: 3692337 - RNA, 14 nt, Human
uguguccaugugug

SEQ ID NO: 3692338 - RNA, 16 nt, Human
uguguccaugugugug

SEQ ID NO: 3692339 - RNA, 18 nt, Human
uguguccaugugugugca

SEQ ID NO: 3692340 - RNA, 21 nt, Human
ugugucccaugacccaccccu

SEQ ID NO: 3692341 - RNA, 19 nt, Human
ugugucccaugaucccugu

SEQ ID NO: 3692342 - RNA, 20 nt, Human
ugugucccaugaucccugug

SEQ ID NO: 3692343 - RNA, 16 nt, Human
ugugucccccucuguc

SEQ ID NO: 3692344 - RNA, 18 nt, Human
ugugucccccucugucca

SEQ ID NO: 3692345 - RNA, 14 nt, Human
uguguccuaguucu

SEQ ID NO: 3692346 - RNA, 14 nt, Human
uguguccucaggga

SEQ ID NO: 3692347 - RNA, 18 nt, Human
uguguccuccaggagcuu

SEQ ID NO: 3692348 - RNA, 19 nt, Human
uguguccuggugcucucug

SEQ ID NO: 3692349 - RNA, 22 nt, Human
uguguccuggugcucucugcca

SEQ ID NO: 3692350 - RNA, 14 nt, Human
uguguccuucccug

SEQ ID NO: 3692351 - RNA, 16 nt, Human
uguguccuucccugca

SEQ ID NO: 3692352 - RNA, 17 nt, Human
uguguccuucccugcau

SEQ ID NO: 3692353 - RNA, 14 nt, Human
uguguccuugcacc

SEQ ID NO: 3692354 - RNA, 18 nt, Human
uguguccuugcaccugca

SEQ ID NO: 3692355 - RNA, 19 nt, Human
uguguccuugcaccugcau

SEQ ID NO: 3692356 - RNA, 12 nt, Human
ugugucuaaacu

SEQ ID NO: 3692357 - RNA, 13 nt, Human
ugugucuaaacug

SEQ ID NO: 3692358 - RNA, 19 nt, Human
ugugucuccugcaugcaga

SEQ ID NO: 3692359 - RNA, 13 nt, Human
ugugucucuuggu

SEQ ID NO: 3692360 - RNA, 16 nt, Human
ugugucucuugguccu

SEQ ID NO: 3692361 - RNA, 14 nt, Human
ugugucucuuuucu

SEQ ID NO: 3692362 - RNA, 16 nt, Human
ugugucugccacauua

SEQ ID NO: 3692363 - RNA, 22 nt, Human
ugugucugcuuuaaagggccug

SEQ ID NO: 3692364 - RNA, 14 nt, Human
ugugucuuaauuau

SEQ ID NO: 3692365 - RNA, 16 nt, Human
ugugucuuaauuauua

SEQ ID NO: 3692366 - RNA, 16 nt, Human
ugugucuuguguuuuu

SEQ ID NO: 3692367 - RNA, 22 nt, Human
ugugucuuucacagcuccuccc

SEQ ID NO: 3692368 - RNA, 12 nt, Human
ugugucuuucua

SEQ ID NO: 3692369 - RNA, 22 nt, Human
ugugugaaagguacuucaaauc

SEQ ID NO: 3692370 - RNA, 14 nt, Human
ugugugaaauugca

SEQ ID NO: 3692371 - RNA, 22 nt, Human
ugugugaagcuuaagggucaua

SEQ ID NO: 3692372 - RNA, 17 nt, Human
ugugugaagugagugag

SEQ ID NO: 3692373 - RNA, 16 nt, Human
ugugugaaugaacacu

SEQ ID NO: 3692374 - RNA, 18 nt, Human
ugugugaaugaacacucu

SEQ ID NO: 3692375 - RNA, 15 nt, Human
ugugugacaauucug

SEQ ID NO: 3692376 - RNA, 20 nt, Human
ugugugacaauucuguuuuu

SEQ ID NO: 3692377 - RNA, 20 nt, Human
ugugugaccaacuguguugu

SEQ ID NO: 3692378 - RNA, 19 nt, Human
ugugugaccccuccugggg

SEQ ID NO: 3692379 - RNA, 20 nt, Human
ugugugaggagcugcuggcu

SEQ ID NO: 3692380 - RNA, 17 nt, Human
ugugugagugugaauau

SEQ ID NO: 3692381 - RNA, 16 nt, Human
ugugugauauuucaga

SEQ ID NO: 3692382 - RNA, 14 nt, Human
ugugugaugugaca

SEQ ID NO: 3692383 - RNA, 17 nt, Human
ugugugaugugacauuu

SEQ ID NO: 3692384 - RNA, 15 nt, Human
ugugugauuaaaagg

SEQ ID NO: 3692385 - RNA, 15 nt, Human
ugugugauugacagc

SEQ ID NO: 3692386 - RNA, 17 nt, Human
ugugugcaaaagcagug

SEQ ID NO: 3692387 - RNA, 22 nt, Human
ugugugcaccuuaccaacuuuc

SEQ ID NO: 3692388 - RNA, 14 nt, Human
ugugugcagagcug

SEQ ID NO: 3692389 - RNA, 15 nt, Human
ugugugcaucaggcu

SEQ ID NO: 3692390 - RNA, 17 nt, Human
ugugugcaucaggcuuu

SEQ ID NO: 3692391 - RNA, 18 nt, Human
ugugugccgagcccuugc

SEQ ID NO: 3692392 - RNA, 14 nt, Human
uguguggacaggac

SEQ ID NO: 3692393 - RNA, 23 nt, Human
uguguggauugccucugaaaagu

SEQ ID NO: 3692394 - RNA, 16 nt, Human
uguguggccacuucug

SEQ ID NO: 3692395 - RNA, 18 nt, Human
ugugugggacuguacaca

SEQ ID NO: 3692396 - RNA, 16 nt, Human
ugugugggagugugua

SEQ ID NO: 3692397 - RNA, 21 nt, Human
uguguggguggauauaaauau

SEQ ID NO: 3692398 - RNA, 22 nt, Human
uguguggguggauauaaauaua

SEQ ID NO: 3692399 - RNA, 14 nt, Human
uguguggucaacau

SEQ ID NO: 3692400 - RNA, 23 nt, Human
uguguggucaacauuucucaugu

SEQ ID NO: 3692401 - RNA, 20 nt, Human
ugugugguuugguguguucc

SEQ ID NO: 3692402 - RNA, 12 nt, Human
uguguguaugug

SEQ ID NO: 3692403 - RNA, 14 nt, Human
uguguguaugugua

SEQ ID NO: 3692404 - RNA, 13 nt, Human
uguguguauuugc

SEQ ID NO: 3692405 - RNA, 19 nt, Human
uguguguccaaaacugccu

SEQ ID NO: 3692406 - RNA, 15 nt, Human
ugugugucccaggca

SEQ ID NO: 3692407 - RNA, 16 nt, Human
ugugugugaaugaaca

SEQ ID NO: 3692408 - RNA, 14 nt, Human
ugugugugauguga

SEQ ID NO: 3692409 - RNA, 18 nt, Human
ugugugugaugugacauu

SEQ ID NO: 3692410 - RNA, 13 nt, Human
ugugugugcgugu

SEQ ID NO: 3692411 - RNA, 20 nt, Human
ugugugugguuuuuuuucua

SEQ ID NO: 3692412 - RNA, 13 nt, Human
uguguguguaugu

SEQ ID NO: 3692413 - RNA, 14 nt, Human
uguguguguauguu

SEQ ID NO: 3692414 - RNA, 13 nt, Human
ugugugugugaau

SEQ ID NO: 3692415 - RNA, 12 nt, Human
ugugugugugug

SEQ ID NO: 3692416 - RNA, 14 nt, Human
ugugugugugugca

SEQ ID NO: 3692417 - RNA, 12 nt, Human
uguguguuccug

SEQ ID NO: 3692418 - RNA, 17 nt, Human
uguguguugccacagga

SEQ ID NO: 3692419 - RNA, 20 nt, Human
uguguguugccacaggacac

SEQ ID NO: 3692420 - RNA, 11 nt, Human
uguguguuuau

SEQ ID NO: 3692421 - RNA, 19 nt, Human
uguguguuuauugucaaag

SEQ ID NO: 3692422 - RNA, 12 nt, Human
uguguuaagagu

SEQ ID NO: 3692423 - RNA, 21 nt, Human
uguguuaagcucugcuauuag

SEQ ID NO: 3692424 - RNA, 19 nt, Human
uguguuaaguauguguaaa

SEQ ID NO: 3692425 - RNA, 15 nt, Human
uacaaacaaucucuu

SEQ ID NO: 3692426 - RNA, 22 nt, Human
uacaaacaauggaaacugaaug

SEQ ID NO: 3692427 - RNA, 19 nt, Human
uacaaacugaagaguaauc

SEQ ID NO: 3692428 - RNA, 16 nt, Human
uacaaacugguauucu

SEQ ID NO: 3692429 - RNA, 16 nt, Human
uacaaagaagacaugu

SEQ ID NO: 3692430 - RNA, 17 nt, Human
uacaaagaagacauguu

SEQ ID NO: 3692431 - RNA, 19 nt, Human
uacaaagaagacauguuuu

SEQ ID NO: 3692432 - RNA, 18 nt, Human
uacaaagcacuagagaau

SEQ ID NO: 3692433 - RNA, 16 nt, Human
uacaaaggcuguauuc

SEQ ID NO: 3692434 - RNA, 18 nt, Human
uacaaaggggaaagaaca

SEQ ID NO: 3692435 - RNA, 16 nt, Human
uacaaagguuuaaaug

SEQ ID NO: 3692436 - RNA, 18 nt, Human
uacaaaguagaagucuua

SEQ ID NO: 3692437 - RNA, 18 nt, Human
uacaaaguauuaagcaua

SEQ ID NO: 3692438 - RNA, 20 nt, Human
uacaaaguguauuuuauaaa

SEQ ID NO: 3692439 - RNA, 13 nt, Human
uacaaagugugua

SEQ ID NO: 3692440 - RNA, 20 nt, Human
uacaaaguuucaauuuguuu

SEQ ID NO: 3692441 - RNA, 17 nt, Human
uacaaauacucuuagga

SEQ ID NO: 3692442 - RNA, 13 nt, Human
uacaaauauauug

SEQ ID NO: 3692443 - RNA, 14 nt, Human
uacaaauauauugu

SEQ ID NO: 3692444 - RNA, 15 nt, Human
uacaaaucaguaauu

SEQ ID NO: 3692445 - RNA, 18 nt, Human
uacaaaugauugcuuuua

SEQ ID NO: 3692446 - RNA, 20 nt, Human
uacaaaugauugcuuuuaaa

SEQ ID NO: 3692447 - RNA, 16 nt, Human
uacaaaugcaucuuug

SEQ ID NO: 3692448 - RNA, 21 nt, Human
uacaaaugcaucuuugaugug

SEQ ID NO: 3692449 - RNA, 17 nt, Human
uacaaauguuaaaaugu

SEQ ID NO: 3692450 - RNA, 21 nt, Human
uacaaauguuaaaauguguug

SEQ ID NO: 3692451 - RNA, 13 nt, Human
uacaaauuauaaa

SEQ ID NO: 3692452 - RNA, 15 nt, Human
uacaaauuauaaaaa

SEQ ID NO: 3692453 - RNA, 15 nt, Human
uacaaauuauaaugu

SEQ ID NO: 3692454 - RNA, 15 nt, Human
uacaaauugcuuacu

SEQ ID NO: 3692455 - RNA, 16 nt, Human
uacaaauugcuugaaa

SEQ ID NO: 3692456 - RNA, 15 nt, Human
uacaaauuuuucugu

SEQ ID NO: 3692457 - RNA, 15 nt, Human
uacaacacaaagaga

SEQ ID NO: 3692458 - RNA, 16 nt, Human
uacaacaccaaaaaau

SEQ ID NO: 3692459 - RNA, 19 nt, Human
uacaacaccaaaaaauauc

SEQ ID NO: 3692460 - RNA, 12 nt, Human
uacaacagauuu

SEQ ID NO: 3692461 - RNA, 17 nt, Human
uacaacagauuugugaa

SEQ ID NO: 3692462 - RNA, 18 nt, Human
uacaacagauuugugaac

SEQ ID NO: 3692463 - RNA, 17 nt, Human
uacaagaaaaaaugaau

SEQ ID NO: 3692464 - RNA, 14 nt, Human
uacaagaagcauuu

SEQ ID NO: 3692465 - RNA, 19 nt, Human
uacaagaagcauuuuguaa

SEQ ID NO: 3692466 - RNA, 15 nt, Human
uacaagacacaguga

SEQ ID NO: 3692467 - RNA, 22 nt, Human
uacaagacugccauauuaaauu

SEQ ID NO: 3692468 - RNA, 23 nt, Human
uacaagagcagccuguggcaucu

SEQ ID NO: 3692469 - RNA, 15 nt, Human
uacaagauaagcuuc

SEQ ID NO: 3692470 - RNA, 15 nt, Human
uacaagauugaaaau

SEQ ID NO: 3692471 - RNA, 17 nt, Human
uacaagauuuagaaaaa

SEQ ID NO: 3692472 - RNA, 16 nt, Human
uacaagccugcacaau

SEQ ID NO: 3692473 - RNA, 18 nt, Human
uacaagcgugagccacug

SEQ ID NO: 3692474 - RNA, 21 nt, Human
uacaaggccccaagguuuaca

SEQ ID NO: 3692475 - RNA, 22 nt, Human
uacaaggccccaagguuuacau

SEQ ID NO: 3692476 - RNA, 17 nt, Human
uacaagguauaauaaaa

SEQ ID NO: 3692477 - RNA, 15 nt, Human
uacaaguaacaaaaa

SEQ ID NO: 3692478 - RNA, 18 nt, Human
uacaaguacugguaagau

SEQ ID NO: 3692479 - RNA, 16 nt, Human
uacaaguaguucugua

SEQ ID NO: 3692480 - RNA, 17 nt, Human
uacaaguauuuuuaauu

SEQ ID NO: 3692481 - RNA, 18 nt, Human
uacaaguauuuuuaauua

SEQ ID NO: 3692482 - RNA, 13 nt, Human
uacaaguuagaaa

SEQ ID NO: 3692483 - RNA, 18 nt, Human
uacaaguucuauuuaagu

SEQ ID NO: 3692484 - RNA, 22 nt, Human
uacaauaaauugcuaauguugc

SEQ ID NO: 3692485 - RNA, 12 nt, Human
uacaauaaugga

SEQ ID NO: 3692486 - RNA, 15 nt, Human
uacaauaauggaaaa

SEQ ID NO: 3692487 - RNA, 18 nt, Human
uacaauauauaaaaauau

SEQ ID NO: 3692488 - RNA, 23 nt, Human
uacaauauauagcuggcaagaau

SEQ ID NO: 3692489 - RNA, 23 nt, Human
uacaauauugauugggaaaacau

SEQ ID NO: 3692490 - RNA, 14 nt, Human
uacaauauuuuaag

SEQ ID NO: 3692491 - RNA, 17 nt, Human
uacaauauuuuaagcau

SEQ ID NO: 3692492 - RNA, 16 nt, Human
uacaaucagcugcuuu

SEQ ID NO: 3692493 - RNA, 20 nt, Human
uacaaucagcugcuuuguua

SEQ ID NO: 3692494 - RNA, 22 nt, Human
uacaaucagcugcuuuguuacc

SEQ ID NO: 3692495 - RNA, 18 nt, Human
uacaaucgcaaaucaaaa

SEQ ID NO: 3692496 - RNA, 17 nt, Human
uacaaucucuuuuuguu

SEQ ID NO: 3692497 - RNA, 13 nt, Human
uacaaugacuuua

SEQ ID NO: 3692498 - RNA, 18 nt, Human
uacaaugaugcuauuugc

SEQ ID NO: 3692499 - RNA, 15 nt, Human
uacaauguaauuauu

SEQ ID NO: 3692500 - RNA, 17 nt, Human
uacaauguauuuauuua

SEQ ID NO: 3692501 - RNA, 19 nt, Human
uacaauguauuuauuuaaa

SEQ ID NO: 3692502 - RNA, 20 nt, Human
uacaaugugaacuuuauuaa

SEQ ID NO: 3692503 - RNA, 21 nt, Human
uacaaugugaacuuuauuaaa

SEQ ID NO: 3692504 - RNA, 22 nt, Human
uacaaugugaacuuuauuaaau

SEQ ID NO: 3692505 - RNA, 17 nt, Human
uacaaugugacuuugaa

SEQ ID NO: 3692506 - RNA, 22 nt, Human
uacaauguucaucccaugaugu

SEQ ID NO: 3692507 - RNA, 13 nt, Human
uacaauguuuuau

SEQ ID NO: 3692508 - RNA, 18 nt, Human
uacaauuaaaaaaaaaga

SEQ ID NO: 3692509 - RNA, 22 nt, Human
uacaauuaaaaaaaaagaucug

SEQ ID NO: 3692510 - RNA, 19 nt, Human
uacaauuauaucaguccuc

SEQ ID NO: 3692511 - RNA, 13 nt, Human
uacaauugaaaug

SEQ ID NO: 3692512 - RNA, 14 nt, Human
uacaauugaacuua

SEQ ID NO: 3692513 - RNA, 22 nt, Human
uacaauugugggcauaaacugu

SEQ ID NO: 3692514 - RNA, 16 nt, Human
uacaauuuacaaagug

SEQ ID NO: 3692515 - RNA, 12 nt, Human
uacaauuuuauc

SEQ ID NO: 3692516 - RNA, 18 nt, Human
uacaauuuucucccagga

SEQ ID NO: 3692517 - RNA, 16 nt, Human
uacaauuuuguuucug

SEQ ID NO: 3692518 - RNA, 17 nt, Human
uacaauuuuuauuucuu

SEQ ID NO: 3692519 - RNA, 22 nt, Human
uacaauuuuuauuucuuuuacu

SEQ ID NO: 3692520 - RNA, 23 nt, Human
uacacaaaacaaaugccacacau

SEQ ID NO: 3692521 - RNA, 13 nt, Human
uacacaaagggga

SEQ ID NO: 3692522 - RNA, 14 nt, Human
uacacaaaggggau

SEQ ID NO: 3692523 - RNA, 19 nt, Human
uacacaaauacuuauucau

SEQ ID NO: 3692524 - RNA, 23 nt, Human
uacacaaaugauagcauaacaua

SEQ ID NO: 3692525 - RNA, 18 nt, Human
uacacaacuaguuuuguu

SEQ ID NO: 3692526 - RNA, 22 nt, Human
uacacaacucacuccuuuuaaa

SEQ ID NO: 3692527 - RNA, 22 nt, Human
uacacaagacuuuccccauacu

SEQ ID NO: 3692528 - RNA, 15 nt, Human
uacacaaguaaacau

SEQ ID NO: 3692529 - RNA, 14 nt, Human
uacacaauaagcaa

SEQ ID NO: 3692530 - RNA, 15 nt, Human
uacacaauaagcaaa

SEQ ID NO: 3692531 - RNA, 17 nt, Human
uacacaaugguuuucuu

SEQ ID NO: 3692532 - RNA, 23 nt, Human
uacacaaugguuuucuugugugu

SEQ ID NO: 3692533 - RNA, 16 nt, Human
uacacaaugugucuuu

SEQ ID NO: 3692534 - RNA, 17 nt, Human
uacacacacacacacag

SEQ ID NO: 3692535 - RNA, 20 nt, Human
uacacacacacacacagcca

SEQ ID NO: 3692536 - RNA, 14 nt, Human
uacacacacagaug

SEQ ID NO: 3692537 - RNA, 15 nt, Human
uacacacacauacac

SEQ ID NO: 3692538 - RNA, 15 nt, Human
uacacacauccacgc

SEQ ID NO: 3692539 - RNA, 16 nt, Human
uacacacggugccuuu

SEQ ID NO: 3692540 - RNA, 17 nt, Human
uacacacggugccuuua

SEQ ID NO: 3692541 - RNA, 17 nt, Human
uacacacguuuguuucu

SEQ ID NO: 3692542 - RNA, 15 nt, Human
uacacacugcauguu

SEQ ID NO: 3692543 - RNA, 20 nt, Human
uacacacugucaugcuucau

SEQ ID NO: 3692544 - RNA, 11 nt, Human
uacacagaaac

SEQ ID NO: 3692545 - RNA, 14 nt, Human
uacacagaaacacu

SEQ ID NO: 3692546 - RNA, 15 nt, Human
uacacagaaacacug

SEQ ID NO: 3692547 - RNA, 22 nt, Human
uacacagaaaugcugcuggcca

SEQ ID NO: 3692548 - RNA, 21 nt, Human
uacacaggacagggguuccuu

SEQ ID NO: 3692549 - RNA, 16 nt, Human
uacacagucugcaaga

SEQ ID NO: 3692550 - RNA, 11 nt, Human
uacacagugug

SEQ ID NO: 3692551 - RNA, 11 nt, Human
uacacaguugc

SEQ ID NO: 3692552 - RNA, 23 nt, Human
uacacauacaguuuuaugcucuu

SEQ ID NO: 3692553 - RNA, 14 nt, Human
uacacauauaccua

SEQ ID NO: 3692554 - RNA, 20 nt, Human
uacacauguauccuuucaca

SEQ ID NO: 3692555 - RNA, 18 nt, Human
uacacauuaaguaaucaa

SEQ ID NO: 3692556 - RNA, 14 nt, Human
uacacauuagauuu

SEQ ID NO: 3692557 - RNA, 23 nt, Human
uacacauuagauuuuauuuuacu

SEQ ID NO: 3692558 - RNA, 20 nt, Human
uacacauucggcucccugga

SEQ ID NO: 3692559 - RNA, 16 nt, Human
uacacauuuguacaga

SEQ ID NO: 3692560 - RNA, 23 nt, Human
uacacauuuuauuuuauuaugca

SEQ ID NO: 3692561 - RNA, 23 nt, Human
uacacauuuuuaaauuguuagcu

SEQ ID NO: 3692562 - RNA, 21 nt, Human
uacacauuuuucagauauaaa

SEQ ID NO: 3692563 - RNA, 17 nt, Human
uacaccacacacaacag

SEQ ID NO: 3692564 - RNA, 18 nt, Human
uacaccacacacaacagc

SEQ ID NO: 3692565 - RNA, 19 nt, Human
uacaccaccucacuccugu

SEQ ID NO: 3692566 - RNA, 20 nt, Human
uacaccacuacauucuguua

SEQ ID NO: 3692567 - RNA, 17 nt, Human
uacaccacucuggcagc

SEQ ID NO: 3692568 - RNA, 20 nt, Human
uacaccacucuggcagccac

SEQ ID NO: 3692569 - RNA, 21 nt, Human
uacaccacucuggcagccaca

SEQ ID NO: 3692570 - RNA, 20 nt, Human
uacaccagagauaauaugag

SEQ ID NO: 3692571 - RNA, 14 nt, Human
uacacccaaagagg

SEQ ID NO: 3692572 - RNA, 11 nt, Human
uacacccagca

SEQ ID NO: 3692573 - RNA, 12 nt, Human
uacacccagcaa

SEQ ID NO: 3692574 - RNA, 19 nt, Human
uacacccaugaaagaaaac

SEQ ID NO: 3692575 - RNA, 19 nt, Human
uuauuaguauuguuguccu

SEQ ID NO: 3692576 - RNA, 13 nt, Human
uuauuauaaaaau

SEQ ID NO: 3692577 - RNA, 22 nt, Human
uuauuauaaucuuauaauuguu

SEQ ID NO: 3692578 - RNA, 15 nt, Human
uuauuauaauuguau

SEQ ID NO: 3692579 - RNA, 13 nt, Human
uuauuauauaauu

SEQ ID NO: 3692580 - RNA, 22 nt, Human
uuauuaucuaaaguguguuguu

SEQ ID NO: 3692581 - RNA, 11 nt, Human
uuauuaugaaa

SEQ ID NO: 3692582 - RNA, 21 nt, Human
uuauuaugaaacuuguguaaa

SEQ ID NO: 3692583 - RNA, 13 nt, Human
uuauuauguaaau

SEQ ID NO: 3692584 - RNA, 14 nt, Human
uuauuauguaaauc

SEQ ID NO: 3692585 - RNA, 22 nt, Human
uuauuauguaaaucccauuauu

SEQ ID NO: 3692586 - RNA, 14 nt, Human
uuauuauuaacaaa

SEQ ID NO: 3692587 - RNA, 16 nt, Human
uuauuauuauuuuuua

SEQ ID NO: 3692588 - RNA, 14 nt, Human
uuauuauuguggua

SEQ ID NO: 3692589 - RNA, 14 nt, Human
uuauucaaagagaa

SEQ ID NO: 3692590 - RNA, 19 nt, Human
uuauucaaagagaaaacau

SEQ ID NO: 3692591 - RNA, 23 nt, Human
uuauucaaagagaaaacaucuca

SEQ ID NO: 3692592 - RNA, 15 nt, Human
uuauucaaaguugcc

SEQ ID NO: 3692593 - RNA, 19 nt, Human
uuauucaauaaaguauuua

SEQ ID NO: 3692594 - RNA, 18 nt, Human
uuauucaauuccucuggg

SEQ ID NO: 3692595 - RNA, 17 nt, Human
uuauucaauuuauuuga

SEQ ID NO: 3692596 - RNA, 18 nt, Human
uuauucaauuuauuugaa

SEQ ID NO: 3692597 - RNA, 21 nt, Human
uuauucaauuuauuugaauga

SEQ ID NO: 3692598 - RNA, 21 nt, Human
uuauucaggaaaagccucugu

SEQ ID NO: 3692599 - RNA, 18 nt, Human
uuauucaguaacugucag

SEQ ID NO: 3692600 - RNA, 16 nt, Human
uuauucaguuaagaaa

SEQ ID NO: 3692601 - RNA, 18 nt, Human
uuauucaguuaagaaaaa

SEQ ID NO: 3692602 - RNA, 16 nt, Human
uuauucauaugcauau

SEQ ID NO: 3692603 - RNA, 21 nt, Human
uuauucauuaguuuugaagau

SEQ ID NO: 3692604 - RNA, 18 nt, Human
uuauucauuauuugucaa

SEQ ID NO: 3692605 - RNA, 12 nt, Human
uuauucauugug

SEQ ID NO: 3692606 - RNA, 12 nt, Human
uuauucauuuaa

SEQ ID NO: 3692607 - RNA, 20 nt, Human
uuauuccaaaccaaauuuua

SEQ ID NO: 3692608 - RNA, 20 nt, Human
uuauuccagaaugcuguaca

SEQ ID NO: 3692609 - RNA, 19 nt, Human
uuauuccauauuagaaaac

SEQ ID NO: 3692610 - RNA, 23 nt, Human
uuauuccauauuagaaaacuuug

SEQ ID NO: 3692611 - RNA, 18 nt, Human
uuauucccuuccugccag

SEQ ID NO: 3692612 - RNA, 22 nt, Human
uuauuccuauauaguuuauuga

SEQ ID NO: 3692613 - RNA, 16 nt, Human
uuauuccuccugcuca

SEQ ID NO: 3692614 - RNA, 20 nt, Human
uuauuccuccugcucauauu

SEQ ID NO: 3692615 - RNA, 19 nt, Human
uuauucguagauauuggac

SEQ ID NO: 3692616 - RNA, 14 nt, Human
uuauucuacuauac

SEQ ID NO: 3692617 - RNA, 13 nt, Human
uuauucuagauua

SEQ ID NO: 3692618 - RNA, 15 nt, Human
uuauucucaaagcag

SEQ ID NO: 3692619 - RNA, 19 nt, Human
uuauucucuuuuaucuguu

SEQ ID NO: 3692620 - RNA, 13 nt, Human
uuauucuggaguu

SEQ ID NO: 3692621 - RNA, 19 nt, Human
uuauucugggaauguauag

SEQ ID NO: 3692622 - RNA, 14 nt, Human
uuauucuucuagag

SEQ ID NO: 3692623 - RNA, 14 nt, Human
uuauucuugugaau

SEQ ID NO: 3692624 - RNA, 16 nt, Human
uuauucuuuuuaaagu

SEQ ID NO: 3692625 - RNA, 22 nt, Human
uuauucuuuuuuucucuagagu

SEQ ID NO: 3692626 - RNA, 14 nt, Human
uuauugaaagaauu

SEQ ID NO: 3692627 - RNA, 12 nt, Human
uuauugaagcag

SEQ ID NO: 3692628 - RNA, 17 nt, Human
uuauugaagcagagugg

SEQ ID NO: 3692629 - RNA, 14 nt, Human
uuauugacacagaa

SEQ ID NO: 3692630 - RNA, 13 nt, Human
uuauugaccauuu

SEQ ID NO: 3692631 - RNA, 14 nt, Human
uuauugacucuuga

SEQ ID NO: 3692632 - RNA, 16 nt, Human
uuauugagaaagagca

SEQ ID NO: 3692633 - RNA, 13 nt, Human
uuauugagaauuu

SEQ ID NO: 3692634 - RNA, 19 nt, Human
uuauugagaauuuuaaauu

SEQ ID NO: 3692635 - RNA, 19 nt, Human
uuauugaggaaaaauaugu

SEQ ID NO: 3692636 - RNA, 23 nt, Human
uuauugaggaaaaauaugugaag

SEQ ID NO: 3692637 - RNA, 19 nt, Human
uuauugaguuccaguugaa

SEQ ID NO: 3692638 - RNA, 15 nt, Human
uuauugauaaguuca

SEQ ID NO: 3692639 - RNA, 21 nt, Human
uuauugauauucuaagaaaua

SEQ ID NO: 3692640 - RNA, 14 nt, Human
uuauugaugaaaau

SEQ ID NO: 3692641 - RNA, 20 nt, Human
uuauugcaauaaaagugcuu

SEQ ID NO: 3692642 - RNA, 13 nt, Human
uuauugcauuaua

SEQ ID NO: 3692643 - RNA, 21 nt, Human
uuauugccaaaacccagcugc

SEQ ID NO: 3692644 - RNA, 19 nt, Human
uuauugccaggaaaggaga

SEQ ID NO: 3692645 - RNA, 12 nt, Human
uuauugccuucu

SEQ ID NO: 3692646 - RNA, 17 nt, Human
uuauugccuucucacca

SEQ ID NO: 3692647 - RNA, 14 nt, Human
uuauugcuaguauu

SEQ ID NO: 3692648 - RNA, 18 nt, Human
uuauugcuaguauuugaa

SEQ ID NO: 3692649 - RNA, 12 nt, Human
uuauuggaaagg

SEQ ID NO: 3692650 - RNA, 13 nt, Human
uuauuggaauuaa

SEQ ID NO: 3692651 - RNA, 19 nt, Human
uuauuggccugaaaugauc

SEQ ID NO: 3692652 - RNA, 15 nt, Human
uuauuggcugagaua

SEQ ID NO: 3692653 - RNA, 19 nt, Human
uuauugggcaagugauuga

SEQ ID NO: 3692654 - RNA, 20 nt, Human
uuauugguuuuccaaucauu

SEQ ID NO: 3692655 - RNA, 18 nt, Human
uuauugguuuugcagaag

SEQ ID NO: 3692656 - RNA, 12 nt, Human
uuauuguaaauu

SEQ ID NO: 3692657 - RNA, 14 nt, Human
uuauuguauaaacu

SEQ ID NO: 3692658 - RNA, 22 nt, Human
uuauuguauaaacuaucaguuu

SEQ ID NO: 3692659 - RNA, 13 nt, Human
uuauuguauucug

SEQ ID NO: 3692660 - RNA, 13 nt, Human
uuauugucuguaa

SEQ ID NO: 3692661 - RNA, 22 nt, Human
uuauugugaaugauucauguua

SEQ ID NO: 3692662 - RNA, 19 nt, Human
uuauuguggauaacaaaga

SEQ ID NO: 3692663 - RNA, 20 nt, Human
uuauugugguaggccuuuua

SEQ ID NO: 3692664 - RNA, 15 nt, Human
uuauuguguuuguca

SEQ ID NO: 3692665 - RNA, 16 nt, Human
uuauuguuccaagaca

SEQ ID NO: 3692666 - RNA, 17 nt, Human
uuauuguuuaaaaucau

SEQ ID NO: 3692667 - RNA, 17 nt, Human
uuauuuaaaaaacuaaa

SEQ ID NO: 3692668 - RNA, 14 nt, Human
uuauuuaaaagauu

SEQ ID NO: 3692669 - RNA, 15 nt, Human
uuauuuaaaagauuc

SEQ ID NO: 3692670 - RNA, 17 nt, Human
uuauuuaaaagauucau

SEQ ID NO: 3692671 - RNA, 15 nt, Human
uuauuuaaaauagca

SEQ ID NO: 3692672 - RNA, 22 nt, Human
uuauuuaaaauagcaaaagaag

SEQ ID NO: 3692673 - RNA, 23 nt, Human
uuauuuaaaccgcuaaaagaaac

SEQ ID NO: 3692674 - RNA, 15 nt, Human
uuauuuaaaugucua

SEQ ID NO: 3692675 - RNA, 20 nt, Human
uuauuuaaaugucuaaugua

SEQ ID NO: 3692676 - RNA, 22 nt, Human
uuauuuaaugaaagacuguaca

SEQ ID NO: 3692677 - RNA, 16 nt, Human
uuauuuaauguuaugu

SEQ ID NO: 3692678 - RNA, 15 nt, Human
uuauuuacauuuaau

SEQ ID NO: 3692679 - RNA, 16 nt, Human
uuauuuacauuuaaua

SEQ ID NO: 3692680 - RNA, 22 nt, Human
uuauuuacugagcuucucugug

SEQ ID NO: 3692681 - RNA, 12 nt, Human
uuauuuagagau

SEQ ID NO: 3692682 - RNA, 15 nt, Human
uuauuuaguauuuau

SEQ ID NO: 3692683 - RNA, 16 nt, Human
uuauuuaguuccuuga

SEQ ID NO: 3692684 - RNA, 14 nt, Human
uuauuuauagucau

SEQ ID NO: 3692685 - RNA, 14 nt, Human
uuauuuauauguac

SEQ ID NO: 3692686 - RNA, 17 nt, Human
uuauuuauauguacugu

SEQ ID NO: 3692687 - RNA, 15 nt, Human
uuauuuauauuuauu

SEQ ID NO: 3692688 - RNA, 16 nt, Human
uuauuuauauuuauug

SEQ ID NO: 3692689 - RNA, 17 nt, Human
uuauuuauauuuauuga

SEQ ID NO: 3692690 - RNA, 14 nt, Human
uuauuuauguauug

SEQ ID NO: 3692691 - RNA, 13 nt, Human
uuauuuauuaaga

SEQ ID NO: 3692692 - RNA, 17 nt, Human
uuauuuauucagcuuca

SEQ ID NO: 3692693 - RNA, 22 nt, Human
uuauuuauucugggaauguaua

SEQ ID NO: 3692694 - RNA, 21 nt, Human
uuauuucacuuuagaugcuga

SEQ ID NO: 3692695 - RNA, 11 nt, Human
uuauuucagaa

SEQ ID NO: 3692696 - RNA, 15 nt, Human
uuauuucagaaaugu

SEQ ID NO: 3692697 - RNA, 23 nt, Human
uuauuucagauuuugauaacugu

SEQ ID NO: 3692698 - RNA, 15 nt, Human
uuauuuccacuaaaa

SEQ ID NO: 3692699 - RNA, 18 nt, Human
uuauuuccacuaaaaaua

SEQ ID NO: 3692700 - RNA, 20 nt, Human
uuauuuccaguguucuauga

SEQ ID NO: 3692701 - RNA, 21 nt, Human
uuauuuccuaguucuguagaa

SEQ ID NO: 3692702 - RNA, 22 nt, Human
uuauuucucagacuuuggaaaa

SEQ ID NO: 3692703 - RNA, 17 nt, Human
uuauuucugcaaacaaa

SEQ ID NO: 3692704 - RNA, 20 nt, Human
uuauuucugcauauguugaa

SEQ ID NO: 3692705 - RNA, 12 nt, Human
uuauuucuguca

SEQ ID NO: 3692706 - RNA, 12 nt, Human
uuauuucuucaa

SEQ ID NO: 3692707 - RNA, 14 nt, Human
uuauuugacaaaau

SEQ ID NO: 3692708 - RNA, 15 nt, Human
uuauuugcagagaca

SEQ ID NO: 3692709 - RNA, 11 nt, Human
uuauuugcaua

SEQ ID NO: 3692710 - RNA, 19 nt, Human
uuauuugcauguuauguuu

SEQ ID NO: 3692711 - RNA, 13 nt, Human
uuauuuguaaauu

SEQ ID NO: 3692712 - RNA, 16 nt, Human
uuauuuguaauagaug

SEQ ID NO: 3692713 - RNA, 15 nt, Human
uuauuuguacaguuc

SEQ ID NO: 3692714 - RNA, 15 nt, Human
uuauuugucagugua

SEQ ID NO: 3692715 - RNA, 19 nt, Human
uuauuugugauguacugua

SEQ ID NO: 3692716 - RNA, 13 nt, Human
uuauuuguguaau

SEQ ID NO: 3692717 - RNA, 16 nt, Human
uuauuuguguaauaga

SEQ ID NO: 3692718 - RNA, 14 nt, Human
uuauuuuaaaauuu

SEQ ID NO: 3692719 - RNA, 17 nt, Human
uuauuuuaauaauguuu

SEQ ID NO: 3692720 - RNA, 20 nt, Human
uuauuuuaauaauguuucaa

SEQ ID NO: 3692721 - RNA, 14 nt, Human
uuauuuuaauguga

SEQ ID NO: 3692722 - RNA, 18 nt, Human
uuauuuuaaugugaugau

SEQ ID NO: 3692723 - RNA, 23 nt, Human
uuauuuuaaugugaugauguaau

SEQ ID NO: 3692724 - RNA, 17 nt, Human
uuauuuuacacagaaac

SEQ ID NO: 3692725 - RNA, 15 nt, Human
uuauuuuacuuuuug

SEQ ID NO: 3692726 - RNA, 16 nt, Human
uguguuagagauuuuu

SEQ ID NO: 3692727 - RNA, 14 nt, Human
uguguuauuuaaau

SEQ ID NO: 3692728 - RNA, 21 nt, Human
uguguucccuuugucuuucaa

SEQ ID NO: 3692729 - RNA, 12 nt, Human
uguguuccuggc

SEQ ID NO: 3692730 - RNA, 24 nt, Human
uguguuccuggcaauaguguguuc

SEQ ID NO: 3692731 - RNA, 18 nt, Human
uguguucucggagugugu

SEQ ID NO: 3692732 - RNA, 19 nt, Human
uguguucuguuuguuaaaa

SEQ ID NO: 3692733 - RNA, 13 nt, Human
uguguugaaaacc

SEQ ID NO: 3692734 - RNA, 14 nt, Human
uguguugaaaacca

SEQ ID NO: 3692735 - RNA, 13 nt, Human
uguguugaaacug

SEQ ID NO: 3692736 - RNA, 18 nt, Human
uguguugauacuguugca

SEQ ID NO: 3692737 - RNA, 19 nt, Human
uguguugauacuguugcac

SEQ ID NO: 3692738 - RNA, 20 nt, Human
uguguugauacuguugcacg

SEQ ID NO: 3692739 - RNA, 23 nt, Human
uguguugccacaggacacaguca

SEQ ID NO: 3692740 - RNA, 18 nt, Human
uguguugccaugugugcu

SEQ ID NO: 3692741 - RNA, 15 nt, Human
uguguugcuauccug

SEQ ID NO: 3692742 - RNA, 21 nt, Human
uguguuggacaaaugugaaga

SEQ ID NO: 3692743 - RNA, 17 nt, Human
uguguugguguggccca

SEQ ID NO: 3692744 - RNA, 19 nt, Human
uguguuguauuaacaaaag

SEQ ID NO: 3692745 - RNA, 14 nt, Human
uguguugucuugaa

SEQ ID NO: 3692746 - RNA, 18 nt, Human
uguguugucuugaaagau

SEQ ID NO: 3692747 - RNA, 13 nt, Human
uguguugugaaug

SEQ ID NO: 3692748 - RNA, 21 nt, Human
uguguuguugcuucuugugaa

SEQ ID NO: 3692749 - RNA, 15 nt, Human
uguguuuaaauaaag

SEQ ID NO: 3692750 - RNA, 18 nt, Human
uguguuuagaauugaagg

SEQ ID NO: 3692751 - RNA, 22 nt, Human
uguguuuagaauugaagguuuu

SEQ ID NO: 3692752 - RNA, 22 nt, Human
uguguuuaggaacuacugagga

SEQ ID NO: 3692753 - RNA, 22 nt, Human
uguguuuauucaaacugaaaag

SEQ ID NO: 3692754 - RNA, 12 nt, Human
uguguuuauucu

SEQ ID NO: 3692755 - RNA, 14 nt, Human
uguguuuauucuug

SEQ ID NO: 3692756 - RNA, 15 nt, Human
uguguuuauucuuga

SEQ ID NO: 3692757 - RNA, 20 nt, Human
uguguuuauucuugaugaaa

SEQ ID NO: 3692758 - RNA, 13 nt, Human
uguguuuauuguc

SEQ ID NO: 3692759 - RNA, 14 nt, Human
uguguuuauuucac

SEQ ID NO: 3692760 - RNA, 13 nt, Human
uguguuucaaacu

SEQ ID NO: 3692761 - RNA, 15 nt, Human
uguguuucaaguuca

SEQ ID NO: 3692762 - RNA, 18 nt, Human
uguguuucacaguuugaa

SEQ ID NO: 3692763 - RNA, 19 nt, Human
uguguuucacaguuugaaa

SEQ ID NO: 3692764 - RNA, 13 nt, Human
uguguuucacuuu

SEQ ID NO: 3692765 - RNA, 21 nt, Human
uguguuucuccugagcuagga

SEQ ID NO: 3692766 - RNA, 17 nt, Human
uguguuucuugccucau

SEQ ID NO: 3692767 - RNA, 16 nt, Human
uguguuugcagccugc

SEQ ID NO: 3692768 - RNA, 17 nt, Human
uguguuuggcuuucagg

SEQ ID NO: 3692769 - RNA, 17 nt, Human
uguguuugguuuacauu

SEQ ID NO: 3692770 - RNA, 18 nt, Human
uguguuugguuuacauuu

SEQ ID NO: 3692771 - RNA, 15 nt, Human
uguguuuguguauuu

SEQ ID NO: 3692772 - RNA, 20 nt, Human
uguguuuuagaguaagaaau

SEQ ID NO: 3692773 - RNA, 12 nt, Human
uguguuuuauaa

SEQ ID NO: 3692774 - RNA, 14 nt, Human
uguguuuuuaaaag

SEQ ID NO: 3692775 - RNA, 20 nt, Human
uguguuuuuaauaaagacag

SEQ ID NO: 3692776 - RNA, 15 nt, Human
uguguuuuucauaaa

SEQ ID NO: 3692777 - RNA, 15 nt, Human
uguguuuuucuauua

SEQ ID NO: 3692778 - RNA, 19 nt, Human
uguguuuuucuauuaaaag

SEQ ID NO: 3692779 - RNA, 22 nt, Human
uguguuuuucuauuaaaagacu

SEQ ID NO: 3692780 - RNA, 16 nt, Human
uguguuuuucuccagu

SEQ ID NO: 3692781 - RNA, 19 nt, Human
uguguuuuugggaugucuu

SEQ ID NO: 3692782 - RNA, 14 nt, Human
uguguuuuuuaaga

SEQ ID NO: 3692783 - RNA, 20 nt, Human
uguuaaaaaaauaagaagaa

SEQ ID NO: 3692784 - RNA, 22 nt, Human
uguuaaaaaaauaagaagaaug

SEQ ID NO: 3692785 - RNA, 18 nt, Human
uguuaaaaaauuuuugaa

SEQ ID NO: 3692786 - RNA, 19 nt, Human
uguuaaaaaauuuuugaaa

SEQ ID NO: 3692787 - RNA, 13 nt, Human
uguuaaaaauguu

SEQ ID NO: 3692788 - RNA, 20 nt, Human
uguuaaaaguuuuauaugcu

SEQ ID NO: 3692789 - RNA, 13 nt, Human
uguuaaaauaaau

SEQ ID NO: 3692790 - RNA, 12 nt, Human
uguuaaaaucua

SEQ ID NO: 3692791 - RNA, 14 nt, Human
uguuaaaaucuauu

SEQ ID NO: 3692792 - RNA, 21 nt, Human
uguuaaaauuaucaauaucua

SEQ ID NO: 3692793 - RNA, 20 nt, Human
uguuaaaauuaugaaucuga

SEQ ID NO: 3692794 - RNA, 17 nt, Human
uguuaaacagccuauuc

SEQ ID NO: 3692795 - RNA, 19 nt, Human
uguuaaacuagcauaucug

SEQ ID NO: 3692796 - RNA, 20 nt, Human
uguuaaacuagcauaucugc

SEQ ID NO: 3692797 - RNA, 22 nt, Human
uguuaaacuagcauaucugccu

SEQ ID NO: 3692798 - RNA, 13 nt, Human
uguuaaacuguua

SEQ ID NO: 3692799 - RNA, 19 nt, Human
uguuaaacuguuagcacug

SEQ ID NO: 3692800 - RNA, 21 nt, Human
uguuaaacuguuagcacuguu

SEQ ID NO: 3692801 - RNA, 13 nt, Human
uguuaaagaugua

SEQ ID NO: 3692802 - RNA, 18 nt, Human
uguuaaagauguagcaaa

SEQ ID NO: 3692803 - RNA, 14 nt, Human
uguuaaauaaauug

SEQ ID NO: 3692804 - RNA, 19 nt, Human
uguuaaaugaaauuguaaa

SEQ ID NO: 3692805 - RNA, 18 nt, Human
uguuaaauugcuguguau

SEQ ID NO: 3692806 - RNA, 18 nt, Human
uguuaaauuuguaaguuu

SEQ ID NO: 3692807 - RNA, 16 nt, Human
uguuaacauuccaaga

SEQ ID NO: 3692808 - RNA, 20 nt, Human
uguuaacauuuuugguaguc

SEQ ID NO: 3692809 - RNA, 16 nt, Human
uguuaaccagaauaaa

SEQ ID NO: 3692810 - RNA, 15 nt, Human
uguuaaccauuuaag

SEQ ID NO: 3692811 - RNA, 19 nt, Human
uguuaaccucagugucauu

SEQ ID NO: 3692812 - RNA, 17 nt, Human
uguuaagacuugacagu

SEQ ID NO: 3692813 - RNA, 23 nt, Human
uguuaagcagcuaaauuuucuga

SEQ ID NO: 3692814 - RNA, 20 nt, Human
uguuaaggaaacucuuaucu

SEQ ID NO: 3692815 - RNA, 20 nt, Human
uguuaagggaagaauuccag

SEQ ID NO: 3692816 - RNA, 24 nt, Human
uguuaagguccugaaaguaacuca

SEQ ID NO: 3692817 - RNA, 15 nt, Human
uguuaaguaugugua

SEQ ID NO: 3692818 - RNA, 16 nt, Human
uguuaaguauguguaa

SEQ ID NO: 3692819 - RNA, 15 nt, Human
uguuaaguauuuuca

SEQ ID NO: 3692820 - RNA, 21 nt, Human
uguuaaguuauagugaauacu

SEQ ID NO: 3692821 - RNA, 13 nt, Human
uguuaauaaaagu

SEQ ID NO: 3692822 - RNA, 22 nt, Human
uguuaauaaagugcacugccac

SEQ ID NO: 3692823 - RNA, 16 nt, Human
uguuaauacaagguau

SEQ ID NO: 3692824 - RNA, 18 nt, Human
uguuaauacuaguuguga

SEQ ID NO: 3692825 - RNA, 17 nt, Human
uguuaaucaauuuaaac

SEQ ID NO: 3692826 - RNA, 23 nt, Human
uguuaaucucuguuauguacugu

SEQ ID NO: 3692827 - RNA, 19 nt, Human
uguuaaucuuaauguauau

SEQ ID NO: 3692828 - RNA, 23 nt, Human
uguuaaucuuaggggagagcuuu

SEQ ID NO: 3692829 - RNA, 14 nt, Human
uguuaaugaaaaug

SEQ ID NO: 3692830 - RNA, 20 nt, Human
uguuaauucagcacugauuu

SEQ ID NO: 3692831 - RNA, 17 nt, Human
uguuaauuuagaaaacu

SEQ ID NO: 3692832 - RNA, 18 nt, Human
uguuaauuuagaaaacuu

SEQ ID NO: 3692833 - RNA, 22 nt, Human
uguuaauuuuuugguacaaaaa

SEQ ID NO: 3692834 - RNA, 15 nt, Human
uguuacaaaauguaa

SEQ ID NO: 3692835 - RNA, 18 nt, Human
uguuacaaaauguaacug

SEQ ID NO: 3692836 - RNA, 16 nt, Human
uguuacacaaugguuu

SEQ ID NO: 3692837 - RNA, 23 nt, Human
uguuacagccaagugccaaaugc

SEQ ID NO: 3692838 - RNA, 14 nt, Human
uguuacaguaaugu

SEQ ID NO: 3692839 - RNA, 14 nt, Human
uguuacauagugua

SEQ ID NO: 3692840 - RNA, 12 nt, Human
uguuacauguau

SEQ ID NO: 3692841 - RNA, 18 nt, Human
uguuaccaugucacugug

SEQ ID NO: 3692842 - RNA, 19 nt, Human
uguuaccaugucacugugg

SEQ ID NO: 3692843 - RNA, 14 nt, Human
uguuaccauucaca

SEQ ID NO: 3692844 - RNA, 18 nt, Human
uguuaccauuggaaauuu

SEQ ID NO: 3692845 - RNA, 15 nt, Human
uguuaccugaaaaca

SEQ ID NO: 3692846 - RNA, 12 nt, Human
uguuaccuuaaa

SEQ ID NO: 3692847 - RNA, 17 nt, Human
uguuacuaaagaaaaua

SEQ ID NO: 3692848 - RNA, 13 nt, Human
uguuacuaacuaa

SEQ ID NO: 3692849 - RNA, 14 nt, Human
uguuacuaacuaaa

SEQ ID NO: 3692850 - RNA, 18 nt, Human
uguuacuaacuaaacucu

SEQ ID NO: 3692851 - RNA, 16 nt, Human
uguuacuaucugcuuu

SEQ ID NO: 3692852 - RNA, 22 nt, Human
uguuacucucuugcaccaaauu

SEQ ID NO: 3692853 - RNA, 15 nt, Human
uguuacugaccagca

SEQ ID NO: 3692854 - RNA, 13 nt, Human
uguuacugaucau

SEQ ID NO: 3692855 - RNA, 12 nt, Human
uguuacugccuu

SEQ ID NO: 3692856 - RNA, 15 nt, Human
uguuacugggcccug

SEQ ID NO: 3692857 - RNA, 14 nt, Human
uguuacuguaauuc

SEQ ID NO: 3692858 - RNA, 17 nt, Human
uguuacuguuaaccauu

SEQ ID NO: 3692859 - RNA, 18 nt, Human
uguuacuguuaaccauuu

SEQ ID NO: 3692860 - RNA, 13 nt, Human
uguuacuguucuu

SEQ ID NO: 3692861 - RNA, 14 nt, Human
uguuacuguucuug

SEQ ID NO: 3692862 - RNA, 20 nt, Human
uguuacuguucuugcugcua

SEQ ID NO: 3692863 - RNA, 12 nt, Human
uguuacuuaccu

SEQ ID NO: 3692864 - RNA, 18 nt, Human
uguuacuuaccuaaacag

SEQ ID NO: 3692865 - RNA, 15 nt, Human
uguuacuucucuaau

SEQ ID NO: 3692866 - RNA, 21 nt, Human
uguuagaacacuauuuucaga

SEQ ID NO: 3692867 - RNA, 22 nt, Human
uguuagaacacuauuuucagaa

SEQ ID NO: 3692868 - RNA, 13 nt, Human
uguuagagacuuu

SEQ ID NO: 3692869 - RNA, 21 nt, Human
uguuagagguuuuaaagugau

SEQ ID NO: 3692870 - RNA, 23 nt, Human
uguuagaguccaacguggggcag

SEQ ID NO: 3692871 - RNA, 20 nt, Human
uguuagauauuuuucauaaa

SEQ ID NO: 3692872 - RNA, 23 nt, Human
uguuagauauuuuucauaaacaa

SEQ ID NO: 3692873 - RNA, 12 nt, Human
uguuagauguuu

SEQ ID NO: 3692874 - RNA, 17 nt, Human
uguuagauuaagaaaua

SEQ ID NO: 3692875 - RNA, 14 nt, Human
uguuagcacuguug

SEQ ID NO: 3692876 - RNA, 15 nt, Human
uguuagcacuguuga

SEQ ID NO: 3692877 - RNA, 16 nt, Human
uguuagcacuguugau

SEQ ID NO: 3692878 - RNA, 19 nt, Human
uguuagccuuuuuucccca

SEQ ID NO: 3692879 - RNA, 20 nt, Human
uguuagccuuuuuuccccag

SEQ ID NO: 3692880 - RNA, 18 nt, Human
uguuagcuccucacugug

SEQ ID NO: 3692881 - RNA, 20 nt, Human
uguuagcuuccuuaaguaua

SEQ ID NO: 3692882 - RNA, 20 nt, Human
uguuagcuuuuuaaaacauu

SEQ ID NO: 3692883 - RNA, 14 nt, Human
uguuaggcugggcc

SEQ ID NO: 3692884 - RNA, 17 nt, Human
uguuaguaugaggcauu

SEQ ID NO: 3692885 - RNA, 20 nt, Human
uguuaguaugaggcauuugu

SEQ ID NO: 3692886 - RNA, 14 nt, Human
uguuaguucccaac

SEQ ID NO: 3692887 - RNA, 15 nt, Human
uguuaguucccaaca

SEQ ID NO: 3692888 - RNA, 14 nt, Human
uguuaguuccugua

SEQ ID NO: 3692889 - RNA, 20 nt, Human
uguuaguuccuguaugaaag

SEQ ID NO: 3692890 - RNA, 17 nt, Human
uguuauacaaccuucau

SEQ ID NO: 3692891 - RNA, 21 nt, Human
uguuauacaaccuucauuuaa

SEQ ID NO: 3692892 - RNA, 22 nt, Human
uguuauacaaccuucauuuaaa

SEQ ID NO: 3692893 - RNA, 16 nt, Human
uguuauacaauacaga

SEQ ID NO: 3692894 - RNA, 19 nt, Human
uguuauagguccuuuagaa

SEQ ID NO: 3692895 - RNA, 18 nt, Human
uguuauagguuguuggau

SEQ ID NO: 3692896 - RNA, 13 nt, Human
uguuauauauaaa

SEQ ID NO: 3692897 - RNA, 15 nt, Human
uguuauaugaacaua

SEQ ID NO: 3692898 - RNA, 19 nt, Human
uguuauauuuaaugcauua

SEQ ID NO: 3692899 - RNA, 20 nt, Human
uguuauauuuaaugcauuaa

SEQ ID NO: 3692900 - RNA, 14 nt, Human
uguuauauuuuucu

SEQ ID NO: 3692901 - RNA, 18 nt, Human
uguuauauuuuucuuaaa

SEQ ID NO: 3692902 - RNA, 22 nt, Human
uguuaucaaacaccaacauaaa

SEQ ID NO: 3692903 - RNA, 21 nt, Human
uguuaucagucaauauuuuua

SEQ ID NO: 3692904 - RNA, 18 nt, Human
uguuaucccaaucauugu

SEQ ID NO: 3692905 - RNA, 19 nt, Human
uguuauccuuuuuuaaaag

SEQ ID NO: 3692906 - RNA, 17 nt, Human
uguuaucuguuugagaa

SEQ ID NO: 3692907 - RNA, 16 nt, Human
uguuaucuucucaagu

SEQ ID NO: 3692908 - RNA, 22 nt, Human
uguuaucuucucaaguucuaag

SEQ ID NO: 3692909 - RNA, 23 nt, Human
uguuaucuucucaaguucuaaga

SEQ ID NO: 3692910 - RNA, 17 nt, Human
uguuaugacuauguaaa

SEQ ID NO: 3692911 - RNA, 22 nt, Human
uucagggaauuucaggaacuag

SEQ ID NO: 3692912 - RNA, 18 nt, Human
uucagggcagggcucuga

SEQ ID NO: 3692913 - RNA, 13 nt, Human
uucagggccucca

SEQ ID NO: 3692914 - RNA, 19 nt, Human
uucagggccugguugaaga

SEQ ID NO: 3692915 - RNA, 20 nt, Human
uucagggcuggcuccugauc

SEQ ID NO: 3692916 - RNA, 18 nt, Human
uacaugggacuaugcuuu

SEQ ID NO: 3692917 - RNA, 14 nt, Human
uacauggugcuggg

SEQ ID NO: 3692918 - RNA, 15 nt, Human
uacaugguguuugug

SEQ ID NO: 3692919 - RNA, 17 nt, Human
uacauguauuaaauuac

SEQ ID NO: 3692920 - RNA, 18 nt, Human
uacauguauuaaauuaca

SEQ ID NO: 3692921 - RNA, 12 nt, Human
uacauguauuau

SEQ ID NO: 3692922 - RNA, 15 nt, Human
uacauguauugcaca

SEQ ID NO: 3692923 - RNA, 15 nt, Human
uacaugugauacauu

SEQ ID NO: 3692924 - RNA, 16 nt, Human
uacaugugauacauuu

SEQ ID NO: 3692925 - RNA, 18 nt, Human
uacaugugauacauuuuu

SEQ ID NO: 3692926 - RNA, 19 nt, Human
uacaugugccgaaugugca

SEQ ID NO: 3692927 - RNA, 20 nt, Human
uacaugugccgaaugugcag

SEQ ID NO: 3692928 - RNA, 14 nt, Human
uacaugugguuuau

SEQ ID NO: 3692929 - RNA, 14 nt, Human
uacauguguguaua

SEQ ID NO: 3692930 - RNA, 20 nt, Human
uacauguguguauauguaga

SEQ ID NO: 3692931 - RNA, 14 nt, Human
uacauguuuaugua

SEQ ID NO: 3692932 - RNA, 21 nt, Human
uacauguuuauguaaacaaau

SEQ ID NO: 3692933 - RNA, 13 nt, Human
uacauuaaagcag

SEQ ID NO: 3692934 - RNA, 23 nt, Human
uacauuaauuauuauugcuguug

SEQ ID NO: 3692935 - RNA, 15 nt, Human
uacauuaguaaaugu

SEQ ID NO: 3692936 - RNA, 18 nt, Human
uacauuaguaaaugucuu

SEQ ID NO: 3692937 - RNA, 19 nt, Human
uacauuaguaaaugucuuu

SEQ ID NO: 3692938 - RNA, 22 nt, Human
uacauuaguaaaugucuuugua

SEQ ID NO: 3692939 - RNA, 21 nt, Human
uacauuagucauucaauaaau

SEQ ID NO: 3692940 - RNA, 21 nt, Human
uacauuaucuaacugugcuca

SEQ ID NO: 3692941 - RNA, 14 nt, Human
uacauuauugcuua

SEQ ID NO: 3692942 - RNA, 15 nt, Human
uacauucaaauuugu

SEQ ID NO: 3692943 - RNA, 17 nt, Human
uacauucaaauuugucu

SEQ ID NO: 3692944 - RNA, 14 nt, Human
uacauuccaacucg

SEQ ID NO: 3692945 - RNA, 20 nt, Human
uacauuccuugauaauguug

SEQ ID NO: 3692946 - RNA, 21 nt, Human
uacauucucuaauaagaaaac

SEQ ID NO: 3692947 - RNA, 12 nt, Human
uacauucuguua

SEQ ID NO: 3692948 - RNA, 16 nt, Human
uacauucuucaagauc

SEQ ID NO: 3692949 - RNA, 18 nt, Human
uacauucuuuuugcucua

SEQ ID NO: 3692950 - RNA, 21 nt, Human
uacauucuuuuugcucuaaaa

SEQ ID NO: 3692951 - RNA, 19 nt, Human
uacauuguacgaagaguau

SEQ ID NO: 3692952 - RNA, 15 nt, Human
uacauuguauauaug

SEQ ID NO: 3692953 - RNA, 17 nt, Human
uacauugucauuuauau

SEQ ID NO: 3692954 - RNA, 17 nt, Human
uacauuguuaccucuau

SEQ ID NO: 3692955 - RNA, 19 nt, Human
uacauuguuugucugucuu

SEQ ID NO: 3692956 - RNA, 15 nt, Human
uacauuuaaaacauu

SEQ ID NO: 3692957 - RNA, 20 nt, Human
uacauuuaaaacauuaaaau

SEQ ID NO: 3692958 - RNA, 15 nt, Human
uacauuuaaaacuua

SEQ ID NO: 3692959 - RNA, 17 nt, Human
uacauuuaaaauugcua

SEQ ID NO: 3692960 - RNA, 11 nt, Human
uacauuuaaag

SEQ ID NO: 3692961 - RNA, 14 nt, Human
uacauuuaaagcau

SEQ ID NO: 3692962 - RNA, 19 nt, Human
uacauuuaaagcauugcug

SEQ ID NO: 3692963 - RNA, 14 nt, Human
uacauuuaaauuuu

SEQ ID NO: 3692964 - RNA, 11 nt, Human
uacauuuaaua

SEQ ID NO: 3692965 - RNA, 13 nt, Human
uacauuuaauaca

SEQ ID NO: 3692966 - RNA, 14 nt, Human
uacauuuauaauug

SEQ ID NO: 3692967 - RNA, 19 nt, Human
uacauuuaugauuuaauaa

SEQ ID NO: 3692968 - RNA, 22 nt, Human
uacauuuaugauuuaauaaaau

SEQ ID NO: 3692969 - RNA, 23 nt, Human
uacauuuauuuauccagaaaacu

SEQ ID NO: 3692970 - RNA, 21 nt, Human
uacauuucaccuacuuuguaa

SEQ ID NO: 3692971 - RNA, 22 nt, Human
uacauuuccgccacaucccucu

SEQ ID NO: 3692972 - RNA, 14 nt, Human
uacauuucgauguu

SEQ ID NO: 3692973 - RNA, 16 nt, Human
uacauuucugaaauga

SEQ ID NO: 3692974 - RNA, 17 nt, Human
uacauuuguauaaaaua

SEQ ID NO: 3692975 - RNA, 17 nt, Human
uacauuuguauguugug

SEQ ID NO: 3692976 - RNA, 13 nt, Human
uacauuuuaacau

SEQ ID NO: 3692977 - RNA, 14 nt, Human
uacauuuuaacaug

SEQ ID NO: 3692978 - RNA, 22 nt, Human
uacauuuuacacacuguacaca

SEQ ID NO: 3692979 - RNA, 14 nt, Human
uacauuuuauauua

SEQ ID NO: 3692980 - RNA, 23 nt, Human
uacauuuuauuaagcuuuuugga

SEQ ID NO: 3692981 - RNA, 20 nt, Human
uacauuuucuaagaaacauu

SEQ ID NO: 3692982 - RNA, 16 nt, Human
uacauuuuguaccaac

SEQ ID NO: 3692983 - RNA, 16 nt, Human
uacauuuuguuguaaa

SEQ ID NO: 3692984 - RNA, 21 nt, Human
uacauuuuguuguaaaaagaa

SEQ ID NO: 3692985 - RNA, 14 nt, Human
uacauuuuuacaau

SEQ ID NO: 3692986 - RNA, 16 nt, Human
uacauuuuuauuuaug

SEQ ID NO: 3692987 - RNA, 22 nt, Human
uacauuuuuauuuaugaaguuu

SEQ ID NO: 3692988 - RNA, 16 nt, Human
uacauuuuucaacuuu

SEQ ID NO: 3692989 - RNA, 17 nt, Human
uacauuuuucaacuuug

SEQ ID NO: 3692990 - RNA, 15 nt, Human
uaccaaaaauuuugu

SEQ ID NO: 3692991 - RNA, 18 nt, Human
uaccaaaauguccaccaa

SEQ ID NO: 3692992 - RNA, 23 nt, Human
uaccaaaauuuuaaaaaagggag

SEQ ID NO: 3692993 - RNA, 17 nt, Human
uaccaaagaugaaugaa

SEQ ID NO: 3692994 - RNA, 20 nt, Human
uaccaaaugcuuuaaaaacu

SEQ ID NO: 3692995 - RNA, 19 nt, Human
uaccaaauuaaaaaaaaau

SEQ ID NO: 3692996 - RNA, 12 nt, Human
uaccaaccuguu

SEQ ID NO: 3692997 - RNA, 14 nt, Human
uaccaacuuuacug

SEQ ID NO: 3692998 - RNA, 13 nt, Human
uaccaacuuucaa

SEQ ID NO: 3692999 - RNA, 14 nt, Human
uaccaacuuucaag

SEQ ID NO: 3693000 - RNA, 16 nt, Human
uaccaaguuucaggua

SEQ ID NO: 3693001 - RNA, 17 nt, Human
uaccaauaaagugaccc

SEQ ID NO: 3693002 - RNA, 13 nt, Human
uaccaauauuuaa

SEQ ID NO: 3693003 - RNA, 21 nt, Human
uaccaauauuuaaucuuuuau

SEQ ID NO: 3693004 - RNA, 20 nt, Human
uaccaaucauuuuaauuauu

SEQ ID NO: 3693005 - RNA, 14 nt, Human
uaccaaugcaugca

SEQ ID NO: 3693006 - RNA, 14 nt, Human
uaccaaugccaaga

SEQ ID NO: 3693007 - RNA, 21 nt, Human
uaccaaugcucuuuucacagc

SEQ ID NO: 3693008 - RNA, 17 nt, Human
uaccacacaucuaugau

SEQ ID NO: 3693009 - RNA, 13 nt, Human
uaccacagacaua

SEQ ID NO: 3693010 - RNA, 23 nt, Human
uaccacaggaaccacaagacugc

SEQ ID NO: 3693011 - RNA, 18 nt, Human
uaccaccagucugacugu

SEQ ID NO: 3693012 - RNA, 15 nt, Human
uaccacccaaugcug

SEQ ID NO: 3693013 - RNA, 18 nt, Human
uaccaccccuuccugucc

SEQ ID NO: 3693014 - RNA, 19 nt, Human
uaccaccccuuccuguccc

SEQ ID NO: 3693015 - RNA, 19 nt, Human
uaccacuaacuccugagaa

SEQ ID NO: 3693016 - RNA, 16 nt, Human
uaccacucacaugaca

SEQ ID NO: 3693017 - RNA, 20 nt, Human
uaccacucgugcaucccuga

SEQ ID NO: 3693018 - RNA, 18 nt, Human
uaccacucuguaauugca

SEQ ID NO: 3693019 - RNA, 19 nt, Human
uaccacucuguaauugcaa

SEQ ID NO: 3693020 - RNA, 11 nt, Human
uaccacugaau

SEQ ID NO: 3693021 - RNA, 15 nt, Human
uaccacugaaucugu

SEQ ID NO: 3693022 - RNA, 20 nt, Human
uaccacugcugauauuuucu

SEQ ID NO: 3693023 - RNA, 21 nt, Human
uaccacugcugauauuuucuc

SEQ ID NO: 3693024 - RNA, 15 nt, Human
uaccacuuuugcaaa

SEQ ID NO: 3693025 - RNA, 21 nt, Human
uaccagacgguucaccagccu

SEQ ID NO: 3693026 - RNA, 21 nt, Human
uaccagacugcagguuggacc

SEQ ID NO: 3693027 - RNA, 23 nt, Human
uaccagacugcagguuggacccc

SEQ ID NO: 3693028 - RNA, 15 nt, Human
uaccagacuguguau

SEQ ID NO: 3693029 - RNA, 19 nt, Human
uaccagagguugugcacug

SEQ ID NO: 3693030 - RNA, 15 nt, Human
uaccagauaacuuuu

SEQ ID NO: 3693031 - RNA, 13 nt, Human
uaccagcagagca

SEQ ID NO: 3693032 - RNA, 14 nt, Human
uaccagcagagcac

SEQ ID NO: 3693033 - RNA, 18 nt, Human
uaccagccaguaaauggg

SEQ ID NO: 3693034 - RNA, 22 nt, Human
uaccagcccuggggcugggccc

SEQ ID NO: 3693035 - RNA, 15 nt, Human
uaccagcgaggaggc

SEQ ID NO: 3693036 - RNA, 22 nt, Human
uaccagcuacuccggaggcuga

SEQ ID NO: 3693037 - RNA, 16 nt, Human
uaccagcuuuuaacca

SEQ ID NO: 3693038 - RNA, 16 nt, Human
uaccaggaacuauaaa

SEQ ID NO: 3693039 - RNA, 16 nt, Human
uaccaggucuccucca

SEQ ID NO: 3693040 - RNA, 14 nt, Human
uaccagguguucua

SEQ ID NO: 3693041 - RNA, 15 nt, Human
uaccagguugaaaga

SEQ ID NO: 3693042 - RNA, 19 nt, Human
uaccaguaaaguguaacau

SEQ ID NO: 3693043 - RNA, 12 nt, Human
uaccaguauuua

SEQ ID NO: 3693044 - RNA, 18 nt, Human
uaccagugaaccaaagag

SEQ ID NO: 3693045 - RNA, 21 nt, Human
uaccagugaauuuuugcaaua

SEQ ID NO: 3693046 - RNA, 19 nt, Human
uaccaguugccuuuuaucc

SEQ ID NO: 3693047 - RNA, 16 nt, Human
uaccauacucauuucu

SEQ ID NO: 3693048 - RNA, 16 nt, Human
uaccauauacagcuca

SEQ ID NO: 3693049 - RNA, 14 nt, Human
uaccauaugaucug

SEQ ID NO: 3693050 - RNA, 17 nt, Human
uaccauccccuguagag

SEQ ID NO: 3693051 - RNA, 15 nt, Human
uaccaugaaacaaag

SEQ ID NO: 3693052 - RNA, 20 nt, Human
uaccaugagaagagggccug

SEQ ID NO: 3693053 - RNA, 22 nt, Human
uaccaugagaagagggccugug

SEQ ID NO: 3693054 - RNA, 15 nt, Human
uaccauguaauggca

SEQ ID NO: 3693055 - RNA, 16 nt, Human
uaccaugugccugauc

SEQ ID NO: 3693056 - RNA, 18 nt, Human
uaccauuauuuuuaggau

SEQ ID NO: 3693057 - RNA, 17 nt, Human
uaccauucacaauaaaa

SEQ ID NO: 3693058 - RNA, 15 nt, Human
uaccauucagaucac

SEQ ID NO: 3693059 - RNA, 14 nt, Human
uaccauucagugau

SEQ ID NO: 3693060 - RNA, 16 nt, Human
uaccauugcuguucua

SEQ ID NO: 3693061 - RNA, 15 nt, Human
uaccauuggaaauuu

SEQ ID NO: 3693062 - RNA, 19 nt, Human
uaccauuggaaauuucacg

SEQ ID NO: 3693063 - RNA, 21 nt, Human
uaccauuuauacaaauuagaa

SEQ ID NO: 3693064 - RNA, 12 nt, Human
uaccauuucaga

SEQ ID NO: 3693065 - RNA, 16 nt, Human
uaccauuucagagagg

SEQ ID NO: 3693066 - RNA, 15 nt, Human
uaccauuugccuccc

SEQ ID NO: 3693067 - RNA, 16 nt, Human
uguuuaucagauacau

SEQ ID NO: 3693068 - RNA, 18 nt, Human
uguuuaucagauacauca

SEQ ID NO: 3693069 - RNA, 19 nt, Human
uguuuaucagauacaucac

SEQ ID NO: 3693070 - RNA, 22 nt, Human
uguuuaucagauacaucacugc

SEQ ID NO: 3693071 - RNA, 23 nt, Human
uguuuaucagauacaucacugcu

SEQ ID NO: 3693072 - RNA, 14 nt, Human
uguuuaucagcagu

SEQ ID NO: 3693073 - RNA, 21 nt, Human
uguuuauccuuucauauaguu

SEQ ID NO: 3693074 - RNA, 22 nt, Human
uguuuaucuagauguaaauuuu

SEQ ID NO: 3693075 - RNA, 14 nt, Human
uguuuaugaaaaua

SEQ ID NO: 3693076 - RNA, 18 nt, Human
uguuuaugaaaauaaaua

SEQ ID NO: 3693077 - RNA, 17 nt, Human
uguuuauggccacauuu

SEQ ID NO: 3693078 - RNA, 13 nt, Human
uguuuauggccuc

SEQ ID NO: 3693079 - RNA, 14 nt, Human
uguuuauggccuca

SEQ ID NO: 3693080 - RNA, 15 nt, Human
uguuuauggccucag

SEQ ID NO: 3693081 - RNA, 16 nt, Human
uguuuaugguaaaaaa

SEQ ID NO: 3693082 - RNA, 11 nt, Human
uguuuauguaa

SEQ ID NO: 3693083 - RNA, 15 nt, Human
uguuuauguaauuuc

SEQ ID NO: 3693084 - RNA, 17 nt, Human
uguuuaugugcuauuaa

SEQ ID NO: 3693085 - RNA, 22 nt, Human
uguuuauguuguuuauaauaaa

SEQ ID NO: 3693086 - RNA, 16 nt, Human
uguuuauuaaaugcuu

SEQ ID NO: 3693087 - RNA, 16 nt, Human
uguuuauuaacaaauu

SEQ ID NO: 3693088 - RNA, 18 nt, Human
uguuuauuacaguauaau

SEQ ID NO: 3693089 - RNA, 18 nt, Human
uguuuauuacuuccauga

SEQ ID NO: 3693090 - RNA, 19 nt, Human
uguuuauuaguuuugcaua

SEQ ID NO: 3693091 - RNA, 13 nt, Human
uguuuauucuuga

SEQ ID NO: 3693092 - RNA, 14 nt, Human
uguuuauucuugau

SEQ ID NO: 3693093 - RNA, 14 nt, Human
uguuuauuuacaag

SEQ ID NO: 3693094 - RNA, 22 nt, Human
uguuuauuuauaagcagauuua

SEQ ID NO: 3693095 - RNA, 14 nt, Human
uguuuauuuauaga

SEQ ID NO: 3693096 - RNA, 13 nt, Human
uguuuauuucagg

SEQ ID NO: 3693097 - RNA, 16 nt, Human
uguuuauuucauuuua

SEQ ID NO: 3693098 - RNA, 22 nt, Human
uguuuauuuucuacguuucuuu

SEQ ID NO: 3693099 - RNA, 21 nt, Human
uguuucaaacauauauaacaa

SEQ ID NO: 3693100 - RNA, 22 nt, Human
uguuucaaacauauauaacaau

SEQ ID NO: 3693101 - RNA, 14 nt, Human
uguuucaaacaugc

SEQ ID NO: 3693102 - RNA, 15 nt, Human
uguuucaaacuguaa

SEQ ID NO: 3693103 - RNA, 13 nt, Human
uguuucaaaguuc

SEQ ID NO: 3693104 - RNA, 10 nt, Human
uguuucaaga

SEQ ID NO: 3693105 - RNA, 16 nt, Human
uguuucaagaaccugg

SEQ ID NO: 3693106 - RNA, 19 nt, Human
uguuucaagaggagccccc

SEQ ID NO: 3693107 - RNA, 22 nt, Human
uguuucaagaggagcccccacc

SEQ ID NO: 3693108 - RNA, 14 nt, Human
uguuucaaucacug

SEQ ID NO: 3693109 - RNA, 20 nt, Human
uguuucacaguuugaaauaa

SEQ ID NO: 3693110 - RNA, 21 nt, Human
uguuucagaggcucagauugu

SEQ ID NO: 3693111 - RNA, 17 nt, Human
uguuucagcuaagggaa

SEQ ID NO: 3693112 - RNA, 19 nt, Human
uguuucagcuaagggaaga

SEQ ID NO: 3693113 - RNA, 23 nt, Human
uguuucagcuaagggaagacauu

SEQ ID NO: 3693114 - RNA, 21 nt, Human
uguuucagugaauaugccugu

SEQ ID NO: 3693115 - RNA, 20 nt, Human
uguuucauauugaugugugu

SEQ ID NO: 3693116 - RNA, 14 nt, Human
uguuucaucuaagu

SEQ ID NO: 3693117 - RNA, 13 nt, Human
uguuucauguuuu

SEQ ID NO: 3693118 - RNA, 14 nt, Human
uguuucauguuuug

SEQ ID NO: 3693119 - RNA, 21 nt, Human
uguuuccagcagaagacaaaa

SEQ ID NO: 3693120 - RNA, 14 nt, Human
uguuuccagcauuc

SEQ ID NO: 3693121 - RNA, 15 nt, Human
uguuuccagcauucc

SEQ ID NO: 3693122 - RNA, 18 nt, Human
uguuuccagcauucccag

SEQ ID NO: 3693123 - RNA, 23 nt, Human
uguuuccuagcacacacuuuugg

SEQ ID NO: 3693124 - RNA, 14 nt, Human
uguuuccucuguuc

SEQ ID NO: 3693125 - RNA, 15 nt, Human
uguuuccucuuccaa

SEQ ID NO: 3693126 - RNA, 11 nt, Human
uguuuccugag

SEQ ID NO: 3693127 - RNA, 21 nt, Human
uguuuccuggcacugcuucca

SEQ ID NO: 3693128 - RNA, 22 nt, Human
uguuuccuggcacugcuuccag

SEQ ID NO: 3693129 - RNA, 16 nt, Human
uguuuccuucauuucu

SEQ ID NO: 3693130 - RNA, 18 nt, Human
uguuuccuuuuucagaua

SEQ ID NO: 3693131 - RNA, 20 nt, Human
uguuucgugaaguauacugu

SEQ ID NO: 3693132 - RNA, 15 nt, Human
uguuucuagggaaau

SEQ ID NO: 3693133 - RNA, 16 nt, Human
uguuucuauacaaaua

SEQ ID NO: 3693134 - RNA, 16 nt, Human
uguuucuaucugauuu

SEQ ID NO: 3693135 - RNA, 22 nt, Human
uguuucuauuuuuugaaaagca

SEQ ID NO: 3693136 - RNA, 15 nt, Human
uguuucucaaaucuu

SEQ ID NO: 3693137 - RNA, 23 nt, Human
uguuucucccccugggcucugcc

SEQ ID NO: 3693138 - RNA, 15 nt, Human
uguuucucccgugcu

SEQ ID NO: 3693139 - RNA, 16 nt, Human
uguuucucccgugcuu

SEQ ID NO: 3693140 - RNA, 13 nt, Human
uguuucucugaaa

SEQ ID NO: 3693141 - RNA, 13 nt, Human
uguuucucugcug

SEQ ID NO: 3693142 - RNA, 14 nt, Human
uguuucucugcugu

SEQ ID NO: 3693143 - RNA, 19 nt, Human
uguuucugaaaagaaauaa

SEQ ID NO: 3693144 - RNA, 14 nt, Human
uguuucugaaaauu

SEQ ID NO: 3693145 - RNA, 22 nt, Human
uguuucugcaguagucucugug

SEQ ID NO: 3693146 - RNA, 16 nt, Human
uguuucuguaagaaac

SEQ ID NO: 3693147 - RNA, 18 nt, Human
uguuucuguccuguaacu

SEQ ID NO: 3693148 - RNA, 15 nt, Human
uguuucuguuauuaa

SEQ ID NO: 3693149 - RNA, 19 nt, Human
uguuucuuccaaagcacau

SEQ ID NO: 3693150 - RNA, 17 nt, Human
uguuucuuccuguuaau

SEQ ID NO: 3693151 - RNA, 12 nt, Human
uguuucuugccu

SEQ ID NO: 3693152 - RNA, 15 nt, Human
uguuucuugccucau

SEQ ID NO: 3693153 - RNA, 15 nt, Human
uguuucuugcuugua

SEQ ID NO: 3693154 - RNA, 13 nt, Human
uguuucuuucuag

SEQ ID NO: 3693155 - RNA, 20 nt, Human
uguuucuuucucugaggaca

SEQ ID NO: 3693156 - RNA, 12 nt, Human
uguuucuuugaa

SEQ ID NO: 3693157 - RNA, 19 nt, Human
uguuucuuugaauuuucau

SEQ ID NO: 3693158 - RNA, 23 nt, Human
uguuucuuugaauuuucauuuua

SEQ ID NO: 3693159 - RNA, 15 nt, Human
uguuucuuugaucau

SEQ ID NO: 3693160 - RNA, 19 nt, Human
uguuucuuuguaaugaaaa

SEQ ID NO: 3693161 - RNA, 15 nt, Human
uguuucuuuucacau

SEQ ID NO: 3693162 - RNA, 18 nt, Human
uguuucuuuuguuuggua

SEQ ID NO: 3693163 - RNA, 22 nt, Human
uguuugaaaauauuaucuuugu

SEQ ID NO: 3693164 - RNA, 17 nt, Human
uguuugaagccugcccu

SEQ ID NO: 3693165 - RNA, 19 nt, Human
uguuugaauauggacaaga

SEQ ID NO: 3693166 - RNA, 22 nt, Human
uguuugacaaagaaacccaagu

SEQ ID NO: 3693167 - RNA, 14 nt, Human
uguuugacaccucu

SEQ ID NO: 3693168 - RNA, 14 nt, Human
uguuugagaaauua

SEQ ID NO: 3693169 - RNA, 14 nt, Human
uguuugagcucaga

SEQ ID NO: 3693170 - RNA, 18 nt, Human
uguuugagcucugcagcc

SEQ ID NO: 3693171 - RNA, 13 nt, Human
uguuugaugcauu

SEQ ID NO: 3693172 - RNA, 18 nt, Human
uguuugcaccuuucuagu

SEQ ID NO: 3693173 - RNA, 22 nt, Human
uguuugcaccuuucuaguugaa

SEQ ID NO: 3693174 - RNA, 22 nt, Human
uguuugcacguuaugguguuuc

SEQ ID NO: 3693175 - RNA, 23 nt, Human
uguuugcacguuaugguguuucu

SEQ ID NO: 3693176 - RNA, 12 nt, Human
uguuugcccaaa

SEQ ID NO: 3693177 - RNA, 19 nt, Human
uguuugcuaagcauuccaa

SEQ ID NO: 3693178 - RNA, 17 nt, Human
uguuugcuaucuuaauu

SEQ ID NO: 3693179 - RNA, 20 nt, Human
uguuugcugaacauuggaga

SEQ ID NO: 3693180 - RNA, 16 nt, Human
uguuugcuuauuguuc

SEQ ID NO: 3693181 - RNA, 16 nt, Human
uguuugcuucaccgug

SEQ ID NO: 3693182 - RNA, 22 nt, Human
uguuugcuucaugugucccaga

SEQ ID NO: 3693183 - RNA, 13 nt, Human
uguuugcuuucug

SEQ ID NO: 3693184 - RNA, 18 nt, Human
uguuuggaauauugucca

SEQ ID NO: 3693185 - RNA, 19 nt, Human
uguuuggagacauuccugg

SEQ ID NO: 3693186 - RNA, 15 nt, Human
uguuuggaggagcaa

SEQ ID NO: 3693187 - RNA, 17 nt, Human
uguuuggauguaauuua

SEQ ID NO: 3693188 - RNA, 16 nt, Human
uguuuggcauguaaau

SEQ ID NO: 3693189 - RNA, 13 nt, Human
uguuuggcuuuca

SEQ ID NO: 3693190 - RNA, 14 nt, Human
uguuuggcuuucag

SEQ ID NO: 3693191 - RNA, 17 nt, Human
uguuugggaugaccagg

SEQ ID NO: 3693192 - RNA, 23 nt, Human
uguuuggggcaggaguagcugag

SEQ ID NO: 3693193 - RNA, 19 nt, Human
uguuugggggacguuucuc

SEQ ID NO: 3693194 - RNA, 15 nt, Human
uguuuggguauccug

SEQ ID NO: 3693195 - RNA, 22 nt, Human
uguuuggugcauagaacugggu

SEQ ID NO: 3693196 - RNA, 18 nt, Human
uguuuggugcucauuuaa

SEQ ID NO: 3693197 - RNA, 18 nt, Human
uguuugguuauagugcaa

SEQ ID NO: 3693198 - RNA, 16 nt, Human
uguuugguucuggggc

SEQ ID NO: 3693199 - RNA, 16 nt, Human
uguuugguuuacauuu

SEQ ID NO: 3693200 - RNA, 22 nt, Human
uguuugguuuuaaaauacugua

SEQ ID NO: 3693201 - RNA, 13 nt, Human
uguuuguaaauaa

SEQ ID NO: 3693202 - RNA, 15 nt, Human
uguuuguaaauaaga

SEQ ID NO: 3693203 - RNA, 21 nt, Human
uguuuguaaauaagagauuug

SEQ ID NO: 3693204 - RNA, 15 nt, Human
uguuugucucuccuu

SEQ ID NO: 3693205 - RNA, 17 nt, Human
uguuugucucuccuuuu

SEQ ID NO: 3693206 - RNA, 15 nt, Human
uguuugugcuucuaa

SEQ ID NO: 3693207 - RNA, 19 nt, Human
uguuugugcuucuaauauu

SEQ ID NO: 3693208 - RNA, 12 nt, Human
uguuuguggccu

SEQ ID NO: 3693209 - RNA, 13 nt, Human
uguuuguggccuc

SEQ ID NO: 3693210 - RNA, 13 nt, Human
uguuugugugugu

SEQ ID NO: 3693211 - RNA, 17 nt, Human
uguuuguuaaaacuggc

SEQ ID NO: 3693212 - RNA, 21 nt, Human
uguuuguuaaaacuggcaucu

SEQ ID NO: 3693213 - RNA, 14 nt, Human
uguuuguucuguuu

SEQ ID NO: 3693214 - RNA, 16 nt, Human
uguuuguucuuguuuu

SEQ ID NO: 3693215 - RNA, 16 nt, Human
uguuuguugcuggcuu

SEQ ID NO: 3693216 - RNA, 11 nt, Human
uguuuguuggu

SEQ ID NO: 3693217 - RNA, 21 nt, Human
uguuuguuuagucuugucuca

SEQ ID NO: 3693218 - RNA, 22 nt, Human
uucaggggcugcccgcucccag

SEQ ID NO: 3693219 - RNA, 13 nt, Human
uucagggggccag

SEQ ID NO: 3693220 - RNA, 22 nt, Human
uucagggggccaggugcacaga

SEQ ID NO: 3693221 - RNA, 22 nt, Human
uucagggggguugugaggccug

SEQ ID NO: 3693222 - RNA, 14 nt, Human
uucaggguaaauag

SEQ ID NO: 3693223 - RNA, 13 nt, Human
uucagggucauag

SEQ ID NO: 3693224 - RNA, 15 nt, Human
uucagggugaugcca

SEQ ID NO: 3693225 - RNA, 16 nt, Human
uucaggguuggccccu

SEQ ID NO: 3693226 - RNA, 17 nt, Human
uucaggguuggccccug

SEQ ID NO: 3693227 - RNA, 21 nt, Human
uucaggguuuucugagggaaa

SEQ ID NO: 3693228 - RNA, 16 nt, Human
uucagguauguugccu

SEQ ID NO: 3693229 - RNA, 13 nt, Human
uucaggugacaug

SEQ ID NO: 3693230 - RNA, 18 nt, Human
uucaggugacaugugaaa

SEQ ID NO: 3693231 - RNA, 22 nt, Human
uucaggugacaugugaaaccuu

SEQ ID NO: 3693232 - RNA, 17 nt, Human
uucaggugcagaggaag

SEQ ID NO: 3693233 - RNA, 20 nt, Human
uucagguguuuaguugcaga

SEQ ID NO: 3693234 - RNA, 15 nt, Human
uucagguuuuguaaa

SEQ ID NO: 3693235 - RNA, 14 nt, Human
uucaguaauaacuc

SEQ ID NO: 3693236 - RNA, 22 nt, Human
uucaguacccucucagcuccag

SEQ ID NO: 3693237 - RNA, 15 nt, Human
uucaguacuucagca

SEQ ID NO: 3693238 - RNA, 14 nt, Human
uucaguacuuuuuu

SEQ ID NO: 3693239 - RNA, 16 nt, Human
uucaguauaauuuaac

SEQ ID NO: 3693240 - RNA, 17 nt, Human
uucaguauuuuggagaa

SEQ ID NO: 3693241 - RNA, 18 nt, Human
uucaguauuuuggagaaa

SEQ ID NO: 3693242 - RNA, 19 nt, Human
uucaguauuuuggagaaau

SEQ ID NO: 3693243 - RNA, 20 nt, Human
uucaguauuuuggagaaauu

SEQ ID NO: 3693244 - RNA, 13 nt, Human
uucagucauuaaa

SEQ ID NO: 3693245 - RNA, 15 nt, Human
uucagucauuaaauu

SEQ ID NO: 3693246 - RNA, 16 nt, Human
uucaguccugcuccag

SEQ ID NO: 3693247 - RNA, 22 nt, Human
uucaguccugggagacccaugu

SEQ ID NO: 3693248 - RNA, 20 nt, Human
uucagucugaaugcugccac

SEQ ID NO: 3693249 - RNA, 14 nt, Human
uucagucuugccuu

SEQ ID NO: 3693250 - RNA, 13 nt, Human
uucagucuuuucc

SEQ ID NO: 3693251 - RNA, 16 nt, Human
uucagugaaagcauca

SEQ ID NO: 3693252 - RNA, 18 nt, Human
uucagugccuuauggaac

SEQ ID NO: 3693253 - RNA, 19 nt, Human
uucagugcuguggccuggg

SEQ ID NO: 3693254 - RNA, 24 nt, Human
uucaguggcacgucaucuaguuuu

SEQ ID NO: 3693255 - RNA, 15 nt, Human
uucaguggcagcugc

SEQ ID NO: 3693256 - RNA, 16 nt, Human
uucaguggcagcugcu

SEQ ID NO: 3693257 - RNA, 17 nt, Human
uucagugguuccuucug

SEQ ID NO: 3693258 - RNA, 12 nt, Human
uucaguguaauu

SEQ ID NO: 3693259 - RNA, 21 nt, Human
uucaguguaauuucuuugccu

SEQ ID NO: 3693260 - RNA, 12 nt, Human
uucaguguacau

SEQ ID NO: 3693261 - RNA, 18 nt, Human
uucaguguuaccugugug

SEQ ID NO: 3693262 - RNA, 16 nt, Human
uucaguucaaagucau

SEQ ID NO: 3693263 - RNA, 15 nt, Human
uucaguucccagaau

SEQ ID NO: 3693264 - RNA, 19 nt, Human
uucaguucccagaaucaaa

SEQ ID NO: 3693265 - RNA, 21 nt, Human
uucaguuccgucagaaagugu

SEQ ID NO: 3693266 - RNA, 23 nt, Human
uucaguuccucuuugcauggaau

SEQ ID NO: 3693267 - RNA, 20 nt, Human
uucaguucuuuggauucuaa

SEQ ID NO: 3693268 - RNA, 18 nt, Human
uucaguugguugugucuu

SEQ ID NO: 3693269 - RNA, 22 nt, Human
uucaguuuauuugaaccaauaa

SEQ ID NO: 3693270 - RNA, 19 nt, Human
uucaguuucaauucagugc

SEQ ID NO: 3693271 - RNA, 19 nt, Human
uucaguuucuaaaauugag

SEQ ID NO: 3693272 - RNA, 11 nt, Human
uucauaaacaa

SEQ ID NO: 3693273 - RNA, 15 nt, Human
uucauaaacaaguuc

SEQ ID NO: 3693274 - RNA, 16 nt, Human
uucauaaaguacuuga

SEQ ID NO: 3693275 - RNA, 20 nt, Human
uucauaaauaaaguuuguug

SEQ ID NO: 3693276 - RNA, 17 nt, Human
uucauaacagugccauu

SEQ ID NO: 3693277 - RNA, 21 nt, Human
uucauaacagugccauugucu

SEQ ID NO: 3693278 - RNA, 18 nt, Human
uucauaacuuauugcuga

SEQ ID NO: 3693279 - RNA, 14 nt, Human
uucauaacuuucau

SEQ ID NO: 3693280 - RNA, 12 nt, Human
uucauaaguauu

SEQ ID NO: 3693281 - RNA, 20 nt, Human
uucauaaguauuaugucucu

SEQ ID NO: 3693282 - RNA, 14 nt, Human
uucauacaaagcau

SEQ ID NO: 3693283 - RNA, 18 nt, Human
uucauacacagccugggc

SEQ ID NO: 3693284 - RNA, 19 nt, Human
uucauaccuaaguacugua

SEQ ID NO: 3693285 - RNA, 20 nt, Human
uucauaccuaaguacuguaa

SEQ ID NO: 3693286 - RNA, 16 nt, Human
uucauaccuacaugua

SEQ ID NO: 3693287 - RNA, 15 nt, Human
uucauaccucagaau

SEQ ID NO: 3693288 - RNA, 22 nt, Human
uucauacuguaacauucaggaa

SEQ ID NO: 3693289 - RNA, 11 nt, Human
uucauagagaa

SEQ ID NO: 3693290 - RNA, 19 nt, Human
uucauagagauuugucuaa

SEQ ID NO: 3693291 - RNA, 20 nt, Human
uucauagagauuugucuaau

SEQ ID NO: 3693292 - RNA, 13 nt, Human
uucauagauugug

SEQ ID NO: 3693293 - RNA, 13 nt, Human
uucauagcccagu

SEQ ID NO: 3693294 - RNA, 22 nt, Human
uucauagcugguuccugcuaga

SEQ ID NO: 3693295 - RNA, 18 nt, Human
uucauagcuguacuucuu

SEQ ID NO: 3693296 - RNA, 19 nt, Human
uucauagggucucuucagg

SEQ ID NO: 3693297 - RNA, 14 nt, Human
uucauaggucacug

SEQ ID NO: 3693298 - RNA, 19 nt, Human
uucauaggucacuggcucu

SEQ ID NO: 3693299 - RNA, 15 nt, Human
uucauaggucugaaa

SEQ ID NO: 3693300 - RNA, 19 nt, Human
uucauaguauccauauuuu

SEQ ID NO: 3693301 - RNA, 17 nt, Human
uucauaguucagaauuu

SEQ ID NO: 3693302 - RNA, 20 nt, Human
uucauaguucagaauuuagu

SEQ ID NO: 3693303 - RNA, 23 nt, Human
uucauaugacauucaugccuggc

SEQ ID NO: 3693304 - RNA, 12 nt, Human
uucauaugcaua

SEQ ID NO: 3693305 - RNA, 16 nt, Human
uucauauguugcucag

SEQ ID NO: 3693306 - RNA, 16 nt, Human
uucauauuaagaauga

SEQ ID NO: 3693307 - RNA, 13 nt, Human
uucauauuacaau

SEQ ID NO: 3693308 - RNA, 22 nt, Human
uucauauucuucauauccuucu

SEQ ID NO: 3693309 - RNA, 14 nt, Human
uucauauucuuuua

SEQ ID NO: 3693310 - RNA, 18 nt, Human
uucauauugcugagagaa

SEQ ID NO: 3693311 - RNA, 14 nt, Human
uucauauugugcca

SEQ ID NO: 3693312 - RNA, 20 nt, Human
uucauauuguggcacaagca

SEQ ID NO: 3693313 - RNA, 19 nt, Human
uucauauuuaauauaugug

SEQ ID NO: 3693314 - RNA, 16 nt, Human
uucauauuuacuucuu

SEQ ID NO: 3693315 - RNA, 20 nt, Human
uucauauuuguacuuucugu

SEQ ID NO: 3693316 - RNA, 17 nt, Human
uucauauuuuaauuuca

SEQ ID NO: 3693317 - RNA, 18 nt, Human
uucauauuuuaauuucaa

SEQ ID NO: 3693318 - RNA, 20 nt, Human
uucauauuuuaauuucaagc

SEQ ID NO: 3693319 - RNA, 22 nt, Human
uucauauuuuaauuucaagcuu

SEQ ID NO: 3693320 - RNA, 17 nt, Human
uucauauuuuucaaaau

SEQ ID NO: 3693321 - RNA, 16 nt, Human
uucaucaaucauugua

SEQ ID NO: 3693322 - RNA, 22 nt, Human
uucaucagaacagcuguugacu

SEQ ID NO: 3693323 - RNA, 15 nt, Human
uucaucauccagaug

SEQ ID NO: 3693324 - RNA, 15 nt, Human
uucaucauuguuucu

SEQ ID NO: 3693325 - RNA, 14 nt, Human
uucaucauuuuuua

SEQ ID NO: 3693326 - RNA, 15 nt, Human
uucauccacuagugc

SEQ ID NO: 3693327 - RNA, 15 nt, Human
uucauccauaacuga

SEQ ID NO: 3693328 - RNA, 13 nt, Human
uucaucccagccc

SEQ ID NO: 3693329 - RNA, 18 nt, Human
uucaucccaugauguagu

SEQ ID NO: 3693330 - RNA, 17 nt, Human
uucaucccucuggggcu

SEQ ID NO: 3693331 - RNA, 18 nt, Human
uucauccggcagccugga

SEQ ID NO: 3693332 - RNA, 16 nt, Human
uucauccuauuguuga

SEQ ID NO: 3693333 - RNA, 11 nt, Human
uucauccuggc

SEQ ID NO: 3693334 - RNA, 17 nt, Human
uucauccuucccacucu

SEQ ID NO: 3693335 - RNA, 20 nt, Human
uucauccuuucacuucuuuc

SEQ ID NO: 3693336 - RNA, 20 nt, Human
uucaucgaaucuacuaauuc

SEQ ID NO: 3693337 - RNA, 23 nt, Human
uucaucgaaucuacuaauuccac

SEQ ID NO: 3693338 - RNA, 22 nt, Human
uucaucucccaccuagcagcac

SEQ ID NO: 3693339 - RNA, 14 nt, Human
uucaucucucagaa

SEQ ID NO: 3693340 - RNA, 17 nt, Human
uucaucucucagaaggg

SEQ ID NO: 3693341 - RNA, 21 nt, Human
uucaucucucagaagggaggc

SEQ ID NO: 3693342 - RNA, 16 nt, Human
uucaucugcucuccuu

SEQ ID NO: 3693343 - RNA, 19 nt, Human
uucaucugcucuccuuccu

SEQ ID NO: 3693344 - RNA, 23 nt, Human
uucaucuggaaccaucagaaaca

SEQ ID NO: 3693345 - RNA, 19 nt, Human
uucaucuggcaacaucuuu

SEQ ID NO: 3693346 - RNA, 13 nt, Human
uucaucugggaaa

SEQ ID NO: 3693347 - RNA, 18 nt, Human
uucaucugggaaagacau

SEQ ID NO: 3693348 - RNA, 18 nt, Human
uucaucuguaacucuaaa

SEQ ID NO: 3693349 - RNA, 21 nt, Human
uucaucuguaacucuaaaaga

SEQ ID NO: 3693350 - RNA, 16 nt, Human
uucaucugucuauauu

SEQ ID NO: 3693351 - RNA, 19 nt, Human
uucaucuucaguugucucu

SEQ ID NO: 3693352 - RNA, 22 nt, Human
uucaucuuuugaggcuucuguu

SEQ ID NO: 3693353 - RNA, 16 nt, Human
uucaucuuuuguauag

SEQ ID NO: 3693354 - RNA, 22 nt, Human
uucaugaaaauagcucuuucag

SEQ ID NO: 3693355 - RNA, 17 nt, Human
uucaugaaagauucaau

SEQ ID NO: 3693356 - RNA, 22 nt, Human
uucaugaaaugcuaugucauuu

SEQ ID NO: 3693357 - RNA, 16 nt, Human
uucaugaccaguaaag

SEQ ID NO: 3693358 - RNA, 23 nt, Human
uucaugacuuuuccauguaucua

SEQ ID NO: 3693359 - RNA, 18 nt, Human
uucaugauaaugaacaga

SEQ ID NO: 3693360 - RNA, 14 nt, Human
uucaugaugcaguc

SEQ ID NO: 3693361 - RNA, 17 nt, Human
uucaugaugcagucucc

SEQ ID NO: 3693362 - RNA, 15 nt, Human
uucaugauuuugaaa

SEQ ID NO: 3693363 - RNA, 17 nt, Human
uucaugauuuugaaauc

SEQ ID NO: 3693364 - RNA, 14 nt, Human
uucaugcauggaaa

SEQ ID NO: 3693365 - RNA, 15 nt, Human
uucaugcauggaaau

SEQ ID NO: 3693366 - RNA, 16 nt, Human
uucaugccuggcuucg

SEQ ID NO: 3693367 - RNA, 17 nt, Human
uucaugccuuuguaagu

SEQ ID NO: 3693368 - RNA, 18 nt, Human
uucaugcuaucucugugu

SEQ ID NO: 3693369 - RNA, 14 nt, Human
uucaugcucagccc

SEQ ID NO: 3693370 - RNA, 14 nt, Human
uucaugcucugcaa

SEQ ID NO: 3693371 - RNA, 14 nt, Human
uucaugcuuuauca

SEQ ID NO: 3693372 - RNA, 19 nt, Human
uucauggaacgcguugaaa

SEQ ID NO: 3693373 - RNA, 20 nt, Human
uucauggacacuuugaaaug

SEQ ID NO: 3693374 - RNA, 16 nt, Human
uucauggaccacuguu

SEQ ID NO: 3693375 - RNA, 20 nt, Human
uucauggaccacuguuucuu

SEQ ID NO: 3693376 - RNA, 22 nt, Human
uucauggcugcuguugcuuaaa

SEQ ID NO: 3693377 - RNA, 17 nt, Human
uucauguaaacugugca

SEQ ID NO: 3693378 - RNA, 20 nt, Human
uucauguaaagugucagaag

SEQ ID NO: 3693379 - RNA, 14 nt, Human
uucauguaaauaaa

SEQ ID NO: 3693380 - RNA, 17 nt, Human
uucauguacaagaugaa

SEQ ID NO: 3693381 - RNA, 21 nt, Human
uucauguacaagaugaaggag

SEQ ID NO: 3693382 - RNA, 20 nt, Human
uucauguccugugucaguuu

SEQ ID NO: 3693383 - RNA, 21 nt, Human
uucauguccugugucaguuua

SEQ ID NO: 3693384 - RNA, 14 nt, Human
uucauguggcugua

SEQ ID NO: 3693385 - RNA, 17 nt, Human
uucauguucccacuuca

SEQ ID NO: 3693386 - RNA, 13 nt, Human
uucauguuucuua

SEQ ID NO: 3693387 - RNA, 17 nt, Human
uucauguuuuaacaaaa

SEQ ID NO: 3693388 - RNA, 16 nt, Human
uucauguuuugugacu

SEQ ID NO: 3693389 - RNA, 17 nt, Human
uucauguuuugugacua

SEQ ID NO: 3693390 - RNA, 18 nt, Human
uucauguuuugugacuau

SEQ ID NO: 3693391 - RNA, 12 nt, Human
uucauuaaauaa

SEQ ID NO: 3693392 - RNA, 16 nt, Human
uucauuaacaaaaugu

SEQ ID NO: 3693393 - RNA, 19 nt, Human
uucauuaagcccucuucca

SEQ ID NO: 3693394 - RNA, 16 nt, Human
uucauuaauucuauaa

SEQ ID NO: 3693395 - RNA, 21 nt, Human
uucauuagcaaaaaaaguugu

SEQ ID NO: 3693396 - RNA, 17 nt, Human
uucauuauguaaaaugu

SEQ ID NO: 3693397 - RNA, 15 nt, Human
uucauuauucucugc

SEQ ID NO: 3693398 - RNA, 20 nt, Human
uucauuauuggaauuaaccu

SEQ ID NO: 3693399 - RNA, 16 nt, Human
uucauuauuugucaaa

SEQ ID NO: 3693400 - RNA, 15 nt, Human
uucauucaauauuga

SEQ ID NO: 3693401 - RNA, 16 nt, Human
uucauucaauauugac

SEQ ID NO: 3693402 - RNA, 17 nt, Human
uucauucacuucucuua

SEQ ID NO: 3693403 - RNA, 16 nt, Human
uucauucauacuuaaa

SEQ ID NO: 3693404 - RNA, 13 nt, Human
uucauucauauua

SEQ ID NO: 3693405 - RNA, 14 nt, Human
uucauuccuccagg

SEQ ID NO: 3693406 - RNA, 21 nt, Human
uucauuccuucagauuuggcu

SEQ ID NO: 3693407 - RNA, 12 nt, Human
uucauucucaua

SEQ ID NO: 3693408 - RNA, 12 nt, Human
uucauucuccuu

SEQ ID NO: 3693409 - RNA, 15 nt, Human
uucauucuccuuguu

SEQ ID NO: 3693410 - RNA, 14 nt, Human
uucauucucuuuua

SEQ ID NO: 3693411 - RNA, 13 nt, Human
uucauucugcaag

SEQ ID NO: 3693412 - RNA, 15 nt, Human
uucauucugcagggu

SEQ ID NO: 3693413 - RNA, 16 nt, Human
uucauucuucagauau

SEQ ID NO: 3693414 - RNA, 16 nt, Human
uucauucuucucuagc

SEQ ID NO: 3693415 - RNA, 17 nt, Human
uucauugagaguuuugu

SEQ ID NO: 3693416 - RNA, 19 nt, Human
uucauugagaguuuugucu

SEQ ID NO: 3693417 - RNA, 19 nt, Human
uucauugcacuuugauuag

SEQ ID NO: 3693418 - RNA, 16 nt, Human
uucauugccagugucu

SEQ ID NO: 3693419 - RNA, 19 nt, Human
uucauugccagugucuuuc

SEQ ID NO: 3693420 - RNA, 21 nt, Human
uucauugccuuaacuggagcc

SEQ ID NO: 3693421 - RNA, 13 nt, Human
uucauugcuguga

SEQ ID NO: 3693422 - RNA, 13 nt, Human
uucauugggcugu

SEQ ID NO: 3693423 - RNA, 19 nt, Human
uucauugguacugccuuaa

SEQ ID NO: 3693424 - RNA, 16 nt, Human
uucauugguuaauuuu

SEQ ID NO: 3693425 - RNA, 16 nt, Human
uucauuguaugaugug

SEQ ID NO: 3693426 - RNA, 12 nt, Human
uucauugugguu

SEQ ID NO: 3693427 - RNA, 19 nt, Human
uucauugugguuauuuuua

SEQ ID NO: 3693428 - RNA, 21 nt, Human
uucauugugguuauuuuuaua

SEQ ID NO: 3693429 - RNA, 15 nt, Human
uucauuuaaaaugau

SEQ ID NO: 3693430 - RNA, 15 nt, Human
uucauuuaagggaaa

SEQ ID NO: 3693431 - RNA, 16 nt, Human
uucauuuacuguggcu

SEQ ID NO: 3693432 - RNA, 22 nt, Human
uucauuuagagcuagucuuuca

SEQ ID NO: 3693433 - RNA, 21 nt, Human
uucauuuagcuaaacggauuc

SEQ ID NO: 3693434 - RNA, 18 nt, Human
uucauuuagugaguuauu

SEQ ID NO: 3693435 - RNA, 13 nt, Human
uucauuucaucua

SEQ ID NO: 3693436 - RNA, 13 nt, Human
uucauuucauugu

SEQ ID NO: 3693437 - RNA, 15 nt, Human
uucauuucauuguau

SEQ ID NO: 3693438 - RNA, 13 nt, Human
uucauuuccacuc

SEQ ID NO: 3693439 - RNA, 13 nt, Human
uucauuuccucaa

SEQ ID NO: 3693440 - RNA, 13 nt, Human
uucauuucugaua

SEQ ID NO: 3693441 - RNA, 12 nt, Human
uucauuugcuuu

SEQ ID NO: 3693442 - RNA, 22 nt, Human
uucauuugguucauuaauucua

SEQ ID NO: 3693443 - RNA, 18 nt, Human
uucauuuguaugucaaag

SEQ ID NO: 3693444 - RNA, 15 nt, Human
uucauuugugucaau

SEQ ID NO: 3693445 - RNA, 18 nt, Human
uucauuuuaacaucugag

SEQ ID NO: 3693446 - RNA, 11 nt, Human
uucauuuucca

SEQ ID NO: 3693447 - RNA, 19 nt, Human
uucauuuugagcugaaaug

SEQ ID NO: 3693448 - RNA, 22 nt, Human
uucauuuugcacugaggauauu

SEQ ID NO: 3693449 - RNA, 17 nt, Human
uucauuuugcuuuaauu

SEQ ID NO: 3693450 - RNA, 14 nt, Human
uucauuuuuaaaug

SEQ ID NO: 3693451 - RNA, 16 nt, Human
uucauuuuuaaaugug

SEQ ID NO: 3693452 - RNA, 17 nt, Human
uucauuuuuaaucauga

SEQ ID NO: 3693453 - RNA, 18 nt, Human
uucauuuuuaaucaugaa

SEQ ID NO: 3693454 - RNA, 13 nt, Human
uucauuuuuccua

SEQ ID NO: 3693455 - RNA, 23 nt, Human
uucauuuuuuucacuggaguuac

SEQ ID NO: 3693456 - RNA, 17 nt, Human
uucauuuuuuuccaggc

SEQ ID NO: 3693457 - RNA, 18 nt, Human
uucauuuuuuuuaauuga

SEQ ID NO: 3693458 - RNA, 14 nt, Human
uuccaaaacaaaaa

SEQ ID NO: 3693459 - RNA, 22 nt, Human
uuccaaaaguggccucuuuguc

SEQ ID NO: 3693460 - RNA, 18 nt, Human
uuccaaaaucucccauuu

SEQ ID NO: 3693461 - RNA, 19 nt, Human
uuccaaaaucucccauuuu

SEQ ID NO: 3693462 - RNA, 13 nt, Human
uuccaaaauucuu

SEQ ID NO: 3693463 - RNA, 16 nt, Human
uuccaaaauucuuauu

SEQ ID NO: 3693464 - RNA, 15 nt, Human
uuccaaaccuuaucu

SEQ ID NO: 3693465 - RNA, 20 nt, Human
uuccaaaccuuaucuccaca

SEQ ID NO: 3693466 - RNA, 13 nt, Human
uuccaaagaaugu

SEQ ID NO: 3693467 - RNA, 20 nt, Human
uuccaaagaauguuagagca

SEQ ID NO: 3693468 - RNA, 22 nt, Human
uuccaaagaguagaauugcauu

SEQ ID NO: 3693469 - RNA, 11 nt, Human
uuccaaagcaa

SEQ ID NO: 3693470 - RNA, 12 nt, Human
uuccaaagcaaa

SEQ ID NO: 3693471 - RNA, 20 nt, Human
uuccaaagcacauugaaaga

SEQ ID NO: 3693472 - RNA, 14 nt, Human
uuccaaaguuaaca

SEQ ID NO: 3693473 - RNA, 20 nt, Human
uuccaaauaaaauguucccu

SEQ ID NO: 3693474 - RNA, 16 nt, Human
uuccaaauaaauaauu

SEQ ID NO: 3693475 - RNA, 17 nt, Human
uuccaaaugcaauuuga

SEQ ID NO: 3693476 - RNA, 16 nt, Human
uuccaaauuauuucuu

SEQ ID NO: 3693477 - RNA, 18 nt, Human
uuccaaauuauuucuuaa

SEQ ID NO: 3693478 - RNA, 13 nt, Human
uuccaaauucaug

SEQ ID NO: 3693479 - RNA, 20 nt, Human
uuccaacaagaagggacuga

SEQ ID NO: 3693480 - RNA, 21 nt, Human
uuccaacaccacagacacaca

SEQ ID NO: 3693481 - RNA, 22 nt, Human
uuccaacaccacagacacacac

SEQ ID NO: 3693482 - RNA, 19 nt, Human
uuccaaccauuuaucuuga

SEQ ID NO: 3693483 - RNA, 20 nt, Human
uuccaaccauuuaucuugaa

SEQ ID NO: 3693484 - RNA, 18 nt, Human
uuccaacuacuaauagaa

SEQ ID NO: 3693485 - RNA, 22 nt, Human
uuccaacugcugccccaaagga

SEQ ID NO: 3693486 - RNA, 14 nt, Human
uuccaagacauugu

SEQ ID NO: 3693487 - RNA, 16 nt, Human
uuccaagacauuguca

SEQ ID NO: 3693488 - RNA, 17 nt, Human
uuccaagacauugucaa

SEQ ID NO: 3693489 - RNA, 20 nt, Human
uuccaagacauugucaauaa

SEQ ID NO: 3693490 - RNA, 21 nt, Human
uuccaagacucuagaguccaa

SEQ ID NO: 3693491 - RNA, 13 nt, Human
uuccaagagccug

SEQ ID NO: 3693492 - RNA, 12 nt, Human
uuccaagagcug

SEQ ID NO: 3693493 - RNA, 12 nt, Human
uuccaagagucu

SEQ ID NO: 3693494 - RNA, 15 nt, Human
uuccaagagucuaaa

SEQ ID NO: 3693495 - RNA, 19 nt, Human
uuccaagcaaauguuacau

SEQ ID NO: 3693496 - RNA, 13 nt, Human
uuccaaggagcug

SEQ ID NO: 3693497 - RNA, 22 nt, Human
uuccaaggagcugagaauagaa

SEQ ID NO: 3693498 - RNA, 23 nt, Human
uuccaaggagcugagaauagaag

SEQ ID NO: 3693499 - RNA, 13 nt, Human
uuccaaggcuucu

SEQ ID NO: 3693500 - RNA, 17 nt, Human
uuccaaggguacuaagg

SEQ ID NO: 3693501 - RNA, 20 nt, Human
uuccaagguggucugcucgg

SEQ ID NO: 3693502 - RNA, 22 nt, Human
uuccaaguagaauugauuuccc

SEQ ID NO: 3693503 - RNA, 14 nt, Human
uuccaagugugcau

SEQ ID NO: 3693504 - RNA, 20 nt, Human
uuccaagugugcauauugua

SEQ ID NO: 3693505 - RNA, 16 nt, Human
uuccaaguugcuaaua

SEQ ID NO: 3693506 - RNA, 21 nt, Human
uuccaauaaaccagguuuaga

SEQ ID NO: 3693507 - RNA, 13 nt, Human
uuccaauauguga

SEQ ID NO: 3693508 - RNA, 15 nt, Human
uuccaauauuucugc

SEQ ID NO: 3693509 - RNA, 15 nt, Human
uuccaauccuggcuc

SEQ ID NO: 3693510 - RNA, 13 nt, Human
uuccaauguuuca

SEQ ID NO: 3693511 - RNA, 22 nt, Human
uuccacaagugccgcaaauugu

SEQ ID NO: 3693512 - RNA, 23 nt, Human
uuccacaaguuaaauaaaucaua

SEQ ID NO: 3693513 - RNA, 13 nt, Human
uuccacaccccca

SEQ ID NO: 3693514 - RNA, 17 nt, Human
uuccacacccccacccc

SEQ ID NO: 3693515 - RNA, 21 nt, Human
uuccacaccuggcacugcugu

SEQ ID NO: 3693516 - RNA, 14 nt, Human
uuccacagaggaca

SEQ ID NO: 3693517 - RNA, 18 nt, Human
uuccacagauuguuucua

SEQ ID NO: 3693518 - RNA, 17 nt, Human
uuccacaggucucagaa

SEQ ID NO: 3693519 - RNA, 13 nt, Human
uguuuguuuauua

SEQ ID NO: 3693520 - RNA, 15 nt, Human
uguuuguuucaagaa

SEQ ID NO: 3693521 - RNA, 13 nt, Human
uguuuguuugucu

SEQ ID NO: 3693522 - RNA, 20 nt, Human
uguuuuaaaaagaaacaaga

SEQ ID NO: 3693523 - RNA, 22 nt, Human
uguuuuaaacauuaauagcagc

SEQ ID NO: 3693524 - RNA, 19 nt, Human
uguuuuaaagaauaugacu

SEQ ID NO: 3693525 - RNA, 19 nt, Human
uguuuuaaauauagaauuu

SEQ ID NO: 3693526 - RNA, 14 nt, Human
uguuuuaaauguac

SEQ ID NO: 3693527 - RNA, 15 nt, Human
uguuuuaaauguaca

SEQ ID NO: 3693528 - RNA, 12 nt, Human
uguuuuaaauuc

SEQ ID NO: 3693529 - RNA, 19 nt, Human
uguuuuaacaagaagcaau

SEQ ID NO: 3693530 - RNA, 17 nt, Human
uguuuuaagaggcaggg

SEQ ID NO: 3693531 - RNA, 18 nt, Human
uguuuuaaggaugcuugu

SEQ ID NO: 3693532 - RNA, 15 nt, Human
uguuuuaaucugaaa

SEQ ID NO: 3693533 - RNA, 18 nt, Human
uguuuuaaucugaaauuc

SEQ ID NO: 3693534 - RNA, 20 nt, Human
uguuuuacaaguuggaguca

SEQ ID NO: 3693535 - RNA, 19 nt, Human
uguuuuacgucugggagaa

SEQ ID NO: 3693536 - RNA, 15 nt, Human
uguuuuacugugaaa

SEQ ID NO: 3693537 - RNA, 23 nt, Human
uguuuuagacaaauacucaugug

SEQ ID NO: 3693538 - RNA, 17 nt, Human
uguuuuaguuaaauuuc

SEQ ID NO: 3693539 - RNA, 20 nt, Human
uguuuuauaauuuugugaag

SEQ ID NO: 3693540 - RNA, 13 nt, Human
uguuuuaucuggu

SEQ ID NO: 3693541 - RNA, 16 nt, Human
uguuuuaucuucuaua

SEQ ID NO: 3693542 - RNA, 18 nt, Human
uguuuuaugacuucauua

SEQ ID NO: 3693543 - RNA, 15 nt, Human
uguuuuaugagaaag

SEQ ID NO: 3693544 - RNA, 20 nt, Human
uguuuuauggccuaaauuua

SEQ ID NO: 3693545 - RNA, 13 nt, Human
uguuuucaaaugg

SEQ ID NO: 3693546 - RNA, 13 nt, Human
uguuuucaaaugu

SEQ ID NO: 3693547 - RNA, 22 nt, Human
uguuuucaaucucguauagaag

SEQ ID NO: 3693548 - RNA, 20 nt, Human
uguuuuccaugaguccccug

SEQ ID NO: 3693549 - RNA, 16 nt, Human
uguuuucccacgagga

SEQ ID NO: 3693550 - RNA, 22 nt, Human
uguuuuccucccuucugcuacu

SEQ ID NO: 3693551 - RNA, 21 nt, Human
uguuuucuaguguaucaaaau

SEQ ID NO: 3693552 - RNA, 12 nt, Human
uguuuucucuga

SEQ ID NO: 3693553 - RNA, 17 nt, Human
uguuuucugaauaacau

SEQ ID NO: 3693554 - RNA, 13 nt, Human
uguuuucugugua

SEQ ID NO: 3693555 - RNA, 14 nt, Human
uguuuucuugauuu

SEQ ID NO: 3693556 - RNA, 22 nt, Human
uguuuucuuucuuuaaauguuu

SEQ ID NO: 3693557 - RNA, 17 nt, Human
uguuuugaaacucagua

SEQ ID NO: 3693558 - RNA, 19 nt, Human
uguuuugaaucucauaauu

SEQ ID NO: 3693559 - RNA, 22 nt, Human
uguuuugaaugguguuguaugc

SEQ ID NO: 3693560 - RNA, 19 nt, Human
uguuuugagcuuuccaugu

SEQ ID NO: 3693561 - RNA, 20 nt, Human
uguuuugauaaaguaguaaa

SEQ ID NO: 3693562 - RNA, 14 nt, Human
uguuuugcacuuuu

SEQ ID NO: 3693563 - RNA, 17 nt, Human
uguuuugccaauuugca

SEQ ID NO: 3693564 - RNA, 21 nt, Human
uguuuugccaauuugcacauu

SEQ ID NO: 3693565 - RNA, 23 nt, Human
uguuuugccaauuugcacauuaa

SEQ ID NO: 3693566 - RNA, 17 nt, Human
uguuuugcucaauagau

SEQ ID NO: 3693567 - RNA, 19 nt, Human
uguuuugcuuuugcucgau

SEQ ID NO: 3693568 - RNA, 16 nt, Human
uguuuugcuuuuucug

SEQ ID NO: 3693569 - RNA, 20 nt, Human
uguuuugcuuuuucugacuc

SEQ ID NO: 3693570 - RNA, 19 nt, Human
uguuuuggacuccaucucu

SEQ ID NO: 3693571 - RNA, 23 nt, Human
uguuuuggcugaaauucuccugg

SEQ ID NO: 3693572 - RNA, 19 nt, Human
uguuuugguagauuaaaua

SEQ ID NO: 3693573 - RNA, 16 nt, Human
uguuuugguaucuguu

SEQ ID NO: 3693574 - RNA, 17 nt, Human
uguuuuguaaacauuua

SEQ ID NO: 3693575 - RNA, 18 nt, Human
uguuuuguaaacauuuau

SEQ ID NO: 3693576 - RNA, 15 nt, Human
uguuuuguaaacuuu

SEQ ID NO: 3693577 - RNA, 19 nt, Human
uguuuuguaaacuuugaaa

SEQ ID NO: 3693578 - RNA, 19 nt, Human
uguuuuguaaaguccccag

SEQ ID NO: 3693579 - RNA, 18 nt, Human
uguuuuguacauagauuu

SEQ ID NO: 3693580 - RNA, 12 nt, Human
uguuuuguacca

SEQ ID NO: 3693581 - RNA, 13 nt, Human
uguuuuguauaca

SEQ ID NO: 3693582 - RNA, 16 nt, Human
uguuuuguauacaaau

SEQ ID NO: 3693583 - RNA, 17 nt, Human
uguuuuguauacaaaua

SEQ ID NO: 3693584 - RNA, 14 nt, Human
uguuuuguguuguu

SEQ ID NO: 3693585 - RNA, 12 nt, Human
uguuuuguuaau

SEQ ID NO: 3693586 - RNA, 22 nt, Human
uguuuuguucaccauuauaaug

SEQ ID NO: 3693587 - RNA, 13 nt, Human
uguuuuguugaca

SEQ ID NO: 3693588 - RNA, 14 nt, Human
uguuuuguugacau

SEQ ID NO: 3693589 - RNA, 15 nt, Human
uguuuuguugacauu

SEQ ID NO: 3693590 - RNA, 20 nt, Human
uguuuuguugacauucugaa

SEQ ID NO: 3693591 - RNA, 21 nt, Human
uguuuuguugacauucugaau

SEQ ID NO: 3693592 - RNA, 14 nt, Human
uguuuuguugcacu

SEQ ID NO: 3693593 - RNA, 20 nt, Human
uguuuuguugguuuuuaaag

SEQ ID NO: 3693594 - RNA, 13 nt, Human
uguuuuguuucug

SEQ ID NO: 3693595 - RNA, 17 nt, Human
uguuuuguuuggagaca

SEQ ID NO: 3693596 - RNA, 23 nt, Human
uguuuuguuugucucuccuuuuc

SEQ ID NO: 3693597 - RNA, 20 nt, Human
uguuuuuaaaaaucauaaac

SEQ ID NO: 3693598 - RNA, 15 nt, Human
uguuuuuaaaaucuu

SEQ ID NO: 3693599 - RNA, 21 nt, Human
uguuuuuaaaaucuuauuaaa

SEQ ID NO: 3693600 - RNA, 19 nt, Human
uguuuuuaaacuguacagu

SEQ ID NO: 3693601 - RNA, 12 nt, Human
uguuuuuaacuc

SEQ ID NO: 3693602 - RNA, 12 nt, Human
uguuuuuaagau

SEQ ID NO: 3693603 - RNA, 14 nt, Human
uguuuuuaagcugu

SEQ ID NO: 3693604 - RNA, 16 nt, Human
uguuuuuaaguuugca

SEQ ID NO: 3693605 - RNA, 13 nt, Human
uguuuuuacccau

SEQ ID NO: 3693606 - RNA, 17 nt, Human
uguuuuuagacaccuuc

SEQ ID NO: 3693607 - RNA, 15 nt, Human
uguuuuuauaaaaau

SEQ ID NO: 3693608 - RNA, 15 nt, Human
uguuuuuauuauuaa

SEQ ID NO: 3693609 - RNA, 17 nt, Human
uguuuuucaguucaaag

SEQ ID NO: 3693610 - RNA, 19 nt, Human
uguuuuucaguucaaaguc

SEQ ID NO: 3693611 - RNA, 14 nt, Human
uguuuuucaugaaa

SEQ ID NO: 3693612 - RNA, 14 nt, Human
uguuuuucauucau

SEQ ID NO: 3693613 - RNA, 20 nt, Human
uguuuuuccuuguauuuaaa

SEQ ID NO: 3693614 - RNA, 15 nt, Human
uguuuuucuauuaaa

SEQ ID NO: 3693615 - RNA, 16 nt, Human
uguuuuucuauuaaaa

SEQ ID NO: 3693616 - RNA, 17 nt, Human
uguuuuucuauuaaaag

SEQ ID NO: 3693617 - RNA, 18 nt, Human
uguuuuucuauuaaaaga

SEQ ID NO: 3693618 - RNA, 19 nt, Human
uguuuuucuauuaaaagac

SEQ ID NO: 3693619 - RNA, 11 nt, Human
uguuuuucuca

SEQ ID NO: 3693620 - RNA, 18 nt, Human
uguuuuucugcuuuagac

SEQ ID NO: 3693621 - RNA, 12 nt, Human
uguuuuucuggg

SEQ ID NO: 3693622 - RNA, 18 nt, Human
uguuuuugaggcuuucug

SEQ ID NO: 3693623 - RNA, 17 nt, Human
uguuuuugggaugucuu

SEQ ID NO: 3693624 - RNA, 18 nt, Human
uguuuuugggaugucuua

SEQ ID NO: 3693625 - RNA, 16 nt, Human
uguuuuuguaaagaaa

SEQ ID NO: 3693626 - RNA, 17 nt, Human
uguuuuuguaaagaaaa

SEQ ID NO: 3693627 - RNA, 15 nt, Human
uguuuuuguaaagug

SEQ ID NO: 3693628 - RNA, 12 nt, Human
uguuuuuguaua

SEQ ID NO: 3693629 - RNA, 14 nt, Human
uguuuuuguauauu

SEQ ID NO: 3693630 - RNA, 19 nt, Human
uguuuuuguauuuuuaaug

SEQ ID NO: 3693631 - RNA, 13 nt, Human
uguuuuugucuua

SEQ ID NO: 3693632 - RNA, 18 nt, Human
uguuuuuguuuuguugca

SEQ ID NO: 3693633 - RNA, 20 nt, Human
uguuuuuuaagauaguguaa

SEQ ID NO: 3693634 - RNA, 14 nt, Human
uguuuuuucaaaau

SEQ ID NO: 3693635 - RNA, 16 nt, Human
uguuuuuucaaaauag

SEQ ID NO: 3693636 - RNA, 23 nt, Human
uguuuuuucaaaauagaaaaguu

SEQ ID NO: 3693637 - RNA, 17 nt, Human
uguuuuuuccugagcuu

SEQ ID NO: 3693638 - RNA, 15 nt, Human
uguuuuuucugccac

SEQ ID NO: 3693639 - RNA, 9 nt, Human
uguuuuuug

SEQ ID NO: 3693640 - RNA, 19 nt, Human
uguuuuuugaaaacauggu

SEQ ID NO: 3693641 - RNA, 17 nt, Human
uguuuuuugagucuuuu

SEQ ID NO: 3693642 - RNA, 15 nt, Human
uguuuuuugccacag

SEQ ID NO: 3693643 - RNA, 18 nt, Human
uguuuuuugccacagcuu

SEQ ID NO: 3693644 - RNA, 14 nt, Human
uguuuuuuggucuu

SEQ ID NO: 3693645 - RNA, 22 nt, Human
uguuuuuuucuuuuuuuauaaa

SEQ ID NO: 3693646 - RNA, 16 nt, Human
uguuuuuuuguuauua

SEQ ID NO: 3693647 - RNA, 17 nt, Human
uguuuuuuuucagccac

SEQ ID NO: 3693648 - RNA, 18 nt, Human
uuaaaaaaaaagaucugu

SEQ ID NO: 3693649 - RNA, 14 nt, Human
uuaaaaaaaacaaa

SEQ ID NO: 3693650 - RNA, 15 nt, Human
uuaaaaaaaacaaaa

SEQ ID NO: 3693651 - RNA, 18 nt, Human
uuaaaaaaaacaaaaaga

SEQ ID NO: 3693652 - RNA, 23 nt, Human
uuaaaaaaaacaaaaagaacaaa

SEQ ID NO: 3693653 - RNA, 19 nt, Human
uuaaaaaaaauuugcucau

SEQ ID NO: 3693654 - RNA, 14 nt, Human
uuaaaaaaagaaaa

SEQ ID NO: 3693655 - RNA, 17 nt, Human
uuaaaaaaauaaaacau

SEQ ID NO: 3693656 - RNA, 23 nt, Human
uuaaaaaaaucacaaaaauuuga

SEQ ID NO: 3693657 - RNA, 14 nt, Human
uuaaaaaaaugaca

SEQ ID NO: 3693658 - RNA, 15 nt, Human
uuaaaaaagaaacau

SEQ ID NO: 3693659 - RNA, 19 nt, Human
uuaaaaaagaaacauuugg

SEQ ID NO: 3693660 - RNA, 21 nt, Human
uuaaaaaagauaaacacaaga

SEQ ID NO: 3693661 - RNA, 19 nt, Human
uuaaaaaagcuuaaaacuu

SEQ ID NO: 3693662 - RNA, 14 nt, Human
uuaaaaaauaaaua

SEQ ID NO: 3693663 - RNA, 15 nt, Human
uuaaaaaauauuuau

SEQ ID NO: 3693664 - RNA, 20 nt, Human
uuaaaaaauauuuucucugu

SEQ ID NO: 3693665 - RNA, 16 nt, Human
uuaaaaaaucuuaaug

SEQ ID NO: 3693666 - RNA, 16 nt, Human
uuaaaaaaugaaaucc

SEQ ID NO: 3693667 - RNA, 16 nt, Human
uuaaaaaauggaacau

SEQ ID NO: 3693668 - RNA, 13 nt, Human
uuaaaaaaugucc

SEQ ID NO: 3693669 - RNA, 16 nt, Human
uuaaaaaauuuuugaa

SEQ ID NO: 3693670 - RNA, 14 nt, Human
uaccauuuguaaua

SEQ ID NO: 3693671 - RNA, 17 nt, Human
uaccauuuguaauaaag

SEQ ID NO: 3693672 - RNA, 22 nt, Human
uaccauuuguaauaaaguauau

SEQ ID NO: 3693673 - RNA, 18 nt, Human
uaccauuuuaaaguuagu

SEQ ID NO: 3693674 - RNA, 16 nt, Human
uaccauuuucugguuc

SEQ ID NO: 3693675 - RNA, 17 nt, Human
uacccaaaagagaaaaa

SEQ ID NO: 3693676 - RNA, 20 nt, Human
uacccaaacccuagguuccc

SEQ ID NO: 3693677 - RNA, 11 nt, Human
uacccaaagga

SEQ ID NO: 3693678 - RNA, 17 nt, Human
uacccaaauccucucca

SEQ ID NO: 3693679 - RNA, 13 nt, Human
uacccaaccacuc

SEQ ID NO: 3693680 - RNA, 13 nt, Human
uacccaauuuccc

SEQ ID NO: 3693681 - RNA, 19 nt, Human
uacccacaccucugccaga

SEQ ID NO: 3693682 - RNA, 15 nt, Human
uacccacccccaccc

SEQ ID NO: 3693683 - RNA, 15 nt, Human
uacccaccuagaaca

SEQ ID NO: 3693684 - RNA, 22 nt, Human
uacccaccuagaacacuaacuc

SEQ ID NO: 3693685 - RNA, 11 nt, Human
uacccaccuga

SEQ ID NO: 3693686 - RNA, 14 nt, Human
uacccaccugagcu

SEQ ID NO: 3693687 - RNA, 15 nt, Human
uacccaccugagcuu

SEQ ID NO: 3693688 - RNA, 18 nt, Human
uacccaccugagcuuugg

SEQ ID NO: 3693689 - RNA, 20 nt, Human
uacccacguucucacaccca

SEQ ID NO: 3693690 - RNA, 21 nt, Human
uacccacguucucacacccac

SEQ ID NO: 3693691 - RNA, 17 nt, Human
uacccacucggucccag

SEQ ID NO: 3693692 - RNA, 11 nt, Human
uacccacugcu

SEQ ID NO: 3693693 - RNA, 12 nt, Human
uacccacugcuc

SEQ ID NO: 3693694 - RNA, 13 nt, Human
uacccacugcucu

SEQ ID NO: 3693695 - RNA, 15 nt, Human
uacccacugcucugg

SEQ ID NO: 3693696 - RNA, 21 nt, Human
uacccacuucuaaauagcaau

SEQ ID NO: 3693697 - RNA, 18 nt, Human
uacccagagaagccccuu

SEQ ID NO: 3693698 - RNA, 19 nt, Human
uacccagagaagccccuuc

SEQ ID NO: 3693699 - RNA, 21 nt, Human
uacccagagaagccccuuccc

SEQ ID NO: 3693700 - RNA, 16 nt, Human
uacccagagaguccug

SEQ ID NO: 3693701 - RNA, 13 nt, Human
uacccagagcauu

SEQ ID NO: 3693702 - RNA, 17 nt, Human
uacccagccaucugccc

SEQ ID NO: 3693703 - RNA, 15 nt, Human
uacccagcccaucuu

SEQ ID NO: 3693704 - RNA, 16 nt, Human
uacccagcgagcccug

SEQ ID NO: 3693705 - RNA, 16 nt, Human
uacccagcuaaauaau

SEQ ID NO: 3693706 - RNA, 21 nt, Human
uacccagcuaaauaaucuuac

SEQ ID NO: 3693707 - RNA, 21 nt, Human
uacccaggaccaagccacagc

SEQ ID NO: 3693708 - RNA, 18 nt, Human
uacccaggguggagugca

SEQ ID NO: 3693709 - RNA, 15 nt, Human
uacccaggugggucc

SEQ ID NO: 3693710 - RNA, 22 nt, Human
uacccaguaacucaucugucac

SEQ ID NO: 3693711 - RNA, 22 nt, Human
uacccaguuucuaaacuggaga

SEQ ID NO: 3693712 - RNA, 23 nt, Human
uacccauacacccccucuucuga

SEQ ID NO: 3693713 - RNA, 15 nt, Human
uacccauagacauga

SEQ ID NO: 3693714 - RNA, 15 nt, Human
uacccauauccccuc

SEQ ID NO: 3693715 - RNA, 22 nt, Human
uacccauccccgcagugugcac

SEQ ID NO: 3693716 - RNA, 21 nt, Human
uacccaucgguguccauuuau

SEQ ID NO: 3693717 - RNA, 21 nt, Human
uacccaucuaguacuugaaaa

SEQ ID NO: 3693718 - RNA, 19 nt, Human
uacccaugucuacacagau

SEQ ID NO: 3693719 - RNA, 17 nt, Human
uaccccaauuccuugua

SEQ ID NO: 3693720 - RNA, 12 nt, Human
uaccccacccuc

SEQ ID NO: 3693721 - RNA, 13 nt, Human
uaccccaucccug

SEQ ID NO: 3693722 - RNA, 16 nt, Human
uaccccauggaccaug

SEQ ID NO: 3693723 - RNA, 16 nt, Human
uacccccaaccucauu

SEQ ID NO: 3693724 - RNA, 17 nt, Human
uaccccccaaccccuga

SEQ ID NO: 3693725 - RNA, 17 nt, Human
uacccccgcccaggcug

SEQ ID NO: 3693726 - RNA, 13 nt, Human
uacccccuccuuc

SEQ ID NO: 3693727 - RNA, 16 nt, Human
uacccccuccuucaga

SEQ ID NO: 3693728 - RNA, 17 nt, Human
uacccccuccuucagac

SEQ ID NO: 3693729 - RNA, 15 nt, Human
uacccccugugccuu

SEQ ID NO: 3693730 - RNA, 10 nt, Human
uaccccuccc

SEQ ID NO: 3693731 - RNA, 19 nt, Human
uaccccucccagcugacag

SEQ ID NO: 3693732 - RNA, 19 nt, Human
uaccccugacuucuguuua

SEQ ID NO: 3693733 - RNA, 19 nt, Human
uaccccuuacaaaugaaaa

SEQ ID NO: 3693734 - RNA, 19 nt, Human
uaccccuuagccucccuga

SEQ ID NO: 3693735 - RNA, 18 nt, Human
uaccccuuucuggcucuc

SEQ ID NO: 3693736 - RNA, 14 nt, Human
uacccgcagaguuc

SEQ ID NO: 3693737 - RNA, 23 nt, Human
uacccgggaagggggcugggaca

SEQ ID NO: 3693738 - RNA, 17 nt, Human
uacccguucacauuuuu

SEQ ID NO: 3693739 - RNA, 17 nt, Human
uacccuaaccaaguucc

SEQ ID NO: 3693740 - RNA, 16 nt, Human
uacccuagccauuccu

SEQ ID NO: 3693741 - RNA, 13 nt, Human
uacccuauaucua

SEQ ID NO: 3693742 - RNA, 16 nt, Human
uacccuauucucucuu

SEQ ID NO: 3693743 - RNA, 22 nt, Human
uacccucaggacaaugucugaa

SEQ ID NO: 3693744 - RNA, 23 nt, Human
uacccucaggcauaggccugggu

SEQ ID NO: 3693745 - RNA, 15 nt, Human
uacccucauguucuu

SEQ ID NO: 3693746 - RNA, 15 nt, Human
uacccucccaccccc

SEQ ID NO: 3693747 - RNA, 12 nt, Human
uacccucccugc

SEQ ID NO: 3693748 - RNA, 23 nt, Human
uacccucccugcuguccccucuu

SEQ ID NO: 3693749 - RNA, 15 nt, Human
uacccucucagcucc

SEQ ID NO: 3693750 - RNA, 20 nt, Human
uacccucucagcuccaggug

SEQ ID NO: 3693751 - RNA, 15 nt, Human
uacccucugaaauac

SEQ ID NO: 3693752 - RNA, 16 nt, Human
uacccucugaaauaca

SEQ ID NO: 3693753 - RNA, 12 nt, Human
uacccucuggag

SEQ ID NO: 3693754 - RNA, 22 nt, Human
uacccucuggagggguguggcu

SEQ ID NO: 3693755 - RNA, 13 nt, Human
uacccugaccugg

SEQ ID NO: 3693756 - RNA, 20 nt, Human
uacccugaccuggcccccuc

SEQ ID NO: 3693757 - RNA, 16 nt, Human
uacccugagcugaggc

SEQ ID NO: 3693758 - RNA, 18 nt, Human
uacccugagcugaggcag

SEQ ID NO: 3693759 - RNA, 13 nt, Human
uacccuggccccu

SEQ ID NO: 3693760 - RNA, 19 nt, Human
uacccuggccccucucccu

SEQ ID NO: 3693761 - RNA, 21 nt, Human
uacccuggccccucucccuug

SEQ ID NO: 3693762 - RNA, 21 nt, Human
uacccugggaaggccucuugg

SEQ ID NO: 3693763 - RNA, 14 nt, Human
uacccuuaagcuag

SEQ ID NO: 3693764 - RNA, 13 nt, Human
uacccuuaauuac

SEQ ID NO: 3693765 - RNA, 17 nt, Human
uacccuuaauuacuuaa

SEQ ID NO: 3693766 - RNA, 16 nt, Human
uacccuucccugcacu

SEQ ID NO: 3693767 - RNA, 17 nt, Human
uacccuucccugcacua

SEQ ID NO: 3693768 - RNA, 21 nt, Human
uacccuucugugcccagcuca

SEQ ID NO: 3693769 - RNA, 22 nt, Human
uacccuucuuuccauuucucuc

SEQ ID NO: 3693770 - RNA, 16 nt, Human
uacccuugagcccucc

SEQ ID NO: 3693771 - RNA, 19 nt, Human
uacccuugagcccucccca

SEQ ID NO: 3693772 - RNA, 17 nt, Human
uacccuuuuucuccagc

SEQ ID NO: 3693773 - RNA, 19 nt, Human
uacccuuuuucuccagcug

SEQ ID NO: 3693774 - RNA, 17 nt, Human
uaccgaaaccuugccuu

SEQ ID NO: 3693775 - RNA, 18 nt, Human
uaccgaaaccuugccuuu

SEQ ID NO: 3693776 - RNA, 17 nt, Human
uaccgaaugugucuuua

SEQ ID NO: 3693777 - RNA, 14 nt, Human
uaccgacccagggu

SEQ ID NO: 3693778 - RNA, 21 nt, Human
uaccgagucucuucuccacug

SEQ ID NO: 3693779 - RNA, 17 nt, Human
uaccgcguaaugcgcca

SEQ ID NO: 3693780 - RNA, 21 nt, Human
uaccgcguaaugcgccaauaa

SEQ ID NO: 3693781 - RNA, 18 nt, Human
uaccggagagagaaugua

SEQ ID NO: 3693782 - RNA, 20 nt, Human
uaccguaggcuuuguauuca

SEQ ID NO: 3693783 - RNA, 15 nt, Human
uaccguuucuucccu

SEQ ID NO: 3693784 - RNA, 15 nt, Human
uaccuaacauuauuu

SEQ ID NO: 3693785 - RNA, 13 nt, Human
uaccuaaguacug

SEQ ID NO: 3693786 - RNA, 17 nt, Human
uaccuaauuagagcaga

SEQ ID NO: 3693787 - RNA, 20 nt, Human
uaccuaauuagagcagauga

SEQ ID NO: 3693788 - RNA, 15 nt, Human
uaccuacauacaauu

SEQ ID NO: 3693789 - RNA, 13 nt, Human
uaccuacauguau

SEQ ID NO: 3693790 - RNA, 18 nt, Human
uaccuaccacagugucug

SEQ ID NO: 3693791 - RNA, 13 nt, Human
uaccuacuuugac

SEQ ID NO: 3693792 - RNA, 18 nt, Human
uaccuagauuuaauauaa

SEQ ID NO: 3693793 - RNA, 16 nt, Human
uaccuagauuuacagc

SEQ ID NO: 3693794 - RNA, 15 nt, Human
uaccuagcuggcucu

SEQ ID NO: 3693795 - RNA, 15 nt, Human
uaccuagugaaacuu

SEQ ID NO: 3693796 - RNA, 21 nt, Human
uaccuaucccaccuccauccc

SEQ ID NO: 3693797 - RNA, 14 nt, Human
uaccucaaacuauc

SEQ ID NO: 3693798 - RNA, 19 nt, Human
uaccucaaccauccuggcu

SEQ ID NO: 3693799 - RNA, 17 nt, Human
uaccucaaccuguaaau

SEQ ID NO: 3693800 - RNA, 16 nt, Human
uaccucaggcagcuca

SEQ ID NO: 3693801 - RNA, 21 nt, Human
uaccucagguugcugguugcu

SEQ ID NO: 3693802 - RNA, 13 nt, Human
uaccucagucagu

SEQ ID NO: 3693803 - RNA, 12 nt, Human
uaccucauguuu

SEQ ID NO: 3693804 - RNA, 15 nt, Human
uaccucauguuuaug

SEQ ID NO: 3693805 - RNA, 17 nt, Human
uaccucauguuuaugaa

SEQ ID NO: 3693806 - RNA, 20 nt, Human
uaccucauguuuaugaaaau

SEQ ID NO: 3693807 - RNA, 23 nt, Human
uaccuccaacagaacuaaauguu

SEQ ID NO: 3693808 - RNA, 17 nt, Human
uaccucccacacuccca

SEQ ID NO: 3693809 - RNA, 15 nt, Human
uaccuccucagggau

SEQ ID NO: 3693810 - RNA, 14 nt, Human
uaccuccucucagu

SEQ ID NO: 3693811 - RNA, 17 nt, Human
uaccuccucucaguguu

SEQ ID NO: 3693812 - RNA, 15 nt, Human
uaccuccugucucug

SEQ ID NO: 3693813 - RNA, 19 nt, Human
uaccucuaauaguauaaac

SEQ ID NO: 3693814 - RNA, 23 nt, Human
uaccucuccagccucagcucuca

SEQ ID NO: 3693815 - RNA, 14 nt, Human
uaccucucuguccc

SEQ ID NO: 3693816 - RNA, 20 nt, Human
uaccucucugucccuugcug

SEQ ID NO: 3693817 - RNA, 17 nt, Human
uaccucucuuauagaau

SEQ ID NO: 3693818 - RNA, 23 nt, Human
uaccucucuuauagaauauuuau

SEQ ID NO: 3693819 - RNA, 22 nt, Human
uaccucuugagccuugaacuuu

SEQ ID NO: 3693820 - RNA, 12 nt, Human
uaccucuuuugc

SEQ ID NO: 3693821 - RNA, 17 nt, Human
uuccaccaaaugugcuu

SEQ ID NO: 3693822 - RNA, 22 nt, Human
uuccaccacagccagcaccugg

SEQ ID NO: 3693823 - RNA, 12 nt, Human
uuccaccagccu

SEQ ID NO: 3693824 - RNA, 19 nt, Human
uuccacccaggggcagccc

SEQ ID NO: 3693825 - RNA, 21 nt, Human
uuccacccaggggcagcccca

SEQ ID NO: 3693826 - RNA, 15 nt, Human
uuccaccccaagaga

SEQ ID NO: 3693827 - RNA, 20 nt, Human
uuccaccccaagagaacucg

SEQ ID NO: 3693828 - RNA, 12 nt, Human
uuccacccccuc

SEQ ID NO: 3693829 - RNA, 14 nt, Human
uuccacccccuccc

SEQ ID NO: 3693830 - RNA, 15 nt, Human
uuccacccccucccu

SEQ ID NO: 3693831 - RNA, 18 nt, Human
uuccacccccucccuggc

SEQ ID NO: 3693832 - RNA, 13 nt, Human
uuccaccugcucu

SEQ ID NO: 3693833 - RNA, 14 nt, Human
uuccaccuuaaauu

SEQ ID NO: 3693834 - RNA, 14 nt, Human
uuccacgaugaaaa

SEQ ID NO: 3693835 - RNA, 19 nt, Human
uuccacgaugaaaaacuuc

SEQ ID NO: 3693836 - RNA, 18 nt, Human
uuccacgcugucuccaga

SEQ ID NO: 3693837 - RNA, 15 nt, Human
uuccacggagccacu

SEQ ID NO: 3693838 - RNA, 21 nt, Human
uuccacggagccacuccucug

SEQ ID NO: 3693839 - RNA, 23 nt, Human
uuccacuaagaacaccugcauuc

SEQ ID NO: 3693840 - RNA, 15 nt, Human
uuccacuacaccugg

SEQ ID NO: 3693841 - RNA, 18 nt, Human
uuccacucaggucuguuu

SEQ ID NO: 3693842 - RNA, 19 nt, Human
uuccacucguguguuucua

SEQ ID NO: 3693843 - RNA, 16 nt, Human
uuccacucugauagaa

SEQ ID NO: 3693844 - RNA, 21 nt, Human
uuccacucuggauucagccuu

SEQ ID NO: 3693845 - RNA, 13 nt, Human
uuccacugagacc

SEQ ID NO: 3693846 - RNA, 14 nt, Human
uuccacugagcucc

SEQ ID NO: 3693847 - RNA, 20 nt, Human
uuccacugagcuccaugugc

SEQ ID NO: 3693848 - RNA, 15 nt, Human
uuccacugagggcag

SEQ ID NO: 3693849 - RNA, 18 nt, Human
uuccacugauggaaacaa

SEQ ID NO: 3693850 - RNA, 13 nt, Human
uuccacugccucu

SEQ ID NO: 3693851 - RNA, 18 nt, Human
uuccacuucuuccuuucu

SEQ ID NO: 3693852 - RNA, 12 nt, Human
uuccacuuggcu

SEQ ID NO: 3693853 - RNA, 15 nt, Human
uuccagaaaggauau

SEQ ID NO: 3693854 - RNA, 21 nt, Human
uuccagaaccacacuugaaac

SEQ ID NO: 3693855 - RNA, 18 nt, Human
uuccagaagaagagaagc

SEQ ID NO: 3693856 - RNA, 15 nt, Human
uuccagaagugugau

SEQ ID NO: 3693857 - RNA, 16 nt, Human
uuccagaaucccaaga

SEQ ID NO: 3693858 - RNA, 14 nt, Human
uuccagaaucugua

SEQ ID NO: 3693859 - RNA, 16 nt, Human
uuccagaaugcuguac

SEQ ID NO: 3693860 - RNA, 22 nt, Human
uuccagacauucucgcuucccu

SEQ ID NO: 3693861 - RNA, 11 nt, Human
uuccagagaag

SEQ ID NO: 3693862 - RNA, 13 nt, Human
uuccagagccuca

SEQ ID NO: 3693863 - RNA, 16 nt, Human
uuccagagggguugag

SEQ ID NO: 3693864 - RNA, 18 nt, Human
uuccagauccuggaaauc

SEQ ID NO: 3693865 - RNA, 19 nt, Human
uuccagauccuggaaauca

SEQ ID NO: 3693866 - RNA, 23 nt, Human
uuccagauggucauccagacuca

SEQ ID NO: 3693867 - RNA, 20 nt, Human
uuccagcaauucuccugccu

SEQ ID NO: 3693868 - RNA, 12 nt, Human
uuccagccaggg

SEQ ID NO: 3693869 - RNA, 14 nt, Human
uuccagccugccac

SEQ ID NO: 3693870 - RNA, 20 nt, Human
uuccagcucaccccccacac

SEQ ID NO: 3693871 - RNA, 19 nt, Human
uuccagcucauucauuuua

SEQ ID NO: 3693872 - RNA, 11 nt, Human
uuccagcuccu

SEQ ID NO: 3693873 - RNA, 18 nt, Human
uuccagcuggaugagaau

SEQ ID NO: 3693874 - RNA, 13 nt, Human
uuccaggaaaaag

SEQ ID NO: 3693875 - RNA, 22 nt, Human
uuccaggaaacuccacaucugc

SEQ ID NO: 3693876 - RNA, 13 nt, Human
uuccaggaccccu

SEQ ID NO: 3693877 - RNA, 20 nt, Human
uuccaggacuguuucaaaca

SEQ ID NO: 3693878 - RNA, 21 nt, Human
uuccaggacuguuucaaacau

SEQ ID NO: 3693879 - RNA, 14 nt, Human
uuccaggauggugu

SEQ ID NO: 3693880 - RNA, 11 nt, Human
uuccaggcagc

SEQ ID NO: 3693881 - RNA, 21 nt, Human
uuccaggcuaguccggaccca

SEQ ID NO: 3693882 - RNA, 15 nt, Human
uuccaggcugggaga

SEQ ID NO: 3693883 - RNA, 16 nt, Human
uuccaggcuucugcug

SEQ ID NO: 3693884 - RNA, 22 nt, Human
uuccaggcuucugcuggggccu

SEQ ID NO: 3693885 - RNA, 19 nt, Human
uuccagggucccucugugu

SEQ ID NO: 3693886 - RNA, 20 nt, Human
uuccagggucccucugugua

SEQ ID NO: 3693887 - RNA, 21 nt, Human
uuccagguacccuucucgcuu

SEQ ID NO: 3693888 - RNA, 18 nt, Human
uuccaguaccuuugucac

SEQ ID NO: 3693889 - RNA, 22 nt, Human
uuccagucaggcucucugggcu

SEQ ID NO: 3693890 - RNA, 18 nt, Human
uuccagucucugcaugua

SEQ ID NO: 3693891 - RNA, 15 nt, Human
uuccagugaggcucu

SEQ ID NO: 3693892 - RNA, 17 nt, Human
uuccagugaggcucugc

SEQ ID NO: 3693893 - RNA, 22 nt, Human
uuccaguggccuggcuccgcug

SEQ ID NO: 3693894 - RNA, 23 nt, Human
uuccagugguccauggaaugcuu

SEQ ID NO: 3693895 - RNA, 17 nt, Human
uuccauaaggaauguag

SEQ ID NO: 3693896 - RNA, 22 nt, Human
uuccauaaucuggacuccucug

SEQ ID NO: 3693897 - RNA, 16 nt, Human
uuccauaauguauaaa

SEQ ID NO: 3693898 - RNA, 12 nt, Human
uuccauaauuau

SEQ ID NO: 3693899 - RNA, 13 nt, Human
uuccauaauuaug

SEQ ID NO: 3693900 - RNA, 15 nt, Human
uuccauacagcucua

SEQ ID NO: 3693901 - RNA, 18 nt, Human
uuccauauauccuuuucu

SEQ ID NO: 3693902 - RNA, 15 nt, Human
uuccauaucuugcga

SEQ ID NO: 3693903 - RNA, 20 nt, Human
uuccauaugaccucaugcau

SEQ ID NO: 3693904 - RNA, 17 nt, Human
uuccauauuagaaaacu

SEQ ID NO: 3693905 - RNA, 23 nt, Human
uuccauauuuuuuuccuuacaua

SEQ ID NO: 3693906 - RNA, 22 nt, Human
uuccaucacccguacaggcaau

SEQ ID NO: 3693907 - RNA, 16 nt, Human
uuccaucaugucccca

SEQ ID NO: 3693908 - RNA, 17 nt, Human
uuccaucauguccccaa

SEQ ID NO: 3693909 - RNA, 19 nt, Human
uuccauccaccuuucccaa

SEQ ID NO: 3693910 - RNA, 15 nt, Human
uuccauccauggcca

SEQ ID NO: 3693911 - RNA, 20 nt, Human
uuccauccauggccagcagc

SEQ ID NO: 3693912 - RNA, 14 nt, Human
uuccaucccagagg

SEQ ID NO: 3693913 - RNA, 21 nt, Human
uuccaucccuacccccuaaga

SEQ ID NO: 3693914 - RNA, 17 nt, Human
uuccaucuaaaaauaua

SEQ ID NO: 3693915 - RNA, 23 nt, Human
uuccaucuccuauaaucugucaa

SEQ ID NO: 3693916 - RNA, 23 nt, Human
uuccaucucgccaccccuccuuc

SEQ ID NO: 3693917 - RNA, 13 nt, Human
uuccaucuuuaca

SEQ ID NO: 3693918 - RNA, 22 nt, Human
uuccaugaaaacguuuuauugu

SEQ ID NO: 3693919 - RNA, 13 nt, Human
uuccaugaauuuu

SEQ ID NO: 3693920 - RNA, 21 nt, Human
uuccaugacugcuugcccuaa

SEQ ID NO: 3693921 - RNA, 13 nt, Human
uuccaugccugag

SEQ ID NO: 3693922 - RNA, 22 nt, Human
uuccaugccugaggguggagac

SEQ ID NO: 3693923 - RNA, 18 nt, Human
uuccaugcguguuucuga

SEQ ID NO: 3693924 - RNA, 21 nt, Human
uuccaugcguguuucugacuc

SEQ ID NO: 3693925 - RNA, 23 nt, Human
uuccaugcugugcgcccagggcu

SEQ ID NO: 3693926 - RNA, 14 nt, Human
uuccauggauuuug

SEQ ID NO: 3693927 - RNA, 20 nt, Human
uuccauguccccucccagag

SEQ ID NO: 3693928 - RNA, 16 nt, Human
uuccaugucgccucug

SEQ ID NO: 3693929 - RNA, 18 nt, Human
uuccaugucgccucugca

SEQ ID NO: 3693930 - RNA, 17 nt, Human
uuccaugugcccaguua

SEQ ID NO: 3693931 - RNA, 15 nt, Human
uuccauguugcugcc

SEQ ID NO: 3693932 - RNA, 14 nt, Human
uuccauuccacaca

SEQ ID NO: 3693933 - RNA, 15 nt, Human
uuccauucuggaagu

SEQ ID NO: 3693934 - RNA, 13 nt, Human
uuccauugcuuau

SEQ ID NO: 3693935 - RNA, 21 nt, Human
uuccauugcuuugaaaaaguu

SEQ ID NO: 3693936 - RNA, 16 nt, Human
uuccauuggaucucau

SEQ ID NO: 3693937 - RNA, 17 nt, Human
uuccauugguccaagau

SEQ ID NO: 3693938 - RNA, 13 nt, Human
uuccauuguguga

SEQ ID NO: 3693939 - RNA, 15 nt, Human
uuccauuguuugaaa

SEQ ID NO: 3693940 - RNA, 22 nt, Human
uuccauuguuugaaacaaagaa

SEQ ID NO: 3693941 - RNA, 20 nt, Human
uuccauuguuuggagacauu

SEQ ID NO: 3693942 - RNA, 17 nt, Human
uuccauuuacugcauuc

SEQ ID NO: 3693943 - RNA, 18 nt, Human
uuccauuuacuuaagacu

SEQ ID NO: 3693944 - RNA, 12 nt, Human
uuccauuuccaa

SEQ ID NO: 3693945 - RNA, 13 nt, Human
uuccauuugcaag

SEQ ID NO: 3693946 - RNA, 13 nt, Human
uuccauuuuaauu

SEQ ID NO: 3693947 - RNA, 16 nt, Human
uucccaaacgccuccc

SEQ ID NO: 3693948 - RNA, 19 nt, Human
uucccaaaggacuccaccc

SEQ ID NO: 3693949 - RNA, 22 nt, Human
uucccaaaugugugcccagcuu

SEQ ID NO: 3693950 - RNA, 21 nt, Human
uucccaacacggguaaaucua

SEQ ID NO: 3693951 - RNA, 18 nt, Human
uucccaacucuagcuggg

SEQ ID NO: 3693952 - RNA, 15 nt, Human
uucccaacugcaagu

SEQ ID NO: 3693953 - RNA, 20 nt, Human
uucccaacuugccuuugaag

SEQ ID NO: 3693954 - RNA, 14 nt, Human
uucccaagaaaugc

SEQ ID NO: 3693955 - RNA, 13 nt, Human
uucccaagcucug

SEQ ID NO: 3693956 - RNA, 12 nt, Human
uucccaauaaau

SEQ ID NO: 3693957 - RNA, 21 nt, Human
uucccaauagcacuuucauug

SEQ ID NO: 3693958 - RNA, 13 nt, Human
uucccaauugcuu

SEQ ID NO: 3693959 - RNA, 16 nt, Human
uucccacauuaaagaa

SEQ ID NO: 3693960 - RNA, 16 nt, Human
uucccacccagccugg

SEQ ID NO: 3693961 - RNA, 22 nt, Human
uucccaccccaaccugcucucc

SEQ ID NO: 3693962 - RNA, 17 nt, Human
uucccaccgcccucccu

SEQ ID NO: 3693963 - RNA, 21 nt, Human
uucccaccucccugcccaggc

SEQ ID NO: 3693964 - RNA, 19 nt, Human
uucccacugcacccccucc

SEQ ID NO: 3693965 - RNA, 13 nt, Human
uucccagaaggca

SEQ ID NO: 3693966 - RNA, 23 nt, Human
uucccagaaucaaagcaaugcau

SEQ ID NO: 3693967 - RNA, 21 nt, Human
uucccagagugugaaacuucc

SEQ ID NO: 3693968 - RNA, 22 nt, Human
uucccagcaguggacucaaaac

SEQ ID NO: 3693969 - RNA, 18 nt, Human
uucccagcucucccucug

SEQ ID NO: 3693970 - RNA, 19 nt, Human
uucccagcucucccucugg

SEQ ID NO: 3693971 - RNA, 16 nt, Human
uuaaaaacaaaaggca

SEQ ID NO: 3693972 - RNA, 16 nt, Human
uuaaaaagaaugacgu

SEQ ID NO: 3693973 - RNA, 18 nt, Human
uuaaaaagggaagaaacu

SEQ ID NO: 3693974 - RNA, 23 nt, Human
uuaaaaagggcagggcaucuccu

SEQ ID NO: 3693975 - RNA, 23 nt, Human
uuaaaaaguauugccaaacauua

SEQ ID NO: 3693976 - RNA, 23 nt, Human
uuaaaaaguccauaccuuauaua

SEQ ID NO: 3693977 - RNA, 17 nt, Human
uuaaaaagucugcauua

SEQ ID NO: 3693978 - RNA, 21 nt, Human
uuaaaaagucugcauuacauu

SEQ ID NO: 3693979 - RNA, 23 nt, Human
uuaaaaagucuuuuaaaaaguau

SEQ ID NO: 3693980 - RNA, 13 nt, Human
uuaaaaaguguuu

SEQ ID NO: 3693981 - RNA, 16 nt, Human
uuaaaaaguuguucaa

SEQ ID NO: 3693982 - RNA, 11 nt, Human
uuaaaaauaaa

SEQ ID NO: 3693983 - RNA, 19 nt, Human
uuaaaaauaucaaauuaau

SEQ ID NO: 3693984 - RNA, 23 nt, Human
uuaaaaauauggaacuucuaaua

SEQ ID NO: 3693985 - RNA, 23 nt, Human
uuaaaaaucaacuuuuuauugcc

SEQ ID NO: 3693986 - RNA, 14 nt, Human
uuaaaaaucucaaa

SEQ ID NO: 3693987 - RNA, 19 nt, Human
uuaaaaaugagugugaagg

SEQ ID NO: 3693988 - RNA, 12 nt, Human
uuaaaaaugcaa

SEQ ID NO: 3693989 - RNA, 14 nt, Human
uuaaaaauguaaau

SEQ ID NO: 3693990 - RNA, 18 nt, Human
uuaaaaaugucuuauugu

SEQ ID NO: 3693991 - RNA, 17 nt, Human
uuaaaaauucagcaaag

SEQ ID NO: 3693992 - RNA, 19 nt, Human
uuaaaaauugucuucaugu

SEQ ID NO: 3693993 - RNA, 12 nt, Human
uuaaaacaaaac

SEQ ID NO: 3693994 - RNA, 18 nt, Human
uuaaaacaaaacaaaaca

SEQ ID NO: 3693995 - RNA, 12 nt, Human
uuaaaacaaaca

SEQ ID NO: 3693996 - RNA, 11 nt, Human
uuaaaacaaga

SEQ ID NO: 3693997 - RNA, 13 nt, Human
uuaaaacacaaca

SEQ ID NO: 3693998 - RNA, 23 nt, Human
uuaaaacacguuuuaaggacuga

SEQ ID NO: 3693999 - RNA, 14 nt, Human
uuaaaacacuucug

SEQ ID NO: 3694000 - RNA, 14 nt, Human
uuaaaacagacacu

SEQ ID NO: 3694001 - RNA, 12 nt, Human
uuaaaacagcug

SEQ ID NO: 3694002 - RNA, 21 nt, Human
uuaaaacagcugcauuagaaa

SEQ ID NO: 3694003 - RNA, 16 nt, Human
uuaaaacaucauuccu

SEQ ID NO: 3694004 - RNA, 23 nt, Human
uuaaaacaucauuccuuuuuauu

SEQ ID NO: 3694005 - RNA, 23 nt, Human
uuaaaacaugcccccuggaaagg

SEQ ID NO: 3694006 - RNA, 13 nt, Human
uuaaaacuaaauu

SEQ ID NO: 3694007 - RNA, 19 nt, Human
uuaaaacuaggcauuugua

SEQ ID NO: 3694008 - RNA, 22 nt, Human
uuaaaacuaggcauuuguaaau

SEQ ID NO: 3694009 - RNA, 23 nt, Human
uuaaaacuaggcauuuguaaaua

SEQ ID NO: 3694010 - RNA, 19 nt, Human
uuaaaacucagccugggac

SEQ ID NO: 3694011 - RNA, 20 nt, Human
uuaaaacugaagucugaaau

SEQ ID NO: 3694012 - RNA, 13 nt, Human
uuaaaacugcuuu

SEQ ID NO: 3694013 - RNA, 22 nt, Human
uuaaaacugcuuuuuuuuuucc

SEQ ID NO: 3694014 - RNA, 9 nt, Human
uuaaaagaa

SEQ ID NO: 3694015 - RNA, 20 nt, Human
uuaaaagaaagccucagaga

SEQ ID NO: 3694016 - RNA, 23 nt, Human
uuaaaagaaaggguucuguaaaa

SEQ ID NO: 3694017 - RNA, 12 nt, Human
uuaaaagaaauu

SEQ ID NO: 3694018 - RNA, 21 nt, Human
uuaaaagaaugggcaguuaca

SEQ ID NO: 3694019 - RNA, 12 nt, Human
uuaaaagacaag

SEQ ID NO: 3694020 - RNA, 15 nt, Human
uuaaaagacaagacu

SEQ ID NO: 3694021 - RNA, 13 nt, Human
uuaaaagacucau

SEQ ID NO: 3694022 - RNA, 23 nt, Human
uuaaaagagagagagagaaaaaa

SEQ ID NO: 3694023 - RNA, 15 nt, Human
uuaaaagaugaaaau

SEQ ID NO: 3694024 - RNA, 14 nt, Human
uuaaaagcauuuuu

SEQ ID NO: 3694025 - RNA, 17 nt, Human
uuaaaagccacauagag

SEQ ID NO: 3694026 - RNA, 13 nt, Human
uuaaaagccugcu

SEQ ID NO: 3694027 - RNA, 21 nt, Human
uuaaaagcuaucuucauguaa

SEQ ID NO: 3694028 - RNA, 23 nt, Human
uuaaaagggauuacccaagcaaa

SEQ ID NO: 3694029 - RNA, 14 nt, Human
uuaaaaguaaaugu

SEQ ID NO: 3694030 - RNA, 18 nt, Human
uuaaaaguguauuuguua

SEQ ID NO: 3694031 - RNA, 16 nt, Human
uuaaaaguuucaaugu

SEQ ID NO: 3694032 - RNA, 22 nt, Human
uuaaaaguuucaaugugauucu

SEQ ID NO: 3694033 - RNA, 16 nt, Human
uuaaaauaaaaauucu

SEQ ID NO: 3694034 - RNA, 20 nt, Human
uuaaaauaaaaauucugaau

SEQ ID NO: 3694035 - RNA, 14 nt, Human
uuaaaauaaaauga

SEQ ID NO: 3694036 - RNA, 17 nt, Human
uuaaaauaaaaugaaaa

SEQ ID NO: 3694037 - RNA, 21 nt, Human
uuaaaauaaaaugaaaauugu

SEQ ID NO: 3694038 - RNA, 20 nt, Human
uuaaaauaagcacugugcua

SEQ ID NO: 3694039 - RNA, 15 nt, Human
uuaaaauaaggauuu

SEQ ID NO: 3694040 - RNA, 17 nt, Human
uuaaaauaagucugauu

SEQ ID NO: 3694041 - RNA, 15 nt, Human
uuaaaauaauuauau

SEQ ID NO: 3694042 - RNA, 11 nt, Human
uuaaaauacaa

SEQ ID NO: 3694043 - RNA, 15 nt, Human
uuaaaauacaagacu

SEQ ID NO: 3694044 - RNA, 19 nt, Human
uuaaaauacacacucaaau

SEQ ID NO: 3694045 - RNA, 21 nt, Human
uuaaaauaccagccaguaaau

SEQ ID NO: 3694046 - RNA, 16 nt, Human
uuaaaauacuguagau

SEQ ID NO: 3694047 - RNA, 18 nt, Human
uuaaaauacuguagauaa

SEQ ID NO: 3694048 - RNA, 20 nt, Human
uuaaaauacuguagauaauu

SEQ ID NO: 3694049 - RNA, 15 nt, Human
uuaaaauagaaauaa

SEQ ID NO: 3694050 - RNA, 18 nt, Human
uuaaaauaggggauauuu

SEQ ID NO: 3694051 - RNA, 20 nt, Human
uuaaaauauauauguugauu

SEQ ID NO: 3694052 - RNA, 13 nt, Human
uuaaaauaucuuu

SEQ ID NO: 3694053 - RNA, 19 nt, Human
uuaaaauaucuuuugaccu

SEQ ID NO: 3694054 - RNA, 17 nt, Human
uuaaaauauuuauuuau

SEQ ID NO: 3694055 - RNA, 17 nt, Human
uuaaaaucacuaacauu

SEQ ID NO: 3694056 - RNA, 20 nt, Human
uuaaaaucacuaacauuaua

SEQ ID NO: 3694057 - RNA, 12 nt, Human
uuaaaauccuca

SEQ ID NO: 3694058 - RNA, 17 nt, Human
uuaaaaucuauucugug

SEQ ID NO: 3694059 - RNA, 12 nt, Human
uuaaaaugagaa

SEQ ID NO: 3694060 - RNA, 19 nt, Human
uuaaaaugagaaaucuaaa

SEQ ID NO: 3694061 - RNA, 16 nt, Human
uuaaaaugauuguaaa

SEQ ID NO: 3694062 - RNA, 18 nt, Human
uuaaaaugauuguaaaau

SEQ ID NO: 3694063 - RNA, 16 nt, Human
uuaaaaugcaacaugu

SEQ ID NO: 3694064 - RNA, 13 nt, Human
uuaaaaugcaaua

SEQ ID NO: 3694065 - RNA, 21 nt, Human
uuaaaauggaugccuugaaua

SEQ ID NO: 3694066 - RNA, 11 nt, Human
uuaaaauguaa

SEQ ID NO: 3694067 - RNA, 16 nt, Human
uuaaaauguaaagcca

SEQ ID NO: 3694068 - RNA, 17 nt, Human
uuaaaauguaauuuaaa

SEQ ID NO: 3694069 - RNA, 21 nt, Human
uuaaaauguaauuuaaaugaa

SEQ ID NO: 3694070 - RNA, 15 nt, Human
uuaaaauguacaugu

SEQ ID NO: 3694071 - RNA, 23 nt, Human
uuaaaauguauucuuaaauucau

SEQ ID NO: 3694072 - RNA, 13 nt, Human
uuaaaauguucac

SEQ ID NO: 3694073 - RNA, 23 nt, Human
uacucccagggcuuacggcccug

SEQ ID NO: 3694074 - RNA, 15 nt, Human
uacucccuugcccua

SEQ ID NO: 3694075 - RNA, 15 nt, Human
uacuccuaccucagc

SEQ ID NO: 3694076 - RNA, 17 nt, Human
uacuccuaccucagccu

SEQ ID NO: 3694077 - RNA, 19 nt, Human
uacuccuaugaucugaguc

SEQ ID NO: 3694078 - RNA, 15 nt, Human
uacuccucacacuua

SEQ ID NO: 3694079 - RNA, 12 nt, Human
uacuccucccag

SEQ ID NO: 3694080 - RNA, 11 nt, Human
uacuccuccuc

SEQ ID NO: 3694081 - RNA, 16 nt, Human
uacuccuccucuuucu

SEQ ID NO: 3694082 - RNA, 18 nt, Human
uacuccuccucuuucucu

SEQ ID NO: 3694083 - RNA, 16 nt, Human
uacuccucugcagugc

SEQ ID NO: 3694084 - RNA, 12 nt, Human
uacuccugacuc

SEQ ID NO: 3694085 - RNA, 14 nt, Human
uacuccugcaaaau

SEQ ID NO: 3694086 - RNA, 22 nt, Human
uacuccugcaaaauuuuauagc

SEQ ID NO: 3694087 - RNA, 19 nt, Human
uacuccuguaauuccuacc

SEQ ID NO: 3694088 - RNA, 13 nt, Human
uacuccugucuuc

SEQ ID NO: 3694089 - RNA, 15 nt, Human
uacuccugucuucug

SEQ ID NO: 3694090 - RNA, 17 nt, Human
uacuccugucuucugcu

SEQ ID NO: 3694091 - RNA, 19 nt, Human
uacuccugucuucugcuuu

SEQ ID NO: 3694092 - RNA, 20 nt, Human
uacuccugucuucugcuuug

SEQ ID NO: 3694093 - RNA, 21 nt, Human
uacuccugucuucugcuuugu

SEQ ID NO: 3694094 - RNA, 22 nt, Human
uacuccugucuucugcuuuguu

SEQ ID NO: 3694095 - RNA, 18 nt, Human
uacuccugugggagccuc

SEQ ID NO: 3694096 - RNA, 14 nt, Human
uacuccuuaagaac

SEQ ID NO: 3694097 - RNA, 21 nt, Human
uacuccuuaagaacacaaagc

SEQ ID NO: 3694098 - RNA, 22 nt, Human
uacucgaguuacagacaaagcg

SEQ ID NO: 3694099 - RNA, 19 nt, Human
uacucggaaauuaaaguuu

SEQ ID NO: 3694100 - RNA, 13 nt, Human
uacucuaagaucu

SEQ ID NO: 3694101 - RNA, 15 nt, Human
uacucuaagaucuua

SEQ ID NO: 3694102 - RNA, 21 nt, Human
uacucuaauucuaaccagagc

SEQ ID NO: 3694103 - RNA, 14 nt, Human
uacucuagaugaag

SEQ ID NO: 3694104 - RNA, 12 nt, Human
uacucuagauuu

SEQ ID NO: 3694105 - RNA, 20 nt, Human
uacucuaugccccaaauaua

SEQ ID NO: 3694106 - RNA, 22 nt, Human
uacucucacacugguucucaau

SEQ ID NO: 3694107 - RNA, 22 nt, Human
uacucuccuggaaauauuaaga

SEQ ID NO: 3694108 - RNA, 23 nt, Human
uacucuccuggaaauauuaagaa

SEQ ID NO: 3694109 - RNA, 20 nt, Human
uacucugaaacacacugaaa

SEQ ID NO: 3694110 - RNA, 22 nt, Human
uacucugaagggcaucaugcau

SEQ ID NO: 3694111 - RNA, 12 nt, Human
uacucugggaac

SEQ ID NO: 3694112 - RNA, 15 nt, Human
uacucugguucuuug

SEQ ID NO: 3694113 - RNA, 19 nt, Human
uacucugugccagagccug

SEQ ID NO: 3694114 - RNA, 22 nt, Human
uacucugugccagagccugggg

SEQ ID NO: 3694115 - RNA, 17 nt, Human
uacucuuaagccaucuu

SEQ ID NO: 3694116 - RNA, 23 nt, Human
uacucuuaagccaucuugguaaa

SEQ ID NO: 3694117 - RNA, 15 nt, Human
uacucuuaaguuucu

SEQ ID NO: 3694118 - RNA, 18 nt, Human
uacucuuauagacaacau

SEQ ID NO: 3694119 - RNA, 18 nt, Human
uacucuucuugaaauuuu

SEQ ID NO: 3694120 - RNA, 19 nt, Human
uacucuuguaagauuuuga

SEQ ID NO: 3694121 - RNA, 23 nt, Human
uacucuuguaagauuuugaaaac

SEQ ID NO: 3694122 - RNA, 12 nt, Human
uacucuuuccua

SEQ ID NO: 3694123 - RNA, 13 nt, Human
uacucuuuccuau

SEQ ID NO: 3694124 - RNA, 15 nt, Human
uacucuuucuguaua

SEQ ID NO: 3694125 - RNA, 14 nt, Human
uacugaaacagauu

SEQ ID NO: 3694126 - RNA, 19 nt, Human
uacugaaagaguccauugu

SEQ ID NO: 3694127 - RNA, 20 nt, Human
uacugaaagguuacccugua

SEQ ID NO: 3694128 - RNA, 22 nt, Human
uacugaaauaaacgucuuaaau

SEQ ID NO: 3694129 - RNA, 19 nt, Human
uacugaacaucugaguccu

SEQ ID NO: 3694130 - RNA, 12 nt, Human
uacugaaggaaa

SEQ ID NO: 3694131 - RNA, 14 nt, Human
uacugaaggaaaaa

SEQ ID NO: 3694132 - RNA, 16 nt, Human
uacugaauuuuuuugu

SEQ ID NO: 3694133 - RNA, 18 nt, Human
uacugaauuuuuuuguaa

SEQ ID NO: 3694134 - RNA, 20 nt, Human
uacugacauguggggccagg

SEQ ID NO: 3694135 - RNA, 14 nt, Human
uacugacauuucuu

SEQ ID NO: 3694136 - RNA, 16 nt, Human
uacugacauuucuucu

SEQ ID NO: 3694137 - RNA, 15 nt, Human
uacugacccuggggc

SEQ ID NO: 3694138 - RNA, 17 nt, Human
uacugacccuggggcug

SEQ ID NO: 3694139 - RNA, 16 nt, Human
uacugacuuugcuugc

SEQ ID NO: 3694140 - RNA, 18 nt, Human
uacugacuuugcuugcuu

SEQ ID NO: 3694141 - RNA, 17 nt, Human
uacugagaaaaccuguu

SEQ ID NO: 3694142 - RNA, 17 nt, Human
uacugagagugaacaaa

SEQ ID NO: 3694143 - RNA, 18 nt, Human
uacugagccuuguaauuc

SEQ ID NO: 3694144 - RNA, 22 nt, Human
uacugaggccuaaaaguaaaca

SEQ ID NO: 3694145 - RNA, 17 nt, Human
uacugaucaugcauugu

SEQ ID NO: 3694146 - RNA, 14 nt, Human
uacugauuguuuca

SEQ ID NO: 3694147 - RNA, 14 nt, Human
uacugauuucagua

SEQ ID NO: 3694148 - RNA, 21 nt, Human
uacugauuuccuuuggagcuu

SEQ ID NO: 3694149 - RNA, 23 nt, Human
uacugauuugggcugaauguaug

SEQ ID NO: 3694150 - RNA, 17 nt, Human
uacugauuuuugugauu

SEQ ID NO: 3694151 - RNA, 14 nt, Human
uacugcaaaucagg

SEQ ID NO: 3694152 - RNA, 23 nt, Human
uacugcaaaucaggcuuuuguuu

SEQ ID NO: 3694153 - RNA, 18 nt, Human
uacugcaaaugucaucag

SEQ ID NO: 3694154 - RNA, 17 nt, Human
uacugcagccuccagag

SEQ ID NO: 3694155 - RNA, 15 nt, Human
uacugcagcuuuaca

SEQ ID NO: 3694156 - RNA, 19 nt, Human
uacugcagcuuuacaugca

SEQ ID NO: 3694157 - RNA, 18 nt, Human
uacugcagggccaggacu

SEQ ID NO: 3694158 - RNA, 18 nt, Human
uacugcauucuucugauc

SEQ ID NO: 3694159 - RNA, 15 nt, Human
uacugcauuuaggga

SEQ ID NO: 3694160 - RNA, 13 nt, Human
uacugccaaccuc

SEQ ID NO: 3694161 - RNA, 16 nt, Human
uacugccaaccucgcu

SEQ ID NO: 3694162 - RNA, 20 nt, Human
uuaaucaauuuaaacccauu

SEQ ID NO: 3694163 - RNA, 19 nt, Human
uuaaucacaaauuucacuu

SEQ ID NO: 3694164 - RNA, 21 nt, Human
uuaaucacaaauuucacuuau

SEQ ID NO: 3694165 - RNA, 17 nt, Human
uuaaucacuguguauau

SEQ ID NO: 3694166 - RNA, 20 nt, Human
uuaaucacuuaacauuccua

SEQ ID NO: 3694167 - RNA, 20 nt, Human
uuaaucagguccucagagaa

SEQ ID NO: 3694168 - RNA, 16 nt, Human
uuaaucauauaaauag

SEQ ID NO: 3694169 - RNA, 19 nt, Human
uuaaucauauaaauagaau

SEQ ID NO: 3694170 - RNA, 18 nt, Human
uuaaucaugaauguguaa

SEQ ID NO: 3694171 - RNA, 13 nt, Human
uuaaucauugccu

SEQ ID NO: 3694172 - RNA, 13 nt, Human
uuaaucauuuuca

SEQ ID NO: 3694173 - RNA, 15 nt, Human
uuaaucauuuucauu

SEQ ID NO: 3694174 - RNA, 12 nt, Human
uuaaucauuuuu

SEQ ID NO: 3694175 - RNA, 18 nt, Human
uuaauccagaauaacuag

SEQ ID NO: 3694176 - RNA, 19 nt, Human
uuaauccaguuauaagaag

SEQ ID NO: 3694177 - RNA, 15 nt, Human
uuaaucuacugcauu

SEQ ID NO: 3694178 - RNA, 16 nt, Human
uuaaucuacugcauuu

SEQ ID NO: 3694179 - RNA, 20 nt, Human
uuaaucuagacaauauacaa

SEQ ID NO: 3694180 - RNA, 17 nt, Human
uuaaucucuaacagugg

SEQ ID NO: 3694181 - RNA, 18 nt, Human
uuaaucucuaacagugga

SEQ ID NO: 3694182 - RNA, 23 nt, Human
uuaaucucuguuauguacuguac

SEQ ID NO: 3694183 - RNA, 15 nt, Human
uuaaucugaaauucu

SEQ ID NO: 3694184 - RNA, 17 nt, Human
uuaaucugaaauucuaa

SEQ ID NO: 3694185 - RNA, 23 nt, Human
uuaaucugaaauucuaaagagca

SEQ ID NO: 3694186 - RNA, 22 nt, Human
uuaaucugguuuauuuuuguuc

SEQ ID NO: 3694187 - RNA, 18 nt, Human
uuaaucuucaaagccuuc

SEQ ID NO: 3694188 - RNA, 20 nt, Human
uuaaucuucaaagccuucuc

SEQ ID NO: 3694189 - RNA, 17 nt, Human
uuaaucuucaguuuuau

SEQ ID NO: 3694190 - RNA, 17 nt, Human
uuaaucuuuaauuuuac

SEQ ID NO: 3694191 - RNA, 20 nt, Human
uuaaucuuuucacaaauaaa

SEQ ID NO: 3694192 - RNA, 18 nt, Human
uuaaugaaagacuguaca

SEQ ID NO: 3694193 - RNA, 20 nt, Human
uuaaugaaagacuguacaaa

SEQ ID NO: 3694194 - RNA, 17 nt, Human
uuaaugaaauaucugua

SEQ ID NO: 3694195 - RNA, 14 nt, Human
uuaaugaagaaagu

SEQ ID NO: 3694196 - RNA, 23 nt, Human
uuaaugaagaaaguggaaaacaa

SEQ ID NO: 3694197 - RNA, 15 nt, Human
uuaaugaagaucuaa

SEQ ID NO: 3694198 - RNA, 15 nt, Human
uuaaugaaguuugaa

SEQ ID NO: 3694199 - RNA, 16 nt, Human
uuaaugaaguuugaau

SEQ ID NO: 3694200 - RNA, 22 nt, Human
uuaaugaaucguaaugaaguug

SEQ ID NO: 3694201 - RNA, 20 nt, Human
uuaaugaaugcuuaaagaau

SEQ ID NO: 3694202 - RNA, 21 nt, Human
uuaaugaaugcuuaaagaauu

SEQ ID NO: 3694203 - RNA, 16 nt, Human
uuaaugagacuuuaaa

SEQ ID NO: 3694204 - RNA, 21 nt, Human
uuaaugauaugcuuguaacua

SEQ ID NO: 3694205 - RNA, 12 nt, Human
uuaaugcacuuu

SEQ ID NO: 3694206 - RNA, 15 nt, Human
uuaaugcacuuucua

SEQ ID NO: 3694207 - RNA, 20 nt, Human
uuaaugcauguuaggaaaau

SEQ ID NO: 3694208 - RNA, 23 nt, Human
uuaaugcauuaaaccugucucca

SEQ ID NO: 3694209 - RNA, 21 nt, Human
uuaaugccugcuuuuuggaaa

SEQ ID NO: 3694210 - RNA, 18 nt, Human
uuaaugccuuuaaaguau

SEQ ID NO: 3694211 - RNA, 21 nt, Human
uuaaugcuaagggcaggccca

SEQ ID NO: 3694212 - RNA, 23 nt, Human
uuaaugcuaaucuugugaaaaua

SEQ ID NO: 3694213 - RNA, 16 nt, Human
uuaaugcuauuugaac

SEQ ID NO: 3694214 - RNA, 21 nt, Human
uuaaugcuauuugaacaagug

SEQ ID NO: 3694215 - RNA, 17 nt, Human
uuaaugcugccuuuucu

SEQ ID NO: 3694216 - RNA, 18 nt, Human
uuaauggaugaaaucaua

SEQ ID NO: 3694217 - RNA, 21 nt, Human
uuaauggauuguuaauuucag

SEQ ID NO: 3694218 - RNA, 22 nt, Human
uuaauggucuaaaaauaaacca

SEQ ID NO: 3694219 - RNA, 17 nt, Human
uuaauguacauagugcu

SEQ ID NO: 3694220 - RNA, 18 nt, Human
uuaauguacauagugcua

SEQ ID NO: 3694221 - RNA, 14 nt, Human
uuaauguauauaaa

SEQ ID NO: 3694222 - RNA, 18 nt, Human
uuaauguauguuaccaaa

SEQ ID NO: 3694223 - RNA, 21 nt, Human
uuaauguauuuguucauguuu

SEQ ID NO: 3694224 - RNA, 22 nt, Human
uuaauguccucucaaaguaaaa

SEQ ID NO: 3694225 - RNA, 19 nt, Human
uuaaugugaacuuguagcu

SEQ ID NO: 3694226 - RNA, 13 nt, Human
uuaaugugaguuu

SEQ ID NO: 3694227 - RNA, 15 nt, Human
uuaaugugcugugua

SEQ ID NO: 3694228 - RNA, 18 nt, Human
uuaaugugcuguguaaag

SEQ ID NO: 3694229 - RNA, 13 nt, Human
uuaauguucugug

SEQ ID NO: 3694230 - RNA, 23 nt, Human
uuaauguugaacaaaauaaauug

SEQ ID NO: 3694231 - RNA, 10 nt, Human
uuaauguuuu

SEQ ID NO: 3694232 - RNA, 14 nt, Human
uuaauguuuucaaa

SEQ ID NO: 3694233 - RNA, 16 nt, Human
uuaauguuuucaaaag

SEQ ID NO: 3694234 - RNA, 18 nt, Human
uuaauguuuuuaaauaua

SEQ ID NO: 3694235 - RNA, 18 nt, Human
uuaauguuuuuugccaca

SEQ ID NO: 3694236 - RNA, 20 nt, Human
uuaauuaaaaacuaguaguu

SEQ ID NO: 3694237 - RNA, 15 nt, Human
uuaauuaaauagcuu

SEQ ID NO: 3694238 - RNA, 14 nt, Human
uuaauuaaaugcuc

SEQ ID NO: 3694239 - RNA, 16 nt, Human
uuaauuaaguaaacua

SEQ ID NO: 3694240 - RNA, 21 nt, Human
uuaauuaaguaaacuaaugag

SEQ ID NO: 3694241 - RNA, 20 nt, Human
uuaauuagggguugcuaaga

SEQ ID NO: 3694242 - RNA, 18 nt, Human
uuaauuagugcuaagugu

SEQ ID NO: 3694243 - RNA, 22 nt, Human
uuaauuaugccuuuuuugauca

SEQ ID NO: 3694244 - RNA, 18 nt, Human
uuaauuauuaacuacauu

SEQ ID NO: 3694245 - RNA, 17 nt, Human
uuaauuauuauucuuca

SEQ ID NO: 3694246 - RNA, 17 nt, Human
uuaauucaacuuaacua

SEQ ID NO: 3694247 - RNA, 16 nt, Human
uuaauucaccaaagua

SEQ ID NO: 3694248 - RNA, 15 nt, Human
uuaauucacucccac

SEQ ID NO: 3694249 - RNA, 22 nt, Human
uuaauucagcacugauuucaca

SEQ ID NO: 3694250 - RNA, 15 nt, Human
uuaauucauguuucu

SEQ ID NO: 3694251 - RNA, 19 nt, Human
uuaauuccaauaugaugac

SEQ ID NO: 3694252 - RNA, 21 nt, Human
uuaauuccaugaaucgcuucu

SEQ ID NO: 3694253 - RNA, 19 nt, Human
uuaauuccuucagcacuuu

SEQ ID NO: 3694254 - RNA, 16 nt, Human
uuaauuccuuucucau

SEQ ID NO: 3694255 - RNA, 17 nt, Human
uuaauucucuuucaaag

SEQ ID NO: 3694256 - RNA, 15 nt, Human
uuaauucuuagcuca

SEQ ID NO: 3694257 - RNA, 13 nt, Human
uuaauugaaauuu

SEQ ID NO: 3694258 - RNA, 15 nt, Human
uuaauugaaggaaag

SEQ ID NO: 3694259 - RNA, 23 nt, Human
uuaauugagaagcguauguuuuu

SEQ ID NO: 3694260 - RNA, 16 nt, Human
uuaauugaucaguuuu

SEQ ID NO: 3694261 - RNA, 22 nt, Human
uuaauugauuauucugauucca

SEQ ID NO: 3694262 - RNA, 15 nt, Human
uuaauuguaaacugu

SEQ ID NO: 3694263 - RNA, 13 nt, Human
uuaauuguauuuu

SEQ ID NO: 3694264 - RNA, 15 nt, Human
uuaauugucuugcac

SEQ ID NO: 3694265 - RNA, 20 nt, Human
uuaauugugaauugauaaua

SEQ ID NO: 3694266 - RNA, 22 nt, Human
uuaauugugaauugauaauaaa

SEQ ID NO: 3694267 - RNA, 21 nt, Human
uuaauugugugaacuuggaag

SEQ ID NO: 3694268 - RNA, 16 nt, Human
uuaauuguuguuucuu

SEQ ID NO: 3694269 - RNA, 18 nt, Human
uuaauuuaaacaccuccu

SEQ ID NO: 3694270 - RNA, 13 nt, Human
uuaauuuaaauga

SEQ ID NO: 3694271 - RNA, 14 nt, Human
uuaauuuaaaugau

SEQ ID NO: 3694272 - RNA, 23 nt, Human
uuaauuuaaguuuugacaagcug

SEQ ID NO: 3694273 - RNA, 16 nt, Human
uuaauuuaggacacau

SEQ ID NO: 3694274 - RNA, 16 nt, Human
uuaauuuauacuggca

SEQ ID NO: 3694275 - RNA, 14 nt, Human
uuaauuuauaugua

SEQ ID NO: 3694276 - RNA, 14 nt, Human
uuaauuuauuuuug

SEQ ID NO: 3694277 - RNA, 13 nt, Human
uuaauuucagucc

SEQ ID NO: 3694278 - RNA, 15 nt, Human
uuaauuuccuuuuug

SEQ ID NO: 3694279 - RNA, 16 nt, Human
uuaauuuccuuuuuga

SEQ ID NO: 3694280 - RNA, 21 nt, Human
uuaauuuccuuuuugacacug

SEQ ID NO: 3694281 - RNA, 15 nt, Human
uuaauuucuucaaaa

SEQ ID NO: 3694282 - RNA, 21 nt, Human
uuaauuucuucaaaauguaua

SEQ ID NO: 3694283 - RNA, 15 nt, Human
uuaauuugaaauaug

SEQ ID NO: 3694284 - RNA, 20 nt, Human
uuaauuugauaucacagucu

SEQ ID NO: 3694285 - RNA, 13 nt, Human
uuaauuugccaaa

SEQ ID NO: 3694286 - RNA, 20 nt, Human
uuaauuuggaaacuaauaaa

SEQ ID NO: 3694287 - RNA, 18 nt, Human
uuaauuuggaccauuuuc

SEQ ID NO: 3694288 - RNA, 19 nt, Human
uuaauuuuaaagugcaaaa

SEQ ID NO: 3694289 - RNA, 17 nt, Human
uuaauuuuaguuuuuca

SEQ ID NO: 3694290 - RNA, 13 nt, Human
uuaauuuucagua

SEQ ID NO: 3694291 - RNA, 22 nt, Human
uuaauuuugacacuauaucugu

SEQ ID NO: 3694292 - RNA, 20 nt, Human
uuaauuuugguuguauucuu

SEQ ID NO: 3694293 - RNA, 23 nt, Human
uuaauuuugguuguauucuuuga

SEQ ID NO: 3694294 - RNA, 14 nt, Human
uuaauuuuuaaaug

SEQ ID NO: 3694295 - RNA, 15 nt, Human
uuaauuuuuccaacu

SEQ ID NO: 3694296 - RNA, 12 nt, Human
uuaauuuuugau

SEQ ID NO: 3694297 - RNA, 13 nt, Human
uuaauuuuugaua

SEQ ID NO: 3694298 - RNA, 15 nt, Human
uuaauuuuugcuuuu

SEQ ID NO: 3694299 - RNA, 22 nt, Human
uuaauuuuuuuaaccaaaggug

SEQ ID NO: 3694300 - RNA, 17 nt, Human
uuacaaaacaaacucau

SEQ ID NO: 3694301 - RNA, 18 nt, Human
uuacaaaacuacaugaga

SEQ ID NO: 3694302 - RNA, 20 nt, Human
uuacaaaagaaauaccuuga

SEQ ID NO: 3694303 - RNA, 12 nt, Human
uuacaaacaugu

SEQ ID NO: 3694304 - RNA, 15 nt, Human
uuacaaacauguggu

SEQ ID NO: 3694305 - RNA, 12 nt, Human
uuacaaacugca

SEQ ID NO: 3694306 - RNA, 18 nt, Human
uuacaaaggcuguauuca

SEQ ID NO: 3694307 - RNA, 17 nt, Human
uuacaaaguguguauua

SEQ ID NO: 3694308 - RNA, 16 nt, Human
uuacaaaucagaaguc

SEQ ID NO: 3694309 - RNA, 17 nt, Human
uuacaaaucagaaguca

SEQ ID NO: 3694310 - RNA, 17 nt, Human
uuacaacagauuuguga

SEQ ID NO: 3694311 - RNA, 14 nt, Human
uucgggcuggccau

SEQ ID NO: 3694312 - RNA, 17 nt, Human
uucggggcugggaaguc

SEQ ID NO: 3694313 - RNA, 18 nt, Human
uucggugagcuacaaaug

SEQ ID NO: 3694314 - RNA, 13 nt, Human
uucggugugcacc

SEQ ID NO: 3694315 - RNA, 18 nt, Human
uucgguugagaauggaaa

SEQ ID NO: 3694316 - RNA, 14 nt, Human
uucgguuucuaacu

SEQ ID NO: 3694317 - RNA, 23 nt, Human
uucguacaguucuucgggaagag

SEQ ID NO: 3694318 - RNA, 18 nt, Human
uucguacauaauacugaa

SEQ ID NO: 3694319 - RNA, 15 nt, Human
uucguagauauugga

SEQ ID NO: 3694320 - RNA, 13 nt, Human
uucguaugaaaau

SEQ ID NO: 3694321 - RNA, 18 nt, Human
uucguccacagcuuccug

SEQ ID NO: 3694322 - RNA, 19 nt, Human
uucguccacagcuuccugu

SEQ ID NO: 3694323 - RNA, 23 nt, Human
uucgugagccccaucuucaccca

SEQ ID NO: 3694324 - RNA, 20 nt, Human
uucgugcggaaucagcuucu

SEQ ID NO: 3694325 - RNA, 17 nt, Human
uucguucuguacuguua

SEQ ID NO: 3694326 - RNA, 20 nt, Human
uucguucuuguucuguuuug

SEQ ID NO: 3694327 - RNA, 16 nt, Human
uucguuucuguauaca

SEQ ID NO: 3694328 - RNA, 13 nt, Human
uucuaaaaaacag

SEQ ID NO: 3694329 - RNA, 14 nt, Human
uucuaaaaacuucu

SEQ ID NO: 3694330 - RNA, 14 nt, Human
uucuaaaaagauua

SEQ ID NO: 3694331 - RNA, 14 nt, Human
uucuaaaaagucag

SEQ ID NO: 3694332 - RNA, 18 nt, Human
uucuaaaaagucagaugu

SEQ ID NO: 3694333 - RNA, 16 nt, Human
uucuaaaacuguacuu

SEQ ID NO: 3694334 - RNA, 18 nt, Human
uucuaaaacuguacuuug

SEQ ID NO: 3694335 - RNA, 17 nt, Human
uucuaaaagcuuucaug

SEQ ID NO: 3694336 - RNA, 18 nt, Human
uucuaaaaucaugaaacu

SEQ ID NO: 3694337 - RNA, 15 nt, Human
uucuaaaaugugaug

SEQ ID NO: 3694338 - RNA, 23 nt, Human
uucuaaaaugugauguucuaagg

SEQ ID NO: 3694339 - RNA, 22 nt, Human
uucuaaacaagaaucagucuau

SEQ ID NO: 3694340 - RNA, 16 nt, Human
uucuaaacaagauuuu

SEQ ID NO: 3694341 - RNA, 23 nt, Human
uucuaaagauaauauuacuguuu

SEQ ID NO: 3694342 - RNA, 13 nt, Human
uucuaaagaugga

SEQ ID NO: 3694343 - RNA, 23 nt, Human
uucuaaagauucuauaguucuag

SEQ ID NO: 3694344 - RNA, 17 nt, Human
uucuaaagcucugacau

SEQ ID NO: 3694345 - RNA, 20 nt, Human
uucuaaaggccucuuccuug

SEQ ID NO: 3694346 - RNA, 20 nt, Human
uucuaaagguguugucccuu

SEQ ID NO: 3694347 - RNA, 16 nt, Human
uucuaaaguucuaaga

SEQ ID NO: 3694348 - RNA, 17 nt, Human
uucuaaaguucuaagau

SEQ ID NO: 3694349 - RNA, 23 nt, Human
uucuaaauacaugccacaucaaa

SEQ ID NO: 3694350 - RNA, 13 nt, Human
uucuaaauagcaa

SEQ ID NO: 3694351 - RNA, 22 nt, Human
uucuaaauaucccuuggacauu

SEQ ID NO: 3694352 - RNA, 18 nt, Human
uucuaaaugaauguuuac

SEQ ID NO: 3694353 - RNA, 21 nt, Human
uucuaaaugaauguuuacacu

SEQ ID NO: 3694354 - RNA, 13 nt, Human
uucuaaaugcaua

SEQ ID NO: 3694355 - RNA, 20 nt, Human
uucuaaauguuuggcaugua

SEQ ID NO: 3694356 - RNA, 14 nt, Human
uucuaaauuuuaua

SEQ ID NO: 3694357 - RNA, 18 nt, Human
uucuaaccaagaggcugg

SEQ ID NO: 3694358 - RNA, 14 nt, Human
uucuaagaaacauu

SEQ ID NO: 3694359 - RNA, 16 nt, Human
uucuaagaaacauuua

SEQ ID NO: 3694360 - RNA, 23 nt, Human
uucuaagaaacauuuauauugau

SEQ ID NO: 3694361 - RNA, 21 nt, Human
uucuaagacucaaauguucua

SEQ ID NO: 3694362 - RNA, 22 nt, Human
uucuaagacucaaauguucuaa

SEQ ID NO: 3694363 - RNA, 20 nt, Human
uucuaagacuuacucuaaga

SEQ ID NO: 3694364 - RNA, 12 nt, Human
uucuaagagaag

SEQ ID NO: 3694365 - RNA, 12 nt, Human
uucuaagaugug

SEQ ID NO: 3694366 - RNA, 21 nt, Human
uucuaagaugugauauucuaa

SEQ ID NO: 3694367 - RNA, 22 nt, Human
uucuaagaugugauauucuaag

SEQ ID NO: 3694368 - RNA, 14 nt, Human
uucuaagauucuaa

SEQ ID NO: 3694369 - RNA, 16 nt, Human
uucuaagauucuaaag

SEQ ID NO: 3694370 - RNA, 17 nt, Human
uucuaagauucuaaagg

SEQ ID NO: 3694371 - RNA, 17 nt, Human
uucuaagauucuaauga

SEQ ID NO: 3694372 - RNA, 19 nt, Human
uucuaagauucuaaugaug

SEQ ID NO: 3694373 - RNA, 18 nt, Human
uucuaaggaauaugagcu

SEQ ID NO: 3694374 - RNA, 21 nt, Human
uucuaaggaccugaaauucca

SEQ ID NO: 3694375 - RNA, 22 nt, Human
uucuaaggaccugaaauuccaa

SEQ ID NO: 3694376 - RNA, 20 nt, Human
uucuaaggccuaggauucua

SEQ ID NO: 3694377 - RNA, 21 nt, Human
uucuaaggccuaggauucuaa

SEQ ID NO: 3694378 - RNA, 13 nt, Human
uucuaaggcucug

SEQ ID NO: 3694379 - RNA, 16 nt, Human
uucuaaggcucugaga

SEQ ID NO: 3694380 - RNA, 18 nt, Human
uucuaaggcucugagagu

SEQ ID NO: 3694381 - RNA, 20 nt, Human
uucuaaggcucugagagucu

SEQ ID NO: 3694382 - RNA, 20 nt, Human
uucuaagguccgguguucua

SEQ ID NO: 3694383 - RNA, 16 nt, Human
uucuaaguaaaaccac

SEQ ID NO: 3694384 - RNA, 19 nt, Human
uucuaaguaaaaccacagc

SEQ ID NO: 3694385 - RNA, 16 nt, Human
uucuaaguaaauacaa

SEQ ID NO: 3694386 - RNA, 12 nt, Human
uucuaaguuucu

SEQ ID NO: 3694387 - RNA, 18 nt, Human
uucuaaguuucuaagauu

SEQ ID NO: 3694388 - RNA, 15 nt, Human
uucuaauaaaacaaa

SEQ ID NO: 3694389 - RNA, 18 nt, Human
uucuaauaaauuauacaa

SEQ ID NO: 3694390 - RNA, 22 nt, Human
uucuaauauauuuuuauauuua

SEQ ID NO: 3694391 - RNA, 23 nt, Human
uucuaaugauggcccauucuacu

SEQ ID NO: 3694392 - RNA, 22 nt, Human
uucuaauuaaccuuacuaauua

SEQ ID NO: 3694393 - RNA, 20 nt, Human
uucuaauuaauaaauuauuu

SEQ ID NO: 3694394 - RNA, 16 nt, Human
uucuaauuagauuaac

SEQ ID NO: 3694395 - RNA, 14 nt, Human
uucuaauugccaug

SEQ ID NO: 3694396 - RNA, 15 nt, Human
uucuaauuugcugcu

SEQ ID NO: 3694397 - RNA, 16 nt, Human
uucuaauuugcugcug

SEQ ID NO: 3694398 - RNA, 22 nt, Human
uucuaauuugcugcugauaaug

SEQ ID NO: 3694399 - RNA, 17 nt, Human
uucuaauuuuggaugga

SEQ ID NO: 3694400 - RNA, 14 nt, Human
uucuacaaagcacu

SEQ ID NO: 3694401 - RNA, 18 nt, Human
uucuacaaugugaacuuu

SEQ ID NO: 3694402 - RNA, 22 nt, Human
uucuacacagugggaacucuga

SEQ ID NO: 3694403 - RNA, 14 nt, Human
uucuacacucuccu

SEQ ID NO: 3694404 - RNA, 17 nt, Human
uucuacacucuccuggg

SEQ ID NO: 3694405 - RNA, 23 nt, Human
uucuacacugggugcugauccuu

SEQ ID NO: 3694406 - RNA, 18 nt, Human
uucuaccaacuggaagca

SEQ ID NO: 3694407 - RNA, 18 nt, Human
uucuaccauuucagagag

SEQ ID NO: 3694408 - RNA, 19 nt, Human
uucuacccagcgagcccug

SEQ ID NO: 3694409 - RNA, 20 nt, Human
uucuacccagcgagcccugg

SEQ ID NO: 3694410 - RNA, 14 nt, Human
uucuacccaggugc

SEQ ID NO: 3694411 - RNA, 14 nt, Human
uucuacggaucauc

SEQ ID NO: 3694412 - RNA, 20 nt, Human
uucuacuaaaaauacaaaaa

SEQ ID NO: 3694413 - RNA, 15 nt, Human
uucuacucauauaua

SEQ ID NO: 3694414 - RNA, 13 nt, Human
uucuacugugacu

SEQ ID NO: 3694415 - RNA, 13 nt, Human
uucuacuugcucu

SEQ ID NO: 3694416 - RNA, 14 nt, Human
uucuacuugcucug

SEQ ID NO: 3694417 - RNA, 19 nt, Human
uucuacuugcucuggaccu

SEQ ID NO: 3694418 - RNA, 22 nt, Human
uucuacuugcucuggaccugcc

SEQ ID NO: 3694419 - RNA, 23 nt, Human
uucuagaaagccuguuccccuca

SEQ ID NO: 3694420 - RNA, 21 nt, Human
uucuagaacaucccugccagc

SEQ ID NO: 3694421 - RNA, 22 nt, Human
uucuagaauuauaagucacaaa

SEQ ID NO: 3694422 - RNA, 21 nt, Human
uucuagaauuuaucacacuuc

SEQ ID NO: 3694423 - RNA, 14 nt, Human
uucuagagaagagg

SEQ ID NO: 3694424 - RNA, 19 nt, Human
uucuagaguucagaguccu

SEQ ID NO: 3694425 - RNA, 16 nt, Human
uucuagauacaauaaa

SEQ ID NO: 3694426 - RNA, 20 nt, Human
uucuagauacaauaaauugc

SEQ ID NO: 3694427 - RNA, 16 nt, Human
uucuagaucagaugcu

SEQ ID NO: 3694428 - RNA, 22 nt, Human
uucuagaucagaugcuccaaga

SEQ ID NO: 3694429 - RNA, 24 nt, Human
uucuagaucagaugcuccaagauu

SEQ ID NO: 3694430 - RNA, 15 nt, Human
uucuagauuaccaug

SEQ ID NO: 3694431 - RNA, 12 nt, Human
uucuagcacugg

SEQ ID NO: 3694432 - RNA, 14 nt, Human
uucuagcacuggcc

SEQ ID NO: 3694433 - RNA, 15 nt, Human
uucuagcauggcaua

SEQ ID NO: 3694434 - RNA, 18 nt, Human
uucuagcauggcauauuu

SEQ ID NO: 3694435 - RNA, 16 nt, Human
uucuagcauggcugcc

SEQ ID NO: 3694436 - RNA, 21 nt, Human
uucuagcccgaauacaaacac

SEQ ID NO: 3694437 - RNA, 20 nt, Human
uucuagcuguugagcuguuu

SEQ ID NO: 3694438 - RNA, 21 nt, Human
uucuaggcacuguaguucuaa

SEQ ID NO: 3694439 - RNA, 14 nt, Human
uucuagguaggaaa

SEQ ID NO: 3694440 - RNA, 18 nt, Human
uucuagguaggaaaugug

SEQ ID NO: 3694441 - RNA, 18 nt, Human
uucuagguggcaaggcug

SEQ ID NO: 3694442 - RNA, 13 nt, Human
uucuagguuucaa

SEQ ID NO: 3694443 - RNA, 14 nt, Human
uucuagucucucug

SEQ ID NO: 3694444 - RNA, 15 nt, Human
uucuaguggucuuug

SEQ ID NO: 3694445 - RNA, 20 nt, Human
uucuaguugaggaguuuccu

SEQ ID NO: 3694446 - RNA, 15 nt, Human
uucuaguuugcucau

SEQ ID NO: 3694447 - RNA, 19 nt, Human
uucuauaaaauacugguau

SEQ ID NO: 3694448 - RNA, 15 nt, Human
uucuauaacagauau

SEQ ID NO: 3694449 - RNA, 21 nt, Human
uucuauaaggccauaaaacag

SEQ ID NO: 3694450 - RNA, 22 nt, Human
uucuauaaguuuuauguuaaau

SEQ ID NO: 3694451 - RNA, 14 nt, Human
uucuauaauuuaaa

SEQ ID NO: 3694452 - RNA, 13 nt, Human
uucuauacaaaua

SEQ ID NO: 3694453 - RNA, 23 nt, Human
uucuauagcagauuguguaacaa

SEQ ID NO: 3694454 - RNA, 16 nt, Human
uucuauaguucuagac

SEQ ID NO: 3694455 - RNA, 17 nt, Human
uucuauaguucuagaca

SEQ ID NO: 3694456 - RNA, 14 nt, Human
uucuauauguuuaa

SEQ ID NO: 3694457 - RNA, 14 nt, Human
uucuaucacauauu

SEQ ID NO: 3694458 - RNA, 17 nt, Human
uucuaucauuuuuguac

SEQ ID NO: 3694459 - RNA, 20 nt, Human
uucuaucauuuuuguacagu

SEQ ID NO: 3694460 - RNA, 19 nt, Human
uuacaacauaaucuaguuu

SEQ ID NO: 3694461 - RNA, 19 nt, Human
uuacaacccgguucacucu

SEQ ID NO: 3694462 - RNA, 23 nt, Human
uuacaacggagucaaaaauuaaa

SEQ ID NO: 3694463 - RNA, 19 nt, Human
uuacaacugaccaaguuuc

SEQ ID NO: 3694464 - RNA, 22 nt, Human
uuacaacugccucgaaacacag

SEQ ID NO: 3694465 - RNA, 16 nt, Human
uuacaagaagaacuca

SEQ ID NO: 3694466 - RNA, 21 nt, Human
uuacaagaaguuuauucucau

SEQ ID NO: 3694467 - RNA, 20 nt, Human
uuacaagggaagauuuaugu

SEQ ID NO: 3694468 - RNA, 17 nt, Human
uuacaaguauacuuaua

SEQ ID NO: 3694469 - RNA, 14 nt, Human
uuacaaguguauau

SEQ ID NO: 3694470 - RNA, 17 nt, Human
uuacaauaguucugugg

SEQ ID NO: 3694471 - RNA, 15 nt, Human
uuacaauauuugugu

SEQ ID NO: 3694472 - RNA, 22 nt, Human
uuacaaucauugcugaaaaugg

SEQ ID NO: 3694473 - RNA, 23 nt, Human
uuacaaucauugcugaaaauggu

SEQ ID NO: 3694474 - RNA, 13 nt, Human
uuacaauguauua

SEQ ID NO: 3694475 - RNA, 18 nt, Human
uuacaauucccugcuguc

SEQ ID NO: 3694476 - RNA, 18 nt, Human
uuacacaaugguuuuuaa

SEQ ID NO: 3694477 - RNA, 20 nt, Human
uuacacaaugguuuuuaaau

SEQ ID NO: 3694478 - RNA, 22 nt, Human
uuacacaaugguuuuuaaauuu

SEQ ID NO: 3694479 - RNA, 18 nt, Human
uuacacacuguacacaua

SEQ ID NO: 3694480 - RNA, 14 nt, Human
uuacacagaaacac

SEQ ID NO: 3694481 - RNA, 18 nt, Human
uuacacagaaaugcugcu

SEQ ID NO: 3694482 - RNA, 18 nt, Human
uuacacaucucagacccu

SEQ ID NO: 3694483 - RNA, 17 nt, Human
uuacacaucuucaacag

SEQ ID NO: 3694484 - RNA, 16 nt, Human
uuacacauuagauuuu

SEQ ID NO: 3694485 - RNA, 23 nt, Human
uuacacauuuuucagauauaaaa

SEQ ID NO: 3694486 - RNA, 14 nt, Human
uuacacgcuuuugu

SEQ ID NO: 3694487 - RNA, 23 nt, Human
uuacacguggaggaaugcucccc

SEQ ID NO: 3694488 - RNA, 14 nt, Human
uuacacugccaucu

SEQ ID NO: 3694489 - RNA, 21 nt, Human
uuacacuggaggagagaagaa

SEQ ID NO: 3694490 - RNA, 22 nt, Human
uuacacuggaggagagaagaau

SEQ ID NO: 3694491 - RNA, 20 nt, Human
uuacacuggcaaugguaguu

SEQ ID NO: 3694492 - RNA, 21 nt, Human
uuacacuguuauuuucagcau

SEQ ID NO: 3694493 - RNA, 14 nt, Human
uuacacuuuugaga

SEQ ID NO: 3694494 - RNA, 15 nt, Human
uuacagaaaaaucuu

SEQ ID NO: 3694495 - RNA, 19 nt, Human
uuacagaaaguggugcuca

SEQ ID NO: 3694496 - RNA, 17 nt, Human
uuacagaaauacuauaa

SEQ ID NO: 3694497 - RNA, 20 nt, Human
uuacagaacacgcuuucaca

SEQ ID NO: 3694498 - RNA, 14 nt, Human
uuacagagaggaga

SEQ ID NO: 3694499 - RNA, 20 nt, Human
uuacagagaggagaaacaca

SEQ ID NO: 3694500 - RNA, 16 nt, Human
uuacagaggaaguuau

SEQ ID NO: 3694501 - RNA, 16 nt, Human
uuacagauuuaauaca

SEQ ID NO: 3694502 - RNA, 22 nt, Human
uuacagccaagugccaaaugcu

SEQ ID NO: 3694503 - RNA, 17 nt, Human
uuacagccucacuugaa

SEQ ID NO: 3694504 - RNA, 15 nt, Human
uuacagccucugacu

SEQ ID NO: 3694505 - RNA, 15 nt, Human
uuacagcgagaggca

SEQ ID NO: 3694506 - RNA, 21 nt, Human
uuacagcgagaggcagagaaa

SEQ ID NO: 3694507 - RNA, 13 nt, Human
uuacagcugccug

SEQ ID NO: 3694508 - RNA, 14 nt, Human
uuacagcugccugc

SEQ ID NO: 3694509 - RNA, 21 nt, Human
uuacagcuggguggcacugcc

SEQ ID NO: 3694510 - RNA, 16 nt, Human
uuacaggaaguacugg

SEQ ID NO: 3694511 - RNA, 24 nt, Human
uuacaggcaccgagaauguuguau

SEQ ID NO: 3694512 - RNA, 17 nt, Human
uuacaggcccugcuccu

SEQ ID NO: 3694513 - RNA, 22 nt, Human
uuacaggcccugcuccugcagc

SEQ ID NO: 3694514 - RNA, 18 nt, Human
uuacagggagccuccugc

SEQ ID NO: 3694515 - RNA, 19 nt, Human
uuacagggagccuccugcc

SEQ ID NO: 3694516 - RNA, 18 nt, Human
uuacagggagcugggaca

SEQ ID NO: 3694517 - RNA, 22 nt, Human
uuacaggguaacugugcugaau

SEQ ID NO: 3694518 - RNA, 19 nt, Human
uuacaggugugcaccacca

SEQ ID NO: 3694519 - RNA, 13 nt, Human
uuacaguaaauaa

SEQ ID NO: 3694520 - RNA, 15 nt, Human
uuacaguaaauaaau

SEQ ID NO: 3694521 - RNA, 18 nt, Human
uuacaguaaauaaauugu

SEQ ID NO: 3694522 - RNA, 22 nt, Human
uuacaguaaugucauaaaguga

SEQ ID NO: 3694523 - RNA, 17 nt, Human
uuacaguccuucaaaau

SEQ ID NO: 3694524 - RNA, 14 nt, Human
uuacagugaagaaa

SEQ ID NO: 3694525 - RNA, 17 nt, Human
uuacaguguagcuugcc

SEQ ID NO: 3694526 - RNA, 12 nt, Human
uuacaguguuua

SEQ ID NO: 3694527 - RNA, 18 nt, Human
uuacaguuacuuuuccuu

SEQ ID NO: 3694528 - RNA, 12 nt, Human
uuacaguucugu

SEQ ID NO: 3694529 - RNA, 22 nt, Human
uuacauaauuuaguuguuucua

SEQ ID NO: 3694530 - RNA, 16 nt, Human
uuacauacuuuaucaa

SEQ ID NO: 3694531 - RNA, 13 nt, Human
uuacaucauuuuu

SEQ ID NO: 3694532 - RNA, 18 nt, Human
uuacaucuguuuuaaauu

SEQ ID NO: 3694533 - RNA, 15 nt, Human
uuacaucuuucacau

SEQ ID NO: 3694534 - RNA, 15 nt, Human
uuacaugaaguauuu

SEQ ID NO: 3694535 - RNA, 17 nt, Human
uuacaugaauugcauuu

SEQ ID NO: 3694536 - RNA, 14 nt, Human
uuacaugacacagc

SEQ ID NO: 3694537 - RNA, 23 nt, Human
uuacaugcaauuuauuaaaauga

SEQ ID NO: 3694538 - RNA, 14 nt, Human
uuacaugcauacuu

SEQ ID NO: 3694539 - RNA, 19 nt, Human
uuacaugcauacuucaaaa

SEQ ID NO: 3694540 - RNA, 22 nt, Human
uuacaugcauacuucaaaagua

SEQ ID NO: 3694541 - RNA, 13 nt, Human
uuacaugcauuug

SEQ ID NO: 3694542 - RNA, 12 nt, Human
uuacaugcuuau

SEQ ID NO: 3694543 - RNA, 13 nt, Human
uuacaugcuuauu

SEQ ID NO: 3694544 - RNA, 19 nt, Human
uuacaugcuuauuccauga

SEQ ID NO: 3694545 - RNA, 17 nt, Human
uuacauggacagaauuu

SEQ ID NO: 3694546 - RNA, 22 nt, Human
uuacaugguuaagguaaaguaa

SEQ ID NO: 3694547 - RNA, 12 nt, Human
uuacaugugaug

SEQ ID NO: 3694548 - RNA, 12 nt, Human
uuacauguuugc

SEQ ID NO: 3694549 - RNA, 19 nt, Human
uuacauuauuaucaacaau

SEQ ID NO: 3694550 - RNA, 22 nt, Human
uuacauuccuugauaauguugu

SEQ ID NO: 3694551 - RNA, 12 nt, Human
uuacauuguaaa

SEQ ID NO: 3694552 - RNA, 13 nt, Human
uuacauuguucaa

SEQ ID NO: 3694553 - RNA, 15 nt, Human
uuacauuuaaagcau

SEQ ID NO: 3694554 - RNA, 18 nt, Human
uuacauuuacaaacugaa

SEQ ID NO: 3694555 - RNA, 19 nt, Human
uuacauuuacaaacugaag

SEQ ID NO: 3694556 - RNA, 17 nt, Human
uuacauuuccaaaugaa

SEQ ID NO: 3694557 - RNA, 14 nt, Human
uuacauuuccuaaa

SEQ ID NO: 3694558 - RNA, 20 nt, Human
uuacauuugaugcaugucuu

SEQ ID NO: 3694559 - RNA, 18 nt, Human
uuacauuuguaauuuaag

SEQ ID NO: 3694560 - RNA, 15 nt, Human
uuacauuuguauaaa

SEQ ID NO: 3694561 - RNA, 16 nt, Human
uuacauuuuacuuuuu

SEQ ID NO: 3694562 - RNA, 14 nt, Human
uuacauuuuauggu

SEQ ID NO: 3694563 - RNA, 23 nt, Human
uuacauuuuauggugccuaguau

SEQ ID NO: 3694564 - RNA, 12 nt, Human
uuacauuuuuaa

SEQ ID NO: 3694565 - RNA, 22 nt, Human
uuacauuuuuaagugcugcauu

SEQ ID NO: 3694566 - RNA, 13 nt, Human
uuacauuuuuaca

SEQ ID NO: 3694567 - RNA, 14 nt, Human
uuacauuuuuacaa

SEQ ID NO: 3694568 - RNA, 19 nt, Human
uuacauuuuuauuuaugaa

SEQ ID NO: 3694569 - RNA, 12 nt, Human
uuaccaaaaauu

SEQ ID NO: 3694570 - RNA, 15 nt, Human
uuaccaaaagucaac

SEQ ID NO: 3694571 - RNA, 14 nt, Human
uuaccaaacagcaa

SEQ ID NO: 3694572 - RNA, 16 nt, Human
uuaccaaagaugaaug

SEQ ID NO: 3694573 - RNA, 14 nt, Human
uuaccaaguuauau

SEQ ID NO: 3694574 - RNA, 15 nt, Human
uuaccacacaucuau

SEQ ID NO: 3694575 - RNA, 20 nt, Human
uuaccacacaucuaugauau

SEQ ID NO: 3694576 - RNA, 22 nt, Human
uuaccacugaagauagaagaaa

SEQ ID NO: 3694577 - RNA, 17 nt, Human
uuaccagaagcuuccau

SEQ ID NO: 3694578 - RNA, 19 nt, Human
uuaccagauaaugcuacuu

SEQ ID NO: 3694579 - RNA, 19 nt, Human
uuaccagcaagaauaaaaa

SEQ ID NO: 3694580 - RNA, 19 nt, Human
uuaccagcagagcaccuua

SEQ ID NO: 3694581 - RNA, 14 nt, Human
uuaccaguugccuu

SEQ ID NO: 3694582 - RNA, 20 nt, Human
uuaccaugagaagagggccu

SEQ ID NO: 3694583 - RNA, 14 nt, Human
uuaccauguaaugg

SEQ ID NO: 3694584 - RNA, 16 nt, Human
uuaccauuggaaauuu

SEQ ID NO: 3694585 - RNA, 15 nt, Human
uuaccauuuguaaua

SEQ ID NO: 3694586 - RNA, 20 nt, Human
uuaccauuuguaauaaagua

SEQ ID NO: 3694587 - RNA, 24 nt, Human
uuacccaaaaacuaaaucucuaau

SEQ ID NO: 3694588 - RNA, 13 nt, Human
uuacccaagcaaa

SEQ ID NO: 3694589 - RNA, 15 nt, Human
uuacccaccuagaac

SEQ ID NO: 3694590 - RNA, 16 nt, Human
uuacccaccuagaaca

SEQ ID NO: 3694591 - RNA, 21 nt, Human
uuacccagagaauauauacau

SEQ ID NO: 3694592 - RNA, 16 nt, Human
uuacccagaguuuuua

SEQ ID NO: 3694593 - RNA, 20 nt, Human
uuacccauauccccucuccc

SEQ ID NO: 3694594 - RNA, 23 nt, Human
uuacccauuugggugggaguguu

SEQ ID NO: 3694595 - RNA, 21 nt, Human
uuaccccauggcugcacaguu

SEQ ID NO: 3694596 - RNA, 19 nt, Human
uuacccucauguucuuaau

SEQ ID NO: 3694597 - RNA, 13 nt, Human
uuacccucuuugc

SEQ ID NO: 3694598 - RNA, 15 nt, Human
uuacccucuuugcug

SEQ ID NO: 3694599 - RNA, 13 nt, Human
uuacccuggcccc

SEQ ID NO: 3694600 - RNA, 17 nt, Human
uuacccuggccccucuc

SEQ ID NO: 3694601 - RNA, 12 nt, Human
uuacccuuagaa

SEQ ID NO: 3694602 - RNA, 17 nt, Human
uuacccuucccugcacu

SEQ ID NO: 3694603 - RNA, 16 nt, Human
uuacccuucugugccc

SEQ ID NO: 3694604 - RNA, 19 nt, Human
uuacccuucugugcccagc

SEQ ID NO: 3694605 - RNA, 13 nt, Human
uuacccuuuagac

SEQ ID NO: 3694606 - RNA, 16 nt, Human
uuaccguuucuucccu

SEQ ID NO: 3694607 - RNA, 17 nt, Human
uuaccuaaacagauaua

SEQ ID NO: 3694608 - RNA, 14 nt, Human
uuaccuaagauuac

SEQ ID NO: 3694609 - RNA, 21 nt, Human
uuaccuagcuaauuauuuaau

SEQ ID NO: 3694610 - RNA, 23 nt, Human
uacugccaaccucgcuccaacuc

SEQ ID NO: 3694611 - RNA, 14 nt, Human
uacugccagaugcu

SEQ ID NO: 3694612 - RNA, 17 nt, Human
uacugccagaugcugau

SEQ ID NO: 3694613 - RNA, 15 nt, Human
uacugccauccuggc

SEQ ID NO: 3694614 - RNA, 22 nt, Human
uacugccauccuggcccagggc

SEQ ID NO: 3694615 - RNA, 20 nt, Human
uacugccauucacuucauaa

SEQ ID NO: 3694616 - RNA, 23 nt, Human
uacugcccaauaugcaguucugc

SEQ ID NO: 3694617 - RNA, 15 nt, Human
uacugccugaauaaa

SEQ ID NO: 3694618 - RNA, 10 nt, Human
uacugccugc

SEQ ID NO: 3694619 - RNA, 14 nt, Human
uacugccugcuugg

SEQ ID NO: 3694620 - RNA, 12 nt, Human
uacugccuugaa

SEQ ID NO: 3694621 - RNA, 15 nt, Human
uacugccuuuagaaa

SEQ ID NO: 3694622 - RNA, 18 nt, Human
uacugccuuuagaaaaua

SEQ ID NO: 3694623 - RNA, 16 nt, Human
uacugcgacuuucugc

SEQ ID NO: 3694624 - RNA, 20 nt, Human
uacugcgacuuucugccugg

SEQ ID NO: 3694625 - RNA, 22 nt, Human
uacugcgacuuucugccuggag

SEQ ID NO: 3694626 - RNA, 19 nt, Human
uacugcuaaguauuuccca

SEQ ID NO: 3694627 - RNA, 22 nt, Human
uacugcuaaguauuucccagca

SEQ ID NO: 3694628 - RNA, 15 nt, Human
uacugcuacuguaau

SEQ ID NO: 3694629 - RNA, 20 nt, Human
uacugcuacuguaauuuuau

SEQ ID NO: 3694630 - RNA, 12 nt, Human
uacugcucugag

SEQ ID NO: 3694631 - RNA, 14 nt, Human
uacugcucugagaa

SEQ ID NO: 3694632 - RNA, 19 nt, Human
uacugcuuggagcugagca

SEQ ID NO: 3694633 - RNA, 24 nt, Human
uacugcuuggagcugagcaaauca

SEQ ID NO: 3694634 - RNA, 14 nt, Human
uacuggaaagcuuu

SEQ ID NO: 3694635 - RNA, 18 nt, Human
uacuggaaauuaggggau

SEQ ID NO: 3694636 - RNA, 21 nt, Human
uacuggaacccuuuuaaaguu

SEQ ID NO: 3694637 - RNA, 23 nt, Human
uacuggaaguuuugcauuuaugg

SEQ ID NO: 3694638 - RNA, 16 nt, Human
uacuggagaaaaugga

SEQ ID NO: 3694639 - RNA, 19 nt, Human
uacuggagcuucauuuugg

SEQ ID NO: 3694640 - RNA, 17 nt, Human
uacuggauaaauuguuu

SEQ ID NO: 3694641 - RNA, 13 nt, Human
uacuggauucuua

SEQ ID NO: 3694642 - RNA, 17 nt, Human
uacuggcauaguuucau

SEQ ID NO: 3694643 - RNA, 15 nt, Human
uacuggcguggauua

SEQ ID NO: 3694644 - RNA, 13 nt, Human
uacugggaaggcu

SEQ ID NO: 3694645 - RNA, 23 nt, Human
uacugggccuuagugggccaggg

SEQ ID NO: 3694646 - RNA, 17 nt, Human
uacugguaagauuguua

SEQ ID NO: 3694647 - RNA, 13 nt, Human
uacugguccaaaa

SEQ ID NO: 3694648 - RNA, 13 nt, Human
uacuggucucucu

SEQ ID NO: 3694649 - RNA, 18 nt, Human
uacugguugcauggaaau

SEQ ID NO: 3694650 - RNA, 15 nt, Human
uacugguuggcuccc

SEQ ID NO: 3694651 - RNA, 12 nt, Human
uacuguaaagaa

SEQ ID NO: 3694652 - RNA, 13 nt, Human
uacuguaaagaaa

SEQ ID NO: 3694653 - RNA, 16 nt, Human
uacuguaaagaaagag

SEQ ID NO: 3694654 - RNA, 19 nt, Human
uacuguaaagaaagagaga

SEQ ID NO: 3694655 - RNA, 18 nt, Human
uacuguaacacuuuacaa

SEQ ID NO: 3694656 - RNA, 13 nt, Human
uacuguaagaaaa

SEQ ID NO: 3694657 - RNA, 14 nt, Human
uacuguaagaaaau

SEQ ID NO: 3694658 - RNA, 18 nt, Human
uacuguaagaauaauuua

SEQ ID NO: 3694659 - RNA, 15 nt, Human
uacuguaagacauua

SEQ ID NO: 3694660 - RNA, 19 nt, Human
uacuguaauaauaccucaa

SEQ ID NO: 3694661 - RNA, 16 nt, Human
uacuguaauuccucaa

SEQ ID NO: 3694662 - RNA, 15 nt, Human
uacuguaauuuguga

SEQ ID NO: 3694663 - RNA, 19 nt, Human
uacuguaauuugugauaca

SEQ ID NO: 3694664 - RNA, 20 nt, Human
uacuguaauuuuauaugaag

SEQ ID NO: 3694665 - RNA, 14 nt, Human
uacuguacagcugg

SEQ ID NO: 3694666 - RNA, 15 nt, Human
uacuguacaugggac

SEQ ID NO: 3694667 - RNA, 21 nt, Human
uacuguacuaauucuuacacu

SEQ ID NO: 3694668 - RNA, 13 nt, Human
uacuguaguuuuu

SEQ ID NO: 3694669 - RNA, 15 nt, Human
uacuguauauucagg

SEQ ID NO: 3694670 - RNA, 13 nt, Human
uacuguaugauca

SEQ ID NO: 3694671 - RNA, 16 nt, Human
uacuguaugaucaaau

SEQ ID NO: 3694672 - RNA, 17 nt, Human
uacuguaugaucaaaug

SEQ ID NO: 3694673 - RNA, 19 nt, Human
uacuguaugaucaaauguu

SEQ ID NO: 3694674 - RNA, 21 nt, Human
uacuguaugaucaaauguuua

SEQ ID NO: 3694675 - RNA, 22 nt, Human
uacuguaugaucaaauguuuaa

SEQ ID NO: 3694676 - RNA, 16 nt, Human
uacuguaugugaugaa

SEQ ID NO: 3694677 - RNA, 17 nt, Human
uacugucaaaugaugug

SEQ ID NO: 3694678 - RNA, 20 nt, Human
uacugucaaaugaugugcaa

SEQ ID NO: 3694679 - RNA, 14 nt, Human
uacugucaauaaac

SEQ ID NO: 3694680 - RNA, 23 nt, Human
uacugucagcuccccucggagaa

SEQ ID NO: 3694681 - RNA, 23 nt, Human
uacugucauccucaaagaaagug

SEQ ID NO: 3694682 - RNA, 17 nt, Human
uacugucuauuaauauu

SEQ ID NO: 3694683 - RNA, 16 nt, Human
uacugucugguuuuaa

SEQ ID NO: 3694684 - RNA, 19 nt, Human
uacugucugguuuuaacaa

SEQ ID NO: 3694685 - RNA, 19 nt, Human
uacugucuuaauuaaguaa

SEQ ID NO: 3694686 - RNA, 20 nt, Human
uacugucuuaauuaaguaaa

SEQ ID NO: 3694687 - RNA, 21 nt, Human
uacugucuucaguaagccgug

SEQ ID NO: 3694688 - RNA, 15 nt, Human
uacugugcuggagcc

SEQ ID NO: 3694689 - RNA, 16 nt, Human
uacugugcuggagcca

SEQ ID NO: 3694690 - RNA, 19 nt, Human
uacuguggaaaaauauuua

SEQ ID NO: 3694691 - RNA, 14 nt, Human
uacuguggaggaag

SEQ ID NO: 3694692 - RNA, 12 nt, Human
uacugugggcaa

SEQ ID NO: 3694693 - RNA, 19 nt, Human
uacugugggcaauuuagaa

SEQ ID NO: 3694694 - RNA, 16 nt, Human
uacugugguguuuugu

SEQ ID NO: 3694695 - RNA, 18 nt, Human
uacuguguacuguauaga

SEQ ID NO: 3694696 - RNA, 13 nt, Human
uacuguguggaac

SEQ ID NO: 3694697 - RNA, 17 nt, Human
uacugugugugagugug

SEQ ID NO: 3694698 - RNA, 23 nt, Human
uacugugugugagugugaauaua

SEQ ID NO: 3694699 - RNA, 18 nt, Human
uacugugugugugaauga

SEQ ID NO: 3694700 - RNA, 19 nt, Human
uacugugugugugaaugaa

SEQ ID NO: 3694701 - RNA, 15 nt, Human
uacuguguuaugcaa

SEQ ID NO: 3694702 - RNA, 16 nt, Human
uacuguguuaugcaaa

SEQ ID NO: 3694703 - RNA, 13 nt, Human
uacuguguuccug

SEQ ID NO: 3694704 - RNA, 14 nt, Human
uacuguguuccugg

SEQ ID NO: 3694705 - RNA, 13 nt, Human
uacuguguuucag

SEQ ID NO: 3694706 - RNA, 19 nt, Human
uacuguuaaccauuuaagu

SEQ ID NO: 3694707 - RNA, 14 nt, Human
uacuguuacuugau

SEQ ID NO: 3694708 - RNA, 17 nt, Human
uacuguuacuugauaac

SEQ ID NO: 3694709 - RNA, 23 nt, Human
uacuguucaaugguucugaaaua

SEQ ID NO: 3694710 - RNA, 23 nt, Human
uacuguucggaagggguuccuca

SEQ ID NO: 3694711 - RNA, 15 nt, Human
uacuguucuaaagcu

SEQ ID NO: 3694712 - RNA, 12 nt, Human
uacuguucucuu

SEQ ID NO: 3694713 - RNA, 14 nt, Human
uacuguucuguguc

SEQ ID NO: 3694714 - RNA, 16 nt, Human
uacuguucuugcugcu

SEQ ID NO: 3694715 - RNA, 18 nt, Human
uacuguucuugcugcuag

SEQ ID NO: 3694716 - RNA, 19 nt, Human
uacuguucuugcugcuaga

SEQ ID NO: 3694717 - RNA, 22 nt, Human
uacuguucuugcugcuagaacu

SEQ ID NO: 3694718 - RNA, 21 nt, Human
uacuguuuaagacacuuccgu

SEQ ID NO: 3694719 - RNA, 21 nt, Human
uacuguuuaccauuuuucauu

SEQ ID NO: 3694720 - RNA, 19 nt, Human
uacuguuuauuaaaguaca

SEQ ID NO: 3694721 - RNA, 18 nt, Human
uacuuaaaaauuuauuag

SEQ ID NO: 3694722 - RNA, 14 nt, Human
uacuuaagacuuaa

SEQ ID NO: 3694723 - RNA, 15 nt, Human
uacuuaagagaaaug

SEQ ID NO: 3694724 - RNA, 13 nt, Human
uacuuaauaaauu

SEQ ID NO: 3694725 - RNA, 14 nt, Human
uacuuaauaaauuc

SEQ ID NO: 3694726 - RNA, 18 nt, Human
uacuuaauuccuuucuca

SEQ ID NO: 3694727 - RNA, 13 nt, Human
uacuuaauuucuu

SEQ ID NO: 3694728 - RNA, 19 nt, Human
uacuuacaugcauuacugc

SEQ ID NO: 3694729 - RNA, 15 nt, Human
uacuuacauucucua

SEQ ID NO: 3694730 - RNA, 17 nt, Human
uacuuaccauaugugcu

SEQ ID NO: 3694731 - RNA, 16 nt, Human
uacuuaccuaaacaga

SEQ ID NO: 3694732 - RNA, 19 nt, Human
uacuuaccuagugaaacuu

SEQ ID NO: 3694733 - RNA, 16 nt, Human
uacuuagaguuucugu

SEQ ID NO: 3694734 - RNA, 17 nt, Human
uacuuagcacuuggccu

SEQ ID NO: 3694735 - RNA, 19 nt, Human
uacuuagcauccuaagaaa

SEQ ID NO: 3694736 - RNA, 21 nt, Human
uacuuagcauccuaagaaaua

SEQ ID NO: 3694737 - RNA, 15 nt, Human
uacuuagcuuaucaa

SEQ ID NO: 3694738 - RNA, 16 nt, Human
uacuuauauuuucgua

SEQ ID NO: 3694739 - RNA, 20 nt, Human
uacuuaucauccacauuguu

SEQ ID NO: 3694740 - RNA, 18 nt, Human
uacuuaucccugcccauu

SEQ ID NO: 3694741 - RNA, 15 nt, Human
uacuuauucauugug

SEQ ID NO: 3694742 - RNA, 18 nt, Human
uacuuauuuguauauggu

SEQ ID NO: 3694743 - RNA, 17 nt, Human
uacuuauuuuugacagu

SEQ ID NO: 3694744 - RNA, 19 nt, Human
uacuuauuuuugacagugu

SEQ ID NO: 3694745 - RNA, 12 nt, Human
uacuucaaaagu

SEQ ID NO: 3694746 - RNA, 14 nt, Human
uacuucaaaaguau

SEQ ID NO: 3694747 - RNA, 18 nt, Human
uacuucaaguuaaaguga

SEQ ID NO: 3694748 - RNA, 21 nt, Human
uacuucaaguuaaagugaaua

SEQ ID NO: 3694749 - RNA, 23 nt, Human
uacuucaaguuaaagugaauaac

SEQ ID NO: 3694750 - RNA, 19 nt, Human
uacuucacugucaggaaga

SEQ ID NO: 3694751 - RNA, 15 nt, Human
uacuucagcaagaga

SEQ ID NO: 3694752 - RNA, 22 nt, Human
uacuucagcaagagagaaccua

SEQ ID NO: 3694753 - RNA, 19 nt, Human
uacuucaggggcacuucau

SEQ ID NO: 3694754 - RNA, 22 nt, Human
uacuucaggggcacuucauuga

SEQ ID NO: 3694755 - RNA, 14 nt, Human
uacuuccaaacuaa

SEQ ID NO: 3694756 - RNA, 23 nt, Human
uacuucccauuuuggaaguuuuc

SEQ ID NO: 3694757 - RNA, 22 nt, Human
uacuuccugaguggccagggaa

SEQ ID NO: 3694758 - RNA, 22 nt, Human
uacuuccugccuggucuccugc

SEQ ID NO: 3694759 - RNA, 18 nt, Human
uacuucgacacuguucuu

SEQ ID NO: 3694760 - RNA, 20 nt, Human
uucuauccaaacauguauuu

SEQ ID NO: 3694761 - RNA, 14 nt, Human
uucuaucccaaacu

SEQ ID NO: 3694762 - RNA, 15 nt, Human
uucuaucuacugauu

SEQ ID NO: 3694763 - RNA, 20 nt, Human
uucuaucuuuuguuuccuuu

SEQ ID NO: 3694764 - RNA, 14 nt, Human
uucuaugaaauauu

SEQ ID NO: 3694765 - RNA, 17 nt, Human
uucuaugacacaugcaa

SEQ ID NO: 3694766 - RNA, 15 nt, Human
uucuaugcugcuuuu

SEQ ID NO: 3694767 - RNA, 19 nt, Human
uucuaugguuaugaaagaa

SEQ ID NO: 3694768 - RNA, 13 nt, Human
uucuauguacuag

SEQ ID NO: 3694769 - RNA, 15 nt, Human
uucuauguacuagua

SEQ ID NO: 3694770 - RNA, 18 nt, Human
uucuauguacuaguacug

SEQ ID NO: 3694771 - RNA, 15 nt, Human
uucuauuaaaagacu

SEQ ID NO: 3694772 - RNA, 18 nt, Human
uucuauuaaaagacucau

SEQ ID NO: 3694773 - RNA, 18 nt, Human
uucuauuaaaagugggaa

SEQ ID NO: 3694774 - RNA, 23 nt, Human
uucuauuaaaagugggaauuagg

SEQ ID NO: 3694775 - RNA, 15 nt, Human
uucuauuaaauaguu

SEQ ID NO: 3694776 - RNA, 20 nt, Human
uucuauuagccagucuuuac

SEQ ID NO: 3694777 - RNA, 18 nt, Human
uucuauuauggaaaacug

SEQ ID NO: 3694778 - RNA, 22 nt, Human
uucuauucaagguggccaaauu

SEQ ID NO: 3694779 - RNA, 13 nt, Human
uucuauugaaaaa

SEQ ID NO: 3694780 - RNA, 14 nt, Human
uucuauugaaaaau

SEQ ID NO: 3694781 - RNA, 23 nt, Human
uucuauugacuucaaugauagua

SEQ ID NO: 3694782 - RNA, 18 nt, Human
uucuauugcaguuauaga

SEQ ID NO: 3694783 - RNA, 15 nt, Human
uucuauugccucuga

SEQ ID NO: 3694784 - RNA, 18 nt, Human
uucuauugccuucuuuga

SEQ ID NO: 3694785 - RNA, 19 nt, Human
uucuauugccuucuuugaa

SEQ ID NO: 3694786 - RNA, 15 nt, Human
uucuauuguacagaa

SEQ ID NO: 3694787 - RNA, 15 nt, Human
uucuauuguuguaca

SEQ ID NO: 3694788 - RNA, 16 nt, Human
uucuauuuaaguguac

SEQ ID NO: 3694789 - RNA, 13 nt, Human
uucuauuuauaau

SEQ ID NO: 3694790 - RNA, 17 nt, Human
uucuauuucacuggagc

SEQ ID NO: 3694791 - RNA, 19 nt, Human
uucuauuucagugccaaua

SEQ ID NO: 3694792 - RNA, 19 nt, Human
uucuauuucuccuccaugg

SEQ ID NO: 3694793 - RNA, 12 nt, Human
uucuauuuggaa

SEQ ID NO: 3694794 - RNA, 18 nt, Human
uucuauuuggggcuugau

SEQ ID NO: 3694795 - RNA, 15 nt, Human
uucuauuuuauuaug

SEQ ID NO: 3694796 - RNA, 16 nt, Human
uucuauuuucucugau

SEQ ID NO: 3694797 - RNA, 15 nt, Human
uucucaaaagcauuu

SEQ ID NO: 3694798 - RNA, 20 nt, Human
uucucaaaagcauuuaucau

SEQ ID NO: 3694799 - RNA, 21 nt, Human
uucucaaaagcauuuaucauu

SEQ ID NO: 3694800 - RNA, 19 nt, Human
uucucaaagaaauuuccac

SEQ ID NO: 3694801 - RNA, 15 nt, Human
uucucaaaguuuuga

SEQ ID NO: 3694802 - RNA, 17 nt, Human
uucucaaaguuuugaaa

SEQ ID NO: 3694803 - RNA, 12 nt, Human
uucucaaauaaa

SEQ ID NO: 3694804 - RNA, 15 nt, Human
uucucaagcccugca

SEQ ID NO: 3694805 - RNA, 11 nt, Human
uucucaagugc

SEQ ID NO: 3694806 - RNA, 17 nt, Human
uucucaagugccuuaau

SEQ ID NO: 3694807 - RNA, 13 nt, Human
uucucaaguucua

SEQ ID NO: 3694808 - RNA, 14 nt, Human
uucucaaguucuaa

SEQ ID NO: 3694809 - RNA, 16 nt, Human
uucucaaguucuaaga

SEQ ID NO: 3694810 - RNA, 18 nt, Human
uucucaaugaaaaauagu

SEQ ID NO: 3694811 - RNA, 20 nt, Human
uucucaauuccaacaguuua

SEQ ID NO: 3694812 - RNA, 18 nt, Human
uucucacacccaccgucc

SEQ ID NO: 3694813 - RNA, 22 nt, Human
uucucacacccaccguccgccc

SEQ ID NO: 3694814 - RNA, 21 nt, Human
uucucacagugggagccaggg

SEQ ID NO: 3694815 - RNA, 12 nt, Human
uucucaccagcu

SEQ ID NO: 3694816 - RNA, 15 nt, Human
uucucaccagcugca

SEQ ID NO: 3694817 - RNA, 16 nt, Human
uucucaccagcugcaa

SEQ ID NO: 3694818 - RNA, 18 nt, Human
uucucaccagcugcaaag

SEQ ID NO: 3694819 - RNA, 21 nt, Human
uucucaccagcugcaaagugu

SEQ ID NO: 3694820 - RNA, 14 nt, Human
uucucaccagcugu

SEQ ID NO: 3694821 - RNA, 15 nt, Human
uucucacuaaaucuu

SEQ ID NO: 3694822 - RNA, 15 nt, Human
uucucacuaauuugu

SEQ ID NO: 3694823 - RNA, 14 nt, Human
uucucacuccacca

SEQ ID NO: 3694824 - RNA, 15 nt, Human
uucucacuccaccac

SEQ ID NO: 3694825 - RNA, 19 nt, Human
uucucacuccuuuuggugu

SEQ ID NO: 3694826 - RNA, 21 nt, Human
uucucacugccaugccagcuu

SEQ ID NO: 3694827 - RNA, 18 nt, Human
uucucacuguucccucug

SEQ ID NO: 3694828 - RNA, 21 nt, Human
uucucagaaggcaaaugacuu

SEQ ID NO: 3694829 - RNA, 22 nt, Human
uucucagaaucucaaauaacua

SEQ ID NO: 3694830 - RNA, 23 nt, Human
uucucagacuuuggaaaaugcau

SEQ ID NO: 3694831 - RNA, 15 nt, Human
uucucagauccuugu

SEQ ID NO: 3694832 - RNA, 21 nt, Human
uucucagauggauugauaauu

SEQ ID NO: 3694833 - RNA, 18 nt, Human
uucucagcucccauuucu

SEQ ID NO: 3694834 - RNA, 19 nt, Human
uucucagcucccauuucua

SEQ ID NO: 3694835 - RNA, 20 nt, Human
uucucagcucccccuguccc

SEQ ID NO: 3694836 - RNA, 13 nt, Human
uucucagggcucc

SEQ ID NO: 3694837 - RNA, 17 nt, Human
uucucagggcuccugcc

SEQ ID NO: 3694838 - RNA, 17 nt, Human
uucucagggucucugcu

SEQ ID NO: 3694839 - RNA, 19 nt, Human
uucucagggucucugcugc

SEQ ID NO: 3694840 - RNA, 20 nt, Human
uucucagggucucugcugcc

SEQ ID NO: 3694841 - RNA, 17 nt, Human
uucucagguguugccaa

SEQ ID NO: 3694842 - RNA, 23 nt, Human
uucucagugccaacuguggcugg

SEQ ID NO: 3694843 - RNA, 18 nt, Human
uucucaguuuuucuuaau

SEQ ID NO: 3694844 - RNA, 19 nt, Human
uucucaguuuuucuuaaua

SEQ ID NO: 3694845 - RNA, 12 nt, Human
uucucauaacuu

SEQ ID NO: 3694846 - RNA, 14 nt, Human
uucucauagcauua

SEQ ID NO: 3694847 - RNA, 16 nt, Human
uucucauagccccggu

SEQ ID NO: 3694848 - RNA, 20 nt, Human
uucucauaggaaaaguacau

SEQ ID NO: 3694849 - RNA, 15 nt, Human
uucucaucacacaca

SEQ ID NO: 3694850 - RNA, 16 nt, Human
uucucaucacuccccu

SEQ ID NO: 3694851 - RNA, 20 nt, Human
uucucaucugcacccuucuu

SEQ ID NO: 3694852 - RNA, 18 nt, Human
uucucaucuugugaaaug

SEQ ID NO: 3694853 - RNA, 11 nt, Human
uucucaugccu

SEQ ID NO: 3694854 - RNA, 12 nt, Human
uucucaugccuc

SEQ ID NO: 3694855 - RNA, 13 nt, Human
uucucauguguuu

SEQ ID NO: 3694856 - RNA, 18 nt, Human
uucucauuccaacaguga

SEQ ID NO: 3694857 - RNA, 20 nt, Human
uucucauuccaacagugagu

SEQ ID NO: 3694858 - RNA, 20 nt, Human
uucucauugacuuuuauaaa

SEQ ID NO: 3694859 - RNA, 13 nt, Human
uucucauugcucu

SEQ ID NO: 3694860 - RNA, 18 nt, Human
uucucauuggaaauuuag

SEQ ID NO: 3694861 - RNA, 15 nt, Human
uucucauuucacccc

SEQ ID NO: 3694862 - RNA, 20 nt, Human
uucucauuugccaauaauaa

SEQ ID NO: 3694863 - RNA, 16 nt, Human
uucucauuuucuuuuc

SEQ ID NO: 3694864 - RNA, 19 nt, Human
uucuccaaaaaucugccug

SEQ ID NO: 3694865 - RNA, 22 nt, Human
uucuccacagcaaccccaggcu

SEQ ID NO: 3694866 - RNA, 15 nt, Human
uucuccaccugccag

SEQ ID NO: 3694867 - RNA, 20 nt, Human
uucuccaccugccagggaca

SEQ ID NO: 3694868 - RNA, 12 nt, Human
uucuccagaacc

SEQ ID NO: 3694869 - RNA, 23 nt, Human
uucuccagauuuuucggaggccc

SEQ ID NO: 3694870 - RNA, 13 nt, Human
uucuccagccagc

SEQ ID NO: 3694871 - RNA, 19 nt, Human
uucuccagcucagaaccca

SEQ ID NO: 3694872 - RNA, 20 nt, Human
uucuccagcucagaacccag

SEQ ID NO: 3694873 - RNA, 12 nt, Human
uucuccagcugg

SEQ ID NO: 3694874 - RNA, 20 nt, Human
uucuccagcugggcucugca

SEQ ID NO: 3694875 - RNA, 18 nt, Human
uucuccaggcucuuuggg

SEQ ID NO: 3694876 - RNA, 14 nt, Human
uucuccagggucag

SEQ ID NO: 3694877 - RNA, 20 nt, Human
uucuccauccacaugggagc

SEQ ID NO: 3694878 - RNA, 15 nt, Human
uucuccaucucucug

SEQ ID NO: 3694879 - RNA, 22 nt, Human
uucuccauggccaccuuuucag

SEQ ID NO: 3694880 - RNA, 12 nt, Human
uucucccacucu

SEQ ID NO: 3694881 - RNA, 18 nt, Human
uucucccacucuccuagg

SEQ ID NO: 3694882 - RNA, 20 nt, Human
uucucccagguaccagcugc

SEQ ID NO: 3694883 - RNA, 12 nt, Human
uucuccccagaa

SEQ ID NO: 3694884 - RNA, 15 nt, Human
uucuccccagcuccc

SEQ ID NO: 3694885 - RNA, 21 nt, Human
uucucccccccggggcugggu

SEQ ID NO: 3694886 - RNA, 23 nt, Human
uucucccccccggggcuggguug

SEQ ID NO: 3694887 - RNA, 14 nt, Human
uucucccccugggc

SEQ ID NO: 3694888 - RNA, 19 nt, Human
uucuccccgcuaaggaaga

SEQ ID NO: 3694889 - RNA, 19 nt, Human
uucuccccugcacuguaaa

SEQ ID NO: 3694890 - RNA, 20 nt, Human
uucuccccugcacuguaaaa

SEQ ID NO: 3694891 - RNA, 19 nt, Human
uucuccccugcccccagga

SEQ ID NO: 3694892 - RNA, 22 nt, Human
uucuccccugcccccaggacug

SEQ ID NO: 3694893 - RNA, 12 nt, Human
uucucccuggau

SEQ ID NO: 3694894 - RNA, 13 nt, Human
uucucccuucggu

SEQ ID NO: 3694895 - RNA, 14 nt, Human
uucuccgccagccu

SEQ ID NO: 3694896 - RNA, 17 nt, Human
uucuccgccagccuccu

SEQ ID NO: 3694897 - RNA, 18 nt, Human
uucuccgccagccuccuc

SEQ ID NO: 3694898 - RNA, 21 nt, Human
uucuccgccagccuccucugg

SEQ ID NO: 3694899 - RNA, 18 nt, Human
uucuccguuagcuccugu

SEQ ID NO: 3694900 - RNA, 15 nt, Human
uucuccuauguguaa

SEQ ID NO: 3694901 - RNA, 11 nt, Human
uucuccucccc

SEQ ID NO: 3694902 - RNA, 19 nt, Human
uucuccucuuguaaauaaa

SEQ ID NO: 3694903 - RNA, 18 nt, Human
uucuccugacccaguccc

SEQ ID NO: 3694904 - RNA, 20 nt, Human
uucuccugcguguucucaga

SEQ ID NO: 3694905 - RNA, 19 nt, Human
uucuccugcugcucccuca

SEQ ID NO: 3694906 - RNA, 23 nt, Human
uucuccugcugcucccucagacu

SEQ ID NO: 3694907 - RNA, 15 nt, Human
uucuccuucagcccu

SEQ ID NO: 3694908 - RNA, 20 nt, Human
uucuccuucagcccucaccc

SEQ ID NO: 3694909 - RNA, 21 nt, Human
uucuccuuguguuacuaaguu

SEQ ID NO: 3694910 - RNA, 13 nt, Human
uuaccuagugaaa

SEQ ID NO: 3694911 - RNA, 21 nt, Human
uuaccuagugaaacuuuucua

SEQ ID NO: 3694912 - RNA, 22 nt, Human
uuaccuagugaaacuuuucuag

SEQ ID NO: 3694913 - RNA, 17 nt, Human
uuaccucaacaagaaga

SEQ ID NO: 3694914 - RNA, 20 nt, Human
uuaccucagccugggcgcug

SEQ ID NO: 3694915 - RNA, 19 nt, Human
uuaccuccaacagaacuaa

SEQ ID NO: 3694916 - RNA, 21 nt, Human
uuaccucccuacuuucuuaga

SEQ ID NO: 3694917 - RNA, 12 nt, Human
uuaccuccugcc

SEQ ID NO: 3694918 - RNA, 14 nt, Human
uuaccuccugccca

SEQ ID NO: 3694919 - RNA, 17 nt, Human
uuaccucucugucaugu

SEQ ID NO: 3694920 - RNA, 22 nt, Human
uuaccugaaaacacugugcaca

SEQ ID NO: 3694921 - RNA, 21 nt, Human
uuaccugaagggguuuucuug

SEQ ID NO: 3694922 - RNA, 13 nt, Human
uuaccugacacaa

SEQ ID NO: 3694923 - RNA, 18 nt, Human
uuaccugaccucuugcug

SEQ ID NO: 3694924 - RNA, 20 nt, Human
uuaccugaccucuugcuguc

SEQ ID NO: 3694925 - RNA, 21 nt, Human
uuaccugaccucuugcugucu

SEQ ID NO: 3694926 - RNA, 18 nt, Human
uuaccugaucaaugacag

SEQ ID NO: 3694927 - RNA, 22 nt, Human
uuaccuguacacugacuugaga

SEQ ID NO: 3694928 - RNA, 19 nt, Human
uuaccugucacauugcauu

SEQ ID NO: 3694929 - RNA, 19 nt, Human
uuaccugugaaguguuacu

SEQ ID NO: 3694930 - RNA, 22 nt, Human
uuaccuguuuucgcaccuacca

SEQ ID NO: 3694931 - RNA, 21 nt, Human
uuaccuuagauuagcucugga

SEQ ID NO: 3694932 - RNA, 14 nt, Human
uuaccuucaauaaa

SEQ ID NO: 3694933 - RNA, 17 nt, Human
uuaccuucaauaaagua

SEQ ID NO: 3694934 - RNA, 18 nt, Human
uuaccuucaauaaaguau

SEQ ID NO: 3694935 - RNA, 19 nt, Human
uuaccuucaauaaaguauc

SEQ ID NO: 3694936 - RNA, 20 nt, Human
uuaccuugucauuuuggucu

SEQ ID NO: 3694937 - RNA, 15 nt, Human
uuaccuuguuauuua

SEQ ID NO: 3694938 - RNA, 13 nt, Human
uuaccuuucauac

SEQ ID NO: 3694939 - RNA, 18 nt, Human
uuaccuuuucagggcugg

SEQ ID NO: 3694940 - RNA, 15 nt, Human
uuaccuuuuuauuug

SEQ ID NO: 3694941 - RNA, 19 nt, Human
uuaccuuuuuuuuuucuug

SEQ ID NO: 3694942 - RNA, 16 nt, Human
uuacgauaaggaagaa

SEQ ID NO: 3694943 - RNA, 22 nt, Human
uuacgaucaggcacaggucagg

SEQ ID NO: 3694944 - RNA, 20 nt, Human
uuacgcacacguacuuaaau

SEQ ID NO: 3694945 - RNA, 16 nt, Human
uuacggaacucaaaua

SEQ ID NO: 3694946 - RNA, 20 nt, Human
uuacgguuuuccagguuuaa

SEQ ID NO: 3694947 - RNA, 17 nt, Human
uuacuaaaaaaaagaug

SEQ ID NO: 3694948 - RNA, 18 nt, Human
uuacuaaaaaaaagauga

SEQ ID NO: 3694949 - RNA, 20 nt, Human
uuacuaaaaguuuugagaaa

SEQ ID NO: 3694950 - RNA, 14 nt, Human
uuacuaaaauauau

SEQ ID NO: 3694951 - RNA, 15 nt, Human
uuacuaaaauggacu

SEQ ID NO: 3694952 - RNA, 18 nt, Human
uuacuaaacauaugauuu

SEQ ID NO: 3694953 - RNA, 22 nt, Human
uuacuaaacauaugauuucacu

SEQ ID NO: 3694954 - RNA, 22 nt, Human
uuacuaaagaaagauuacuuag

SEQ ID NO: 3694955 - RNA, 13 nt, Human
uuacuaagaagaa

SEQ ID NO: 3694956 - RNA, 22 nt, Human
uuacuaagaugacauugcuaag

SEQ ID NO: 3694957 - RNA, 23 nt, Human
uuacuaagaugacauugcuaaga

SEQ ID NO: 3694958 - RNA, 21 nt, Human
uuacuaagcauagcaaacaga

SEQ ID NO: 3694959 - RNA, 17 nt, Human
uuacuaagccacaagaa

SEQ ID NO: 3694960 - RNA, 20 nt, Human
uuacuaagccacaagaaauu

SEQ ID NO: 3694961 - RNA, 17 nt, Human
uuacuaauuauacuacu

SEQ ID NO: 3694962 - RNA, 13 nt, Human
uuacuacaguugu

SEQ ID NO: 3694963 - RNA, 15 nt, Human
uuacuacaguuguuu

SEQ ID NO: 3694964 - RNA, 22 nt, Human
uuacuacaguuuuuaacucuac

SEQ ID NO: 3694965 - RNA, 18 nt, Human
uuacuacaugugggagcu

SEQ ID NO: 3694966 - RNA, 16 nt, Human
uuacuagggaucccuc

SEQ ID NO: 3694967 - RNA, 14 nt, Human
uuacuagguaacuu

SEQ ID NO: 3694968 - RNA, 21 nt, Human
uuacuaggugcccagaaugag

SEQ ID NO: 3694969 - RNA, 23 nt, Human
uuacuauaagaacuuugagcuac

SEQ ID NO: 3694970 - RNA, 22 nt, Human
uuacuauccuggcuuugcccaa

SEQ ID NO: 3694971 - RNA, 13 nt, Human
uuacuaugccugu

SEQ ID NO: 3694972 - RNA, 14 nt, Human
uuacuaugccugug

SEQ ID NO: 3694973 - RNA, 23 nt, Human
uuacuauuaagcaguaaaaacug

SEQ ID NO: 3694974 - RNA, 21 nt, Human
uuacuauucauuaaauguuug

SEQ ID NO: 3694975 - RNA, 15 nt, Human
uuacuauuucuugug

SEQ ID NO: 3694976 - RNA, 19 nt, Human
uuacuauuuuacuucuaga

SEQ ID NO: 3694977 - RNA, 17 nt, Human
uuacuauuuucuacaau

SEQ ID NO: 3694978 - RNA, 21 nt, Human
uuacucaaaguuaaccuaccu

SEQ ID NO: 3694979 - RNA, 15 nt, Human
uuacucaacccucuc

SEQ ID NO: 3694980 - RNA, 13 nt, Human
uuacucagcccug

SEQ ID NO: 3694981 - RNA, 14 nt, Human
uuacucaggaagaa

SEQ ID NO: 3694982 - RNA, 17 nt, Human
uuacucaggaagaacac

SEQ ID NO: 3694983 - RNA, 16 nt, Human
uuacucaguaauuugu

SEQ ID NO: 3694984 - RNA, 16 nt, Human
uuacuccauaaacaga

SEQ ID NO: 3694985 - RNA, 12 nt, Human
uuacuccuccuc

SEQ ID NO: 3694986 - RNA, 17 nt, Human
uuacuccuccucuuucu

SEQ ID NO: 3694987 - RNA, 18 nt, Human
uuacuccuccucuuucuc

SEQ ID NO: 3694988 - RNA, 19 nt, Human
uuacuccugugggagccuc

SEQ ID NO: 3694989 - RNA, 14 nt, Human
uuacucugccuaca

SEQ ID NO: 3694990 - RNA, 23 nt, Human
uuacucuucaguuaagccuuugg

SEQ ID NO: 3694991 - RNA, 14 nt, Human
uuacucuuguaaga

SEQ ID NO: 3694992 - RNA, 17 nt, Human
uuacucuuguaagauuu

SEQ ID NO: 3694993 - RNA, 13 nt, Human
uuacucuuuccua

SEQ ID NO: 3694994 - RNA, 15 nt, Human
uuacugaacaguaac

SEQ ID NO: 3694995 - RNA, 16 nt, Human
uuacugaagccuuucu

SEQ ID NO: 3694996 - RNA, 19 nt, Human
uuacugaagguaaaauuga

SEQ ID NO: 3694997 - RNA, 20 nt, Human
uuacugaagguaaaauugaa

SEQ ID NO: 3694998 - RNA, 23 nt, Human
uuacugaaugcaccauggucaaa

SEQ ID NO: 3694999 - RNA, 19 nt, Human
uuacugacccuggggcugg

SEQ ID NO: 3695000 - RNA, 16 nt, Human
uuacugagcuucucug

SEQ ID NO: 3695001 - RNA, 17 nt, Human
uuacugagcuucucugu

SEQ ID NO: 3695002 - RNA, 16 nt, Human
uuacugaucaugcauu

SEQ ID NO: 3695003 - RNA, 22 nt, Human
uuacugcagccuuugccucccc

SEQ ID NO: 3695004 - RNA, 12 nt, Human
uuacugcaguug

SEQ ID NO: 3695005 - RNA, 14 nt, Human
uuacugccuugaaa

SEQ ID NO: 3695006 - RNA, 17 nt, Human
uuacugcuaaguauuuc

SEQ ID NO: 3695007 - RNA, 22 nt, Human
uuacugcuaaguauuucccagc

SEQ ID NO: 3695008 - RNA, 23 nt, Human
uuacugcuaaguauuucccagca

SEQ ID NO: 3695009 - RNA, 15 nt, Human
uuacugcucugagaa

SEQ ID NO: 3695010 - RNA, 20 nt, Human
uuacuggccuuuuucauuua

SEQ ID NO: 3695011 - RNA, 16 nt, Human
uuacuggcguggauua

SEQ ID NO: 3695012 - RNA, 22 nt, Human
uuacuggcguggauuaaacuua

SEQ ID NO: 3695013 - RNA, 18 nt, Human
uuacugguccaaaagauu

SEQ ID NO: 3695014 - RNA, 13 nt, Human
uuacugguugcau

SEQ ID NO: 3695015 - RNA, 15 nt, Human
uuacugguugcaugg

SEQ ID NO: 3695016 - RNA, 14 nt, Human
uuacuguaaaaugc

SEQ ID NO: 3695017 - RNA, 20 nt, Human
uuacuguaaaaugcaaaaaa

SEQ ID NO: 3695018 - RNA, 18 nt, Human
uuacuguaaccuguugcu

SEQ ID NO: 3695019 - RNA, 15 nt, Human
uuacuguaacugauu

SEQ ID NO: 3695020 - RNA, 15 nt, Human
uuacuguaagaaaau

SEQ ID NO: 3695021 - RNA, 15 nt, Human
uuacuguaauuccuc

SEQ ID NO: 3695022 - RNA, 23 nt, Human
uuacuguacagacagaaaaaacu

SEQ ID NO: 3695023 - RNA, 13 nt, Human
uuacuguacauga

SEQ ID NO: 3695024 - RNA, 14 nt, Human
uuacugucaauaaa

SEQ ID NO: 3695025 - RNA, 15 nt, Human
uuacugucaauaaac

SEQ ID NO: 3695026 - RNA, 18 nt, Human
uuacugucaauaaacagc

SEQ ID NO: 3695027 - RNA, 22 nt, Human
uuacugucugguuuuaacaauu

SEQ ID NO: 3695028 - RNA, 23 nt, Human
uuacugucugguuuuaacaauuu

SEQ ID NO: 3695029 - RNA, 11 nt, Human
uuacugucuua

SEQ ID NO: 3695030 - RNA, 20 nt, Human
uuacuguggaggaaggauug

SEQ ID NO: 3695031 - RNA, 18 nt, Human
uuacuguggccaguauuu

SEQ ID NO: 3695032 - RNA, 16 nt, Human
uuacuguggcuucuua

SEQ ID NO: 3695033 - RNA, 20 nt, Human
uuacuguguuuuauaaaaua

SEQ ID NO: 3695034 - RNA, 23 nt, Human
uuacuguuaccugaucaaugaca

SEQ ID NO: 3695035 - RNA, 18 nt, Human
uuacuguuagucauuugc

SEQ ID NO: 3695036 - RNA, 14 nt, Human
uuacuguucuugcu

SEQ ID NO: 3695037 - RNA, 21 nt, Human
uuacuguugauaauucuuauu

SEQ ID NO: 3695038 - RNA, 14 nt, Human
uuacuguugugacc

SEQ ID NO: 3695039 - RNA, 17 nt, Human
uuacuguuuauuacuuc

SEQ ID NO: 3695040 - RNA, 23 nt, Human
uuacuguuuauuacuuccaugaa

SEQ ID NO: 3695041 - RNA, 14 nt, Human
uuacuguuucuguc

SEQ ID NO: 3695042 - RNA, 21 nt, Human
uuacuguuugucuucucccca

SEQ ID NO: 3695043 - RNA, 23 nt, Human
uuacuguuuugaaaucaaugcaa

SEQ ID NO: 3695044 - RNA, 21 nt, Human
uuacuuaaaccgccaaggcug

SEQ ID NO: 3695045 - RNA, 14 nt, Human
uuacuuaaagauuu

SEQ ID NO: 3695046 - RNA, 19 nt, Human
uuacuuaaagauuuaucaa

SEQ ID NO: 3695047 - RNA, 16 nt, Human
uuacuuaacuguuuca

SEQ ID NO: 3695048 - RNA, 22 nt, Human
uuacuuaagacuuaaugagacu

SEQ ID NO: 3695049 - RNA, 13 nt, Human
uuacuuaccuaaa

SEQ ID NO: 3695050 - RNA, 20 nt, Human
uuacuuagaggaaauaagaa

SEQ ID NO: 3695051 - RNA, 15 nt, Human
uuacuuagcuuauca

SEQ ID NO: 3695052 - RNA, 19 nt, Human
uuacuuagcuuaucaauuu

SEQ ID NO: 3695053 - RNA, 18 nt, Human
uuacuuagguguggggga

SEQ ID NO: 3695054 - RNA, 15 nt, Human
uuacuuaguauugca

SEQ ID NO: 3695055 - RNA, 17 nt, Human
uuacuuaucauccacau

SEQ ID NO: 3695056 - RNA, 16 nt, Human
uuacuuaucuuaugcc

SEQ ID NO: 3695057 - RNA, 18 nt, Human
uuacuuauuaucuucagg

SEQ ID NO: 3695058 - RNA, 19 nt, Human
uuacuugcauugaauauau

SEQ ID NO: 3695059 - RNA, 17 nt, Human
uucuccuuucacaaccu

SEQ ID NO: 3695060 - RNA, 23 nt, Human
uucucguuuuuauagucaauggc

SEQ ID NO: 3695061 - RNA, 21 nt, Human
uucucuaaguuccacugagcu

SEQ ID NO: 3695062 - RNA, 23 nt, Human
uucucuaaguuccacugagcucc

SEQ ID NO: 3695063 - RNA, 16 nt, Human
uucucuaauaagaaaa

SEQ ID NO: 3695064 - RNA, 12 nt, Human
uucucuaauaug

SEQ ID NO: 3695065 - RNA, 15 nt, Human
uucucuaaucgaaag

SEQ ID NO: 3695066 - RNA, 20 nt, Human
uucucuacuuugaggaaacc

SEQ ID NO: 3695067 - RNA, 18 nt, Human
uucucuagcucucuaggc

SEQ ID NO: 3695068 - RNA, 20 nt, Human
uucucuagggaaggccaccu

SEQ ID NO: 3695069 - RNA, 21 nt, Human
uucucuauaaaaaauauguau

SEQ ID NO: 3695070 - RNA, 21 nt, Human
uucucucagaccgucuuccuc

SEQ ID NO: 3695071 - RNA, 22 nt, Human
uucucucagaccgucuuccucc

SEQ ID NO: 3695072 - RNA, 12 nt, Human
uucucucaucuc

SEQ ID NO: 3695073 - RNA, 15 nt, Human
uucucuccagccccu

SEQ ID NO: 3695074 - RNA, 12 nt, Human
uucucuccagcu

SEQ ID NO: 3695075 - RNA, 23 nt, Human
uucucuccccaacccccauucuc

SEQ ID NO: 3695076 - RNA, 19 nt, Human
uucucuccuguccucccuc

SEQ ID NO: 3695077 - RNA, 22 nt, Human
uucucuccuguccucccucacc

SEQ ID NO: 3695078 - RNA, 17 nt, Human
uucucucuacagugcca

SEQ ID NO: 3695079 - RNA, 20 nt, Human
uucucucuacugguccucuu

SEQ ID NO: 3695080 - RNA, 12 nt, Human
uucucucucacc

SEQ ID NO: 3695081 - RNA, 13 nt, Human
uucucucucuaag

SEQ ID NO: 3695082 - RNA, 21 nt, Human
uucucucuuuauacagcugua

SEQ ID NO: 3695083 - RNA, 19 nt, Human
uucucugaacacaggcagc

SEQ ID NO: 3695084 - RNA, 16 nt, Human
uucucugaagggaggu

SEQ ID NO: 3695085 - RNA, 17 nt, Human
uucucugacuucugccu

SEQ ID NO: 3695086 - RNA, 13 nt, Human
uucucugaggaag

SEQ ID NO: 3695087 - RNA, 13 nt, Human
uucucugaggaca

SEQ ID NO: 3695088 - RNA, 16 nt, Human
uucucugaggacaaga

SEQ ID NO: 3695089 - RNA, 14 nt, Human
uucucugaggacac

SEQ ID NO: 3695090 - RNA, 16 nt, Human
uucucugauacagaaa

SEQ ID NO: 3695091 - RNA, 17 nt, Human
uucucugauacagaaaa

SEQ ID NO: 3695092 - RNA, 13 nt, Human
uucucugccagug

SEQ ID NO: 3695093 - RNA, 21 nt, Human
uucucugcccagcuuuucauu

SEQ ID NO: 3695094 - RNA, 21 nt, Human
uucucugcccauuccccagcc

SEQ ID NO: 3695095 - RNA, 11 nt, Human
uucucugcuuc

SEQ ID NO: 3695096 - RNA, 19 nt, Human
uucucugcuucagcuugcu

SEQ ID NO: 3695097 - RNA, 22 nt, Human
uucucuggaaaggggggagcug

SEQ ID NO: 3695098 - RNA, 20 nt, Human
uucucuggcuguaaggcucu

SEQ ID NO: 3695099 - RNA, 11 nt, Human
uucucuguaca

SEQ ID NO: 3695100 - RNA, 14 nt, Human
uucucuguauagua

SEQ ID NO: 3695101 - RNA, 22 nt, Human
uucucugucucagacuuuugua

SEQ ID NO: 3695102 - RNA, 13 nt, Human
uucucugucucau

SEQ ID NO: 3695103 - RNA, 18 nt, Human
uucucuguggcaaagcag

SEQ ID NO: 3695104 - RNA, 16 nt, Human
uucucugugucuaaga

SEQ ID NO: 3695105 - RNA, 17 nt, Human
uucucugugucuaagau

SEQ ID NO: 3695106 - RNA, 23 nt, Human
uucucuguucuacccguuccaaa

SEQ ID NO: 3695107 - RNA, 23 nt, Human
uucucuguugucguaaagauuug

SEQ ID NO: 3695108 - RNA, 14 nt, Human
uucucuuacugcaa

SEQ ID NO: 3695109 - RNA, 23 nt, Human
uucucuuacugcaaaugucauca

SEQ ID NO: 3695110 - RNA, 16 nt, Human
uucucuucauuuuccc

SEQ ID NO: 3695111 - RNA, 21 nt, Human
uucucuuccacucuccuugcu

SEQ ID NO: 3695112 - RNA, 23 nt, Human
uucucuucccugcgccugugaug

SEQ ID NO: 3695113 - RNA, 23 nt, Human
uucucuucuccccuuccauuucu

SEQ ID NO: 3695114 - RNA, 14 nt, Human
uucucuucucuguu

SEQ ID NO: 3695115 - RNA, 15 nt, Human
uucucuugagcuggc

SEQ ID NO: 3695116 - RNA, 13 nt, Human
uucucuugccuca

SEQ ID NO: 3695117 - RNA, 22 nt, Human
uucucuugccucagcuucccca

SEQ ID NO: 3695118 - RNA, 11 nt, Human
uucucuuggug

SEQ ID NO: 3695119 - RNA, 14 nt, Human
uucucuuucccugg

SEQ ID NO: 3695120 - RNA, 11 nt, Human
uucucuuucuc

SEQ ID NO: 3695121 - RNA, 14 nt, Human
uucucuuucucucu

SEQ ID NO: 3695122 - RNA, 14 nt, Human
uucucuuucuuccu

SEQ ID NO: 3695123 - RNA, 12 nt, Human
uucucuuugaaa

SEQ ID NO: 3695124 - RNA, 14 nt, Human
uucucuuugccuca

SEQ ID NO: 3695125 - RNA, 23 nt, Human
uucucuuugguguacaaaaugga

SEQ ID NO: 3695126 - RNA, 21 nt, Human
uucucuuuuccccuuuccugu

SEQ ID NO: 3695127 - RNA, 15 nt, Human
uucucuuuucuaaaa

SEQ ID NO: 3695128 - RNA, 15 nt, Human
uucugaaaagaaaua

SEQ ID NO: 3695129 - RNA, 17 nt, Human
uucugaaaagaaauaau

SEQ ID NO: 3695130 - RNA, 15 nt, Human
uucugaaaauauaac

SEQ ID NO: 3695131 - RNA, 19 nt, Human
uucugaaaguuacccacug

SEQ ID NO: 3695132 - RNA, 12 nt, Human
uucugaacagcu

SEQ ID NO: 3695133 - RNA, 14 nt, Human
uucugaacagcugg

SEQ ID NO: 3695134 - RNA, 15 nt, Human
uucugaacagcuggu

SEQ ID NO: 3695135 - RNA, 16 nt, Human
uucugaacagcuggug

SEQ ID NO: 3695136 - RNA, 22 nt, Human
uucugaacuaaagugcugcacu

SEQ ID NO: 3695137 - RNA, 16 nt, Human
uucugaacucaaacug

SEQ ID NO: 3695138 - RNA, 22 nt, Human
uucugaaguuauauuuccuaua

SEQ ID NO: 3695139 - RNA, 16 nt, Human
uucugaauaauuucuu

SEQ ID NO: 3695140 - RNA, 17 nt, Human
uucugaauaauuucuua

SEQ ID NO: 3695141 - RNA, 18 nt, Human
uucugaaugcugcuacuu

SEQ ID NO: 3695142 - RNA, 13 nt, Human
uucugaauuugca

SEQ ID NO: 3695143 - RNA, 16 nt, Human
uucugaauuugcaaag

SEQ ID NO: 3695144 - RNA, 21 nt, Human
uucugaauuugcaaaguacug

SEQ ID NO: 3695145 - RNA, 22 nt, Human
uucugaauuugcaaaguacugu

SEQ ID NO: 3695146 - RNA, 19 nt, Human
uucugacaaaaaguuucca

SEQ ID NO: 3695147 - RNA, 14 nt, Human
uucugacaaacugu

SEQ ID NO: 3695148 - RNA, 20 nt, Human
uucugacaaacuguguacau

SEQ ID NO: 3695149 - RNA, 13 nt, Human
uucugacagccuc

SEQ ID NO: 3695150 - RNA, 18 nt, Human
uucugacaguuuuucugu

SEQ ID NO: 3695151 - RNA, 23 nt, Human
uucugacauuaacaguuuuccau

SEQ ID NO: 3695152 - RNA, 14 nt, Human
uucugaccacacuu

SEQ ID NO: 3695153 - RNA, 16 nt, Human
uucugacccaugcugc

SEQ ID NO: 3695154 - RNA, 23 nt, Human
uucugacccaugcugcccuguga

SEQ ID NO: 3695155 - RNA, 18 nt, Human
uucugacccugcuucaaa

SEQ ID NO: 3695156 - RNA, 14 nt, Human
uucugaccucagca

SEQ ID NO: 3695157 - RNA, 16 nt, Human
uucugaccuucagcuc

SEQ ID NO: 3695158 - RNA, 18 nt, Human
uucugaccuucagcucac

SEQ ID NO: 3695159 - RNA, 13 nt, Human
uucugacggcccu

SEQ ID NO: 3695160 - RNA, 20 nt, Human
uucugacgugccuuuugcac

SEQ ID NO: 3695161 - RNA, 19 nt, Human
uucugacucgguuucucca

SEQ ID NO: 3695162 - RNA, 22 nt, Human
uucugacuucauagauuuccuu

SEQ ID NO: 3695163 - RNA, 12 nt, Human
uucugagaaaac

SEQ ID NO: 3695164 - RNA, 15 nt, Human
uucugagaaagacua

SEQ ID NO: 3695165 - RNA, 21 nt, Human
uucugagaaagacuauucaaa

SEQ ID NO: 3695166 - RNA, 17 nt, Human
uucugagacgucaugag

SEQ ID NO: 3695167 - RNA, 16 nt, Human
uucugagaucuguuga

SEQ ID NO: 3695168 - RNA, 23 nt, Human
uucugagauggcucccaggggcu

SEQ ID NO: 3695169 - RNA, 19 nt, Human
uucugagauucaauauuga

SEQ ID NO: 3695170 - RNA, 21 nt, Human
uucugagauucaauauugaau

SEQ ID NO: 3695171 - RNA, 20 nt, Human
uucugagcagcgagccugcu

SEQ ID NO: 3695172 - RNA, 19 nt, Human
uucugagcccgguaagagc

SEQ ID NO: 3695173 - RNA, 21 nt, Human
uucugaggccugaauccaaaa

SEQ ID NO: 3695174 - RNA, 20 nt, Human
uucugaggguccacuacuca

SEQ ID NO: 3695175 - RNA, 17 nt, Human
uucugaggugcacuggg

SEQ ID NO: 3695176 - RNA, 20 nt, Human
uucugaguuucauucuccug

SEQ ID NO: 3695177 - RNA, 15 nt, Human
uucugaguuuuacca

SEQ ID NO: 3695178 - RNA, 19 nt, Human
uucugaguuuuguguuugu

SEQ ID NO: 3695179 - RNA, 22 nt, Human
uucugaguuuuguguuuguugu

SEQ ID NO: 3695180 - RNA, 18 nt, Human
uucugauaaccauagcau

SEQ ID NO: 3695181 - RNA, 22 nt, Human
uucugauaacuagauggugcug

SEQ ID NO: 3695182 - RNA, 14 nt, Human
uucugauauagaau

SEQ ID NO: 3695183 - RNA, 14 nt, Human
uucugaucaaggcc

SEQ ID NO: 3695184 - RNA, 20 nt, Human
uucugaucacugaaauaaaa

SEQ ID NO: 3695185 - RNA, 14 nt, Human
uucugaucuucacu

SEQ ID NO: 3695186 - RNA, 15 nt, Human
uucugaugaaucuug

SEQ ID NO: 3695187 - RNA, 14 nt, Human
uucugaugagcaac

SEQ ID NO: 3695188 - RNA, 16 nt, Human
uucugauguacucuaa

SEQ ID NO: 3695189 - RNA, 14 nt, Human
uucugauuagaaau

SEQ ID NO: 3695190 - RNA, 13 nt, Human
uucugauuagcuu

SEQ ID NO: 3695191 - RNA, 21 nt, Human
uucugauucgaaugacacugu

SEQ ID NO: 3695192 - RNA, 21 nt, Human
uucugauuguaacguugcugu

SEQ ID NO: 3695193 - RNA, 13 nt, Human
uucugauuucuuu

SEQ ID NO: 3695194 - RNA, 17 nt, Human
uucugauuuuaggagcu

SEQ ID NO: 3695195 - RNA, 24 nt, Human
uucugauuuuaggagcuaaggcuc

SEQ ID NO: 3695196 - RNA, 12 nt, Human
uucugcaaacaa

SEQ ID NO: 3695197 - RNA, 17 nt, Human
uucugcaacaagcaugc

SEQ ID NO: 3695198 - RNA, 15 nt, Human
uucugcacacagcac

SEQ ID NO: 3695199 - RNA, 22 nt, Human
uucugcacccuccacccugucc

SEQ ID NO: 3695200 - RNA, 16 nt, Human
uucugcaccuuaucuu

SEQ ID NO: 3695201 - RNA, 13 nt, Human
uucugcacugaaa

SEQ ID NO: 3695202 - RNA, 15 nt, Human
uucugcacugagcag

SEQ ID NO: 3695203 - RNA, 20 nt, Human
uucugcacugagcagagucu

SEQ ID NO: 3695204 - RNA, 12 nt, Human
uucugcagaaga

SEQ ID NO: 3695205 - RNA, 20 nt, Human
uucugcaguagucucugugc

SEQ ID NO: 3695206 - RNA, 21 nt, Human
uucugcaguagucucugugcu

SEQ ID NO: 3695207 - RNA, 20 nt, Human
uucugcaucaucuguagaua

SEQ ID NO: 3695208 - RNA, 16 nt, Human
uucugcaucuccacuu

SEQ ID NO: 3695209 - RNA, 22 nt, Human
uacuucguguccgacucuucug

SEQ ID NO: 3695210 - RNA, 21 nt, Human
uacuucuagagauaguacaua

SEQ ID NO: 3695211 - RNA, 20 nt, Human
uacuucucauuuuuuaaaaa

SEQ ID NO: 3695212 - RNA, 20 nt, Human
uacuucuccacccugcucuc

SEQ ID NO: 3695213 - RNA, 21 nt, Human
uacuucugagggcaucuuggu

SEQ ID NO: 3695214 - RNA, 14 nt, Human
uacuucuuauacau

SEQ ID NO: 3695215 - RNA, 18 nt, Human
uacuucuucauucaauac

SEQ ID NO: 3695216 - RNA, 15 nt, Human
uacuucuucuguaau

SEQ ID NO: 3695217 - RNA, 13 nt, Human
uacuucuugaaua

SEQ ID NO: 3695218 - RNA, 15 nt, Human
uacuugaaaaaguaa

SEQ ID NO: 3695219 - RNA, 13 nt, Human
uacuugaacaaaa

SEQ ID NO: 3695220 - RNA, 15 nt, Human
uacuugaacaaaagg

SEQ ID NO: 3695221 - RNA, 17 nt, Human
uacuugaaccauaaaau

SEQ ID NO: 3695222 - RNA, 24 nt, Human
uacuugaacguuuucuaauugcuu

SEQ ID NO: 3695223 - RNA, 16 nt, Human
uacuugaagggccaga

SEQ ID NO: 3695224 - RNA, 19 nt, Human
uacuugaagggccagagcc

SEQ ID NO: 3695225 - RNA, 22 nt, Human
uacuugaagggccagagccagg

SEQ ID NO: 3695226 - RNA, 14 nt, Human
uacuugaccuccua

SEQ ID NO: 3695227 - RNA, 17 nt, Human
uacuugauaacaauguu

SEQ ID NO: 3695228 - RNA, 23 nt, Human
uacuugaugaguguaacaagaaa

SEQ ID NO: 3695229 - RNA, 19 nt, Human
uuauacaaccuucauuuaa

SEQ ID NO: 3695230 - RNA, 12 nt, Human
uuauacacauaa

SEQ ID NO: 3695231 - RNA, 13 nt, Human
uuauacacauaau

SEQ ID NO: 3695232 - RNA, 18 nt, Human
uuauacagcucagcuuuu

SEQ ID NO: 3695233 - RNA, 22 nt, Human
uuauacaggucauauuaauaua

SEQ ID NO: 3695234 - RNA, 17 nt, Human
uuauacaguagugagaa

SEQ ID NO: 3695235 - RNA, 17 nt, Human
uuauacaguuauaaaau

SEQ ID NO: 3695236 - RNA, 15 nt, Human
uuauacaguuuuaaa

SEQ ID NO: 3695237 - RNA, 16 nt, Human
uuauacaguuuuaaag

SEQ ID NO: 3695238 - RNA, 13 nt, Human
uuauacauaaaca

SEQ ID NO: 3695239 - RNA, 23 nt, Human
uuauacaugacacugaaaugccu

SEQ ID NO: 3695240 - RNA, 18 nt, Human
uuauacccagaaaguuau

SEQ ID NO: 3695241 - RNA, 18 nt, Human
uuauacccguuucacaug

SEQ ID NO: 3695242 - RNA, 16 nt, Human
uuauaccuaccugugu

SEQ ID NO: 3695243 - RNA, 20 nt, Human
uuauacgaguaauaugccug

SEQ ID NO: 3695244 - RNA, 21 nt, Human
uuauacgauaaauaacuuuuu

SEQ ID NO: 3695245 - RNA, 15 nt, Human
uuauacguguagcua

SEQ ID NO: 3695246 - RNA, 21 nt, Human
uuauacguguagcuauaucua

SEQ ID NO: 3695247 - RNA, 18 nt, Human
uuauacuccaguguacau

SEQ ID NO: 3695248 - RNA, 13 nt, Human
uuauacugauuau

SEQ ID NO: 3695249 - RNA, 11 nt, Human
uucuugugaag

SEQ ID NO: 3695250 - RNA, 19 nt, Human
uucuugugaauauguacau

SEQ ID NO: 3695251 - RNA, 14 nt, Human
uucuugugcuuuuc

SEQ ID NO: 3695252 - RNA, 18 nt, Human
uucuuguguguaugcaca

SEQ ID NO: 3695253 - RNA, 13 nt, Human
uucuuguucuguu

SEQ ID NO: 3695254 - RNA, 16 nt, Human
uucuuguuuccuuguu

SEQ ID NO: 3695255 - RNA, 19 nt, Human
uucuuuaaaagaaugacua

SEQ ID NO: 3695256 - RNA, 16 nt, Human
uucuuuaaaagaaugg

SEQ ID NO: 3695257 - RNA, 15 nt, Human
uucuuuaaaauuaca

SEQ ID NO: 3695258 - RNA, 13 nt, Human
uucuuuaaacugu

SEQ ID NO: 3695259 - RNA, 13 nt, Human
uucuuuaaagaug

SEQ ID NO: 3695260 - RNA, 12 nt, Human
uucuuuaaauua

SEQ ID NO: 3695261 - RNA, 19 nt, Human
uucuuuaacugccguaauu

SEQ ID NO: 3695262 - RNA, 14 nt, Human
uucuuuaacuuaau

SEQ ID NO: 3695263 - RNA, 12 nt, Human
uucuuuaaugcu

SEQ ID NO: 3695264 - RNA, 20 nt, Human
uucuuuacaaaacaaacuca

SEQ ID NO: 3695265 - RNA, 20 nt, Human
uucuuuaccugagaccaguu

SEQ ID NO: 3695266 - RNA, 11 nt, Human
uucuuuagaac

SEQ ID NO: 3695267 - RNA, 15 nt, Human
uucuuuaggagauuu

SEQ ID NO: 3695268 - RNA, 13 nt, Human
uucuuuauaaacu

SEQ ID NO: 3695269 - RNA, 18 nt, Human
uucuuuauaauucuacuu

SEQ ID NO: 3695270 - RNA, 19 nt, Human
uucuuuauacaacagugcu

SEQ ID NO: 3695271 - RNA, 22 nt, Human
uucuuuauacaacagugcuaaa

SEQ ID NO: 3695272 - RNA, 16 nt, Human
uucuuuauacuguaau

SEQ ID NO: 3695273 - RNA, 23 nt, Human
uucuuuauauacaauaauggaaa

SEQ ID NO: 3695274 - RNA, 12 nt, Human
uucuuucagugg

SEQ ID NO: 3695275 - RNA, 14 nt, Human
uucuuucauuucuu

SEQ ID NO: 3695276 - RNA, 17 nt, Human
uucuuuccauuaugauu

SEQ ID NO: 3695277 - RNA, 20 nt, Human
uucuuuccauuaugauucuu

SEQ ID NO: 3695278 - RNA, 12 nt, Human
uucuuucuagaa

SEQ ID NO: 3695279 - RNA, 13 nt, Human
uucuuucuagaaa

SEQ ID NO: 3695280 - RNA, 22 nt, Human
uucuuucuaguggucuuuguaa

SEQ ID NO: 3695281 - RNA, 13 nt, Human
uucuuucucucag

SEQ ID NO: 3695282 - RNA, 12 nt, Human
uucuuucuggcu

SEQ ID NO: 3695283 - RNA, 17 nt, Human
uucuuucuggcuaugca

SEQ ID NO: 3695284 - RNA, 13 nt, Human
uucuuucuuuaaa

SEQ ID NO: 3695285 - RNA, 16 nt, Human
uucuuucuuugggaau

SEQ ID NO: 3695286 - RNA, 22 nt, Human
uucuuugaaaauaguuauucag

SEQ ID NO: 3695287 - RNA, 17 nt, Human
uucuuugaauaaauguc

SEQ ID NO: 3695288 - RNA, 18 nt, Human
uucuuugaauaaauguca

SEQ ID NO: 3695289 - RNA, 15 nt, Human
uucuuugaauuuacu

SEQ ID NO: 3695290 - RNA, 22 nt, Human
uucuuugaauuuucauuuuaca

SEQ ID NO: 3695291 - RNA, 16 nt, Human
uucuuugauaauguua

SEQ ID NO: 3695292 - RNA, 22 nt, Human
uucuuugaucaugaauaacuga

SEQ ID NO: 3695293 - RNA, 13 nt, Human
uucuuugauucuc

SEQ ID NO: 3695294 - RNA, 14 nt, Human
uucuuugauucugu

SEQ ID NO: 3695295 - RNA, 18 nt, Human
uucuuugccaucucugcu

SEQ ID NO: 3695296 - RNA, 14 nt, Human
uucuuugcuguaag

SEQ ID NO: 3695297 - RNA, 17 nt, Human
uucuuugcuugaacaca

SEQ ID NO: 3695298 - RNA, 22 nt, Human
uucuuugcuugaacacaguauu

SEQ ID NO: 3695299 - RNA, 16 nt, Human
uucuuuggaguuaaaa

SEQ ID NO: 3695300 - RNA, 18 nt, Human
uucuuugggaauauuuga

SEQ ID NO: 3695301 - RNA, 20 nt, Human
uucuuugggaauauuugaau

SEQ ID NO: 3695302 - RNA, 21 nt, Human
uucuuuggugccuuuccuguu

SEQ ID NO: 3695303 - RNA, 12 nt, Human
uucuuuguguag

SEQ ID NO: 3695304 - RNA, 19 nt, Human
uucuuuguguagcuuugcu

SEQ ID NO: 3695305 - RNA, 23 nt, Human
uucuuuguuaauuuggaccauuu

SEQ ID NO: 3695306 - RNA, 12 nt, Human
uucuuuuaagaa

SEQ ID NO: 3695307 - RNA, 13 nt, Human
uucuuuuaauuuu

SEQ ID NO: 3695308 - RNA, 21 nt, Human
uucuuuuauaaaaaaaaugaa

SEQ ID NO: 3695309 - RNA, 15 nt, Human
uucuuuucacauucu

SEQ ID NO: 3695310 - RNA, 13 nt, Human
uucuuuucccccu

SEQ ID NO: 3695311 - RNA, 22 nt, Human
uucuuuucucauguguuugcau

SEQ ID NO: 3695312 - RNA, 21 nt, Human
uucuuuucuggaauguaauca

SEQ ID NO: 3695313 - RNA, 20 nt, Human
uucuuuucuucacucaaauu

SEQ ID NO: 3695314 - RNA, 23 nt, Human
uucuuuuguuacuguucuugcug

SEQ ID NO: 3695315 - RNA, 14 nt, Human
uucuuuuguuuggu

SEQ ID NO: 3695316 - RNA, 15 nt, Human
uucuuuuguuuggua

SEQ ID NO: 3695317 - RNA, 22 nt, Human
uucuuuuguuuuuugaaguguu

SEQ ID NO: 3695318 - RNA, 16 nt, Human
uucuuuuuaaaauggu

SEQ ID NO: 3695319 - RNA, 20 nt, Human
uucuuuuuaaaauggugcuu

SEQ ID NO: 3695320 - RNA, 20 nt, Human
uucuuuuuaaagcuuuugau

SEQ ID NO: 3695321 - RNA, 13 nt, Human
uucuuuuuacaua

SEQ ID NO: 3695322 - RNA, 18 nt, Human
uucuuuuuacauaacugc

SEQ ID NO: 3695323 - RNA, 16 nt, Human
uucuuuuuauuuucuu

SEQ ID NO: 3695324 - RNA, 13 nt, Human
uucuuuuugcucu

SEQ ID NO: 3695325 - RNA, 20 nt, Human
uucuuuuugcucuaaaauau

SEQ ID NO: 3695326 - RNA, 14 nt, Human
uucuuuuuuauuaa

SEQ ID NO: 3695327 - RNA, 22 nt, Human
uucuuuuuugugugauuuaaga

SEQ ID NO: 3695328 - RNA, 21 nt, Human
uucuuuuuuuuuuuuuugaga

SEQ ID NO: 3695329 - RNA, 13 nt, Human
uugaaaaaaaaua

SEQ ID NO: 3695330 - RNA, 11 nt, Human
uugaaaaaagc

SEQ ID NO: 3695331 - RNA, 14 nt, Human
uugaaaaaagcuca

SEQ ID NO: 3695332 - RNA, 15 nt, Human
uugaaaaaagcucau

SEQ ID NO: 3695333 - RNA, 17 nt, Human
uugaaaaaagcucauuu

SEQ ID NO: 3695334 - RNA, 18 nt, Human
uugaaaaaguuaaugcuu

SEQ ID NO: 3695335 - RNA, 19 nt, Human
uugaaaaauauaaaauuau

SEQ ID NO: 3695336 - RNA, 16 nt, Human
uugaaaaauuccuauu

SEQ ID NO: 3695337 - RNA, 19 nt, Human
uugaaaacacuguucucug

SEQ ID NO: 3695338 - RNA, 22 nt, Human
uugaaaacacuguucucugccc

SEQ ID NO: 3695339 - RNA, 23 nt, Human
uugaaaacacuguucucugcccu

SEQ ID NO: 3695340 - RNA, 16 nt, Human
uugaaaaccaaaauga

SEQ ID NO: 3695341 - RNA, 17 nt, Human
uugaaaaccaaaaugac

SEQ ID NO: 3695342 - RNA, 22 nt, Human
uugaaaaccaaaaugacaucuu

SEQ ID NO: 3695343 - RNA, 24 nt, Human
uugaaaaccaacaccaucacagcu

SEQ ID NO: 3695344 - RNA, 18 nt, Human
uugaaaaccuaaaagaca

SEQ ID NO: 3695345 - RNA, 15 nt, Human
uugaaaacuacauuu

SEQ ID NO: 3695346 - RNA, 20 nt, Human
uugaaaacuacauuuuaaca

SEQ ID NO: 3695347 - RNA, 16 nt, Human
uugaaaacuucagaag

SEQ ID NO: 3695348 - RNA, 13 nt, Human
uugaaaacuuuuc

SEQ ID NO: 3695349 - RNA, 16 nt, Human
uugaaaacuuuucuca

SEQ ID NO: 3695350 - RNA, 13 nt, Human
uugaaaagacauc

SEQ ID NO: 3695351 - RNA, 13 nt, Human
uugaaaagaggug

SEQ ID NO: 3695352 - RNA, 22 nt, Human
uugaaaaguaauauuuauuaaa

SEQ ID NO: 3695353 - RNA, 15 nt, Human
uugaaaagucaaacu

SEQ ID NO: 3695354 - RNA, 20 nt, Human
uugaaaauguaaguaaaugu

SEQ ID NO: 3695355 - RNA, 16 nt, Human
uugaaaauguccagga

SEQ ID NO: 3695356 - RNA, 15 nt, Human
uugaaacaauacuca

SEQ ID NO: 3695357 - RNA, 15 nt, Human
uugaaacacugguuu

SEQ ID NO: 3695358 - RNA, 19 nt, Human
uugaaacacuuuuuugggg

SEQ ID NO: 3695359 - RNA, 12 nt, Human
uugaaacauugc

SEQ ID NO: 3695360 - RNA, 18 nt, Human
uugaaacauugcuuuuaa

SEQ ID NO: 3695361 - RNA, 14 nt, Human
uugaaaccugcucu

SEQ ID NO: 3695362 - RNA, 14 nt, Human
uugaaaccuguaua

SEQ ID NO: 3695363 - RNA, 20 nt, Human
uugaaacggaugauuucuau

SEQ ID NO: 3695364 - RNA, 22 nt, Human
uugaaacggaugauuucuaugc

SEQ ID NO: 3695365 - RNA, 15 nt, Human
uugaaagaauguaaa

SEQ ID NO: 3695366 - RNA, 16 nt, Human
uugaaagaauuauccu

SEQ ID NO: 3695367 - RNA, 13 nt, Human
uugaaagaccuuc

SEQ ID NO: 3695368 - RNA, 15 nt, Human
uugaaagauucaggu

SEQ ID NO: 3695369 - RNA, 13 nt, Human
uugaaagcaaaaa

SEQ ID NO: 3695370 - RNA, 19 nt, Human
uugaaagcaaaaaugcuaa

SEQ ID NO: 3695371 - RNA, 19 nt, Human
uugaaagccccagaaauca

SEQ ID NO: 3695372 - RNA, 12 nt, Human
uugaaagcugug

SEQ ID NO: 3695373 - RNA, 22 nt, Human
uugaaagcuguggccagcuugu

SEQ ID NO: 3695374 - RNA, 20 nt, Human
uugaaaggcauucucugaag

SEQ ID NO: 3695375 - RNA, 21 nt, Human
uugaaagggguugugaagagg

SEQ ID NO: 3695376 - RNA, 22 nt, Human
uugaaagugaauaaacuucagc

SEQ ID NO: 3695377 - RNA, 20 nt, Human
uugaaagugggcaaaagcuu

SEQ ID NO: 3695378 - RNA, 16 nt, Human
uugaaauaaaaagagu

SEQ ID NO: 3695379 - RNA, 16 nt, Human
uugaaauaacuggaac

SEQ ID NO: 3695380 - RNA, 21 nt, Human
uugaaauaacuggaacaaauu

SEQ ID NO: 3695381 - RNA, 15 nt, Human
uugaaauaagcuauu

SEQ ID NO: 3695382 - RNA, 20 nt, Human
uugaaauauaggaacuuaaa

SEQ ID NO: 3695383 - RNA, 22 nt, Human
uugaaauauauggucuaauguu

SEQ ID NO: 3695384 - RNA, 19 nt, Human
uugaaaucaaugcaagagu

SEQ ID NO: 3695385 - RNA, 15 nt, Human
uugaaaucuguaucu

SEQ ID NO: 3695386 - RNA, 21 nt, Human
uugaaaugaaauuuaaacauu

SEQ ID NO: 3695387 - RNA, 15 nt, Human
uugaaauggaaauua

SEQ ID NO: 3695388 - RNA, 11 nt, Human
uugaaauguaa

SEQ ID NO: 3695389 - RNA, 14 nt, Human
uugaaaugucacgu

SEQ ID NO: 3695390 - RNA, 19 nt, Human
uugaaauguguuucuguau

SEQ ID NO: 3695391 - RNA, 18 nt, Human
uugaaauuaaccucucac

SEQ ID NO: 3695392 - RNA, 19 nt, Human
uugaaauuauaucuguggu

SEQ ID NO: 3695393 - RNA, 20 nt, Human
uugaaauuaugugacauuuu

SEQ ID NO: 3695394 - RNA, 21 nt, Human
uugaaauucuauuuauaauac

SEQ ID NO: 3695395 - RNA, 12 nt, Human
uugaaauucuga

SEQ ID NO: 3695396 - RNA, 15 nt, Human
uugaaauucugaauu

SEQ ID NO: 3695397 - RNA, 18 nt, Human
uugaaauugaaccuuugu

SEQ ID NO: 3695398 - RNA, 15 nt, Human
uugaaauuguaauua

SEQ ID NO: 3695399 - RNA, 19 nt, Human
uugaaauugugaacucauu

SEQ ID NO: 3695400 - RNA, 14 nt, Human
uuauacuggcaugc

SEQ ID NO: 3695401 - RNA, 24 nt, Human
uuauacugggacaccauuaccaaa

SEQ ID NO: 3695402 - RNA, 23 nt, Human
uuauagagcagaaauucuguuuu

SEQ ID NO: 3695403 - RNA, 19 nt, Human
uuauagagggccaagacuu

SEQ ID NO: 3695404 - RNA, 21 nt, Human
uuauagaugggaaugaagcuu

SEQ ID NO: 3695405 - RNA, 14 nt, Human
uuauagauucuaaa

SEQ ID NO: 3695406 - RNA, 15 nt, Human
uuauagauucuaaag

SEQ ID NO: 3695407 - RNA, 19 nt, Human
uuauagauucuaaagauuc

SEQ ID NO: 3695408 - RNA, 20 nt, Human
uuauagauucuaaagauucu

SEQ ID NO: 3695409 - RNA, 21 nt, Human
uuauagauucuaaagauucua

SEQ ID NO: 3695410 - RNA, 17 nt, Human
uuauagccucugucugg

SEQ ID NO: 3695411 - RNA, 24 nt, Human
uuauaggauuuauuuaaaauagca

SEQ ID NO: 3695412 - RNA, 18 nt, Human
uuauaggucacuccuggg

SEQ ID NO: 3695413 - RNA, 18 nt, Human
uuauagguccuuuagaaa

SEQ ID NO: 3695414 - RNA, 16 nt, Human
uuauaguacaugauaa

SEQ ID NO: 3695415 - RNA, 17 nt, Human
uuauaguacaugauaaa

SEQ ID NO: 3695416 - RNA, 15 nt, Human
uuauaguauaucugg

SEQ ID NO: 3695417 - RNA, 17 nt, Human
uuauagugcaauauauu

SEQ ID NO: 3695418 - RNA, 19 nt, Human
uuauagugcaauauauuuu

SEQ ID NO: 3695419 - RNA, 17 nt, Human
uuauaguuaaucuauaa

SEQ ID NO: 3695420 - RNA, 19 nt, Human
uuauaguuacuguguaauu

SEQ ID NO: 3695421 - RNA, 15 nt, Human
uuauaguuguaacua

SEQ ID NO: 3695422 - RNA, 12 nt, Human
uuauaguuucug

SEQ ID NO: 3695423 - RNA, 13 nt, Human
uuauaguuucuga

SEQ ID NO: 3695424 - RNA, 17 nt, Human
uuauauaaagagaaaau

SEQ ID NO: 3695425 - RNA, 19 nt, Human
uuauauaaagagaaaauug

SEQ ID NO: 3695426 - RNA, 14 nt, Human
uuauauaaaguauu

SEQ ID NO: 3695427 - RNA, 18 nt, Human
uuauauaaaguauucuuu

SEQ ID NO: 3695428 - RNA, 23 nt, Human
uuauauaaauguaaaaauaauaa

SEQ ID NO: 3695429 - RNA, 12 nt, Human
uuauauaacugu

SEQ ID NO: 3695430 - RNA, 16 nt, Human
uuauauaaguauucua

SEQ ID NO: 3695431 - RNA, 18 nt, Human
uuauauaauaucuaaagu

SEQ ID NO: 3695432 - RNA, 17 nt, Human
uuauauacaauaaugga

SEQ ID NO: 3695433 - RNA, 19 nt, Human
uuauauacaauaauggaaa

SEQ ID NO: 3695434 - RNA, 14 nt, Human
uuauauacagagga

SEQ ID NO: 3695435 - RNA, 21 nt, Human
uuauauacagaggaaaucugu

SEQ ID NO: 3695436 - RNA, 18 nt, Human
uuauauacuuguuguuua

SEQ ID NO: 3695437 - RNA, 22 nt, Human
uuauauacuuguuguuuaaugu

SEQ ID NO: 3695438 - RNA, 21 nt, Human
uuauauagguuuuguuugcua

SEQ ID NO: 3695439 - RNA, 23 nt, Human
uuauauagguuuuguuugcuauc

SEQ ID NO: 3695440 - RNA, 15 nt, Human
uuauauauaaauaua

SEQ ID NO: 3695441 - RNA, 15 nt, Human
uuauauauacaguaa

SEQ ID NO: 3695442 - RNA, 14 nt, Human
uuauauauauaucu

SEQ ID NO: 3695443 - RNA, 22 nt, Human
uuauauauauuuuuuucugaaa

SEQ ID NO: 3695444 - RNA, 14 nt, Human
uuauauauggacau

SEQ ID NO: 3695445 - RNA, 19 nt, Human
uuauauauuauauggaaau

SEQ ID NO: 3695446 - RNA, 16 nt, Human
uuauauauuuaaaagu

SEQ ID NO: 3695447 - RNA, 15 nt, Human
uuauauauuuauaac

SEQ ID NO: 3695448 - RNA, 20 nt, Human
uuauauauuuauaacucauc

SEQ ID NO: 3695449 - RNA, 23 nt, Human
uuauauauuuauaacucaucaua

SEQ ID NO: 3695450 - RNA, 14 nt, Human
uuauaucaaaguau

SEQ ID NO: 3695451 - RNA, 19 nt, Human
uuauaucuauauuuuacau

SEQ ID NO: 3695452 - RNA, 16 nt, Human
uuauaucuggccucug

SEQ ID NO: 3695453 - RNA, 17 nt, Human
uuauaucuguacaauga

SEQ ID NO: 3695454 - RNA, 22 nt, Human
uuauaucuuguagcuuuaucaa

SEQ ID NO: 3695455 - RNA, 18 nt, Human
uuauaugcuauuucuaua

SEQ ID NO: 3695456 - RNA, 13 nt, Human
uuauaugcuuacu

SEQ ID NO: 3695457 - RNA, 14 nt, Human
uuauauggaaauuc

SEQ ID NO: 3695458 - RNA, 15 nt, Human
uuauauggaagaaag

SEQ ID NO: 3695459 - RNA, 18 nt, Human
uuauauggaagaaaguaa

SEQ ID NO: 3695460 - RNA, 20 nt, Human
uuauauggaugauucagaaa

SEQ ID NO: 3695461 - RNA, 19 nt, Human
uuauauguacccucugaaa

SEQ ID NO: 3695462 - RNA, 24 nt, Human
uuauauguacccucugaaauacau

SEQ ID NO: 3695463 - RNA, 16 nt, Human
uuauauguaccguagg

SEQ ID NO: 3695464 - RNA, 14 nt, Human
uuauauguacuguu

SEQ ID NO: 3695465 - RNA, 20 nt, Human
uuauauguauccaguacauu

SEQ ID NO: 3695466 - RNA, 21 nt, Human
uuauauguauccaguacauuu

SEQ ID NO: 3695467 - RNA, 15 nt, Human
uuauauguauguguu

SEQ ID NO: 3695468 - RNA, 20 nt, Human
uuauauguauguguuuagaa

SEQ ID NO: 3695469 - RNA, 18 nt, Human
uuauauguuguaagcaac

SEQ ID NO: 3695470 - RNA, 18 nt, Human
uuauauguuguaauauuu

SEQ ID NO: 3695471 - RNA, 15 nt, Human
uuauauguuguucuu

SEQ ID NO: 3695472 - RNA, 11 nt, Human
uuauauucaac

SEQ ID NO: 3695473 - RNA, 16 nt, Human
uuauauucaaccaugg

SEQ ID NO: 3695474 - RNA, 14 nt, Human
uuauauugaaaaaa

SEQ ID NO: 3695475 - RNA, 22 nt, Human
uuauauugaagacaauuugaua

SEQ ID NO: 3695476 - RNA, 18 nt, Human
uuauauugagacaaaaau

SEQ ID NO: 3695477 - RNA, 15 nt, Human
uuauauugauaacag

SEQ ID NO: 3695478 - RNA, 16 nt, Human
uuauauuguaagaaau

SEQ ID NO: 3695479 - RNA, 16 nt, Human
uuauauuuacaaaugg

SEQ ID NO: 3695480 - RNA, 17 nt, Human
uuauauuuaguuauagu

SEQ ID NO: 3695481 - RNA, 18 nt, Human
uuauauuuaguuauaguu

SEQ ID NO: 3695482 - RNA, 18 nt, Human
uuauauuuaugugucugu

SEQ ID NO: 3695483 - RNA, 20 nt, Human
uuauauuucccuaaaauaca

SEQ ID NO: 3695484 - RNA, 22 nt, Human
uuauauuucccuaaaauacauu

SEQ ID NO: 3695485 - RNA, 14 nt, Human
uuauauuuccuuua

SEQ ID NO: 3695486 - RNA, 20 nt, Human
uuauauuuccuuuaugugaa

SEQ ID NO: 3695487 - RNA, 12 nt, Human
uuauauuugaaa

SEQ ID NO: 3695488 - RNA, 13 nt, Human
uuauauuugaaau

SEQ ID NO: 3695489 - RNA, 19 nt, Human
uuauauuuuacuacugugg

SEQ ID NO: 3695490 - RNA, 12 nt, Human
uuauauuuucaa

SEQ ID NO: 3695491 - RNA, 15 nt, Human
uuauauuuugcaguu

SEQ ID NO: 3695492 - RNA, 19 nt, Human
uuauauuuuuaauaaaagu

SEQ ID NO: 3695493 - RNA, 15 nt, Human
uuauauuuuucuuaa

SEQ ID NO: 3695494 - RNA, 16 nt, Human
uuauauuuuucuuaaa

SEQ ID NO: 3695495 - RNA, 20 nt, Human
uuauauuuuucuuaaaaagu

SEQ ID NO: 3695496 - RNA, 21 nt, Human
uuauauuuuucuuaaaaagua

SEQ ID NO: 3695497 - RNA, 22 nt, Human
uuaucaaaaaaaaaaaaaugug

SEQ ID NO: 3695498 - RNA, 16 nt, Human
uuaucaaaacuuucuu

SEQ ID NO: 3695499 - RNA, 13 nt, Human
uuaucaaaucagu

SEQ ID NO: 3695500 - RNA, 15 nt, Human
uuaucaacuuccuaa

SEQ ID NO: 3695501 - RNA, 20 nt, Human
uuaucaagcuaauaaaauau

SEQ ID NO: 3695502 - RNA, 11 nt, Human
uuaucaagugu

SEQ ID NO: 3695503 - RNA, 14 nt, Human
uuaucaagugucuu

SEQ ID NO: 3695504 - RNA, 17 nt, Human
uuaucaauaucuaauau

SEQ ID NO: 3695505 - RNA, 22 nt, Human
uuaucaauaucuaauauauaug

SEQ ID NO: 3695506 - RNA, 19 nt, Human
uuaucaauuacaacaguga

SEQ ID NO: 3695507 - RNA, 23 nt, Human
uuaucaauuugucauuuugaagc

SEQ ID NO: 3695508 - RNA, 19 nt, Human
uuaucacacaaagcagaau

SEQ ID NO: 3695509 - RNA, 19 nt, Human
uuaucacauguauguuuug

SEQ ID NO: 3695510 - RNA, 18 nt, Human
uuaucacauuauuugcau

SEQ ID NO: 3695511 - RNA, 18 nt, Human
uuaucaccacaguaaguu

SEQ ID NO: 3695512 - RNA, 20 nt, Human
uuaucaccagagagggacug

SEQ ID NO: 3695513 - RNA, 19 nt, Human
uuaucaccagcugccucuu

SEQ ID NO: 3695514 - RNA, 21 nt, Human
uuaucacccagaagaaaauag

SEQ ID NO: 3695515 - RNA, 18 nt, Human
uuaucaccuggcuuguuu

SEQ ID NO: 3695516 - RNA, 15 nt, Human
uuaucacuuuucugu

SEQ ID NO: 3695517 - RNA, 17 nt, Human
uuaucacuuuuugaacu

SEQ ID NO: 3695518 - RNA, 21 nt, Human
uuaucacuuuuugaacuaaga

SEQ ID NO: 3695519 - RNA, 15 nt, Human
uuaucagaacuaugu

SEQ ID NO: 3695520 - RNA, 15 nt, Human
uuaucagagucauga

SEQ ID NO: 3695521 - RNA, 22 nt, Human
uuaucagcuacuuaagagaaau

SEQ ID NO: 3695522 - RNA, 21 nt, Human
uuaucaguaagaaaaagaaga

SEQ ID NO: 3695523 - RNA, 14 nt, Human
uuaucagucaauau

SEQ ID NO: 3695524 - RNA, 23 nt, Human
uuaucagucaauauuuuuagaua

SEQ ID NO: 3695525 - RNA, 13 nt, Human
uuaucaugaagcc

SEQ ID NO: 3695526 - RNA, 22 nt, Human
uuaucaugaagccuguggauga

SEQ ID NO: 3695527 - RNA, 11 nt, Human
uuaucaugcaa

SEQ ID NO: 3695528 - RNA, 13 nt, Human
uuaucaugcuguc

SEQ ID NO: 3695529 - RNA, 20 nt, Human
uuaucaugugaaaucauuca

SEQ ID NO: 3695530 - RNA, 13 nt, Human
uuaucauguguaa

SEQ ID NO: 3695531 - RNA, 15 nt, Human
uuaucauguguaauc

SEQ ID NO: 3695532 - RNA, 21 nt, Human
uuaucauguguaaucaauaaa

SEQ ID NO: 3695533 - RNA, 18 nt, Human
uuaucauguuaguaauac

SEQ ID NO: 3695534 - RNA, 12 nt, Human
uuaucauuuuca

SEQ ID NO: 3695535 - RNA, 22 nt, Human
uuauccaaaaguggaagugaca

SEQ ID NO: 3695536 - RNA, 19 nt, Human
uuauccauuuguaauuaaa

SEQ ID NO: 3695537 - RNA, 13 nt, Human
uuaucccugccca

SEQ ID NO: 3695538 - RNA, 16 nt, Human
uuaucccuuaagaaug

SEQ ID NO: 3695539 - RNA, 21 nt, Human
uuauccucugaucuccauggc

SEQ ID NO: 3695540 - RNA, 11 nt, Human
uuauccucugu

SEQ ID NO: 3695541 - RNA, 20 nt, Human
uuauccucuuuagaguuaga

SEQ ID NO: 3695542 - RNA, 16 nt, Human
uuauccugaaauuuca

SEQ ID NO: 3695543 - RNA, 22 nt, Human
uuauccugaacucuucugcaaa

SEQ ID NO: 3695544 - RNA, 15 nt, Human
uuaucgaaauaacaa

SEQ ID NO: 3695545 - RNA, 21 nt, Human
uuaucgaaauaacaauguuaa

SEQ ID NO: 3695546 - RNA, 21 nt, Human
uuaucgccuuuugacagcugu

SEQ ID NO: 3695547 - RNA, 14 nt, Human
uuaucggaagcagu

SEQ ID NO: 3695548 - RNA, 14 nt, Human
uuaucgggaacagu

SEQ ID NO: 3695549 - RNA, 11 nt, Human
uagauagaaau

SEQ ID NO: 3695550 - RNA, 12 nt, Human
uagauagaaaua

SEQ ID NO: 3695551 - RNA, 23 nt, Human
uagauagaaauaaauagcuauau

SEQ ID NO: 3695552 - RNA, 19 nt, Human
uagauagcagccuggcucc

SEQ ID NO: 3695553 - RNA, 17 nt, Human
uagauagcccuguccug

SEQ ID NO: 3695554 - RNA, 19 nt, Human
uagauagcccuguccuggu

SEQ ID NO: 3695555 - RNA, 14 nt, Human
uagauaggccaugg

SEQ ID NO: 3695556 - RNA, 17 nt, Human
uagauaggccaugggca

SEQ ID NO: 3695557 - RNA, 13 nt, Human
uagauagggcugg

SEQ ID NO: 3695558 - RNA, 16 nt, Human
uagauagguaaauacc

SEQ ID NO: 3695559 - RNA, 13 nt, Human
uagauauaaugaa

SEQ ID NO: 3695560 - RNA, 14 nt, Human
uagauauaaugaac

SEQ ID NO: 3695561 - RNA, 23 nt, Human
uagauauaaugaacaaaauuauu

SEQ ID NO: 3695562 - RNA, 15 nt, Human
uagauauccucugcu

SEQ ID NO: 3695563 - RNA, 15 nt, Human
uagauauuacuuuau

SEQ ID NO: 3695564 - RNA, 13 nt, Human
uagauauuuggcu

SEQ ID NO: 3695565 - RNA, 17 nt, Human
uagauauuuggcuuaaa

SEQ ID NO: 3695566 - RNA, 12 nt, Human
uagauauuuuca

SEQ ID NO: 3695567 - RNA, 15 nt, Human
uagauauuuucacaa

SEQ ID NO: 3695568 - RNA, 17 nt, Human
uagaucaaauacuuuaa

SEQ ID NO: 3695569 - RNA, 17 nt, Human
uagaucacauaacagaa

SEQ ID NO: 3695570 - RNA, 20 nt, Human
uagaucacauaacagaaugc

SEQ ID NO: 3695571 - RNA, 19 nt, Human
uagaucagaugcuccaaga

SEQ ID NO: 3695572 - RNA, 14 nt, Human
uagaucauaaggcu

SEQ ID NO: 3695573 - RNA, 13 nt, Human
uagaucauaguuu

SEQ ID NO: 3695574 - RNA, 17 nt, Human
uagaucauaguuuuauu

SEQ ID NO: 3695575 - RNA, 21 nt, Human
uagauccauuuccauugcuua

SEQ ID NO: 3695576 - RNA, 17 nt, Human
uagauccuaagaugugu

SEQ ID NO: 3695577 - RNA, 21 nt, Human
uagauccuaagauguguucuu

SEQ ID NO: 3695578 - RNA, 19 nt, Human
uagaucuccaggagaacug

SEQ ID NO: 3695579 - RNA, 13 nt, Human
uagaucucugaag

SEQ ID NO: 3695580 - RNA, 16 nt, Human
uagaucuggcauguua

SEQ ID NO: 3695581 - RNA, 15 nt, Human
uagaugaacucaacu

SEQ ID NO: 3695582 - RNA, 18 nt, Human
uagaugacauugacuauu

SEQ ID NO: 3695583 - RNA, 20 nt, Human
uagaugagaauucagcugcc

SEQ ID NO: 3695584 - RNA, 23 nt, Human
uagaugagcccagcccuguucug

SEQ ID NO: 3695585 - RNA, 12 nt, Human
uagaugauaaag

SEQ ID NO: 3695586 - RNA, 14 nt, Human
uagaugauguauuu

SEQ ID NO: 3695587 - RNA, 21 nt, Human
uagaugauuaaauaagauucu

SEQ ID NO: 3695588 - RNA, 18 nt, Human
uagaugauuucaguucua

SEQ ID NO: 3695589 - RNA, 22 nt, Human
uagaugauuucaguucuaggaa

SEQ ID NO: 3695590 - RNA, 15 nt, Human
uagaugcaguucuga

SEQ ID NO: 3695591 - RNA, 20 nt, Human
uagaugcauuuggguccagg

SEQ ID NO: 3695592 - RNA, 22 nt, Human
uagaugcauuuggguccaggag

SEQ ID NO: 3695593 - RNA, 23 nt, Human
uagaugcauuuggguccaggagg

SEQ ID NO: 3695594 - RNA, 16 nt, Human
uagaugccugaacuug

SEQ ID NO: 3695595 - RNA, 17 nt, Human
uagaugcgcagccccau

SEQ ID NO: 3695596 - RNA, 16 nt, Human
uagaugcuacuaagaa

SEQ ID NO: 3695597 - RNA, 10 nt, Human
uagaugcuga

SEQ ID NO: 3695598 - RNA, 23 nt, Human
uagaugcugacuguacuccuccc

SEQ ID NO: 3695599 - RNA, 15 nt, Human
uagaugcuggcccag

SEQ ID NO: 3695600 - RNA, 16 nt, Human
uagaugcuggcccagg

SEQ ID NO: 3695601 - RNA, 22 nt, Human
uagaugcuggcccagggcccag

SEQ ID NO: 3695602 - RNA, 14 nt, Human
uagauggugaaauu

SEQ ID NO: 3695603 - RNA, 16 nt, Human
uagaugguuacacugu

SEQ ID NO: 3695604 - RNA, 20 nt, Human
uagaugguuacacuguuaga

SEQ ID NO: 3695605 - RNA, 15 nt, Human
uagauguaguauuuu

SEQ ID NO: 3695606 - RNA, 17 nt, Human
uagauguaguauuuuuu

SEQ ID NO: 3695607 - RNA, 19 nt, Human
uagauguaugcacacacau

SEQ ID NO: 3695608 - RNA, 16 nt, Human
uagauguauguacuuc

SEQ ID NO: 3695609 - RNA, 18 nt, Human
uagaugucccuuucuugg

SEQ ID NO: 3695610 - RNA, 23 nt, Human
uagaugucccuuucuuggccagu

SEQ ID NO: 3695611 - RNA, 19 nt, Human
uagaugugauuuaauagug

SEQ ID NO: 3695612 - RNA, 22 nt, Human
uagaugugcauuuuugugaaau

SEQ ID NO: 3695613 - RNA, 21 nt, Human
uagauguucuaagucuuucca

SEQ ID NO: 3695614 - RNA, 15 nt, Human
uagauguucuacuuu

SEQ ID NO: 3695615 - RNA, 21 nt, Human
uagauguucucuaucauuuaa

SEQ ID NO: 3695616 - RNA, 22 nt, Human
uagauguucucuaucauuuaau

SEQ ID NO: 3695617 - RNA, 21 nt, Human
uagauguuuauucuucuagag

SEQ ID NO: 3695618 - RNA, 16 nt, Human
uagauguuuugguaga

SEQ ID NO: 3695619 - RNA, 21 nt, Human
uagauguuuugguagauuaaa

SEQ ID NO: 3695620 - RNA, 20 nt, Human
uagauuaaauauagauuaga

SEQ ID NO: 3695621 - RNA, 18 nt, Human
uagauuaaaucauacucc

SEQ ID NO: 3695622 - RNA, 15 nt, Human
uagauuaauggcacu

SEQ ID NO: 3695623 - RNA, 16 nt, Human
uagauuagaauucugu

SEQ ID NO: 3695624 - RNA, 16 nt, Human
uagauuagcucuggac

SEQ ID NO: 3695625 - RNA, 21 nt, Human
uagauuaguacuggauuauuc

SEQ ID NO: 3695626 - RNA, 21 nt, Human
uagauuauauugagacaaaaa

SEQ ID NO: 3695627 - RNA, 13 nt, Human
uagauucaaaggu

SEQ ID NO: 3695628 - RNA, 16 nt, Human
uagauucaaagguucu

SEQ ID NO: 3695629 - RNA, 17 nt, Human
uagauucaaagguucua

SEQ ID NO: 3695630 - RNA, 22 nt, Human
uagauucaccuguaaaacuuua

SEQ ID NO: 3695631 - RNA, 16 nt, Human
uagauuccauuuacug

SEQ ID NO: 3695632 - RNA, 15 nt, Human
uagauucuaaagauu

SEQ ID NO: 3695633 - RNA, 23 nt, Human
uagauucucuggcuguaaggcuc

SEQ ID NO: 3695634 - RNA, 23 nt, Human
uagauucucugugucuaagauuc

SEQ ID NO: 3695635 - RNA, 21 nt, Human
uagauugaaaacuuuucucag

SEQ ID NO: 3695636 - RNA, 16 nt, Human
uagauugcuucuguag

SEQ ID NO: 3695637 - RNA, 18 nt, Human
uagauuguccuuuugcaa

SEQ ID NO: 3695638 - RNA, 13 nt, Human
uagauuuaauaua

SEQ ID NO: 3695639 - RNA, 23 nt, Human
uagauuucauaguucagaauuua

SEQ ID NO: 3695640 - RNA, 23 nt, Human
uagauuucucacacucuaacugu

SEQ ID NO: 3695641 - RNA, 13 nt, Human
uagauuugaccua

SEQ ID NO: 3695642 - RNA, 14 nt, Human
uagauuugaccucc

SEQ ID NO: 3695643 - RNA, 24 nt, Human
uagauuuggcuccucugcuucuca

SEQ ID NO: 3695644 - RNA, 20 nt, Human
uagauuugugugcaucaggc

SEQ ID NO: 3695645 - RNA, 13 nt, Human
uagauuuguuuug

SEQ ID NO: 3695646 - RNA, 14 nt, Human
uagauuuguuuugu

SEQ ID NO: 3695647 - RNA, 17 nt, Human
uagauuuuacaugaagu

SEQ ID NO: 3695648 - RNA, 17 nt, Human
uagauuuuauuuuacua

SEQ ID NO: 3695649 - RNA, 12 nt, Human
uagauuuuccaa

SEQ ID NO: 3695650 - RNA, 13 nt, Human
uagauuuuccaaa

SEQ ID NO: 3695651 - RNA, 14 nt, Human
uagauuuucugguu

SEQ ID NO: 3695652 - RNA, 17 nt, Human
uagauuuucugguucua

SEQ ID NO: 3695653 - RNA, 19 nt, Human
uagauuuucugguucuaac

SEQ ID NO: 3695654 - RNA, 21 nt, Human
uagauuuucugguucuaacau

SEQ ID NO: 3695655 - RNA, 15 nt, Human
uagauuuucuuuaaa

SEQ ID NO: 3695656 - RNA, 23 nt, Human
uagauuuuguuuugcuuuuucug

SEQ ID NO: 3695657 - RNA, 18 nt, Human
uagcaaaaaguggggcag

SEQ ID NO: 3695658 - RNA, 23 nt, Human
uagcaaaacgcauggagugugua

SEQ ID NO: 3695659 - RNA, 16 nt, Human
uagcaaaacuuuuaaa

SEQ ID NO: 3695660 - RNA, 21 nt, Human
uagcaaaacuuuuaaacuaca

SEQ ID NO: 3695661 - RNA, 14 nt, Human
uagcaaaagaagua

SEQ ID NO: 3695662 - RNA, 17 nt, Human
uagcaaaagaaguaaca

SEQ ID NO: 3695663 - RNA, 23 nt, Human
uagcaaaauaaaacauagcaaau

SEQ ID NO: 3695664 - RNA, 17 nt, Human
uagcaaacccugucaaa

SEQ ID NO: 3695665 - RNA, 12 nt, Human
uagcaaagaauu

SEQ ID NO: 3695666 - RNA, 21 nt, Human
uagcaaagcggguuauaauga

SEQ ID NO: 3695667 - RNA, 16 nt, Human
uagcaacaacaauugg

SEQ ID NO: 3695668 - RNA, 19 nt, Human
uagcaacaacaauugguaa

SEQ ID NO: 3695669 - RNA, 17 nt, Human
uagcaagacacaucccu

SEQ ID NO: 3695670 - RNA, 24 nt, Human
uagcaagauugcuuaaaauagcaa

SEQ ID NO: 3695671 - RNA, 15 nt, Human
uagcaagcuggccuc

SEQ ID NO: 3695672 - RNA, 16 nt, Human
uagcaagcuggccucu

SEQ ID NO: 3695673 - RNA, 19 nt, Human
uagcaaggucauuucuuca

SEQ ID NO: 3695674 - RNA, 18 nt, Human
uagcaagugaauuuuucu

SEQ ID NO: 3695675 - RNA, 18 nt, Human
uagcaaguuacagugaug

SEQ ID NO: 3695676 - RNA, 15 nt, Human
uagcacagacccugc

SEQ ID NO: 3695677 - RNA, 17 nt, Human
uagcacagacccugccc

SEQ ID NO: 3695678 - RNA, 20 nt, Human
uagcacagacccugcccugu

SEQ ID NO: 3695679 - RNA, 22 nt, Human
uagcacagacccugcccugugg

SEQ ID NO: 3695680 - RNA, 14 nt, Human
uagcacagauuuua

SEQ ID NO: 3695681 - RNA, 22 nt, Human
uagcacagauuuuaauugucau

SEQ ID NO: 3695682 - RNA, 20 nt, Human
uagcacagcguuaugugucu

SEQ ID NO: 3695683 - RNA, 12 nt, Human
uagcacagcucc

SEQ ID NO: 3695684 - RNA, 13 nt, Human
uagcacagcuccc

SEQ ID NO: 3695685 - RNA, 15 nt, Human
uagcacaggcugagu

SEQ ID NO: 3695686 - RNA, 19 nt, Human
uagcacaggcugagugcag

SEQ ID NO: 3695687 - RNA, 18 nt, Human
uagcacaggggggccgcc

SEQ ID NO: 3695688 - RNA, 18 nt, Human
uagcacauaaacuuuggg

SEQ ID NO: 3695689 - RNA, 14 nt, Human
uagcaccagggaag

SEQ ID NO: 3695690 - RNA, 13 nt, Human
uagcaccagggac

SEQ ID NO: 3695691 - RNA, 20 nt, Human
uagcacguuuaaaguucugu

SEQ ID NO: 3695692 - RNA, 16 nt, Human
uagcacuaccacuccu

SEQ ID NO: 3695693 - RNA, 14 nt, Human
uagcacuaggcacc

SEQ ID NO: 3695694 - RNA, 16 nt, Human
uagcacuaggcaccca

SEQ ID NO: 3695695 - RNA, 18 nt, Human
uagcacucacaugcugga

SEQ ID NO: 3695696 - RNA, 19 nt, Human
uagcacugacagauuucca

SEQ ID NO: 3695697 - RNA, 13 nt, Human
uagcacugagcaa

SEQ ID NO: 3695698 - RNA, 15 nt, Human
uugaaauuuugcaaa

SEQ ID NO: 3695699 - RNA, 17 nt, Human
uugaaauuuugcaaaua

SEQ ID NO: 3695700 - RNA, 20 nt, Human
uugaaauuuugcaaauauaa

SEQ ID NO: 3695701 - RNA, 21 nt, Human
uugaaauuuuuauuaaauuau

SEQ ID NO: 3695702 - RNA, 14 nt, Human
uugaacacaaacug

SEQ ID NO: 3695703 - RNA, 15 nt, Human
uugaacacaaacugu

SEQ ID NO: 3695704 - RNA, 14 nt, Human
uugaacacaguauu

SEQ ID NO: 3695705 - RNA, 15 nt, Human
uugaacauguggcuu

SEQ ID NO: 3695706 - RNA, 18 nt, Human
uugaaccaaaacauuccg

SEQ ID NO: 3695707 - RNA, 17 nt, Human
uugaaccauaaaauguc

SEQ ID NO: 3695708 - RNA, 14 nt, Human
uugaaccauaguua

SEQ ID NO: 3695709 - RNA, 21 nt, Human
uugaaccauccacuuacauau

SEQ ID NO: 3695710 - RNA, 18 nt, Human
uugaacccgggaggcaga

SEQ ID NO: 3695711 - RNA, 19 nt, Human
uugaacccgggaggcagag

SEQ ID NO: 3695712 - RNA, 13 nt, Human
uugaaccuauuuc

SEQ ID NO: 3695713 - RNA, 19 nt, Human
uugaaccugaugaaaauaa

SEQ ID NO: 3695714 - RNA, 21 nt, Human
uugaaccugugaguaaauauu

SEQ ID NO: 3695715 - RNA, 22 nt, Human
uugaacgcccccccccaccccu

SEQ ID NO: 3695716 - RNA, 16 nt, Human
uugaacguuuucuaau

SEQ ID NO: 3695717 - RNA, 20 nt, Human
uugaacguuuucuaauugcu

SEQ ID NO: 3695718 - RNA, 18 nt, Human
uugaacuaagaaacuuuu

SEQ ID NO: 3695719 - RNA, 19 nt, Human
uugaacuaagaaacuuuug

SEQ ID NO: 3695720 - RNA, 16 nt, Human
uugaacucuucucauu

SEQ ID NO: 3695721 - RNA, 19 nt, Human
uugaacucuucucauuacu

SEQ ID NO: 3695722 - RNA, 15 nt, Human
uugaacugagcuugg

SEQ ID NO: 3695723 - RNA, 21 nt, Human
uugaacugauaguuacuguug

SEQ ID NO: 3695724 - RNA, 17 nt, Human
uugaacuguuagaaugu

SEQ ID NO: 3695725 - RNA, 18 nt, Human
uugaacuuccugcaggua

SEQ ID NO: 3695726 - RNA, 22 nt, Human
uugaacuuuccuggaugucuga

SEQ ID NO: 3695727 - RNA, 15 nt, Human
uugaacuuugaccuc

SEQ ID NO: 3695728 - RNA, 18 nt, Human
uugaacuuugaccucugc

SEQ ID NO: 3695729 - RNA, 22 nt, Human
uugaacuuugaccucugcagca

SEQ ID NO: 3695730 - RNA, 23 nt, Human
uugaacuuuuguacugaauuuuu

SEQ ID NO: 3695731 - RNA, 22 nt, Human
uugaagaaauuauaaagauaaa

SEQ ID NO: 3695732 - RNA, 16 nt, Human
uugaagaacugcaggc

SEQ ID NO: 3695733 - RNA, 22 nt, Human
uugaagaagguggaccuuuuaa

SEQ ID NO: 3695734 - RNA, 16 nt, Human
uugaagaaugaacaaa

SEQ ID NO: 3695735 - RNA, 15 nt, Human
uugaagaauguuaag

SEQ ID NO: 3695736 - RNA, 17 nt, Human
uugaagacaaaaauacu

SEQ ID NO: 3695737 - RNA, 13 nt, Human
uugaagacaauuu

SEQ ID NO: 3695738 - RNA, 16 nt, Human
uugaagacaauuugau

SEQ ID NO: 3695739 - RNA, 22 nt, Human
uugaagacaauuugauacauaa

SEQ ID NO: 3695740 - RNA, 19 nt, Human
uugaagacuuuucuuucag

SEQ ID NO: 3695741 - RNA, 17 nt, Human
uugaagagagagcugag

SEQ ID NO: 3695742 - RNA, 22 nt, Human
uugaagaggaaaaugaauaaua

SEQ ID NO: 3695743 - RNA, 22 nt, Human
uugaagauaucuugaaaugaaa

SEQ ID NO: 3695744 - RNA, 12 nt, Human
uugaagcagagu

SEQ ID NO: 3695745 - RNA, 19 nt, Human
uugaagcauagauaauauu

SEQ ID NO: 3695746 - RNA, 17 nt, Human
uugaagcauuuuauaaa

SEQ ID NO: 3695747 - RNA, 13 nt, Human
uugaagccacuga

SEQ ID NO: 3695748 - RNA, 21 nt, Human
uugaagccugcccuugucuga

SEQ ID NO: 3695749 - RNA, 15 nt, Human
uugaagccugcuccu

SEQ ID NO: 3695750 - RNA, 19 nt, Human
uugaagcuaauuauuuuaa

SEQ ID NO: 3695751 - RNA, 23 nt, Human
uugaagcucuggugacaccagcc

SEQ ID NO: 3695752 - RNA, 16 nt, Human
uugaaggaauacaaua

SEQ ID NO: 3695753 - RNA, 18 nt, Human
uugaaggaauacaauaua

SEQ ID NO: 3695754 - RNA, 14 nt, Human
uugaaggacuaaua

SEQ ID NO: 3695755 - RNA, 16 nt, Human
uugaaggaugcugucu

SEQ ID NO: 3695756 - RNA, 15 nt, Human
uugaagggcccagga

SEQ ID NO: 3695757 - RNA, 23 nt, Human
uugaaggugcugacggccaggga

SEQ ID NO: 3695758 - RNA, 14 nt, Human
uugaagguuuuuga

SEQ ID NO: 3695759 - RNA, 16 nt, Human
uugaagguuuuugaua

SEQ ID NO: 3695760 - RNA, 16 nt, Human
uugaaguaaugaauuu

SEQ ID NO: 3695761 - RNA, 12 nt, Human
uugaaguauuua

SEQ ID NO: 3695762 - RNA, 15 nt, Human
uugaagucaugcucc

SEQ ID NO: 3695763 - RNA, 19 nt, Human
uugaagucuauaaaaaaua

SEQ ID NO: 3695764 - RNA, 18 nt, Human
uugaagucuuuaauaaau

SEQ ID NO: 3695765 - RNA, 18 nt, Human
uugaaguggccagaugag

SEQ ID NO: 3695766 - RNA, 21 nt, Human
uugaaguuguuacuaacuaaa

SEQ ID NO: 3695767 - RNA, 15 nt, Human
uugaaguuuacauuu

SEQ ID NO: 3695768 - RNA, 22 nt, Human
uugaaguuucaaguuuuaaagu

SEQ ID NO: 3695769 - RNA, 17 nt, Human
uugaauaaaaaccuuuu

SEQ ID NO: 3695770 - RNA, 14 nt, Human
uugaauaaaagugc

SEQ ID NO: 3695771 - RNA, 23 nt, Human
uugaauaaacaccacuggauuaa

SEQ ID NO: 3695772 - RNA, 21 nt, Human
uugaauaaagccugcuuuuua

SEQ ID NO: 3695773 - RNA, 19 nt, Human
uugaauaaugguaccagau

SEQ ID NO: 3695774 - RNA, 16 nt, Human
uugaauaccauuaaaa

SEQ ID NO: 3695775 - RNA, 14 nt, Human
uugaauacuugaac

SEQ ID NO: 3695776 - RNA, 19 nt, Human
uugaauacuuugaaugugu

SEQ ID NO: 3695777 - RNA, 13 nt, Human
uugaauacuuuuu

SEQ ID NO: 3695778 - RNA, 15 nt, Human
uugaauauaaacacu

SEQ ID NO: 3695779 - RNA, 16 nt, Human
uugaauauaaacacua

SEQ ID NO: 3695780 - RNA, 18 nt, Human
uugaauauaaacacuaua

SEQ ID NO: 3695781 - RNA, 13 nt, Human
uugaauauaugau

SEQ ID NO: 3695782 - RNA, 19 nt, Human
uugaauauauuauaaucuu

SEQ ID NO: 3695783 - RNA, 15 nt, Human
uugaauaugauuaaa

SEQ ID NO: 3695784 - RNA, 15 nt, Human
uugaauauggacaag

SEQ ID NO: 3695785 - RNA, 17 nt, Human
uugaauauggacaagag

SEQ ID NO: 3695786 - RNA, 13 nt, Human
uugaauauuacuc

SEQ ID NO: 3695787 - RNA, 21 nt, Human
uugaauauuacuccuauuuuu

SEQ ID NO: 3695788 - RNA, 23 nt, Human
uugaauauuacuccuauuuuugu

SEQ ID NO: 3695789 - RNA, 12 nt, Human
uugaauauugug

SEQ ID NO: 3695790 - RNA, 14 nt, Human
uugaaucaauaaua

SEQ ID NO: 3695791 - RNA, 19 nt, Human
uugaauccaugcuugggug

SEQ ID NO: 3695792 - RNA, 15 nt, Human
uugaauccucucucu

SEQ ID NO: 3695793 - RNA, 15 nt, Human
uugaaucuauuuaag

SEQ ID NO: 3695794 - RNA, 14 nt, Human
uugaaucuauuuca

SEQ ID NO: 3695795 - RNA, 14 nt, Human
uugaaucuugucuc

SEQ ID NO: 3695796 - RNA, 15 nt, Human
uugaaucuugucuca

SEQ ID NO: 3695797 - RNA, 16 nt, Human
uugaaucuugucucaa

SEQ ID NO: 3695798 - RNA, 17 nt, Human
uugaaucuugucucaau

SEQ ID NO: 3695799 - RNA, 17 nt, Human
uugaaugacaacagaag

SEQ ID NO: 3695800 - RNA, 20 nt, Human
uugaaugacaacagaagcuu

SEQ ID NO: 3695801 - RNA, 22 nt, Human
uugaaugacuaagaggaaagua

SEQ ID NO: 3695802 - RNA, 20 nt, Human
uugaaugauuuuucuuuaca

SEQ ID NO: 3695803 - RNA, 23 nt, Human
uugaaugccauagucaaagagag

SEQ ID NO: 3695804 - RNA, 15 nt, Human
uugaaugcugccagu

SEQ ID NO: 3695805 - RNA, 23 nt, Human
uugaaugcugccaguguggagug

SEQ ID NO: 3695806 - RNA, 23 nt, Human
uugaaugcuuuuugaauguuauu

SEQ ID NO: 3695807 - RNA, 20 nt, Human
uugaauggcuauguuuuuaa

SEQ ID NO: 3695808 - RNA, 15 nt, Human
uugaauggguccauu

SEQ ID NO: 3695809 - RNA, 22 nt, Human
uugaauguggcuugagaaauau

SEQ ID NO: 3695810 - RNA, 20 nt, Human
uugaauguguuucacaguuu

SEQ ID NO: 3695811 - RNA, 14 nt, Human
uugaauguuaagca

SEQ ID NO: 3695812 - RNA, 17 nt, Human
uugaauuaaaacuucuu

SEQ ID NO: 3695813 - RNA, 23 nt, Human
uugaauuaaauuaggaauaaaua

SEQ ID NO: 3695814 - RNA, 23 nt, Human
uugaauuauccacaugaaaauaa

SEQ ID NO: 3695815 - RNA, 13 nt, Human
uugaauuaucuug

SEQ ID NO: 3695816 - RNA, 18 nt, Human
uugaauuaucuugguuga

SEQ ID NO: 3695817 - RNA, 12 nt, Human
uugaauucauuu

SEQ ID NO: 3695818 - RNA, 19 nt, Human
uugaauucauuucacugua

SEQ ID NO: 3695819 - RNA, 15 nt, Human
uugaauuuaacaaug

SEQ ID NO: 3695820 - RNA, 16 nt, Human
uugaauuuaacaaugc

SEQ ID NO: 3695821 - RNA, 16 nt, Human
uugaauuuucccacug

SEQ ID NO: 3695822 - RNA, 17 nt, Human
uugaauuuucccacugc

SEQ ID NO: 3695823 - RNA, 18 nt, Human
uugaauuuugaugaacaa

SEQ ID NO: 3695824 - RNA, 16 nt, Human
uugaauuuuuccuaug

SEQ ID NO: 3695825 - RNA, 14 nt, Human
uugaauuuuucucu

SEQ ID NO: 3695826 - RNA, 16 nt, Human
uugacaaaauuuguug

SEQ ID NO: 3695827 - RNA, 13 nt, Human
uugacaaacucuc

SEQ ID NO: 3695828 - RNA, 13 nt, Human
uugacaauaaaau

SEQ ID NO: 3695829 - RNA, 16 nt, Human
uugacaauaaaauauu

SEQ ID NO: 3695830 - RNA, 19 nt, Human
uugacaauuccuagauaaa

SEQ ID NO: 3695831 - RNA, 16 nt, Human
uugacacagaaaaugu

SEQ ID NO: 3695832 - RNA, 20 nt, Human
uugacacauccgccuuuugu

SEQ ID NO: 3695833 - RNA, 23 nt, Human
uugacacauccgccuuuuguaua

SEQ ID NO: 3695834 - RNA, 19 nt, Human
uugacacuauaucuguaua

SEQ ID NO: 3695835 - RNA, 22 nt, Human
uugacacuauucacuaaaauua

SEQ ID NO: 3695836 - RNA, 17 nt, Human
uugacacugaaaguuuu

SEQ ID NO: 3695837 - RNA, 15 nt, Human
uugacacugaacuua

SEQ ID NO: 3695838 - RNA, 18 nt, Human
uugacacuggaaugaguu

SEQ ID NO: 3695839 - RNA, 17 nt, Human
uugacacuuaaaaaugg

SEQ ID NO: 3695840 - RNA, 19 nt, Human
uugacacuuuucauaucau

SEQ ID NO: 3695841 - RNA, 17 nt, Human
uugacagaacacugucu

SEQ ID NO: 3695842 - RNA, 17 nt, Human
uugacagagccugcccc

SEQ ID NO: 3695843 - RNA, 19 nt, Human
uugacagaucaagcuguga

SEQ ID NO: 3695844 - RNA, 12 nt, Human
uugacagcucag

SEQ ID NO: 3695845 - RNA, 14 nt, Human
uugacagcuuugcu

SEQ ID NO: 3695846 - RNA, 17 nt, Human
uugacagcuuugcugcu

SEQ ID NO: 3695847 - RNA, 16 nt, Human
uuaucgggagcagugu

SEQ ID NO: 3695848 - RNA, 21 nt, Human
uuaucgggagcagugucuucc

SEQ ID NO: 3695849 - RNA, 17 nt, Human
uuaucguccagugacuu

SEQ ID NO: 3695850 - RNA, 15 nt, Human
uuaucuaaaagaaau

SEQ ID NO: 3695851 - RNA, 15 nt, Human
uuaucuaaauuaaag

SEQ ID NO: 3695852 - RNA, 19 nt, Human
uuaucuaagaauacagcuu

SEQ ID NO: 3695853 - RNA, 17 nt, Human
uuaucuaauuuauaaaa

SEQ ID NO: 3695854 - RNA, 20 nt, Human
uuaucuaccaacuuucaaga

SEQ ID NO: 3695855 - RNA, 21 nt, Human
uuaucuacccaagggcagaaa

SEQ ID NO: 3695856 - RNA, 23 nt, Human
uuaucuacccaagggcagaaagu

SEQ ID NO: 3695857 - RNA, 19 nt, Human
uuaucuacuuccaaacuaa

SEQ ID NO: 3695858 - RNA, 17 nt, Human
uuaucuagauacuguau

SEQ ID NO: 3695859 - RNA, 15 nt, Human
uuaucuagauguaaa

SEQ ID NO: 3695860 - RNA, 16 nt, Human
uuaucuagauguaaau

SEQ ID NO: 3695861 - RNA, 15 nt, Human
uuaucuauaauuuac

SEQ ID NO: 3695862 - RNA, 13 nt, Human
uuaucuauauaaa

SEQ ID NO: 3695863 - RNA, 15 nt, Human
uuaucuauauaaaau

SEQ ID NO: 3695864 - RNA, 13 nt, Human
uuaucuauuugua

SEQ ID NO: 3695865 - RNA, 21 nt, Human
uuaucuauuuguauauauaca

SEQ ID NO: 3695866 - RNA, 11 nt, Human
uuaucucaaaa

SEQ ID NO: 3695867 - RNA, 18 nt, Human
uuaucucagauauuugca

SEQ ID NO: 3695868 - RNA, 17 nt, Human
uuaucucagucaugcau

SEQ ID NO: 3695869 - RNA, 14 nt, Human
uuaucucuauuuaa

SEQ ID NO: 3695870 - RNA, 15 nt, Human
uuaucucuauuuaau

SEQ ID NO: 3695871 - RNA, 19 nt, Human
uuaucucuauuuaauauuu

SEQ ID NO: 3695872 - RNA, 17 nt, Human
uuaucugaauuuuuaaa

SEQ ID NO: 3695873 - RNA, 14 nt, Human
uuaucugaucagaa

SEQ ID NO: 3695874 - RNA, 12 nt, Human
uuaucugugaau

SEQ ID NO: 3695875 - RNA, 19 nt, Human
uuaucuguuuaaagcauau

SEQ ID NO: 3695876 - RNA, 12 nt, Human
uuaucuguuucc

SEQ ID NO: 3695877 - RNA, 16 nt, Human
uuaucuuaaaacuccu

SEQ ID NO: 3695878 - RNA, 15 nt, Human
uuaucuuaaagcacu

SEQ ID NO: 3695879 - RNA, 15 nt, Human
uuaucuuacaauauu

SEQ ID NO: 3695880 - RNA, 18 nt, Human
uuaucuuauacuguacaa

SEQ ID NO: 3695881 - RNA, 20 nt, Human
uuaucuuauacuguacaaua

SEQ ID NO: 3695882 - RNA, 22 nt, Human
uuaucuuauacuguacaauaaa

SEQ ID NO: 3695883 - RNA, 17 nt, Human
uuaucuuaugccacggg

SEQ ID NO: 3695884 - RNA, 20 nt, Human
uuaucuucaggacacucacu

SEQ ID NO: 3695885 - RNA, 19 nt, Human
uuaucuucucaaguucuaa

SEQ ID NO: 3695886 - RNA, 22 nt, Human
uuaucuucucaaguucuaagau

SEQ ID NO: 3695887 - RNA, 17 nt, Human
uuaucuugaaggaaaaa

SEQ ID NO: 3695888 - RNA, 17 nt, Human
uuaucuugauacauuca

SEQ ID NO: 3695889 - RNA, 19 nt, Human
uuaucuugggacuggguuu

SEQ ID NO: 3695890 - RNA, 17 nt, Human
uuaucuugguugaaaau

SEQ ID NO: 3695891 - RNA, 15 nt, Human
uuaucuuucgcacag

SEQ ID NO: 3695892 - RNA, 17 nt, Human
uuaucuuucgugauaaa

SEQ ID NO: 3695893 - RNA, 14 nt, Human
uuaugaaaaagaag

SEQ ID NO: 3695894 - RNA, 18 nt, Human
uuaugaaaauaaauagcu

SEQ ID NO: 3695895 - RNA, 14 nt, Human
uuaugaaauaaaga

SEQ ID NO: 3695896 - RNA, 19 nt, Human
uuaugaacacuuaaauuau

SEQ ID NO: 3695897 - RNA, 22 nt, Human
uuaugaagaaaauacuuaaaug

SEQ ID NO: 3695898 - RNA, 22 nt, Human
uuaugaagaaggugaauagcca

SEQ ID NO: 3695899 - RNA, 20 nt, Human
uuaugaaguuuaaaacagua

SEQ ID NO: 3695900 - RNA, 17 nt, Human
uuaugaauauuuauaac

SEQ ID NO: 3695901 - RNA, 18 nt, Human
uuaugaaugugaagccuu

SEQ ID NO: 3695902 - RNA, 20 nt, Human
uuaugaaugugaagccuucc

SEQ ID NO: 3695903 - RNA, 13 nt, Human
uuaugaauguuuc

SEQ ID NO: 3695904 - RNA, 15 nt, Human
uuaugacaguaauug

SEQ ID NO: 3695905 - RNA, 16 nt, Human
uuaugacaguaauugu

SEQ ID NO: 3695906 - RNA, 16 nt, Human
uuaugacaucacuugu

SEQ ID NO: 3695907 - RNA, 21 nt, Human
uuaugacaucacuuguacaaa

SEQ ID NO: 3695908 - RNA, 11 nt, Human
uuaugacucca

SEQ ID NO: 3695909 - RNA, 19 nt, Human
uuaugacuucauuaauaau

SEQ ID NO: 3695910 - RNA, 23 nt, Human
uuaugagaaacuggcaaagcaga

SEQ ID NO: 3695911 - RNA, 14 nt, Human
uuaugagaaaugua

SEQ ID NO: 3695912 - RNA, 21 nt, Human
uuaugagaaauguaaugcgau

SEQ ID NO: 3695913 - RNA, 16 nt, Human
uuaugagcagaaggaa

SEQ ID NO: 3695914 - RNA, 18 nt, Human
uuaugagcucuucauguu

SEQ ID NO: 3695915 - RNA, 14 nt, Human
uuaugagcugugag

SEQ ID NO: 3695916 - RNA, 21 nt, Human
uuaugagcugugagaagggug

SEQ ID NO: 3695917 - RNA, 13 nt, Human
uuaugagggccac

SEQ ID NO: 3695918 - RNA, 18 nt, Human
uuaugagggccacggguc

SEQ ID NO: 3695919 - RNA, 15 nt, Human
uuaugaguaacuauu

SEQ ID NO: 3695920 - RNA, 13 nt, Human
uuaugaguuuuug

SEQ ID NO: 3695921 - RNA, 23 nt, Human
uuaugaguuuuugauagcuuuau

SEQ ID NO: 3695922 - RNA, 21 nt, Human
uuaugauaaaaaauuuuguaa

SEQ ID NO: 3695923 - RNA, 23 nt, Human
uuaugauccagcagauuauucac

SEQ ID NO: 3695924 - RNA, 13 nt, Human
uuaugaucuggcc

SEQ ID NO: 3695925 - RNA, 21 nt, Human
uuaugaucuggcccuugcuua

SEQ ID NO: 3695926 - RNA, 23 nt, Human
uuaugaugaaaaccuacauauuc

SEQ ID NO: 3695927 - RNA, 23 nt, Human
uuaugaugacguacaaguaguuc

SEQ ID NO: 3695928 - RNA, 21 nt, Human
uuaugauggaagacaggaaag

SEQ ID NO: 3695929 - RNA, 23 nt, Human
uuaugauggaagacaggaaaguu

SEQ ID NO: 3695930 - RNA, 13 nt, Human
uuaugaugugcuu

SEQ ID NO: 3695931 - RNA, 17 nt, Human
uuaugaugugcuuaaca

SEQ ID NO: 3695932 - RNA, 19 nt, Human
uuaugauuaaguaaugaua

SEQ ID NO: 3695933 - RNA, 15 nt, Human
uuaugauuguuaugu

SEQ ID NO: 3695934 - RNA, 13 nt, Human
uuaugauuugggu

SEQ ID NO: 3695935 - RNA, 18 nt, Human
uuaugauuuucauaacuu

SEQ ID NO: 3695936 - RNA, 19 nt, Human
uuaugauuuuuaaagaaaa

SEQ ID NO: 3695937 - RNA, 18 nt, Human
uuaugauuuuuuuuucau

SEQ ID NO: 3695938 - RNA, 17 nt, Human
uuaugcaaaagcaagcu

SEQ ID NO: 3695939 - RNA, 21 nt, Human
uuaugcaaaagcaagcugauu

SEQ ID NO: 3695940 - RNA, 22 nt, Human
uuaugcacuaaauaugaacccu

SEQ ID NO: 3695941 - RNA, 23 nt, Human
uuaugcaggggcaaacaccugcu

SEQ ID NO: 3695942 - RNA, 15 nt, Human
uuaugcagugcugcu

SEQ ID NO: 3695943 - RNA, 16 nt, Human
uuaugcaugaaguaau

SEQ ID NO: 3695944 - RNA, 16 nt, Human
uuaugccaccugaaua

SEQ ID NO: 3695945 - RNA, 20 nt, Human
uuaugccggaugugcuuuuc

SEQ ID NO: 3695946 - RNA, 13 nt, Human
uuaugccugcuuu

SEQ ID NO: 3695947 - RNA, 17 nt, Human
uuaugccuuuuuugauc

SEQ ID NO: 3695948 - RNA, 15 nt, Human
uuaugcuauuaaagu

SEQ ID NO: 3695949 - RNA, 14 nt, Human
uuaugcucaggguc

SEQ ID NO: 3695950 - RNA, 21 nt, Human
uuaugcucuuaauugccaccu

SEQ ID NO: 3695951 - RNA, 20 nt, Human
uuaugcucuuuuuuacucau

SEQ ID NO: 3695952 - RNA, 18 nt, Human
uuaugcuguagucuuacc

SEQ ID NO: 3695953 - RNA, 14 nt, Human
uuaugcuuccagaa

SEQ ID NO: 3695954 - RNA, 15 nt, Human
uuaugcuuccagaaa

SEQ ID NO: 3695955 - RNA, 14 nt, Human
uuaugcuuuaaaca

SEQ ID NO: 3695956 - RNA, 15 nt, Human
uuauggaaaaauaaa

SEQ ID NO: 3695957 - RNA, 18 nt, Human
uuauggaacacucugaga

SEQ ID NO: 3695958 - RNA, 20 nt, Human
uuauggaacacucugagacu

SEQ ID NO: 3695959 - RNA, 22 nt, Human
uuauggaaucuaccaacuguuu

SEQ ID NO: 3695960 - RNA, 23 nt, Human
uuauggaauugauuugcauugaa

SEQ ID NO: 3695961 - RNA, 14 nt, Human
uuauggagaccucu

SEQ ID NO: 3695962 - RNA, 19 nt, Human
uuauggagucauuuuuaca

SEQ ID NO: 3695963 - RNA, 16 nt, Human
uuauggaugauuuaag

SEQ ID NO: 3695964 - RNA, 14 nt, Human
uuauggcacaucag

SEQ ID NO: 3695965 - RNA, 13 nt, Human
uuauggccucagc

SEQ ID NO: 3695966 - RNA, 23 nt, Human
uuaugggaaccccuucauccucu

SEQ ID NO: 3695967 - RNA, 19 nt, Human
uuaugggaauaauugcuuu

SEQ ID NO: 3695968 - RNA, 15 nt, Human
uuaugggccccuggc

SEQ ID NO: 3695969 - RNA, 13 nt, Human
uuaugggcugggu

SEQ ID NO: 3695970 - RNA, 13 nt, Human
uuaugggucacag

SEQ ID NO: 3695971 - RNA, 21 nt, Human
uuaugguaacugcuuucuguu

SEQ ID NO: 3695972 - RNA, 19 nt, Human
uuaugguccuaaaagcaaa

SEQ ID NO: 3695973 - RNA, 20 nt, Human
uuaugguguuucucccucuc

SEQ ID NO: 3695974 - RNA, 20 nt, Human
uuauguaaaaggccaaaccu

SEQ ID NO: 3695975 - RNA, 13 nt, Human
uuauguaaauaau

SEQ ID NO: 3695976 - RNA, 11 nt, Human
uuauguaaauc

SEQ ID NO: 3695977 - RNA, 13 nt, Human
uuauguaaauccc

SEQ ID NO: 3695978 - RNA, 21 nt, Human
uuauguaaaucccauuauuca

SEQ ID NO: 3695979 - RNA, 23 nt, Human
uuauguaaaucccauuauucaaa

SEQ ID NO: 3695980 - RNA, 13 nt, Human
uuauguaauuuca

SEQ ID NO: 3695981 - RNA, 20 nt, Human
uuauguacuaguguucuguu

SEQ ID NO: 3695982 - RNA, 12 nt, Human
uuauguacugua

SEQ ID NO: 3695983 - RNA, 18 nt, Human
uuauguacuguacuaauu

SEQ ID NO: 3695984 - RNA, 15 nt, Human
uuauguagauauuug

SEQ ID NO: 3695985 - RNA, 18 nt, Human
uuauguagauauuuggcu

SEQ ID NO: 3695986 - RNA, 15 nt, Human
uuauguagaugugca

SEQ ID NO: 3695987 - RNA, 16 nt, Human
uuauguagcacauaaa

SEQ ID NO: 3695988 - RNA, 13 nt, Human
uuauguagcucuu

SEQ ID NO: 3695989 - RNA, 15 nt, Human
uuauguaguaauuga

SEQ ID NO: 3695990 - RNA, 19 nt, Human
uuauguaguaauugacaug

SEQ ID NO: 3695991 - RNA, 13 nt, Human
uuauguauauggu

SEQ ID NO: 3695992 - RNA, 17 nt, Human
uuauguaucagaagaga

SEQ ID NO: 3695993 - RNA, 19 nt, Human
uuauguauuuccuggaugu

SEQ ID NO: 3695994 - RNA, 17 nt, Human
uuaugucaucauacaug

SEQ ID NO: 3695995 - RNA, 15 nt, Human
uuauguccacugugu

SEQ ID NO: 3695996 - RNA, 18 nt, Human
uuauguccacuguguaua

SEQ ID NO: 3695997 - RNA, 12 nt, Human
uugacagggcac

SEQ ID NO: 3695998 - RNA, 19 nt, Human
uugacagggcacaccgggc

SEQ ID NO: 3695999 - RNA, 19 nt, Human
uugacaguaacuugguuau

SEQ ID NO: 3696000 - RNA, 19 nt, Human
uugacaguguugaaaaugu

SEQ ID NO: 3696001 - RNA, 18 nt, Human
uugacaguucugaagaau

SEQ ID NO: 3696002 - RNA, 13 nt, Human
uugacaucaacug

SEQ ID NO: 3696003 - RNA, 13 nt, Human
uugacaugggaca

SEQ ID NO: 3696004 - RNA, 18 nt, Human
uugacauguacagagaac

SEQ ID NO: 3696005 - RNA, 15 nt, Human
uugacauuauagaca

SEQ ID NO: 3696006 - RNA, 13 nt, Human
uugacauucugaa

SEQ ID NO: 3696007 - RNA, 15 nt, Human
uugacauucugaaug

SEQ ID NO: 3696008 - RNA, 23 nt, Human
uugacauugaaaucuaggaaaau

SEQ ID NO: 3696009 - RNA, 15 nt, Human
uugacauuuguaguu

SEQ ID NO: 3696010 - RNA, 16 nt, Human
uugaccaagaacugca

SEQ ID NO: 3696011 - RNA, 17 nt, Human
uugaccaagaacugcau

SEQ ID NO: 3696012 - RNA, 20 nt, Human
uugaccaagcaggaagcuca

SEQ ID NO: 3696013 - RNA, 22 nt, Human
uugaccaagcaggaagcucaga

SEQ ID NO: 3696014 - RNA, 22 nt, Human
uugaccagcagaucccagcuca

SEQ ID NO: 3696015 - RNA, 19 nt, Human
uugaccauucuccaccugc

SEQ ID NO: 3696016 - RNA, 17 nt, Human
uugacccacaagaaaug

SEQ ID NO: 3696017 - RNA, 15 nt, Human
uugacccugcacccu

SEQ ID NO: 3696018 - RNA, 16 nt, Human
uugacccuugcuguga

SEQ ID NO: 3696019 - RNA, 15 nt, Human
uugaccgacagcuuu

SEQ ID NO: 3696020 - RNA, 22 nt, Human
uugaccguguuggucuguacug

SEQ ID NO: 3696021 - RNA, 18 nt, Human
uugaccuaagauuuauuu

SEQ ID NO: 3696022 - RNA, 15 nt, Human
uugaccucaggugau

SEQ ID NO: 3696023 - RNA, 21 nt, Human
uugaccucaggugauccaccc

SEQ ID NO: 3696024 - RNA, 24 nt, Human
uugaccuccucccuguuauuuuca

SEQ ID NO: 3696025 - RNA, 14 nt, Human
uugaccucugcagc

SEQ ID NO: 3696026 - RNA, 16 nt, Human
uugaccucugcagcaa

SEQ ID NO: 3696027 - RNA, 12 nt, Human
uugaccugaggc

SEQ ID NO: 3696028 - RNA, 13 nt, Human
uugaccugaggcu

SEQ ID NO: 3696029 - RNA, 17 nt, Human
uugaccugcauuguaaa

SEQ ID NO: 3696030 - RNA, 21 nt, Human
uugaccugccucccuucaugc

SEQ ID NO: 3696031 - RNA, 23 nt, Human
uugaccugccucccuucaugcau

SEQ ID NO: 3696032 - RNA, 16 nt, Human
uugaccugcuccgcug

SEQ ID NO: 3696033 - RNA, 20 nt, Human
uugaccuucauuucauguau

SEQ ID NO: 3696034 - RNA, 13 nt, Human
uugaccuuuguac

SEQ ID NO: 3696035 - RNA, 23 nt, Human
uugacgguuuuuuauuauugugg

SEQ ID NO: 3696036 - RNA, 19 nt, Human
uugacuauuuuuguuuuua

SEQ ID NO: 3696037 - RNA, 21 nt, Human
uugacuauuuuuguuuuuauu

SEQ ID NO: 3696038 - RNA, 23 nt, Human
uugacucaggauuuaaaaacugg

SEQ ID NO: 3696039 - RNA, 19 nt, Human
uugacucccaaguuuccau

SEQ ID NO: 3696040 - RNA, 12 nt, Human
uugacucugggu

SEQ ID NO: 3696041 - RNA, 19 nt, Human
uugacucuggguccuuccu

SEQ ID NO: 3696042 - RNA, 21 nt, Human
uugacucuuuugccauuaaac

SEQ ID NO: 3696043 - RNA, 20 nt, Human
uugacugaagaugcagcuca

SEQ ID NO: 3696044 - RNA, 21 nt, Human
uugacugguuuacaggcccug

SEQ ID NO: 3696045 - RNA, 20 nt, Human
uugacuguuauuuguugaga

SEQ ID NO: 3696046 - RNA, 16 nt, Human
uugacuuauuuucucu

SEQ ID NO: 3696047 - RNA, 16 nt, Human
uugacuugauuagugc

SEQ ID NO: 3696048 - RNA, 23 nt, Human
uugacuuuacgcccaucucagga

SEQ ID NO: 3696049 - RNA, 13 nt, Human
uugacuuuauaaa

SEQ ID NO: 3696050 - RNA, 23 nt, Human
uugacuuuccccaccagaugcug

SEQ ID NO: 3696051 - RNA, 11 nt, Human
uugacuuuguc

SEQ ID NO: 3696052 - RNA, 18 nt, Human
uugacuuuuauaaagcau

SEQ ID NO: 3696053 - RNA, 16 nt, Human
uugacuuuuugcauuu

SEQ ID NO: 3696054 - RNA, 11 nt, Human
uugagaaaaau

SEQ ID NO: 3696055 - RNA, 10 nt, Human
uugagaaacc

SEQ ID NO: 3696056 - RNA, 19 nt, Human
uugagaaagagcacuuaag

SEQ ID NO: 3696057 - RNA, 15 nt, Human
uugagaaaugaauaa

SEQ ID NO: 3696058 - RNA, 19 nt, Human
uugagaaaugcauauugua

SEQ ID NO: 3696059 - RNA, 18 nt, Human
uugagaacuuuauuucca

SEQ ID NO: 3696060 - RNA, 15 nt, Human
uugagaacuuuccau

SEQ ID NO: 3696061 - RNA, 13 nt, Human
uugagaagcugcu

SEQ ID NO: 3696062 - RNA, 17 nt, Human
uugagaaggagagaaag

SEQ ID NO: 3696063 - RNA, 19 nt, Human
uugagaaguuuuguacaga

SEQ ID NO: 3696064 - RNA, 23 nt, Human
uugagacaaaaauuaucuauuug

SEQ ID NO: 3696065 - RNA, 22 nt, Human
uugagacacggagcccagcccu

SEQ ID NO: 3696066 - RNA, 20 nt, Human
uugagacacugguuuacacu

SEQ ID NO: 3696067 - RNA, 16 nt, Human
uugagaccgugaagau

SEQ ID NO: 3696068 - RNA, 21 nt, Human
uugagaccgugaagauacuuu

SEQ ID NO: 3696069 - RNA, 16 nt, Human
uugagacuucaagcuu

SEQ ID NO: 3696070 - RNA, 12 nt, Human
uugagacuuuuu

SEQ ID NO: 3696071 - RNA, 15 nt, Human
uugagacuuuuuggu

SEQ ID NO: 3696072 - RNA, 13 nt, Human
uugagagagaugu

SEQ ID NO: 3696073 - RNA, 15 nt, Human
uugagagagaugugu

SEQ ID NO: 3696074 - RNA, 23 nt, Human
uugagagagauguguaauuuuuc

SEQ ID NO: 3696075 - RNA, 15 nt, Human
uugagagugugacca

SEQ ID NO: 3696076 - RNA, 18 nt, Human
uugagaguuuugucuuga

SEQ ID NO: 3696077 - RNA, 17 nt, Human
uugagauagaagaacug

SEQ ID NO: 3696078 - RNA, 20 nt, Human
uugagauauuaaugcccaga

SEQ ID NO: 3696079 - RNA, 13 nt, Human
uugagauggggau

SEQ ID NO: 3696080 - RNA, 18 nt, Human
uugagauggggauaaaau

SEQ ID NO: 3696081 - RNA, 23 nt, Human
uugagauggggauaaaaugacua

SEQ ID NO: 3696082 - RNA, 16 nt, Human
uugagauguguucaca

SEQ ID NO: 3696083 - RNA, 12 nt, Human
uugagauuagag

SEQ ID NO: 3696084 - RNA, 15 nt, Human
uugagauuguccuca

SEQ ID NO: 3696085 - RNA, 15 nt, Human
uugagcaauuucccc

SEQ ID NO: 3696086 - RNA, 20 nt, Human
uugagcaugacagccugcag

SEQ ID NO: 3696087 - RNA, 19 nt, Human
uugagccagcagacauugu

SEQ ID NO: 3696088 - RNA, 19 nt, Human
uugagcccacaaagccuua

SEQ ID NO: 3696089 - RNA, 23 nt, Human
uugagccccaaguccugaagagg

SEQ ID NO: 3696090 - RNA, 22 nt, Human
uugagcccuccccaggaauuug

SEQ ID NO: 3696091 - RNA, 18 nt, Human
uugagcccuuguuucagg

SEQ ID NO: 3696092 - RNA, 20 nt, Human
uugagccgggccccugggcu

SEQ ID NO: 3696093 - RNA, 21 nt, Human
uugagccuaaaaauaaagcac

SEQ ID NO: 3696094 - RNA, 11 nt, Human
uugagccuggg

SEQ ID NO: 3696095 - RNA, 14 nt, Human
uugagccugggagg

SEQ ID NO: 3696096 - RNA, 19 nt, Human
uugagcuacuggauucuua

SEQ ID NO: 3696097 - RNA, 15 nt, Human
uugagcuauugcugu

SEQ ID NO: 3696098 - RNA, 15 nt, Human
uugagcucucugccc

SEQ ID NO: 3696099 - RNA, 14 nt, Human
uugagcugagaugg

SEQ ID NO: 3696100 - RNA, 20 nt, Human
uugagcugcuuuuuuugaaa

SEQ ID NO: 3696101 - RNA, 16 nt, Human
uugagcuuaaucuuug

SEQ ID NO: 3696102 - RNA, 18 nt, Human
uugagcuuagugaaauua

SEQ ID NO: 3696103 - RNA, 14 nt, Human
uugagcuuuccaug

SEQ ID NO: 3696104 - RNA, 20 nt, Human
uugaggaaaaauaugugaag

SEQ ID NO: 3696105 - RNA, 18 nt, Human
uugaggaaacaacagcuu

SEQ ID NO: 3696106 - RNA, 11 nt, Human
uugaggacaca

SEQ ID NO: 3696107 - RNA, 14 nt, Human
uugaggacacaugu

SEQ ID NO: 3696108 - RNA, 15 nt, Human
uugaggacuucuugc

SEQ ID NO: 3696109 - RNA, 15 nt, Human
uugaggagcauguuu

SEQ ID NO: 3696110 - RNA, 21 nt, Human
uugaggagcauguuuuguaua

SEQ ID NO: 3696111 - RNA, 13 nt, Human
uugaggaguguga

SEQ ID NO: 3696112 - RNA, 21 nt, Human
uugaggauauauuuucacuuu

SEQ ID NO: 3696113 - RNA, 18 nt, Human
uugaggauuaguuuagaa

SEQ ID NO: 3696114 - RNA, 18 nt, Human
uugaggauuuagaagugu

SEQ ID NO: 3696115 - RNA, 16 nt, Human
uugaggauuuugagua

SEQ ID NO: 3696116 - RNA, 20 nt, Human
uugaggccaagaauauugca

SEQ ID NO: 3696117 - RNA, 19 nt, Human
uugaggccugcccucaggg

SEQ ID NO: 3696118 - RNA, 14 nt, Human
uugaggcugcagcg

SEQ ID NO: 3696119 - RNA, 20 nt, Human
uugaggcuuauauuugugua

SEQ ID NO: 3696120 - RNA, 14 nt, Human
uugagggcccagag

SEQ ID NO: 3696121 - RNA, 21 nt, Human
uugagggcccagagcaggaag

SEQ ID NO: 3696122 - RNA, 13 nt, Human
uugagggcugcag

SEQ ID NO: 3696123 - RNA, 14 nt, Human
uugaggggaccagg

SEQ ID NO: 3696124 - RNA, 17 nt, Human
uugaggggaccaggagu

SEQ ID NO: 3696125 - RNA, 16 nt, Human
uugaggggauuaauau

SEQ ID NO: 3696126 - RNA, 16 nt, Human
uugaggggcuccugga

SEQ ID NO: 3696127 - RNA, 18 nt, Human
uugaggguauguuuuaua

SEQ ID NO: 3696128 - RNA, 16 nt, Human
uugagguaaagauaug

SEQ ID NO: 3696129 - RNA, 19 nt, Human
uugagguacucugcacaua

SEQ ID NO: 3696130 - RNA, 21 nt, Human
uugagguagaccaggauuucu

SEQ ID NO: 3696131 - RNA, 16 nt, Human
uugaggucaaguaaga

SEQ ID NO: 3696132 - RNA, 22 nt, Human
uugaggucaaguaagaagacau

SEQ ID NO: 3696133 - RNA, 13 nt, Human
uugaggucucagc

SEQ ID NO: 3696134 - RNA, 15 nt, Human
uugaggucuguucuu

SEQ ID NO: 3696135 - RNA, 17 nt, Human
uugaggucuuuugacau

SEQ ID NO: 3696136 - RNA, 23 nt, Human
uugaggucuuuugacauguggaa

SEQ ID NO: 3696137 - RNA, 12 nt, Human
uugaguaaaaua

SEQ ID NO: 3696138 - RNA, 18 nt, Human
uugaguaaaauaaauauu

SEQ ID NO: 3696139 - RNA, 15 nt, Human
uugaguagacacauu

SEQ ID NO: 3696140 - RNA, 20 nt, Human
uugaguagagagcaagggaa

SEQ ID NO: 3696141 - RNA, 13 nt, Human
uugaguagauauu

SEQ ID NO: 3696142 - RNA, 21 nt, Human
uugaguagauauuacuuuauc

SEQ ID NO: 3696143 - RNA, 16 nt, Human
uugagucaaaaaaucu

SEQ ID NO: 3696144 - RNA, 15 nt, Human
uugagucccuuccag

SEQ ID NO: 3696145 - RNA, 12 nt, Human
uugagugauuau

SEQ ID NO: 3696146 - RNA, 14 nt, Human
uugagugucaagcu

SEQ ID NO: 3696147 - RNA, 13 nt, Human
uagcacuggccug

SEQ ID NO: 3696148 - RNA, 15 nt, Human
uagcacuggccugca

SEQ ID NO: 3696149 - RNA, 20 nt, Human
uagcacuguugauguaucug

SEQ ID NO: 3696150 - RNA, 17 nt, Human
uagcacuuauguuacug

SEQ ID NO: 3696151 - RNA, 20 nt, Human
uagcacuuccuugccagucu

SEQ ID NO: 3696152 - RNA, 17 nt, Human
uagcacuuucauugcca

SEQ ID NO: 3696153 - RNA, 17 nt, Human
uagcacuuugaaauacc

SEQ ID NO: 3696154 - RNA, 21 nt, Human
uagcagaagaaaggaacauuu

SEQ ID NO: 3696155 - RNA, 13 nt, Human
uagcagacaggcc

SEQ ID NO: 3696156 - RNA, 15 nt, Human
uagcagacaguguuu

SEQ ID NO: 3696157 - RNA, 22 nt, Human
uagcagagggguaagagaggau

SEQ ID NO: 3696158 - RNA, 12 nt, Human
uagcagaugguu

SEQ ID NO: 3696159 - RNA, 21 nt, Human
uagcagcaaaaauauaaaaua

SEQ ID NO: 3696160 - RNA, 19 nt, Human
uagcagcaccguucugugc

SEQ ID NO: 3696161 - RNA, 20 nt, Human
uagcagcccucaauugugaa

SEQ ID NO: 3696162 - RNA, 21 nt, Human
uagcagcccucaauugugaaa

SEQ ID NO: 3696163 - RNA, 21 nt, Human
uagcagccuggcuccccuggg

SEQ ID NO: 3696164 - RNA, 10 nt, Human
uagcagcugg

SEQ ID NO: 3696165 - RNA, 17 nt, Human
uagcaggagaggagagc

SEQ ID NO: 3696166 - RNA, 19 nt, Human
uagcaggagaggagagcca

SEQ ID NO: 3696167 - RNA, 14 nt, Human
uagcagggaaaaua

SEQ ID NO: 3696168 - RNA, 20 nt, Human
uagcaguaaaagaugaaguu

SEQ ID NO: 3696169 - RNA, 13 nt, Human
uagcaguaaaaua

SEQ ID NO: 3696170 - RNA, 16 nt, Human
uagcaguccccuuccc

SEQ ID NO: 3696171 - RNA, 17 nt, Human
uagcagugagucauauc

SEQ ID NO: 3696172 - RNA, 13 nt, Human
uagcagugauuuu

SEQ ID NO: 3696173 - RNA, 15 nt, Human
uagcagugauuuuua

SEQ ID NO: 3696174 - RNA, 20 nt, Human
uagcagugucuguaaaagag

SEQ ID NO: 3696175 - RNA, 14 nt, Human
uagcaguucugcaa

SEQ ID NO: 3696176 - RNA, 17 nt, Human
uagcaguucugcaaaua

SEQ ID NO: 3696177 - RNA, 23 nt, Human
uagcauaaacacaucacagauga

SEQ ID NO: 3696178 - RNA, 15 nt, Human
uagcauacauuuaua

SEQ ID NO: 3696179 - RNA, 21 nt, Human
uagcauacauuuauaauguuu

SEQ ID NO: 3696180 - RNA, 16 nt, Human
uagcauacguacacau

SEQ ID NO: 3696181 - RNA, 14 nt, Human
uagcauaucugccu

SEQ ID NO: 3696182 - RNA, 18 nt, Human
uagcauaucugccuuuau

SEQ ID NO: 3696183 - RNA, 21 nt, Human
uagcauaucugccuuuauugu

SEQ ID NO: 3696184 - RNA, 23 nt, Human
uagcauaucugccuuuauugugu

SEQ ID NO: 3696185 - RNA, 14 nt, Human
uagcauaugacaaa

SEQ ID NO: 3696186 - RNA, 18 nt, Human
uagcauaugacaaauguu

SEQ ID NO: 3696187 - RNA, 23 nt, Human
uagcaucacuuaaaacacguuuu

SEQ ID NO: 3696188 - RNA, 18 nt, Human
uagcauccuggaauaucu

SEQ ID NO: 3696189 - RNA, 17 nt, Human
uagcaucuguacaaagg

SEQ ID NO: 3696190 - RNA, 16 nt, Human
uagcaugaagacagag

SEQ ID NO: 3696191 - RNA, 22 nt, Human
uagcaugacaagccccaggcag

SEQ ID NO: 3696192 - RNA, 15 nt, Human
uagcaugacauuucu

SEQ ID NO: 3696193 - RNA, 19 nt, Human
uagcaugaggccacugcug

SEQ ID NO: 3696194 - RNA, 17 nt, Human
uagcaugcacaaagugu

SEQ ID NO: 3696195 - RNA, 19 nt, Human
uagcaugcacaaaguguau

SEQ ID NO: 3696196 - RNA, 19 nt, Human
uagcaugccaacaagaaug

SEQ ID NO: 3696197 - RNA, 17 nt, Human
uagcauggauagaguau

SEQ ID NO: 3696198 - RNA, 18 nt, Human
uagcauguauugugucuu

SEQ ID NO: 3696199 - RNA, 18 nt, Human
uagcaugucgucaaagcu

SEQ ID NO: 3696200 - RNA, 22 nt, Human
uagcauguguuugguucugggg

SEQ ID NO: 3696201 - RNA, 16 nt, Human
uagcauuaacuaaucu

SEQ ID NO: 3696202 - RNA, 16 nt, Human
uagcauuaugcaauua

SEQ ID NO: 3696203 - RNA, 15 nt, Human
uagcauucuggcagu

SEQ ID NO: 3696204 - RNA, 19 nt, Human
uagcauuuguguugaagag

SEQ ID NO: 3696205 - RNA, 16 nt, Human
uagcauuuuaaacaaa

SEQ ID NO: 3696206 - RNA, 16 nt, Human
uagccaaaaauagcua

SEQ ID NO: 3696207 - RNA, 21 nt, Human
uagccaaaaauagcuaaauac

SEQ ID NO: 3696208 - RNA, 13 nt, Human
uagccaaaaugug

SEQ ID NO: 3696209 - RNA, 15 nt, Human
uagccaaaaugugag

SEQ ID NO: 3696210 - RNA, 17 nt, Human
uagccaaaccucaccaa

SEQ ID NO: 3696211 - RNA, 23 nt, Human
uagccaaaugacugaaagcacug

SEQ ID NO: 3696212 - RNA, 19 nt, Human
uagccaacggccccagcuu

SEQ ID NO: 3696213 - RNA, 21 nt, Human
uagccaacggccccagcuucu

SEQ ID NO: 3696214 - RNA, 21 nt, Human
uagccaaggugggcugagccc

SEQ ID NO: 3696215 - RNA, 21 nt, Human
uagccaaugucuccuccccuu

SEQ ID NO: 3696216 - RNA, 14 nt, Human
uagccaccaacucu

SEQ ID NO: 3696217 - RNA, 14 nt, Human
uagccaccaucuuu

SEQ ID NO: 3696218 - RNA, 18 nt, Human
uagccaccgccuccuaca

SEQ ID NO: 3696219 - RNA, 13 nt, Human
uagccacucagga

SEQ ID NO: 3696220 - RNA, 14 nt, Human
uagccacucaggag

SEQ ID NO: 3696221 - RNA, 17 nt, Human
uagccacuuaccuucaa

SEQ ID NO: 3696222 - RNA, 14 nt, Human
uagccagacacucu

SEQ ID NO: 3696223 - RNA, 15 nt, Human
uagccagaggacugu

SEQ ID NO: 3696224 - RNA, 15 nt, Human
uagccagauuugucu

SEQ ID NO: 3696225 - RNA, 19 nt, Human
uagccagcacacagggcag

SEQ ID NO: 3696226 - RNA, 14 nt, Human
uagccagcugcucc

SEQ ID NO: 3696227 - RNA, 22 nt, Human
uagccaggaucaugguguaaua

SEQ ID NO: 3696228 - RNA, 22 nt, Human
uagccagggggacuagccccug

SEQ ID NO: 3696229 - RNA, 22 nt, Human
uagccagguaaugugaauaaau

SEQ ID NO: 3696230 - RNA, 18 nt, Human
uagccaggucccccugca

SEQ ID NO: 3696231 - RNA, 21 nt, Human
uagccaggucccccugcagcu

SEQ ID NO: 3696232 - RNA, 15 nt, Human
uagccaguaauccug

SEQ ID NO: 3696233 - RNA, 22 nt, Human
uagccaguaauccuguaggaag

SEQ ID NO: 3696234 - RNA, 15 nt, Human
uagccagugaacaua

SEQ ID NO: 3696235 - RNA, 16 nt, Human
uagccagugcuccagg

SEQ ID NO: 3696236 - RNA, 15 nt, Human
uagccauauuuguaa

SEQ ID NO: 3696237 - RNA, 22 nt, Human
uagccauuccugguacccagcc

SEQ ID NO: 3696238 - RNA, 18 nt, Human
uagcccaaugaaaugaau

SEQ ID NO: 3696239 - RNA, 23 nt, Human
uagcccacacuugagaggaugaa

SEQ ID NO: 3696240 - RNA, 18 nt, Human
uagcccacccugcugccu

SEQ ID NO: 3696241 - RNA, 21 nt, Human
uagcccacuuacauuuacaaa

SEQ ID NO: 3696242 - RNA, 12 nt, Human
uagcccaggaga

SEQ ID NO: 3696243 - RNA, 18 nt, Human
uagcccaggagagagaaa

SEQ ID NO: 3696244 - RNA, 22 nt, Human
uagcccaggagagagaaagcca

SEQ ID NO: 3696245 - RNA, 16 nt, Human
uagcccaucccugccu

SEQ ID NO: 3696246 - RNA, 20 nt, Human
uagcccaucccugccugguc

SEQ ID NO: 3696247 - RNA, 18 nt, Human
uagccccaagaaggcugg

SEQ ID NO: 3696248 - RNA, 19 nt, Human
uagcccccaggcugcugga

SEQ ID NO: 3696249 - RNA, 14 nt, Human
uagcccccucuucc

SEQ ID NO: 3696250 - RNA, 16 nt, Human
uagcccccuggccucu

SEQ ID NO: 3696251 - RNA, 22 nt, Human
uagcccccugguaauagcugua

SEQ ID NO: 3696252 - RNA, 18 nt, Human
uagccccuuagcccccac

SEQ ID NO: 3696253 - RNA, 16 nt, Human
uagcccgccugccagu

SEQ ID NO: 3696254 - RNA, 19 nt, Human
uagcccgccugccaguccu

SEQ ID NO: 3696255 - RNA, 20 nt, Human
uagcccgccugccaguccua

SEQ ID NO: 3696256 - RNA, 18 nt, Human
uagcccucacccuggggc

SEQ ID NO: 3696257 - RNA, 20 nt, Human
uagcccuccuuuuuccaaca

SEQ ID NO: 3696258 - RNA, 15 nt, Human
uagcccucucccucu

SEQ ID NO: 3696259 - RNA, 16 nt, Human
uagcccuggccagagg

SEQ ID NO: 3696260 - RNA, 17 nt, Human
uagcccuguccuggugg

SEQ ID NO: 3696261 - RNA, 14 nt, Human
uagcccuuucugug

SEQ ID NO: 3696262 - RNA, 17 nt, Human
uagcccuuucugugugc

SEQ ID NO: 3696263 - RNA, 15 nt, Human
uagccgaccucagcc

SEQ ID NO: 3696264 - RNA, 14 nt, Human
uagccgagagccug

SEQ ID NO: 3696265 - RNA, 22 nt, Human
uagccgggcgugguggcaggca

SEQ ID NO: 3696266 - RNA, 22 nt, Human
uagccuaagauauacuuguuuu

SEQ ID NO: 3696267 - RNA, 16 nt, Human
uagccuaggugacaga

SEQ ID NO: 3696268 - RNA, 19 nt, Human
uagccucaauuucugaaca

SEQ ID NO: 3696269 - RNA, 11 nt, Human
uagccucacgc

SEQ ID NO: 3696270 - RNA, 20 nt, Human
uagccucagaugauuucccc

SEQ ID NO: 3696271 - RNA, 14 nt, Human
uagccucauaguua

SEQ ID NO: 3696272 - RNA, 13 nt, Human
uagccucccugaa

SEQ ID NO: 3696273 - RNA, 17 nt, Human
uagccuccugaccugag

SEQ ID NO: 3696274 - RNA, 16 nt, Human
uagccucugucuggca

SEQ ID NO: 3696275 - RNA, 11 nt, Human
uagccuggacc

SEQ ID NO: 3696276 - RNA, 14 nt, Human
uagccuggacugcu

SEQ ID NO: 3696277 - RNA, 20 nt, Human
uagccuguccugucaucauc

SEQ ID NO: 3696278 - RNA, 18 nt, Human
uagccugugccucuggga

SEQ ID NO: 3696279 - RNA, 23 nt, Human
uagccuguggcaguaaagagaaa

SEQ ID NO: 3696280 - RNA, 20 nt, Human
uagccuguggcccuguccug

SEQ ID NO: 3696281 - RNA, 20 nt, Human
uagccuuauccucugaucuc

SEQ ID NO: 3696282 - RNA, 18 nt, Human
uagccuuccuccacaucc

SEQ ID NO: 3696283 - RNA, 14 nt, Human
uagccuucucuguu

SEQ ID NO: 3696284 - RNA, 20 nt, Human
uagccuucucuguucauuuc

SEQ ID NO: 3696285 - RNA, 12 nt, Human
uagccuugcuug

SEQ ID NO: 3696286 - RNA, 13 nt, Human
uagccuuucuuuu

SEQ ID NO: 3696287 - RNA, 18 nt, Human
uagccuuuggcucuggag

SEQ ID NO: 3696288 - RNA, 20 nt, Human
uagcgacaacagauuggauu

SEQ ID NO: 3696289 - RNA, 15 nt, Human
uagcgaggcucuaac

SEQ ID NO: 3696290 - RNA, 19 nt, Human
uagcgaggcucuaaccaca

SEQ ID NO: 3696291 - RNA, 19 nt, Human
uagcgaucucuccuggccu

SEQ ID NO: 3696292 - RNA, 19 nt, Human
uagcgcuauaguuacuguc

SEQ ID NO: 3696293 - RNA, 18 nt, Human
uagcgggauggggcuccc

SEQ ID NO: 3696294 - RNA, 15 nt, Human
uagcguucuuguaau

SEQ ID NO: 3696295 - RNA, 18 nt, Human
uagcguucuuguaauuuu

SEQ ID NO: 3696296 - RNA, 17 nt, Human
uuauguccugugagaug

SEQ ID NO: 3696297 - RNA, 22 nt, Human
uuauguccugugagauguguau

SEQ ID NO: 3696298 - RNA, 18 nt, Human
uuaugucuaaaauccugc

SEQ ID NO: 3696299 - RNA, 15 nt, Human
uuaugucucuucuga

SEQ ID NO: 3696300 - RNA, 17 nt, Human
uuaugucuguuuaagaa

SEQ ID NO: 3696301 - RNA, 23 nt, Human
uuaugugaaugaucucucugaau

SEQ ID NO: 3696302 - RNA, 17 nt, Human
uuaugugaauuuuuaag

SEQ ID NO: 3696303 - RNA, 14 nt, Human
uuaugugacauuuu

SEQ ID NO: 3696304 - RNA, 16 nt, Human
uuaugugaucaugugu

SEQ ID NO: 3696305 - RNA, 21 nt, Human
uuaugugcuauuaauauuugu

SEQ ID NO: 3696306 - RNA, 20 nt, Human
uuaugugguuuuagauuuuc

SEQ ID NO: 3696307 - RNA, 20 nt, Human
uuauguguaugugaguauuc

SEQ ID NO: 3696308 - RNA, 17 nt, Human
uuaugugugcaugugug

SEQ ID NO: 3696309 - RNA, 12 nt, Human
uuaugugugugu

SEQ ID NO: 3696310 - RNA, 14 nt, Human
uuaugugugugugu

SEQ ID NO: 3696311 - RNA, 16 nt, Human
uuauguuauauauaaa

SEQ ID NO: 3696312 - RNA, 10 nt, Human
uuauguugac

SEQ ID NO: 3696313 - RNA, 15 nt, Human
uuauguugacauuug

SEQ ID NO: 3696314 - RNA, 18 nt, Human
uuauguuuugguccacuu

SEQ ID NO: 3696315 - RNA, 20 nt, Human
uuauguuuugguccacuuuu

SEQ ID NO: 3696316 - RNA, 15 nt, Human
uuauguuuuguuucu

SEQ ID NO: 3696317 - RNA, 18 nt, Human
uuauguuuuuguacucug

SEQ ID NO: 3696318 - RNA, 12 nt, Human
uuauuaaaaucu

SEQ ID NO: 3696319 - RNA, 21 nt, Human
uuauuaaaaugauuguaaaau

SEQ ID NO: 3696320 - RNA, 16 nt, Human
uuauuaaaauucugaa

SEQ ID NO: 3696321 - RNA, 12 nt, Human
uuauuaaaauug

SEQ ID NO: 3696322 - RNA, 16 nt, Human
uuauuaaacaaauaau

SEQ ID NO: 3696323 - RNA, 18 nt, Human
uuauuaaacguaugcaug

SEQ ID NO: 3696324 - RNA, 21 nt, Human
uuauuaaagaaaaaaauguau

SEQ ID NO: 3696325 - RNA, 19 nt, Human
uuauuaaaguuucaaaaau

SEQ ID NO: 3696326 - RNA, 15 nt, Human
uuauuaaauaaaauc

SEQ ID NO: 3696327 - RNA, 18 nt, Human
uuauuaaauacaaaacuu

SEQ ID NO: 3696328 - RNA, 18 nt, Human
uuauuaaauguagcuuca

SEQ ID NO: 3696329 - RNA, 13 nt, Human
uuauuaaauugca

SEQ ID NO: 3696330 - RNA, 22 nt, Human
uuauuaaauuuuuuuguaugaa

SEQ ID NO: 3696331 - RNA, 16 nt, Human
uuauuaacaaaacagu

SEQ ID NO: 3696332 - RNA, 16 nt, Human
uuauuaacaauuaggc

SEQ ID NO: 3696333 - RNA, 21 nt, Human
uuauuaacuaauaugggcauu

SEQ ID NO: 3696334 - RNA, 15 nt, Human
uuauuaacuacauuu

SEQ ID NO: 3696335 - RNA, 18 nt, Human
uuauuaacuacauuuaug

SEQ ID NO: 3696336 - RNA, 14 nt, Human
uuauuaacuuaaua

SEQ ID NO: 3696337 - RNA, 19 nt, Human
uuauuaagauggauucuca

SEQ ID NO: 3696338 - RNA, 19 nt, Human
uuauuaagcuuuuuggaau

SEQ ID NO: 3696339 - RNA, 20 nt, Human
uuauuaauauauauuaucuu

SEQ ID NO: 3696340 - RNA, 11 nt, Human
uuauuaauauu

SEQ ID NO: 3696341 - RNA, 18 nt, Human
uuauuaauauuuaacauu

SEQ ID NO: 3696342 - RNA, 16 nt, Human
uuauuaaugcuaaggg

SEQ ID NO: 3696343 - RNA, 22 nt, Human
uuauuaauuguuuugcacuuuu

SEQ ID NO: 3696344 - RNA, 12 nt, Human
uuauuaauuuga

SEQ ID NO: 3696345 - RNA, 20 nt, Human
uuauuaauuuuaguuuuuca

SEQ ID NO: 3696346 - RNA, 14 nt, Human
uuauuacaguauaa

SEQ ID NO: 3696347 - RNA, 21 nt, Human
uuauuacauccuuguggcaca

SEQ ID NO: 3696348 - RNA, 18 nt, Human
uuauuacaucuuucacau

SEQ ID NO: 3696349 - RNA, 18 nt, Human
uuauuacguaugucuggu

SEQ ID NO: 3696350 - RNA, 17 nt, Human
uuauuacuguaagaaaa

SEQ ID NO: 3696351 - RNA, 13 nt, Human
uuauuacuguuua

SEQ ID NO: 3696352 - RNA, 18 nt, Human
uuauuacuguuugucuuc

SEQ ID NO: 3696353 - RNA, 14 nt, Human
uuauuacuuccaug

SEQ ID NO: 3696354 - RNA, 11 nt, Human
uuauuagauga

SEQ ID NO: 3696355 - RNA, 12 nt, Human
uuauuagauguu

SEQ ID NO: 3696356 - RNA, 23 nt, Human
uuauuagcagcugacuuucaaag

SEQ ID NO: 3696357 - RNA, 18 nt, Human
uuauuagcccugcauuuu

SEQ ID NO: 3696358 - RNA, 23 nt, Human
uuauuagggagaaaauucaauug

SEQ ID NO: 3696359 - RNA, 20 nt, Human
uuauuaguaagaaaacauca

SEQ ID NO: 3696360 - RNA, 16 nt, Human
uuauuaguauuguugu

SEQ ID NO: 3696361 - RNA, 20 nt, Human
uuauuaguguaugcuuugaa

SEQ ID NO: 3696362 - RNA, 18 nt, Human
uuauuaguuuacaucauu

SEQ ID NO: 3696363 - RNA, 12 nt, Human
uuauuaguuuug

SEQ ID NO: 3696364 - RNA, 14 nt, Human
uuauuauaaacugu

SEQ ID NO: 3696365 - RNA, 14 nt, Human
uuauuauauuuaca

SEQ ID NO: 3696366 - RNA, 17 nt, Human
uuauuaucaaguagacu

SEQ ID NO: 3696367 - RNA, 13 nt, Human
uuauuaucuuuaa

SEQ ID NO: 3696368 - RNA, 23 nt, Human
uuauuaugaaacuuguguaaaua

SEQ ID NO: 3696369 - RNA, 13 nt, Human
uuauuaugaagaa

SEQ ID NO: 3696370 - RNA, 14 nt, Human
uuauuaugcauuau

SEQ ID NO: 3696371 - RNA, 14 nt, Human
uuauuauuacuguu

SEQ ID NO: 3696372 - RNA, 16 nt, Human
uuauuauugaaauugu

SEQ ID NO: 3696373 - RNA, 11 nt, Human
uuauuauugug

SEQ ID NO: 3696374 - RNA, 12 nt, Human
uuauuauuuauu

SEQ ID NO: 3696375 - RNA, 13 nt, Human
uuauucaaagaga

SEQ ID NO: 3696376 - RNA, 13 nt, Human
uuauucaaaguug

SEQ ID NO: 3696377 - RNA, 19 nt, Human
uuauucaaaguugccuaaa

SEQ ID NO: 3696378 - RNA, 14 nt, Human
uuauucaacagcaa

SEQ ID NO: 3696379 - RNA, 11 nt, Human
uuauucaaggu

SEQ ID NO: 3696380 - RNA, 16 nt, Human
uuauucaaguuauugu

SEQ ID NO: 3696381 - RNA, 20 nt, Human
uuauucaauaaaguauuuaa

SEQ ID NO: 3696382 - RNA, 19 nt, Human
uuauucaauuccucuggga

SEQ ID NO: 3696383 - RNA, 14 nt, Human
uuauucacugauuu

SEQ ID NO: 3696384 - RNA, 15 nt, Human
uuauucagcuucauu

SEQ ID NO: 3696385 - RNA, 20 nt, Human
uuauucagcuucauuugugu

SEQ ID NO: 3696386 - RNA, 20 nt, Human
uuauucaggaaaagccucug

SEQ ID NO: 3696387 - RNA, 23 nt, Human
uuauucauaagccaauuuuucug

SEQ ID NO: 3696388 - RNA, 12 nt, Human
uucacucucuga

SEQ ID NO: 3696389 - RNA, 14 nt, Human
uucacucuuccaga

SEQ ID NO: 3696390 - RNA, 15 nt, Human
uucacucuuccagaa

SEQ ID NO: 3696391 - RNA, 18 nt, Human
uucacucuuggagccugc

SEQ ID NO: 3696392 - RNA, 12 nt, Human
uucacugcugca

SEQ ID NO: 3696393 - RNA, 15 nt, Human
uucacugcuggcugc

SEQ ID NO: 3696394 - RNA, 18 nt, Human
uucacugcuggcugccuu

SEQ ID NO: 3696395 - RNA, 17 nt, Human
uucacuggagcacaaua

SEQ ID NO: 3696396 - RNA, 16 nt, Human
uucacuggaguuacau

SEQ ID NO: 3696397 - RNA, 19 nt, Human
uucacuggaguuacauuaa

SEQ ID NO: 3696398 - RNA, 13 nt, Human
uucacuggcccaa

SEQ ID NO: 3696399 - RNA, 12 nt, Human
uucacuguacgu

SEQ ID NO: 3696400 - RNA, 15 nt, Human
uucacuguagaauga

SEQ ID NO: 3696401 - RNA, 22 nt, Human
uucacuguagaaugauuucaug

SEQ ID NO: 3696402 - RNA, 13 nt, Human
uucacuguauaaa

SEQ ID NO: 3696403 - RNA, 21 nt, Human
uucacugucaggaagaaauca

SEQ ID NO: 3696404 - RNA, 15 nt, Human
uucacugucugucug

SEQ ID NO: 3696405 - RNA, 19 nt, Human
uucacugucuuuaauucug

SEQ ID NO: 3696406 - RNA, 22 nt, Human
uucacugugaccuugagaagau

SEQ ID NO: 3696407 - RNA, 13 nt, Human
uucacugugcugu

SEQ ID NO: 3696408 - RNA, 16 nt, Human
uucacuguuagcuuuu

SEQ ID NO: 3696409 - RNA, 19 nt, Human
uucacuguuucaucuaagu

SEQ ID NO: 3696410 - RNA, 15 nt, Human
uucacuuauauguuc

SEQ ID NO: 3696411 - RNA, 22 nt, Human
uucacuuaugaaugauuugcau

SEQ ID NO: 3696412 - RNA, 12 nt, Human
uucacuucaaaa

SEQ ID NO: 3696413 - RNA, 19 nt, Human
uucacuucugacucuuccc

SEQ ID NO: 3696414 - RNA, 19 nt, Human
uucacuuucacauagaugu

SEQ ID NO: 3696415 - RNA, 15 nt, Human
uucagaaaaagaaau

SEQ ID NO: 3696416 - RNA, 17 nt, Human
uucagaaaacagaaaaa

SEQ ID NO: 3696417 - RNA, 21 nt, Human
uucagaaaauauuauguguuu

SEQ ID NO: 3696418 - RNA, 19 nt, Human
uucagaaagcauuacauuu

SEQ ID NO: 3696419 - RNA, 20 nt, Human
uucagaaagcauuacauuuc

SEQ ID NO: 3696420 - RNA, 16 nt, Human
uucagaaagugugcuu

SEQ ID NO: 3696421 - RNA, 15 nt, Human
uucagaaauauaaca

SEQ ID NO: 3696422 - RNA, 20 nt, Human
uucagaaauauaacacauuu

SEQ ID NO: 3696423 - RNA, 22 nt, Human
uucagaaauauaacacauuuuu

SEQ ID NO: 3696424 - RNA, 17 nt, Human
uucagaaaugcugccug

SEQ ID NO: 3696425 - RNA, 19 nt, Human
uucagaaaugcugccugcc

SEQ ID NO: 3696426 - RNA, 22 nt, Human
uucagaaaugcugccugccugu

SEQ ID NO: 3696427 - RNA, 12 nt, Human
uucagaaauguu

SEQ ID NO: 3696428 - RNA, 20 nt, Human
uucagaaauuggaacagaau

SEQ ID NO: 3696429 - RNA, 21 nt, Human
uucagaaauuggaacagaaug

SEQ ID NO: 3696430 - RNA, 19 nt, Human
uucagaaccucuuccccag

SEQ ID NO: 3696431 - RNA, 15 nt, Human
uucagaaguuaguuu

SEQ ID NO: 3696432 - RNA, 20 nt, Human
uucagaaguuaguuuguaua

SEQ ID NO: 3696433 - RNA, 13 nt, Human
uucagaaguuuaa

SEQ ID NO: 3696434 - RNA, 16 nt, Human
uucagaauaagcuucc

SEQ ID NO: 3696435 - RNA, 21 nt, Human
uucagaaucacuucugagaac

SEQ ID NO: 3696436 - RNA, 18 nt, Human
uucagaaucugaauguaa

SEQ ID NO: 3696437 - RNA, 23 nt, Human
uucagaauuuuauacuuucccua

SEQ ID NO: 3696438 - RNA, 21 nt, Human
uucagacaagcaacagguuuu

SEQ ID NO: 3696439 - RNA, 15 nt, Human
uucagacacuuugga

SEQ ID NO: 3696440 - RNA, 16 nt, Human
uucagacagcugccug

SEQ ID NO: 3696441 - RNA, 17 nt, Human
uucagacagcugccugg

SEQ ID NO: 3696442 - RNA, 16 nt, Human
uucagacauagaauua

SEQ ID NO: 3696443 - RNA, 15 nt, Human
uucagaccccagcgg

SEQ ID NO: 3696444 - RNA, 20 nt, Human
uucagacucccauuccugaa

SEQ ID NO: 3696445 - RNA, 23 nt, Human
uucagacuugccaugugacucug

SEQ ID NO: 3696446 - RNA, 14 nt, Human
uucagagaaaggca

SEQ ID NO: 3696447 - RNA, 13 nt, Human
uucagagaauauc

SEQ ID NO: 3696448 - RNA, 15 nt, Human
uucagagaggccuuu

SEQ ID NO: 3696449 - RNA, 23 nt, Human
uucagagauuuauauaaauguaa

SEQ ID NO: 3696450 - RNA, 23 nt, Human
uucagagcugacacaggaugaag

SEQ ID NO: 3696451 - RNA, 21 nt, Human
uucagagcugcccucuccugg

SEQ ID NO: 3696452 - RNA, 22 nt, Human
uucagagcugcccucuccuggg

SEQ ID NO: 3696453 - RNA, 22 nt, Human
uucagaggcccucgcugccagc

SEQ ID NO: 3696454 - RNA, 23 nt, Human
uucagaggcccucgcugccagcu

SEQ ID NO: 3696455 - RNA, 13 nt, Human
uucagaggcucag

SEQ ID NO: 3696456 - RNA, 14 nt, Human
uucagaguuuucug

SEQ ID NO: 3696457 - RNA, 16 nt, Human
uucagaguuuucuggg

SEQ ID NO: 3696458 - RNA, 18 nt, Human
uucagaguuuucugggua

SEQ ID NO: 3696459 - RNA, 17 nt, Human
uucagauaacuguuauu

SEQ ID NO: 3696460 - RNA, 16 nt, Human
uucagauacuggauug

SEQ ID NO: 3696461 - RNA, 12 nt, Human
uucagauauaaa

SEQ ID NO: 3696462 - RNA, 18 nt, Human
uucagauauuauugcuuu

SEQ ID NO: 3696463 - RNA, 13 nt, Human
uucagauccuacc

SEQ ID NO: 3696464 - RNA, 15 nt, Human
uucagauccuacccc

SEQ ID NO: 3696465 - RNA, 15 nt, Human
uucagaugcuucugg

SEQ ID NO: 3696466 - RNA, 21 nt, Human
uucagaugggaggaaagagag

SEQ ID NO: 3696467 - RNA, 17 nt, Human
uucagauguaauguuuu

SEQ ID NO: 3696468 - RNA, 13 nt, Human
uucagauguaugu

SEQ ID NO: 3696469 - RNA, 19 nt, Human
uucagaugucuucugccug

SEQ ID NO: 3696470 - RNA, 20 nt, Human
uucagaugucuucugccugu

SEQ ID NO: 3696471 - RNA, 16 nt, Human
uucagaugugaaccau

SEQ ID NO: 3696472 - RNA, 18 nt, Human
uucagaugugaaccauua

SEQ ID NO: 3696473 - RNA, 19 nt, Human
uucagauguggagccaggc

SEQ ID NO: 3696474 - RNA, 17 nt, Human
uucagauuugcacaaaa

SEQ ID NO: 3696475 - RNA, 19 nt, Human
uucagauuugcacaaaaag

SEQ ID NO: 3696476 - RNA, 20 nt, Human
uucagcaaacucuuuuccca

SEQ ID NO: 3696477 - RNA, 19 nt, Human
uucagcaaagugguucccu

SEQ ID NO: 3696478 - RNA, 18 nt, Human
uucagcaagagagaaccu

SEQ ID NO: 3696479 - RNA, 22 nt, Human
uucagcaccaagcaugucccag

SEQ ID NO: 3696480 - RNA, 22 nt, Human
uucagcaccuacaguguacagu

SEQ ID NO: 3696481 - RNA, 16 nt, Human
uucagcacuagccaaa

SEQ ID NO: 3696482 - RNA, 14 nt, Human
uucagcacuguccc

SEQ ID NO: 3696483 - RNA, 16 nt, Human
uucagcacugucccuu

SEQ ID NO: 3696484 - RNA, 20 nt, Human
uucagcacugucccuugccu

SEQ ID NO: 3696485 - RNA, 21 nt, Human
uucagcacugucccuugccuc

SEQ ID NO: 3696486 - RNA, 17 nt, Human
uucagcacuugucucau

SEQ ID NO: 3696487 - RNA, 20 nt, Human
uucagcacuugucucauuuu

SEQ ID NO: 3696488 - RNA, 22 nt, Human
uucagcacuuuagaauaugccu

SEQ ID NO: 3696489 - RNA, 16 nt, Human
uugcuaauuaaaaagu

SEQ ID NO: 3696490 - RNA, 20 nt, Human
uugcuaauuaacugaaacau

SEQ ID NO: 3696491 - RNA, 18 nt, Human
uugcuaauugcuguugaa

SEQ ID NO: 3696492 - RNA, 21 nt, Human
uugcuaauugcuguugaaagc

SEQ ID NO: 3696493 - RNA, 15 nt, Human
uugcuaauuuucuca

SEQ ID NO: 3696494 - RNA, 23 nt, Human
uugcuaccacggccuccuuuccg

SEQ ID NO: 3696495 - RNA, 15 nt, Human
uugcuaccaguauuu

SEQ ID NO: 3696496 - RNA, 23 nt, Human
uugcuaccaguauuuagaagcca

SEQ ID NO: 3696497 - RNA, 13 nt, Human
uugcuaccucagu

SEQ ID NO: 3696498 - RNA, 17 nt, Human
uugcuaccucagucagu

SEQ ID NO: 3696499 - RNA, 18 nt, Human
uugcuagacucuagacaa

SEQ ID NO: 3696500 - RNA, 14 nt, Human
uugcuagagcuccu

SEQ ID NO: 3696501 - RNA, 15 nt, Human
uugcuagagcuccuc

SEQ ID NO: 3696502 - RNA, 18 nt, Human
uugcuagcaguaaaagau

SEQ ID NO: 3696503 - RNA, 23 nt, Human
uugcuagcaguaaaagaugaagu

SEQ ID NO: 3696504 - RNA, 17 nt, Human
uugcuaguauuugaauu

SEQ ID NO: 3696505 - RNA, 18 nt, Human
uugcuaguauuugaauua

SEQ ID NO: 3696506 - RNA, 22 nt, Human
uugcuaucaacaauaaaauuuu

SEQ ID NO: 3696507 - RNA, 16 nt, Human
uugcuaucggggaagc

SEQ ID NO: 3696508 - RNA, 20 nt, Human
uugcuaucggggaagccaga

SEQ ID NO: 3696509 - RNA, 19 nt, Human
uugcuauguuacuauuuuc

SEQ ID NO: 3696510 - RNA, 14 nt, Human
uugcuauucugucc

SEQ ID NO: 3696511 - RNA, 16 nt, Human
uugcuauucugucccu

SEQ ID NO: 3696512 - RNA, 19 nt, Human
uugcuauucugucccuagg

SEQ ID NO: 3696513 - RNA, 12 nt, Human
uugcucacccag

SEQ ID NO: 3696514 - RNA, 15 nt, Human
uugcucaccuggggu

SEQ ID NO: 3696515 - RNA, 23 nt, Human
uugcucaugcauagucccagcua

SEQ ID NO: 3696516 - RNA, 11 nt, Human
uugcucaugga

SEQ ID NO: 3696517 - RNA, 12 nt, Human
uugcuccacccc

SEQ ID NO: 3696518 - RNA, 16 nt, Human
uugcuccccagugaag

SEQ ID NO: 3696519 - RNA, 14 nt, Human
uugcuccccuuccc

SEQ ID NO: 3696520 - RNA, 21 nt, Human
uugcuccccuuccccuuccuu

SEQ ID NO: 3696521 - RNA, 17 nt, Human
uugcucccuucagcccc

SEQ ID NO: 3696522 - RNA, 17 nt, Human
uugcuccgccuggccug

SEQ ID NO: 3696523 - RNA, 17 nt, Human
uugcuccuaauguugaa

SEQ ID NO: 3696524 - RNA, 14 nt, Human
uugcuccuggccuu

SEQ ID NO: 3696525 - RNA, 22 nt, Human
uugcucgggucccuucaccucc

SEQ ID NO: 3696526 - RNA, 20 nt, Human
uugcucuaaaauauuuauga

SEQ ID NO: 3696527 - RNA, 16 nt, Human
uugcucuaucucucaa

SEQ ID NO: 3696528 - RNA, 21 nt, Human
uugcucuccccugcccugcug

SEQ ID NO: 3696529 - RNA, 21 nt, Human
uugcucucccgguucuuccag

SEQ ID NO: 3696530 - RNA, 16 nt, Human
uugcucucccucuucu

SEQ ID NO: 3696531 - RNA, 20 nt, Human
uugcucucugugucugagag

SEQ ID NO: 3696532 - RNA, 15 nt, Human
uugcucugcaggcac

SEQ ID NO: 3696533 - RNA, 15 nt, Human
uugcucuggaccugc

SEQ ID NO: 3696534 - RNA, 14 nt, Human
uugcucugggugga

SEQ ID NO: 3696535 - RNA, 18 nt, Human
uugcucuugaugccuggc

SEQ ID NO: 3696536 - RNA, 22 nt, Human
uugcucuugcagagaagccuug

SEQ ID NO: 3696537 - RNA, 11 nt, Human
uugcugaaauu

SEQ ID NO: 3696538 - RNA, 16 nt, Human
uugcugaaauuuuaua

SEQ ID NO: 3696539 - RNA, 19 nt, Human
uugcugaauacagaggcaa

SEQ ID NO: 3696540 - RNA, 18 nt, Human
uugcugaauaggcgauca

SEQ ID NO: 3696541 - RNA, 22 nt, Human
uugcugaaucggaaucucuggg

SEQ ID NO: 3696542 - RNA, 20 nt, Human
uugcugaccccacuuggacu

SEQ ID NO: 3696543 - RNA, 14 nt, Human
uugcugacccuccc

SEQ ID NO: 3696544 - RNA, 11 nt, Human
uugcugagagc

SEQ ID NO: 3696545 - RNA, 17 nt, Human
uugcugagcuguuuaua

SEQ ID NO: 3696546 - RNA, 24 nt, Human
uugcugagcuguuuauagagaaug

SEQ ID NO: 3696547 - RNA, 15 nt, Human
uugcugauucuugag

SEQ ID NO: 3696548 - RNA, 14 nt, Human
uugcugauuuuaau

SEQ ID NO: 3696549 - RNA, 18 nt, Human
uugcugauuuuauucuug

SEQ ID NO: 3696550 - RNA, 15 nt, Human
uugcugcaaaccuga

SEQ ID NO: 3696551 - RNA, 18 nt, Human
uugcugcaauuuuauaag

SEQ ID NO: 3696552 - RNA, 21 nt, Human
uugcugcagagaaacuuaagc

SEQ ID NO: 3696553 - RNA, 15 nt, Human
uugcugcauggcagg

SEQ ID NO: 3696554 - RNA, 20 nt, Human
uugcugccauuacagaggua

SEQ ID NO: 3696555 - RNA, 20 nt, Human
uugcugccccaucagugcuc

SEQ ID NO: 3696556 - RNA, 15 nt, Human
uugcugccucaugcu

SEQ ID NO: 3696557 - RNA, 22 nt, Human
uugcugccucggauccccuucc

SEQ ID NO: 3696558 - RNA, 23 nt, Human
uugcugcuagaacuuuuuuaaau

SEQ ID NO: 3696559 - RNA, 20 nt, Human
uugcugcuauuuuacugucu

SEQ ID NO: 3696560 - RNA, 23 nt, Human
uugcugcuauuuuacugucuuaa

SEQ ID NO: 3696561 - RNA, 15 nt, Human
uugcugcuucuccca

SEQ ID NO: 3696562 - RNA, 17 nt, Human
uugcugcuucucccagg

SEQ ID NO: 3696563 - RNA, 21 nt, Human
uugcugcuucucccaggcaag

SEQ ID NO: 3696564 - RNA, 16 nt, Human
uugcugcuuguacacu

SEQ ID NO: 3696565 - RNA, 23 nt, Human
uugcugcuuuuccuuggggcagg

SEQ ID NO: 3696566 - RNA, 15 nt, Human
uugcuggaguacuua

SEQ ID NO: 3696567 - RNA, 11 nt, Human
uugcuggcuug

SEQ ID NO: 3696568 - RNA, 12 nt, Human
uugcugggcuuu

SEQ ID NO: 3696569 - RNA, 15 nt, Human
uugcuggucacugcc

SEQ ID NO: 3696570 - RNA, 23 nt, Human
uugcuggucuuguaagagcuaua

SEQ ID NO: 3696571 - RNA, 15 nt, Human
uugcugguugcugug

SEQ ID NO: 3696572 - RNA, 16 nt, Human
uugcugguugcugugu

SEQ ID NO: 3696573 - RNA, 13 nt, Human
uugcuguacaaaa

SEQ ID NO: 3696574 - RNA, 14 nt, Human
uugcuguacuagag

SEQ ID NO: 3696575 - RNA, 18 nt, Human
uugcugucccuuuuccuu

SEQ ID NO: 3696576 - RNA, 20 nt, Human
uugcuguccugaucugugau

SEQ ID NO: 3696577 - RNA, 11 nt, Human
uugcugucucu

SEQ ID NO: 3696578 - RNA, 20 nt, Human
uugcugugagcaagaaguca

SEQ ID NO: 3696579 - RNA, 17 nt, Human
uugcugugaggcugucc

SEQ ID NO: 3696580 - RNA, 14 nt, Human
uugcugugccuccc

SEQ ID NO: 3696581 - RNA, 21 nt, Human
uugcuguguuuaauuugacuu

SEQ ID NO: 3696582 - RNA, 21 nt, Human
uugcuguugaugaggccucuu

SEQ ID NO: 3696583 - RNA, 20 nt, Human
uugcuguugauuucuuucca

SEQ ID NO: 3696584 - RNA, 19 nt, Human
uugcuguugucccucugcu

SEQ ID NO: 3696585 - RNA, 18 nt, Human
uugcuguuuuaaacauua

SEQ ID NO: 3696586 - RNA, 13 nt, Human
uugcuguuuugau

SEQ ID NO: 3696587 - RNA, 24 nt, Human
uugcuuaaaugugaauuacuaacu

SEQ ID NO: 3696588 - RNA, 23 nt, Human
uugcuuaaauuucuuaugugaca

SEQ ID NO: 3696589 - RNA, 21 nt, Human
uugcuuaauuacaauauuucu

SEQ ID NO: 3696590 - RNA, 15 nt, Human
uugcuuacaauuuuu

SEQ ID NO: 3696591 - RNA, 13 nt, Human
uugcuuacauuuu

SEQ ID NO: 3696592 - RNA, 12 nt, Human
uugcuuacuaag

SEQ ID NO: 3696593 - RNA, 12 nt, Human
uugcuuaguaaa

SEQ ID NO: 3696594 - RNA, 15 nt, Human
uugcuuaguaaaauu

SEQ ID NO: 3696595 - RNA, 16 nt, Human
uugcuuauuguuccaa

SEQ ID NO: 3696596 - RNA, 23 nt, Human
uugcuuauuguuccaagacauug

SEQ ID NO: 3696597 - RNA, 13 nt, Human
uugcuuauuuaau

SEQ ID NO: 3696598 - RNA, 14 nt, Human
uugcuucauaaaug

SEQ ID NO: 3696599 - RNA, 15 nt, Human
uugcuucauaaauga

SEQ ID NO: 3696600 - RNA, 21 nt, Human
uugcuucauagcugguuccug

SEQ ID NO: 3696601 - RNA, 13 nt, Human
uugcuucaugugu

SEQ ID NO: 3696602 - RNA, 18 nt, Human
uugcuucaugugucccag

SEQ ID NO: 3696603 - RNA, 19 nt, Human
uugcuucaugugucccaga

SEQ ID NO: 3696604 - RNA, 15 nt, Human
uugcuucuuacugau

SEQ ID NO: 3696605 - RNA, 22 nt, Human
uugcuucuucccuuaaaauuua

SEQ ID NO: 3696606 - RNA, 22 nt, Human
uugcuucuucuccuauguguaa

SEQ ID NO: 3696607 - RNA, 15 nt, Human
uugcuucuugugaag

SEQ ID NO: 3696608 - RNA, 17 nt, Human
uugcuucuuucuagaaa

SEQ ID NO: 3696609 - RNA, 22 nt, Human
uugcuugaaagaaaauaugcau

SEQ ID NO: 3696610 - RNA, 17 nt, Human
uugcuugagcccaggag

SEQ ID NO: 3696611 - RNA, 20 nt, Human
uugcuugcaguagauuuucu

SEQ ID NO: 3696612 - RNA, 16 nt, Human
uugcuugccucucugu

SEQ ID NO: 3696613 - RNA, 18 nt, Human
uugcuugccugauauaaa

SEQ ID NO: 3696614 - RNA, 15 nt, Human
uugcuuguaccucug

SEQ ID NO: 3696615 - RNA, 14 nt, Human
uugcuugucuucug

SEQ ID NO: 3696616 - RNA, 16 nt, Human
uugcuuuaauauaaau

SEQ ID NO: 3696617 - RNA, 18 nt, Human
uugcuuuaauauaaaugc

SEQ ID NO: 3696618 - RNA, 19 nt, Human
uugcuuuaauauaaaugca

SEQ ID NO: 3696619 - RNA, 16 nt, Human
uugcuuuaccuuuuca

SEQ ID NO: 3696620 - RNA, 19 nt, Human
uugcuuuacugucaaaaua

SEQ ID NO: 3696621 - RNA, 22 nt, Human
uugcuuuacugucaaaauaauu

SEQ ID NO: 3696622 - RNA, 11 nt, Human
uugcuuucacu

SEQ ID NO: 3696623 - RNA, 13 nt, Human
uugcuuucacucu

SEQ ID NO: 3696624 - RNA, 15 nt, Human
uugcuuucugcucag

SEQ ID NO: 3696625 - RNA, 15 nt, Human
uugcuuucuuuucuc

SEQ ID NO: 3696626 - RNA, 11 nt, Human
uugcuuugagc

SEQ ID NO: 3696627 - RNA, 14 nt, Human
uugcuuuguugcac

SEQ ID NO: 3696628 - RNA, 16 nt, Human
uugcuuuuaaaaucca

SEQ ID NO: 3696629 - RNA, 15 nt, Human
uugcuuuuaaaauuu

SEQ ID NO: 3696630 - RNA, 18 nt, Human
uugcuuuuaaaauuuuaa

SEQ ID NO: 3696631 - RNA, 14 nt, Human
uugcuuuuaauuaa

SEQ ID NO: 3696632 - RNA, 13 nt, Human
uugcuuuuagaaa

SEQ ID NO: 3696633 - RNA, 12 nt, Human
uugcuuuucaug

SEQ ID NO: 3696634 - RNA, 13 nt, Human
uugcuuuucaugc

SEQ ID NO: 3696635 - RNA, 22 nt, Human
uugcuuuucaugcaaacucuuu

SEQ ID NO: 3696636 - RNA, 19 nt, Human
uugcuuuuccacugccugg

SEQ ID NO: 3696637 - RNA, 21 nt, Human
uugcuuuucccucuuuucuua

SEQ ID NO: 3696638 - RNA, 19 nt, Human
uugcuuuuucacagucacu

SEQ ID NO: 3696639 - RNA, 17 nt, Human
uagguucccuguucuuc

SEQ ID NO: 3696640 - RNA, 13 nt, Human
uagguucuaaagu

SEQ ID NO: 3696641 - RNA, 20 nt, Human
uagguucuaaaguucuaaga

SEQ ID NO: 3696642 - RNA, 12 nt, Human
uagguucuucuu

SEQ ID NO: 3696643 - RNA, 15 nt, Human
uagguuggacuggaa

SEQ ID NO: 3696644 - RNA, 12 nt, Human
uagguugugaau

SEQ ID NO: 3696645 - RNA, 16 nt, Human
uagguuuaacauaaag

SEQ ID NO: 3696646 - RNA, 18 nt, Human
uagguuucuaaaaaguca

SEQ ID NO: 3696647 - RNA, 17 nt, Human
uagguuugcaagccucc

SEQ ID NO: 3696648 - RNA, 22 nt, Human
uagguuuggacaaaauggaaua

SEQ ID NO: 3696649 - RNA, 23 nt, Human
uagguuuuaauaauuuuuuaauu

SEQ ID NO: 3696650 - RNA, 19 nt, Human
uagguuuuuuuguauagua

SEQ ID NO: 3696651 - RNA, 16 nt, Human
uaguaaaaauuaaaaa

SEQ ID NO: 3696652 - RNA, 16 nt, Human
uaguaaaacacagagg

SEQ ID NO: 3696653 - RNA, 18 nt, Human
uaguaaaauuuauuucau

SEQ ID NO: 3696654 - RNA, 12 nt, Human
uaguaaagaaau

SEQ ID NO: 3696655 - RNA, 13 nt, Human
uaguaaagaaauu

SEQ ID NO: 3696656 - RNA, 14 nt, Human
uaguaaauaaugcu

SEQ ID NO: 3696657 - RNA, 15 nt, Human
uaguaaauaaugcuu

SEQ ID NO: 3696658 - RNA, 16 nt, Human
uaguaaauaaugcuuu

SEQ ID NO: 3696659 - RNA, 19 nt, Human
uaguaaauaaugcuuugaa

SEQ ID NO: 3696660 - RNA, 14 nt, Human
uaguaacacuaaua

SEQ ID NO: 3696661 - RNA, 22 nt, Human
uaguaacacuaauauauuuaaa

SEQ ID NO: 3696662 - RNA, 12 nt, Human
uaguaacugaca

SEQ ID NO: 3696663 - RNA, 18 nt, Human
uaguaacuucuuauggaa

SEQ ID NO: 3696664 - RNA, 19 nt, Human
uaguaacuucuuauggaau

SEQ ID NO: 3696665 - RNA, 16 nt, Human
uaguaagaaaacauca

SEQ ID NO: 3696666 - RNA, 11 nt, Human
uaguaagaaua

SEQ ID NO: 3696667 - RNA, 21 nt, Human
uaguaagaucucuuucuaaag

SEQ ID NO: 3696668 - RNA, 21 nt, Human
uaguaagauugauaucuauaa

SEQ ID NO: 3696669 - RNA, 22 nt, Human
uaguaagauugauaucuauaaa

SEQ ID NO: 3696670 - RNA, 15 nt, Human
uaguaagcauagaaa

SEQ ID NO: 3696671 - RNA, 17 nt, Human
uaguaaggaguucauuu

SEQ ID NO: 3696672 - RNA, 14 nt, Human
uaguaaggcugugu

SEQ ID NO: 3696673 - RNA, 17 nt, Human
uaguaaguaauuaugca

SEQ ID NO: 3696674 - RNA, 21 nt, Human
uaguaaguaauuaugcacuaa

SEQ ID NO: 3696675 - RNA, 23 nt, Human
uaguaaguuaauguauauaaaaa

SEQ ID NO: 3696676 - RNA, 17 nt, Human
uaguaaguucagcacuu

SEQ ID NO: 3696677 - RNA, 14 nt, Human
uaguaauagagcaa

SEQ ID NO: 3696678 - RNA, 19 nt, Human
uaguaauauauuuaaaggg

SEQ ID NO: 3696679 - RNA, 12 nt, Human
uaguaaucugua

SEQ ID NO: 3696680 - RNA, 21 nt, Human
uaguaaugcuacgugugauuu

SEQ ID NO: 3696681 - RNA, 22 nt, Human
uaguaaugcuacgugugauuuu

SEQ ID NO: 3696682 - RNA, 14 nt, Human
uaguaauucucagg

SEQ ID NO: 3696683 - RNA, 21 nt, Human
uaguaauuucuuuuuuuccuu

SEQ ID NO: 3696684 - RNA, 16 nt, Human
uaguacaaaguuucaa

SEQ ID NO: 3696685 - RNA, 19 nt, Human
uaguacacuuuuaugagcu

SEQ ID NO: 3696686 - RNA, 16 nt, Human
uaguaccaaaugcuuu

SEQ ID NO: 3696687 - RNA, 23 nt, Human
uaguaccaaucauuuuaauuauu

SEQ ID NO: 3696688 - RNA, 20 nt, Human
uaguaccauuuauacaaauu

SEQ ID NO: 3696689 - RNA, 17 nt, Human
uaguacccaccugagcu

SEQ ID NO: 3696690 - RNA, 15 nt, Human
uaguaccugaaaagu

SEQ ID NO: 3696691 - RNA, 14 nt, Human
uaguacuaacuccu

SEQ ID NO: 3696692 - RNA, 16 nt, Human
uaguacuauaucuguu

SEQ ID NO: 3696693 - RNA, 23 nt, Human
uaguacuauaucuguuuuacugc

SEQ ID NO: 3696694 - RNA, 19 nt, Human
uaguacuccugcaaaauuu

SEQ ID NO: 3696695 - RNA, 19 nt, Human
uaguacuccuuaagaacac

SEQ ID NO: 3696696 - RNA, 13 nt, Human
uaguacugcucuu

SEQ ID NO: 3696697 - RNA, 18 nt, Human
uaguacuucuucuguaau

SEQ ID NO: 3696698 - RNA, 15 nt, Human
uaguacuuuauagaa

SEQ ID NO: 3696699 - RNA, 18 nt, Human
uaguacuuuauagaagaa

SEQ ID NO: 3696700 - RNA, 15 nt, Human
uaguagaaauuuuac

SEQ ID NO: 3696701 - RNA, 19 nt, Human
uaguagaaauuuuacaaua

SEQ ID NO: 3696702 - RNA, 12 nt, Human
uaguagagacag

SEQ ID NO: 3696703 - RNA, 22 nt, Human
uaguagagguacacuugugaau

SEQ ID NO: 3696704 - RNA, 23 nt, Human
uaguagauguucuacuuuguucu

SEQ ID NO: 3696705 - RNA, 14 nt, Human
uaguagauuaaaaa

SEQ ID NO: 3696706 - RNA, 17 nt, Human
uaguagcccuuucugug

SEQ ID NO: 3696707 - RNA, 21 nt, Human
uaguagcguuuuuuaaaugua

SEQ ID NO: 3696708 - RNA, 17 nt, Human
uaguagggguaccacug

SEQ ID NO: 3696709 - RNA, 22 nt, Human
uaguagggugagggauaagcaa

SEQ ID NO: 3696710 - RNA, 19 nt, Human
uaguaguuccugcuacaac

SEQ ID NO: 3696711 - RNA, 14 nt, Human
uaguaguucucuug

SEQ ID NO: 3696712 - RNA, 14 nt, Human
uaguaguuuuuaca

SEQ ID NO: 3696713 - RNA, 14 nt, Human
uaguauaaagaaaa

SEQ ID NO: 3696714 - RNA, 16 nt, Human
uaguauaaagaaaagu

SEQ ID NO: 3696715 - RNA, 19 nt, Human
uaguauauuaaaaauggua

SEQ ID NO: 3696716 - RNA, 19 nt, Human
uaguauauuuauauaauua

SEQ ID NO: 3696717 - RNA, 13 nt, Human
uaguaucaaaaga

SEQ ID NO: 3696718 - RNA, 17 nt, Human
uaguaucaguguuuuaa

SEQ ID NO: 3696719 - RNA, 19 nt, Human
uaguaucaguguuuuaaau

SEQ ID NO: 3696720 - RNA, 21 nt, Human
uaguaucaguguuuuaaauuc

SEQ ID NO: 3696721 - RNA, 22 nt, Human
uaguaucaguguuuuaaauucu

SEQ ID NO: 3696722 - RNA, 15 nt, Human
uaguauccuccaggu

SEQ ID NO: 3696723 - RNA, 18 nt, Human
uaguauccuccagguuuu

SEQ ID NO: 3696724 - RNA, 16 nt, Human
uaguaucuaacaugua

SEQ ID NO: 3696725 - RNA, 15 nt, Human
uaguaucuauaugac

SEQ ID NO: 3696726 - RNA, 16 nt, Human
uaguaucuauaugacu

SEQ ID NO: 3696727 - RNA, 19 nt, Human
uaguauggccugugucacu

SEQ ID NO: 3696728 - RNA, 23 nt, Human
uaguauuaucuuguucaggaaaa

SEQ ID NO: 3696729 - RNA, 13 nt, Human
uaguauugacaaa

SEQ ID NO: 3696730 - RNA, 17 nt, Human
uaguauugacaaaaugu

SEQ ID NO: 3696731 - RNA, 18 nt, Human
uaguauugacaaaauguu

SEQ ID NO: 3696732 - RNA, 21 nt, Human
uaguauugacaaaauguuauu

SEQ ID NO: 3696733 - RNA, 22 nt, Human
uaguauugacaaaauguuauuu

SEQ ID NO: 3696734 - RNA, 16 nt, Human
uaguauugcaaaguca

SEQ ID NO: 3696735 - RNA, 16 nt, Human
uaguauuguuguccuu

SEQ ID NO: 3696736 - RNA, 16 nt, Human
uaguauuuauuuaaug

SEQ ID NO: 3696737 - RNA, 22 nt, Human
uaguauuugaaaacagaaauug

SEQ ID NO: 3696738 - RNA, 14 nt, Human
uaguauuugaauua

SEQ ID NO: 3696739 - RNA, 21 nt, Human
uaguauuugaauuaaaacuuc

SEQ ID NO: 3696740 - RNA, 14 nt, Human
uaguauuuucuaaa

SEQ ID NO: 3696741 - RNA, 13 nt, Human
uaguauuuuuauc

SEQ ID NO: 3696742 - RNA, 18 nt, Human
uaguauuuuuuacauuuu

SEQ ID NO: 3696743 - RNA, 14 nt, Human
uagucaaauugugu

SEQ ID NO: 3696744 - RNA, 23 nt, Human
uagucaagaaaaauuauuguaua

SEQ ID NO: 3696745 - RNA, 19 nt, Human
uagucaagacgaacaugua

SEQ ID NO: 3696746 - RNA, 15 nt, Human
uagucaagauugugu

SEQ ID NO: 3696747 - RNA, 21 nt, Human
uagucaaucaagucuguuuac

SEQ ID NO: 3696748 - RNA, 18 nt, Human
uagucaaugacaugaauu

SEQ ID NO: 3696749 - RNA, 19 nt, Human
uagucaccccaaguagucu

SEQ ID NO: 3696750 - RNA, 14 nt, Human
uagucaccuuuuaa

SEQ ID NO: 3696751 - RNA, 14 nt, Human
uagucacugagaca

SEQ ID NO: 3696752 - RNA, 23 nt, Human
uagucacugccugcagaggucug

SEQ ID NO: 3696753 - RNA, 17 nt, Human
uagucacuuauuucaua

SEQ ID NO: 3696754 - RNA, 14 nt, Human
uagucauagaagaa

SEQ ID NO: 3696755 - RNA, 13 nt, Human
uagucauuuacua

SEQ ID NO: 3696756 - RNA, 19 nt, Human
uagucauuuauuuuaaaaa

SEQ ID NO: 3696757 - RNA, 22 nt, Human
uaguccaaugucuuuuuaagcu

SEQ ID NO: 3696758 - RNA, 23 nt, Human
uaguccagcuuuguucuucuuaa

SEQ ID NO: 3696759 - RNA, 15 nt, Human
uagucccagcuacuc

SEQ ID NO: 3696760 - RNA, 21 nt, Human
uagucccagcuacucagaagc

SEQ ID NO: 3696761 - RNA, 17 nt, Human
uagucccuuccacaccc

SEQ ID NO: 3696762 - RNA, 14 nt, Human
uagucccuuccccu

SEQ ID NO: 3696763 - RNA, 22 nt, Human
uaguccgugcugacagcugcuc

SEQ ID NO: 3696764 - RNA, 18 nt, Human
uaguccuagaggaccuga

SEQ ID NO: 3696765 - RNA, 14 nt, Human
uaguccuauucuau

SEQ ID NO: 3696766 - RNA, 22 nt, Human
uaguccugugaaugccacugcc

SEQ ID NO: 3696767 - RNA, 10 nt, Human
uaguccuugg

SEQ ID NO: 3696768 - RNA, 12 nt, Human
uagucgugagcu

SEQ ID NO: 3696769 - RNA, 13 nt, Human
uagucuaagacua

SEQ ID NO: 3696770 - RNA, 19 nt, Human
uagucuagauggcuccucu

SEQ ID NO: 3696771 - RNA, 19 nt, Human
uagucucacugcuugaacu

SEQ ID NO: 3696772 - RNA, 17 nt, Human
uagucuccuuugcacug

SEQ ID NO: 3696773 - RNA, 18 nt, Human
uagucuccuuugcacuga

SEQ ID NO: 3696774 - RNA, 16 nt, Human
uagucucuuuaaaagg

SEQ ID NO: 3696775 - RNA, 15 nt, Human
uagucucuuuauucc

SEQ ID NO: 3696776 - RNA, 18 nt, Human
uagucucuuuauuccuag

SEQ ID NO: 3696777 - RNA, 13 nt, Human
uagucugguuucu

SEQ ID NO: 3696778 - RNA, 18 nt, Human
uagucugugugaagguga

SEQ ID NO: 3696779 - RNA, 17 nt, Human
uagucugugugcugugg

SEQ ID NO: 3696780 - RNA, 18 nt, Human
uagucuucucauagcauu

SEQ ID NO: 3696781 - RNA, 22 nt, Human
uagucuugucucagauuuuauu

SEQ ID NO: 3696782 - RNA, 18 nt, Human
uagucuuuagcuauuacu

SEQ ID NO: 3696783 - RNA, 19 nt, Human
uagucuuuagcuauuacug

SEQ ID NO: 3696784 - RNA, 12 nt, Human
uagucuuucaca

SEQ ID NO: 3696785 - RNA, 22 nt, Human
uagugaaacucguuaauuugua

SEQ ID NO: 3696786 - RNA, 13 nt, Human
uagugaaacuuuu

SEQ ID NO: 3696787 - RNA, 19 nt, Human
uagugaaacuuuucuagaa

SEQ ID NO: 3696788 - RNA, 17 nt, Human
uagugaaccucaccccg

SEQ ID NO: 3696789 - RNA, 21 nt, Human
uugcuuuuugugauaugcaca

SEQ ID NO: 3696790 - RNA, 14 nt, Human
uugcuuuuuuaugg

SEQ ID NO: 3696791 - RNA, 13 nt, Human
uuggaaaaaguga

SEQ ID NO: 3696792 - RNA, 22 nt, Human
uuggaaaagaauacagaaagau

SEQ ID NO: 3696793 - RNA, 12 nt, Human
uuggaaaauaaa

SEQ ID NO: 3696794 - RNA, 17 nt, Human
uuggaaaauaaauuauu

SEQ ID NO: 3696795 - RNA, 14 nt, Human
uuggaaacacuaaa

SEQ ID NO: 3696796 - RNA, 21 nt, Human
uuggaaacacuaaauguuaaa

SEQ ID NO: 3696797 - RNA, 22 nt, Human
uuggaaacauuuuuuaaaacaa

SEQ ID NO: 3696798 - RNA, 18 nt, Human
uuggaaaccugcccugcc

SEQ ID NO: 3696799 - RNA, 21 nt, Human
uuggaaaccugcccugccuga

SEQ ID NO: 3696800 - RNA, 18 nt, Human
uuggaaacuaauaaaaua

SEQ ID NO: 3696801 - RNA, 20 nt, Human
uuggaaacuaauaaaauauu

SEQ ID NO: 3696802 - RNA, 23 nt, Human
uuggaaacuaauaaaauauuuuc

SEQ ID NO: 3696803 - RNA, 18 nt, Human
uuggaaagaagaaagacu

SEQ ID NO: 3696804 - RNA, 20 nt, Human
uuggaaagcaucaccucagg

SEQ ID NO: 3696805 - RNA, 22 nt, Human
uuggaaagcaucaccucaggcc

SEQ ID NO: 3696806 - RNA, 22 nt, Human
uuggaaagcuccuagcagagag

SEQ ID NO: 3696807 - RNA, 21 nt, Human
uuggaaaguacacucugcugu

SEQ ID NO: 3696808 - RNA, 14 nt, Human
uuggaaagucagaa

SEQ ID NO: 3696809 - RNA, 22 nt, Human
uuggaaauagaaauuuccagag

SEQ ID NO: 3696810 - RNA, 24 nt, Human
uuggaaauccuaguuuccucuccu

SEQ ID NO: 3696811 - RNA, 21 nt, Human
uuggaaauuagguugaaacau

SEQ ID NO: 3696812 - RNA, 23 nt, Human
uuggaaauuagguugaaacauau

SEQ ID NO: 3696813 - RNA, 11 nt, Human
uuggaaauucc

SEQ ID NO: 3696814 - RNA, 15 nt, Human
uuggaaauuuagcau

SEQ ID NO: 3696815 - RNA, 17 nt, Human
uuggaaauuuagcauug

SEQ ID NO: 3696816 - RNA, 14 nt, Human
uuggaaauuuguua

SEQ ID NO: 3696817 - RNA, 15 nt, Human
uuggaaccagacucu

SEQ ID NO: 3696818 - RNA, 17 nt, Human
uuggaaccaugccuucc

SEQ ID NO: 3696819 - RNA, 19 nt, Human
uuggaaccuuguuuuggac

SEQ ID NO: 3696820 - RNA, 20 nt, Human
uuggaacuaacacgugaugu

SEQ ID NO: 3696821 - RNA, 22 nt, Human
uuggaacuaacacgugauguga

SEQ ID NO: 3696822 - RNA, 16 nt, Human
uuggaacucugcuuga

SEQ ID NO: 3696823 - RNA, 13 nt, Human
uuggaacuggagg

SEQ ID NO: 3696824 - RNA, 14 nt, Human
uuggaacuggaggc

SEQ ID NO: 3696825 - RNA, 14 nt, Human
uuggaacuugccug

SEQ ID NO: 3696826 - RNA, 15 nt, Human
uuggaagaccccacc

SEQ ID NO: 3696827 - RNA, 14 nt, Human
uuggaagaggaaaa

SEQ ID NO: 3696828 - RNA, 22 nt, Human
uuggaagauggcauaaccuguc

SEQ ID NO: 3696829 - RNA, 15 nt, Human
uuggaagauucagcu

SEQ ID NO: 3696830 - RNA, 19 nt, Human
uuggaagcuccgcuuucua

SEQ ID NO: 3696831 - RNA, 11 nt, Human
uuggaaggaac

SEQ ID NO: 3696832 - RNA, 19 nt, Human
uuggaaggaacguccccug

SEQ ID NO: 3696833 - RNA, 13 nt, Human
uuggaaggagaca

SEQ ID NO: 3696834 - RNA, 18 nt, Human
uuggaaggagacacagau

SEQ ID NO: 3696835 - RNA, 17 nt, Human
uuggaaguuuagcucug

SEQ ID NO: 3696836 - RNA, 15 nt, Human
uuggaaguuuuaauc

SEQ ID NO: 3696837 - RNA, 15 nt, Human
uuggaauauaauugu

SEQ ID NO: 3696838 - RNA, 17 nt, Human
uuggaaucuagaagaaa

SEQ ID NO: 3696839 - RNA, 19 nt, Human
uuggaaucuagaagaaaug

SEQ ID NO: 3696840 - RNA, 23 nt, Human
uuggaaugcacucagacuguaua

SEQ ID NO: 3696841 - RNA, 18 nt, Human
uuggaaugggcagcucau

SEQ ID NO: 3696842 - RNA, 19 nt, Human
uuggaauuaaccuggugcu

SEQ ID NO: 3696843 - RNA, 19 nt, Human
uuggaauuuguaaccucag

SEQ ID NO: 3696844 - RNA, 14 nt, Human
uuggacaaaucaca

SEQ ID NO: 3696845 - RNA, 19 nt, Human
uuggacaaaucacauauuu

SEQ ID NO: 3696846 - RNA, 15 nt, Human
uuggacaagcuucug

SEQ ID NO: 3696847 - RNA, 17 nt, Human
uuggacaagcuucugag

SEQ ID NO: 3696848 - RNA, 19 nt, Human
uuggacaagcuucugagac

SEQ ID NO: 3696849 - RNA, 15 nt, Human
uuggacaaucaugaa

SEQ ID NO: 3696850 - RNA, 15 nt, Human
uuggacacuguacaa

SEQ ID NO: 3696851 - RNA, 18 nt, Human
uuggacacuuaauucugu

SEQ ID NO: 3696852 - RNA, 19 nt, Human
uuggacacuuaauucuguu

SEQ ID NO: 3696853 - RNA, 19 nt, Human
uuggacagaagcagcucuu

SEQ ID NO: 3696854 - RNA, 23 nt, Human
uuggacauagauauuuucacaau

SEQ ID NO: 3696855 - RNA, 18 nt, Human
uuggacauuaagcaucac

SEQ ID NO: 3696856 - RNA, 16 nt, Human
uuggacauuuuauguc

SEQ ID NO: 3696857 - RNA, 18 nt, Human
uuggacauuuucuucaga

SEQ ID NO: 3696858 - RNA, 21 nt, Human
uuggaccaaaaaccaguauug

SEQ ID NO: 3696859 - RNA, 14 nt, Human
uuggaccauuuucc

SEQ ID NO: 3696860 - RNA, 13 nt, Human
uuggaccccagcu

SEQ ID NO: 3696861 - RNA, 20 nt, Human
uuggaccccagcugggaggc

SEQ ID NO: 3696862 - RNA, 15 nt, Human
uuggacccgcucugg

SEQ ID NO: 3696863 - RNA, 16 nt, Human
uuggacccgcucugga

SEQ ID NO: 3696864 - RNA, 16 nt, Human
uuggacccuuccaugg

SEQ ID NO: 3696865 - RNA, 21 nt, Human
uuggaccuaaauggccucaug

SEQ ID NO: 3696866 - RNA, 18 nt, Human
uuggaccucgugcuuuaa

SEQ ID NO: 3696867 - RNA, 15 nt, Human
uuggaccucugcucu

SEQ ID NO: 3696868 - RNA, 18 nt, Human
uuggaccucugcucugag

SEQ ID NO: 3696869 - RNA, 21 nt, Human
uuggaccucugcucugaggcu

SEQ ID NO: 3696870 - RNA, 22 nt, Human
uuggaccuuacgaucaggcaca

SEQ ID NO: 3696871 - RNA, 21 nt, Human
uuggacggccugaugcucccu

SEQ ID NO: 3696872 - RNA, 15 nt, Human
uuggacucuugcucu

SEQ ID NO: 3696873 - RNA, 16 nt, Human
uuggacucuugcucuu

SEQ ID NO: 3696874 - RNA, 13 nt, Human
uuggacuucuggg

SEQ ID NO: 3696875 - RNA, 23 nt, Human
uuggacuuucaaaauuaaaucug

SEQ ID NO: 3696876 - RNA, 18 nt, Human
uuggacuuuucguuaaca

SEQ ID NO: 3696877 - RNA, 14 nt, Human
uuggagaaauuauu

SEQ ID NO: 3696878 - RNA, 15 nt, Human
uuggagaaauuauuu

SEQ ID NO: 3696879 - RNA, 15 nt, Human
uuggagaagaacuga

SEQ ID NO: 3696880 - RNA, 20 nt, Human
uuggagaagcccgugugaga

SEQ ID NO: 3696881 - RNA, 18 nt, Human
uuggagaagucucagcua

SEQ ID NO: 3696882 - RNA, 18 nt, Human
uuggagaauuuagguuuu

SEQ ID NO: 3696883 - RNA, 11 nt, Human
uuggagacaga

SEQ ID NO: 3696884 - RNA, 18 nt, Human
uuggagaguaaaaacuga

SEQ ID NO: 3696885 - RNA, 20 nt, Human
uuggagaguaaaaacugaau

SEQ ID NO: 3696886 - RNA, 14 nt, Human
uuggagaucaagga

SEQ ID NO: 3696887 - RNA, 22 nt, Human
uuggagaugcugaggguguuuc

SEQ ID NO: 3696888 - RNA, 11 nt, Human
uuggagccugc

SEQ ID NO: 3696889 - RNA, 15 nt, Human
uuggagccugcagag

SEQ ID NO: 3696890 - RNA, 14 nt, Human
uuggagccugcagg

SEQ ID NO: 3696891 - RNA, 19 nt, Human
uuggagcucguggaacagu

SEQ ID NO: 3696892 - RNA, 13 nt, Human
uuggagcucugag

SEQ ID NO: 3696893 - RNA, 14 nt, Human
uuggagcuucaugg

SEQ ID NO: 3696894 - RNA, 21 nt, Human
uuggaggcaauccuaccuugc

SEQ ID NO: 3696895 - RNA, 16 nt, Human
uuggaggccuuuagau

SEQ ID NO: 3696896 - RNA, 22 nt, Human
uuggagggcccacuuguauccu

SEQ ID NO: 3696897 - RNA, 15 nt, Human
uuggagggccugggc

SEQ ID NO: 3696898 - RNA, 22 nt, Human
uuggagggucccaagcugggcc

SEQ ID NO: 3696899 - RNA, 14 nt, Human
uuggaguagaaugu

SEQ ID NO: 3696900 - RNA, 19 nt, Human
uuggaguucauucauauua

SEQ ID NO: 3696901 - RNA, 15 nt, Human
uuggauaauaaggaa

SEQ ID NO: 3696902 - RNA, 19 nt, Human
uuggauaauaaggaaaagu

SEQ ID NO: 3696903 - RNA, 22 nt, Human
uuggauacagcaguagacauuu

SEQ ID NO: 3696904 - RNA, 20 nt, Human
uuggauauguaaaacauuua

SEQ ID NO: 3696905 - RNA, 16 nt, Human
uuggaucuugaaugug

SEQ ID NO: 3696906 - RNA, 17 nt, Human
uuggaucuugaaugugg

SEQ ID NO: 3696907 - RNA, 16 nt, Human
uuggauggcuugucua

SEQ ID NO: 3696908 - RNA, 21 nt, Human
uuggaugggagugagacagaa

SEQ ID NO: 3696909 - RNA, 15 nt, Human
uuggauuaaauacau

SEQ ID NO: 3696910 - RNA, 20 nt, Human
uuggauuauucauuuaaaau

SEQ ID NO: 3696911 - RNA, 17 nt, Human
uuggauuauucuuucuc

SEQ ID NO: 3696912 - RNA, 15 nt, Human
uuggauuauuuaaua

SEQ ID NO: 3696913 - RNA, 18 nt, Human
uuggauuauuuaauaaca

SEQ ID NO: 3696914 - RNA, 14 nt, Human
uuggauuguauauu

SEQ ID NO: 3696915 - RNA, 21 nt, Human
uuggauuuaaaagccugcuca

SEQ ID NO: 3696916 - RNA, 14 nt, Human
uuggauuuccuaau

SEQ ID NO: 3696917 - RNA, 22 nt, Human
uuggauuuuauguugacauuug

SEQ ID NO: 3696918 - RNA, 20 nt, Human
uuggauuuugcaaggugcau

SEQ ID NO: 3696919 - RNA, 21 nt, Human
uuggauuuuuaauuaaaaacu

SEQ ID NO: 3696920 - RNA, 15 nt, Human
uuggcaaaagccuug

SEQ ID NO: 3696921 - RNA, 20 nt, Human
uuggcaaaagccuuguguau

SEQ ID NO: 3696922 - RNA, 15 nt, Human
uuggcacagaaacac

SEQ ID NO: 3696923 - RNA, 13 nt, Human
uuggcaccagaca

SEQ ID NO: 3696924 - RNA, 23 nt, Human
uuggcaccagacacccaggacuu

SEQ ID NO: 3696925 - RNA, 16 nt, Human
uuggcaccuucccccu

SEQ ID NO: 3696926 - RNA, 16 nt, Human
uuggcagaugcagcuc

SEQ ID NO: 3696927 - RNA, 21 nt, Human
uuggcagaugcagcucuuccu

SEQ ID NO: 3696928 - RNA, 22 nt, Human
uuggcagaugcagcucuuccug

SEQ ID NO: 3696929 - RNA, 18 nt, Human
uuggcagcaggugcugcu

SEQ ID NO: 3696930 - RNA, 21 nt, Human
uuggcagcaggugcugcuacc

SEQ ID NO: 3696931 - RNA, 13 nt, Human
uuggcagccuugu

SEQ ID NO: 3696932 - RNA, 20 nt, Human
uuggcagguaggaauauuau

SEQ ID NO: 3696933 - RNA, 14 nt, Human
uuggcagucugaau

SEQ ID NO: 3696934 - RNA, 19 nt, Human
uuggcauaacauaaaucug

SEQ ID NO: 3696935 - RNA, 23 nt, Human
uuggcauaacauaaaucugugaa

SEQ ID NO: 3696936 - RNA, 17 nt, Human
uuggcaucccugggccu

SEQ ID NO: 3696937 - RNA, 16 nt, Human
uuggcauggaaauuua

SEQ ID NO: 3696938 - RNA, 23 nt, Human
uucagcacuuuagaauaugccuu

SEQ ID NO: 3696939 - RNA, 19 nt, Human
uucagcagcaaauuuucag

SEQ ID NO: 3696940 - RNA, 16 nt, Human
uucagcauauuuauag

SEQ ID NO: 3696941 - RNA, 13 nt, Human
uucagcaucugac

SEQ ID NO: 3696942 - RNA, 22 nt, Human
uucagcaugaaaauguguguuu

SEQ ID NO: 3696943 - RNA, 11 nt, Human
uucagcauuug

SEQ ID NO: 3696944 - RNA, 18 nt, Human
uucagccaccagccccug

SEQ ID NO: 3696945 - RNA, 13 nt, Human
uucagcccaucuc

SEQ ID NO: 3696946 - RNA, 13 nt, Human
uucagccuaagag

SEQ ID NO: 3696947 - RNA, 21 nt, Human
uucagccuagccgaccucagc

SEQ ID NO: 3696948 - RNA, 12 nt, Human
uucagccucugg

SEQ ID NO: 3696949 - RNA, 14 nt, Human
uucagccugccuuc

SEQ ID NO: 3696950 - RNA, 18 nt, Human
uucagcuaagggaagaca

SEQ ID NO: 3696951 - RNA, 14 nt, Human
uucagcuaggaaca

SEQ ID NO: 3696952 - RNA, 22 nt, Human
uucagcuaggaacaaaucuucc

SEQ ID NO: 3696953 - RNA, 13 nt, Human
uucagcucacugu

SEQ ID NO: 3696954 - RNA, 15 nt, Human
uucagcuccagcccc

SEQ ID NO: 3696955 - RNA, 21 nt, Human
uucagcuccagccccuuucca

SEQ ID NO: 3696956 - RNA, 23 nt, Human
uucagcuccagccccuuuccaaa

SEQ ID NO: 3696957 - RNA, 15 nt, Human
uucagcuccagcuca

SEQ ID NO: 3696958 - RNA, 10 nt, Human
uucagcuccu

SEQ ID NO: 3696959 - RNA, 18 nt, Human
uucagcucucuguauaaa

SEQ ID NO: 3696960 - RNA, 21 nt, Human
uucagcucucuguauaaacau

SEQ ID NO: 3696961 - RNA, 15 nt, Human
uucagcucugaaaga

SEQ ID NO: 3696962 - RNA, 17 nt, Human
uucagcucugcaagaau

SEQ ID NO: 3696963 - RNA, 24 nt, Human
uucagcucugcaagaauugaagca

SEQ ID NO: 3696964 - RNA, 13 nt, Human
uucagcucuuuuu

SEQ ID NO: 3696965 - RNA, 13 nt, Human
uucagcugccagu

SEQ ID NO: 3696966 - RNA, 13 nt, Human
uucagcugcccca

SEQ ID NO: 3696967 - RNA, 15 nt, Human
uucagcuguccuccc

SEQ ID NO: 3696968 - RNA, 16 nt, Human
uucagcugucuuuugg

SEQ ID NO: 3696969 - RNA, 20 nt, Human
uucagcugucuuuuggagga

SEQ ID NO: 3696970 - RNA, 14 nt, Human
uucagcuucauuug

SEQ ID NO: 3696971 - RNA, 17 nt, Human
uucagcuucugcugggc

SEQ ID NO: 3696972 - RNA, 19 nt, Human
uucaggaaaagccucugug

SEQ ID NO: 3696973 - RNA, 18 nt, Human
uucaggaaaaggccuggg

SEQ ID NO: 3696974 - RNA, 20 nt, Human
uucaggaaccucgaguacug

SEQ ID NO: 3696975 - RNA, 11 nt, Human
uucaggaagcu

SEQ ID NO: 3696976 - RNA, 16 nt, Human
uucaggaagcucaggg

SEQ ID NO: 3696977 - RNA, 19 nt, Human
uucaggaauguguggccug

SEQ ID NO: 3696978 - RNA, 18 nt, Human
uucaggacacucacuaca

SEQ ID NO: 3696979 - RNA, 20 nt, Human
uucaggagcagccucagaac

SEQ ID NO: 3696980 - RNA, 17 nt, Human
uucaggagcgcaagaua

SEQ ID NO: 3696981 - RNA, 18 nt, Human
uucaggaggaauacugaa

SEQ ID NO: 3696982 - RNA, 12 nt, Human
uucaggagggau

SEQ ID NO: 3696983 - RNA, 17 nt, Human
uucaggauacucuguca

SEQ ID NO: 3696984 - RNA, 17 nt, Human
uucaggcauuuuccccc

SEQ ID NO: 3696985 - RNA, 13 nt, Human
uucaggcugcuug

SEQ ID NO: 3696986 - RNA, 19 nt, Human
uucagggaagauaaguugg

SEQ ID NO: 3696987 - RNA, 23 nt, Human
uucagggaaggaggagccugucc

SEQ ID NO: 3696988 - RNA, 16 nt, Human
uucagggcagauuuua

SEQ ID NO: 3696989 - RNA, 23 nt, Human
uucagggcagauuuuaguuuuau

SEQ ID NO: 3696990 - RNA, 17 nt, Human
uucaggggacucagccc

SEQ ID NO: 3696991 - RNA, 19 nt, Human
uucaggggacucagcccug

SEQ ID NO: 3696992 - RNA, 23 nt, Human
uucaggggcuagcuaagccaaga

SEQ ID NO: 3696993 - RNA, 23 nt, Human
uucagggugcagcccaaucugcc

SEQ ID NO: 3696994 - RNA, 22 nt, Human
uucaggguuggccccugcccgg

SEQ ID NO: 3696995 - RNA, 16 nt, Human
uucagguaacaggcag

SEQ ID NO: 3696996 - RNA, 20 nt, Human
uucagguagaggugcaugcc

SEQ ID NO: 3696997 - RNA, 19 nt, Human
uucagguagcugccccugg

SEQ ID NO: 3696998 - RNA, 14 nt, Human
uucaggugacaugu

SEQ ID NO: 3696999 - RNA, 16 nt, Human
uucaggugacauguga

SEQ ID NO: 3697000 - RNA, 17 nt, Human
uucaggugacaugugaa

SEQ ID NO: 3697001 - RNA, 18 nt, Human
uucaggugcagaggaagu

SEQ ID NO: 3697002 - RNA, 19 nt, Human
uucagguuaucgaaauaac

SEQ ID NO: 3697003 - RNA, 16 nt, Human
uucaguaauaaaacau

SEQ ID NO: 3697004 - RNA, 18 nt, Human
uucaguaauaaaacaucu

SEQ ID NO: 3697005 - RNA, 20 nt, Human
uucaguaauaaacuguguuu

SEQ ID NO: 3697006 - RNA, 21 nt, Human
uucaguacuuuuuuaaauauu

SEQ ID NO: 3697007 - RNA, 23 nt, Human
uucaguauaauuuaacuucagag

SEQ ID NO: 3697008 - RNA, 19 nt, Human
uucaguauguugucaaaga

SEQ ID NO: 3697009 - RNA, 16 nt, Human
uucaguauguuuuaca

SEQ ID NO: 3697010 - RNA, 19 nt, Human
uucaguauguuuuacacug

SEQ ID NO: 3697011 - RNA, 20 nt, Human
uucaguauguuuuacacugu

SEQ ID NO: 3697012 - RNA, 16 nt, Human
uucagucauuaaauua

SEQ ID NO: 3697013 - RNA, 18 nt, Human
uucagucucuauaccaau

SEQ ID NO: 3697014 - RNA, 21 nt, Human
uucagugauaacuccuaagag

SEQ ID NO: 3697015 - RNA, 16 nt, Human
uucagugauuacuguc

SEQ ID NO: 3697016 - RNA, 13 nt, Human
uucagugccaaua

SEQ ID NO: 3697017 - RNA, 14 nt, Human
uucagugcccacca

SEQ ID NO: 3697018 - RNA, 13 nt, Human
uucagugcugugg

SEQ ID NO: 3697019 - RNA, 21 nt, Human
uucagugcuguggccugggca

SEQ ID NO: 3697020 - RNA, 13 nt, Human
uucaguggcagcu

SEQ ID NO: 3697021 - RNA, 14 nt, Human
uucaguggcagcug

SEQ ID NO: 3697022 - RNA, 17 nt, Human
uucaguggcagcugcuu

SEQ ID NO: 3697023 - RNA, 20 nt, Human
uucaguggcagggcucagga

SEQ ID NO: 3697024 - RNA, 13 nt, Human
uucaguguaauuu

SEQ ID NO: 3697025 - RNA, 17 nt, Human
uucaguguaauuucuuu

SEQ ID NO: 3697026 - RNA, 19 nt, Human
uucaguguaauuucuuugc

SEQ ID NO: 3697027 - RNA, 13 nt, Human
uucaguguacaug

SEQ ID NO: 3697028 - RNA, 16 nt, Human
uucaguguaguuaauu

SEQ ID NO: 3697029 - RNA, 18 nt, Human
uucaguguaguuaauuua

SEQ ID NO: 3697030 - RNA, 20 nt, Human
uucaguguaguuaauuuauc

SEQ ID NO: 3697031 - RNA, 15 nt, Human
uucaguguauuucag

SEQ ID NO: 3697032 - RNA, 22 nt, Human
uucagugucaaauaaacacugu

SEQ ID NO: 3697033 - RNA, 23 nt, Human
uucagugucaaauaaacacugug

SEQ ID NO: 3697034 - RNA, 13 nt, Human
uucagugucccgg

SEQ ID NO: 3697035 - RNA, 18 nt, Human
uucagugucccgggcccg

SEQ ID NO: 3697036 - RNA, 12 nt, Human
uucaguguuaaa

SEQ ID NO: 3697037 - RNA, 10 nt, Human
uucaguguuu

SEQ ID NO: 3697038 - RNA, 14 nt, Human
uucaguuaagaaaa

SEQ ID NO: 3697039 - RNA, 16 nt, Human
uucaguuaagaaaaaa

SEQ ID NO: 3697040 - RNA, 18 nt, Human
uucaguuaagaaaaaaau

SEQ ID NO: 3697041 - RNA, 11 nt, Human
uucaguuacag

SEQ ID NO: 3697042 - RNA, 13 nt, Human
uucaguuacagaa

SEQ ID NO: 3697043 - RNA, 15 nt, Human
uucaguuacagaaag

SEQ ID NO: 3697044 - RNA, 16 nt, Human
uucaguuacagaaagu

SEQ ID NO: 3697045 - RNA, 22 nt, Human
uucaguucaaagucaugauguu

SEQ ID NO: 3697046 - RNA, 17 nt, Human
uucaguucccagaauca

SEQ ID NO: 3697047 - RNA, 16 nt, Human
uucaguucuaggaaaa

SEQ ID NO: 3697048 - RNA, 14 nt, Human
uucaguucuuugga

SEQ ID NO: 3697049 - RNA, 17 nt, Human
uucaguugcuugucuuc

SEQ ID NO: 3697050 - RNA, 19 nt, Human
uucaguugcuugucuucug

SEQ ID NO: 3697051 - RNA, 19 nt, Human
uucaguuggcugacuucca

SEQ ID NO: 3697052 - RNA, 20 nt, Human
uucaguuguguuuguugcug

SEQ ID NO: 3697053 - RNA, 22 nt, Human
uucaguuguguuuguugcuggc

SEQ ID NO: 3697054 - RNA, 17 nt, Human
uucaguuguucuuuuua

SEQ ID NO: 3697055 - RNA, 17 nt, Human
uucaguuuuaucuuuaa

SEQ ID NO: 3697056 - RNA, 19 nt, Human
uucauaaacaacuuaaugu

SEQ ID NO: 3697057 - RNA, 19 nt, Human
uucauaacuuauugcugau

SEQ ID NO: 3697058 - RNA, 21 nt, Human
uucauaacuuauugcugauuu

SEQ ID NO: 3697059 - RNA, 16 nt, Human
uucauaacuuccugua

SEQ ID NO: 3697060 - RNA, 17 nt, Human
uucauaacuuucauuaa

SEQ ID NO: 3697061 - RNA, 22 nt, Human
uucauaagccaauuuuucugca

SEQ ID NO: 3697062 - RNA, 23 nt, Human
uucauaagccaauuuuucugcac

SEQ ID NO: 3697063 - RNA, 17 nt, Human
uucauaaguauuucaaa

SEQ ID NO: 3697064 - RNA, 14 nt, Human
uucauaaucuuugc

SEQ ID NO: 3697065 - RNA, 23 nt, Human
uucauaaugacuuaagcacacuu

SEQ ID NO: 3697066 - RNA, 11 nt, Human
uucauaauggc

SEQ ID NO: 3697067 - RNA, 20 nt, Human
uucauaauggccugagacuu

SEQ ID NO: 3697068 - RNA, 19 nt, Human
uucauaauuauuauuuggc

SEQ ID NO: 3697069 - RNA, 13 nt, Human
uucauacauugua

SEQ ID NO: 3697070 - RNA, 19 nt, Human
uucauacauuguacgaaga

SEQ ID NO: 3697071 - RNA, 22 nt, Human
uucauaccuaaguacuguaaua

SEQ ID NO: 3697072 - RNA, 19 nt, Human
uucauaccuacauguauuu

SEQ ID NO: 3697073 - RNA, 14 nt, Human
uucauacuuaaaaa

SEQ ID NO: 3697074 - RNA, 13 nt, Human
uucauacuugaac

SEQ ID NO: 3697075 - RNA, 15 nt, Human
uucauagaaaaagua

SEQ ID NO: 3697076 - RNA, 18 nt, Human
uucauagagacuugggaa

SEQ ID NO: 3697077 - RNA, 18 nt, Human
uucauagagauuugucua

SEQ ID NO: 3697078 - RNA, 19 nt, Human
uucauagcuaagaaauaaa

SEQ ID NO: 3697079 - RNA, 15 nt, Human
uucauagcuguacuu

SEQ ID NO: 3697080 - RNA, 13 nt, Human
uucauaggagaca

SEQ ID NO: 3697081 - RNA, 16 nt, Human
uucauaggagacacau

SEQ ID NO: 3697082 - RNA, 13 nt, Human
uucauaggucuga

SEQ ID NO: 3697083 - RNA, 17 nt, Human
uucauaggucugaaauu

SEQ ID NO: 3697084 - RNA, 22 nt, Human
uucauaggucugaaauuuuucu

SEQ ID NO: 3697085 - RNA, 17 nt, Human
uucauaguaacuucuua

SEQ ID NO: 3697086 - RNA, 21 nt, Human
uucauauaguuagcuaauaaa

SEQ ID NO: 3697087 - RNA, 15 nt, Human
uucauaucauccaca

SEQ ID NO: 3697088 - RNA, 18 nt, Human
uagugaagacuccagaaa

SEQ ID NO: 3697089 - RNA, 23 nt, Human
uagugaauuaucccuuuucuuga

SEQ ID NO: 3697090 - RNA, 20 nt, Human
uagugacccggaggccacau

SEQ ID NO: 3697091 - RNA, 19 nt, Human
uagugacuuuucaaguauu

SEQ ID NO: 3697092 - RNA, 15 nt, Human
uagugagaagaauau

SEQ ID NO: 3697093 - RNA, 15 nt, Human
uagugagaccccugu

SEQ ID NO: 3697094 - RNA, 18 nt, Human
uagugagaccccugucuc

SEQ ID NO: 3697095 - RNA, 13 nt, Human
uagugagcccaga

SEQ ID NO: 3697096 - RNA, 19 nt, Human
uagugaucaaauugugcag

SEQ ID NO: 3697097 - RNA, 18 nt, Human
uagugaucugaacagaaa

SEQ ID NO: 3697098 - RNA, 15 nt, Human
uagugcaaauuguca

SEQ ID NO: 3697099 - RNA, 17 nt, Human
uagugcaauauauuuug

SEQ ID NO: 3697100 - RNA, 18 nt, Human
uagugcaauauauuuugu

SEQ ID NO: 3697101 - RNA, 15 nt, Human
uagugcacaaaauga

SEQ ID NO: 3697102 - RNA, 15 nt, Human
uagugcagcugaaau

SEQ ID NO: 3697103 - RNA, 15 nt, Human
uagugcagcugauuu

SEQ ID NO: 3697104 - RNA, 17 nt, Human
uagugcagcugauuuua

SEQ ID NO: 3697105 - RNA, 18 nt, Human
uagugcagcugauuuuaa

SEQ ID NO: 3697106 - RNA, 16 nt, Human
uagugcaguuauuugc

SEQ ID NO: 3697107 - RNA, 19 nt, Human
uagugcaucuuugccucuc

SEQ ID NO: 3697108 - RNA, 17 nt, Human
uagugcccuccacagcc

SEQ ID NO: 3697109 - RNA, 19 nt, Human
uagugccuucuaaaggugu

SEQ ID NO: 3697110 - RNA, 15 nt, Human
uagugcuacaggguc

SEQ ID NO: 3697111 - RNA, 17 nt, Human
uagugcuacagggucca

SEQ ID NO: 3697112 - RNA, 15 nt, Human
uagugcuauauauau

SEQ ID NO: 3697113 - RNA, 21 nt, Human
uagugcuauauauauaaauau

SEQ ID NO: 3697114 - RNA, 19 nt, Human
uagugcucgcuuucuaugu

SEQ ID NO: 3697115 - RNA, 12 nt, Human
uagugcugaagc

SEQ ID NO: 3697116 - RNA, 15 nt, Human
uagugcugaagcuua

SEQ ID NO: 3697117 - RNA, 17 nt, Human
uagugcugaagcuuauu

SEQ ID NO: 3697118 - RNA, 22 nt, Human
uagugcugcugugugcuuuuuu

SEQ ID NO: 3697119 - RNA, 13 nt, Human
uagugcugugaaa

SEQ ID NO: 3697120 - RNA, 23 nt, Human
uagugcuuuccuuuuuuaaaaau

SEQ ID NO: 3697121 - RNA, 23 nt, Human
uaguggaaaaacacauggggaaa

SEQ ID NO: 3697122 - RNA, 18 nt, Human
uaguggacccugaaaugu

SEQ ID NO: 3697123 - RNA, 19 nt, Human
uaguggacccugaaaugug

SEQ ID NO: 3697124 - RNA, 16 nt, Human
uaguggccagaccaga

SEQ ID NO: 3697125 - RNA, 18 nt, Human
uaguggccaucauuucug

SEQ ID NO: 3697126 - RNA, 15 nt, Human
uagugggccagggcu

SEQ ID NO: 3697127 - RNA, 18 nt, Human
uaguggggucucccucuc

SEQ ID NO: 3697128 - RNA, 23 nt, Human
uaguggggucucccucuccugcc

SEQ ID NO: 3697129 - RNA, 15 nt, Human
uaguggucuuuguaa

SEQ ID NO: 3697130 - RNA, 16 nt, Human
uaguggucuuuguaag

SEQ ID NO: 3697131 - RNA, 13 nt, Human
uagugguggcucu

SEQ ID NO: 3697132 - RNA, 18 nt, Human
uagugguucuuggaaaaa

SEQ ID NO: 3697133 - RNA, 13 nt, Human
uaguguaaaaaug

SEQ ID NO: 3697134 - RNA, 14 nt, Human
uaguguaaaaauga

SEQ ID NO: 3697135 - RNA, 22 nt, Human
uaguguaaaaaugagaacaugu

SEQ ID NO: 3697136 - RNA, 11 nt, Human
uaguguaaaau

SEQ ID NO: 3697137 - RNA, 19 nt, Human
uaguguaaaauaagaauga

SEQ ID NO: 3697138 - RNA, 15 nt, Human
uaguguaggcuuuac

SEQ ID NO: 3697139 - RNA, 21 nt, Human
uaguguaggcuuuacuuagcu

SEQ ID NO: 3697140 - RNA, 19 nt, Human
uaguguaucaaaaugcucu

SEQ ID NO: 3697141 - RNA, 19 nt, Human
uaguguaugauuacuggcc

SEQ ID NO: 3697142 - RNA, 23 nt, Human
uaguguccauuuugugaagcccu

SEQ ID NO: 3697143 - RNA, 12 nt, Human
uagugucuauca

SEQ ID NO: 3697144 - RNA, 18 nt, Human
uagugucuggaucaguaa

SEQ ID NO: 3697145 - RNA, 21 nt, Human
uagugucuggaucaguaaaau

SEQ ID NO: 3697146 - RNA, 17 nt, Human
uagugugaaauauauua

SEQ ID NO: 3697147 - RNA, 20 nt, Human
uaguguguugugcuuucaag

SEQ ID NO: 3697148 - RNA, 12 nt, Human
uaguguuaauca

SEQ ID NO: 3697149 - RNA, 14 nt, Human
uaguguuaaucaau

SEQ ID NO: 3697150 - RNA, 23 nt, Human
uaguguuaaucaauuuaaaccca

SEQ ID NO: 3697151 - RNA, 22 nt, Human
uaguguuauugagagagaugug

SEQ ID NO: 3697152 - RNA, 12 nt, Human
uaguguucuguu

SEQ ID NO: 3697153 - RNA, 17 nt, Human
uaguguuucugugcaug

SEQ ID NO: 3697154 - RNA, 20 nt, Human
uaguguuuggguauauucau

SEQ ID NO: 3697155 - RNA, 13 nt, Human
uaguuaaagaaag

SEQ ID NO: 3697156 - RNA, 15 nt, Human
uaguuaaauuucugg

SEQ ID NO: 3697157 - RNA, 14 nt, Human
uaguuaagacauga

SEQ ID NO: 3697158 - RNA, 18 nt, Human
uaguuaauuuaucuaaau

SEQ ID NO: 3697159 - RNA, 22 nt, Human
uaguuaccuuauaguuacugug

SEQ ID NO: 3697160 - RNA, 23 nt, Human
uaguuaccuuauaguuacugugu

SEQ ID NO: 3697161 - RNA, 14 nt, Human
uaguuacuguaaaa

SEQ ID NO: 3697162 - RNA, 15 nt, Human
uaguuacuguguaaa

SEQ ID NO: 3697163 - RNA, 16 nt, Human
uaguuacuguguaaac

SEQ ID NO: 3697164 - RNA, 17 nt, Human
uaguuacuguguaauua

SEQ ID NO: 3697165 - RNA, 19 nt, Human
uaguuacuguguaauuagu

SEQ ID NO: 3697166 - RNA, 22 nt, Human
uaguuagccaauauuuuucuua

SEQ ID NO: 3697167 - RNA, 15 nt, Human
uaguuauaguuucag

SEQ ID NO: 3697168 - RNA, 15 nt, Human
uaguuauauaauugu

SEQ ID NO: 3697169 - RNA, 12 nt, Human
uaguuaucaugu

SEQ ID NO: 3697170 - RNA, 13 nt, Human
uaguuaucauguu

SEQ ID NO: 3697171 - RNA, 14 nt, Human
uaguuaucauguua

SEQ ID NO: 3697172 - RNA, 15 nt, Human
uaguuaucauguuag

SEQ ID NO: 3697173 - RNA, 19 nt, Human
uaguuauguaaauaauucu

SEQ ID NO: 3697174 - RNA, 13 nt, Human
uaguuauuuugca

SEQ ID NO: 3697175 - RNA, 21 nt, Human
uaguucaagaaaugaagagcu

SEQ ID NO: 3697176 - RNA, 19 nt, Human
uaguucaauauuuguuacu

SEQ ID NO: 3697177 - RNA, 16 nt, Human
uaguucaaucuggauu

SEQ ID NO: 3697178 - RNA, 23 nt, Human
uaguucaaucuggauucauauuu

SEQ ID NO: 3697179 - RNA, 15 nt, Human
uaguucagacacuuu

SEQ ID NO: 3697180 - RNA, 20 nt, Human
uaguucauccaauccucacu

SEQ ID NO: 3697181 - RNA, 14 nt, Human
uaguucauguaaau

SEQ ID NO: 3697182 - RNA, 22 nt, Human
uaguucauguaaauaauacauu

SEQ ID NO: 3697183 - RNA, 20 nt, Human
uaguuccaccaucaagccac

SEQ ID NO: 3697184 - RNA, 20 nt, Human
uaguuccacuuauagccucu

SEQ ID NO: 3697185 - RNA, 18 nt, Human
uaguucccucugcucagc

SEQ ID NO: 3697186 - RNA, 16 nt, Human
uaguuccuaagaagcu

SEQ ID NO: 3697187 - RNA, 21 nt, Human
uaguuccugcuaaaacaauga

SEQ ID NO: 3697188 - RNA, 22 nt, Human
uaguucuagaaaaacaggcacu

SEQ ID NO: 3697189 - RNA, 12 nt, Human
uaguucuagaca

SEQ ID NO: 3697190 - RNA, 22 nt, Human
uaguucuagugcagcugaaauu

SEQ ID NO: 3697191 - RNA, 22 nt, Human
uaguucucuugguguuaaaaca

SEQ ID NO: 3697192 - RNA, 14 nt, Human
uaguucugccagga

SEQ ID NO: 3697193 - RNA, 15 nt, Human
uaguucugcuccaga

SEQ ID NO: 3697194 - RNA, 16 nt, Human
uaguucuguagaaaug

SEQ ID NO: 3697195 - RNA, 12 nt, Human
uaguucuguauu

SEQ ID NO: 3697196 - RNA, 15 nt, Human
uaguucuguauuuga

SEQ ID NO: 3697197 - RNA, 17 nt, Human
uaguucuguauuugaaa

SEQ ID NO: 3697198 - RNA, 22 nt, Human
uaguucuguuugguguguccca

SEQ ID NO: 3697199 - RNA, 19 nt, Human
uaguugaaacgcagacacu

SEQ ID NO: 3697200 - RNA, 22 nt, Human
uaguugaacugauaguuacugu

SEQ ID NO: 3697201 - RNA, 13 nt, Human
uaguugaauacuu

SEQ ID NO: 3697202 - RNA, 17 nt, Human
uaguugaauacuugaac

SEQ ID NO: 3697203 - RNA, 21 nt, Human
uaguugaauacuugaaccaua

SEQ ID NO: 3697204 - RNA, 17 nt, Human
uaguugagccagcagac

SEQ ID NO: 3697205 - RNA, 20 nt, Human
uaguugagccagcagacauu

SEQ ID NO: 3697206 - RNA, 23 nt, Human
uaguugagccagcagacauuguc

SEQ ID NO: 3697207 - RNA, 12 nt, Human
uaguugagcccc

SEQ ID NO: 3697208 - RNA, 17 nt, Human
uaguugagccccaaguc

SEQ ID NO: 3697209 - RNA, 13 nt, Human
uaguugauauguu

SEQ ID NO: 3697210 - RNA, 20 nt, Human
uaguugcaacuuuguauaaa

SEQ ID NO: 3697211 - RNA, 19 nt, Human
uaguugcagaaacauuuug

SEQ ID NO: 3697212 - RNA, 18 nt, Human
uaguugcagacucaguuu

SEQ ID NO: 3697213 - RNA, 15 nt, Human
uaguugcuccgccuc

SEQ ID NO: 3697214 - RNA, 16 nt, Human
uaguugcuccgccucu

SEQ ID NO: 3697215 - RNA, 16 nt, Human
uaguuggcagaaauac

SEQ ID NO: 3697216 - RNA, 17 nt, Human
uaguuggcagaaauaca

SEQ ID NO: 3697217 - RNA, 18 nt, Human
uaguuguaaaccaaguga

SEQ ID NO: 3697218 - RNA, 18 nt, Human
uaguugucaguauuauuc

SEQ ID NO: 3697219 - RNA, 21 nt, Human
uaguuguccauauuuucacag

SEQ ID NO: 3697220 - RNA, 18 nt, Human
uaguuguguacucuggcc

SEQ ID NO: 3697221 - RNA, 12 nt, Human
uaguugugucug

SEQ ID NO: 3697222 - RNA, 14 nt, Human
uaguuguuaaguuu

SEQ ID NO: 3697223 - RNA, 16 nt, Human
uaguuguuuuaaguac

SEQ ID NO: 3697224 - RNA, 13 nt, Human
uaguuuacagaaa

SEQ ID NO: 3697225 - RNA, 20 nt, Human
uaguuuacagaaaaaucuug

SEQ ID NO: 3697226 - RNA, 14 nt, Human
uaguuuacuguuuu

SEQ ID NO: 3697227 - RNA, 14 nt, Human
uaguuuauaaaaga

SEQ ID NO: 3697228 - RNA, 18 nt, Human
uaguuuauacaguuuuaa

SEQ ID NO: 3697229 - RNA, 21 nt, Human
uaguuuauacaguuuuaaaga

SEQ ID NO: 3697230 - RNA, 17 nt, Human
uaguuucauaauugugu

SEQ ID NO: 3697231 - RNA, 13 nt, Human
uaguuuccuuuuu

SEQ ID NO: 3697232 - RNA, 18 nt, Human
uaguuucuguucugugga

SEQ ID NO: 3697233 - RNA, 20 nt, Human
uaguuugaccucacagugac

SEQ ID NO: 3697234 - RNA, 20 nt, Human
uaguuugaggaaauuugcag

SEQ ID NO: 3697235 - RNA, 18 nt, Human
uaguuugcauuccugaua

SEQ ID NO: 3697236 - RNA, 17 nt, Human
uaguuugcauuucagaa

SEQ ID NO: 3697237 - RNA, 17 nt, Human
uaguuuguacaugcauu

SEQ ID NO: 3697238 - RNA, 15 nt, Human
uuggcauuaaaacuu

SEQ ID NO: 3697239 - RNA, 13 nt, Human
uuggcauucccca

SEQ ID NO: 3697240 - RNA, 16 nt, Human
uuggccaagcagggag

SEQ ID NO: 3697241 - RNA, 23 nt, Human
uuggccaaugcaccuaaagaaaa

SEQ ID NO: 3697242 - RNA, 14 nt, Human
uuggccacuccgag

SEQ ID NO: 3697243 - RNA, 13 nt, Human
uuggccaggcugg

SEQ ID NO: 3697244 - RNA, 21 nt, Human
uuggccauaagcaacaauuuu

SEQ ID NO: 3697245 - RNA, 18 nt, Human
uuggccauauuuaccuca

SEQ ID NO: 3697246 - RNA, 16 nt, Human
uuggccaucucuggau

SEQ ID NO: 3697247 - RNA, 20 nt, Human
uuggcccaggaguuuggcca

SEQ ID NO: 3697248 - RNA, 21 nt, Human
uuggcccaggaguuuggccag

SEQ ID NO: 3697249 - RNA, 15 nt, Human
uuggcccccgagcug

SEQ ID NO: 3697250 - RNA, 16 nt, Human
uuggcccccgagcugg

SEQ ID NO: 3697251 - RNA, 19 nt, Human
uuggcccccgagcuggggg

SEQ ID NO: 3697252 - RNA, 13 nt, Human
uuggcccuauuua

SEQ ID NO: 3697253 - RNA, 22 nt, Human
uuggccgcaccuaaagcagcca

SEQ ID NO: 3697254 - RNA, 13 nt, Human
uuggccucagagg

SEQ ID NO: 3697255 - RNA, 17 nt, Human
uuggccuccccugcuga

SEQ ID NO: 3697256 - RNA, 19 nt, Human
uuggccuccggccuccccu

SEQ ID NO: 3697257 - RNA, 19 nt, Human
uuggccugaucagaccacg

SEQ ID NO: 3697258 - RNA, 14 nt, Human
uuggccuggaguuu

SEQ ID NO: 3697259 - RNA, 19 nt, Human
uuggccuguagaguugcug

SEQ ID NO: 3697260 - RNA, 16 nt, Human
uuggccugucucaucc

SEQ ID NO: 3697261 - RNA, 23 nt, Human
uuggccugucucauccccagggg

SEQ ID NO: 3697262 - RNA, 17 nt, Human
uuggcgaugccagccaa

SEQ ID NO: 3697263 - RNA, 17 nt, Human
uuggcgcacccuccccu

SEQ ID NO: 3697264 - RNA, 20 nt, Human
uuggcguaggcuacagagaa

SEQ ID NO: 3697265 - RNA, 21 nt, Human
uuggcguaggcuacagagaag

SEQ ID NO: 3697266 - RNA, 22 nt, Human
uuggcguaggcuacagagaagc

SEQ ID NO: 3697267 - RNA, 18 nt, Human
uuggcucacacucgacau

SEQ ID NO: 3697268 - RNA, 17 nt, Human
uuggcucgaaucucugu

SEQ ID NO: 3697269 - RNA, 21 nt, Human
uuggcucgaaucucugugccu

SEQ ID NO: 3697270 - RNA, 19 nt, Human
uuggcucugccaguccugu

SEQ ID NO: 3697271 - RNA, 23 nt, Human
uuggcucugccaguccuguccuu

SEQ ID NO: 3697272 - RNA, 14 nt, Human
uuggcucuggagac

SEQ ID NO: 3697273 - RNA, 21 nt, Human
uuggcugaaauucuccuggag

SEQ ID NO: 3697274 - RNA, 15 nt, Human
uuggcugcuuggccu

SEQ ID NO: 3697275 - RNA, 12 nt, Human
uuggcuggaccc

SEQ ID NO: 3697276 - RNA, 15 nt, Human
uuggcuggacccagc

SEQ ID NO: 3697277 - RNA, 21 nt, Human
uuggcuggaugaaauuuucua

SEQ ID NO: 3697278 - RNA, 20 nt, Human
uuggcuggugugguacagag

SEQ ID NO: 3697279 - RNA, 18 nt, Human
uuggcugugucuaaacug

SEQ ID NO: 3697280 - RNA, 23 nt, Human
uuggcugugucuaaacugcauua

SEQ ID NO: 3697281 - RNA, 18 nt, Human
uuggcuuauaauucuuuc

SEQ ID NO: 3697282 - RNA, 21 nt, Human
uuggcuuccaugaugguuauu

SEQ ID NO: 3697283 - RNA, 22 nt, Human
uuggcuucugugaugagcugau

SEQ ID NO: 3697284 - RNA, 16 nt, Human
uuggcuucuguuucua

SEQ ID NO: 3697285 - RNA, 14 nt, Human
uuggcuugacucag

SEQ ID NO: 3697286 - RNA, 21 nt, Human
uuggcuuguagaauuguuaua

SEQ ID NO: 3697287 - RNA, 20 nt, Human
uuggcuuuauccucuuuaga

SEQ ID NO: 3697288 - RNA, 22 nt, Human
uuggcuuuauccucuuuagagu

SEQ ID NO: 3697289 - RNA, 22 nt, Human
uuggcuuuucugauccaguuuu

SEQ ID NO: 3697290 - RNA, 12 nt, Human
uugggaaaacau

SEQ ID NO: 3697291 - RNA, 15 nt, Human
uugggaaaacauuug

SEQ ID NO: 3697292 - RNA, 17 nt, Human
uugggaaacuugucacu

SEQ ID NO: 3697293 - RNA, 22 nt, Human
uugggaaguuaaagggaagaaa

SEQ ID NO: 3697294 - RNA, 14 nt, Human
uugggaauaaauau

SEQ ID NO: 3697295 - RNA, 17 nt, Human
uugggaauaaauaugcc

SEQ ID NO: 3697296 - RNA, 16 nt, Human
uugggaauauuugaau

SEQ ID NO: 3697297 - RNA, 19 nt, Human
uugggaaugaggcuugcug

SEQ ID NO: 3697298 - RNA, 11 nt, Human
uugggaauguu

SEQ ID NO: 3697299 - RNA, 20 nt, Human
uugggacccaguggcagggc

SEQ ID NO: 3697300 - RNA, 16 nt, Human
uugggaccccuggugg

SEQ ID NO: 3697301 - RNA, 20 nt, Human
uugggacccugcuuuagagc

SEQ ID NO: 3697302 - RNA, 13 nt, Human
uugggagagacuu

SEQ ID NO: 3697303 - RNA, 21 nt, Human
uugggagagccauacauaaaa

SEQ ID NO: 3697304 - RNA, 16 nt, Human
uugggagauauauuuu

SEQ ID NO: 3697305 - RNA, 15 nt, Human
uugggagcacuggag

SEQ ID NO: 3697306 - RNA, 11 nt, Human
uugggagcagg

SEQ ID NO: 3697307 - RNA, 17 nt, Human
uugggagcuugggaaug

SEQ ID NO: 3697308 - RNA, 20 nt, Human
uugggaggaagcagaauaaa

SEQ ID NO: 3697309 - RNA, 14 nt, Human
uugggaggccgagg

SEQ ID NO: 3697310 - RNA, 18 nt, Human
uugggaggccgaggcagg

SEQ ID NO: 3697311 - RNA, 12 nt, Human
uugggaggcuga

SEQ ID NO: 3697312 - RNA, 15 nt, Human
uugggaguccaggca

SEQ ID NO: 3697313 - RNA, 18 nt, Human
uugggaguccaggcacag

SEQ ID NO: 3697314 - RNA, 18 nt, Human
uugggaguuuugaauguu

SEQ ID NO: 3697315 - RNA, 13 nt, Human
uugggaugucuua

SEQ ID NO: 3697316 - RNA, 21 nt, Human
uugggauuccugacccaggcc

SEQ ID NO: 3697317 - RNA, 14 nt, Human
uugggauugggggc

SEQ ID NO: 3697318 - RNA, 16 nt, Human
uugggauugggggcug

SEQ ID NO: 3697319 - RNA, 14 nt, Human
uugggauuugcugu

SEQ ID NO: 3697320 - RNA, 18 nt, Human
uugggcacccccagccug

SEQ ID NO: 3697321 - RNA, 21 nt, Human
uugggcacccccagccugggc

SEQ ID NO: 3697322 - RNA, 17 nt, Human
uugggcagagcuggcuc

SEQ ID NO: 3697323 - RNA, 21 nt, Human
uugggcagcgcccuuccucuc

SEQ ID NO: 3697324 - RNA, 22 nt, Human
uugggcagcgcccuuccucucc

SEQ ID NO: 3697325 - RNA, 23 nt, Human
uugggcagcgcccuuccucucca

SEQ ID NO: 3697326 - RNA, 17 nt, Human
uugggcaugugggcuuc

SEQ ID NO: 3697327 - RNA, 13 nt, Human
uugggccagacau

SEQ ID NO: 3697328 - RNA, 17 nt, Human
uugggccauacuggccu

SEQ ID NO: 3697329 - RNA, 18 nt, Human
uugggccauacuggccuc

SEQ ID NO: 3697330 - RNA, 14 nt, Human
uugggccccagccu

SEQ ID NO: 3697331 - RNA, 11 nt, Human
uugggcccugc

SEQ ID NO: 3697332 - RNA, 12 nt, Human
uugggcccugca

SEQ ID NO: 3697333 - RNA, 16 nt, Human
uugggccugcuccaga

SEQ ID NO: 3697334 - RNA, 18 nt, Human
uugggcgccgugcugggc

SEQ ID NO: 3697335 - RNA, 19 nt, Human
uugggcgccgugcugggca

SEQ ID NO: 3697336 - RNA, 12 nt, Human
uugggcucugau

SEQ ID NO: 3697337 - RNA, 13 nt, Human
uugggcucugaug

SEQ ID NO: 3697338 - RNA, 13 nt, Human
uugggcucugcug

SEQ ID NO: 3697339 - RNA, 17 nt, Human
uugggcugaauguaugu

SEQ ID NO: 3697340 - RNA, 22 nt, Human
uugggcugaauguauguaaaua

SEQ ID NO: 3697341 - RNA, 18 nt, Human
uugggcuucagcugccag

SEQ ID NO: 3697342 - RNA, 19 nt, Human
uuggggaaacagcaucucc

SEQ ID NO: 3697343 - RNA, 23 nt, Human
uuggggaagagagccugcaggau

SEQ ID NO: 3697344 - RNA, 14 nt, Human
uuggggacacaugu

SEQ ID NO: 3697345 - RNA, 20 nt, Human
uuggggaggacaaaacuucu

SEQ ID NO: 3697346 - RNA, 15 nt, Human
uuggggauuuucaaa

SEQ ID NO: 3697347 - RNA, 15 nt, Human
uuggggcccagugca

SEQ ID NO: 3697348 - RNA, 18 nt, Human
uuggggcucccagccagg

SEQ ID NO: 3697349 - RNA, 18 nt, Human
uugggggacagggcuggc

SEQ ID NO: 3697350 - RNA, 21 nt, Human
uugggggacagggcuggccca

SEQ ID NO: 3697351 - RNA, 23 nt, Human
uugggggaggggagacuuugaug

SEQ ID NO: 3697352 - RNA, 16 nt, Human
uuggggggcauauauu

SEQ ID NO: 3697353 - RNA, 23 nt, Human
uuggggggggcccgccuggcaga

SEQ ID NO: 3697354 - RNA, 16 nt, Human
uuggggguaaaaaaua

SEQ ID NO: 3697355 - RNA, 22 nt, Human
uugggggucaggcagccaguga

SEQ ID NO: 3697356 - RNA, 17 nt, Human
uuggggguucaggcccg

SEQ ID NO: 3697357 - RNA, 13 nt, Human
uuggggugacagu

SEQ ID NO: 3697358 - RNA, 22 nt, Human
uuggggugccccucuccuucuu

SEQ ID NO: 3697359 - RNA, 18 nt, Human
uuggggugguugaggcua

SEQ ID NO: 3697360 - RNA, 21 nt, Human
uuggguauccugcccaguguu

SEQ ID NO: 3697361 - RNA, 15 nt, Human
uugggucuauuccag

SEQ ID NO: 3697362 - RNA, 14 nt, Human
uuggguggagaagc

SEQ ID NO: 3697363 - RNA, 16 nt, Human
uuggguggagaagcca

SEQ ID NO: 3697364 - RNA, 16 nt, Human
uuggguggaugccugg

SEQ ID NO: 3697365 - RNA, 17 nt, Human
uugggugggcaggaaaa

SEQ ID NO: 3697366 - RNA, 19 nt, Human
uuggguggggggcuucaua

SEQ ID NO: 3697367 - RNA, 20 nt, Human
uuggguggggggcuucauac

SEQ ID NO: 3697368 - RNA, 22 nt, Human
uuggguucaagcgauucuucug

SEQ ID NO: 3697369 - RNA, 21 nt, Human
uuggguucaugaugcagucuc

SEQ ID NO: 3697370 - RNA, 22 nt, Human
uuggguucaugaugcagucucc

SEQ ID NO: 3697371 - RNA, 14 nt, Human
uugguaaaccuuuu

SEQ ID NO: 3697372 - RNA, 16 nt, Human
uugguaaagacuggcu

SEQ ID NO: 3697373 - RNA, 19 nt, Human
uugguaaagacuggcuuuu

SEQ ID NO: 3697374 - RNA, 14 nt, Human
uugguaaauguuuc

SEQ ID NO: 3697375 - RNA, 17 nt, Human
uugguaaauguuucuuu

SEQ ID NO: 3697376 - RNA, 23 nt, Human
uugguaaauuuccccaacagugu

SEQ ID NO: 3697377 - RNA, 18 nt, Human
uugguaacucuguaauuc

SEQ ID NO: 3697378 - RNA, 12 nt, Human
uugguaacuuuu

SEQ ID NO: 3697379 - RNA, 19 nt, Human
uugguaccagauaacuuuu

SEQ ID NO: 3697380 - RNA, 16 nt, Human
uugguaccuugcacac

SEQ ID NO: 3697381 - RNA, 12 nt, Human
uugguauauuuu

SEQ ID NO: 3697382 - RNA, 17 nt, Human
uugguaucaagaaaguc

SEQ ID NO: 3697383 - RNA, 13 nt, Human
uugguauccuuau

SEQ ID NO: 3697384 - RNA, 21 nt, Human
uugguauuguauuuauucaau

SEQ ID NO: 3697385 - RNA, 23 nt, Human
uuggucaugugggucuuccaggg

SEQ ID NO: 3697386 - RNA, 14 nt, Human
uugguccacuuuuc

SEQ ID NO: 3697387 - RNA, 22 nt, Human
uugguccagagcggaggcugug

SEQ ID NO: 3697388 - RNA, 16 nt, Human
uuggucccccuuccau

SEQ ID NO: 3697389 - RNA, 12 nt, Human
uugguccucuug

SEQ ID NO: 3697390 - RNA, 12 nt, Human
uugguccugcug

SEQ ID NO: 3697391 - RNA, 14 nt, Human
uugguccuuuacac

SEQ ID NO: 3697392 - RNA, 22 nt, Human
uuggucucccuucucuacacuc

SEQ ID NO: 3697393 - RNA, 20 nt, Human
uuggucuguacugauucaau

SEQ ID NO: 3697394 - RNA, 14 nt, Human
uuggucuuuguauc

SEQ ID NO: 3697395 - RNA, 16 nt, Human
uuggugauucaaaugg

SEQ ID NO: 3697396 - RNA, 16 nt, Human
uuggugcaacccuuac

SEQ ID NO: 3697397 - RNA, 21 nt, Human
uuggugcaacccuuaccccuu

SEQ ID NO: 3697398 - RNA, 16 nt, Human
uuggugcauagaacug

SEQ ID NO: 3697399 - RNA, 20 nt, Human
uuggugccuggccuggcaca

SEQ ID NO: 3697400 - RNA, 18 nt, Human
uuggugccuuuccuguuc

SEQ ID NO: 3697401 - RNA, 19 nt, Human
uuggugcuuuuuauaaaaa

SEQ ID NO: 3697402 - RNA, 14 nt, Human
uugguggauguaaa

SEQ ID NO: 3697403 - RNA, 21 nt, Human
uugguggcagauuuuacaaaa

SEQ ID NO: 3697404 - RNA, 12 nt, Human
uuggugguuuuu

SEQ ID NO: 3697405 - RNA, 20 nt, Human
uugguguaaagccaacaccc

SEQ ID NO: 3697406 - RNA, 15 nt, Human
uugguguaauuugaa

SEQ ID NO: 3697407 - RNA, 20 nt, Human
uugguguaauuugaagauug

SEQ ID NO: 3697408 - RNA, 23 nt, Human
uugguguauagaaguuuguccau

SEQ ID NO: 3697409 - RNA, 14 nt, Human
uuggugugcugagg

SEQ ID NO: 3697410 - RNA, 13 nt, Human
uugguguguccca

SEQ ID NO: 3697411 - RNA, 16 nt, Human
uugguguguggagaug

SEQ ID NO: 3697412 - RNA, 13 nt, Human
uugguguugacau

SEQ ID NO: 3697413 - RNA, 15 nt, Human
uugguuaaaacugua

SEQ ID NO: 3697414 - RNA, 19 nt, Human
uugguuaagcuuugacacu

SEQ ID NO: 3697415 - RNA, 20 nt, Human
uugguuaagcuuugacacug

SEQ ID NO: 3697416 - RNA, 16 nt, Human
uugguuaagucuguuu

SEQ ID NO: 3697417 - RNA, 18 nt, Human
uugguuaagucuguuuua

SEQ ID NO: 3697418 - RNA, 19 nt, Human
uugguuaggcauuguggga

SEQ ID NO: 3697419 - RNA, 21 nt, Human
uugguucaauaaagcacugag

SEQ ID NO: 3697420 - RNA, 20 nt, Human
uugguucauuaauucuauaa

SEQ ID NO: 3697421 - RNA, 15 nt, Human
uugguuccucucugg

SEQ ID NO: 3697422 - RNA, 15 nt, Human
uugguuccuucccaa

SEQ ID NO: 3697423 - RNA, 13 nt, Human
uugguucuaagga

SEQ ID NO: 3697424 - RNA, 15 nt, Human
uugguucuaauagaa

SEQ ID NO: 3697425 - RNA, 13 nt, Human
uugguucuggggc

SEQ ID NO: 3697426 - RNA, 13 nt, Human
uugguucuguguc

SEQ ID NO: 3697427 - RNA, 15 nt, Human
uugguucuugagggg

SEQ ID NO: 3697428 - RNA, 23 nt, Human
uugguucuugaggggaccaggag

SEQ ID NO: 3697429 - RNA, 13 nt, Human
uugguugcuuuaa

SEQ ID NO: 3697430 - RNA, 12 nt, Human
uugguuggaagg

SEQ ID NO: 3697431 - RNA, 18 nt, Human
uugguugguaggguggga

SEQ ID NO: 3697432 - RNA, 12 nt, Human
uugguuguauuc

SEQ ID NO: 3697433 - RNA, 12 nt, Human
uugguuuaaaaa

SEQ ID NO: 3697434 - RNA, 12 nt, Human
uugguuuaauau

SEQ ID NO: 3697435 - RNA, 21 nt, Human
uugguuuacauuuaaagcauu

SEQ ID NO: 3697436 - RNA, 14 nt, Human
uugguuugccuucc

SEQ ID NO: 3697437 - RNA, 19 nt, Human
uugguuuuaauugaaggaa

SEQ ID NO: 3697438 - RNA, 16 nt, Human
uugguuuugcuacaua

SEQ ID NO: 3697439 - RNA, 18 nt, Human
uugguuuuguuccccucc

SEQ ID NO: 3697440 - RNA, 22 nt, Human
uugguuuuuacugcucugagaa

SEQ ID NO: 3697441 - RNA, 15 nt, Human
uuguaaaaaaaaaug

SEQ ID NO: 3697442 - RNA, 21 nt, Human
uuguaaaaaaaaaugccuuug

SEQ ID NO: 3697443 - RNA, 22 nt, Human
uuguaaaaaaaaaugccuuuga

SEQ ID NO: 3697444 - RNA, 19 nt, Human
uuguaaaaacagcauugcu

SEQ ID NO: 3697445 - RNA, 14 nt, Human
uuguaaaaagaaaa

SEQ ID NO: 3697446 - RNA, 13 nt, Human
uuguaaaacaggu

SEQ ID NO: 3697447 - RNA, 13 nt, Human
uuguaaaagaaau

SEQ ID NO: 3697448 - RNA, 23 nt, Human
uuguaaaagcaacaucagcuuga

SEQ ID NO: 3697449 - RNA, 17 nt, Human
uuguaaaagcauuuugu

SEQ ID NO: 3697450 - RNA, 18 nt, Human
uuguaaaagcauuuugua

SEQ ID NO: 3697451 - RNA, 15 nt, Human
uuguaaaaugacaau

SEQ ID NO: 3697452 - RNA, 15 nt, Human
uuguaaacaaacucu

SEQ ID NO: 3697453 - RNA, 16 nt, Human
uuguaaacaaacucuu

SEQ ID NO: 3697454 - RNA, 15 nt, Human
uuguaaacauguguu

SEQ ID NO: 3697455 - RNA, 14 nt, Human
uuguaaacuuugaa

SEQ ID NO: 3697456 - RNA, 17 nt, Human
uuguaaacuuugaaaua

SEQ ID NO: 3697457 - RNA, 19 nt, Human
uuguaaacuuugaaauaua

SEQ ID NO: 3697458 - RNA, 21 nt, Human
uuguaaacuuugaaauauaug

SEQ ID NO: 3697459 - RNA, 21 nt, Human
uuguaaagaaauuuacuauau

SEQ ID NO: 3697460 - RNA, 13 nt, Human
uuguaaagacugg

SEQ ID NO: 3697461 - RNA, 17 nt, Human
uuguaaaguauguauua

SEQ ID NO: 3697462 - RNA, 12 nt, Human
uuguaaaguuuc

SEQ ID NO: 3697463 - RNA, 13 nt, Human
uuguaaauaagag

SEQ ID NO: 3697464 - RNA, 14 nt, Human
uuguaaauacacau

SEQ ID NO: 3697465 - RNA, 17 nt, Human
uuguaaauagcucaggu

SEQ ID NO: 3697466 - RNA, 11 nt, Human
uuguaaauaua

SEQ ID NO: 3697467 - RNA, 16 nt, Human
uuguaaauauaaagac

SEQ ID NO: 3697468 - RNA, 13 nt, Human
uuguaaauauaua

SEQ ID NO: 3697469 - RNA, 18 nt, Human
uuguaaauauauaaauau

SEQ ID NO: 3697470 - RNA, 21 nt, Human
uuguaaauauauaaauauaua

SEQ ID NO: 3697471 - RNA, 14 nt, Human
uuguaaauauuaaa

SEQ ID NO: 3697472 - RNA, 13 nt, Human
uuguaaauauugu

SEQ ID NO: 3697473 - RNA, 19 nt, Human
uuguaaauauuuauguaaa

SEQ ID NO: 3697474 - RNA, 14 nt, Human
uuguaaaucacauc

SEQ ID NO: 3697475 - RNA, 16 nt, Human
uuguaaaugugguaaa

SEQ ID NO: 3697476 - RNA, 20 nt, Human
uuguaaauguguuggacaaa

SEQ ID NO: 3697477 - RNA, 14 nt, Human
uuguaaauguuauu

SEQ ID NO: 3697478 - RNA, 21 nt, Human
uuguaaauuaaacauaaaaca

SEQ ID NO: 3697479 - RNA, 18 nt, Human
uuguaaauuaacuuuuau

SEQ ID NO: 3697480 - RNA, 15 nt, Human
uuguaaauuaaucuu

SEQ ID NO: 3697481 - RNA, 20 nt, Human
uuguaaauuaggaggcucaa

SEQ ID NO: 3697482 - RNA, 17 nt, Human
uuguaaauuauauuugu

SEQ ID NO: 3697483 - RNA, 14 nt, Human
uuguaaauuucucu

SEQ ID NO: 3697484 - RNA, 16 nt, Human
uuguaacaagaaaaca

SEQ ID NO: 3697485 - RNA, 14 nt, Human
uuguaacagacauu

SEQ ID NO: 3697486 - RNA, 16 nt, Human
uuguaacccagauuuu

SEQ ID NO: 3697487 - RNA, 22 nt, Human
uuguaacccagauuuugcugua

SEQ ID NO: 3697488 - RNA, 15 nt, Human
uuguaaccucagcuc

SEQ ID NO: 3697489 - RNA, 12 nt, Human
uuguaaccugcu

SEQ ID NO: 3697490 - RNA, 17 nt, Human
uuguaacuaaaauaauu

SEQ ID NO: 3697491 - RNA, 21 nt, Human
uuguaacuaaaauaauuuugu

SEQ ID NO: 3697492 - RNA, 22 nt, Human
uuguaacuaaaauaauuuugua

SEQ ID NO: 3697493 - RNA, 21 nt, Human
uuguaacuguuuagaugaaug

SEQ ID NO: 3697494 - RNA, 15 nt, Human
uuguaagaaggcaau

SEQ ID NO: 3697495 - RNA, 18 nt, Human
uuguaagacaaagguuuu

SEQ ID NO: 3697496 - RNA, 16 nt, Human
uuguaagacaauccau

SEQ ID NO: 3697497 - RNA, 19 nt, Human
uuguaagacaauccaugua

SEQ ID NO: 3697498 - RNA, 22 nt, Human
uuguaagcaugcacaaauucug

SEQ ID NO: 3697499 - RNA, 20 nt, Human
uuguaaggaaugauuaauua

SEQ ID NO: 3697500 - RNA, 19 nt, Human
uuguaaguaaacugcccug

SEQ ID NO: 3697501 - RNA, 20 nt, Human
uuguaagucaguguugagau

SEQ ID NO: 3697502 - RNA, 19 nt, Human
uuguaagugaaaaacauga

SEQ ID NO: 3697503 - RNA, 16 nt, Human
uuguaagugagugugc

SEQ ID NO: 3697504 - RNA, 19 nt, Human
uuguaagugagugugcugc

SEQ ID NO: 3697505 - RNA, 21 nt, Human
uuguaagugcuacauaaauug

SEQ ID NO: 3697506 - RNA, 17 nt, Human
uuguaaguuucagguga

SEQ ID NO: 3697507 - RNA, 19 nt, Human
uuguaaguuucaggugaca

SEQ ID NO: 3697508 - RNA, 22 nt, Human
uuguaaguuucaggugacaugu

SEQ ID NO: 3697509 - RNA, 18 nt, Human
uuguaauaaaguauauaa

SEQ ID NO: 3697510 - RNA, 19 nt, Human
uuguaauaaaguauauaau

SEQ ID NO: 3697511 - RNA, 14 nt, Human
uuguaauaagcaau

SEQ ID NO: 3697512 - RNA, 21 nt, Human
uuguaauagauguuugauaga

SEQ ID NO: 3697513 - RNA, 15 nt, Human
uuguaaucugaauaa

SEQ ID NO: 3697514 - RNA, 13 nt, Human
uuguaaugaaaac

SEQ ID NO: 3697515 - RNA, 18 nt, Human
uuguaaugaauuccuaga

SEQ ID NO: 3697516 - RNA, 14 nt, Human
uuguaaugcugcac

SEQ ID NO: 3697517 - RNA, 19 nt, Human
uuguaaugucuugagcucu

SEQ ID NO: 3697518 - RNA, 21 nt, Human
uuguaauguugugaauaauua

SEQ ID NO: 3697519 - RNA, 23 nt, Human
uuguaauguugugaauaauuaca

SEQ ID NO: 3697520 - RNA, 23 nt, Human
uuguaauuaaaagcaaaucauuu

SEQ ID NO: 3697521 - RNA, 15 nt, Human
uuguaauuauaucug

SEQ ID NO: 3697522 - RNA, 14 nt, Human
uuguaauuaugauu

SEQ ID NO: 3697523 - RNA, 17 nt, Human
uuguaauuaugauuugg

SEQ ID NO: 3697524 - RNA, 14 nt, Human
uuguaauuauggag

SEQ ID NO: 3697525 - RNA, 18 nt, Human
uuguaauuauugugauuu

SEQ ID NO: 3697526 - RNA, 22 nt, Human
uuguaauuauuuuuaauaugua

SEQ ID NO: 3697527 - RNA, 18 nt, Human
uuguaauugcuuacauuu

SEQ ID NO: 3697528 - RNA, 21 nt, Human
uuguaauuuaaacaggcccag

SEQ ID NO: 3697529 - RNA, 13 nt, Human
uuguaauuuuaca

SEQ ID NO: 3697530 - RNA, 22 nt, Human
uuguaauuuuacacgcuuuugu

SEQ ID NO: 3697531 - RNA, 15 nt, Human
uuguaauuuucuuga

SEQ ID NO: 3697532 - RNA, 22 nt, Human
uuguaauuuucuugaugacugg

SEQ ID NO: 3697533 - RNA, 23 nt, Human
uuguaauuuucuugaugacugga

SEQ ID NO: 3697534 - RNA, 14 nt, Human
uuguacaaaguauu

SEQ ID NO: 3697535 - RNA, 20 nt, Human
uuguacaaaguauuaagcau

SEQ ID NO: 3697536 - RNA, 21 nt, Human
uuguacaaaguauuaagcaua

SEQ ID NO: 3697537 - RNA, 11 nt, Human
uucauaucauu

SEQ ID NO: 3697538 - RNA, 13 nt, Human
uucauaugcugua

SEQ ID NO: 3697539 - RNA, 14 nt, Human
uucauauguugcuc

SEQ ID NO: 3697540 - RNA, 18 nt, Human
uucauauguugcucaguc

SEQ ID NO: 3697541 - RNA, 22 nt, Human
uucauauuaagaaugaucugau

SEQ ID NO: 3697542 - RNA, 14 nt, Human
uucauauucagcuu

SEQ ID NO: 3697543 - RNA, 16 nt, Human
uucauauucuuucaau

SEQ ID NO: 3697544 - RNA, 13 nt, Human
uucauauucuuuu

SEQ ID NO: 3697545 - RNA, 12 nt, Human
uucauauugugc

SEQ ID NO: 3697546 - RNA, 16 nt, Human
uucauauugugccaau

SEQ ID NO: 3697547 - RNA, 17 nt, Human
uuguucuguuaacugaa

SEQ ID NO: 3697548 - RNA, 14 nt, Human
uuguucuuacacau

SEQ ID NO: 3697549 - RNA, 14 nt, Human
uuguucuuccaaag

SEQ ID NO: 3697550 - RNA, 17 nt, Human
uuguucuugguuuguaa

SEQ ID NO: 3697551 - RNA, 20 nt, Human
uuguucuugguuuguaaauu

SEQ ID NO: 3697552 - RNA, 14 nt, Human
uuguucuuguauuu

SEQ ID NO: 3697553 - RNA, 15 nt, Human
uuguucuuguauuua

SEQ ID NO: 3697554 - RNA, 20 nt, Human
uuguucuuguuuuuaaguuu

SEQ ID NO: 3697555 - RNA, 14 nt, Human
uuguucuuucagaa

SEQ ID NO: 3697556 - RNA, 13 nt, Human
uuguucuuuuuau

SEQ ID NO: 3697557 - RNA, 15 nt, Human
uuguugaacuguuag

SEQ ID NO: 3697558 - RNA, 18 nt, Human
uuguugaacuguuagaau

SEQ ID NO: 3697559 - RNA, 18 nt, Human
uuguugacaguucugaag

SEQ ID NO: 3697560 - RNA, 20 nt, Human
uuguugacauucugaaugcu

SEQ ID NO: 3697561 - RNA, 14 nt, Human
uuguugacuuauuu

SEQ ID NO: 3697562 - RNA, 18 nt, Human
uuguugagcuauugcugu

SEQ ID NO: 3697563 - RNA, 20 nt, Human
uuguugauaaauuccacugg

SEQ ID NO: 3697564 - RNA, 21 nt, Human
uuguugaugggcacuugagaa

SEQ ID NO: 3697565 - RNA, 16 nt, Human
uuguugcaagauguga

SEQ ID NO: 3697566 - RNA, 19 nt, Human
uuguugcaagaugugaauu

SEQ ID NO: 3697567 - RNA, 20 nt, Human
uuguugcacugaaguuugau

SEQ ID NO: 3697568 - RNA, 20 nt, Human
uuguugccaugugcaccuug

SEQ ID NO: 3697569 - RNA, 14 nt, Human
uuguugcggaugga

SEQ ID NO: 3697570 - RNA, 20 nt, Human
uuguugcucagcaaggggcu

SEQ ID NO: 3697571 - RNA, 18 nt, Human
uuguugcucccugugaca

SEQ ID NO: 3697572 - RNA, 14 nt, Human
uuguugcuucuugu

SEQ ID NO: 3697573 - RNA, 21 nt, Human
uuguuggaaaagaauacagaa

SEQ ID NO: 3697574 - RNA, 20 nt, Human
uuguuggaguguuucuaaua

SEQ ID NO: 3697575 - RNA, 20 nt, Human
uuguuggaucuucaauggcu

SEQ ID NO: 3697576 - RNA, 20 nt, Human
uuguuggcagcauaaaggcc

SEQ ID NO: 3697577 - RNA, 16 nt, Human
uuguuggcauagcucu

SEQ ID NO: 3697578 - RNA, 14 nt, Human
uauagaaacacgaa

SEQ ID NO: 3697579 - RNA, 12 nt, Human
uauagaaagaua

SEQ ID NO: 3697580 - RNA, 11 nt, Human
uauagaaagug

SEQ ID NO: 3697581 - RNA, 14 nt, Human
uauagaaaguguuc

SEQ ID NO: 3697582 - RNA, 22 nt, Human
uauagaaaguguucuguuacaa

SEQ ID NO: 3697583 - RNA, 23 nt, Human
uauagaaaguguucuguuacaaa

SEQ ID NO: 3697584 - RNA, 18 nt, Human
uauagaacugaaugagaa

SEQ ID NO: 3697585 - RNA, 13 nt, Human
uauagaacuucau

SEQ ID NO: 3697586 - RNA, 13 nt, Human
uauagaagaaugc

SEQ ID NO: 3697587 - RNA, 22 nt, Human
uauagaaguauaaagaauugug

SEQ ID NO: 3697588 - RNA, 15 nt, Human
uauagaauuagcuuu

SEQ ID NO: 3697589 - RNA, 22 nt, Human
uauagaauuagcuuuuucaucc

SEQ ID NO: 3697590 - RNA, 21 nt, Human
uauagaauugcaauuuuaaca

SEQ ID NO: 3697591 - RNA, 17 nt, Human
uauagaauuuuuaaugu

SEQ ID NO: 3697592 - RNA, 16 nt, Human
uauagacaaauaauaa

SEQ ID NO: 3697593 - RNA, 16 nt, Human
uauagacacccuggca

SEQ ID NO: 3697594 - RNA, 20 nt, Human
uauagacaggagaagaaaga

SEQ ID NO: 3697595 - RNA, 23 nt, Human
uauagacaguccuuaaaaaucac

SEQ ID NO: 3697596 - RNA, 14 nt, Human
uauagacaguuugu

SEQ ID NO: 3697597 - RNA, 15 nt, Human
uauagagcagaaauu

SEQ ID NO: 3697598 - RNA, 18 nt, Human
uauagagucauuguaaug

SEQ ID NO: 3697599 - RNA, 15 nt, Human
uauagauauaaugaa

SEQ ID NO: 3697600 - RNA, 23 nt, Human
uauagauauaaugaacaaaauua

SEQ ID NO: 3697601 - RNA, 22 nt, Human
uauagaucacauaacagaaugc

SEQ ID NO: 3697602 - RNA, 23 nt, Human
uauagaucacauaacagaaugca

SEQ ID NO: 3697603 - RNA, 17 nt, Human
uauagaugggaaugaag

SEQ ID NO: 3697604 - RNA, 20 nt, Human
uauagauguugcuaacagca

SEQ ID NO: 3697605 - RNA, 20 nt, Human
uauagauuagaauucuguau

SEQ ID NO: 3697606 - RNA, 22 nt, Human
uauagauuagagaguguugaaa

SEQ ID NO: 3697607 - RNA, 15 nt, Human
uauagauuauaacuu

SEQ ID NO: 3697608 - RNA, 15 nt, Human
uauagauucuaaaga

SEQ ID NO: 3697609 - RNA, 17 nt, Human
uauagauucuaaagauu

SEQ ID NO: 3697610 - RNA, 14 nt, Human
uauagauuugaccu

SEQ ID NO: 3697611 - RNA, 22 nt, Human
uauagcaaaacuuuuaaacuac

SEQ ID NO: 3697612 - RNA, 16 nt, Human
uauagcaacaacaauu

SEQ ID NO: 3697613 - RNA, 23 nt, Human
uauagcaauccauguuaguuuuu

SEQ ID NO: 3697614 - RNA, 20 nt, Human
uauagcagcaaaaauauaaa

SEQ ID NO: 3697615 - RNA, 17 nt, Human
uauagcaucacuuaaaa

SEQ ID NO: 3697616 - RNA, 20 nt, Human
uauagcaugaaauaaaauau

SEQ ID NO: 3697617 - RNA, 18 nt, Human
uauagccaaaaauagcua

SEQ ID NO: 3697618 - RNA, 14 nt, Human
uauagccaauauaa

SEQ ID NO: 3697619 - RNA, 18 nt, Human
uauagccuaggugacaga

SEQ ID NO: 3697620 - RNA, 21 nt, Human
uauagccuauggcagaaaaaa

SEQ ID NO: 3697621 - RNA, 22 nt, Human
uauagcuaggugacauauacau

SEQ ID NO: 3697622 - RNA, 11 nt, Human
uauagcuauua

SEQ ID NO: 3697623 - RNA, 22 nt, Human
uauagcuauuacugucugguuu

SEQ ID NO: 3697624 - RNA, 13 nt, Human
uauagcuauuuuu

SEQ ID NO: 3697625 - RNA, 22 nt, Human
uauagcuguacaaauauaagaa

SEQ ID NO: 3697626 - RNA, 20 nt, Human
uauagcuguauugaaucaug

SEQ ID NO: 3697627 - RNA, 21 nt, Human
uauagcuguauugaaucaugu

SEQ ID NO: 3697628 - RNA, 12 nt, Human
uauaggaauuga

SEQ ID NO: 3697629 - RNA, 14 nt, Human
uauaggaauugacc

SEQ ID NO: 3697630 - RNA, 19 nt, Human
uauaggauuuauuuaaaau

SEQ ID NO: 3697631 - RNA, 21 nt, Human
uauaggauuuauuuaaaauag

SEQ ID NO: 3697632 - RNA, 23 nt, Human
uauaggcaccuaccaccacgccc

SEQ ID NO: 3697633 - RNA, 13 nt, Human
uauaggcuauuuu

SEQ ID NO: 3697634 - RNA, 17 nt, Human
uauaggcuauuuucuaa

SEQ ID NO: 3697635 - RNA, 20 nt, Human
uauaggugauguuugcucuu

SEQ ID NO: 3697636 - RNA, 22 nt, Human
uauagguugugcaaauuaacag

SEQ ID NO: 3697637 - RNA, 18 nt, Human
uauagguuuuguuugcua

SEQ ID NO: 3697638 - RNA, 15 nt, Human
uauaguaaugaguuu

SEQ ID NO: 3697639 - RNA, 12 nt, Human
uauaguacauga

SEQ ID NO: 3697640 - RNA, 11 nt, Human
uauaguauuug

SEQ ID NO: 3697641 - RNA, 13 nt, Human
uauagucauuuau

SEQ ID NO: 3697642 - RNA, 21 nt, Human
uauagucauuuauuuuaaaaa

SEQ ID NO: 3697643 - RNA, 20 nt, Human
uauagucccagcuacucaga

SEQ ID NO: 3697644 - RNA, 16 nt, Human
uauagugcaauauauu

SEQ ID NO: 3697645 - RNA, 18 nt, Human
uauaguggaaaaacacau

SEQ ID NO: 3697646 - RNA, 13 nt, Human
uauaguguaaaau

SEQ ID NO: 3697647 - RNA, 14 nt, Human
uauaguguauagaa

SEQ ID NO: 3697648 - RNA, 17 nt, Human
uauaguuacuguccugu

SEQ ID NO: 3697649 - RNA, 18 nt, Human
uauaguuacuguguaauu

SEQ ID NO: 3697650 - RNA, 20 nt, Human
uauaguuacuguguaauuag

SEQ ID NO: 3697651 - RNA, 17 nt, Human
uauaguuaggauagcau

SEQ ID NO: 3697652 - RNA, 19 nt, Human
uauaguuaggauagcauuu

SEQ ID NO: 3697653 - RNA, 20 nt, Human
uauaguuauguaaauaauuc

SEQ ID NO: 3697654 - RNA, 17 nt, Human
uauaguuccuaagaagc

SEQ ID NO: 3697655 - RNA, 12 nt, Human
uauaguucuagg

SEQ ID NO: 3697656 - RNA, 13 nt, Human
uauaguugcuuuu

SEQ ID NO: 3697657 - RNA, 18 nt, Human
uauaguuuaaaacacauu

SEQ ID NO: 3697658 - RNA, 14 nt, Human
uauaguuucugagg

SEQ ID NO: 3697659 - RNA, 23 nt, Human
uauaguuuuacuuuuaaacugug

SEQ ID NO: 3697660 - RNA, 12 nt, Human
uauauaaaaaga

SEQ ID NO: 3697661 - RNA, 21 nt, Human
uauauaaaaauauauauagug

SEQ ID NO: 3697662 - RNA, 16 nt, Human
uauauaaaauaaauau

SEQ ID NO: 3697663 - RNA, 17 nt, Human
uauauaaaauaaauaua

SEQ ID NO: 3697664 - RNA, 18 nt, Human
uauauaaaauaaauauau

SEQ ID NO: 3697665 - RNA, 23 nt, Human
uauauaaaauaaauauauauaaa

SEQ ID NO: 3697666 - RNA, 14 nt, Human
uauauaaaauaacu

SEQ ID NO: 3697667 - RNA, 21 nt, Human
uauauaaaauauuuucauaca

SEQ ID NO: 3697668 - RNA, 15 nt, Human
uauauaaaccuaaaa

SEQ ID NO: 3697669 - RNA, 12 nt, Human
uauauaaagaaa

SEQ ID NO: 3697670 - RNA, 15 nt, Human
uauauaaagagaaaa

SEQ ID NO: 3697671 - RNA, 16 nt, Human
uauauaaagagaaaau

SEQ ID NO: 3697672 - RNA, 19 nt, Human
uauauaaagagaaaauuga

SEQ ID NO: 3697673 - RNA, 20 nt, Human
uauauaaagagaaaauugaa

SEQ ID NO: 3697674 - RNA, 14 nt, Human
uauauaaaguauag

SEQ ID NO: 3697675 - RNA, 15 nt, Human
uauauaaauaaauau

SEQ ID NO: 3697676 - RNA, 18 nt, Human
uauauaaauaaauauaua

SEQ ID NO: 3697677 - RNA, 12 nt, Human
uauauaaauaua

SEQ ID NO: 3697678 - RNA, 13 nt, Human
uauauaaauauau

SEQ ID NO: 3697679 - RNA, 20 nt, Human
uauauaaauauauauaaaua

SEQ ID NO: 3697680 - RNA, 19 nt, Human
uauauaaauauauuauuac

SEQ ID NO: 3697681 - RNA, 18 nt, Human
uauauaaauguaaaaaua

SEQ ID NO: 3697682 - RNA, 23 nt, Human
uauauaaauuuuuuuuguuucau

SEQ ID NO: 3697683 - RNA, 13 nt, Human
uauauaacaaugc

SEQ ID NO: 3697684 - RNA, 17 nt, Human
uauauaacaaugcugua

SEQ ID NO: 3697685 - RNA, 18 nt, Human
uauauaacagauacauuu

SEQ ID NO: 3697686 - RNA, 17 nt, Human
uauauaagaaagacauc

SEQ ID NO: 3697687 - RNA, 20 nt, Human
uauauaagagcaugaaauuu

SEQ ID NO: 3697688 - RNA, 18 nt, Human
uauauaaguauucuaaau

SEQ ID NO: 3697689 - RNA, 14 nt, Human
uauauaauaaagua

SEQ ID NO: 3697690 - RNA, 13 nt, Human
uauauaauaaauu

SEQ ID NO: 3697691 - RNA, 19 nt, Human
uauauaauaucuaaaguua

SEQ ID NO: 3697692 - RNA, 18 nt, Human
uauauacaaaaagaaaau

SEQ ID NO: 3697693 - RNA, 19 nt, Human
uauauacaaccugcuuggg

SEQ ID NO: 3697694 - RNA, 13 nt, Human
uauauacaauaau

SEQ ID NO: 3697695 - RNA, 21 nt, Human
uauauacacacacaaagagag

SEQ ID NO: 3697696 - RNA, 17 nt, Human
uauauacaguaacuuua

SEQ ID NO: 3697697 - RNA, 23 nt, Human
uauauacauacacuuguauaaau

SEQ ID NO: 3697698 - RNA, 14 nt, Human
uauauacauaugua

SEQ ID NO: 3697699 - RNA, 15 nt, Human
uauauacaugugugu

SEQ ID NO: 3697700 - RNA, 18 nt, Human
uauauacauguguguaua

SEQ ID NO: 3697701 - RNA, 13 nt, Human
uauauagaaugcu

SEQ ID NO: 3697702 - RNA, 14 nt, Human
uauauagagauguu

SEQ ID NO: 3697703 - RNA, 18 nt, Human
uauauagcauuuauggua

SEQ ID NO: 3697704 - RNA, 14 nt, Human
uauauaggcuauuu

SEQ ID NO: 3697705 - RNA, 24 nt, Human
uauauagguuuuguuugcuaucuu

SEQ ID NO: 3697706 - RNA, 18 nt, Human
uauauaguaccuuugcuc

SEQ ID NO: 3697707 - RNA, 22 nt, Human
uauauaguuuauugacaauaau

SEQ ID NO: 3697708 - RNA, 10 nt, Human
uauauauaaa

SEQ ID NO: 3697709 - RNA, 12 nt, Human
uauauauaaacc

SEQ ID NO: 3697710 - RNA, 14 nt, Human
uauauauaaagaau

SEQ ID NO: 3697711 - RNA, 16 nt, Human
uauauauacacacaca

SEQ ID NO: 3697712 - RNA, 13 nt, Human
uauauauacauaa

SEQ ID NO: 3697713 - RNA, 14 nt, Human
uauauauacauaug

SEQ ID NO: 3697714 - RNA, 15 nt, Human
uauauauagaaauau

SEQ ID NO: 3697715 - RNA, 12 nt, Human
uauauauagaau

SEQ ID NO: 3697716 - RNA, 16 nt, Human
uauauauauaaaugua

SEQ ID NO: 3697717 - RNA, 14 nt, Human
uauauauauauaac

SEQ ID NO: 3697718 - RNA, 14 nt, Human
uauauauauauaua

SEQ ID NO: 3697719 - RNA, 16 nt, Human
uauauauauauaugua

SEQ ID NO: 3697720 - RNA, 15 nt, Human
uauauauauaucagu

SEQ ID NO: 3697721 - RNA, 13 nt, Human
uauauauaugugu

SEQ ID NO: 3697722 - RNA, 16 nt, Human
uauauaucaguuugau

SEQ ID NO: 3697723 - RNA, 14 nt, Human
uauauauccucugu

SEQ ID NO: 3697724 - RNA, 21 nt, Human
uauauaucugcuucaguggag

SEQ ID NO: 3697725 - RNA, 13 nt, Human
uauauauggacau

SEQ ID NO: 3697726 - RNA, 17 nt, Human
uauauauguacaguuau

SEQ ID NO: 3697727 - RNA, 19 nt, Human
uauauauguacaguuaucu

SEQ ID NO: 3697728 - RNA, 12 nt, Human
uauauaugugua

SEQ ID NO: 3697729 - RNA, 23 nt, Human
uuccccgagggaugaugccacac

SEQ ID NO: 3697730 - RNA, 19 nt, Human
uuccccuaaccucauuccc

SEQ ID NO: 3697731 - RNA, 20 nt, Human
uuccccuaaucuuuucugaa

SEQ ID NO: 3697732 - RNA, 15 nt, Human
uuccccuaucauuua

SEQ ID NO: 3697733 - RNA, 16 nt, Human
uuccccuccuaccccu

SEQ ID NO: 3697734 - RNA, 19 nt, Human
uuccccuccuaccccuccc

SEQ ID NO: 3697735 - RNA, 21 nt, Human
uuccccuccuaccccucccag

SEQ ID NO: 3697736 - RNA, 22 nt, Human
uuccccuccuaccccucccagc

SEQ ID NO: 3697737 - RNA, 18 nt, Human
uuccccucugcugcuguc

SEQ ID NO: 3697738 - RNA, 16 nt, Human
uuccccucuugucucc

SEQ ID NO: 3697739 - RNA, 16 nt, Human
uuccccuggggaccca

SEQ ID NO: 3697740 - RNA, 15 nt, Human
uuccccuguggggau

SEQ ID NO: 3697741 - RNA, 12 nt, Human
uuccccuguguc

SEQ ID NO: 3697742 - RNA, 13 nt, Human
uuccccuguguca

SEQ ID NO: 3697743 - RNA, 19 nt, Human
uuccccuguuuauucauau

SEQ ID NO: 3697744 - RNA, 16 nt, Human
uuccccuuauccuccc

SEQ ID NO: 3697745 - RNA, 14 nt, Human
uuccccuuccacug

SEQ ID NO: 3697746 - RNA, 15 nt, Human
uuccccuuccacuga

SEQ ID NO: 3697747 - RNA, 13 nt, Human
uuccccuuccuuc

SEQ ID NO: 3697748 - RNA, 14 nt, Human
uuccccuuccuucu

SEQ ID NO: 3697749 - RNA, 22 nt, Human
uuccccuugcccagggcucagc

SEQ ID NO: 3697750 - RNA, 22 nt, Human
uuccccuugcccuugcccugac

SEQ ID NO: 3697751 - RNA, 13 nt, Human
uuccccuuuugca

SEQ ID NO: 3697752 - RNA, 16 nt, Human
uuccccuuuugccaau

SEQ ID NO: 3697753 - RNA, 23 nt, Human
uucccgaaccccaaggagggaga

SEQ ID NO: 3697754 - RNA, 12 nt, Human
uucccgcucagc

SEQ ID NO: 3697755 - RNA, 16 nt, Human
uucccgcucagcccuc

SEQ ID NO: 3697756 - RNA, 21 nt, Human
uucccgcucagcccucccugc

SEQ ID NO: 3697757 - RNA, 17 nt, Human
uucccgggccagggcug

SEQ ID NO: 3697758 - RNA, 18 nt, Human
uucccgggccagggcugc

SEQ ID NO: 3697759 - RNA, 19 nt, Human
uucccggucccgaguacag

SEQ ID NO: 3697760 - RNA, 21 nt, Human
uucccgucccauauccugccu

SEQ ID NO: 3697761 - RNA, 13 nt, Human
uucccguggcccc

SEQ ID NO: 3697762 - RNA, 17 nt, Human
uucccguggccccagcc

SEQ ID NO: 3697763 - RNA, 19 nt, Human
uucccguggccccagccug

SEQ ID NO: 3697764 - RNA, 14 nt, Human
uucccguuucucca

SEQ ID NO: 3697765 - RNA, 14 nt, Human
uucccuaacacuua

SEQ ID NO: 3697766 - RNA, 19 nt, Human
uucccuaagccaagggccu

SEQ ID NO: 3697767 - RNA, 16 nt, Human
uucccuaaucuauggu

SEQ ID NO: 3697768 - RNA, 16 nt, Human
uucccuacccucuaga

SEQ ID NO: 3697769 - RNA, 14 nt, Human
uucccuaccucagg

SEQ ID NO: 3697770 - RNA, 17 nt, Human
uucccuacuuccuguga

SEQ ID NO: 3697771 - RNA, 18 nt, Human
uucccuagggcugggugu

SEQ ID NO: 3697772 - RNA, 19 nt, Human
uucccuaggggacacuucc

SEQ ID NO: 3697773 - RNA, 12 nt, Human
uucccuaucacu

SEQ ID NO: 3697774 - RNA, 16 nt, Human
uucccuaucuuugcca

SEQ ID NO: 3697775 - RNA, 20 nt, Human
uucccucaccuuucccaucu

SEQ ID NO: 3697776 - RNA, 19 nt, Human
uucccucccagaggagcca

SEQ ID NO: 3697777 - RNA, 11 nt, Human
uucccucccuu

SEQ ID NO: 3697778 - RNA, 14 nt, Human
uucccucucaucuc

SEQ ID NO: 3697779 - RNA, 21 nt, Human
uucccucucucauacccuccc

SEQ ID NO: 3697780 - RNA, 21 nt, Human
uucccucugccugucccucuc

SEQ ID NO: 3697781 - RNA, 14 nt, Human
uucccucuuuggcu

SEQ ID NO: 3697782 - RNA, 15 nt, Human
uucccugaauguauu

SEQ ID NO: 3697783 - RNA, 17 nt, Human
uucccugacacugcggg

SEQ ID NO: 3697784 - RNA, 13 nt, Human
uucccugacucau

SEQ ID NO: 3697785 - RNA, 18 nt, Human
uucccugacuccucuaag

SEQ ID NO: 3697786 - RNA, 12 nt, Human
uucccugaggug

SEQ ID NO: 3697787 - RNA, 16 nt, Human
uucccugagucaccag

SEQ ID NO: 3697788 - RNA, 19 nt, Human
uucccugauugaccugcuc

SEQ ID NO: 3697789 - RNA, 19 nt, Human
uucccugcauuucugaguu

SEQ ID NO: 3697790 - RNA, 14 nt, Human
uucccugccucuca

SEQ ID NO: 3697791 - RNA, 12 nt, Human
uucccugccugg

SEQ ID NO: 3697792 - RNA, 17 nt, Human
uucccugcuuaaugaaa

SEQ ID NO: 3697793 - RNA, 14 nt, Human
uucccugcuuccag

SEQ ID NO: 3697794 - RNA, 16 nt, Human
uucccugcuuccagga

SEQ ID NO: 3697795 - RNA, 23 nt, Human
uucccuggaaaccuuccacccag

SEQ ID NO: 3697796 - RNA, 12 nt, Human
uucccuggacca

SEQ ID NO: 3697797 - RNA, 16 nt, Human
uucccuggccuuucau

SEQ ID NO: 3697798 - RNA, 15 nt, Human
uucccuggcggcccc

SEQ ID NO: 3697799 - RNA, 20 nt, Human
uucccuggcggccccaacuc

SEQ ID NO: 3697800 - RNA, 20 nt, Human
uucccugggaucuggugguc

SEQ ID NO: 3697801 - RNA, 17 nt, Human
uucccugggcugugcua

SEQ ID NO: 3697802 - RNA, 20 nt, Human
uucccugggcugugcuaccu

SEQ ID NO: 3697803 - RNA, 13 nt, Human
uucccuggguuag

SEQ ID NO: 3697804 - RNA, 15 nt, Human
uucccugugccuccu

SEQ ID NO: 3697805 - RNA, 18 nt, Human
uucccugugccuccuccc

SEQ ID NO: 3697806 - RNA, 12 nt, Human
uucccuguucuu

SEQ ID NO: 3697807 - RNA, 15 nt, Human
uucccuguucuuccu

SEQ ID NO: 3697808 - RNA, 19 nt, Human
uucccuucaguacccucuc

SEQ ID NO: 3697809 - RNA, 23 nt, Human
uucccuucaguacccucucagcu

SEQ ID NO: 3697810 - RNA, 14 nt, Human
uucccuucaucugg

SEQ ID NO: 3697811 - RNA, 16 nt, Human
uucccuucaucuggaa

SEQ ID NO: 3697812 - RNA, 18 nt, Human
uucccuucccuaaaguga

SEQ ID NO: 3697813 - RNA, 15 nt, Human
uucccuucccuucca

SEQ ID NO: 3697814 - RNA, 12 nt, Human
uucccuucucca

SEQ ID NO: 3697815 - RNA, 20 nt, Human
uucccuucuccaucucucug

SEQ ID NO: 3697816 - RNA, 20 nt, Human
uucccuucuccuuccaacug

SEQ ID NO: 3697817 - RNA, 13 nt, Human
uucccuucucuca

SEQ ID NO: 3697818 - RNA, 22 nt, Human
uucccuugaaacuuugggaaaa

SEQ ID NO: 3697819 - RNA, 15 nt, Human
uucccuugagcccuc

SEQ ID NO: 3697820 - RNA, 18 nt, Human
uucccuugcuuuucccuc

SEQ ID NO: 3697821 - RNA, 11 nt, Human
uucccuuggcc

SEQ ID NO: 3697822 - RNA, 14 nt, Human
uucccuuggccuca

SEQ ID NO: 3697823 - RNA, 20 nt, Human
uucccuuguagcuccucccc

SEQ ID NO: 3697824 - RNA, 21 nt, Human
uucccuuuagcacguuuaaag

SEQ ID NO: 3697825 - RNA, 18 nt, Human
uucccuuugcuccacccc

SEQ ID NO: 3697826 - RNA, 14 nt, Human
uucccuuugucuuu

SEQ ID NO: 3697827 - RNA, 22 nt, Human
uucccuuugugagucaauacau

SEQ ID NO: 3697828 - RNA, 21 nt, Human
uucccuuuuaaacacauuuug

SEQ ID NO: 3697829 - RNA, 15 nt, Human
uucccuuuuuuuaag

SEQ ID NO: 3697830 - RNA, 20 nt, Human
uuccgaaaaauccucuuccu

SEQ ID NO: 3697831 - RNA, 22 nt, Human
uuccgaagaagaugcuccagca

SEQ ID NO: 3697832 - RNA, 16 nt, Human
uuccgacccucuggga

SEQ ID NO: 3697833 - RNA, 15 nt, Human
uuccgcacuuuccac

SEQ ID NO: 3697834 - RNA, 14 nt, Human
uuccgccccuuccc

SEQ ID NO: 3697835 - RNA, 15 nt, Human
uuccgccccuucccu

SEQ ID NO: 3697836 - RNA, 13 nt, Human
uuccggccccucc

SEQ ID NO: 3697837 - RNA, 18 nt, Human
uuccggccccuccccucc

SEQ ID NO: 3697838 - RNA, 19 nt, Human
uuccgggcaaaugccaggg

SEQ ID NO: 3697839 - RNA, 19 nt, Human
uuccgguagggaggcagcc

SEQ ID NO: 3697840 - RNA, 16 nt, Human
uuccguagacuguuua

SEQ ID NO: 3697841 - RNA, 19 nt, Human
uuccguagguuauuuucag

SEQ ID NO: 3697842 - RNA, 13 nt, Human
uuccgucuccccc

SEQ ID NO: 3697843 - RNA, 15 nt, Human
uuccguguccacccc

SEQ ID NO: 3697844 - RNA, 14 nt, Human
uuccguuaaaauac

SEQ ID NO: 3697845 - RNA, 16 nt, Human
uuccguuaaaauacca

SEQ ID NO: 3697846 - RNA, 13 nt, Human
uuccguuuacauu

SEQ ID NO: 3697847 - RNA, 12 nt, Human
uuccuaaaacag

SEQ ID NO: 3697848 - RNA, 13 nt, Human
uuccuaaaauuau

SEQ ID NO: 3697849 - RNA, 20 nt, Human
uuccuaaauauauuuuaaga

SEQ ID NO: 3697850 - RNA, 13 nt, Human
uuccuaaaugcag

SEQ ID NO: 3697851 - RNA, 16 nt, Human
uuccuaagaagcuucu

SEQ ID NO: 3697852 - RNA, 18 nt, Human
uuccuaagaccugggguu

SEQ ID NO: 3697853 - RNA, 21 nt, Human
uuccuaagccacuugaaaugu

SEQ ID NO: 3697854 - RNA, 17 nt, Human
uuccuaaggcacccaca

SEQ ID NO: 3697855 - RNA, 17 nt, Human
uuccuaaguauaaaugg

SEQ ID NO: 3697856 - RNA, 13 nt, Human
uuccuaagugauu

SEQ ID NO: 3697857 - RNA, 14 nt, Human
uuccuaaguucuua

SEQ ID NO: 3697858 - RNA, 15 nt, Human
uuccuaauaaaguuc

SEQ ID NO: 3697859 - RNA, 23 nt, Human
uuccuaaucagaaauuuuuauca

SEQ ID NO: 3697860 - RNA, 17 nt, Human
uuccuaauccucuagga

SEQ ID NO: 3697861 - RNA, 16 nt, Human
uuccuaauuccacagc

SEQ ID NO: 3697862 - RNA, 17 nt, Human
uuccuaauuccacagcu

SEQ ID NO: 3697863 - RNA, 20 nt, Human
uuccuacaagagcagccugu

SEQ ID NO: 3697864 - RNA, 22 nt, Human
uuccuacaagagcagccugugg

SEQ ID NO: 3697865 - RNA, 23 nt, Human
uuccuacaagagcagccuguggc

SEQ ID NO: 3697866 - RNA, 14 nt, Human
uuccuacaauauau

SEQ ID NO: 3697867 - RNA, 15 nt, Human
uuccuacagcacuac

SEQ ID NO: 3697868 - RNA, 20 nt, Human
uuccuacagcacuacugggu

SEQ ID NO: 3697869 - RNA, 21 nt, Human
uuccuacagcacuacugggug

SEQ ID NO: 3697870 - RNA, 22 nt, Human
uuccuacagcacuacugggugu

SEQ ID NO: 3697871 - RNA, 19 nt, Human
uuccuaccaagucaaacuu

SEQ ID NO: 3697872 - RNA, 17 nt, Human
uuccuacccaaccacuc

SEQ ID NO: 3697873 - RNA, 21 nt, Human
uuccuacccacaccucugcca

SEQ ID NO: 3697874 - RNA, 16 nt, Human
uuccuacccugccucc

SEQ ID NO: 3697875 - RNA, 15 nt, Human
uuccuaccucccugc

SEQ ID NO: 3697876 - RNA, 22 nt, Human
uuccuacucuucucucugcucu

SEQ ID NO: 3697877 - RNA, 15 nt, Human
uuccuacuggucucu

SEQ ID NO: 3697878 - RNA, 22 nt, Human
uuccuagauggcagucacugaa

SEQ ID NO: 3697879 - RNA, 15 nt, Human
uuccuagccaccgcc

SEQ ID NO: 3697880 - RNA, 22 nt, Human
uuccuagccaccgccuccuaca

SEQ ID NO: 3697881 - RNA, 18 nt, Human
uuccuagcccucucacau

SEQ ID NO: 3697882 - RNA, 13 nt, Human
uuccuaguuggug

SEQ ID NO: 3697883 - RNA, 21 nt, Human
uuccuaguuggugagaaaccu

SEQ ID NO: 3697884 - RNA, 22 nt, Human
uuccuaguuggugagaaaccug

SEQ ID NO: 3697885 - RNA, 15 nt, Human
uuccuaguuuucucc

SEQ ID NO: 3697886 - RNA, 15 nt, Human
uuccuauaacacugu

SEQ ID NO: 3697887 - RNA, 20 nt, Human
uuccuauaacuugaugcaug

SEQ ID NO: 3697888 - RNA, 18 nt, Human
uuccuauaccauuuccgu

SEQ ID NO: 3697889 - RNA, 19 nt, Human
uuccuauauaguuuauuga

SEQ ID NO: 3697890 - RNA, 12 nt, Human
uuccuauaugca

SEQ ID NO: 3697891 - RNA, 17 nt, Human
uuccuaucaaaaagaua

SEQ ID NO: 3697892 - RNA, 18 nt, Human
uuccuaucaaaaagauau

SEQ ID NO: 3697893 - RNA, 17 nt, Human
uuccuauugucauuaaa

SEQ ID NO: 3697894 - RNA, 18 nt, Human
uuccuauugucauuaaag

SEQ ID NO: 3697895 - RNA, 12 nt, Human
uuccuauuguga

SEQ ID NO: 3697896 - RNA, 23 nt, Human
uuccuauuucagaaguuuaaaua

SEQ ID NO: 3697897 - RNA, 18 nt, Human
uuccuauuugccaugggc

SEQ ID NO: 3697898 - RNA, 22 nt, Human
uuccuauuugccaugggcuuca

SEQ ID NO: 3697899 - RNA, 21 nt, Human
uuccuauuuguuuucauggug

SEQ ID NO: 3697900 - RNA, 17 nt, Human
uuccuauuuucagccca

SEQ ID NO: 3697901 - RNA, 16 nt, Human
uuccuauuuuuaaaua

SEQ ID NO: 3697902 - RNA, 17 nt, Human
uuccuauuuuuaaauaa

SEQ ID NO: 3697903 - RNA, 21 nt, Human
uuccucaacaguguuuucaga

SEQ ID NO: 3697904 - RNA, 22 nt, Human
uuccucaacaguguuuucagaa

SEQ ID NO: 3697905 - RNA, 14 nt, Human
uuccucacaguccc

SEQ ID NO: 3697906 - RNA, 15 nt, Human
uuccucagccagccu

SEQ ID NO: 3697907 - RNA, 19 nt, Human
uuccucauccaccccaucc

SEQ ID NO: 3697908 - RNA, 14 nt, Human
uuccucauccucag

SEQ ID NO: 3697909 - RNA, 15 nt, Human
uuccucaugaaugua

SEQ ID NO: 3697910 - RNA, 21 nt, Human
uuccucaugaauguaaauuug

SEQ ID NO: 3697911 - RNA, 17 nt, Human
uuccucauuaaauuacc

SEQ ID NO: 3697912 - RNA, 16 nt, Human
uuccucauuccugaaa

SEQ ID NO: 3697913 - RNA, 16 nt, Human
uuccuccagcugcacc

SEQ ID NO: 3697914 - RNA, 13 nt, Human
uuccuccauccuc

SEQ ID NO: 3697915 - RNA, 18 nt, Human
uuccuccauccuccuccu

SEQ ID NO: 3697916 - RNA, 12 nt, Human
uuccuccccagc

SEQ ID NO: 3697917 - RNA, 19 nt, Human
uuccucccucccucuuucc

SEQ ID NO: 3697918 - RNA, 22 nt, Human
uuccucccucccucuuucccuc

SEQ ID NO: 3697919 - RNA, 14 nt, Human
uuccuccuccccac

SEQ ID NO: 3697920 - RNA, 12 nt, Human
uuccuccugaca

SEQ ID NO: 3697921 - RNA, 14 nt, Human
uuccuccuggaaau

SEQ ID NO: 3697922 - RNA, 17 nt, Human
uuccuccuguguacagg

SEQ ID NO: 3697923 - RNA, 15 nt, Human
uuccuccuuccaugg

SEQ ID NO: 3697924 - RNA, 15 nt, Human
uuccucgccucuccc

SEQ ID NO: 3697925 - RNA, 13 nt, Human
uuccucgcuucuu

SEQ ID NO: 3697926 - RNA, 15 nt, Human
uuccucuagaagcca

SEQ ID NO: 3697927 - RNA, 19 nt, Human
uuccucuagugcccuccac

SEQ ID NO: 3697928 - RNA, 17 nt, Human
uuccucuauacaucucu

SEQ ID NO: 3697929 - RNA, 20 nt, Human
uuccucuauacaucucuccc

SEQ ID NO: 3697930 - RNA, 22 nt, Human
uuccucuauacaucucucccca

SEQ ID NO: 3697931 - RNA, 17 nt, Human
uuccucuauugauguac

SEQ ID NO: 3697932 - RNA, 21 nt, Human
uuccucuauugauguacaguc

SEQ ID NO: 3697933 - RNA, 13 nt, Human
uuccucuccacug

SEQ ID NO: 3697934 - RNA, 14 nt, Human
uuccucuccacugc

SEQ ID NO: 3697935 - RNA, 19 nt, Human
uuccucuccacugccuucg

SEQ ID NO: 3697936 - RNA, 13 nt, Human
uuccucugagccu

SEQ ID NO: 3697937 - RNA, 11 nt, Human
uuccucugccc

SEQ ID NO: 3697938 - RNA, 12 nt, Human
uuccucugccug

SEQ ID NO: 3697939 - RNA, 13 nt, Human
uuccucugccugc

SEQ ID NO: 3697940 - RNA, 14 nt, Human
uuccucugccugcc

SEQ ID NO: 3697941 - RNA, 14 nt, Human
uuccucugcuaaau

SEQ ID NO: 3697942 - RNA, 17 nt, Human
uuccucugcuaaauuga

SEQ ID NO: 3697943 - RNA, 22 nt, Human
uuccucugcuaaauugauguug

SEQ ID NO: 3697944 - RNA, 11 nt, Human
uuccucugcuc

SEQ ID NO: 3697945 - RNA, 13 nt, Human
uuccucugcuccc

SEQ ID NO: 3697946 - RNA, 14 nt, Human
uuccucugcucccc

SEQ ID NO: 3697947 - RNA, 15 nt, Human
uuccucugcuuugaa

SEQ ID NO: 3697948 - RNA, 21 nt, Human
uuccucuguauugugcugauu

SEQ ID NO: 3697949 - RNA, 19 nt, Human
uuccucuugacccugcacc

SEQ ID NO: 3697950 - RNA, 23 nt, Human
uuccucuugacccugcacccucc

SEQ ID NO: 3697951 - RNA, 15 nt, Human
uuccucuugucugau

SEQ ID NO: 3697952 - RNA, 11 nt, Human
uuccucuuucc

SEQ ID NO: 3697953 - RNA, 17 nt, Human
uuccucuuuccaucuac

SEQ ID NO: 3697954 - RNA, 13 nt, Human
uuccucuuugcuu

SEQ ID NO: 3697955 - RNA, 17 nt, Human
uuccugaaacuauauuu

SEQ ID NO: 3697956 - RNA, 20 nt, Human
uuccugaaacuauauuuugu

SEQ ID NO: 3697957 - RNA, 12 nt, Human
uuccugaaagaa

SEQ ID NO: 3697958 - RNA, 18 nt, Human
uuccugaaagaaacaguu

SEQ ID NO: 3697959 - RNA, 15 nt, Human
uuccugaacuauaac

SEQ ID NO: 3697960 - RNA, 11 nt, Human
uuccugaagcu

SEQ ID NO: 3697961 - RNA, 18 nt, Human
uuccugaauccaaacuaa

SEQ ID NO: 3697962 - RNA, 14 nt, Human
uuccugaaugaaau

SEQ ID NO: 3697963 - RNA, 16 nt, Human
uuccugaaugaaauau

SEQ ID NO: 3697964 - RNA, 20 nt, Human
uuccugacaucacagcagcc

SEQ ID NO: 3697965 - RNA, 13 nt, Human
uuccugacccagg

SEQ ID NO: 3697966 - RNA, 16 nt, Human
uuccugacccaggccg

SEQ ID NO: 3697967 - RNA, 21 nt, Human
uuccugagauuuccuccuggc

SEQ ID NO: 3697968 - RNA, 20 nt, Human
uuccugagcuuggccagaag

SEQ ID NO: 3697969 - RNA, 14 nt, Human
uuccugagcuuuau

SEQ ID NO: 3697970 - RNA, 20 nt, Human
uuccugaggcugggcucccu

SEQ ID NO: 3697971 - RNA, 23 nt, Human
uuccugagggaucuauacuugcu

SEQ ID NO: 3697972 - RNA, 22 nt, Human
uuccugagucccaucccugcgu

SEQ ID NO: 3697973 - RNA, 20 nt, Human
uuccugaguuaggcuuucuc

SEQ ID NO: 3697974 - RNA, 20 nt, Human
uuccugauagcauaugacaa

SEQ ID NO: 3697975 - RNA, 22 nt, Human
uuccugauagcauaugacaaau

SEQ ID NO: 3697976 - RNA, 20 nt, Human
uuccugauaugauuuaaaac

SEQ ID NO: 3697977 - RNA, 13 nt, Human
uuccugaugaccc

SEQ ID NO: 3697978 - RNA, 19 nt, Human
uuccugaugcuucuucaga

SEQ ID NO: 3697979 - RNA, 21 nt, Human
uuccugauggcaggauggccu

SEQ ID NO: 3697980 - RNA, 15 nt, Human
uuccugcagccugga

SEQ ID NO: 3697981 - RNA, 21 nt, Human
uuccugcaggcaggaacaaac

SEQ ID NO: 3697982 - RNA, 18 nt, Human
uuccugcauucacccaga

SEQ ID NO: 3697983 - RNA, 15 nt, Human
uuccugcauuuguga

SEQ ID NO: 3697984 - RNA, 16 nt, Human
uuccugcauuugugaa

SEQ ID NO: 3697985 - RNA, 12 nt, Human
uuccugccacca

SEQ ID NO: 3697986 - RNA, 18 nt, Human
uuccugccaccagucacu

SEQ ID NO: 3697987 - RNA, 20 nt, Human
uuccugccagccccugccau

SEQ ID NO: 3697988 - RNA, 14 nt, Human
uuccugccccucuu

SEQ ID NO: 3697989 - RNA, 15 nt, Human
uuccugccccucuuu

SEQ ID NO: 3697990 - RNA, 18 nt, Human
uuccugccgcaacaguuu

SEQ ID NO: 3697991 - RNA, 16 nt, Human
uuccugccuggucucc

SEQ ID NO: 3697992 - RNA, 17 nt, Human
uuccugccuggucuccu

SEQ ID NO: 3697993 - RNA, 16 nt, Human
uuccugccugucuccu

SEQ ID NO: 3697994 - RNA, 23 nt, Human
uuccugccuucuucuuuuugcug

SEQ ID NO: 3697995 - RNA, 17 nt, Human
uuccugcggagugaaga

SEQ ID NO: 3697996 - RNA, 19 nt, Human
uuccugcggagugaagagg

SEQ ID NO: 3697997 - RNA, 21 nt, Human
uuccugcgggcuuuuccccgg

SEQ ID NO: 3697998 - RNA, 16 nt, Human
uuccugcuagaaaugg

SEQ ID NO: 3697999 - RNA, 14 nt, Human
uuccugcugagccu

SEQ ID NO: 3698000 - RNA, 15 nt, Human
uuccugcugcugucu

SEQ ID NO: 3698001 - RNA, 18 nt, Human
uuccuggaauugccagcu

SEQ ID NO: 3698002 - RNA, 22 nt, Human
uuccuggagcagaagcagcaac

SEQ ID NO: 3698003 - RNA, 15 nt, Human
uuccuggagcccaga

SEQ ID NO: 3698004 - RNA, 16 nt, Human
uuccuggagcccagag

SEQ ID NO: 3698005 - RNA, 13 nt, Human
uuccuggaugucu

SEQ ID NO: 3698006 - RNA, 15 nt, Human
uuccuggaugucuga

SEQ ID NO: 3698007 - RNA, 18 nt, Human
uuccuggcaauagugugu

SEQ ID NO: 3698008 - RNA, 14 nt, Human
uuccuggcacugcu

SEQ ID NO: 3698009 - RNA, 22 nt, Human
uuccuggcacugcuuccaguga

SEQ ID NO: 3698010 - RNA, 14 nt, Human
uuccuggccugaga

SEQ ID NO: 3698011 - RNA, 14 nt, Human
uuccuggcuucuua

SEQ ID NO: 3698012 - RNA, 15 nt, Human
uuccugggagcuuuu

SEQ ID NO: 3698013 - RNA, 16 nt, Human
uuccugggagcuuuug

SEQ ID NO: 3698014 - RNA, 20 nt, Human
uuccuggggugcccuccacu

SEQ ID NO: 3698015 - RNA, 22 nt, Human
uuccuggggugcccuccacugc

SEQ ID NO: 3698016 - RNA, 22 nt, Human
uuccugguagaccacugccaua

SEQ ID NO: 3698017 - RNA, 19 nt, Human
uuccuggugccaauuucaa

SEQ ID NO: 3698018 - RNA, 11 nt, Human
uuccuggugcu

SEQ ID NO: 3698019 - RNA, 21 nt, Human
uuccuguaaaaaaaaaaaagu

SEQ ID NO: 3698020 - RNA, 19 nt, Human
uuccuguaacacaagccac

SEQ ID NO: 3698021 - RNA, 22 nt, Human
uuccuguaacacaagccacaga

SEQ ID NO: 3698022 - RNA, 16 nt, Human
uuccuguacugugucu

SEQ ID NO: 3698023 - RNA, 17 nt, Human
uuccuguagcaucuucu

SEQ ID NO: 3698024 - RNA, 18 nt, Human
uuccuguagcaucuucug

SEQ ID NO: 3698025 - RNA, 23 nt, Human
uuccugucccaccauacgagcac

SEQ ID NO: 3698026 - RNA, 14 nt, Human
uuccugucccaccu

SEQ ID NO: 3698027 - RNA, 15 nt, Human
uuccugucccaccuc

SEQ ID NO: 3698028 - RNA, 18 nt, Human
uuccuguccccaucuguc

SEQ ID NO: 3698029 - RNA, 23 nt, Human
uuccugucccugcgccuuuccuu

SEQ ID NO: 3698030 - RNA, 20 nt, Human
uuccuguccucccagcuccu

SEQ ID NO: 3698031 - RNA, 21 nt, Human
uauauauguguaugcacagua

SEQ ID NO: 3698032 - RNA, 23 nt, Human
uauauauguguaugcacaguaaa

SEQ ID NO: 3698033 - RNA, 22 nt, Human
uauauauguguguuuaaauaaa

SEQ ID NO: 3698034 - RNA, 13 nt, Human
uauauauuauacu

SEQ ID NO: 3698035 - RNA, 14 nt, Human
uauauauuauacuu

SEQ ID NO: 3698036 - RNA, 18 nt, Human
uauauauuauacuuguaa

SEQ ID NO: 3698037 - RNA, 14 nt, Human
uauauauuaucuuu

SEQ ID NO: 3698038 - RNA, 18 nt, Human
uauauauuaucuuuucau

SEQ ID NO: 3698039 - RNA, 14 nt, Human
uauauauucuauua

SEQ ID NO: 3698040 - RNA, 21 nt, Human
uauauauucuggcugauaaaa

SEQ ID NO: 3698041 - RNA, 17 nt, Human
uauauauucuuauaaaa

SEQ ID NO: 3698042 - RNA, 11 nt, Human
uauauauuucc

SEQ ID NO: 3698043 - RNA, 13 nt, Human
uauauauuucuau

SEQ ID NO: 3698044 - RNA, 23 nt, Human
uauauauuuugugugaaauugca

SEQ ID NO: 3698045 - RNA, 20 nt, Human
uauauauuuuugguugucaa

SEQ ID NO: 3698046 - RNA, 21 nt, Human
uauauauuuuuuucugaaauu

SEQ ID NO: 3698047 - RNA, 15 nt, Human
uauaucaaaguauuu

SEQ ID NO: 3698048 - RNA, 22 nt, Human
uauaucacccagacauaaagga

SEQ ID NO: 3698049 - RNA, 13 nt, Human
uauaucagaaaag

SEQ ID NO: 3698050 - RNA, 23 nt, Human
uauaucagccugagucuccugug

SEQ ID NO: 3698051 - RNA, 13 nt, Human
uauaucaguuuga

SEQ ID NO: 3698052 - RNA, 15 nt, Human
uauaucauauguaua

SEQ ID NO: 3698053 - RNA, 22 nt, Human
uauaucauuggaacaacugaua

SEQ ID NO: 3698054 - RNA, 14 nt, Human
uauauccauguacu

SEQ ID NO: 3698055 - RNA, 17 nt, Human
uauauccauguacugua

SEQ ID NO: 3698056 - RNA, 18 nt, Human
uauauccauguacuguag

SEQ ID NO: 3698057 - RNA, 19 nt, Human
uauaucccugauaaauauu

SEQ ID NO: 3698058 - RNA, 15 nt, Human
uauauccugugacug

SEQ ID NO: 3698059 - RNA, 21 nt, Human
uauauccuuuucuucuaugua

SEQ ID NO: 3698060 - RNA, 16 nt, Human
uauaucguuaucacug

SEQ ID NO: 3698061 - RNA, 20 nt, Human
uauaucguuaucacugugca

SEQ ID NO: 3698062 - RNA, 15 nt, Human
uauaucuaaaucugu

SEQ ID NO: 3698063 - RNA, 18 nt, Human
uauaucuauaaacacugu

SEQ ID NO: 3698064 - RNA, 13 nt, Human
uauaucuauauau

SEQ ID NO: 3698065 - RNA, 22 nt, Human
uauaucuauauauaauucugua

SEQ ID NO: 3698066 - RNA, 16 nt, Human
uauaucuauauguacu

SEQ ID NO: 3698067 - RNA, 21 nt, Human
uauaucuauauuuuacauaaa

SEQ ID NO: 3698068 - RNA, 17 nt, Human
uauaucuaucuauuuga

SEQ ID NO: 3698069 - RNA, 15 nt, Human
uauaucuaucuuaua

SEQ ID NO: 3698070 - RNA, 17 nt, Human
uauaucucaaauuguaa

SEQ ID NO: 3698071 - RNA, 19 nt, Human
uauaucugaggaauucugu

SEQ ID NO: 3698072 - RNA, 20 nt, Human
uauaucugaggaauucugua

SEQ ID NO: 3698073 - RNA, 21 nt, Human
uauaucugaggaauucuguau

SEQ ID NO: 3698074 - RNA, 22 nt, Human
uauaucugaggaauucuguaua

SEQ ID NO: 3698075 - RNA, 13 nt, Human
uauaucugcuguc

SEQ ID NO: 3698076 - RNA, 14 nt, Human
uauaucuggaauga

SEQ ID NO: 3698077 - RNA, 14 nt, Human
uauaucuguauaua

SEQ ID NO: 3698078 - RNA, 20 nt, Human
uauaucuguauguauuagug

SEQ ID NO: 3698079 - RNA, 14 nt, Human
uauaucuuguagcu

SEQ ID NO: 3698080 - RNA, 14 nt, Human
uauaucuuuuucca

SEQ ID NO: 3698081 - RNA, 14 nt, Human
uauaugagaagaau

SEQ ID NO: 3698082 - RNA, 15 nt, Human
uauaugagaagaaua

SEQ ID NO: 3698083 - RNA, 13 nt, Human
uauaugcuucugu

SEQ ID NO: 3698084 - RNA, 18 nt, Human
uauauggacaaaacaaga

SEQ ID NO: 3698085 - RNA, 18 nt, Human
uauauggaugauucagaa

SEQ ID NO: 3698086 - RNA, 22 nt, Human
uauauggaugauucagaaauug

SEQ ID NO: 3698087 - RNA, 16 nt, Human
uauauggcaagaaagc

SEQ ID NO: 3698088 - RNA, 17 nt, Human
uauauggccucaagauc

SEQ ID NO: 3698089 - RNA, 22 nt, Human
uauaugguauauauacauauau

SEQ ID NO: 3698090 - RNA, 17 nt, Human
uauauggucuaauguuu

SEQ ID NO: 3698091 - RNA, 22 nt, Human
uauauggugguaauaagggaaa

SEQ ID NO: 3698092 - RNA, 14 nt, Human
uauauguacuguuu

SEQ ID NO: 3698093 - RNA, 13 nt, Human
uauauguacuugu

SEQ ID NO: 3698094 - RNA, 11 nt, Human
uauauguaugu

SEQ ID NO: 3698095 - RNA, 12 nt, Human
uauauguaugug

SEQ ID NO: 3698096 - RNA, 13 nt, Human
uauauguaugugu

SEQ ID NO: 3698097 - RNA, 14 nt, Human
uauauguauguguu

SEQ ID NO: 3698098 - RNA, 15 nt, Human
uauauguauguguuu

SEQ ID NO: 3698099 - RNA, 18 nt, Human
uauauguauguguuuaga

SEQ ID NO: 3698100 - RNA, 18 nt, Human
uauauguguauauauaca

SEQ ID NO: 3698101 - RNA, 22 nt, Human
uauauguguguguauguuugca

SEQ ID NO: 3698102 - RNA, 19 nt, Human
uauauguguguuuaaauaa

SEQ ID NO: 3698103 - RNA, 18 nt, Human
uauauguguuuuucacau

SEQ ID NO: 3698104 - RNA, 15 nt, Human
uauauuaaaaauaua

SEQ ID NO: 3698105 - RNA, 19 nt, Human
uauauuaaaaauauaaaac

SEQ ID NO: 3698106 - RNA, 20 nt, Human
uauauuaaaaauauaaaacu

SEQ ID NO: 3698107 - RNA, 23 nt, Human
uauauuaaaaauauaaaacugcg

SEQ ID NO: 3698108 - RNA, 17 nt, Human
uauauuaaaaaugguaa

SEQ ID NO: 3698109 - RNA, 15 nt, Human
uauauuaaaauaagc

SEQ ID NO: 3698110 - RNA, 22 nt, Human
uauauuaaacaaaguuucagag

SEQ ID NO: 3698111 - RNA, 23 nt, Human
uauauuaauaguaauuuguaaag

SEQ ID NO: 3698112 - RNA, 15 nt, Human
uauauuaauguacuu

SEQ ID NO: 3698113 - RNA, 12 nt, Human
uauauuacaaug

SEQ ID NO: 3698114 - RNA, 13 nt, Human
uauauuacaauga

SEQ ID NO: 3698115 - RNA, 22 nt, Human
uauauuacacuacacacugugu

SEQ ID NO: 3698116 - RNA, 22 nt, Human
uauauuacuagcauaugaguuu

SEQ ID NO: 3698117 - RNA, 16 nt, Human
uauauuacugacauuu

SEQ ID NO: 3698118 - RNA, 16 nt, Human
uauauuaguauguaug

SEQ ID NO: 3698119 - RNA, 20 nt, Human
uauauuauaaauauauauaa

SEQ ID NO: 3698120 - RNA, 21 nt, Human
uauauuauaaauauauauaaa

SEQ ID NO: 3698121 - RNA, 22 nt, Human
uauauuauaaauauauauaaag

SEQ ID NO: 3698122 - RNA, 20 nt, Human
uauauuauacuuguaauuau

SEQ ID NO: 3698123 - RNA, 22 nt, Human
uauauuaucaugcaaaugcugu

SEQ ID NO: 3698124 - RNA, 20 nt, Human
uauauuauuacuuguaaaua

SEQ ID NO: 3698125 - RNA, 23 nt, Human
uauauuauuucuaggaagaauuu

SEQ ID NO: 3698126 - RNA, 14 nt, Human
uauauuauuugcag

SEQ ID NO: 3698127 - RNA, 21 nt, Human
uauauuccauauauuagcauu

SEQ ID NO: 3698128 - RNA, 23 nt, Human
uauauuccuuuucccaggaaaga

SEQ ID NO: 3698129 - RNA, 22 nt, Human
uauauucucuuugguguacaaa

SEQ ID NO: 3698130 - RNA, 16 nt, Human
uauauucuuucaaagg

SEQ ID NO: 3698131 - RNA, 12 nt, Human
uauauugaacuu

SEQ ID NO: 3698132 - RNA, 22 nt, Human
uauauugaacuuuuguacugaa

SEQ ID NO: 3698133 - RNA, 20 nt, Human
uauauugaagacaauuugau

SEQ ID NO: 3698134 - RNA, 14 nt, Human
uauauugcaaugaa

SEQ ID NO: 3698135 - RNA, 19 nt, Human
uauauuguaagaaauacug

SEQ ID NO: 3698136 - RNA, 22 nt, Human
uauauuguaagaaauacuguac

SEQ ID NO: 3698137 - RNA, 19 nt, Human
uauauuguguuuguguauu

SEQ ID NO: 3698138 - RNA, 14 nt, Human
uauauuuaaaaaca

SEQ ID NO: 3698139 - RNA, 15 nt, Human
uauauuuaaaaauaa

SEQ ID NO: 3698140 - RNA, 17 nt, Human
uauauuuaaaaauaagu

SEQ ID NO: 3698141 - RNA, 19 nt, Human
uauauuuaacucucuuuau

SEQ ID NO: 3698142 - RNA, 15 nt, Human
uauauuuacaaaugg

SEQ ID NO: 3698143 - RNA, 16 nt, Human
uauauuuaguaucuuu

SEQ ID NO: 3698144 - RNA, 16 nt, Human
uauauuuaguuauagu

SEQ ID NO: 3698145 - RNA, 18 nt, Human
uauauuuaguuauaguuu

SEQ ID NO: 3698146 - RNA, 12 nt, Human
uauauuuauaac

SEQ ID NO: 3698147 - RNA, 16 nt, Human
uauauuuauaacucau

SEQ ID NO: 3698148 - RNA, 18 nt, Human
uauauuuauauaauuaug

SEQ ID NO: 3698149 - RNA, 19 nt, Human
uauauuucagauguaaugu

SEQ ID NO: 3698150 - RNA, 13 nt, Human
uauauuucccuga

SEQ ID NO: 3698151 - RNA, 21 nt, Human
uauauuucccugaaggaacca

SEQ ID NO: 3698152 - RNA, 21 nt, Human
uauauuuccuauaccauuucc

SEQ ID NO: 3698153 - RNA, 13 nt, Human
uauauuuccuuua

SEQ ID NO: 3698154 - RNA, 14 nt, Human
uauauuuccuuuau

SEQ ID NO: 3698155 - RNA, 20 nt, Human
uauauuuccuuuaugugaau

SEQ ID NO: 3698156 - RNA, 13 nt, Human
uauauuucuaaau

SEQ ID NO: 3698157 - RNA, 20 nt, Human
uauauuugaaauauugacuu

SEQ ID NO: 3698158 - RNA, 13 nt, Human
uauauuugauuua

SEQ ID NO: 3698159 - RNA, 20 nt, Human
uauauuugauuuauuaacuu

SEQ ID NO: 3698160 - RNA, 22 nt, Human
uauauuugauuuauuaacuuaa

SEQ ID NO: 3698161 - RNA, 14 nt, Human
uauauuuguacaaa

SEQ ID NO: 3698162 - RNA, 15 nt, Human
uauauuuguacaaaa

SEQ ID NO: 3698163 - RNA, 17 nt, Human
uauauuuguaggagaaa

SEQ ID NO: 3698164 - RNA, 22 nt, Human
uauauuugugauagcacuuucu

SEQ ID NO: 3698165 - RNA, 22 nt, Human
uauauuuuaaccugcauaaaaa

SEQ ID NO: 3698166 - RNA, 13 nt, Human
uauauuuuauaua

SEQ ID NO: 3698167 - RNA, 22 nt, Human
uauauuuuauuuuuagaauuuu

SEQ ID NO: 3698168 - RNA, 24 nt, Human
uauauuuucaugacuuuuccaugu

SEQ ID NO: 3698169 - RNA, 18 nt, Human
uauauuuucguaugaaaa

SEQ ID NO: 3698170 - RNA, 14 nt, Human
uauauuuucuguuu

SEQ ID NO: 3698171 - RNA, 13 nt, Human
uauauuuugggaa

SEQ ID NO: 3698172 - RNA, 19 nt, Human
uauauuuugugugaaauug

SEQ ID NO: 3698173 - RNA, 15 nt, Human
uauauuuuuaagaua

SEQ ID NO: 3698174 - RNA, 17 nt, Human
uauauuuuuaagauaau

SEQ ID NO: 3698175 - RNA, 21 nt, Human
uauauuuuuauaauaaacaua

SEQ ID NO: 3698176 - RNA, 15 nt, Human
uauauuuuucuuaaa

SEQ ID NO: 3698177 - RNA, 18 nt, Human
uauauuuuucuuaaaaag

SEQ ID NO: 3698178 - RNA, 12 nt, Human
uauauuuuuguc

SEQ ID NO: 3698179 - RNA, 17 nt, Human
uauauuuuuguuuguuu

SEQ ID NO: 3698180 - RNA, 18 nt, Human
uuguuggccuccggccuc

SEQ ID NO: 3698181 - RNA, 21 nt, Human
uuguuggcguaggcuacagag

SEQ ID NO: 3698182 - RNA, 22 nt, Human
uuguuggcguaggcuacagaga

SEQ ID NO: 3698183 - RNA, 19 nt, Human
uuguugggauuccugaccc

SEQ ID NO: 3698184 - RNA, 22 nt, Human
uuguugggauuccugacccagg

SEQ ID NO: 3698185 - RNA, 16 nt, Human
uuguuguaaaaagaaa

SEQ ID NO: 3698186 - RNA, 15 nt, Human
uuguuguaaccugcu

SEQ ID NO: 3698187 - RNA, 17 nt, Human
uuguuguguacagacuu

SEQ ID NO: 3698188 - RNA, 15 nt, Human
uuguuguucuguuaa

SEQ ID NO: 3698189 - RNA, 15 nt, Human
uuguuguuucuugcc

SEQ ID NO: 3698190 - RNA, 15 nt, Human
uuguuguuuguaugu

SEQ ID NO: 3698191 - RNA, 17 nt, Human
uuguuguuuguuuaguc

SEQ ID NO: 3698192 - RNA, 9 nt, Human
uuguuuaaa

SEQ ID NO: 3698193 - RNA, 21 nt, Human
uuguuuaaaaaccgaauaaau

SEQ ID NO: 3698194 - RNA, 15 nt, Human
uuguuuaaaauguaa

SEQ ID NO: 3698195 - RNA, 17 nt, Human
uuguuuaaagcaacugu

SEQ ID NO: 3698196 - RNA, 12 nt, Human
uuguuuaauggu

SEQ ID NO: 3698197 - RNA, 17 nt, Human
uuguuuaaugugaacuu

SEQ ID NO: 3698198 - RNA, 20 nt, Human
uuguuuaaugugaacuugua

SEQ ID NO: 3698199 - RNA, 23 nt, Human
uuguuuaaugugaacuuguagcu

SEQ ID NO: 3698200 - RNA, 23 nt, Human
uuguuuacaugcuuauuccauga

SEQ ID NO: 3698201 - RNA, 18 nt, Human
uuguuuacuuaaagauuu

SEQ ID NO: 3698202 - RNA, 23 nt, Human
uuguuuagucuuuauacugcaaa

SEQ ID NO: 3698203 - RNA, 21 nt, Human
uuguuuaucagauacaucacu

SEQ ID NO: 3698204 - RNA, 22 nt, Human
uuguuuaucagauacaucacug

SEQ ID NO: 3698205 - RNA, 18 nt, Human
uuguuuauuaaauaguua

SEQ ID NO: 3698206 - RNA, 17 nt, Human
uuguuuauuuuuauaua

SEQ ID NO: 3698207 - RNA, 14 nt, Human
uuguuucaagaacc

SEQ ID NO: 3698208 - RNA, 16 nt, Human
uuguuucaauugcauc

SEQ ID NO: 3698209 - RNA, 16 nt, Human
uuguuuccucuuccaa

SEQ ID NO: 3698210 - RNA, 19 nt, Human
uuguuuccucuuccaaagu

SEQ ID NO: 3698211 - RNA, 17 nt, Human
uuguuuccuuuuuuccc

SEQ ID NO: 3698212 - RNA, 15 nt, Human
uuguuucgcucuuug

SEQ ID NO: 3698213 - RNA, 14 nt, Human
uuguuucuaccucc

SEQ ID NO: 3698214 - RNA, 16 nt, Human
uuguuucuaccuccca

SEQ ID NO: 3698215 - RNA, 14 nt, Human
uuguuucuacuuug

SEQ ID NO: 3698216 - RNA, 18 nt, Human
uuguuucugagaaaagaa

SEQ ID NO: 3698217 - RNA, 12 nt, Human
uuguuucuguac

SEQ ID NO: 3698218 - RNA, 15 nt, Human
uuguuucuguuccaa

SEQ ID NO: 3698219 - RNA, 23 nt, Human
uuguuucuuaaauaagaaacuuu

SEQ ID NO: 3698220 - RNA, 17 nt, Human
uuguuucuuaauuugga

SEQ ID NO: 3698221 - RNA, 15 nt, Human
uuguuucuuccaaag

SEQ ID NO: 3698222 - RNA, 17 nt, Human
uuguuucuuguuuauug

SEQ ID NO: 3698223 - RNA, 16 nt, Human
uuguuucuuucucuga

SEQ ID NO: 3698224 - RNA, 20 nt, Human
uuguuucuuugaauuuucau

SEQ ID NO: 3698225 - RNA, 21 nt, Human
uuguuugaaacaaagaagguu

SEQ ID NO: 3698226 - RNA, 21 nt, Human
uuguuugagaaauuaaguauc

SEQ ID NO: 3698227 - RNA, 23 nt, Human
uuguuugaugcauuaaaagaaaa

SEQ ID NO: 3698228 - RNA, 15 nt, Human
uuguuugcuuauugu

SEQ ID NO: 3698229 - RNA, 12 nt, Human
uuguuuggagac

SEQ ID NO: 3698230 - RNA, 18 nt, Human
uuguuuggcaaggaaagg

SEQ ID NO: 3698231 - RNA, 14 nt, Human
uuguuuggcuuccu

SEQ ID NO: 3698232 - RNA, 21 nt, Human
uuguuuggguauccugcccag

SEQ ID NO: 3698233 - RNA, 19 nt, Human
uuguuugguauuguauuua

SEQ ID NO: 3698234 - RNA, 18 nt, Human
uuguuugguuauagugca

SEQ ID NO: 3698235 - RNA, 22 nt, Human
uuguuuguaaauaagagauuug

SEQ ID NO: 3698236 - RNA, 13 nt, Human
uuguuuguaugua

SEQ ID NO: 3698237 - RNA, 20 nt, Human
uuguuugucucuccuuuucu

SEQ ID NO: 3698238 - RNA, 13 nt, Human
uuguuugucuuua

SEQ ID NO: 3698239 - RNA, 19 nt, Human
uuguuuguuaauaaagugc

SEQ ID NO: 3698240 - RNA, 14 nt, Human
uuguuuguuuaguc

SEQ ID NO: 3698241 - RNA, 13 nt, Human
uuguuuguuucaa

SEQ ID NO: 3698242 - RNA, 13 nt, Human
uuguuuguuuucc

SEQ ID NO: 3698243 - RNA, 12 nt, Human
uuguuuguuuug

SEQ ID NO: 3698244 - RNA, 15 nt, Human
uuguuuguuuuugcu

SEQ ID NO: 3698245 - RNA, 13 nt, Human
uuguuuuaaaacu

SEQ ID NO: 3698246 - RNA, 14 nt, Human
uuguuuuaaaauua

SEQ ID NO: 3698247 - RNA, 18 nt, Human
uuguuuuaaaauuaaagc

SEQ ID NO: 3698248 - RNA, 13 nt, Human
uuguuuuaaucug

SEQ ID NO: 3698249 - RNA, 13 nt, Human
uuguuuuacaaua

SEQ ID NO: 3698250 - RNA, 19 nt, Human
uuguuuuaucaugacaugu

SEQ ID NO: 3698251 - RNA, 16 nt, Human
uuguuuucaguguaca

SEQ ID NO: 3698252 - RNA, 17 nt, Human
uuguuuucccgccaagc

SEQ ID NO: 3698253 - RNA, 20 nt, Human
uuguuuucuucuguauguua

SEQ ID NO: 3698254 - RNA, 14 nt, Human
uuguuuugaaaaua

SEQ ID NO: 3698255 - RNA, 19 nt, Human
uuguuuugacggaugauug

SEQ ID NO: 3698256 - RNA, 24 nt, Human
uuguuuugagcuuuccauguugcu

SEQ ID NO: 3698257 - RNA, 23 nt, Human
uuguuuugauguuuguggccuca

SEQ ID NO: 3698258 - RNA, 14 nt, Human
uuguuuugcacuuu

SEQ ID NO: 3698259 - RNA, 16 nt, Human
uuguuuugcacuuuuu

SEQ ID NO: 3698260 - RNA, 18 nt, Human
uuguuuugccaacauugc

SEQ ID NO: 3698261 - RNA, 14 nt, Human
uuguuuugcuuccc

SEQ ID NO: 3698262 - RNA, 22 nt, Human
uuguuuuggcugaaauucuccu

SEQ ID NO: 3698263 - RNA, 18 nt, Human
uuguuuugggggucaggc

SEQ ID NO: 3698264 - RNA, 16 nt, Human
uuguuuugugcagaga

SEQ ID NO: 3698265 - RNA, 19 nt, Human
uuguuuugugucucuuaug

SEQ ID NO: 3698266 - RNA, 14 nt, Human
uuguuuuguugcac

SEQ ID NO: 3698267 - RNA, 14 nt, Human
uuguuuuguuuuaa

SEQ ID NO: 3698268 - RNA, 16 nt, Human
uuguuuuuauuaaaag

SEQ ID NO: 3698269 - RNA, 13 nt, Human
uuguuuuucugau

SEQ ID NO: 3698270 - RNA, 18 nt, Human
uuguuuuucugcuuuaga

SEQ ID NO: 3698271 - RNA, 21 nt, Human
uuguuuuuuaaagucuugcug

SEQ ID NO: 3698272 - RNA, 14 nt, Human
uuguuuuuuaguuc

SEQ ID NO: 3698273 - RNA, 14 nt, Human
uuguuuuuuaucuu

SEQ ID NO: 3698274 - RNA, 13 nt, Human
uuguuuuuugagu

SEQ ID NO: 3698275 - RNA, 22 nt, Human
uuuaaaaaaaaaaguuacagaa

SEQ ID NO: 3698276 - RNA, 14 nt, Human
uuuaaaaaaaaagu

SEQ ID NO: 3698277 - RNA, 15 nt, Human
uuuaaaaaaauaaaa

SEQ ID NO: 3698278 - RNA, 18 nt, Human
uuuaaaaaaauaaaacau

SEQ ID NO: 3698279 - RNA, 22 nt, Human
uuuaaaaaaauacaguauucug

SEQ ID NO: 3698280 - RNA, 15 nt, Human
uuuaaaaaacuaaaa

SEQ ID NO: 3698281 - RNA, 20 nt, Human
uuuaaaaaagaaacauuugg

SEQ ID NO: 3698282 - RNA, 19 nt, Human
uuuaaaaaagcaacagaaa

SEQ ID NO: 3698283 - RNA, 13 nt, Human
uuuaaaaaagcuu

SEQ ID NO: 3698284 - RNA, 16 nt, Human
uuuaaaaaaguuuaaa

SEQ ID NO: 3698285 - RNA, 22 nt, Human
uuuaaaaaauaaauaaaaacua

SEQ ID NO: 3698286 - RNA, 20 nt, Human
uuuaaaaaauaacuaccaag

SEQ ID NO: 3698287 - RNA, 18 nt, Human
uuuaaaaaauauuuauua

SEQ ID NO: 3698288 - RNA, 22 nt, Human
uuuaaaaaauauuuauuaaaua

SEQ ID NO: 3698289 - RNA, 20 nt, Human
uuuaaaaaaugaaauccuuu

SEQ ID NO: 3698290 - RNA, 22 nt, Human
uuuaaaaaauggacucuugaaa

SEQ ID NO: 3698291 - RNA, 17 nt, Human
uuuaaaaaauuaaucug

SEQ ID NO: 3698292 - RNA, 19 nt, Human
uuuaaaaacauagaaaaau

SEQ ID NO: 3698293 - RNA, 15 nt, Human
uuuaaaaaccuugua

SEQ ID NO: 3698294 - RNA, 12 nt, Human
uuuaaaaaguaa

SEQ ID NO: 3698295 - RNA, 16 nt, Human
uuuaaaaaguauugcc

SEQ ID NO: 3698296 - RNA, 13 nt, Human
uuuaaaaaucaac

SEQ ID NO: 3698297 - RNA, 15 nt, Human
uuuaaaaaucaacuu

SEQ ID NO: 3698298 - RNA, 22 nt, Human
uuuaaaaaucuaccuucuguag

SEQ ID NO: 3698299 - RNA, 18 nt, Human
uuuaaaaaucuuaaugua

SEQ ID NO: 3698300 - RNA, 19 nt, Human
uuuaaaaaugguaucaaaa

SEQ ID NO: 3698301 - RNA, 12 nt, Human
uuuaaaaauguc

SEQ ID NO: 3698302 - RNA, 12 nt, Human
uuuaaaaauugu

SEQ ID NO: 3698303 - RNA, 12 nt, Human
uuuaaaaauuua

SEQ ID NO: 3698304 - RNA, 14 nt, Human
uuuaaaaauuuacu

SEQ ID NO: 3698305 - RNA, 23 nt, Human
uuuaaaacacauguuuuuauaca

SEQ ID NO: 3698306 - RNA, 15 nt, Human
uuuaaaacaguauuu

SEQ ID NO: 3698307 - RNA, 14 nt, Human
uuuaaaacauguaa

SEQ ID NO: 3698308 - RNA, 14 nt, Human
uuuaaaacccauuu

SEQ ID NO: 3698309 - RNA, 16 nt, Human
uuuaaaacuggaccug

SEQ ID NO: 3698310 - RNA, 13 nt, Human
uuuaaaagaauga

SEQ ID NO: 3698311 - RNA, 17 nt, Human
uuuaaaagaaugggcag

SEQ ID NO: 3698312 - RNA, 16 nt, Human
uuuaaaagacaagacu

SEQ ID NO: 3698313 - RNA, 19 nt, Human
uuuaaaagacaagacuuca

SEQ ID NO: 3698314 - RNA, 19 nt, Human
uuuaaaagacacacuuguc

SEQ ID NO: 3698315 - RNA, 14 nt, Human
uuuaaaagacacug

SEQ ID NO: 3698316 - RNA, 14 nt, Human
uuuaaaagauucau

SEQ ID NO: 3698317 - RNA, 19 nt, Human
uuuaaaagcacgacagugg

SEQ ID NO: 3698318 - RNA, 19 nt, Human
uuuaaaagcccuuuccaaa

SEQ ID NO: 3698319 - RNA, 19 nt, Human
uuuaaaagguauuuugaau

SEQ ID NO: 3698320 - RNA, 22 nt, Human
uuuaaaagguauuuugaauacc

SEQ ID NO: 3698321 - RNA, 23 nt, Human
uuuaaaaguaaaaugucuuucca

SEQ ID NO: 3698322 - RNA, 15 nt, Human
uuuaaaaguuauuaa

SEQ ID NO: 3698323 - RNA, 17 nt, Human
uuuaaaaguuucaaugu

SEQ ID NO: 3698324 - RNA, 20 nt, Human
uuuaaaaguuucaaugugau

SEQ ID NO: 3698325 - RNA, 16 nt, Human
uuuaaaauaaaaugaa

SEQ ID NO: 3698326 - RNA, 22 nt, Human
uuuaaaauaaaaugaaaauugu

SEQ ID NO: 3698327 - RNA, 13 nt, Human
uuuaaaauagaaa

SEQ ID NO: 3698328 - RNA, 23 nt, Human
uuuaaaauagcguucuuguaauu

SEQ ID NO: 3698329 - RNA, 15 nt, Human
uuuaaaaucaacuua

SEQ ID NO: 3698330 - RNA, 18 nt, Human
uuuaaaaucacuaacauu

SEQ ID NO: 3698331 - RNA, 19 nt, Human
uuccuguccucuuucagcu

SEQ ID NO: 3698332 - RNA, 20 nt, Human
uuccugucuagucucuccug

SEQ ID NO: 3698333 - RNA, 22 nt, Human
uuccuguguguccaaaacugcc

SEQ ID NO: 3698334 - RNA, 17 nt, Human
uuccuguucagcauucu

SEQ ID NO: 3698335 - RNA, 14 nt, Human
uuccuguucaguaa

SEQ ID NO: 3698336 - RNA, 17 nt, Human
uuccuguugucaagaau

SEQ ID NO: 3698337 - RNA, 13 nt, Human
uuccuguuucaag

SEQ ID NO: 3698338 - RNA, 15 nt, Human
uuccuuaaacugugu

SEQ ID NO: 3698339 - RNA, 19 nt, Human
uuccuuaaguauaucaugu

SEQ ID NO: 3698340 - RNA, 20 nt, Human
uuccuuaaguauaucaugua

SEQ ID NO: 3698341 - RNA, 20 nt, Human
uuccuuaagucagaacagca

SEQ ID NO: 3698342 - RNA, 16 nt, Human
uuccuuacugcagaau

SEQ ID NO: 3698343 - RNA, 22 nt, Human
uuccuuagacucuuuuccuucc

SEQ ID NO: 3698344 - RNA, 23 nt, Human
uuccuuagcuuagaccucagccu

SEQ ID NO: 3698345 - RNA, 23 nt, Human
uuccuuauguauauuuaaaagaa

SEQ ID NO: 3698346 - RNA, 14 nt, Human
uuccuucaagaaug

SEQ ID NO: 3698347 - RNA, 21 nt, Human
uuccuucaagaaugcaguacu

SEQ ID NO: 3698348 - RNA, 22 nt, Human
uuccuucagagagcagugcuuu

SEQ ID NO: 3698349 - RNA, 12 nt, Human
uuccuucagauu

SEQ ID NO: 3698350 - RNA, 15 nt, Human
uuccuucagcacuuu

SEQ ID NO: 3698351 - RNA, 22 nt, Human
uuccuucagggugaugccaggu

SEQ ID NO: 3698352 - RNA, 22 nt, Human
uuccuucagugcaucugggaag

SEQ ID NO: 3698353 - RNA, 19 nt, Human
uuccuucauucaacccacc

SEQ ID NO: 3698354 - RNA, 17 nt, Human
uuccuucauuuccuccg

SEQ ID NO: 3698355 - RNA, 12 nt, Human
uuccuucccacc

SEQ ID NO: 3698356 - RNA, 19 nt, Human
uuccuucccugcugugaaa

SEQ ID NO: 3698357 - RNA, 21 nt, Human
uuccuucccugcugugaaaga

SEQ ID NO: 3698358 - RNA, 12 nt, Human
uuccuucccugg

SEQ ID NO: 3698359 - RNA, 16 nt, Human
uuccuucccugggcug

SEQ ID NO: 3698360 - RNA, 14 nt, Human
uuccuuccuucccu

SEQ ID NO: 3698361 - RNA, 16 nt, Human
uuccuucucaucugug

SEQ ID NO: 3698362 - RNA, 13 nt, Human
uuccuucucccau

SEQ ID NO: 3698363 - RNA, 15 nt, Human
uuccuucucccaucu

SEQ ID NO: 3698364 - RNA, 17 nt, Human
uuccuucugccugagcu

SEQ ID NO: 3698365 - RNA, 20 nt, Human
uuccuucugugaaaguacau

SEQ ID NO: 3698366 - RNA, 12 nt, Human
uuccuucuuuga

SEQ ID NO: 3698367 - RNA, 13 nt, Human
uuccuugaccagc

SEQ ID NO: 3698368 - RNA, 15 nt, Human
uuccuugaccuuccu

SEQ ID NO: 3698369 - RNA, 20 nt, Human
uuccuugaguugauucagcu

SEQ ID NO: 3698370 - RNA, 21 nt, Human
uuccuugaguugauucagcuc

SEQ ID NO: 3698371 - RNA, 14 nt, Human
uuccuugaucauuu

SEQ ID NO: 3698372 - RNA, 17 nt, Human
uuccuugcauacaaaca

SEQ ID NO: 3698373 - RNA, 11 nt, Human
uuccuugcucu

SEQ ID NO: 3698374 - RNA, 18 nt, Human
uuccuugcuguccuaggc

SEQ ID NO: 3698375 - RNA, 17 nt, Human
uuccuuggacucauuuu

SEQ ID NO: 3698376 - RNA, 20 nt, Human
uuccuuggacucauuuuaaa

SEQ ID NO: 3698377 - RNA, 13 nt, Human
uuccuuggcuggu

SEQ ID NO: 3698378 - RNA, 15 nt, Human
uuccuuggcuggugc

SEQ ID NO: 3698379 - RNA, 14 nt, Human
uuccuuggggcagg

SEQ ID NO: 3698380 - RNA, 19 nt, Human
uuccuuguagccuuuugac

SEQ ID NO: 3698381 - RNA, 20 nt, Human
uuccuuguagcgacuaaacu

SEQ ID NO: 3698382 - RNA, 13 nt, Human
uuccuugucccca

SEQ ID NO: 3698383 - RNA, 16 nt, Human
uuccuuguccccacac

SEQ ID NO: 3698384 - RNA, 20 nt, Human
uuccuuguccccacacuccu

SEQ ID NO: 3698385 - RNA, 14 nt, Human
uuccuuguuuauca

SEQ ID NO: 3698386 - RNA, 21 nt, Human
uuccuuguuuaucagauacau

SEQ ID NO: 3698387 - RNA, 16 nt, Human
uuccuuuaaaaaaauu

SEQ ID NO: 3698388 - RNA, 15 nt, Human
uuccuuuaaaaaacu

SEQ ID NO: 3698389 - RNA, 16 nt, Human
uuccuuuacuuucccu

SEQ ID NO: 3698390 - RNA, 17 nt, Human
uuccuuuacuuucccuu

SEQ ID NO: 3698391 - RNA, 14 nt, Human
uuccuuuauauuua

SEQ ID NO: 3698392 - RNA, 15 nt, Human
uuccuuuaugugaau

SEQ ID NO: 3698393 - RNA, 16 nt, Human
uuccuuuauguucuca

SEQ ID NO: 3698394 - RNA, 20 nt, Human
uuccuuucauuuacuguggc

SEQ ID NO: 3698395 - RNA, 23 nt, Human
uuccuuuccaacguuuggaagau

SEQ ID NO: 3698396 - RNA, 18 nt, Human
uuccuuuccagguauuuu

SEQ ID NO: 3698397 - RNA, 15 nt, Human
uuccuuuccccagcc

SEQ ID NO: 3698398 - RNA, 12 nt, Human
uuccuuucccuu

SEQ ID NO: 3698399 - RNA, 14 nt, Human
uuccuuucccuucc

SEQ ID NO: 3698400 - RNA, 18 nt, Human
uuccuuucccuuccucuu

SEQ ID NO: 3698401 - RNA, 14 nt, Human
uuccuuucucaccg

SEQ ID NO: 3698402 - RNA, 19 nt, Human
uuccuuucuccaggaccaa

SEQ ID NO: 3698403 - RNA, 17 nt, Human
uuccuuucucuuucucu

SEQ ID NO: 3698404 - RNA, 12 nt, Human
uuccuuucuuga

SEQ ID NO: 3698405 - RNA, 17 nt, Human
uuccuuucuuuuccccc

SEQ ID NO: 3698406 - RNA, 13 nt, Human
uuccuuugaagau

SEQ ID NO: 3698407 - RNA, 14 nt, Human
uuccuuugaagaua

SEQ ID NO: 3698408 - RNA, 19 nt, Human
uuccuuugcauauuauaaa

SEQ ID NO: 3698409 - RNA, 15 nt, Human
uuccuuugcucuuuc

SEQ ID NO: 3698410 - RNA, 16 nt, Human
uuccuuuggaagaaaa

SEQ ID NO: 3698411 - RNA, 17 nt, Human
uuccuuuggaagaaaaa

SEQ ID NO: 3698412 - RNA, 18 nt, Human
uuccuuuguguuucuauu

SEQ ID NO: 3698413 - RNA, 21 nt, Human
uuccuuuuaaaacacuuccau

SEQ ID NO: 3698414 - RNA, 21 nt, Human
uuccuuuuaaguaagguccaa

SEQ ID NO: 3698415 - RNA, 12 nt, Human
uuccuuuuacuu

SEQ ID NO: 3698416 - RNA, 20 nt, Human
uuccuuuuauuucuucacca

SEQ ID NO: 3698417 - RNA, 13 nt, Human
uuccuuuucccag

SEQ ID NO: 3698418 - RNA, 23 nt, Human
uuccuuuucccaggaaagaagca

SEQ ID NO: 3698419 - RNA, 13 nt, Human
uuccuuuucuuua

SEQ ID NO: 3698420 - RNA, 15 nt, Human
uuccuuuuguguaca

SEQ ID NO: 3698421 - RNA, 17 nt, Human
uuccuuuuguguacagu

SEQ ID NO: 3698422 - RNA, 20 nt, Human
uuccuuuuuauuuauaugua

SEQ ID NO: 3698423 - RNA, 18 nt, Human
uuccuuuuugacacugaa

SEQ ID NO: 3698424 - RNA, 13 nt, Human
uuccuuuuuuccc

SEQ ID NO: 3698425 - RNA, 22 nt, Human
uuccuuuuuucccauaagacaa

SEQ ID NO: 3698426 - RNA, 14 nt, Human
uuccuuuuuuugua

SEQ ID NO: 3698427 - RNA, 14 nt, Human
uucgaagcucagcc

SEQ ID NO: 3698428 - RNA, 22 nt, Human
uucgaagcucagcccacccccc

SEQ ID NO: 3698429 - RNA, 15 nt, Human
uucgaagucauuaaa

SEQ ID NO: 3698430 - RNA, 14 nt, Human
uucgaccagccagg

SEQ ID NO: 3698431 - RNA, 17 nt, Human
uucgaccugauuuacag

SEQ ID NO: 3698432 - RNA, 15 nt, Human
uucgagaagcugcuc

SEQ ID NO: 3698433 - RNA, 21 nt, Human
uucgagaagcugcucuggaau

SEQ ID NO: 3698434 - RNA, 14 nt, Human
uucgagaccagccu

SEQ ID NO: 3698435 - RNA, 21 nt, Human
uucgaugggcccaauucuuac

SEQ ID NO: 3698436 - RNA, 11 nt, Human
uucgcagccac

SEQ ID NO: 3698437 - RNA, 16 nt, Human
uucgcagccacccuga

SEQ ID NO: 3698438 - RNA, 19 nt, Human
uucgcagccacccugagga

SEQ ID NO: 3698439 - RNA, 24 nt, Human
uucgcagccacccugaggagucug

SEQ ID NO: 3698440 - RNA, 17 nt, Human
uucgcagcugaagugga

SEQ ID NO: 3698441 - RNA, 21 nt, Human
uucgcaggauucuuccucccu

SEQ ID NO: 3698442 - RNA, 19 nt, Human
uucgcaucaaaagacaauu

SEQ ID NO: 3698443 - RNA, 17 nt, Human
uucgcauggucacacac

SEQ ID NO: 3698444 - RNA, 19 nt, Human
uucgcauggucacacacug

SEQ ID NO: 3698445 - RNA, 23 nt, Human
uucgcauggucacacacugaugc

SEQ ID NO: 3698446 - RNA, 20 nt, Human
uucgcccgagcuguuuaugu

SEQ ID NO: 3698447 - RNA, 20 nt, Human
uucgccguggcugcggcacc

SEQ ID NO: 3698448 - RNA, 14 nt, Human
uucgccuggagccc

SEQ ID NO: 3698449 - RNA, 19 nt, Human
uucgcuccugugucuugca

SEQ ID NO: 3698450 - RNA, 16 nt, Human
uucgcuugagaaaaaa

SEQ ID NO: 3698451 - RNA, 12 nt, Human
uucggaaaccuu

SEQ ID NO: 3698452 - RNA, 19 nt, Human
uucggaggccccacugaug

SEQ ID NO: 3698453 - RNA, 17 nt, Human
uucggauuuggggugga

SEQ ID NO: 3698454 - RNA, 20 nt, Human
uucggcagauacugucucuu

SEQ ID NO: 3698455 - RNA, 22 nt, Human
uucggccuccauccugaggcuc

SEQ ID NO: 3698456 - RNA, 18 nt, Human
uucggcucugggugggca

SEQ ID NO: 3698457 - RNA, 14 nt, Human
uucgggaagagagg

SEQ ID NO: 3698458 - RNA, 23 nt, Human
uucgggaagagaggaguucaaug

SEQ ID NO: 3698459 - RNA, 14 nt, Human
uucgggcugugccc

SEQ ID NO: 3698460 - RNA, 13 nt, Human
uucggggcuggga

SEQ ID NO: 3698461 - RNA, 17 nt, Human
uucgggugugcaauguc

SEQ ID NO: 3698462 - RNA, 20 nt, Human
uucgguuucuaacuuggagc

SEQ ID NO: 3698463 - RNA, 13 nt, Human
uucguaacacagc

SEQ ID NO: 3698464 - RNA, 20 nt, Human
uucguacaguucuucgggaa

SEQ ID NO: 3698465 - RNA, 17 nt, Human
uucgugaacauccccuc

SEQ ID NO: 3698466 - RNA, 17 nt, Human
uucgugaaguauacugu

SEQ ID NO: 3698467 - RNA, 18 nt, Human
uucgugaaguauacugua

SEQ ID NO: 3698468 - RNA, 18 nt, Human
uucgugacaauguuuaca

SEQ ID NO: 3698469 - RNA, 19 nt, Human
uucgugacaauguuuacaa

SEQ ID NO: 3698470 - RNA, 15 nt, Human
uucgugagccccauc

SEQ ID NO: 3698471 - RNA, 13 nt, Human
uucguggggaggu

SEQ ID NO: 3698472 - RNA, 17 nt, Human
uucguggugaucaauua

SEQ ID NO: 3698473 - RNA, 22 nt, Human
uucguggugaucaauuaaaugu

SEQ ID NO: 3698474 - RNA, 19 nt, Human
uucguuaacuguguaugua

SEQ ID NO: 3698475 - RNA, 12 nt, Human
uucguucugugg

SEQ ID NO: 3698476 - RNA, 13 nt, Human
uucguucuguuua

SEQ ID NO: 3698477 - RNA, 17 nt, Human
uucguucuuguuaguac

SEQ ID NO: 3698478 - RNA, 16 nt, Human
uucguuuaaugaaugc

SEQ ID NO: 3698479 - RNA, 15 nt, Human
uucguuuauuuucaa

SEQ ID NO: 3698480 - RNA, 14 nt, Human
uucguuucuguaua

SEQ ID NO: 3698481 - RNA, 11 nt, Human
uucguuuguuu

SEQ ID NO: 3698482 - RNA, 18 nt, Human
uuuaaaaucagcuauuuu

SEQ ID NO: 3698483 - RNA, 21 nt, Human
uuuaaaaucugagggaaaugu

SEQ ID NO: 3698484 - RNA, 16 nt, Human
uuuaaaaugagaaauc

SEQ ID NO: 3698485 - RNA, 12 nt, Human
uuuaaaaugauu

SEQ ID NO: 3698486 - RNA, 18 nt, Human
uuuaaaauguaauuuaaa

SEQ ID NO: 3698487 - RNA, 16 nt, Human
uuuaaaauuacaacua

SEQ ID NO: 3698488 - RNA, 19 nt, Human
uuuaaaauucucuuccaac

SEQ ID NO: 3698489 - RNA, 16 nt, Human
uuuaaaauugugaugu

SEQ ID NO: 3698490 - RNA, 10 nt, Human
uuuaaaauuu

SEQ ID NO: 3698491 - RNA, 13 nt, Human
uuuaaaauuucau

SEQ ID NO: 3698492 - RNA, 13 nt, Human
uuuaaaauuucuu

SEQ ID NO: 3698493 - RNA, 17 nt, Human
uuuaaaauuuuaucucu

SEQ ID NO: 3698494 - RNA, 13 nt, Human
uuuaaacaaaaua

SEQ ID NO: 3698495 - RNA, 16 nt, Human
uuuaaacaaaauagaa

SEQ ID NO: 3698496 - RNA, 20 nt, Human
uuuaaacaaaauagaagcug

SEQ ID NO: 3698497 - RNA, 18 nt, Human
uuuaaacaaacauugugu

SEQ ID NO: 3698498 - RNA, 23 nt, Human
uuuaaacaaacauuguguugaca

SEQ ID NO: 3698499 - RNA, 15 nt, Human
uuuaaacacauuaaa

SEQ ID NO: 3698500 - RNA, 14 nt, Human
uuuaaacaccuccu

SEQ ID NO: 3698501 - RNA, 16 nt, Human
uuuaaacaggcccagc

SEQ ID NO: 3698502 - RNA, 13 nt, Human
uuuaaacauaucc

SEQ ID NO: 3698503 - RNA, 13 nt, Human
uuuaaacauuaaa

SEQ ID NO: 3698504 - RNA, 19 nt, Human
uuuaaaccaauugcugcua

SEQ ID NO: 3698505 - RNA, 20 nt, Human
uuuaaaccgcuaaaagaaac

SEQ ID NO: 3698506 - RNA, 22 nt, Human
uuuaaaccgcuaaaagaaacuu

SEQ ID NO: 3698507 - RNA, 22 nt, Human
uuuaaaccucaccuuugugggg

SEQ ID NO: 3698508 - RNA, 21 nt, Human
uuuaaacucugaauuuaucuu

SEQ ID NO: 3698509 - RNA, 22 nt, Human
uuuaaacugaaugaacaaccuc

SEQ ID NO: 3698510 - RNA, 18 nt, Human
uuuaaacuucuuaacugg

SEQ ID NO: 3698511 - RNA, 17 nt, Human
uuuaaagaaaaaaaugu

SEQ ID NO: 3698512 - RNA, 18 nt, Human
uuuaaagaaaagaugaaa

SEQ ID NO: 3698513 - RNA, 13 nt, Human
uuuaaagaaaagu

SEQ ID NO: 3698514 - RNA, 18 nt, Human
uuuaaagaaacaugguuu

SEQ ID NO: 3698515 - RNA, 16 nt, Human
uuuaaagaaaguguau

SEQ ID NO: 3698516 - RNA, 17 nt, Human
uuuaaagaagaaaaaaa

SEQ ID NO: 3698517 - RNA, 18 nt, Human
uuuaaagaaucauuauuu

SEQ ID NO: 3698518 - RNA, 15 nt, Human
uuuaaagaauuucuu

SEQ ID NO: 3698519 - RNA, 17 nt, Human
uuuaaagacccuccuau

SEQ ID NO: 3698520 - RNA, 17 nt, Human
uuuaaagagaauguaga

SEQ ID NO: 3698521 - RNA, 15 nt, Human
uuuaaagagagguua

SEQ ID NO: 3698522 - RNA, 17 nt, Human
uuuaaagagucuagauu

SEQ ID NO: 3698523 - RNA, 18 nt, Human
uuuaaagagucuagauuc

SEQ ID NO: 3698524 - RNA, 23 nt, Human
uuuaaagagucuagauucaaagg

SEQ ID NO: 3698525 - RNA, 17 nt, Human
uuuaaagauguagacag

SEQ ID NO: 3698526 - RNA, 12 nt, Human
uuuaaagauuuu

SEQ ID NO: 3698527 - RNA, 17 nt, Human
uuuaaagcaacugucua

SEQ ID NO: 3698528 - RNA, 15 nt, Human
uuuaaagcagguucu

SEQ ID NO: 3698529 - RNA, 16 nt, Human
uuuaaagcauugcuuu

SEQ ID NO: 3698530 - RNA, 18 nt, Human
uuuaaagccauucugauu

SEQ ID NO: 3698531 - RNA, 16 nt, Human
uuuaaagcuuccauug

SEQ ID NO: 3698532 - RNA, 17 nt, Human
uuuaaaggaaaaaaugu

SEQ ID NO: 3698533 - RNA, 21 nt, Human
uuuaaaggaaaaaauguugga

SEQ ID NO: 3698534 - RNA, 18 nt, Human
uuuaaaggcauuagaguc

SEQ ID NO: 3698535 - RNA, 17 nt, Human
uuuaaaggcccuaucug

SEQ ID NO: 3698536 - RNA, 22 nt, Human
uuuaaaggggcagaaaaacucu

SEQ ID NO: 3698537 - RNA, 16 nt, Human
uuuaaaguagauuaga

SEQ ID NO: 3698538 - RNA, 15 nt, Human
uuuaaagucuugcug

SEQ ID NO: 3698539 - RNA, 17 nt, Human
uuuaaaguguauuauaa

SEQ ID NO: 3698540 - RNA, 23 nt, Human
uuuaaauaaaagaaaaaauaucu

SEQ ID NO: 3698541 - RNA, 21 nt, Human
uuuaaauaaacuuuuuuucaa

SEQ ID NO: 3698542 - RNA, 22 nt, Human
uuuaaauaaacuuuuuuucaau

SEQ ID NO: 3698543 - RNA, 21 nt, Human
uuuaaauaaauaaauagcuag

SEQ ID NO: 3698544 - RNA, 20 nt, Human
uuuaaauacgcacuacaugu

SEQ ID NO: 3698545 - RNA, 12 nt, Human
uuuaaauauaau

SEQ ID NO: 3698546 - RNA, 18 nt, Human
uuuaaauauaauucugua

SEQ ID NO: 3698547 - RNA, 23 nt, Human
uuuaaauaucugaacauuuacua

SEQ ID NO: 3698548 - RNA, 19 nt, Human
uuuaaauauuuucuauuuu

SEQ ID NO: 3698549 - RNA, 20 nt, Human
uuuaaauccuguugaaaagc

SEQ ID NO: 3698550 - RNA, 22 nt, Human
uuuaaaucuaaaucuauuuauu

SEQ ID NO: 3698551 - RNA, 14 nt, Human
uuuaaaugaagaaa

SEQ ID NO: 3698552 - RNA, 11 nt, Human
uuuaaaugcac

SEQ ID NO: 3698553 - RNA, 11 nt, Human
uuuaaauguac

SEQ ID NO: 3698554 - RNA, 20 nt, Human
uuuaaauguacaguuugggg

SEQ ID NO: 3698555 - RNA, 18 nt, Human
uuuaaauguuuuucuaug

SEQ ID NO: 3698556 - RNA, 16 nt, Human
uuuaaauuaauaucuu

SEQ ID NO: 3698557 - RNA, 22 nt, Human
uuuaaauuagaaaauauucucu

SEQ ID NO: 3698558 - RNA, 20 nt, Human
uuuaaauuauaacuuaaaau

SEQ ID NO: 3698559 - RNA, 19 nt, Human
uuuaaauuauaaggacugc

SEQ ID NO: 3698560 - RNA, 21 nt, Human
uuuaaauucacaauagaaacu

SEQ ID NO: 3698561 - RNA, 12 nt, Human
uuuaaauucuga

SEQ ID NO: 3698562 - RNA, 17 nt, Human
uuuaaauucugagacau

SEQ ID NO: 3698563 - RNA, 21 nt, Human
uuuaaauucuuuuuuaaauuu

SEQ ID NO: 3698564 - RNA, 23 nt, Human
uuuaaauugcucacaguuauuac

SEQ ID NO: 3698565 - RNA, 11 nt, Human
uuuaaauugug

SEQ ID NO: 3698566 - RNA, 14 nt, Human
uuuaaauuuaagua

SEQ ID NO: 3698567 - RNA, 15 nt, Human
uuuaacaaaaaccaa

SEQ ID NO: 3698568 - RNA, 19 nt, Human
uuuaacaaaaagugcuuca

SEQ ID NO: 3698569 - RNA, 20 nt, Human
uuuaacaacauguuuccagc

SEQ ID NO: 3698570 - RNA, 18 nt, Human
uuuaacaauaacuacugu

SEQ ID NO: 3698571 - RNA, 23 nt, Human
uuuaacaauaacuacuguguucc

SEQ ID NO: 3698572 - RNA, 23 nt, Human
uuuaacaauuuccuuuauauuua

SEQ ID NO: 3698573 - RNA, 12 nt, Human
uuuaacagaaau

SEQ ID NO: 3698574 - RNA, 21 nt, Human
uuuaacagaaauuguauauug

SEQ ID NO: 3698575 - RNA, 15 nt, Human
uuuaacagucauuua

SEQ ID NO: 3698576 - RNA, 14 nt, Human
uuuaacauaaaggu

SEQ ID NO: 3698577 - RNA, 13 nt, Human
uuuaacauaagcu

SEQ ID NO: 3698578 - RNA, 11 nt, Human
uuuaacaugcc

SEQ ID NO: 3698579 - RNA, 22 nt, Human
uuuaacauuugccuugcagaac

SEQ ID NO: 3698580 - RNA, 11 nt, Human
uuuaacauuuu

SEQ ID NO: 3698581 - RNA, 22 nt, Human
uuuaacauuuuguucuuacaca

SEQ ID NO: 3698582 - RNA, 14 nt, Human
uuuaaccaaaacau

SEQ ID NO: 3698583 - RNA, 13 nt, Human
uuuaaccaaaggu

SEQ ID NO: 3698584 - RNA, 14 nt, Human
uuuaaccucuaaau

SEQ ID NO: 3698585 - RNA, 16 nt, Human
uuuaaccuuugauaga

SEQ ID NO: 3698586 - RNA, 22 nt, Human
uuuaacgaaugaagaugucuaa

SEQ ID NO: 3698587 - RNA, 17 nt, Human
uuuaacuaaauuuuaaa

SEQ ID NO: 3698588 - RNA, 14 nt, Human
uuuaacuacccuua

SEQ ID NO: 3698589 - RNA, 12 nt, Human
uuuaacucagau

SEQ ID NO: 3698590 - RNA, 18 nt, Human
uuuaacucagaucacuac

SEQ ID NO: 3698591 - RNA, 22 nt, Human
uuuaacucauaccuuuaaagga

SEQ ID NO: 3698592 - RNA, 17 nt, Human
uuuaacucuacugugua

SEQ ID NO: 3698593 - RNA, 18 nt, Human
uuuaacucuacuguguaa

SEQ ID NO: 3698594 - RNA, 18 nt, Human
uuuaacucuagaauuugg

SEQ ID NO: 3698595 - RNA, 19 nt, Human
uuuaacucuauaauguguu

SEQ ID NO: 3698596 - RNA, 13 nt, Human
uuuaacucugucu

SEQ ID NO: 3698597 - RNA, 17 nt, Human
uuuaacucugucuucac

SEQ ID NO: 3698598 - RNA, 19 nt, Human
uuuaacugaagauguugag

SEQ ID NO: 3698599 - RNA, 23 nt, Human
uuuaacuggugcacuuuguaaau

SEQ ID NO: 3698600 - RNA, 17 nt, Human
uuuaacuguggauauug

SEQ ID NO: 3698601 - RNA, 14 nt, Human
uuuaacuuaaauag

SEQ ID NO: 3698602 - RNA, 16 nt, Human
uuuaacuuaacugaaa

SEQ ID NO: 3698603 - RNA, 13 nt, Human
uuuaacuucugcc

SEQ ID NO: 3698604 - RNA, 18 nt, Human
uuuaagaaaaaauaacac

SEQ ID NO: 3698605 - RNA, 18 nt, Human
uuuaagaaaaaggaugca

SEQ ID NO: 3698606 - RNA, 12 nt, Human
uuuaagaaaagu

SEQ ID NO: 3698607 - RNA, 16 nt, Human
uuuaagaaaaguauuu

SEQ ID NO: 3698608 - RNA, 23 nt, Human
uuuaagaaaaguauuuugaaguu

SEQ ID NO: 3698609 - RNA, 12 nt, Human
uuuaagaaagaa

SEQ ID NO: 3698610 - RNA, 15 nt, Human
uuuaagaauaucugu

SEQ ID NO: 3698611 - RNA, 22 nt, Human
uuuaagacagucccaucaaaac

SEQ ID NO: 3698612 - RNA, 18 nt, Human
uuuaagacagucuuuggg

SEQ ID NO: 3698613 - RNA, 17 nt, Human
uuuaagacguguuugug

SEQ ID NO: 3698614 - RNA, 23 nt, Human
uuuaagacucucgcaucuuccca

SEQ ID NO: 3698615 - RNA, 12 nt, Human
uuuaagagaaau

SEQ ID NO: 3698616 - RNA, 15 nt, Human
uuuaagauaaauuau

SEQ ID NO: 3698617 - RNA, 15 nt, Human
uuuaagauaauaguu

SEQ ID NO: 3698618 - RNA, 12 nt, Human
uuuaagauguga

SEQ ID NO: 3698619 - RNA, 17 nt, Human
uuuaagauuccuuuucu

SEQ ID NO: 3698620 - RNA, 14 nt, Human
uuuaagauuuuucu

SEQ ID NO: 3698621 - RNA, 16 nt, Human
uuuaagauuuuucuca

SEQ ID NO: 3698622 - RNA, 16 nt, Human
uuuaagcaaauacuua

SEQ ID NO: 3698623 - RNA, 20 nt, Human
uuuaagcacucuuaaagcaa

SEQ ID NO: 3698624 - RNA, 14 nt, Human
uuuaagcagaauug

SEQ ID NO: 3698625 - RNA, 15 nt, Human
uuuaagcagaauugg

SEQ ID NO: 3698626 - RNA, 20 nt, Human
uuuaagcagcucuugcuaau

SEQ ID NO: 3698627 - RNA, 23 nt, Human
uuuaagcauuacucuuguaagau

SEQ ID NO: 3698628 - RNA, 12 nt, Human
uuuaagccaaaa

SEQ ID NO: 3698629 - RNA, 18 nt, Human
uuuaagccuucaaaacua

SEQ ID NO: 3698630 - RNA, 22 nt, Human
uuuaagcuaggaaaagaaaucu

SEQ ID NO: 3698631 - RNA, 23 nt, Human
uuuaagcuaggaaaagaaaucua

SEQ ID NO: 3698632 - RNA, 18 nt, Human
uauauuuuuuuaauuuaa

SEQ ID NO: 3698633 - RNA, 20 nt, Human
uauauuuuuuucugaaauuu

SEQ ID NO: 3698634 - RNA, 19 nt, Human
uaucaaaaagauaucaaag

SEQ ID NO: 3698635 - RNA, 14 nt, Human
uaucaaaauagucu

SEQ ID NO: 3698636 - RNA, 15 nt, Human
uaucaaacagcucag

SEQ ID NO: 3698637 - RNA, 17 nt, Human
uaucaaacccuagccuu

SEQ ID NO: 3698638 - RNA, 20 nt, Human
uaucaaacccuagccuugcu

SEQ ID NO: 3698639 - RNA, 13 nt, Human
uaucaaacugaag

SEQ ID NO: 3698640 - RNA, 19 nt, Human
uaucaaagggugaaaauua

SEQ ID NO: 3698641 - RNA, 12 nt, Human
uaucaaagucau

SEQ ID NO: 3698642 - RNA, 20 nt, Human
uaucaaauauuagaugugau

SEQ ID NO: 3698643 - RNA, 14 nt, Human
uaucaaauuaauug

SEQ ID NO: 3698644 - RNA, 16 nt, Human
uaucaaauuaauugug

SEQ ID NO: 3698645 - RNA, 17 nt, Human
uaucaaauuaauugugu

SEQ ID NO: 3698646 - RNA, 18 nt, Human
uaucaaccccagacacug

SEQ ID NO: 3698647 - RNA, 19 nt, Human
uaucaaccccagacacugg

SEQ ID NO: 3698648 - RNA, 21 nt, Human
uaucaaccccagacacugguu

SEQ ID NO: 3698649 - RNA, 16 nt, Human
uaucaagacauagcau

SEQ ID NO: 3698650 - RNA, 23 nt, Human
uaucaagccaguacgugcuaaca

SEQ ID NO: 3698651 - RNA, 12 nt, Human
uaucaagcuaau

SEQ ID NO: 3698652 - RNA, 23 nt, Human
uaucaagcuaauaaaauaucauu

SEQ ID NO: 3698653 - RNA, 22 nt, Human
uaucaaggacucugguuucuca

SEQ ID NO: 3698654 - RNA, 16 nt, Human
uaucaaguauagaaaa

SEQ ID NO: 3698655 - RNA, 18 nt, Human
uaucaaguauuauaccuu

SEQ ID NO: 3698656 - RNA, 17 nt, Human
uaucaagucaaucauuu

SEQ ID NO: 3698657 - RNA, 20 nt, Human
uaucaagucaaucauuucuc

SEQ ID NO: 3698658 - RNA, 18 nt, Human
uaucaaguggcaugugcu

SEQ ID NO: 3698659 - RNA, 17 nt, Human
uaucaauaucuaauaua

SEQ ID NO: 3698660 - RNA, 22 nt, Human
uaucaauaucuaauauauauga

SEQ ID NO: 3698661 - RNA, 15 nt, Human
uaucaaucaguauaa

SEQ ID NO: 3698662 - RNA, 21 nt, Human
uaucaauuugucauuuugaag

SEQ ID NO: 3698663 - RNA, 20 nt, Human
uaucacaaaucuuaacuuga

SEQ ID NO: 3698664 - RNA, 20 nt, Human
uaucacacacauugcuguga

SEQ ID NO: 3698665 - RNA, 16 nt, Human
uaucacagucuaauuu

SEQ ID NO: 3698666 - RNA, 20 nt, Human
uaucacagucuaauuuuuau

SEQ ID NO: 3698667 - RNA, 18 nt, Human
uaucacauguauguuuug

SEQ ID NO: 3698668 - RNA, 21 nt, Human
uaucacauguauguuuuggua

SEQ ID NO: 3698669 - RNA, 12 nt, Human
uaucacauguuu

SEQ ID NO: 3698670 - RNA, 20 nt, Human
uaucacauuggagucacugc

SEQ ID NO: 3698671 - RNA, 21 nt, Human
uaucacccaacgcuccaaagu

SEQ ID NO: 3698672 - RNA, 18 nt, Human
uaucacccagaagaaaau

SEQ ID NO: 3698673 - RNA, 22 nt, Human
uaucacccagaagaaaauagug

SEQ ID NO: 3698674 - RNA, 23 nt, Human
uaucaccgugggcucccugacug

SEQ ID NO: 3698675 - RNA, 13 nt, Human
uaucacucauuaa

SEQ ID NO: 3698676 - RNA, 19 nt, Human
uaucacucauuaauuaacc

SEQ ID NO: 3698677 - RNA, 18 nt, Human
uaucacugacacaaaaag

SEQ ID NO: 3698678 - RNA, 20 nt, Human
uaucacugugcaguugcugu

SEQ ID NO: 3698679 - RNA, 22 nt, Human
uaucacuuaaacuugcaucacu

SEQ ID NO: 3698680 - RNA, 15 nt, Human
uaucacuuuuugaac

SEQ ID NO: 3698681 - RNA, 22 nt, Human
uaucacuuuuugaacuaagaaa

SEQ ID NO: 3698682 - RNA, 14 nt, Human
uaucagaacuaugu

SEQ ID NO: 3698683 - RNA, 17 nt, Human
uaucagaauucucagaa

SEQ ID NO: 3698684 - RNA, 20 nt, Human
uaucagacacucuggcuggu

SEQ ID NO: 3698685 - RNA, 14 nt, Human
uaucagagaugucc

SEQ ID NO: 3698686 - RNA, 18 nt, Human
uaucagaguauccacugu

SEQ ID NO: 3698687 - RNA, 15 nt, Human
uaucagauacaucac

SEQ ID NO: 3698688 - RNA, 19 nt, Human
uaucagauacaucacugcu

SEQ ID NO: 3698689 - RNA, 14 nt, Human
uaucagauugcuuu

SEQ ID NO: 3698690 - RNA, 14 nt, Human
uaucagcaaaaaag

SEQ ID NO: 3698691 - RNA, 14 nt, Human
uaucagcaaagaaa

SEQ ID NO: 3698692 - RNA, 20 nt, Human
uaucagcacauauuuucugu

SEQ ID NO: 3698693 - RNA, 15 nt, Human
uaucagcacgugugg

SEQ ID NO: 3698694 - RNA, 13 nt, Human
uaucagccugagu

SEQ ID NO: 3698695 - RNA, 11 nt, Human
uaucagccugu

SEQ ID NO: 3698696 - RNA, 21 nt, Human
uaucaggacccagaggaaggg

SEQ ID NO: 3698697 - RNA, 16 nt, Human
uaucaggauuuuucaa

SEQ ID NO: 3698698 - RNA, 23 nt, Human
uaucaggucucccacgugggaga

SEQ ID NO: 3698699 - RNA, 23 nt, Human
uaucaggugcccaucccuggaag

SEQ ID NO: 3698700 - RNA, 19 nt, Human
uaucaggugcugccaucca

SEQ ID NO: 3698701 - RNA, 15 nt, Human
uaucaguaaauaacu

SEQ ID NO: 3698702 - RNA, 21 nt, Human
uaucagucaauauuuuuagau

SEQ ID NO: 3698703 - RNA, 16 nt, Human
uaucagugacagaguu

SEQ ID NO: 3698704 - RNA, 17 nt, Human
uaucagugacagaguuc

SEQ ID NO: 3698705 - RNA, 23 nt, Human
uaucagugcucgagacacaguga

SEQ ID NO: 3698706 - RNA, 17 nt, Human
uaucagugugcccccca

SEQ ID NO: 3698707 - RNA, 15 nt, Human
uaucaguuacacaug

SEQ ID NO: 3698708 - RNA, 15 nt, Human
uaucaguuacucagc

SEQ ID NO: 3698709 - RNA, 17 nt, Human
uaugaacauauuguuga

SEQ ID NO: 3698710 - RNA, 17 nt, Human
uaugaacuuaacaugcu

SEQ ID NO: 3698711 - RNA, 21 nt, Human
uaugaacuugaggacacaugu

SEQ ID NO: 3698712 - RNA, 16 nt, Human
uaugaagaaaaaauac

SEQ ID NO: 3698713 - RNA, 15 nt, Human
uaugaagaaaauacu

SEQ ID NO: 3698714 - RNA, 20 nt, Human
uaugaagaaaauacuuaaau

SEQ ID NO: 3698715 - RNA, 23 nt, Human
uaugaagcuuuuaugugaaacau

SEQ ID NO: 3698716 - RNA, 15 nt, Human
uaugaaguauauaau

SEQ ID NO: 3698717 - RNA, 16 nt, Human
uaugaaguauauaaug

SEQ ID NO: 3698718 - RNA, 13 nt, Human
uaugaagugcgug

SEQ ID NO: 3698719 - RNA, 19 nt, Human
uaugaagugcgugaaugua

SEQ ID NO: 3698720 - RNA, 20 nt, Human
uaugaaguuacuuucuuaau

SEQ ID NO: 3698721 - RNA, 12 nt, Human
uaugaauaacau

SEQ ID NO: 3698722 - RNA, 17 nt, Human
uaugaauacagcagcaa

SEQ ID NO: 3698723 - RNA, 21 nt, Human
uaugaauauauggcauuugca

SEQ ID NO: 3698724 - RNA, 14 nt, Human
uaugaaucucuacg

SEQ ID NO: 3698725 - RNA, 21 nt, Human
uaugaaucugagagaugcugu

SEQ ID NO: 3698726 - RNA, 23 nt, Human
uaugaaugauuugcauaugaaag

SEQ ID NO: 3698727 - RNA, 20 nt, Human
uaugaaugcccccagcuggc

SEQ ID NO: 3698728 - RNA, 17 nt, Human
uaugaauuacauuugua

SEQ ID NO: 3698729 - RNA, 14 nt, Human
uaugaauuauucaa

SEQ ID NO: 3698730 - RNA, 18 nt, Human
uaugaauuauucaauuua

SEQ ID NO: 3698731 - RNA, 13 nt, Human
uaugaauuguaca

SEQ ID NO: 3698732 - RNA, 14 nt, Human
uaugaauuguacag

SEQ ID NO: 3698733 - RNA, 15 nt, Human
uaugaauuuaaauau

SEQ ID NO: 3698734 - RNA, 14 nt, Human
uaugacaguaaaca

SEQ ID NO: 3698735 - RNA, 15 nt, Human
uaugacaguaauugu

SEQ ID NO: 3698736 - RNA, 18 nt, Human
uaugacaguaauuguguu

SEQ ID NO: 3698737 - RNA, 15 nt, Human
uaugacaguuauacu

SEQ ID NO: 3698738 - RNA, 22 nt, Human
uaugacauaaaaacaacuuuau

SEQ ID NO: 3698739 - RNA, 23 nt, Human
uaugacauaaaaacaacuuuaua

SEQ ID NO: 3698740 - RNA, 14 nt, Human
uaugacauucaugc

SEQ ID NO: 3698741 - RNA, 20 nt, Human
uaugacauucaugccuggcu

SEQ ID NO: 3698742 - RNA, 16 nt, Human
uaugaccuucuaggaa

SEQ ID NO: 3698743 - RNA, 12 nt, Human
uaugacuaaaga

SEQ ID NO: 3698744 - RNA, 13 nt, Human
uaugacuaaagag

SEQ ID NO: 3698745 - RNA, 14 nt, Human
uaugacuaaagaga

SEQ ID NO: 3698746 - RNA, 21 nt, Human
uaugacuaaagagagaaugua

SEQ ID NO: 3698747 - RNA, 17 nt, Human
uaugacuccagaauuuc

SEQ ID NO: 3698748 - RNA, 17 nt, Human
uaugacugcuccccagc

SEQ ID NO: 3698749 - RNA, 16 nt, Human
uaugacuucauuaaua

SEQ ID NO: 3698750 - RNA, 21 nt, Human
uaugacuugggcacccccagc

SEQ ID NO: 3698751 - RNA, 22 nt, Human
uaugacuugggcacccccagcc

SEQ ID NO: 3698752 - RNA, 13 nt, Human
uaugacuuuuuau

SEQ ID NO: 3698753 - RNA, 12 nt, Human
uaugagaaaugu

SEQ ID NO: 3698754 - RNA, 13 nt, Human
uaugagaaaugua

SEQ ID NO: 3698755 - RNA, 16 nt, Human
uaugagaaauguaaug

SEQ ID NO: 3698756 - RNA, 15 nt, Human
uaugagacuuuaugu

SEQ ID NO: 3698757 - RNA, 20 nt, Human
uaugagcauccugagccccg

SEQ ID NO: 3698758 - RNA, 22 nt, Human
uaugagcauccugagccccgcc

SEQ ID NO: 3698759 - RNA, 21 nt, Human
uaugagccgugaacugugcau

SEQ ID NO: 3698760 - RNA, 15 nt, Human
uaugagcucuucaug

SEQ ID NO: 3698761 - RNA, 13 nt, Human
uaugagcugaggg

SEQ ID NO: 3698762 - RNA, 23 nt, Human
uaugaggacuugugucucugugc

SEQ ID NO: 3698763 - RNA, 13 nt, Human
uaugaggagggga

SEQ ID NO: 3698764 - RNA, 14 nt, Human
uaugaggaugcaga

SEQ ID NO: 3698765 - RNA, 14 nt, Human
uaugaggcauuugu

SEQ ID NO: 3698766 - RNA, 15 nt, Human
uaugagggaaaauga

SEQ ID NO: 3698767 - RNA, 15 nt, Human
uaugaggucuaggaa

SEQ ID NO: 3698768 - RNA, 19 nt, Human
uaugaggucuaggaacaua

SEQ ID NO: 3698769 - RNA, 18 nt, Human
uaugaguaacuauuauua

SEQ ID NO: 3698770 - RNA, 16 nt, Human
uaugaguacaaaugcc

SEQ ID NO: 3698771 - RNA, 17 nt, Human
uaugaguacaaaugccu

SEQ ID NO: 3698772 - RNA, 14 nt, Human
uaugaguauacaau

SEQ ID NO: 3698773 - RNA, 20 nt, Human
uaugaguauacaauauauaa

SEQ ID NO: 3698774 - RNA, 17 nt, Human
uaugagucaaugugcag

SEQ ID NO: 3698775 - RNA, 16 nt, Human
uaugagucuagauguu

SEQ ID NO: 3698776 - RNA, 22 nt, Human
uaugaguuguuuucagacucag

SEQ ID NO: 3698777 - RNA, 17 nt, Human
uaugaguuucauagcua

SEQ ID NO: 3698778 - RNA, 22 nt, Human
uaugaguuuuugauagcuuuau

SEQ ID NO: 3698779 - RNA, 15 nt, Human
uaugauaaaaaauuu

SEQ ID NO: 3698780 - RNA, 23 nt, Human
uaugauaaaaaauuuuguaauuu

SEQ ID NO: 3698781 - RNA, 17 nt, Human
uaugauacuugaaaauu

SEQ ID NO: 3698782 - RNA, 13 nt, Human
uaugauaucccug

SEQ ID NO: 3698783 - RNA, 14 nt, Human
uaugauauuccaua

SEQ ID NO: 3698784 - RNA, 18 nt, Human
uaugauauuccauaguau

SEQ ID NO: 3698785 - RNA, 19 nt, Human
uaugauauuccauaguaua

SEQ ID NO: 3698786 - RNA, 20 nt, Human
uaugauauuccauaguauau

SEQ ID NO: 3698787 - RNA, 18 nt, Human
uaugauauugcauaugca

SEQ ID NO: 3698788 - RNA, 15 nt, Human
uaugaucaaauguuu

SEQ ID NO: 3698789 - RNA, 20 nt, Human
uaugaucaaauguuuaauca

SEQ ID NO: 3698790 - RNA, 10 nt, Human
uaugauccag

SEQ ID NO: 3698791 - RNA, 19 nt, Human
uaugauccagcagauuauu

SEQ ID NO: 3698792 - RNA, 21 nt, Human
uaugauccagcagauuauuca

SEQ ID NO: 3698793 - RNA, 22 nt, Human
uaugauccagcagauuauucac

SEQ ID NO: 3698794 - RNA, 14 nt, Human
uaugaucugucugu

SEQ ID NO: 3698795 - RNA, 20 nt, Human
uaugaucuguuuuguaucuu

SEQ ID NO: 3698796 - RNA, 21 nt, Human
uaugaugacguacaaguaguu

SEQ ID NO: 3698797 - RNA, 15 nt, Human
uaugaugacuguuuu

SEQ ID NO: 3698798 - RNA, 22 nt, Human
uaugauguaaucucucugcagc

SEQ ID NO: 3698799 - RNA, 21 nt, Human
uaugauguauacugccacuaa

SEQ ID NO: 3698800 - RNA, 17 nt, Human
uaugaugugcuuaacag

SEQ ID NO: 3698801 - RNA, 21 nt, Human
uaugaugugcuuaacagggaa

SEQ ID NO: 3698802 - RNA, 19 nt, Human
uaugauguuaguuuuccuu

SEQ ID NO: 3698803 - RNA, 23 nt, Human
uaugauuaaaaauaucaaauuaa

SEQ ID NO: 3698804 - RNA, 16 nt, Human
uaugauuaaguaauga

SEQ ID NO: 3698805 - RNA, 20 nt, Human
uaugauuaaguaaugauaac

SEQ ID NO: 3698806 - RNA, 16 nt, Human
uaugauuaguaaagaa

SEQ ID NO: 3698807 - RNA, 21 nt, Human
uaugauuauuaacgaugucca

SEQ ID NO: 3698808 - RNA, 14 nt, Human
uaugauucugcuuu

SEQ ID NO: 3698809 - RNA, 17 nt, Human
uaugauuuaaaacaugu

SEQ ID NO: 3698810 - RNA, 13 nt, Human
uaugauuuacauu

SEQ ID NO: 3698811 - RNA, 17 nt, Human
uaugauuuauaaacaga

SEQ ID NO: 3698812 - RNA, 19 nt, Human
uaugauuuauaaacagaca

SEQ ID NO: 3698813 - RNA, 18 nt, Human
uaugauuuauaguuugua

SEQ ID NO: 3698814 - RNA, 18 nt, Human
uaugauuuggaaaauaaa

SEQ ID NO: 3698815 - RNA, 16 nt, Human
uaugauuuuauuugac

SEQ ID NO: 3698816 - RNA, 14 nt, Human
uaugauuuucauaa

SEQ ID NO: 3698817 - RNA, 12 nt, Human
uaugauuuuuaa

SEQ ID NO: 3698818 - RNA, 23 nt, Human
uaugauuuuuaaagaaaaguuuu

SEQ ID NO: 3698819 - RNA, 18 nt, Human
uaugauuuuuuaaaagaa

SEQ ID NO: 3698820 - RNA, 12 nt, Human
uaugcaaagcac

SEQ ID NO: 3698821 - RNA, 16 nt, Human
uucugcagcuguuuua

SEQ ID NO: 3698822 - RNA, 23 nt, Human
uucugcagguugaagccaugucu

SEQ ID NO: 3698823 - RNA, 15 nt, Human
uucugcaguaaaucu

SEQ ID NO: 3698824 - RNA, 18 nt, Human
uucugcaguaaaucuuuu

SEQ ID NO: 3698825 - RNA, 22 nt, Human
uucugcaguaaaucuuuuacaa

SEQ ID NO: 3698826 - RNA, 21 nt, Human
uucugcauauguugaauacuu

SEQ ID NO: 3698827 - RNA, 16 nt, Human
uucugcaucagcugcu

SEQ ID NO: 3698828 - RNA, 23 nt, Human
uucugcaucagcugcugaaacaa

SEQ ID NO: 3698829 - RNA, 13 nt, Human
uucugcauugcua

SEQ ID NO: 3698830 - RNA, 23 nt, Human
uucugcauuuuauucuggaugga

SEQ ID NO: 3698831 - RNA, 17 nt, Human
uucugcauuuugcuauu

SEQ ID NO: 3698832 - RNA, 15 nt, Human
uucugccacauaaaa

SEQ ID NO: 3698833 - RNA, 15 nt, Human
uucugccagggagcu

SEQ ID NO: 3698834 - RNA, 13 nt, Human
uucugcccccagc

SEQ ID NO: 3698835 - RNA, 16 nt, Human
uucugcccuggcugcu

SEQ ID NO: 3698836 - RNA, 18 nt, Human
uucugcccuggcugcugc

SEQ ID NO: 3698837 - RNA, 20 nt, Human
uucugcccuggcugcugccc

SEQ ID NO: 3698838 - RNA, 22 nt, Human
uucugccgaccccuaguucccu

SEQ ID NO: 3698839 - RNA, 15 nt, Human
uucugccgcccccuc

SEQ ID NO: 3698840 - RNA, 17 nt, Human
uucugccggcccugggg

SEQ ID NO: 3698841 - RNA, 14 nt, Human
uucugccuccccuu

SEQ ID NO: 3698842 - RNA, 18 nt, Human
uucugccucucuaggacc

SEQ ID NO: 3698843 - RNA, 15 nt, Human
uucugccucugaugu

SEQ ID NO: 3698844 - RNA, 23 nt, Human
uucugccugaggggcagccugcc

SEQ ID NO: 3698845 - RNA, 16 nt, Human
uucugccugccagcug

SEQ ID NO: 3698846 - RNA, 22 nt, Human
uucugccugccagcugcacuga

SEQ ID NO: 3698847 - RNA, 21 nt, Human
uucugccuguuauaacucugc

SEQ ID NO: 3698848 - RNA, 15 nt, Human
uucugccuuugaugu

SEQ ID NO: 3698849 - RNA, 21 nt, Human
uucugccuuugccaggugacu

SEQ ID NO: 3698850 - RNA, 16 nt, Human
uucugccuuuucacug

SEQ ID NO: 3698851 - RNA, 15 nt, Human
uucugcucagcucug

SEQ ID NO: 3698852 - RNA, 19 nt, Human
uucugcucaucauucucug

SEQ ID NO: 3698853 - RNA, 9 nt, Human
uucugcucc

SEQ ID NO: 3698854 - RNA, 20 nt, Human
uucugcuccacccuuggccu

SEQ ID NO: 3698855 - RNA, 16 nt, Human
uucugcuccuucccca

SEQ ID NO: 3698856 - RNA, 23 nt, Human
uucugcucugguuguuucuguuc

SEQ ID NO: 3698857 - RNA, 18 nt, Human
uucugcuggaaacagacu

SEQ ID NO: 3698858 - RNA, 13 nt, Human
uucugcuggauaa

SEQ ID NO: 3698859 - RNA, 12 nt, Human
uucugcuggccu

SEQ ID NO: 3698860 - RNA, 20 nt, Human
uucugcugggcuggggccug

SEQ ID NO: 3698861 - RNA, 21 nt, Human
uucugcuggggccugggacaa

SEQ ID NO: 3698862 - RNA, 18 nt, Human
uucugcuuuccucuuccu

SEQ ID NO: 3698863 - RNA, 15 nt, Human
uucugcuuucuuuga

SEQ ID NO: 3698864 - RNA, 11 nt, Human
uucugcuuugu

SEQ ID NO: 3698865 - RNA, 18 nt, Human
uucuggaaaagaggaguu

SEQ ID NO: 3698866 - RNA, 17 nt, Human
uucuggaauacaugaaa

SEQ ID NO: 3698867 - RNA, 15 nt, Human
uucuggaauguaauc

SEQ ID NO: 3698868 - RNA, 16 nt, Human
uucuggaauguaauca

SEQ ID NO: 3698869 - RNA, 22 nt, Human
uucuggaauguaaucaauguuu

SEQ ID NO: 3698870 - RNA, 17 nt, Human
uucuggaauuuguucaa

SEQ ID NO: 3698871 - RNA, 19 nt, Human
uucuggacagucagcucuu

SEQ ID NO: 3698872 - RNA, 19 nt, Human
uucuggacccuuauaaaau

SEQ ID NO: 3698873 - RNA, 17 nt, Human
uucuggaccucuggguu

SEQ ID NO: 3698874 - RNA, 18 nt, Human
uucuggaccucuggguug

SEQ ID NO: 3698875 - RNA, 15 nt, Human
uucuggacuaaaacu

SEQ ID NO: 3698876 - RNA, 17 nt, Human
uucuggacuauagcugu

SEQ ID NO: 3698877 - RNA, 13 nt, Human
uucuggagcccuu

SEQ ID NO: 3698878 - RNA, 19 nt, Human
uucuggaggaaagggagga

SEQ ID NO: 3698879 - RNA, 20 nt, Human
uucuggagguugauaacuuu

SEQ ID NO: 3698880 - RNA, 13 nt, Human
uucuggauaaagc

SEQ ID NO: 3698881 - RNA, 19 nt, Human
uucuggauaaagccacuga

SEQ ID NO: 3698882 - RNA, 14 nt, Human
uucuggaugggaca

SEQ ID NO: 3698883 - RNA, 18 nt, Human
uucuggauggugugccuu

SEQ ID NO: 3698884 - RNA, 23 nt, Human
uucuggauggugugccuuccaga

SEQ ID NO: 3698885 - RNA, 15 nt, Human
uucuggcagaggagg

SEQ ID NO: 3698886 - RNA, 20 nt, Human
uucuggcagaguugaagaca

SEQ ID NO: 3698887 - RNA, 17 nt, Human
uucuggcagguccuccc

SEQ ID NO: 3698888 - RNA, 19 nt, Human
uucuggcagguccuccccu

SEQ ID NO: 3698889 - RNA, 18 nt, Human
uucuggccaguguuuaaa

SEQ ID NO: 3698890 - RNA, 22 nt, Human
uucuggccaguguuuaaaacuu

SEQ ID NO: 3698891 - RNA, 16 nt, Human
uucuggcuaugcauuu

SEQ ID NO: 3698892 - RNA, 10 nt, Human
uucuggcuca

SEQ ID NO: 3698893 - RNA, 19 nt, Human
uucuggcugaacacuggca

SEQ ID NO: 3698894 - RNA, 22 nt, Human
uucuggcuggagccuagaacag

SEQ ID NO: 3698895 - RNA, 17 nt, Human
uucugggaaauggcuug

SEQ ID NO: 3698896 - RNA, 23 nt, Human
uucugggaaauggcuugaagcca

SEQ ID NO: 3698897 - RNA, 23 nt, Human
uucugggaauguauaguauuuga

SEQ ID NO: 3698898 - RNA, 16 nt, Human
uucugggaggaagcag

SEQ ID NO: 3698899 - RNA, 21 nt, Human
uucugggagggcagcagggcu

SEQ ID NO: 3698900 - RNA, 20 nt, Human
uucugggcaccacaaaauau

SEQ ID NO: 3698901 - RNA, 16 nt, Human
uucugggcucuuuccu

SEQ ID NO: 3698902 - RNA, 16 nt, Human
uucugggcuucaucug

SEQ ID NO: 3698903 - RNA, 14 nt, Human
uucuggggaaagac

SEQ ID NO: 3698904 - RNA, 20 nt, Human
uucuggggaaagacacugcc

SEQ ID NO: 3698905 - RNA, 22 nt, Human
uucuggggaaagacacugccug

SEQ ID NO: 3698906 - RNA, 18 nt, Human
uucuggggcaggcugggc

SEQ ID NO: 3698907 - RNA, 14 nt, Human
uucuggggccccuu

SEQ ID NO: 3698908 - RNA, 19 nt, Human
uucuggggggacccagugc

SEQ ID NO: 3698909 - RNA, 21 nt, Human
uucuggggggacccagugcag

SEQ ID NO: 3698910 - RNA, 14 nt, Human
uucuggggucccca

SEQ ID NO: 3698911 - RNA, 15 nt, Human
uucugggguuuuucu

SEQ ID NO: 3698912 - RNA, 19 nt, Human
uucuggguggggcaguggg

SEQ ID NO: 3698913 - RNA, 13 nt, Human
uucugggugucca

SEQ ID NO: 3698914 - RNA, 18 nt, Human
uucugguacucuccuaga

SEQ ID NO: 3698915 - RNA, 15 nt, Human
uucugguacuuucug

SEQ ID NO: 3698916 - RNA, 17 nt, Human
uucugguacuuucuguu

SEQ ID NO: 3698917 - RNA, 17 nt, Human
uucugguagauagaaau

SEQ ID NO: 3698918 - RNA, 22 nt, Human
uucugguaggaauagcauguca

SEQ ID NO: 3698919 - RNA, 22 nt, Human
uucugguaugaacuugaggaca

SEQ ID NO: 3698920 - RNA, 14 nt, Human
uucugguccuuuuu

SEQ ID NO: 3698921 - RNA, 16 nt, Human
uucugguccuuuuugg

SEQ ID NO: 3698922 - RNA, 13 nt, Human
uucuggucucguc

SEQ ID NO: 3698923 - RNA, 19 nt, Human
uucuggugggguguguucc

SEQ ID NO: 3698924 - RNA, 21 nt, Human
uucuggugugaacuaaacuuu

SEQ ID NO: 3698925 - RNA, 15 nt, Human
uucugguuagcucag

SEQ ID NO: 3698926 - RNA, 16 nt, Human
uucugguuagcucagc

SEQ ID NO: 3698927 - RNA, 19 nt, Human
uucugguuagcucagcccc

SEQ ID NO: 3698928 - RNA, 21 nt, Human
uucugguucuuguguuggcug

SEQ ID NO: 3698929 - RNA, 22 nt, Human
uucugguugaugccugugaacu

SEQ ID NO: 3698930 - RNA, 17 nt, Human
uucugguuuaaacuugu

SEQ ID NO: 3698931 - RNA, 22 nt, Human
uucugguuuaaacuuguuugcu

SEQ ID NO: 3698932 - RNA, 19 nt, Human
uucuguaaaauggaaaacu

SEQ ID NO: 3698933 - RNA, 17 nt, Human
uucuguaaaaugucugu

SEQ ID NO: 3698934 - RNA, 19 nt, Human
uucuguaagaaaccuacug

SEQ ID NO: 3698935 - RNA, 13 nt, Human
uucuguaauugug

SEQ ID NO: 3698936 - RNA, 15 nt, Human
uucuguacauagccu

SEQ ID NO: 3698937 - RNA, 18 nt, Human
uucuguacauagccuaua

SEQ ID NO: 3698938 - RNA, 12 nt, Human
uucuguaccagu

SEQ ID NO: 3698939 - RNA, 21 nt, Human
uucuguaccaguuaauuuuuc

SEQ ID NO: 3698940 - RNA, 15 nt, Human
uucuguacuguuacu

SEQ ID NO: 3698941 - RNA, 21 nt, Human
uucuguagaaaugguuguauu

SEQ ID NO: 3698942 - RNA, 20 nt, Human
uucuguagagccuucugaug

SEQ ID NO: 3698943 - RNA, 16 nt, Human
uucuguagguucugug

SEQ ID NO: 3698944 - RNA, 20 nt, Human
uucuguaguacuccuuaaga

SEQ ID NO: 3698945 - RNA, 21 nt, Human
uucuguauaaagccuguauuc

SEQ ID NO: 3698946 - RNA, 13 nt, Human
uucuguauacaac

SEQ ID NO: 3698947 - RNA, 23 nt, Human
uucuguauacaacccuggcauua

SEQ ID NO: 3698948 - RNA, 14 nt, Human
uucuguauagauua

SEQ ID NO: 3698949 - RNA, 17 nt, Human
uucuguauauaaauggg

SEQ ID NO: 3698950 - RNA, 15 nt, Human
uucuguauauacuuu

SEQ ID NO: 3698951 - RNA, 11 nt, Human
uucuguauuug

SEQ ID NO: 3698952 - RNA, 15 nt, Human
uucuguauuugaaag

SEQ ID NO: 3698953 - RNA, 13 nt, Human
uucugucacucag

SEQ ID NO: 3698954 - RNA, 22 nt, Human
uucugucagaugagaacaaagc

SEQ ID NO: 3698955 - RNA, 13 nt, Human
uucugucccuagg

SEQ ID NO: 3698956 - RNA, 18 nt, Human
uucugucgccuuagcaug

SEQ ID NO: 3698957 - RNA, 21 nt, Human
uucugucgccuuagcauguuu

SEQ ID NO: 3698958 - RNA, 14 nt, Human
uucugucucugccu

SEQ ID NO: 3698959 - RNA, 22 nt, Human
uucugucuucauccccucagaa

SEQ ID NO: 3698960 - RNA, 19 nt, Human
uucugugagacccccacac

SEQ ID NO: 3698961 - RNA, 18 nt, Human
uucugugaugagcugauc

SEQ ID NO: 3698962 - RNA, 19 nt, Human
uucugugcccagaauacug

SEQ ID NO: 3698963 - RNA, 20 nt, Human
uucugugcccagaauacuga

SEQ ID NO: 3698964 - RNA, 14 nt, Human
uucugugcccagcu

SEQ ID NO: 3698965 - RNA, 16 nt, Human
uucugugccugaauau

SEQ ID NO: 3698966 - RNA, 19 nt, Human
uucuguggaaaguguaaag

SEQ ID NO: 3698967 - RNA, 21 nt, Human
uucuguggaaaguguaaagca

SEQ ID NO: 3698968 - RNA, 22 nt, Human
uucuguggcgaggcaugcuauc

SEQ ID NO: 3698969 - RNA, 12 nt, Human
uucuguggcuca

SEQ ID NO: 3698970 - RNA, 12 nt, Human
uuuaugagaaau

SEQ ID NO: 3698971 - RNA, 14 nt, Human
uuuaugagaaaugu

SEQ ID NO: 3698972 - RNA, 14 nt, Human
uuuaugagauggau

SEQ ID NO: 3698973 - RNA, 23 nt, Human
uuuaugagcucauguagcaauca

SEQ ID NO: 3698974 - RNA, 20 nt, Human
uuuaugaguaacuauuauua

SEQ ID NO: 3698975 - RNA, 22 nt, Human
uuuaugauacuugaaaauuaac

SEQ ID NO: 3698976 - RNA, 14 nt, Human
uuuaugaucagugu

SEQ ID NO: 3698977 - RNA, 21 nt, Human
uuuaugaucaguguuguugcu

SEQ ID NO: 3698978 - RNA, 17 nt, Human
uuuaugaugaugaaaau

SEQ ID NO: 3698979 - RNA, 19 nt, Human
uuuaugauuuucauaacuu

SEQ ID NO: 3698980 - RNA, 22 nt, Human
uuuaugauuuucauaacuuauu

SEQ ID NO: 3698981 - RNA, 16 nt, Human
uuuaugcaaaagguuu

SEQ ID NO: 3698982 - RNA, 16 nt, Human
uuuaugcaaauauuuu

SEQ ID NO: 3698983 - RNA, 17 nt, Human
uuuaugcaaggaaggaa

SEQ ID NO: 3698984 - RNA, 18 nt, Human
uuuaugcaaggaaggaaa

SEQ ID NO: 3698985 - RNA, 19 nt, Human
uuuaugcagugcugcuuug

SEQ ID NO: 3698986 - RNA, 14 nt, Human
uuuaugcauauuau

SEQ ID NO: 3698987 - RNA, 20 nt, Human
uuuaugcauuugcauuugcu

SEQ ID NO: 3698988 - RNA, 16 nt, Human
uuuaugcucaauccau

SEQ ID NO: 3698989 - RNA, 14 nt, Human
uuuaugcucuuuuu

SEQ ID NO: 3698990 - RNA, 12 nt, Human
uuuaugcuuuaa

SEQ ID NO: 3698991 - RNA, 17 nt, Human
uuuauggaaucuaccaa

SEQ ID NO: 3698992 - RNA, 23 nt, Human
uuuauggaggauggagagagggg

SEQ ID NO: 3698993 - RNA, 17 nt, Human
uuuauggcacuaguauu

SEQ ID NO: 3698994 - RNA, 21 nt, Human
uuuauggcagacauugugcua

SEQ ID NO: 3698995 - RNA, 22 nt, Human
uuuauggccacauuuaauaucu

SEQ ID NO: 3698996 - RNA, 22 nt, Human
uuuauggccucagcugccucac

SEQ ID NO: 3698997 - RNA, 19 nt, Human
uuuaugguaaaaaauuuau

SEQ ID NO: 3698998 - RNA, 21 nt, Human
uuuaugguaacugcuuucugu

SEQ ID NO: 3698999 - RNA, 18 nt, Human
uuuaugguaaucauauua

SEQ ID NO: 3699000 - RNA, 18 nt, Human
uuuaugguccuaaaagca

SEQ ID NO: 3699001 - RNA, 21 nt, Human
uuuaugguuacuucuucucuu

SEQ ID NO: 3699002 - RNA, 15 nt, Human
uuuaugguuauguuu

SEQ ID NO: 3699003 - RNA, 16 nt, Human
uuuaugguuauguuuu

SEQ ID NO: 3699004 - RNA, 21 nt, Human
uuuaugguuauguuuuucugu

SEQ ID NO: 3699005 - RNA, 21 nt, Human
uuuaugguuucccccuucuac

SEQ ID NO: 3699006 - RNA, 19 nt, Human
uuuauguaaugaaguaaag

SEQ ID NO: 3699007 - RNA, 22 nt, Human
uuuauguaaugaaguaaagcca

SEQ ID NO: 3699008 - RNA, 20 nt, Human
uuuauguauguuuacacugu

SEQ ID NO: 3699009 - RNA, 11 nt, Human
uuuauguauug

SEQ ID NO: 3699010 - RNA, 22 nt, Human
uuuaugucccuucacauaguuu

SEQ ID NO: 3699011 - RNA, 14 nt, Human
uuuaugugaaacau

SEQ ID NO: 3699012 - RNA, 15 nt, Human
uuuaugugaauuuuu

SEQ ID NO: 3699013 - RNA, 20 nt, Human
uuuaugugaauuuuuaagcu

SEQ ID NO: 3699014 - RNA, 18 nt, Human
uuuaugugugaggagcug

SEQ ID NO: 3699015 - RNA, 21 nt, Human
uuuauguuauauauaaauaua

SEQ ID NO: 3699016 - RNA, 17 nt, Human
uuuauguucauuuguuu

SEQ ID NO: 3699017 - RNA, 11 nt, Human
uuuauguugac

SEQ ID NO: 3699018 - RNA, 14 nt, Human
uuuauguugacauu

SEQ ID NO: 3699019 - RNA, 17 nt, Human
uuuauguugacauuugu

SEQ ID NO: 3699020 - RNA, 18 nt, Human
uuuauguugacauuuguu

SEQ ID NO: 3699021 - RNA, 13 nt, Human
uuuauguuugaau

SEQ ID NO: 3699022 - RNA, 14 nt, Human
uuuauguuugucuu

SEQ ID NO: 3699023 - RNA, 18 nt, Human
uuuauguuuuguuucuga

SEQ ID NO: 3699024 - RNA, 12 nt, Human
uuuauuaaaaca

SEQ ID NO: 3699025 - RNA, 18 nt, Human
uuuauuaaaauauuucag

SEQ ID NO: 3699026 - RNA, 14 nt, Human
uuuauuaaaaucuu

SEQ ID NO: 3699027 - RNA, 15 nt, Human
uuuauuaaaaucuua

SEQ ID NO: 3699028 - RNA, 23 nt, Human
uuuauuaaacagauuuuuacaaa

SEQ ID NO: 3699029 - RNA, 12 nt, Human
uuuauuaaagaa

SEQ ID NO: 3699030 - RNA, 11 nt, Human
uuuauuaaaua

SEQ ID NO: 3699031 - RNA, 19 nt, Human
uuuauuaaauaaaaucaau

SEQ ID NO: 3699032 - RNA, 12 nt, Human
uuuauuaacaaa

SEQ ID NO: 3699033 - RNA, 16 nt, Human
uuuauuaauaaacauu

SEQ ID NO: 3699034 - RNA, 21 nt, Human
uuuauuaauaaacauucuauc

SEQ ID NO: 3699035 - RNA, 19 nt, Human
uuuauuaaucacuguguau

SEQ ID NO: 3699036 - RNA, 21 nt, Human
uuuauuaaucacuguguauau

SEQ ID NO: 3699037 - RNA, 19 nt, Human
uuuauuaaucuuaguguau

SEQ ID NO: 3699038 - RNA, 12 nt, Human
uuuauuaccagu

SEQ ID NO: 3699039 - RNA, 14 nt, Human
uuuauuaccucuga

SEQ ID NO: 3699040 - RNA, 16 nt, Human
uuuauuacguaugucu

SEQ ID NO: 3699041 - RNA, 18 nt, Human
uuuauuacguaugucugg

SEQ ID NO: 3699042 - RNA, 13 nt, Human
uuuauuacugauu

SEQ ID NO: 3699043 - RNA, 21 nt, Human
uuuauuacuguuuauuacuuc

SEQ ID NO: 3699044 - RNA, 21 nt, Human
uuuauuaugaaacuuguguaa

SEQ ID NO: 3699045 - RNA, 17 nt, Human
uuuauuaugcauuauau

SEQ ID NO: 3699046 - RNA, 14 nt, Human
uuuauuauguaaau

SEQ ID NO: 3699047 - RNA, 21 nt, Human
uuuauuauguacaaauagauu

SEQ ID NO: 3699048 - RNA, 14 nt, Human
uuuauucaaacuga

SEQ ID NO: 3699049 - RNA, 12 nt, Human
uuuauucaaggu

SEQ ID NO: 3699050 - RNA, 13 nt, Human
uuuauucaauaaa

SEQ ID NO: 3699051 - RNA, 17 nt, Human
uuuauucaauuccucug

SEQ ID NO: 3699052 - RNA, 15 nt, Human
uuuauucauaugcau

SEQ ID NO: 3699053 - RNA, 22 nt, Human
uuuauuccagaaugcuguacau

SEQ ID NO: 3699054 - RNA, 23 nt, Human
uuuauuccagaaugcuguacauc

SEQ ID NO: 3699055 - RNA, 13 nt, Human
uuuauuccagagc

SEQ ID NO: 3699056 - RNA, 17 nt, Human
uuuauucuugugaauau

SEQ ID NO: 3699057 - RNA, 16 nt, Human
uuuauucuuuuuaaag

SEQ ID NO: 3699058 - RNA, 12 nt, Human
uuuauugacaca

SEQ ID NO: 3699059 - RNA, 14 nt, Human
uuuauugagaaaga

SEQ ID NO: 3699060 - RNA, 16 nt, Human
uuuauugagaaagagc

SEQ ID NO: 3699061 - RNA, 20 nt, Human
uuuauugaggaaaaauaugu

SEQ ID NO: 3699062 - RNA, 17 nt, Human
uuuauugcacaaaauau

SEQ ID NO: 3699063 - RNA, 22 nt, Human
uuuauugccaaaacccagcugc

SEQ ID NO: 3699064 - RNA, 13 nt, Human
uuuauugccuucu

SEQ ID NO: 3699065 - RNA, 23 nt, Human
uuuauugccuuuuaauuuuuaau

SEQ ID NO: 3699066 - RNA, 17 nt, Human
uuuauugcuugauacuu

SEQ ID NO: 3699067 - RNA, 14 nt, Human
uuuauugcuuuaua

SEQ ID NO: 3699068 - RNA, 16 nt, Human
uuuauuguaacagaca

SEQ ID NO: 3699069 - RNA, 20 nt, Human
uuuauuguaacagacauugu

SEQ ID NO: 3699070 - RNA, 22 nt, Human
uuuauuguaacagacauuguuu

SEQ ID NO: 3699071 - RNA, 13 nt, Human
uuuauuguauucu

SEQ ID NO: 3699072 - RNA, 14 nt, Human
uuuauuguauucug

SEQ ID NO: 3699073 - RNA, 18 nt, Human
uuuauuguauucuggggu

SEQ ID NO: 3699074 - RNA, 12 nt, Human
uuuauugucugu

SEQ ID NO: 3699075 - RNA, 14 nt, Human
uuuauugucuguaa

SEQ ID NO: 3699076 - RNA, 22 nt, Human
uuuauuguuuucuauuuaugcc

SEQ ID NO: 3699077 - RNA, 15 nt, Human
uuuauuuaaaagauu

SEQ ID NO: 3699078 - RNA, 22 nt, Human
uuuauuuaacuuuuaguaaagu

SEQ ID NO: 3699079 - RNA, 19 nt, Human
uuuauuuaaugcuguggca

SEQ ID NO: 3699080 - RNA, 17 nt, Human
uuuauuuaauguuaugu

SEQ ID NO: 3699081 - RNA, 11 nt, Human
uuuauuuacua

SEQ ID NO: 3699082 - RNA, 16 nt, Human
uuuauuuacugcuagu

SEQ ID NO: 3699083 - RNA, 15 nt, Human
uuuauuuauacuauu

SEQ ID NO: 3699084 - RNA, 14 nt, Human
uuuauuuaugaagu

SEQ ID NO: 3699085 - RNA, 14 nt, Human
uuuauuuauguacu

SEQ ID NO: 3699086 - RNA, 14 nt, Human
uuuauuuauuaaga

SEQ ID NO: 3699087 - RNA, 13 nt, Human
uuuauuuauuuau

SEQ ID NO: 3699088 - RNA, 16 nt, Human
uuuauuuauuuauuca

SEQ ID NO: 3699089 - RNA, 15 nt, Human
uuuauuuauuuuauc

SEQ ID NO: 3699090 - RNA, 11 nt, Human
uuuauuucacu

SEQ ID NO: 3699091 - RNA, 13 nt, Human
uuuauuuccagug

SEQ ID NO: 3699092 - RNA, 16 nt, Human
uuuauuucuccuuuug

SEQ ID NO: 3699093 - RNA, 16 nt, Human
uuuauuucugcauaug

SEQ ID NO: 3699094 - RNA, 16 nt, Human
uuuauuuguaaauuua

SEQ ID NO: 3699095 - RNA, 12 nt, Human
uuuauuuguuga

SEQ ID NO: 3699096 - RNA, 12 nt, Human
uuuauuuuauga

SEQ ID NO: 3699097 - RNA, 16 nt, Human
uuuauuuuauguuuag

SEQ ID NO: 3699098 - RNA, 16 nt, Human
uuuauuuucuuuugaa

SEQ ID NO: 3699099 - RNA, 21 nt, Human
uuuauuuucuuuuguaaaugu

SEQ ID NO: 3699100 - RNA, 18 nt, Human
uuuauuuugaaauggaaa

SEQ ID NO: 3699101 - RNA, 15 nt, Human
uuuauuuuguaugaa

SEQ ID NO: 3699102 - RNA, 21 nt, Human
uuuauuuuguaugaaauauau

SEQ ID NO: 3699103 - RNA, 13 nt, Human
uuuauuuugugua

SEQ ID NO: 3699104 - RNA, 15 nt, Human
uuuauuuuguuaaaa

SEQ ID NO: 3699105 - RNA, 23 nt, Human
uuuauuuuuagaauuuugugaaa

SEQ ID NO: 3699106 - RNA, 12 nt, Human
uuuauuuuucau

SEQ ID NO: 3699107 - RNA, 17 nt, Human
uuuauuuuucuugucuu

SEQ ID NO: 3699108 - RNA, 16 nt, Human
uuuauuuuuuauacag

SEQ ID NO: 3699109 - RNA, 13 nt, Human
uuuauuuuuuggg

SEQ ID NO: 3699110 - RNA, 17 nt, Human
uuuauuuuuuucugaau

SEQ ID NO: 3699111 - RNA, 15 nt, Human
uuucaaaaaaauaaa

SEQ ID NO: 3699112 - RNA, 13 nt, Human
uuucaaaaacauu

SEQ ID NO: 3699113 - RNA, 17 nt, Human
uuucaaaaauauaacuu

SEQ ID NO: 3699114 - RNA, 22 nt, Human
uuucaaaaauuuggaauucugu

SEQ ID NO: 3699115 - RNA, 12 nt, Human
uuucaaaaccag

SEQ ID NO: 3699116 - RNA, 20 nt, Human
uuucaaaauagaaaaguuau

SEQ ID NO: 3699117 - RNA, 17 nt, Human
uuucaaaauccaaaaag

SEQ ID NO: 3699118 - RNA, 19 nt, Human
uuucaaaauccaaaaagaa

SEQ ID NO: 3699119 - RNA, 22 nt, Human
uuucaaaauuguuacaaauugu

SEQ ID NO: 3699120 - RNA, 17 nt, Human
uuucaaacacaaaugca

SEQ ID NO: 3699121 - RNA, 14 nt, Human
uaugcaaagcacug

SEQ ID NO: 3699122 - RNA, 17 nt, Human
uaugcaaggaaggaaag

SEQ ID NO: 3699123 - RNA, 20 nt, Human
uaugcaaggaaggaaagaaa

SEQ ID NO: 3699124 - RNA, 21 nt, Human
uaugcaauaaaauuauuugca

SEQ ID NO: 3699125 - RNA, 15 nt, Human
uaugcaauauaucua

SEQ ID NO: 3699126 - RNA, 20 nt, Human
uaugcaaucaaaucugcuuu

SEQ ID NO: 3699127 - RNA, 15 nt, Human
uaugcacaauuccau

SEQ ID NO: 3699128 - RNA, 14 nt, Human
uaugcacacauuuu

SEQ ID NO: 3699129 - RNA, 16 nt, Human
uaugcacaugaacuua

SEQ ID NO: 3699130 - RNA, 14 nt, Human
uaugcaccuugugu

SEQ ID NO: 3699131 - RNA, 20 nt, Human
uaugcaccuugugucuguac

SEQ ID NO: 3699132 - RNA, 22 nt, Human
uaugcaccuugugucuguacac

SEQ ID NO: 3699133 - RNA, 17 nt, Human
uaugcacgaccuuggga

SEQ ID NO: 3699134 - RNA, 16 nt, Human
uaugcacuaagucucu

SEQ ID NO: 3699135 - RNA, 18 nt, Human
uaugcagaaauagacaaa

SEQ ID NO: 3699136 - RNA, 21 nt, Human
uaugcagaaauagacaaaaag

SEQ ID NO: 3699137 - RNA, 18 nt, Human
uaugcagaacacauuuca

SEQ ID NO: 3699138 - RNA, 14 nt, Human
uaugcagaauguuu

SEQ ID NO: 3699139 - RNA, 17 nt, Human
uaugcagauagaaucaa

SEQ ID NO: 3699140 - RNA, 19 nt, Human
uaugcaguauugagcacug

SEQ ID NO: 3699141 - RNA, 18 nt, Human
uaugcaguguagauuuua

SEQ ID NO: 3699142 - RNA, 15 nt, Human
uaugcauaaagucag

SEQ ID NO: 3699143 - RNA, 17 nt, Human
uaugcauauauauaugu

SEQ ID NO: 3699144 - RNA, 14 nt, Human
uaugcauauuuguu

SEQ ID NO: 3699145 - RNA, 16 nt, Human
uaugcaucuaauaaaa

SEQ ID NO: 3699146 - RNA, 22 nt, Human
uaugcaugaaguaauaugcaca

SEQ ID NO: 3699147 - RNA, 22 nt, Human
uaugcaugguguagaugcccug

SEQ ID NO: 3699148 - RNA, 24 nt, Human
uaugcauuugaaaauuuugauguu

SEQ ID NO: 3699149 - RNA, 20 nt, Human
uaugccacuuccuuuuaacu

SEQ ID NO: 3699150 - RNA, 14 nt, Human
uaugccagcucagu

SEQ ID NO: 3699151 - RNA, 17 nt, Human
uaugccagcucaguccc

SEQ ID NO: 3699152 - RNA, 17 nt, Human
uaugccucuccuuugua

SEQ ID NO: 3699153 - RNA, 18 nt, Human
uaugccucuccuuuguau

SEQ ID NO: 3699154 - RNA, 21 nt, Human
uaugccucuccuuuguauauu

SEQ ID NO: 3699155 - RNA, 14 nt, Human
uaugccugcucuuu

SEQ ID NO: 3699156 - RNA, 10 nt, Human
uaugccugug

SEQ ID NO: 3699157 - RNA, 14 nt, Human
uaugccuucuuauu

SEQ ID NO: 3699158 - RNA, 19 nt, Human
uaugccuucuuauugcuuu

SEQ ID NO: 3699159 - RNA, 18 nt, Human
uaugccuuggggaggaca

SEQ ID NO: 3699160 - RNA, 23 nt, Human
uaugccuuggggaggacaaaacu

SEQ ID NO: 3699161 - RNA, 20 nt, Human
uaugccuuuaaaucugugau

SEQ ID NO: 3699162 - RNA, 13 nt, Human
uaugcgguuaauu

SEQ ID NO: 3699163 - RNA, 19 nt, Human
uaugcuaccaccagcugug

SEQ ID NO: 3699164 - RNA, 18 nt, Human
uaugcuauugacaauaaa

SEQ ID NO: 3699165 - RNA, 15 nt, Human
uaugcuauuucuaua

SEQ ID NO: 3699166 - RNA, 18 nt, Human
uaugcuauuucuauauuu

SEQ ID NO: 3699167 - RNA, 23 nt, Human
uaugcuauuucuauauuuucauu

SEQ ID NO: 3699168 - RNA, 14 nt, Human
uaugcucuuuuguu

SEQ ID NO: 3699169 - RNA, 19 nt, Human
uaugcugaaacagaauacu

SEQ ID NO: 3699170 - RNA, 15 nt, Human
uaugcugaguuugug

SEQ ID NO: 3699171 - RNA, 20 nt, Human
uaugcugaucaucgccagag

SEQ ID NO: 3699172 - RNA, 11 nt, Human
uaugcugcuuu

SEQ ID NO: 3699173 - RNA, 12 nt, Human
uaugcugcuuuu

SEQ ID NO: 3699174 - RNA, 16 nt, Human
uaugcuguaaaagcaa

SEQ ID NO: 3699175 - RNA, 14 nt, Human
uaugcuguaucugu

SEQ ID NO: 3699176 - RNA, 15 nt, Human
uaugcuguaucugug

SEQ ID NO: 3699177 - RNA, 15 nt, Human
uaugcuguauuuucu

SEQ ID NO: 3699178 - RNA, 16 nt, Human
uaugcuguauuuucuu

SEQ ID NO: 3699179 - RNA, 16 nt, Human
uaugcuuaaaauaagc

SEQ ID NO: 3699180 - RNA, 21 nt, Human
uaugcuuacugauauauuuua

SEQ ID NO: 3699181 - RNA, 17 nt, Human
uaugcuuaguaaugcua

SEQ ID NO: 3699182 - RNA, 15 nt, Human
uaugcuuauacacuu

SEQ ID NO: 3699183 - RNA, 13 nt, Human
uaugcuuauuuua

SEQ ID NO: 3699184 - RNA, 14 nt, Human
uaugcuuauuuuaa

SEQ ID NO: 3699185 - RNA, 13 nt, Human
uaugcuucauaca

SEQ ID NO: 3699186 - RNA, 17 nt, Human
uaugcuucauacaggga

SEQ ID NO: 3699187 - RNA, 15 nt, Human
uaugcuucuguuuua

SEQ ID NO: 3699188 - RNA, 13 nt, Human
uaugcuucuugga

SEQ ID NO: 3699189 - RNA, 20 nt, Human
uaugcuuguaacuaaaauaa

SEQ ID NO: 3699190 - RNA, 13 nt, Human
uaugcuuuauuaa

SEQ ID NO: 3699191 - RNA, 21 nt, Human
uaugcuuuccaaaccuuaucu

SEQ ID NO: 3699192 - RNA, 15 nt, Human
uaugcuuugaaacag

SEQ ID NO: 3699193 - RNA, 21 nt, Human
uauggaaaaaccauuugaagu

SEQ ID NO: 3699194 - RNA, 20 nt, Human
uauggaaaaauaaaacuguc

SEQ ID NO: 3699195 - RNA, 13 nt, Human
uauggaaaacugu

SEQ ID NO: 3699196 - RNA, 13 nt, Human
uauggaacucucu

SEQ ID NO: 3699197 - RNA, 17 nt, Human
uauggaacuucuaauau

SEQ ID NO: 3699198 - RNA, 14 nt, Human
uauggaagaaagua

SEQ ID NO: 3699199 - RNA, 22 nt, Human
uauggaagcauauuguuauuau

SEQ ID NO: 3699200 - RNA, 19 nt, Human
uauggaaggguuuguggcu

SEQ ID NO: 3699201 - RNA, 18 nt, Human
uauggaaguugcauaauu

SEQ ID NO: 3699202 - RNA, 23 nt, Human
uauggaauacaguguuauuuucu

SEQ ID NO: 3699203 - RNA, 19 nt, Human
uauggaauugauuugcauu

SEQ ID NO: 3699204 - RNA, 20 nt, Human
uauggaauuuauaauucagu

SEQ ID NO: 3699205 - RNA, 22 nt, Human
uauggacacuggugccauguca

SEQ ID NO: 3699206 - RNA, 16 nt, Human
uauggacggugcucca

SEQ ID NO: 3699207 - RNA, 16 nt, Human
uauggacucugcacau

SEQ ID NO: 3699208 - RNA, 15 nt, Human
uauggagagaaaaca

SEQ ID NO: 3699209 - RNA, 14 nt, Human
uauggagagcccug

SEQ ID NO: 3699210 - RNA, 23 nt, Human
uauggaggagaguguuuaacuga

SEQ ID NO: 3699211 - RNA, 15 nt, Human
uauggaggauggaga

SEQ ID NO: 3699212 - RNA, 19 nt, Human
uauggaggcuuugcauaga

SEQ ID NO: 3699213 - RNA, 20 nt, Human
uauggaugauucagaaauug

SEQ ID NO: 3699214 - RNA, 15 nt, Human
uauggauguccccag

SEQ ID NO: 3699215 - RNA, 22 nt, Human
uauggauucauuuauaagaaga

SEQ ID NO: 3699216 - RNA, 15 nt, Human
uauggauucuaaaau

SEQ ID NO: 3699217 - RNA, 19 nt, Human
uauggauuuucuaaggaag

SEQ ID NO: 3699218 - RNA, 22 nt, Human
uauggcagaagacaccagagca

SEQ ID NO: 3699219 - RNA, 20 nt, Human
uauggcagaguuguaaauau

SEQ ID NO: 3699220 - RNA, 14 nt, Human
uauggcagcgaaag

SEQ ID NO: 3699221 - RNA, 13 nt, Human
uauggcagugucu

SEQ ID NO: 3699222 - RNA, 13 nt, Human
uauggcauuugca

SEQ ID NO: 3699223 - RNA, 20 nt, Human
uauggcccuggccuagcaua

SEQ ID NO: 3699224 - RNA, 12 nt, Human
uauggccucagc

SEQ ID NO: 3699225 - RNA, 19 nt, Human
uauggccucagcugccuca

SEQ ID NO: 3699226 - RNA, 13 nt, Human
uauggccuguguc

SEQ ID NO: 3699227 - RNA, 17 nt, Human
uauggcuauaggugcua

SEQ ID NO: 3699228 - RNA, 21 nt, Human
uauggcugcauaguauuccau

SEQ ID NO: 3699229 - RNA, 16 nt, Human
uaugggacucaaugca

SEQ ID NO: 3699230 - RNA, 22 nt, Human
uaugggagagugucaaccagac

SEQ ID NO: 3699231 - RNA, 16 nt, Human
uaugggagccccaggg

SEQ ID NO: 3699232 - RNA, 21 nt, Human
uauggggaagguuaucagugc

SEQ ID NO: 3699233 - RNA, 18 nt, Human
uauggguaggguaaauca

SEQ ID NO: 3699234 - RNA, 11 nt, Human
uaugggucaca

SEQ ID NO: 3699235 - RNA, 22 nt, Human
uauggguguguguuugugugag

SEQ ID NO: 3699236 - RNA, 22 nt, Human
uauggguuagauguugccaugu

SEQ ID NO: 3699237 - RNA, 13 nt, Human
uauggguuuggcu

SEQ ID NO: 3699238 - RNA, 15 nt, Human
uaugguaaaaaauuu

SEQ ID NO: 3699239 - RNA, 21 nt, Human
uaugguacauuuuucaacuuu

SEQ ID NO: 3699240 - RNA, 16 nt, Human
uaugguaccagaugca

SEQ ID NO: 3699241 - RNA, 14 nt, Human
uaugguauuugagu

SEQ ID NO: 3699242 - RNA, 22 nt, Human
uauggucaacacuuaaggguuu

SEQ ID NO: 3699243 - RNA, 15 nt, Human
uauggucauagccca

SEQ ID NO: 3699244 - RNA, 17 nt, Human
uauggucuaauguuuaa

SEQ ID NO: 3699245 - RNA, 16 nt, Human
uauggugaacccacaa

SEQ ID NO: 3699246 - RNA, 22 nt, Human
uauggugcaauguguguauaug

SEQ ID NO: 3699247 - RNA, 20 nt, Human
uaugguuacuucuucucuua

SEQ ID NO: 3699248 - RNA, 21 nt, Human
uaugguugauaguuuaccuga

SEQ ID NO: 3699249 - RNA, 22 nt, Human
uaugguuuuugagauauuaaug

SEQ ID NO: 3699250 - RNA, 23 nt, Human
uauguaaaaauaaccuugcagaa

SEQ ID NO: 3699251 - RNA, 13 nt, Human
uauguaaaacauu

SEQ ID NO: 3699252 - RNA, 12 nt, Human
uauguaaaauaa

SEQ ID NO: 3699253 - RNA, 19 nt, Human
uauguaaaauaaaauuaug

SEQ ID NO: 3699254 - RNA, 14 nt, Human
uauguaaacauaau

SEQ ID NO: 3699255 - RNA, 19 nt, Human
uauguaaacugcauuagaa

SEQ ID NO: 3699256 - RNA, 17 nt, Human
uauguaaaguauguaaa

SEQ ID NO: 3699257 - RNA, 20 nt, Human
uauguaaaucccauuauuca

SEQ ID NO: 3699258 - RNA, 24 nt, Human
uauguaacugcauugagaacugca

SEQ ID NO: 3699259 - RNA, 21 nt, Human
uauguaagaauucagaagacc

SEQ ID NO: 3699260 - RNA, 15 nt, Human
uauguaagagcaccu

SEQ ID NO: 3699261 - RNA, 17 nt, Human
uauguaaucucuaggaa

SEQ ID NO: 3699262 - RNA, 16 nt, Human
uauguaaugaaguaaa

SEQ ID NO: 3699263 - RNA, 15 nt, Human
uauguaaugcaaaau

SEQ ID NO: 3699264 - RNA, 18 nt, Human
uauguacaauauuuuaag

SEQ ID NO: 3699265 - RNA, 20 nt, Human
uauguacaauauuuuaagca

SEQ ID NO: 3699266 - RNA, 18 nt, Human
uauguacaggaugcuuug

SEQ ID NO: 3699267 - RNA, 12 nt, Human
uauguacaguua

SEQ ID NO: 3699268 - RNA, 14 nt, Human
uauguacauauaua

SEQ ID NO: 3699269 - RNA, 14 nt, Human
uauguacauuucua

SEQ ID NO: 3699270 - RNA, 15 nt, Human
uauguacauuucuaa

SEQ ID NO: 3699271 - RNA, 16 nt, Human
uucuguggcucacaga

SEQ ID NO: 3699272 - RNA, 22 nt, Human
uucugugggagaauucuuacau

SEQ ID NO: 3699273 - RNA, 20 nt, Human
uucuguggggccccucaccu

SEQ ID NO: 3699274 - RNA, 22 nt, Human
uucuguggggccccucaccuac

SEQ ID NO: 3699275 - RNA, 23 nt, Human
uucuguggggccccucaccuacu

SEQ ID NO: 3699276 - RNA, 20 nt, Human
uucugugguuggcugggaaa

SEQ ID NO: 3699277 - RNA, 18 nt, Human
uucugugguuucauguua

SEQ ID NO: 3699278 - RNA, 15 nt, Human
uucuguguaaccauu

SEQ ID NO: 3699279 - RNA, 18 nt, Human
uucuguguaaccauuuua

SEQ ID NO: 3699280 - RNA, 14 nt, Human
uucuguguaucucu

SEQ ID NO: 3699281 - RNA, 23 nt, Human
uucugugucuuucacagcuccuc

SEQ ID NO: 3699282 - RNA, 17 nt, Human
uucugugugucaguuuu

SEQ ID NO: 3699283 - RNA, 21 nt, Human
uucugugugucaguuuucaua

SEQ ID NO: 3699284 - RNA, 22 nt, Human
uucugugugugaugugcauggg

SEQ ID NO: 3699285 - RNA, 16 nt, Human
uucuguguguuccugg

SEQ ID NO: 3699286 - RNA, 20 nt, Human
uucuguguuuaauuucuuca

SEQ ID NO: 3699287 - RNA, 17 nt, Human
uucuguguuuauucaaa

SEQ ID NO: 3699288 - RNA, 21 nt, Human
uucuguuaaaaucuauucugu

SEQ ID NO: 3699289 - RNA, 16 nt, Human
uucuguuaaaaugcau

SEQ ID NO: 3699290 - RNA, 14 nt, Human
uucuguuaacugaa

SEQ ID NO: 3699291 - RNA, 21 nt, Human
uucuguuauauccccugcuac

SEQ ID NO: 3699292 - RNA, 15 nt, Human
uucuguucauuuguu

SEQ ID NO: 3699293 - RNA, 20 nt, Human
uucuguucuguggaaagugu

SEQ ID NO: 3699294 - RNA, 18 nt, Human
uucuguucuuucuggcua

SEQ ID NO: 3699295 - RNA, 17 nt, Human
uucuguugcugccucau

SEQ ID NO: 3699296 - RNA, 21 nt, Human
uucuguuggccagugugacaa

SEQ ID NO: 3699297 - RNA, 11 nt, Human
uucuguuguaa

SEQ ID NO: 3699298 - RNA, 13 nt, Human
uucuguuguaacu

SEQ ID NO: 3699299 - RNA, 20 nt, Human
uucuguugucauugcuguug

SEQ ID NO: 3699300 - RNA, 19 nt, Human
uucuguuuaauuuucacuu

SEQ ID NO: 3699301 - RNA, 18 nt, Human
uucuguuuauggccacau

SEQ ID NO: 3699302 - RNA, 21 nt, Human
uucuguuucuaauuugcugcu

SEQ ID NO: 3699303 - RNA, 23 nt, Human
uucuguuucuaauuugcugcuga

SEQ ID NO: 3699304 - RNA, 22 nt, Human
uucuguuucuauucucuccuca

SEQ ID NO: 3699305 - RNA, 15 nt, Human
uucuguuugauucuu

SEQ ID NO: 3699306 - RNA, 14 nt, Human
uucuguuuguuaaa

SEQ ID NO: 3699307 - RNA, 14 nt, Human
uucuguuuucaauc

SEQ ID NO: 3699308 - RNA, 15 nt, Human
uucuguuuucuguuu

SEQ ID NO: 3699309 - RNA, 17 nt, Human
uucuguuuugccugaag

SEQ ID NO: 3699310 - RNA, 20 nt, Human
uucuguuuuucuaggccugg

SEQ ID NO: 3699311 - RNA, 15 nt, Human
uucuuaaaauauauu

SEQ ID NO: 3699312 - RNA, 18 nt, Human
uucuuaaaaugcaauauu

SEQ ID NO: 3699313 - RNA, 21 nt, Human
uucuuaaaaugcaauauuugu

SEQ ID NO: 3699314 - RNA, 17 nt, Human
uucuuaaacaaauguau

SEQ ID NO: 3699315 - RNA, 17 nt, Human
uucuuaaacacuugcaa

SEQ ID NO: 3699316 - RNA, 13 nt, Human
uucuuaaagaguu

SEQ ID NO: 3699317 - RNA, 17 nt, Human
uucuuaaagucaagauu

SEQ ID NO: 3699318 - RNA, 13 nt, Human
uucuuaaaguuga

SEQ ID NO: 3699319 - RNA, 18 nt, Human
uucuuaaauaagaaacuu

SEQ ID NO: 3699320 - RNA, 21 nt, Human
uucuuaaauaucuuuuauguu

SEQ ID NO: 3699321 - RNA, 21 nt, Human
uucuuaaaugggcuacuuugu

SEQ ID NO: 3699322 - RNA, 16 nt, Human
uucuuaacaaccuggc

SEQ ID NO: 3699323 - RNA, 13 nt, Human
uucuuaaccaucu

SEQ ID NO: 3699324 - RNA, 20 nt, Human
uucuuaacccuuuccagagu

SEQ ID NO: 3699325 - RNA, 13 nt, Human
uucuuaacuucuu

SEQ ID NO: 3699326 - RNA, 20 nt, Human
uucuuaaggauugugauauu

SEQ ID NO: 3699327 - RNA, 22 nt, Human
uucuuaaggauugugauauuuu

SEQ ID NO: 3699328 - RNA, 23 nt, Human
uucuuaaggugaggccugucugu

SEQ ID NO: 3699329 - RNA, 14 nt, Human
uucuuaaucauuuu

SEQ ID NO: 3699330 - RNA, 21 nt, Human
uucuuaauguacauagugcua

SEQ ID NO: 3699331 - RNA, 13 nt, Human
uucuuaauuaauu

SEQ ID NO: 3699332 - RNA, 22 nt, Human
uucuuaauuauuauaaaaauau

SEQ ID NO: 3699333 - RNA, 19 nt, Human
uucuuaauucaugaggagg

SEQ ID NO: 3699334 - RNA, 17 nt, Human
uucuuaauuuggaaacu

SEQ ID NO: 3699335 - RNA, 22 nt, Human
uucuuaauuuggaaacuaauaa

SEQ ID NO: 3699336 - RNA, 23 nt, Human
uucuuaauuuggaaacuaauaaa

SEQ ID NO: 3699337 - RNA, 16 nt, Human
uucuuacacauacagu

SEQ ID NO: 3699338 - RNA, 14 nt, Human
uucuuacaugcauu

SEQ ID NO: 3699339 - RNA, 16 nt, Human
uucuuacaugcauuug

SEQ ID NO: 3699340 - RNA, 12 nt, Human
uucuuacuccuc

SEQ ID NO: 3699341 - RNA, 14 nt, Human
uucuuacugcuuaa

SEQ ID NO: 3699342 - RNA, 23 nt, Human
uucuuacuugaugaguguaacaa

SEQ ID NO: 3699343 - RNA, 22 nt, Human
uucuuagaaauuuauuuccuag

SEQ ID NO: 3699344 - RNA, 18 nt, Human
uucuuagccuguggcagu

SEQ ID NO: 3699345 - RNA, 12 nt, Human
uucuuagcucaa

SEQ ID NO: 3699346 - RNA, 18 nt, Human
uucuuaggggaaggagaa

SEQ ID NO: 3699347 - RNA, 13 nt, Human
uucuuagugacuu

SEQ ID NO: 3699348 - RNA, 18 nt, Human
uucuuaguucucacuguu

SEQ ID NO: 3699349 - RNA, 12 nt, Human
uucuuauaauac

SEQ ID NO: 3699350 - RNA, 18 nt, Human
uucuuaugaggaggggag

SEQ ID NO: 3699351 - RNA, 16 nt, Human
uucuuaugcaaaaugg

SEQ ID NO: 3699352 - RNA, 17 nt, Human
uucuuauuacuagacug

SEQ ID NO: 3699353 - RNA, 19 nt, Human
uucuuauucucacuccacc

SEQ ID NO: 3699354 - RNA, 13 nt, Human
uucuuauuuugug

SEQ ID NO: 3699355 - RNA, 22 nt, Human
uucuuauuuuuccuaacaaaag

SEQ ID NO: 3699356 - RNA, 19 nt, Human
uucuuauuuuuuucuauuu

SEQ ID NO: 3699357 - RNA, 21 nt, Human
uucuucaaaauguauauauuu

SEQ ID NO: 3699358 - RNA, 22 nt, Human
uucuucaacaucaauguucauu

SEQ ID NO: 3699359 - RNA, 14 nt, Human
uucuucaaccagca

SEQ ID NO: 3699360 - RNA, 18 nt, Human
uucuucacacagacacua

SEQ ID NO: 3699361 - RNA, 16 nt, Human
uucuucaccaaaucuu

SEQ ID NO: 3699362 - RNA, 21 nt, Human
uucuucaccuaagucucugug

SEQ ID NO: 3699363 - RNA, 14 nt, Human
uucuucagccaccu

SEQ ID NO: 3699364 - RNA, 23 nt, Human
uucuucagccaccucucuuuuuc

SEQ ID NO: 3699365 - RNA, 22 nt, Human
uucuucagcguaaaauggugaa

SEQ ID NO: 3699366 - RNA, 11 nt, Human
uucuucaguug

SEQ ID NO: 3699367 - RNA, 17 nt, Human
uucuucaugcaaugaca

SEQ ID NO: 3699368 - RNA, 15 nt, Human
uucuucauguucaau

SEQ ID NO: 3699369 - RNA, 21 nt, Human
uucuuccacaagagcccaggc

SEQ ID NO: 3699370 - RNA, 11 nt, Human
uucuuccagga

SEQ ID NO: 3699371 - RNA, 11 nt, Human
uucuuccaguu

SEQ ID NO: 3699372 - RNA, 22 nt, Human
uucuuccaguuacuuuccaauu

SEQ ID NO: 3699373 - RNA, 14 nt, Human
uucuuccaucccag

SEQ ID NO: 3699374 - RNA, 19 nt, Human
uucuucccaucacuggagc

SEQ ID NO: 3699375 - RNA, 17 nt, Human
uucuucccuuaucccug

SEQ ID NO: 3699376 - RNA, 21 nt, Human
uucuucccuuuuacauacugc

SEQ ID NO: 3699377 - RNA, 22 nt, Human
uucuucccuuuuacauacugcu

SEQ ID NO: 3699378 - RNA, 12 nt, Human
uucuuccucagc

SEQ ID NO: 3699379 - RNA, 13 nt, Human
uucuuccucagcc

SEQ ID NO: 3699380 - RNA, 14 nt, Human
uucuuccucagcca

SEQ ID NO: 3699381 - RNA, 17 nt, Human
uucuuccucagccagcc

SEQ ID NO: 3699382 - RNA, 13 nt, Human
uucuuccucccuc

SEQ ID NO: 3699383 - RNA, 14 nt, Human
uucuuccuggccgc

SEQ ID NO: 3699384 - RNA, 16 nt, Human
uucuuccuuuucacug

SEQ ID NO: 3699385 - RNA, 16 nt, Human
uucuucgacuguuguu

SEQ ID NO: 3699386 - RNA, 23 nt, Human
uucuucuauguaggaaaaaaaua

SEQ ID NO: 3699387 - RNA, 22 nt, Human
uucuucuccacuuucuagccag

SEQ ID NO: 3699388 - RNA, 15 nt, Human
uucuucuccuaugug

SEQ ID NO: 3699389 - RNA, 13 nt, Human
uucuucugaacuc

SEQ ID NO: 3699390 - RNA, 20 nt, Human
uucuucugaacucaaacuga

SEQ ID NO: 3699391 - RNA, 23 nt, Human
uucuucugaacucaaacugagga

SEQ ID NO: 3699392 - RNA, 15 nt, Human
uucuucugcuucagc

SEQ ID NO: 3699393 - RNA, 15 nt, Human
uucuucuguaauauu

SEQ ID NO: 3699394 - RNA, 20 nt, Human
uucuucuguccugagaagca

SEQ ID NO: 3699395 - RNA, 20 nt, Human
uucuucuguguuuauaaaau

SEQ ID NO: 3699396 - RNA, 16 nt, Human
uucuucuguucugcag

SEQ ID NO: 3699397 - RNA, 13 nt, Human
uucuucuucagaa

SEQ ID NO: 3699398 - RNA, 15 nt, Human
uucuucuucagaaga

SEQ ID NO: 3699399 - RNA, 13 nt, Human
uucuucuucccuc

SEQ ID NO: 3699400 - RNA, 13 nt, Human
uucuucuuccuga

SEQ ID NO: 3699401 - RNA, 12 nt, Human
uucuucuuuaau

SEQ ID NO: 3699402 - RNA, 15 nt, Human
uucuucuuuuugcug

SEQ ID NO: 3699403 - RNA, 16 nt, Human
uucuucuuuuugcugu

SEQ ID NO: 3699404 - RNA, 21 nt, Human
uucuucuuuuugcuucaaaaa

SEQ ID NO: 3699405 - RNA, 13 nt, Human
uucuugaaagcug

SEQ ID NO: 3699406 - RNA, 21 nt, Human
uucuugaauuuaauaaucugu

SEQ ID NO: 3699407 - RNA, 21 nt, Human
uucuugacaaaaccuaacuug

SEQ ID NO: 3699408 - RNA, 19 nt, Human
uucuugaggggaccaggag

SEQ ID NO: 3699409 - RNA, 21 nt, Human
uucuugaucaacaucuuuucu

SEQ ID NO: 3699410 - RNA, 21 nt, Human
uucuugaugacuggaauuuuu

SEQ ID NO: 3699411 - RNA, 22 nt, Human
uucuugaugacuggaauuuuua

SEQ ID NO: 3699412 - RNA, 14 nt, Human
uucuugauguaaaa

SEQ ID NO: 3699413 - RNA, 16 nt, Human
uucuugauguugcuua

SEQ ID NO: 3699414 - RNA, 20 nt, Human
uucuugcauauuuuguaacu

SEQ ID NO: 3699415 - RNA, 20 nt, Human
uucuugcauccuuccuauaa

SEQ ID NO: 3699416 - RNA, 16 nt, Human
uucuugccucugugcu

SEQ ID NO: 3699417 - RNA, 15 nt, Human
uucuugcugcccugc

SEQ ID NO: 3699418 - RNA, 12 nt, Human
uucuugcugcua

SEQ ID NO: 3699419 - RNA, 13 nt, Human
uucuugcugcuag

SEQ ID NO: 3699420 - RNA, 16 nt, Human
uuucaaacauauauaa

SEQ ID NO: 3699421 - RNA, 19 nt, Human
uuucaaacuuacuauuuug

SEQ ID NO: 3699422 - RNA, 15 nt, Human
uuucaaacuuuacua

SEQ ID NO: 3699423 - RNA, 22 nt, Human
uuucaaacuuuauugacaagug

SEQ ID NO: 3699424 - RNA, 19 nt, Human
uuucaaagaugcugugagu

SEQ ID NO: 3699425 - RNA, 16 nt, Human
uuucaaagauucaaaa

SEQ ID NO: 3699426 - RNA, 22 nt, Human
uuucaaagcaauugaaaugcau

SEQ ID NO: 3699427 - RNA, 17 nt, Human
uuucaaagggagagaga

SEQ ID NO: 3699428 - RNA, 14 nt, Human
uuucaaauguucuc

SEQ ID NO: 3699429 - RNA, 16 nt, Human
uuucaaauugagagaa

SEQ ID NO: 3699430 - RNA, 18 nt, Human
uuucaaauuuagaaacua

SEQ ID NO: 3699431 - RNA, 17 nt, Human
uuucaacagugaagaca

SEQ ID NO: 3699432 - RNA, 19 nt, Human
uuucaacagugaagacaga

SEQ ID NO: 3699433 - RNA, 15 nt, Human
uuucaacggaaagug

SEQ ID NO: 3699434 - RNA, 13 nt, Human
uuucaacucauug

SEQ ID NO: 3699435 - RNA, 16 nt, Human
uuucaacugccaaaau

SEQ ID NO: 3699436 - RNA, 22 nt, Human
uuucaacuuggcuuccuuucuu

SEQ ID NO: 3699437 - RNA, 21 nt, Human
uuucaagaaaaaauaaaugga

SEQ ID NO: 3699438 - RNA, 15 nt, Human
uuucaagaaccugga

SEQ ID NO: 3699439 - RNA, 17 nt, Human
uuucaagaaccuggaaa

SEQ ID NO: 3699440 - RNA, 16 nt, Human
uuucaagaacuuguuu

SEQ ID NO: 3699441 - RNA, 18 nt, Human
uuucaagacugaauucca

SEQ ID NO: 3699442 - RNA, 21 nt, Human
uuucaagagucuaauagucuu

SEQ ID NO: 3699443 - RNA, 22 nt, Human
uuucaagagucuaauagucuuu

SEQ ID NO: 3699444 - RNA, 23 nt, Human
uuucaagcagucgugccuguguc

SEQ ID NO: 3699445 - RNA, 14 nt, Human
uuucaagcaucucc

SEQ ID NO: 3699446 - RNA, 17 nt, Human
uuucaagcaucuccuga

SEQ ID NO: 3699447 - RNA, 18 nt, Human
uuucaaggcacucuagau

SEQ ID NO: 3699448 - RNA, 17 nt, Human
uuucaaggcccucagca

SEQ ID NO: 3699449 - RNA, 13 nt, Human
uuucaagguucua

SEQ ID NO: 3699450 - RNA, 14 nt, Human
uuucaagguucuaa

SEQ ID NO: 3699451 - RNA, 18 nt, Human
uuucaagucaaauuaaua

SEQ ID NO: 3699452 - RNA, 23 nt, Human
uuucaagugccuuucugcaguuu

SEQ ID NO: 3699453 - RNA, 18 nt, Human
uuucaaguuuuaaaguuc

SEQ ID NO: 3699454 - RNA, 19 nt, Human
uuucaauaaagcauuuaua

SEQ ID NO: 3699455 - RNA, 18 nt, Human
uuucaauaacgaaguugg

SEQ ID NO: 3699456 - RNA, 16 nt, Human
uuucaauacagauaua

SEQ ID NO: 3699457 - RNA, 21 nt, Human
uuucaauagccacuaaccuug

SEQ ID NO: 3699458 - RNA, 22 nt, Human
uuucaauaggaaaaacugauuu

SEQ ID NO: 3699459 - RNA, 17 nt, Human
uuucaauauauugaacu

SEQ ID NO: 3699460 - RNA, 23 nt, Human
uuucaaugugauauaaacagcuu

SEQ ID NO: 3699461 - RNA, 13 nt, Human
uuucaaugugauu

SEQ ID NO: 3699462 - RNA, 14 nt, Human
uuucaaugugauuc

SEQ ID NO: 3699463 - RNA, 22 nt, Human
uuucaaugugauucuaaugucu

SEQ ID NO: 3699464 - RNA, 23 nt, Human
uuucaauguguugauacauuccc

SEQ ID NO: 3699465 - RNA, 13 nt, Human
uuucaauuaaacg

SEQ ID NO: 3699466 - RNA, 17 nt, Human
uuucaauuaaacggauu

SEQ ID NO: 3699467 - RNA, 18 nt, Human
uuucaauuaaacggauua

SEQ ID NO: 3699468 - RNA, 17 nt, Human
uuucaauucaaaaaugu

SEQ ID NO: 3699469 - RNA, 14 nt, Human
uuucaauucucaaa

SEQ ID NO: 3699470 - RNA, 18 nt, Human
uuucaauugcaucuccca

SEQ ID NO: 3699471 - RNA, 20 nt, Human
uuucaauugcaucucccaga

SEQ ID NO: 3699472 - RNA, 14 nt, Human
uuucaauuuccaag

SEQ ID NO: 3699473 - RNA, 16 nt, Human
uuucaauuuuaaacau

SEQ ID NO: 3699474 - RNA, 17 nt, Human
uuucaauuuugcaugcu

SEQ ID NO: 3699475 - RNA, 13 nt, Human
uuucacaaauaaa

SEQ ID NO: 3699476 - RNA, 13 nt, Human
uuucacaaauauu

SEQ ID NO: 3699477 - RNA, 17 nt, Human
uuucacaaauauuaaaa

SEQ ID NO: 3699478 - RNA, 13 nt, Human
uuucacaacauuu

SEQ ID NO: 3699479 - RNA, 20 nt, Human
uuucacaccggaagguuuuu

SEQ ID NO: 3699480 - RNA, 23 nt, Human
uuucacaccugaaaauguuagug

SEQ ID NO: 3699481 - RNA, 20 nt, Human
uuucacaggugugguguaau

SEQ ID NO: 3699482 - RNA, 20 nt, Human
uuucacagugugauuuugau

SEQ ID NO: 3699483 - RNA, 21 nt, Human
uuucacauaaaugcagcccau

SEQ ID NO: 3699484 - RNA, 21 nt, Human
uuucacauagcccacuuacau

SEQ ID NO: 3699485 - RNA, 16 nt, Human
uuucacauagcugucu

SEQ ID NO: 3699486 - RNA, 20 nt, Human
uuucacauuaauggucuaaa

SEQ ID NO: 3699487 - RNA, 18 nt, Human
uuucacauuagaagacaa

SEQ ID NO: 3699488 - RNA, 16 nt, Human
uuucacauucuuauaa

SEQ ID NO: 3699489 - RNA, 13 nt, Human
uuucacauuggaa

SEQ ID NO: 3699490 - RNA, 15 nt, Human
uuucacauuguuugc

SEQ ID NO: 3699491 - RNA, 14 nt, Human
uuucacauuuuccu

SEQ ID NO: 3699492 - RNA, 22 nt, Human
uuucaccccucccuuucucccc

SEQ ID NO: 3699493 - RNA, 16 nt, Human
uuucaccuacuuugua

SEQ ID NO: 3699494 - RNA, 17 nt, Human
uuucaccuccuucaauu

SEQ ID NO: 3699495 - RNA, 15 nt, Human
uuucaccugcugcuu

SEQ ID NO: 3699496 - RNA, 18 nt, Human
uuucaccuggaagcauuu

SEQ ID NO: 3699497 - RNA, 22 nt, Human
uuucaccuggaagcauuuguuu

SEQ ID NO: 3699498 - RNA, 17 nt, Human
uuucaccuguaaaccug

SEQ ID NO: 3699499 - RNA, 18 nt, Human
uuucaccuguaaaccuga

SEQ ID NO: 3699500 - RNA, 14 nt, Human
uuucaccuuuacuu

SEQ ID NO: 3699501 - RNA, 16 nt, Human
uuucaccuuuacuuua

SEQ ID NO: 3699502 - RNA, 16 nt, Human
uuucaccuuuucagga

SEQ ID NO: 3699503 - RNA, 16 nt, Human
uuucacgauucauuuu

SEQ ID NO: 3699504 - RNA, 22 nt, Human
uuucacggugccagguuuucug

SEQ ID NO: 3699505 - RNA, 16 nt, Human
uuucacuauaauguga

SEQ ID NO: 3699506 - RNA, 20 nt, Human
uuucacuauaaugugaaaug

SEQ ID NO: 3699507 - RNA, 16 nt, Human
uuucacuauuuccuuu

SEQ ID NO: 3699508 - RNA, 19 nt, Human
uuucacuauuuuuauuuau

SEQ ID NO: 3699509 - RNA, 19 nt, Human
uuucacucuaagucaugua

SEQ ID NO: 3699510 - RNA, 15 nt, Human
uuucacucuccuugg

SEQ ID NO: 3699511 - RNA, 24 nt, Human
uuucacucuuauugcccacgcugg

SEQ ID NO: 3699512 - RNA, 14 nt, Human
uuucacugcuggcu

SEQ ID NO: 3699513 - RNA, 24 nt, Human
uuucacugcuggcugccuuagaac

SEQ ID NO: 3699514 - RNA, 23 nt, Human
uuucacugcuguuauauuucauc

SEQ ID NO: 3699515 - RNA, 15 nt, Human
uuucacugucugucu

SEQ ID NO: 3699516 - RNA, 21 nt, Human
uuucacugucuuuaauucugu

SEQ ID NO: 3699517 - RNA, 15 nt, Human
uuucacuuauaccug

SEQ ID NO: 3699518 - RNA, 20 nt, Human
uuucacuucgggcuguguaa

SEQ ID NO: 3699519 - RNA, 17 nt, Human
uuucacuuuagaugcug

SEQ ID NO: 3699520 - RNA, 13 nt, Human
uuucagaaaacag

SEQ ID NO: 3699521 - RNA, 21 nt, Human
uuucagaaagaaguggggaca

SEQ ID NO: 3699522 - RNA, 16 nt, Human
uuucagaaagccuuuc

SEQ ID NO: 3699523 - RNA, 21 nt, Human
uuucagaaagccuuucauuuu

SEQ ID NO: 3699524 - RNA, 13 nt, Human
uuucagaaauaua

SEQ ID NO: 3699525 - RNA, 20 nt, Human
uuucagaaauauaacacauu

SEQ ID NO: 3699526 - RNA, 11 nt, Human
uuucagaaaug

SEQ ID NO: 3699527 - RNA, 12 nt, Human
uuucagaaaugu

SEQ ID NO: 3699528 - RNA, 13 nt, Human
uuucagaaaugug

SEQ ID NO: 3699529 - RNA, 13 nt, Human
uuucagaagaaau

SEQ ID NO: 3699530 - RNA, 23 nt, Human
uuucagaaguuaguuuguauaua

SEQ ID NO: 3699531 - RNA, 15 nt, Human
uuucagaauauguca

SEQ ID NO: 3699532 - RNA, 10 nt, Human
uuucagaccc

SEQ ID NO: 3699533 - RNA, 12 nt, Human
uuucagaccuuu

SEQ ID NO: 3699534 - RNA, 15 nt, Human
uuucagacugcuuua

SEQ ID NO: 3699535 - RNA, 18 nt, Human
uuucagaguucuuuuuga

SEQ ID NO: 3699536 - RNA, 18 nt, Human
uuucagauaacuguuauu

SEQ ID NO: 3699537 - RNA, 13 nt, Human
uuucagauacugg

SEQ ID NO: 3699538 - RNA, 21 nt, Human
uuucagauacuggauuguacu

SEQ ID NO: 3699539 - RNA, 15 nt, Human
uuucagauauauauc

SEQ ID NO: 3699540 - RNA, 16 nt, Human
uuucagauauauauca

SEQ ID NO: 3699541 - RNA, 12 nt, Human
uuucagaugcuu

SEQ ID NO: 3699542 - RNA, 16 nt, Human
uuucagauguaauguu

SEQ ID NO: 3699543 - RNA, 17 nt, Human
uuucagauguaauguuu

SEQ ID NO: 3699544 - RNA, 15 nt, Human
uuucagaugucuucu

SEQ ID NO: 3699545 - RNA, 11 nt, Human
uuucagaugug

SEQ ID NO: 3699546 - RNA, 18 nt, Human
uuucagaugugaaccauu

SEQ ID NO: 3699547 - RNA, 15 nt, Human
uuucagauuugcaca

SEQ ID NO: 3699548 - RNA, 17 nt, Human
uuucagauuugcacaaa

SEQ ID NO: 3699549 - RNA, 19 nt, Human
uuucagauuugcacaaaaa

SEQ ID NO: 3699550 - RNA, 22 nt, Human
uuucagcacuagccaaaccuca

SEQ ID NO: 3699551 - RNA, 23 nt, Human
uuucagcacuagccaaaccucac

SEQ ID NO: 3699552 - RNA, 21 nt, Human
uuucagcagacuaugaauauu

SEQ ID NO: 3699553 - RNA, 18 nt, Human
uuucagcgacuccguugg

SEQ ID NO: 3699554 - RNA, 23 nt, Human
uuucagcgacuccguuggccacu

SEQ ID NO: 3699555 - RNA, 22 nt, Human
uuucagcgauguaugcagcuau

SEQ ID NO: 3699556 - RNA, 15 nt, Human
uuucagcuaucagua

SEQ ID NO: 3699557 - RNA, 11 nt, Human
uuucagcucuc

SEQ ID NO: 3699558 - RNA, 16 nt, Human
uuucagcucucuguau

SEQ ID NO: 3699559 - RNA, 16 nt, Human
uuucagcugucuuuug

SEQ ID NO: 3699560 - RNA, 14 nt, Human
uuucagcugugaac

SEQ ID NO: 3699561 - RNA, 14 nt, Human
uuucagcuuacaca

SEQ ID NO: 3699562 - RNA, 19 nt, Human
uuucagcuucugcugggcu

SEQ ID NO: 3699563 - RNA, 19 nt, Human
uuucaggauacucugucag

SEQ ID NO: 3699564 - RNA, 13 nt, Human
uuucaggaucuau

SEQ ID NO: 3699565 - RNA, 16 nt, Human
uuucaggaucuauuuu

SEQ ID NO: 3699566 - RNA, 22 nt, Human
uuucaggcaggcaccuagcaau

SEQ ID NO: 3699567 - RNA, 13 nt, Human
uuucagggcuggc

SEQ ID NO: 3699568 - RNA, 18 nt, Human
uuucagggcuggcuccug

SEQ ID NO: 3699569 - RNA, 16 nt, Human
uuucaggguuuucuga

SEQ ID NO: 3699570 - RNA, 15 nt, Human
uucuugcugcuagaa

SEQ ID NO: 3699571 - RNA, 17 nt, Human
uucuugcugcuagaacu

SEQ ID NO: 3699572 - RNA, 20 nt, Human
uucuugcugcuagaacuuuu

SEQ ID NO: 3699573 - RNA, 23 nt, Human
uucuugcugcuagaacuuuuuua

SEQ ID NO: 3699574 - RNA, 13 nt, Human
uucuugcuuguac

SEQ ID NO: 3699575 - RNA, 22 nt, Human
uucuugcuuguaccucuggcug

SEQ ID NO: 3699576 - RNA, 23 nt, Human
uucuugcuuguaccucuggcuga

SEQ ID NO: 3699577 - RNA, 17 nt, Human
uucuuggacacuuaauu

SEQ ID NO: 3699578 - RNA, 23 nt, Human
uucuuggacacuuaauucuguuc

SEQ ID NO: 3699579 - RNA, 19 nt, Human
uucuuggcaaaagccuugu

SEQ ID NO: 3699580 - RNA, 20 nt, Human
uucuuggcaaaagccuugug

SEQ ID NO: 3699581 - RNA, 22 nt, Human
uucuuggcuuaaucauuuucau

SEQ ID NO: 3699582 - RNA, 17 nt, Human
uucuuggggcccagugc

SEQ ID NO: 3699583 - RNA, 18 nt, Human
uucuuggggcccagugca

SEQ ID NO: 3699584 - RNA, 15 nt, Human
uucuugguagagauu

SEQ ID NO: 3699585 - RNA, 16 nt, Human
uucuugguugaggaaa

SEQ ID NO: 3699586 - RNA, 16 nt, Human
uucuugguuggcuggc

SEQ ID NO: 3699587 - RNA, 20 nt, Human
uucuugguuggcuggccuuc

SEQ ID NO: 3699588 - RNA, 16 nt, Human
uucuugguuuguaaau

SEQ ID NO: 3699589 - RNA, 19 nt, Human
uucuuguaaggcuuugauu

SEQ ID NO: 3699590 - RNA, 14 nt, Human
uucuuguaucugga

SEQ ID NO: 3699591 - RNA, 18 nt, Human
uucuuguauuaagaauga

SEQ ID NO: 3699592 - RNA, 13 nt, Human
uucuuguauuuau

SEQ ID NO: 3699593 - RNA, 16 nt, Human
uucuugucacaauaaa

SEQ ID NO: 3699594 - RNA, 19 nt, Human
uucuugucagacauaaagc

SEQ ID NO: 3699595 - RNA, 21 nt, Human
uucuugucagacauaaagcca

SEQ ID NO: 3699596 - RNA, 11 nt, Human
uucuugucuau

SEQ ID NO: 3699597 - RNA, 18 nt, Human
uucuugucuauaaagcau

SEQ ID NO: 3699598 - RNA, 14 nt, Human
uucuugucuauagu

SEQ ID NO: 3699599 - RNA, 19 nt, Human
uucuugucugauuggcuca

SEQ ID NO: 3699600 - RNA, 14 nt, Human
uucuuguguguuua

SEQ ID NO: 3699601 - RNA, 21 nt, Human
uucuuguguguuuauugucaa

SEQ ID NO: 3699602 - RNA, 23 nt, Human
uucuuguuaguacuauaucuguu

SEQ ID NO: 3699603 - RNA, 14 nt, Human
uucuuguucuguuu

SEQ ID NO: 3699604 - RNA, 14 nt, Human
uucuuguuggugca

SEQ ID NO: 3699605 - RNA, 13 nt, Human
uucuuuaaaagaa

SEQ ID NO: 3699606 - RNA, 14 nt, Human
uucuuuaaacacuc

SEQ ID NO: 3699607 - RNA, 14 nt, Human
uucuuuaaagaagu

SEQ ID NO: 3699608 - RNA, 20 nt, Human
uucuuuaaaguucuucuaag

SEQ ID NO: 3699609 - RNA, 13 nt, Human
uucuuuaaauguu

SEQ ID NO: 3699610 - RNA, 13 nt, Human
uucuuuaaauuau

SEQ ID NO: 3699611 - RNA, 15 nt, Human
uucuuuaaauuaugu

SEQ ID NO: 3699612 - RNA, 19 nt, Human
uucuuuaaccuuguauaaa

SEQ ID NO: 3699613 - RNA, 17 nt, Human
uucuuuaauuuuggaau

SEQ ID NO: 3699614 - RNA, 14 nt, Human
uucuuuagagaacu

SEQ ID NO: 3699615 - RNA, 19 nt, Human
uucuuuagagaacugaaaa

SEQ ID NO: 3699616 - RNA, 14 nt, Human
uucuuuauaaacuu

SEQ ID NO: 3699617 - RNA, 18 nt, Human
uucuuuauacaacagugc

SEQ ID NO: 3699618 - RNA, 15 nt, Human
uucuuuauacuguaa

SEQ ID NO: 3699619 - RNA, 18 nt, Human
uucuuuauauacaauaau

SEQ ID NO: 3699620 - RNA, 21 nt, Human
uucuuuauauacaauaaugga

SEQ ID NO: 3699621 - RNA, 23 nt, Human
uucuuucaagggcuuuccugugc

SEQ ID NO: 3699622 - RNA, 12 nt, Human
uucuuucagaaa

SEQ ID NO: 3699623 - RNA, 12 nt, Human
uucuuuccagag

SEQ ID NO: 3699624 - RNA, 14 nt, Human
uucuuuccauuaug

SEQ ID NO: 3699625 - RNA, 15 nt, Human
uucuuuccauuugca

SEQ ID NO: 3699626 - RNA, 16 nt, Human
uucuuucccagucugu

SEQ ID NO: 3699627 - RNA, 13 nt, Human
uucuuucccagug

SEQ ID NO: 3699628 - RNA, 21 nt, Human
uucuuucccugcuuaaugaaa

SEQ ID NO: 3699629 - RNA, 14 nt, Human
uucuuucccuuccu

SEQ ID NO: 3699630 - RNA, 22 nt, Human
uucuuuccucuuccccuugccc

SEQ ID NO: 3699631 - RNA, 13 nt, Human
uucuuuccugccu

SEQ ID NO: 3699632 - RNA, 19 nt, Human
uucuuucuaguucagcugc

SEQ ID NO: 3699633 - RNA, 20 nt, Human
uucuuucuggcuaugcauuu

SEQ ID NO: 3699634 - RNA, 15 nt, Human
uucuuucugucuuua

SEQ ID NO: 3699635 - RNA, 13 nt, Human
uucuuucuuccuc

SEQ ID NO: 3699636 - RNA, 15 nt, Human
uucuuucuuccucug

SEQ ID NO: 3699637 - RNA, 20 nt, Human
uucuuugaaaaaaaauaaau

SEQ ID NO: 3699638 - RNA, 13 nt, Human
uucuuugaauaaa

SEQ ID NO: 3699639 - RNA, 19 nt, Human
uucuuugaauaaaugucac

SEQ ID NO: 3699640 - RNA, 15 nt, Human
uucuuugaauuuuca

SEQ ID NO: 3699641 - RNA, 18 nt, Human
uucuuugaauuuucauuu

SEQ ID NO: 3699642 - RNA, 17 nt, Human
uucuuugauaauguuaa

SEQ ID NO: 3699643 - RNA, 18 nt, Human
uucuuugauaauguuaaa

SEQ ID NO: 3699644 - RNA, 16 nt, Human
uucuuugaucaugaau

SEQ ID NO: 3699645 - RNA, 13 nt, Human
uucuuugauguua

SEQ ID NO: 3699646 - RNA, 18 nt, Human
uucuuugauguuaacaca

SEQ ID NO: 3699647 - RNA, 15 nt, Human
uucuuugcaaaaauc

SEQ ID NO: 3699648 - RNA, 16 nt, Human
uucuuugcaaaaaucc

SEQ ID NO: 3699649 - RNA, 15 nt, Human
uucuuugccaucucu

SEQ ID NO: 3699650 - RNA, 19 nt, Human
uucuuugccaucucugcuc

SEQ ID NO: 3699651 - RNA, 21 nt, Human
uucuuugccaucucugcucca

SEQ ID NO: 3699652 - RNA, 18 nt, Human
uucuuugccuguucaguu

SEQ ID NO: 3699653 - RNA, 16 nt, Human
uucuuugcuugaacac

SEQ ID NO: 3699654 - RNA, 20 nt, Human
uucuuuggaaaguacacucu

SEQ ID NO: 3699655 - RNA, 22 nt, Human
uucuuugggaauauuugaaucu

SEQ ID NO: 3699656 - RNA, 13 nt, Human
uucuuugggccag

SEQ ID NO: 3699657 - RNA, 14 nt, Human
uucuuuggugccuu

SEQ ID NO: 3699658 - RNA, 19 nt, Human
uucuuuggugccuuuccug

SEQ ID NO: 3699659 - RNA, 12 nt, Human
uucuuuguauca

SEQ ID NO: 3699660 - RNA, 11 nt, Human
uucuuuguguu

SEQ ID NO: 3699661 - RNA, 16 nt, Human
uucuuuguuacaggca

SEQ ID NO: 3699662 - RNA, 19 nt, Human
uucuuuuaacuucuuucua

SEQ ID NO: 3699663 - RNA, 14 nt, Human
uucuuuuaagaauc

SEQ ID NO: 3699664 - RNA, 12 nt, Human
uucuuuuaucac

SEQ ID NO: 3699665 - RNA, 17 nt, Human
uucuuuucacauucuua

SEQ ID NO: 3699666 - RNA, 14 nt, Human
uucuuuucucagug

SEQ ID NO: 3699667 - RNA, 15 nt, Human
uucuuuucuuuguau

SEQ ID NO: 3699668 - RNA, 14 nt, Human
uucuuuucuuuuua

SEQ ID NO: 3699669 - RNA, 12 nt, Human
uucuuuugaauu

SEQ ID NO: 3699670 - RNA, 14 nt, Human
uucuuuugccauga

SEQ ID NO: 3699671 - RNA, 21 nt, Human
uucuuuugcccuucacagugu

SEQ ID NO: 3699672 - RNA, 23 nt, Human
uucuuuugcccuucacaguguuu

SEQ ID NO: 3699673 - RNA, 12 nt, Human
uucuuuuguaaa

SEQ ID NO: 3699674 - RNA, 14 nt, Human
uucuuuuguaagug

SEQ ID NO: 3699675 - RNA, 20 nt, Human
uucuuuuguauguaaaugug

SEQ ID NO: 3699676 - RNA, 15 nt, Human
uucuuuuguuacugu

SEQ ID NO: 3699677 - RNA, 19 nt, Human
uucuuuuguuuuuugaagu

SEQ ID NO: 3699678 - RNA, 16 nt, Human
uucuuuuuauuuuuua

SEQ ID NO: 3699679 - RNA, 13 nt, Human
uucuuuuucugga

SEQ ID NO: 3699680 - RNA, 14 nt, Human
uucuuuuucuggac

SEQ ID NO: 3699681 - RNA, 18 nt, Human
uucuuuuucuucuucccu

SEQ ID NO: 3699682 - RNA, 15 nt, Human
uucuuuuugaaaugu

SEQ ID NO: 3699683 - RNA, 15 nt, Human
uucuuuuugaaguau

SEQ ID NO: 3699684 - RNA, 16 nt, Human
uucuuuuugaaguauu

SEQ ID NO: 3699685 - RNA, 17 nt, Human
uucuuuuugaucaucuu

SEQ ID NO: 3699686 - RNA, 12 nt, Human
uucuuuuugcuc

SEQ ID NO: 3699687 - RNA, 21 nt, Human
uucuuuuugcucuaaaauauu

SEQ ID NO: 3699688 - RNA, 14 nt, Human
uucuuuuugcuguu

SEQ ID NO: 3699689 - RNA, 19 nt, Human
uucuuuuugggagagacuu

SEQ ID NO: 3699690 - RNA, 21 nt, Human
uucuuuuugggagagacuugu

SEQ ID NO: 3699691 - RNA, 17 nt, Human
uucuuuuuuaaauuaau

SEQ ID NO: 3699692 - RNA, 23 nt, Human
uucuuuuuuaaauuuucuucagu

SEQ ID NO: 3699693 - RNA, 16 nt, Human
uucuuuuuuauuaauc

SEQ ID NO: 3699694 - RNA, 20 nt, Human
uucuuuuuuauuaaucacug

SEQ ID NO: 3699695 - RNA, 21 nt, Human
uucuuuuuuauuaaucacugu

SEQ ID NO: 3699696 - RNA, 20 nt, Human
uucuuuuuuuuuaaguucuu

SEQ ID NO: 3699697 - RNA, 22 nt, Human
uucuuuuuuuuuuuuuugagac

SEQ ID NO: 3699698 - RNA, 20 nt, Human
uugaaaaaaacuucauucuc

SEQ ID NO: 3699699 - RNA, 22 nt, Human
uugaaaaaagaaauucccugga

SEQ ID NO: 3699700 - RNA, 13 nt, Human
uugaaaaaagcuc

SEQ ID NO: 3699701 - RNA, 20 nt, Human
uugaaaaaagcucauuucau

SEQ ID NO: 3699702 - RNA, 22 nt, Human
uugaaaaaauagagccugaggg

SEQ ID NO: 3699703 - RNA, 21 nt, Human
uugaaaaaauuuaaaaguaaa

SEQ ID NO: 3699704 - RNA, 14 nt, Human
uugaaaaagacauu

SEQ ID NO: 3699705 - RNA, 16 nt, Human
uugaaaaagacauuca

SEQ ID NO: 3699706 - RNA, 12 nt, Human
uugaaaaagcag

SEQ ID NO: 3699707 - RNA, 15 nt, Human
uugaaaaaguuuguu

SEQ ID NO: 3699708 - RNA, 13 nt, Human
uugaaaaauauaa

SEQ ID NO: 3699709 - RNA, 17 nt, Human
uugaaaaauauaaaauu

SEQ ID NO: 3699710 - RNA, 21 nt, Human
uugaaaaaugugcaaaacagc

SEQ ID NO: 3699711 - RNA, 23 nt, Human
uugaaaaauuccuauugugauuu

SEQ ID NO: 3699712 - RNA, 15 nt, Human
uugaaaacagaaauu

SEQ ID NO: 3699713 - RNA, 18 nt, Human
uugaaaacauaaucugca

SEQ ID NO: 3699714 - RNA, 20 nt, Human
uugaaaaccaaaaugacauc

SEQ ID NO: 3699715 - RNA, 23 nt, Human
uugaaaaccaaaaugacaucuuu

SEQ ID NO: 3699716 - RNA, 16 nt, Human
uugaaaacuacauuuu

SEQ ID NO: 3699717 - RNA, 21 nt, Human
uugaaaacuacauuuuaacau

SEQ ID NO: 3699718 - RNA, 18 nt, Human
uugaaaagacuccaaaga

SEQ ID NO: 3699719 - RNA, 21 nt, Human
uugaaaagaggugugcaagag

SEQ ID NO: 3699720 - RNA, 15 nt, Human
uugaaaagcagacau

SEQ ID NO: 3699721 - RNA, 17 nt, Human
uauguacauuucuaagu

SEQ ID NO: 3699722 - RNA, 21 nt, Human
uauguacauuucuaagucaaa

SEQ ID NO: 3699723 - RNA, 16 nt, Human
uauguaccauguacau

SEQ ID NO: 3699724 - RNA, 20 nt, Human
uauguacccucugaaauaca

SEQ ID NO: 3699725 - RNA, 16 nt, Human
uauguacguuuguaug

SEQ ID NO: 3699726 - RNA, 18 nt, Human
uauguacguuuguaugug

SEQ ID NO: 3699727 - RNA, 19 nt, Human
uauguacguuuguaugugu

SEQ ID NO: 3699728 - RNA, 14 nt, Human
uauguacuacauga

SEQ ID NO: 3699729 - RNA, 18 nt, Human
uauguacuaguacugugu

SEQ ID NO: 3699730 - RNA, 19 nt, Human
uauguacuaguacugugua

SEQ ID NO: 3699731 - RNA, 23 nt, Human
uauguacuaguacuguguacugu

SEQ ID NO: 3699732 - RNA, 14 nt, Human
uauguacuaguguu

SEQ ID NO: 3699733 - RNA, 21 nt, Human
uauguacuccucuuuacacug

SEQ ID NO: 3699734 - RNA, 19 nt, Human
uauguacuugucaaagaag

SEQ ID NO: 3699735 - RNA, 19 nt, Human
uauguagacuauauacaug

SEQ ID NO: 3699736 - RNA, 15 nt, Human
uauguagauauuugg

SEQ ID NO: 3699737 - RNA, 18 nt, Human
uauguagauauuuggcuu

SEQ ID NO: 3699738 - RNA, 15 nt, Human
uauguagcaaaauac

SEQ ID NO: 3699739 - RNA, 19 nt, Human
uauguagcagggaaaauau

SEQ ID NO: 3699740 - RNA, 19 nt, Human
uauguagccuucacacaga

SEQ ID NO: 3699741 - RNA, 15 nt, Human
uauguagcucuuugu

SEQ ID NO: 3699742 - RNA, 17 nt, Human
uauguagguaagacugu

SEQ ID NO: 3699743 - RNA, 18 nt, Human
uauguaguaucuauauga

SEQ ID NO: 3699744 - RNA, 15 nt, Human
uauguauaauucaaa

SEQ ID NO: 3699745 - RNA, 14 nt, Human
uauguauacaugug

SEQ ID NO: 3699746 - RNA, 21 nt, Human
uauguauacaugugccaugcu

SEQ ID NO: 3699747 - RNA, 23 nt, Human
uauguauggguaggguaaaucag

SEQ ID NO: 3699748 - RNA, 17 nt, Human
uauguauggugcaaugu

SEQ ID NO: 3699749 - RNA, 16 nt, Human
uauguaugguuugaaa

SEQ ID NO: 3699750 - RNA, 14 nt, Human
uauguaugugugua

SEQ ID NO: 3699751 - RNA, 17 nt, Human
uauguauguguguaugg

SEQ ID NO: 3699752 - RNA, 17 nt, Human
uauguauguguuuagaa

SEQ ID NO: 3699753 - RNA, 16 nt, Human
uauguauguuuacaua

SEQ ID NO: 3699754 - RNA, 20 nt, Human
uauguauuagugauauuucu

SEQ ID NO: 3699755 - RNA, 21 nt, Human
uauguauuagugauauuucuc

SEQ ID NO: 3699756 - RNA, 20 nt, Human
uauguauuguaaacaugugu

SEQ ID NO: 3699757 - RNA, 17 nt, Human
uauguauugugcaaugu

SEQ ID NO: 3699758 - RNA, 21 nt, Human
uauguauugugcaauguguau

SEQ ID NO: 3699759 - RNA, 11 nt, Human
uauguauuucc

SEQ ID NO: 3699760 - RNA, 16 nt, Human
uauguauuuuauguau

SEQ ID NO: 3699761 - RNA, 16 nt, Human
uaugucagucacuaaa

SEQ ID NO: 3699762 - RNA, 19 nt, Human
uaugucaucauacaugacu

SEQ ID NO: 3699763 - RNA, 16 nt, Human
uaugucauuucauguc

SEQ ID NO: 3699764 - RNA, 13 nt, Human
uauguccaggugu

SEQ ID NO: 3699765 - RNA, 13 nt, Human
uauguccauaucu

SEQ ID NO: 3699766 - RNA, 15 nt, Human
uauguccauaucuaa

SEQ ID NO: 3699767 - RNA, 14 nt, Human
uaugucucuucuga

SEQ ID NO: 3699768 - RNA, 12 nt, Human
uaugucugaugg

SEQ ID NO: 3699769 - RNA, 14 nt, Human
uaugucugccaugu

SEQ ID NO: 3699770 - RNA, 17 nt, Human
uaugucugguucucaau

SEQ ID NO: 3699771 - RNA, 22 nt, Human
uaugucugguucucaauuccaa

SEQ ID NO: 3699772 - RNA, 17 nt, Human
uaugucuuuuauauuug

SEQ ID NO: 3699773 - RNA, 14 nt, Human
uaugugaaaggaua

SEQ ID NO: 3699774 - RNA, 14 nt, Human
uaugugaacauuua

SEQ ID NO: 3699775 - RNA, 22 nt, Human
uaugugaauauggacucaguuu

SEQ ID NO: 3699776 - RNA, 21 nt, Human
uaugugaauccucuucuuuau

SEQ ID NO: 3699777 - RNA, 22 nt, Human
uaugugaaugaucucucugaau

SEQ ID NO: 3699778 - RNA, 18 nt, Human
uaugugaauuuuuaagcu

SEQ ID NO: 3699779 - RNA, 19 nt, Human
uaugugacaauuuuguaca

SEQ ID NO: 3699780 - RNA, 14 nt, Human
uaugugacauuaac

SEQ ID NO: 3699781 - RNA, 14 nt, Human
uaugugacauuuua

SEQ ID NO: 3699782 - RNA, 22 nt, Human
uaugugagagauucugugaucu

SEQ ID NO: 3699783 - RNA, 21 nt, Human
uaugugagauuuuuuauugcu

SEQ ID NO: 3699784 - RNA, 14 nt, Human
uaugugaguauucu

SEQ ID NO: 3699785 - RNA, 17 nt, Human
uaugugaguauucucau

SEQ ID NO: 3699786 - RNA, 23 nt, Human
uaugugaguguguguuugugcug

SEQ ID NO: 3699787 - RNA, 14 nt, Human
uaugugaucugucu

SEQ ID NO: 3699788 - RNA, 17 nt, Human
uaugugcacugucacuu

SEQ ID NO: 3699789 - RNA, 12 nt, Human
uauguggaagug

SEQ ID NO: 3699790 - RNA, 18 nt, Human
uaugugggauauugaaug

SEQ ID NO: 3699791 - RNA, 19 nt, Human
uaugugggauauugaaugu

SEQ ID NO: 3699792 - RNA, 20 nt, Human
uaugugggggucuguguguu

SEQ ID NO: 3699793 - RNA, 19 nt, Human
uauguggguugccugguga

SEQ ID NO: 3699794 - RNA, 19 nt, Human
uaugugguuuccacgauga

SEQ ID NO: 3699795 - RNA, 16 nt, Human
uaugugguuuuagauu

SEQ ID NO: 3699796 - RNA, 13 nt, Human
uauguguaauaaa

SEQ ID NO: 3699797 - RNA, 21 nt, Human
uauguguauauauacauacac

SEQ ID NO: 3699798 - RNA, 17 nt, Human
uauguguaucucacacu

SEQ ID NO: 3699799 - RNA, 12 nt, Human
uauguguaugua

SEQ ID NO: 3699800 - RNA, 13 nt, Human
uauguguauguac

SEQ ID NO: 3699801 - RNA, 16 nt, Human
uauguguccauuuccu

SEQ ID NO: 3699802 - RNA, 22 nt, Human
uauguguccauuuccuuaugcu

SEQ ID NO: 3699803 - RNA, 21 nt, Human
uaugugugaggagcugcuggc

SEQ ID NO: 3699804 - RNA, 12 nt, Human
uauguguguaua

SEQ ID NO: 3699805 - RNA, 12 nt, Human
uaugugugugua

SEQ ID NO: 3699806 - RNA, 22 nt, Human
uauguguguguguugugugugg

SEQ ID NO: 3699807 - RNA, 13 nt, Human
uauguguguuuaa

SEQ ID NO: 3699808 - RNA, 21 nt, Human
uauguguguuuaaauaaagua

SEQ ID NO: 3699809 - RNA, 16 nt, Human
uauguguguuucuguc

SEQ ID NO: 3699810 - RNA, 13 nt, Human
uauguguguuuua

SEQ ID NO: 3699811 - RNA, 16 nt, Human
uauguguuuagaauug

SEQ ID NO: 3699812 - RNA, 16 nt, Human
uauguguuuuucacau

SEQ ID NO: 3699813 - RNA, 15 nt, Human
uauguuaaaagauuu

SEQ ID NO: 3699814 - RNA, 19 nt, Human
uauguuaaccucaguguca

SEQ ID NO: 3699815 - RNA, 18 nt, Human
uauguuaagcucuuuaug

SEQ ID NO: 3699816 - RNA, 13 nt, Human
uauguuaauauuu

SEQ ID NO: 3699817 - RNA, 16 nt, Human
uauguuaauauuucug

SEQ ID NO: 3699818 - RNA, 14 nt, Human
uauguuaauauuuu

SEQ ID NO: 3699819 - RNA, 19 nt, Human
uauguuacaucuguuuuaa

SEQ ID NO: 3699820 - RNA, 12 nt, Human
uauguuacuauu

SEQ ID NO: 3699821 - RNA, 21 nt, Human
uauguuauagaacuucaugga

SEQ ID NO: 3699822 - RNA, 21 nt, Human
uauguucaacuaggaucagaa

SEQ ID NO: 3699823 - RNA, 13 nt, Human
uauguucacuguc

SEQ ID NO: 3699824 - RNA, 16 nt, Human
uauguucagauuauug

SEQ ID NO: 3699825 - RNA, 16 nt, Human
uauguuccauuaaacg

SEQ ID NO: 3699826 - RNA, 18 nt, Human
uauguucuaaccuuuaca

SEQ ID NO: 3699827 - RNA, 16 nt, Human
uauguugcccaggcag

SEQ ID NO: 3699828 - RNA, 19 nt, Human
uauguugcccaggcagguc

SEQ ID NO: 3699829 - RNA, 21 nt, Human
uauguugcccaggcaggucuu

SEQ ID NO: 3699830 - RNA, 14 nt, Human
uauguugccuuuau

SEQ ID NO: 3699831 - RNA, 17 nt, Human
uauguugcucagucucc

SEQ ID NO: 3699832 - RNA, 22 nt, Human
uauguuguaauauuucuucaaa

SEQ ID NO: 3699833 - RNA, 15 nt, Human
uauguuguauagauu

SEQ ID NO: 3699834 - RNA, 13 nt, Human
uauguugucaaag

SEQ ID NO: 3699835 - RNA, 20 nt, Human
uauguugugaagauguuugc

SEQ ID NO: 3699836 - RNA, 20 nt, Human
uauguuguuuauaauaaaaa

SEQ ID NO: 3699837 - RNA, 23 nt, Human
uauguuuaaaguaauuguuccag

SEQ ID NO: 3699838 - RNA, 12 nt, Human
uauguuuacaaa

SEQ ID NO: 3699839 - RNA, 18 nt, Human
uauguuuacacugucaaa

SEQ ID NO: 3699840 - RNA, 22 nt, Human
uauguuuagauagggcugggca

SEQ ID NO: 3699841 - RNA, 18 nt, Human
uauguuuauauaaaugcu

SEQ ID NO: 3699842 - RNA, 22 nt, Human
uauguuucucuuugauuauuug

SEQ ID NO: 3699843 - RNA, 19 nt, Human
uauguuuguacaagauugu

SEQ ID NO: 3699844 - RNA, 12 nt, Human
uauguuuuacac

SEQ ID NO: 3699845 - RNA, 15 nt, Human
uauguuuuacacugu

SEQ ID NO: 3699846 - RNA, 17 nt, Human
uauguuuuacacuguac

SEQ ID NO: 3699847 - RNA, 18 nt, Human
uauguuuuagcauguguu

SEQ ID NO: 3699848 - RNA, 16 nt, Human
uauguuuuuauaaaaa

SEQ ID NO: 3699849 - RNA, 16 nt, Human
uauguuuuugaaggca

SEQ ID NO: 3699850 - RNA, 18 nt, Human
uauguuuuuguguauuug

SEQ ID NO: 3699851 - RNA, 15 nt, Human
uauguuuuuguucaa

SEQ ID NO: 3699852 - RNA, 16 nt, Human
uauguuuuuguucaaa

SEQ ID NO: 3699853 - RNA, 23 nt, Human
uauguuuuuguucaguuuaucug

SEQ ID NO: 3699854 - RNA, 17 nt, Human
uauguuuuuuagaucaa

SEQ ID NO: 3699855 - RNA, 19 nt, Human
uauguuuuuuagaucaaau

SEQ ID NO: 3699856 - RNA, 22 nt, Human
uauguuuuuuuucugcuggaaa

SEQ ID NO: 3699857 - RNA, 18 nt, Human
uauuaaaaaacuucaugu

SEQ ID NO: 3699858 - RNA, 17 nt, Human
uauuaaaaaagagacau

SEQ ID NO: 3699859 - RNA, 23 nt, Human
uauuaaaaaagagacauccaaau

SEQ ID NO: 3699860 - RNA, 20 nt, Human
uauuaaaaagguuuacagaa

SEQ ID NO: 3699861 - RNA, 12 nt, Human
uauuaaaaaguc

SEQ ID NO: 3699862 - RNA, 17 nt, Human
uauuaaaaagucuuuua

SEQ ID NO: 3699863 - RNA, 19 nt, Human
uauuaaaaagucuuuuaaa

SEQ ID NO: 3699864 - RNA, 21 nt, Human
uauuaaaaauauaaaacugcg

SEQ ID NO: 3699865 - RNA, 16 nt, Human
uauuaaaaaucucaaa

SEQ ID NO: 3699866 - RNA, 20 nt, Human
uauuaaaaaucucaaauuuc

SEQ ID NO: 3699867 - RNA, 22 nt, Human
uauuaaaaaucucaaauuucua

SEQ ID NO: 3699868 - RNA, 23 nt, Human
uauuaaaaauuggcuaguugaau

SEQ ID NO: 3699869 - RNA, 16 nt, Human
ucuuuucuuuuuacau

SEQ ID NO: 3699870 - RNA, 14 nt, Human
ucuuuugaagcaua

SEQ ID NO: 3699871 - RNA, 19 nt, Human
ucuuuugaauccaugcuug

SEQ ID NO: 3699872 - RNA, 17 nt, Human
ucuuuugaauuguuaca

SEQ ID NO: 3699873 - RNA, 18 nt, Human
ucuuuugaauuguuacau

SEQ ID NO: 3699874 - RNA, 14 nt, Human
ucuuuugacaugug

SEQ ID NO: 3699875 - RNA, 21 nt, Human
ucuuuugcccuucacaguguu

SEQ ID NO: 3699876 - RNA, 19 nt, Human
ucuuuugcuuuugcccauu

SEQ ID NO: 3699877 - RNA, 21 nt, Human
ucuuuuggaggacguacguaa

SEQ ID NO: 3699878 - RNA, 17 nt, Human
ucuuuugggggaaacuu

SEQ ID NO: 3699879 - RNA, 10 nt, Human
ucuuuuguaa

SEQ ID NO: 3699880 - RNA, 19 nt, Human
ucuuuuguaagguuuuugu

SEQ ID NO: 3699881 - RNA, 18 nt, Human
ucuuuuguaagugcuaca

SEQ ID NO: 3699882 - RNA, 19 nt, Human
ucuuuuguaauaaacuauu

SEQ ID NO: 3699883 - RNA, 10 nt, Human
ucuuuuguau

SEQ ID NO: 3699884 - RNA, 21 nt, Human
ucuuuuguuacuguucuugcu

SEQ ID NO: 3699885 - RNA, 14 nt, Human
ucuuuuguuuccuu

SEQ ID NO: 3699886 - RNA, 12 nt, Human
ucuuuuguuugg

SEQ ID NO: 3699887 - RNA, 18 nt, Human
ucuuuuguuuuuugaagu

SEQ ID NO: 3699888 - RNA, 20 nt, Human
ucuuuuuaaaaauuguuauu

SEQ ID NO: 3699889 - RNA, 14 nt, Human
ucuuuuuaaagcuu

SEQ ID NO: 3699890 - RNA, 19 nt, Human
ucuuuuuaaguaaugugga

SEQ ID NO: 3699891 - RNA, 19 nt, Human
ucuuuuuaccuuucauaca

SEQ ID NO: 3699892 - RNA, 14 nt, Human
ucuuuuuaugcauu

SEQ ID NO: 3699893 - RNA, 14 nt, Human
ucuuuuuauugaau

SEQ ID NO: 3699894 - RNA, 15 nt, Human
ucuuuuuauugaauc

SEQ ID NO: 3699895 - RNA, 22 nt, Human
ucuuuuuauugaugugcaaaaa

SEQ ID NO: 3699896 - RNA, 21 nt, Human
ucuuuuuauuuuuuaauuauu

SEQ ID NO: 3699897 - RNA, 12 nt, Human
ucuuuuucuacc

SEQ ID NO: 3699898 - RNA, 11 nt, Human
ucuuuuucuga

SEQ ID NO: 3699899 - RNA, 12 nt, Human
ucuuuuucuucu

SEQ ID NO: 3699900 - RNA, 19 nt, Human
ucuuuuugacucuugcaau

SEQ ID NO: 3699901 - RNA, 16 nt, Human
ucuuuuugcuuugcuu

SEQ ID NO: 3699902 - RNA, 19 nt, Human
ucuuuuugggagagacuug

SEQ ID NO: 3699903 - RNA, 15 nt, Human
ucuuuuuguuguaaa

SEQ ID NO: 3699904 - RNA, 15 nt, Human
ucuuuuuuaaaauca

SEQ ID NO: 3699905 - RNA, 19 nt, Human
ucuuuuuuaauaaacuacu

SEQ ID NO: 3699906 - RNA, 13 nt, Human
ucuuuuuuacaaa

SEQ ID NO: 3699907 - RNA, 19 nt, Human
ucuuuuuuacaaaggcugu

SEQ ID NO: 3699908 - RNA, 15 nt, Human
ucuuuuuuacucauu

SEQ ID NO: 3699909 - RNA, 20 nt, Human
ucuuuuuuacucauugaaau

SEQ ID NO: 3699910 - RNA, 21 nt, Human
ucuuuuuuacucauugaaaug

SEQ ID NO: 3699911 - RNA, 15 nt, Human
ucuuuuuuagcauaa

SEQ ID NO: 3699912 - RNA, 24 nt, Human
ucuuuuuuauuaaucacuguguau

SEQ ID NO: 3699913 - RNA, 14 nt, Human
ucuuuuuucacaaa

SEQ ID NO: 3699914 - RNA, 23 nt, Human
ucuuuuuucauggacacuuugaa

SEQ ID NO: 3699915 - RNA, 17 nt, Human
ucuuuuuuucccccccu

SEQ ID NO: 3699916 - RNA, 16 nt, Human
ucuuuuuuucucuaga

SEQ ID NO: 3699917 - RNA, 15 nt, Human
ucuuuuuuucuuugg

SEQ ID NO: 3699918 - RNA, 22 nt, Human
ucuuuuuuuuaaugugcugugu

SEQ ID NO: 3699919 - RNA, 19 nt, Human
ucuuuuuuuuauuccacau

SEQ ID NO: 3699920 - RNA, 20 nt, Human
ucuuuuuuuuuaaguucuua

SEQ ID NO: 3699921 - RNA, 23 nt, Human
ucuuuuuuuuuuaagugaaauuu

SEQ ID NO: 3699922 - RNA, 23 nt, Human
ucuuuuuuuuuuuuuaaagacag

SEQ ID NO: 3699923 - RNA, 22 nt, Human
ucuuuuuuuuuuuuuaauaaau

SEQ ID NO: 3699924 - RNA, 23 nt, Human
ucuuuuuuuuuuuuuaauaaauu

SEQ ID NO: 3699925 - RNA, 14 nt, Human
ugagaaggagagaa

SEQ ID NO: 3699926 - RNA, 15 nt, Human
ugagaaggagagaaa

SEQ ID NO: 3699927 - RNA, 22 nt, Human
ugagaaggagucagaaacuguu

SEQ ID NO: 3699928 - RNA, 16 nt, Human
ugagaaggcagccacc

SEQ ID NO: 3699929 - RNA, 17 nt, Human
ugagaaggcagccacca

SEQ ID NO: 3699930 - RNA, 17 nt, Human
ugagaagguuuauuguu

SEQ ID NO: 3699931 - RNA, 18 nt, Human
ugagaagugaaugcuggg

SEQ ID NO: 3699932 - RNA, 22 nt, Human
ugagaagugaaugcugggacuc

SEQ ID NO: 3699933 - RNA, 17 nt, Human
ugagaauaagagaguca

SEQ ID NO: 3699934 - RNA, 16 nt, Human
ugagaauagaaggaaa

SEQ ID NO: 3699935 - RNA, 18 nt, Human
ugagaauagaaggaaacu

SEQ ID NO: 3699936 - RNA, 22 nt, Human
ugagaauagaaggaaacuagcu

SEQ ID NO: 3699937 - RNA, 23 nt, Human
ugagaauagaaggaaacuagcuu

SEQ ID NO: 3699938 - RNA, 16 nt, Human
ugagaaucaaaacucu

SEQ ID NO: 3699939 - RNA, 12 nt, Human
ugagaaucuacc

SEQ ID NO: 3699940 - RNA, 17 nt, Human
ugagaauucagcugccc

SEQ ID NO: 3699941 - RNA, 18 nt, Human
ugagaauucagcugcccc

SEQ ID NO: 3699942 - RNA, 15 nt, Human
ugagaauuccaagga

SEQ ID NO: 3699943 - RNA, 19 nt, Human
ugagaauugggcggcucug

SEQ ID NO: 3699944 - RNA, 14 nt, Human
ugagaauuucuaaa

SEQ ID NO: 3699945 - RNA, 20 nt, Human
ugagaauuugagugcucuga

SEQ ID NO: 3699946 - RNA, 15 nt, Human
ugagaauuuuaaauu

SEQ ID NO: 3699947 - RNA, 23 nt, Human
ugagaauuuuaaauuauaacuua

SEQ ID NO: 3699948 - RNA, 16 nt, Human
ugagacaaaaauuauc

SEQ ID NO: 3699949 - RNA, 14 nt, Human
ugagacaaacaugc

SEQ ID NO: 3699950 - RNA, 18 nt, Human
ugagacaaauggaggccu

SEQ ID NO: 3699951 - RNA, 23 nt, Human
ugagacaagaaaauaagagcuca

SEQ ID NO: 3699952 - RNA, 15 nt, Human
ugagacaaugccuug

SEQ ID NO: 3699953 - RNA, 16 nt, Human
ugagacacaggaugaa

SEQ ID NO: 3699954 - RNA, 17 nt, Human
ugagacacggagcccag

SEQ ID NO: 3699955 - RNA, 21 nt, Human
ugagacacggagcccagcccu

SEQ ID NO: 3699956 - RNA, 22 nt, Human
ugagacacggagcccagcccuc

SEQ ID NO: 3699957 - RNA, 14 nt, Human
ugagacagaaucuc

SEQ ID NO: 3699958 - RNA, 11 nt, Human
ugagacagagu

SEQ ID NO: 3699959 - RNA, 13 nt, Human
ugagacagcccgg

SEQ ID NO: 3699960 - RNA, 20 nt, Human
ugagacagcccgggcucugc

SEQ ID NO: 3699961 - RNA, 14 nt, Human
ugagacagcucugc

SEQ ID NO: 3699962 - RNA, 18 nt, Human
ugagacaguccagccugg

SEQ ID NO: 3699963 - RNA, 19 nt, Human
ugagacaguccagccugga

SEQ ID NO: 3699964 - RNA, 17 nt, Human
ugagacagugaauuugg

SEQ ID NO: 3699965 - RNA, 16 nt, Human
ugagacaguuucuuag

SEQ ID NO: 3699966 - RNA, 23 nt, Human
ugagacaguuucuuagcuuuuua

SEQ ID NO: 3699967 - RNA, 15 nt, Human
ugagaccaaccuggg

SEQ ID NO: 3699968 - RNA, 15 nt, Human
ugagaccaccucuca

SEQ ID NO: 3699969 - RNA, 14 nt, Human
ugagaccacuguua

SEQ ID NO: 3699970 - RNA, 14 nt, Human
ugagaccagccugg

SEQ ID NO: 3699971 - RNA, 17 nt, Human
ugagaccagccugggca

SEQ ID NO: 3699972 - RNA, 12 nt, Human
ugagaccaguug

SEQ ID NO: 3699973 - RNA, 23 nt, Human
ugagaccaguugggagcacugga

SEQ ID NO: 3699974 - RNA, 12 nt, Human
ugagacccagga

SEQ ID NO: 3699975 - RNA, 14 nt, Human
ugagacccaggacu

SEQ ID NO: 3699976 - RNA, 21 nt, Human
ugagacccauuccuauuucuu

SEQ ID NO: 3699977 - RNA, 14 nt, Human
ugagacccccacac

SEQ ID NO: 3699978 - RNA, 15 nt, Human
ugagacccccacacc

SEQ ID NO: 3699979 - RNA, 17 nt, Human
ugagacccccacaccuc

SEQ ID NO: 3699980 - RNA, 15 nt, Human
ugagaccccugucuc

SEQ ID NO: 3699981 - RNA, 23 nt, Human
ugagaccgugaagauacuuugua

SEQ ID NO: 3699982 - RNA, 18 nt, Human
ugagaccuaaucucugua

SEQ ID NO: 3699983 - RNA, 19 nt, Human
ugagaccuaaucucuguaa

SEQ ID NO: 3699984 - RNA, 20 nt, Human
ugagaccuaaucucuguaaa

SEQ ID NO: 3699985 - RNA, 17 nt, Human
ugagaccuacaggcuga

SEQ ID NO: 3699986 - RNA, 18 nt, Human
ugagaccuacaggcugac

SEQ ID NO: 3699987 - RNA, 14 nt, Human
ugagaccucagcca

SEQ ID NO: 3699988 - RNA, 13 nt, Human
ugagaccugcccc

SEQ ID NO: 3699989 - RNA, 14 nt, Human
ugagaccugccccu

SEQ ID NO: 3699990 - RNA, 20 nt, Human
ugagacgccaccauuccugg

SEQ ID NO: 3699991 - RNA, 21 nt, Human
ugagacgccaccauuccugga

SEQ ID NO: 3699992 - RNA, 22 nt, Human
ugagacuaaucuuauucauuuu

SEQ ID NO: 3699993 - RNA, 15 nt, Human
ugagacucagugcag

SEQ ID NO: 3699994 - RNA, 12 nt, Human
ugagacucgaga

SEQ ID NO: 3699995 - RNA, 16 nt, Human
ugagacucgagaacuu

SEQ ID NO: 3699996 - RNA, 20 nt, Human
ugagacucgcgacaaugcaa

SEQ ID NO: 3699997 - RNA, 23 nt, Human
ugagacucgcgacaaugcaaacc

SEQ ID NO: 3699998 - RNA, 12 nt, Human
ugagacucuguc

SEQ ID NO: 3699999 - RNA, 20 nt, Human
ugagacucugucucaaaaaa

SEQ ID NO: 3700000 - RNA, 23 nt, Human
ugagacugcgggaugguccuggg

SEQ ID NO: 3700001 - RNA, 21 nt, Human
ugagacuggauacugcccggg

SEQ ID NO: 3700002 - RNA, 21 nt, Human
ugagacugugcuguuguucuc

SEQ ID NO: 3700003 - RNA, 17 nt, Human
ugagacuugccuuccua

SEQ ID NO: 3700004 - RNA, 19 nt, Human
ugagacuugccuuccuaag

SEQ ID NO: 3700005 - RNA, 14 nt, Human
ugagacuuuaaaag

SEQ ID NO: 3700006 - RNA, 14 nt, Human
ugagacuuucuuuc

SEQ ID NO: 3700007 - RNA, 15 nt, Human
ugagacuuuuuggug

SEQ ID NO: 3700008 - RNA, 13 nt, Human
ugagagaaaauaa

SEQ ID NO: 3700009 - RNA, 19 nt, Human
ugagagaauggaaaacaga

SEQ ID NO: 3700010 - RNA, 23 nt, Human
ugagagaauggaaaacagacuca

SEQ ID NO: 3700011 - RNA, 17 nt, Human
ugagagacacacugaag

SEQ ID NO: 3700012 - RNA, 19 nt, Human
ugagagacacacugaagaa

SEQ ID NO: 3700013 - RNA, 19 nt, Human
ugagagacauuaacucauu

SEQ ID NO: 3700014 - RNA, 14 nt, Human
ugagagaccaggca

SEQ ID NO: 3700015 - RNA, 20 nt, Human
ugagagacccaaggaggaaa

SEQ ID NO: 3700016 - RNA, 21 nt, Human
ugagagacccaaggaggaaaa

SEQ ID NO: 3700017 - RNA, 21 nt, Human
ugagagacggugucuuguucu

SEQ ID NO: 3700018 - RNA, 12 nt, Human
ugagagacuuuu

SEQ ID NO: 3700019 - RNA, 16 nt, Human
ugagagagaugggagc

SEQ ID NO: 3700020 - RNA, 14 nt, Human
ugagagagaugugu

SEQ ID NO: 3700021 - RNA, 21 nt, Human
ugagagaugcagaaauauuug

SEQ ID NO: 3700022 - RNA, 23 nt, Human
ugagagaugcuguagacaucugu

SEQ ID NO: 3700023 - RNA, 21 nt, Human
ugagagcaguuugguuucuag

SEQ ID NO: 3700024 - RNA, 15 nt, Human
ugagagcauaauuua

SEQ ID NO: 3700025 - RNA, 21 nt, Human
ugagagcaucaggccuagagg

SEQ ID NO: 3700026 - RNA, 20 nt, Human
ugagagcccagagguaacag

SEQ ID NO: 3700027 - RNA, 12 nt, Human
ugagagccccag

SEQ ID NO: 3700028 - RNA, 15 nt, Human
ugagagccccagcug

SEQ ID NO: 3700029 - RNA, 15 nt, Human
ugagagcgaggcuga

SEQ ID NO: 3700030 - RNA, 15 nt, Human
ugagagcgcagcccg

SEQ ID NO: 3700031 - RNA, 14 nt, Human
ugagagcugggugu

SEQ ID NO: 3700032 - RNA, 14 nt, Human
ugagaggaaaucac

SEQ ID NO: 3700033 - RNA, 23 nt, Human
ugagaggaugaauguaugugcac

SEQ ID NO: 3700034 - RNA, 18 nt, Human
ugagaggcagacuucccu

SEQ ID NO: 3700035 - RNA, 13 nt, Human
ugagaggcaggca

SEQ ID NO: 3700036 - RNA, 16 nt, Human
ugagaggcaggcauag

SEQ ID NO: 3700037 - RNA, 14 nt, Human
ugagaggcauuucc

SEQ ID NO: 3700038 - RNA, 12 nt, Human
ugagaggcccug

SEQ ID NO: 3700039 - RNA, 14 nt, Human
ugagaggcccugga

SEQ ID NO: 3700040 - RNA, 17 nt, Human
ugagaggcccuggauca

SEQ ID NO: 3700041 - RNA, 21 nt, Human
ugagaggcgacaggaguauuu

SEQ ID NO: 3700042 - RNA, 22 nt, Human
ugagagggcaugcgcacaaggc

SEQ ID NO: 3700043 - RNA, 22 nt, Human
ugagagggcucgaggggugggc

SEQ ID NO: 3700044 - RNA, 18 nt, Human
ugagaggggaacagacug

SEQ ID NO: 3700045 - RNA, 19 nt, Human
ugagaggggagagcugaac

SEQ ID NO: 3700046 - RNA, 17 nt, Human
ugagaggggaggccaag

SEQ ID NO: 3700047 - RNA, 17 nt, Human
ugagaguaucaggucuc

SEQ ID NO: 3700048 - RNA, 23 nt, Human
ugagaguauuuaggcagauugaa

SEQ ID NO: 3700049 - RNA, 16 nt, Human
ugagagucagcucucu

SEQ ID NO: 3700050 - RNA, 19 nt, Human
ugagagucagcucucugcc

SEQ ID NO: 3700051 - RNA, 14 nt, Human
ugagagucuagauu

SEQ ID NO: 3700052 - RNA, 19 nt, Human
ugagagucuagcacucauu

SEQ ID NO: 3700053 - RNA, 20 nt, Human
ugagagucugcacuuaacaa

SEQ ID NO: 3700054 - RNA, 16 nt, Human
ugagagugaacaaauu

SEQ ID NO: 3700055 - RNA, 16 nt, Human
ugagaguuuaguugua

SEQ ID NO: 3700056 - RNA, 17 nt, Human
ugagaguuuuggaugca

SEQ ID NO: 3700057 - RNA, 19 nt, Human
ugagaguuuuggaugcagu

SEQ ID NO: 3700058 - RNA, 20 nt, Human
ugagauaccagcgaggaggc

SEQ ID NO: 3700059 - RNA, 15 nt, Human
ugagauacuuugcau

SEQ ID NO: 3700060 - RNA, 21 nt, Human
ugagauagaagaacugcaaag

SEQ ID NO: 3700061 - RNA, 18 nt, Human
ugagauagcauugugaac

SEQ ID NO: 3700062 - RNA, 22 nt, Human
ugagauagcugguguuagggcu

SEQ ID NO: 3700063 - RNA, 20 nt, Human
ugagauauuuauuguuuauu

SEQ ID NO: 3700064 - RNA, 13 nt, Human
ugagaucaggcuc

SEQ ID NO: 3700065 - RNA, 16 nt, Human
ugagaucuaaaaauaa

SEQ ID NO: 3700066 - RNA, 23 nt, Human
ugagaucuaaaaauaacuguaau

SEQ ID NO: 3700067 - RNA, 20 nt, Human
ugagaucuaagccuuuccau

SEQ ID NO: 3700068 - RNA, 21 nt, Human
ugagaucuaagccuuuccaua

SEQ ID NO: 3700069 - RNA, 23 nt, Human
ugagaucuaagccuuuccauaag

SEQ ID NO: 3700070 - RNA, 15 nt, Human
ugagaugcagcugga

SEQ ID NO: 3700071 - RNA, 22 nt, Human
ugagaugcguuguuacaggaag

SEQ ID NO: 3700072 - RNA, 14 nt, Human
ugagaugcuagaac

SEQ ID NO: 3700073 - RNA, 16 nt, Human
ugagaugcuagaacuc

SEQ ID NO: 3700074 - RNA, 11 nt, Human
ggguacaugug

SEQ ID NO: 3700075 - RNA, 13 nt, Human
ggguacccacugc

SEQ ID NO: 3700076 - RNA, 14 nt, Human
ggguagcagcugga

SEQ ID NO: 3700077 - RNA, 14 nt, Human
ggguagcccgccug

SEQ ID NO: 3700078 - RNA, 18 nt, Human
ggguagcccgccugccag

SEQ ID NO: 3700079 - RNA, 15 nt, Human
ggguagcuagaggaa

SEQ ID NO: 3700080 - RNA, 12 nt, Human
ggguaggcggga

SEQ ID NO: 3700081 - RNA, 15 nt, Human
ggguaggguaaauca

SEQ ID NO: 3700082 - RNA, 10 nt, Human
ggguauccug

SEQ ID NO: 3700083 - RNA, 22 nt, Human
ggguauguuuaaucuguuaugu

SEQ ID NO: 3700084 - RNA, 14 nt, Human
gggucacucuggca

SEQ ID NO: 3700085 - RNA, 18 nt, Human
gggucagaaacaggaccg

SEQ ID NO: 3700086 - RNA, 20 nt, Human
gggucagaacccugccaugg

SEQ ID NO: 3700087 - RNA, 12 nt, Human
gggucagccagg

SEQ ID NO: 3700088 - RNA, 16 nt, Human
gggucagccagggccu

SEQ ID NO: 3700089 - RNA, 13 nt, Human
gggucaggaagga

SEQ ID NO: 3700090 - RNA, 17 nt, Human
gggucaggccgggcaga

SEQ ID NO: 3700091 - RNA, 21 nt, Human
gggucagucuggugggaggac

SEQ ID NO: 3700092 - RNA, 20 nt, Human
gggucauguuugcaggggug

SEQ ID NO: 3700093 - RNA, 18 nt, Human
gggucauucauggccugg

SEQ ID NO: 3700094 - RNA, 12 nt, Human
ggguccaaauaa

SEQ ID NO: 3700095 - RNA, 23 nt, Human
gggucccaagcugggccccagcc

SEQ ID NO: 3700096 - RNA, 16 nt, Human
gggucccagccacccc

SEQ ID NO: 3700097 - RNA, 22 nt, Human
gggucccagugggaggggcagg

SEQ ID NO: 3700098 - RNA, 23 nt, Human
gggucccagugggaggggcaggc

SEQ ID NO: 3700099 - RNA, 16 nt, Human
ggguccggcagcuucu

SEQ ID NO: 3700100 - RNA, 15 nt, Human
ggguccuagaaauuc

SEQ ID NO: 3700101 - RNA, 18 nt, Human
ggguccuccuccagggac

SEQ ID NO: 3700102 - RNA, 19 nt, Human
ggguccucuucugggccug

SEQ ID NO: 3700103 - RNA, 18 nt, Human
ggguccugcagccugcag

SEQ ID NO: 3700104 - RNA, 20 nt, Human
ggguccuguggcaggcagcg

SEQ ID NO: 3700105 - RNA, 23 nt, Human
ggguccuguggcaggcagcgcca

SEQ ID NO: 3700106 - RNA, 18 nt, Human
gggucgacuucgggcugg

SEQ ID NO: 3700107 - RNA, 23 nt, Human
gggucggaacccaagcuuagaac

SEQ ID NO: 3700108 - RNA, 15 nt, Human
gggucggcugaccau

SEQ ID NO: 3700109 - RNA, 13 nt, Human
gggucguggagag

SEQ ID NO: 3700110 - RNA, 22 nt, Human
gggucguuugcuuuucaggguu

SEQ ID NO: 3700111 - RNA, 23 nt, Human
gggucucacuauguugcccaggc

SEQ ID NO: 3700112 - RNA, 18 nt, Human
gggucuccaggaggagac

SEQ ID NO: 3700113 - RNA, 13 nt, Human
gggucucccuggc

SEQ ID NO: 3700114 - RNA, 14 nt, Human
gggucucccuggcu

SEQ ID NO: 3700115 - RNA, 18 nt, Human
gggucucccuggcucccu

SEQ ID NO: 3700116 - RNA, 14 nt, Human
gggucucucccuca

SEQ ID NO: 3700117 - RNA, 14 nt, Human
gggucucugcugcc

SEQ ID NO: 3700118 - RNA, 15 nt, Human
gggucucugcugccg

SEQ ID NO: 3700119 - RNA, 17 nt, Human
gggucucuuuuguaaau

SEQ ID NO: 3700120 - RNA, 22 nt, Human
gggucuggcagccucccaucca

SEQ ID NO: 3700121 - RNA, 18 nt, Human
gggucuggcugguguuaa

SEQ ID NO: 3700122 - RNA, 21 nt, Human
gggucugggggcacaagacug

SEQ ID NO: 3700123 - RNA, 15 nt, Human
gggucuguaaaaucu

SEQ ID NO: 3700124 - RNA, 23 nt, Human
gggucuucccuaccucaggcagg

SEQ ID NO: 3700125 - RNA, 18 nt, Human
gggucuugcaaaauuccu

SEQ ID NO: 3700126 - RNA, 20 nt, Human
gggucuugguuccagccugc

SEQ ID NO: 3700127 - RNA, 22 nt, Human
gggucuuugugguagcuuaucu

SEQ ID NO: 3700128 - RNA, 13 nt, Human
gggugaaggcugg

SEQ ID NO: 3700129 - RNA, 16 nt, Human
gggugacaagagccug

SEQ ID NO: 3700130 - RNA, 21 nt, Human
gggugacaagauagagagcua

SEQ ID NO: 3700131 - RNA, 13 nt, Human
gggugacacagac

SEQ ID NO: 3700132 - RNA, 14 nt, Human
gggugacacagacu

SEQ ID NO: 3700133 - RNA, 19 nt, Human
gggugacagagcaagugag

SEQ ID NO: 3700134 - RNA, 13 nt, Human
gggugacagucau

SEQ ID NO: 3700135 - RNA, 13 nt, Human
gggugacggcccu

SEQ ID NO: 3700136 - RNA, 18 nt, Human
gggugagaugcuggagaa

SEQ ID NO: 3700137 - RNA, 15 nt, Human
gggugaggaccacuc

SEQ ID NO: 3700138 - RNA, 15 nt, Human
gggugaggagcuggg

SEQ ID NO: 3700139 - RNA, 18 nt, Human
gggugauauggacagcag

SEQ ID NO: 3700140 - RNA, 14 nt, Human
gggugaugagggca

SEQ ID NO: 3700141 - RNA, 18 nt, Human
gggugaugagggcagcag

SEQ ID NO: 3700142 - RNA, 19 nt, Human
gggugaugagggcagcagc

SEQ ID NO: 3700143 - RNA, 21 nt, Human
gggugaugagggcagcagcca

SEQ ID NO: 3700144 - RNA, 22 nt, Human
gggugauuucagagagggcaga

SEQ ID NO: 3700145 - RNA, 23 nt, Human
gggugcaguaucaugcccugugc

SEQ ID NO: 3700146 - RNA, 18 nt, Human
gggugcccaagcucagaa

SEQ ID NO: 3700147 - RNA, 13 nt, Human
gggugcccacagc

SEQ ID NO: 3700148 - RNA, 12 nt, Human
gggugcccccuc

SEQ ID NO: 3700149 - RNA, 15 nt, Human
gggugcccccuccuc

SEQ ID NO: 3700150 - RNA, 18 nt, Human
gggugcccuccacugccc

SEQ ID NO: 3700151 - RNA, 20 nt, Human
gggugcccuccacugcccuc

SEQ ID NO: 3700152 - RNA, 21 nt, Human
gggugcggcggucccagcucc

SEQ ID NO: 3700153 - RNA, 16 nt, Human
gggugcuacuggggaa

SEQ ID NO: 3700154 - RNA, 16 nt, Human
gggugcucccuaccac

SEQ ID NO: 3700155 - RNA, 15 nt, Human
gggugcugggaggag

SEQ ID NO: 3700156 - RNA, 19 nt, Human
gggugcugggccccugccu

SEQ ID NO: 3700157 - RNA, 21 nt, Human
gggugcuuuuauagaggcuag

SEQ ID NO: 3700158 - RNA, 22 nt, Human
ggguggagacugcuucccaucc

SEQ ID NO: 3700159 - RNA, 14 nt, Human
ggguggaggagagc

SEQ ID NO: 3700160 - RNA, 19 nt, Human
ggguggaggagagccuggu

SEQ ID NO: 3700161 - RNA, 14 nt, Human
ggguggaugccugg

SEQ ID NO: 3700162 - RNA, 13 nt, Human
ggguggcagcaac

SEQ ID NO: 3700163 - RNA, 20 nt, Human
ggguggccaggccgggaaaa

SEQ ID NO: 3700164 - RNA, 11 nt, Human
ggguggcccau

SEQ ID NO: 3700165 - RNA, 18 nt, Human
ggguggcuacucugugcc

SEQ ID NO: 3700166 - RNA, 18 nt, Human
ggguggcuagucagagag

SEQ ID NO: 3700167 - RNA, 15 nt, Human
ggguggcugcagccu

SEQ ID NO: 3700168 - RNA, 19 nt, Human
gggugggccaggcugaugg

SEQ ID NO: 3700169 - RNA, 12 nt, Human
gggugggccucu

SEQ ID NO: 3700170 - RNA, 22 nt, Human
ggguggggaauguuugggcaga

SEQ ID NO: 3700171 - RNA, 20 nt, Human
ggguggggaccucaggccug

SEQ ID NO: 3700172 - RNA, 18 nt, Human
ggguggggagagacgggc

SEQ ID NO: 3700173 - RNA, 14 nt, Human
ggguggggcagugc

SEQ ID NO: 3700174 - RNA, 16 nt, Human
gggugggggccaccug

SEQ ID NO: 3700175 - RNA, 21 nt, Human
ggguggggucaugcccuccuc

SEQ ID NO: 3700176 - RNA, 11 nt, Human
gggugggucag

SEQ ID NO: 3700177 - RNA, 13 nt, Human
gggugguggggag

SEQ ID NO: 3700178 - RNA, 19 nt, Human
ggguguaacaggucuccuc

SEQ ID NO: 3700179 - RNA, 19 nt, Human
ggguguccccgcugcugug

SEQ ID NO: 3700180 - RNA, 14 nt, Human
gggugucugccccc

SEQ ID NO: 3700181 - RNA, 12 nt, Human
ggguguggcagu

SEQ ID NO: 3700182 - RNA, 18 nt, Human
ggguguuguauggggagg

SEQ ID NO: 3700183 - RNA, 12 nt, Human
ggguuacaaacu

SEQ ID NO: 3700184 - RNA, 16 nt, Human
ggguuacaaacugcaa

SEQ ID NO: 3700185 - RNA, 22 nt, Human
ggguuacaguaugcuugcucua

SEQ ID NO: 3700186 - RNA, 20 nt, Human
ggguucagccccuccucugc

SEQ ID NO: 3700187 - RNA, 21 nt, Human
ggguucagccccuccucugcc

SEQ ID NO: 3700188 - RNA, 22 nt, Human
ggguucagccccuccucugcca

SEQ ID NO: 3700189 - RNA, 13 nt, Human
ggguucaggggac

SEQ ID NO: 3700190 - RNA, 20 nt, Human
ggguucauaggucacuggcu

SEQ ID NO: 3700191 - RNA, 14 nt, Human
ggguucaugaugca

SEQ ID NO: 3700192 - RNA, 19 nt, Human
ggguuccagcaccacacuc

SEQ ID NO: 3700193 - RNA, 23 nt, Human
ggguucccuugagggcugcaguu

SEQ ID NO: 3700194 - RNA, 16 nt, Human
ggguuccgcacuuucc

SEQ ID NO: 3700195 - RNA, 21 nt, Human
ggguuccguguccacccccau

SEQ ID NO: 3700196 - RNA, 17 nt, Human
ggguuccuccccuccag

SEQ ID NO: 3700197 - RNA, 12 nt, Human
ggguucuaccca

SEQ ID NO: 3700198 - RNA, 22 nt, Human
ggguucuacccaggugcuagga

SEQ ID NO: 3700199 - RNA, 15 nt, Human
ggguucuguaaaaug

SEQ ID NO: 3700200 - RNA, 19 nt, Human
ggguucuuucuuccucugc

SEQ ID NO: 3700201 - RNA, 23 nt, Human
ggguugaaaauucaaaaaguguu

SEQ ID NO: 3700202 - RNA, 11 nt, Human
ggguugauuaa

SEQ ID NO: 3700203 - RNA, 19 nt, Human
ggguugauuaaggcaguac

SEQ ID NO: 3700204 - RNA, 18 nt, Human
ggguugccacaggccucc

SEQ ID NO: 3700205 - RNA, 19 nt, Human
ggguugccacaggccuccc

SEQ ID NO: 3700206 - RNA, 20 nt, Human
ggguugcuguauaaguuauu

SEQ ID NO: 3700207 - RNA, 21 nt, Human
ggguuggagcaguagcuggag

SEQ ID NO: 3700208 - RNA, 18 nt, Human
ggguuggccccugcccgg

SEQ ID NO: 3700209 - RNA, 19 nt, Human
ggguuggccccugcccggc

SEQ ID NO: 3700210 - RNA, 20 nt, Human
ggguuggcgcacccuccccu

SEQ ID NO: 3700211 - RNA, 20 nt, Human
ggguuggcugggcccagaag

SEQ ID NO: 3700212 - RNA, 13 nt, Human
ggguuggcugggu

SEQ ID NO: 3700213 - RNA, 14 nt, Human
ggguuggcugggua

SEQ ID NO: 3700214 - RNA, 12 nt, Human
ggguuggcuuuu

SEQ ID NO: 3700215 - RNA, 22 nt, Human
ggguuggggugguugaggcuaa

SEQ ID NO: 3700216 - RNA, 15 nt, Human
ggguuggugugcuga

SEQ ID NO: 3700217 - RNA, 14 nt, Human
ggguugugaggccu

SEQ ID NO: 3700218 - RNA, 19 nt, Human
ggguuuacagugaagaaag

SEQ ID NO: 3700219 - RNA, 20 nt, Human
ggguuucgucauguuggcca

SEQ ID NO: 3700220 - RNA, 17 nt, Human
ggguuucuaaagcugcc

SEQ ID NO: 3700221 - RNA, 22 nt, Human
ggguuucugagcugcucugaau

SEQ ID NO: 3700222 - RNA, 15 nt, Human
ggguuucugcccugc

SEQ ID NO: 3700223 - RNA, 18 nt, Human
ggguuugaggauaggagu

SEQ ID NO: 3700224 - RNA, 18 nt, Human
ugaaaaaaaaaaugcuga

SEQ ID NO: 3700225 - RNA, 16 nt, Human
ugaaaaaaaguuuaca

SEQ ID NO: 3700226 - RNA, 16 nt, Human
ugaaaaaagcaguucu

SEQ ID NO: 3700227 - RNA, 12 nt, Human
ugaaaaaagcuc

SEQ ID NO: 3700228 - RNA, 20 nt, Human
ugaaaaaagcucauuucaug

SEQ ID NO: 3700229 - RNA, 18 nt, Human
ugaaaaaaggacaauuuc

SEQ ID NO: 3700230 - RNA, 23 nt, Human
ugaaaaaauauauaucaaauaua

SEQ ID NO: 3700231 - RNA, 12 nt, Human
ugaaaaacuucc

SEQ ID NO: 3700232 - RNA, 9 nt, Human
ugaaaaaga

SEQ ID NO: 3700233 - RNA, 17 nt, Human
ugaaaaagcauguacag

SEQ ID NO: 3700234 - RNA, 23 nt, Human
ugaaaaagcauguacaguguucu

SEQ ID NO: 3700235 - RNA, 22 nt, Human
ugaaaaaguucugcagauaaac

SEQ ID NO: 3700236 - RNA, 13 nt, Human
ugaaaaauauaaa

SEQ ID NO: 3700237 - RNA, 19 nt, Human
ugaaaaauauaaaauuaug

SEQ ID NO: 3700238 - RNA, 16 nt, Human
ugaaaaaugaaagaug

SEQ ID NO: 3700239 - RNA, 19 nt, Human
ugaaaaaugggcacuuaaa

SEQ ID NO: 3700240 - RNA, 16 nt, Human
ugaaaaaugugcaaaa

SEQ ID NO: 3700241 - RNA, 20 nt, Human
ugaaaaaugugcaaaacagc

SEQ ID NO: 3700242 - RNA, 21 nt, Human
ugaaaaauuccacucaaaaua

SEQ ID NO: 3700243 - RNA, 12 nt, Human
ugaaaaauuccu

SEQ ID NO: 3700244 - RNA, 13 nt, Human
ugaaaaauuccua

SEQ ID NO: 3700245 - RNA, 22 nt, Human
ugaaaaauuccuauugugauuu

SEQ ID NO: 3700246 - RNA, 14 nt, Human
ugaaaacaagugcu

SEQ ID NO: 3700247 - RNA, 17 nt, Human
ugaaaacacauuuuucu

SEQ ID NO: 3700248 - RNA, 21 nt, Human
ugaaaacacauuuuucuuagg

SEQ ID NO: 3700249 - RNA, 16 nt, Human
ugaaaacacugugcac

SEQ ID NO: 3700250 - RNA, 14 nt, Human
ugaaaacagaaauu

SEQ ID NO: 3700251 - RNA, 15 nt, Human
ugaaaacagaaauug

SEQ ID NO: 3700252 - RNA, 21 nt, Human
ugaaaacagaaauugguaccu

SEQ ID NO: 3700253 - RNA, 14 nt, Human
ugaaaacauguaau

SEQ ID NO: 3700254 - RNA, 21 nt, Human
ugaaaaccaaaaugacaucuu

SEQ ID NO: 3700255 - RNA, 21 nt, Human
ugaaaaccaucuggccuggcc

SEQ ID NO: 3700256 - RNA, 16 nt, Human
ugaaaacccagagagg

SEQ ID NO: 3700257 - RNA, 13 nt, Human
ugaaaaccucaca

SEQ ID NO: 3700258 - RNA, 20 nt, Human
ugaaaacggagcugaacaau

SEQ ID NO: 3700259 - RNA, 19 nt, Human
ugaaaacguuuuauugugu

SEQ ID NO: 3700260 - RNA, 20 nt, Human
ugaaaacuacauuuuaacau

SEQ ID NO: 3700261 - RNA, 19 nt, Human
ugaaaacucauuacuuuuc

SEQ ID NO: 3700262 - RNA, 19 nt, Human
ugaaaagaaaaaugagccu

SEQ ID NO: 3700263 - RNA, 14 nt, Human
ugaaaagaaauaau

SEQ ID NO: 3700264 - RNA, 16 nt, Human
ugaaaagaaggaaaga

SEQ ID NO: 3700265 - RNA, 19 nt, Human
ugaaaagacaagaaaauca

SEQ ID NO: 3700266 - RNA, 17 nt, Human
ugaaaagacaucaagca

SEQ ID NO: 3700267 - RNA, 17 nt, Human
ugaaaagacuccaaaga

SEQ ID NO: 3700268 - RNA, 22 nt, Human
ugaaaagacuccaaagaaaugu

SEQ ID NO: 3700269 - RNA, 13 nt, Human
ugaaaagaggugu

SEQ ID NO: 3700270 - RNA, 13 nt, Human
ugaaaagauguac

SEQ ID NO: 3700271 - RNA, 22 nt, Human
ugaaaagauguaccugguggau

SEQ ID NO: 3700272 - RNA, 14 nt, Human
ugaaaagcaauauu

SEQ ID NO: 3700273 - RNA, 16 nt, Human
ugaaaagcaauauugu

SEQ ID NO: 3700274 - RNA, 18 nt, Human
ugaaaagcagguugauaa

SEQ ID NO: 3700275 - RNA, 19 nt, Human
ugaaaagcagguugauaaa

SEQ ID NO: 3700276 - RNA, 16 nt, Human
ugaaaagccauguuua

SEQ ID NO: 3700277 - RNA, 19 nt, Human
ugaaaagccucuguuuuga

SEQ ID NO: 3700278 - RNA, 19 nt, Human
ugaaaagcuauuagccagg

SEQ ID NO: 3700279 - RNA, 16 nt, Human
ugaaaagcuucuuaau

SEQ ID NO: 3700280 - RNA, 21 nt, Human
ugaaaagcuuuguuuguucuu

SEQ ID NO: 3700281 - RNA, 14 nt, Human
ugaaaaggccaaga

SEQ ID NO: 3700282 - RNA, 20 nt, Human
ugaaaaggguguugggaggg

SEQ ID NO: 3700283 - RNA, 21 nt, Human
ugaaaagguucuucaucccuu

SEQ ID NO: 3700284 - RNA, 12 nt, Human
ugaaaagucaaa

SEQ ID NO: 3700285 - RNA, 17 nt, Human
ugaaaagucguuuucca

SEQ ID NO: 3700286 - RNA, 22 nt, Human
ugaaaagucguuuuccaaacug

SEQ ID NO: 3700287 - RNA, 18 nt, Human
ugaaaaguguguauauau

SEQ ID NO: 3700288 - RNA, 19 nt, Human
ugaaaaguguguauauauu

SEQ ID NO: 3700289 - RNA, 20 nt, Human
ugaaaaguuacuaccuguca

SEQ ID NO: 3700290 - RNA, 20 nt, Human
ugaaaauaaaaagaucacuu

SEQ ID NO: 3700291 - RNA, 13 nt, Human
ugaaaauaaagaa

SEQ ID NO: 3700292 - RNA, 16 nt, Human
ugaaaauaacugaauu

SEQ ID NO: 3700293 - RNA, 16 nt, Human
ugaaaauaagaauaga

SEQ ID NO: 3700294 - RNA, 20 nt, Human
ugaaaauaagccaugagaau

SEQ ID NO: 3700295 - RNA, 17 nt, Human
ugaaaauaaucucugau

SEQ ID NO: 3700296 - RNA, 12 nt, Human
ugaaaauaauug

SEQ ID NO: 3700297 - RNA, 13 nt, Human
ugaaaauaccauu

SEQ ID NO: 3700298 - RNA, 18 nt, Human
ugaaaauacuuaggaagg

SEQ ID NO: 3700299 - RNA, 18 nt, Human
ugaaaauagguauacagu

SEQ ID NO: 3700300 - RNA, 18 nt, Human
ugaaaauaguuuauuuua

SEQ ID NO: 3700301 - RNA, 22 nt, Human
ugaaaauaguuuauuuuaaaac

SEQ ID NO: 3700302 - RNA, 19 nt, Human
ugaaaauauuaucuuugua

SEQ ID NO: 3700303 - RNA, 20 nt, Human
ugaaaauauuguuuuacaau

SEQ ID NO: 3700304 - RNA, 23 nt, Human
ugaaaauauuguuuuacaauagu

SEQ ID NO: 3700305 - RNA, 12 nt, Human
ugaaaauauuua

SEQ ID NO: 3700306 - RNA, 21 nt, Human
ugaaaauauuuguaucacaaa

SEQ ID NO: 3700307 - RNA, 16 nt, Human
ugaaaaucgugacaac

SEQ ID NO: 3700308 - RNA, 21 nt, Human
ugaaaaugaauaucuauuaau

SEQ ID NO: 3700309 - RNA, 23 nt, Human
ugaaaaugaauaucuauuaauau

SEQ ID NO: 3700310 - RNA, 20 nt, Human
ugaaaauggaaguggcaaua

SEQ ID NO: 3700311 - RNA, 19 nt, Human
ugaaaauguaagcuguuua

SEQ ID NO: 3700312 - RNA, 22 nt, Human
ugaaaauguaaguaaaugucug

SEQ ID NO: 3700313 - RNA, 12 nt, Human
ugaaaauguacu

SEQ ID NO: 3700314 - RNA, 13 nt, Human
ugaaaauguacug

SEQ ID NO: 3700315 - RNA, 14 nt, Human
ugaaaaugucagaa

SEQ ID NO: 3700316 - RNA, 14 nt, Human
ugaaaauguccuug

SEQ ID NO: 3700317 - RNA, 16 nt, Human
ugaaaauguccuugug

SEQ ID NO: 3700318 - RNA, 18 nt, Human
ugaaaauguccuugugau

SEQ ID NO: 3700319 - RNA, 13 nt, Human
ugaaaaugucuug

SEQ ID NO: 3700320 - RNA, 16 nt, Human
ugaaaaugucuugugu

SEQ ID NO: 3700321 - RNA, 13 nt, Human
ugaaaaugugaau

SEQ ID NO: 3700322 - RNA, 15 nt, Human
ugaaaauuaacacug

SEQ ID NO: 3700323 - RNA, 16 nt, Human
ugaaaauuaacacugc

SEQ ID NO: 3700324 - RNA, 15 nt, Human
ugaaaauuauuugaa

SEQ ID NO: 3700325 - RNA, 16 nt, Human
ugaaaauuauuuuaaa

SEQ ID NO: 3700326 - RNA, 21 nt, Human
ugaaaauuauuuuaaacaaaa

SEQ ID NO: 3700327 - RNA, 22 nt, Human
ugaaaauuauuuuguucauaca

SEQ ID NO: 3700328 - RNA, 17 nt, Human
ugaaaauucaaaaagug

SEQ ID NO: 3700329 - RNA, 18 nt, Human
ugaaaauucaaaaagugu

SEQ ID NO: 3700330 - RNA, 14 nt, Human
ugaaaauucagugg

SEQ ID NO: 3700331 - RNA, 18 nt, Human
ugaaaauuccagaaagga

SEQ ID NO: 3700332 - RNA, 22 nt, Human
ugaaaauucgcccgagcuguuu

SEQ ID NO: 3700333 - RNA, 23 nt, Human
ugaaaauugccuuucuguguuua

SEQ ID NO: 3700334 - RNA, 17 nt, Human
ugaaaauuggacagauu

SEQ ID NO: 3700335 - RNA, 23 nt, Human
ugaaaauuggacagauugccugu

SEQ ID NO: 3700336 - RNA, 22 nt, Human
ugaaaauuugagacuauuuaaa

SEQ ID NO: 3700337 - RNA, 18 nt, Human
ugaaacaaauaaucacau

SEQ ID NO: 3700338 - RNA, 19 nt, Human
ugaaacaaauaaucacauu

SEQ ID NO: 3700339 - RNA, 18 nt, Human
ugaaacacaccaggcugu

SEQ ID NO: 3700340 - RNA, 22 nt, Human
ugaaacacaccaggcugugggc

SEQ ID NO: 3700341 - RNA, 13 nt, Human
ugaaacacagcug

SEQ ID NO: 3700342 - RNA, 14 nt, Human
ugaaacacagcugu

SEQ ID NO: 3700343 - RNA, 18 nt, Human
ugaaacacagcuguucuu

SEQ ID NO: 3700344 - RNA, 19 nt, Human
ugaaacacagcuguucuuc

SEQ ID NO: 3700345 - RNA, 23 nt, Human
ugaaacacucaguuguucaauaa

SEQ ID NO: 3700346 - RNA, 15 nt, Human
ugaaacacugguuuu

SEQ ID NO: 3700347 - RNA, 20 nt, Human
ugaaacacugguuuuaaaua

SEQ ID NO: 3700348 - RNA, 12 nt, Human
ugaaacagaaaa

SEQ ID NO: 3700349 - RNA, 15 nt, Human
ugaaacagaaaaaua

SEQ ID NO: 3700350 - RNA, 16 nt, Human
ugaaacagaaacaaaa

SEQ ID NO: 3700351 - RNA, 14 nt, Human
ugaaacagcugccu

SEQ ID NO: 3700352 - RNA, 15 nt, Human
ugaaacagcugccuu

SEQ ID NO: 3700353 - RNA, 19 nt, Human
ugaaacagcugccuuagcu

SEQ ID NO: 3700354 - RNA, 23 nt, Human
ugaaacagcugccuuagcuucag

SEQ ID NO: 3700355 - RNA, 22 nt, Human
ugaaacauaucucuuaucuuac

SEQ ID NO: 3700356 - RNA, 20 nt, Human
ugaaacaugcuuguguuucu

SEQ ID NO: 3700357 - RNA, 18 nt, Human
ugaaacauuuucucccug

SEQ ID NO: 3700358 - RNA, 19 nt, Human
ugaaacauuuucucccugg

SEQ ID NO: 3700359 - RNA, 14 nt, Human
ugaaacauuuuguc

SEQ ID NO: 3700360 - RNA, 23 nt, Human
ugaaacccugucucuacuaaaaa

SEQ ID NO: 3700361 - RNA, 16 nt, Human
ugaaaccuacacacug

SEQ ID NO: 3700362 - RNA, 18 nt, Human
ugaaaccuaguacugccc

SEQ ID NO: 3700363 - RNA, 18 nt, Human
ugaaaccuuuagggcagc

SEQ ID NO: 3700364 - RNA, 20 nt, Human
ugaaaccuuuagggcagcuu

SEQ ID NO: 3700365 - RNA, 21 nt, Human
ugaaaccuuuagggcagcuug

SEQ ID NO: 3700366 - RNA, 19 nt, Human
ugaaaccuuuuuccuagua

SEQ ID NO: 3700367 - RNA, 17 nt, Human
ugaaaccuuuuuuaaga

SEQ ID NO: 3700368 - RNA, 18 nt, Human
ugaaaccuuuuuuaagau

SEQ ID NO: 3700369 - RNA, 23 nt, Human
ugaaaccuuuuuuaagauuuuuc

SEQ ID NO: 3700370 - RNA, 20 nt, Human
ugaaacgcuccuuugugugu

SEQ ID NO: 3700371 - RNA, 20 nt, Human
ugaaacggaugauuucuaug

SEQ ID NO: 3700372 - RNA, 22 nt, Human
ugaaacuagaaagcagagauuu

SEQ ID NO: 3700373 - RNA, 15 nt, Human
ugaaacuagacuuga

SEQ ID NO: 3700374 - RNA, 20 nt, Human
ugaaacuagacuugaggaaa

SEQ ID NO: 3700375 - RNA, 13 nt, Human
ugaaacuauauuu

SEQ ID NO: 3700376 - RNA, 21 nt, Human
ugaaacuauauuuugucauau

SEQ ID NO: 3700377 - RNA, 19 nt, Human
ugaaacucauagacacuga

SEQ ID NO: 3700378 - RNA, 20 nt, Human
ugaaacugcuuguuuccuag

SEQ ID NO: 3700379 - RNA, 22 nt, Human
ugaaacuuauuuuuuucugauu

SEQ ID NO: 3700380 - RNA, 18 nt, Human
ugaaacuucaagcaccag

SEQ ID NO: 3700381 - RNA, 14 nt, Human
ugaaacuuugagau

SEQ ID NO: 3700382 - RNA, 23 nt, Human
ugaaacuuugagaucuaaaaaua

SEQ ID NO: 3700383 - RNA, 21 nt, Human
ugaaacuuugggaaaacaugu

SEQ ID NO: 3700384 - RNA, 15 nt, Human
ugaaacuuuucuaga

SEQ ID NO: 3700385 - RNA, 16 nt, Human
ugaaacuuuucuagaa

SEQ ID NO: 3700386 - RNA, 21 nt, Human
ugaaacuuuucuagaauuauu

SEQ ID NO: 3700387 - RNA, 22 nt, Human
ugaaagaaaauaccaaggaaca

SEQ ID NO: 3700388 - RNA, 20 nt, Human
ugaaagaaaauaugcaucua

SEQ ID NO: 3700389 - RNA, 14 nt, Human
ugaaagaaaauuga

SEQ ID NO: 3700390 - RNA, 14 nt, Human
ugaaagaaacaguu

SEQ ID NO: 3700391 - RNA, 16 nt, Human
ugaaagaaaggacucu

SEQ ID NO: 3700392 - RNA, 21 nt, Human
ugaaagaaaggggcaggagcu

SEQ ID NO: 3700393 - RNA, 20 nt, Human
ugaaagaauagaacacaguu

SEQ ID NO: 3700394 - RNA, 15 nt, Human
ugaaagacugaagaa

SEQ ID NO: 3700395 - RNA, 16 nt, Human
ugaaagacugaagaaa

SEQ ID NO: 3700396 - RNA, 21 nt, Human
ugaaagacuuccaaagaaugu

SEQ ID NO: 3700397 - RNA, 19 nt, Human
ugaaagaggcugaggccug

SEQ ID NO: 3700398 - RNA, 15 nt, Human
ugaaagagucuuucu

SEQ ID NO: 3700399 - RNA, 16 nt, Human
ugaaagaugaucauuu

SEQ ID NO: 3700400 - RNA, 22 nt, Human
ugaaagaugauuugcaauggga

SEQ ID NO: 3700401 - RNA, 18 nt, Human
ugaaagauggcugugccu

SEQ ID NO: 3700402 - RNA, 23 nt, Human
ugaaagauggcugugccucugcc

SEQ ID NO: 3700403 - RNA, 13 nt, Human
ugaaagauuaaac

SEQ ID NO: 3700404 - RNA, 15 nt, Human
ugaaagauuaaacag

SEQ ID NO: 3700405 - RNA, 21 nt, Human
ugaaagauucagguauguugc

SEQ ID NO: 3700406 - RNA, 20 nt, Human
ugaaagcaaaaaugcuaaua

SEQ ID NO: 3700407 - RNA, 11 nt, Human
ugaaagcacag

SEQ ID NO: 3700408 - RNA, 19 nt, Human
ugaaagcagggaauuucua

SEQ ID NO: 3700409 - RNA, 18 nt, Human
ugaaagcagggacuugaa

SEQ ID NO: 3700410 - RNA, 23 nt, Human
ugaaagcagggacuugaacccau

SEQ ID NO: 3700411 - RNA, 17 nt, Human
ugaaagcauccaugugu

SEQ ID NO: 3700412 - RNA, 13 nt, Human
ugaaagcccaagu

SEQ ID NO: 3700413 - RNA, 13 nt, Human
ugaaagcuagaga

SEQ ID NO: 3700414 - RNA, 17 nt, Human
ugaaagcucuguugcaa

SEQ ID NO: 3700415 - RNA, 21 nt, Human
ugaaagcugagaacuccugac

SEQ ID NO: 3700416 - RNA, 22 nt, Human
ugaaagcugagaacuccugacu

SEQ ID NO: 3700417 - RNA, 12 nt, Human
ugaaaggaaaga

SEQ ID NO: 3700418 - RNA, 13 nt, Human
ugaaaggaaagug

SEQ ID NO: 3700419 - RNA, 16 nt, Human
ugaaaggaaauuaagg

SEQ ID NO: 3700420 - RNA, 19 nt, Human
ugaaaggaagauaaacgug

SEQ ID NO: 3700421 - RNA, 22 nt, Human
ugaaaggcaggccuauuucauc

SEQ ID NO: 3700422 - RNA, 23 nt, Human
ugaaaggcaggccuauuucauca

SEQ ID NO: 3700423 - RNA, 21 nt, Human
ugaaaggcuuuucaaccacaa

SEQ ID NO: 3700424 - RNA, 22 nt, Human
ugaaagggagcuaucaggaaca

SEQ ID NO: 3700425 - RNA, 16 nt, Human
ugaaagggaucaucau

SEQ ID NO: 3700426 - RNA, 17 nt, Human
ugaaagggaucaucaug

SEQ ID NO: 3700427 - RNA, 23 nt, Human
ugaaagggcaauaugaaguuacu

SEQ ID NO: 3700428 - RNA, 15 nt, Human
ugaaagggcccagag

SEQ ID NO: 3700429 - RNA, 17 nt, Human
ugaaagggcccagagag

SEQ ID NO: 3700430 - RNA, 18 nt, Human
ugaaagggcccagagagg

SEQ ID NO: 3700431 - RNA, 16 nt, Human
ugaaagguaauuugag

SEQ ID NO: 3700432 - RNA, 15 nt, Human
ugaaagguacuauau

SEQ ID NO: 3700433 - RNA, 18 nt, Human
ugaaagguagacuuuuau

SEQ ID NO: 3700434 - RNA, 17 nt, Human
ugaaagguuuuuuuuca

SEQ ID NO: 3700435 - RNA, 18 nt, Human
ugaaagguuuuuuuucag

SEQ ID NO: 3700436 - RNA, 20 nt, Human
ugaaaguagcagugugaagu

SEQ ID NO: 3700437 - RNA, 14 nt, Human
ugaaagucaguuua

SEQ ID NO: 3700438 - RNA, 17 nt, Human
ugaaagucaugaacaca

SEQ ID NO: 3700439 - RNA, 22 nt, Human
ugaaagucuugugacuagugcu

SEQ ID NO: 3700440 - RNA, 16 nt, Human
ugaaagugaugacaua

SEQ ID NO: 3700441 - RNA, 18 nt, Human
ugaaagugcauuuuugua

SEQ ID NO: 3700442 - RNA, 21 nt, Human
ugaaagugcauuuuuguaaau

SEQ ID NO: 3700443 - RNA, 16 nt, Human
ugaaagugccuuugca

SEQ ID NO: 3700444 - RNA, 19 nt, Human
ugaaagugggcaaaagcuu

SEQ ID NO: 3700445 - RNA, 15 nt, Human
ugaaaguuguacaug

SEQ ID NO: 3700446 - RNA, 18 nt, Human
ugaaaguuuucagaaccu

SEQ ID NO: 3700447 - RNA, 13 nt, Human
ugaaaguuuugua

SEQ ID NO: 3700448 - RNA, 20 nt, Human
ugaaauaacaaaauggacau

SEQ ID NO: 3700449 - RNA, 20 nt, Human
ugaaauaagaauucagacau

SEQ ID NO: 3700450 - RNA, 18 nt, Human
ugaaauaagccagacauc

SEQ ID NO: 3700451 - RNA, 13 nt, Human
ugaaauaagcuau

SEQ ID NO: 3700452 - RNA, 22 nt, Human
ugaaauacauaugauaaauuug

SEQ ID NO: 3700453 - RNA, 22 nt, Human
ugaaauaccagugaaccaaaga

SEQ ID NO: 3700454 - RNA, 11 nt, Human
ugaaauaccuc

SEQ ID NO: 3700455 - RNA, 13 nt, Human
ugaaauaccucau

SEQ ID NO: 3700456 - RNA, 17 nt, Human
ugaaauaccucauguuu

SEQ ID NO: 3700457 - RNA, 19 nt, Human
ugaaauaccucauguuuau

SEQ ID NO: 3700458 - RNA, 16 nt, Human
ugaaauacuguuugag

SEQ ID NO: 3700459 - RNA, 17 nt, Human
ugaaauaggaaacaagu

SEQ ID NO: 3700460 - RNA, 18 nt, Human
ugaaauaggaaacaagug

SEQ ID NO: 3700461 - RNA, 19 nt, Human
ugaaauaguucaaagccaa

SEQ ID NO: 3700462 - RNA, 15 nt, Human
ugaaauaucuguauu

SEQ ID NO: 3700463 - RNA, 16 nt, Human
ugaaauaugauguuaa

SEQ ID NO: 3700464 - RNA, 20 nt, Human
ugaaauaugauguuaaaaaa

SEQ ID NO: 3700465 - RNA, 12 nt, Human
ugaaauaugcau

SEQ ID NO: 3700466 - RNA, 18 nt, Human
ugaaauaugcuggcugga

SEQ ID NO: 3700467 - RNA, 15 nt, Human
ugaaauaugugaagu

SEQ ID NO: 3700468 - RNA, 18 nt, Human
ugaaauauuauguuaaaa

SEQ ID NO: 3700469 - RNA, 16 nt, Human
ugaaauauuuuacagu

SEQ ID NO: 3700470 - RNA, 21 nt, Human
ugaaauauuuuuuaauuuaaa

SEQ ID NO: 3700471 - RNA, 22 nt, Human
ugaaaucaguaaacacugugua

SEQ ID NO: 3700472 - RNA, 16 nt, Human
ugaaaucaguuacucu

SEQ ID NO: 3700473 - RNA, 17 nt, Human
ugaaauccuugacugga

SEQ ID NO: 3700474 - RNA, 15 nt, Human
ugaaaucuaggaaaa

SEQ ID NO: 3700475 - RNA, 19 nt, Human
ugaaaucuaggaaaauuau

SEQ ID NO: 3700476 - RNA, 19 nt, Human
ugaaaucuuacagcugggu

SEQ ID NO: 3700477 - RNA, 14 nt, Human
ugaaaugaaauuua

SEQ ID NO: 3700478 - RNA, 17 nt, Human
ugaaaugaaauuuaaac

SEQ ID NO: 3700479 - RNA, 14 nt, Human
ugaaaugaacacaa

SEQ ID NO: 3700480 - RNA, 17 nt, Human
ugaaaugaacacaaauu

SEQ ID NO: 3700481 - RNA, 22 nt, Human
ugaaaugaacacaaauuaugcu

SEQ ID NO: 3700482 - RNA, 17 nt, Human
ugaaaugaccucugucc

SEQ ID NO: 3700483 - RNA, 19 nt, Human
ugaaaugaggucagagccu

SEQ ID NO: 3700484 - RNA, 20 nt, Human
ugaaaugaggucagagccug

SEQ ID NO: 3700485 - RNA, 19 nt, Human
ugaaaugaggucuguuuaa

SEQ ID NO: 3700486 - RNA, 14 nt, Human
ugaaaugauagauu

SEQ ID NO: 3700487 - RNA, 19 nt, Human
ugaaaugcagagucaauga

SEQ ID NO: 3700488 - RNA, 18 nt, Human
ugaaaugcaucauucuug

SEQ ID NO: 3700489 - RNA, 20 nt, Human
ugaaaugccuuacuuuguau

SEQ ID NO: 3700490 - RNA, 21 nt, Human
ugaaaugccuuacuuuguaug

SEQ ID NO: 3700491 - RNA, 17 nt, Human
ugaaaugcuaugucauu

SEQ ID NO: 3700492 - RNA, 17 nt, Human
ugaaaugcugaaaauug

SEQ ID NO: 3700493 - RNA, 19 nt, Human
ugaaauggacuuuuguaca

SEQ ID NO: 3700494 - RNA, 17 nt, Human
ugaaauggauacuacau

SEQ ID NO: 3700495 - RNA, 19 nt, Human
ugaaauguaaggcugugua

SEQ ID NO: 3700496 - RNA, 20 nt, Human
ugaaauguaaggcuguguaa

SEQ ID NO: 3700497 - RNA, 21 nt, Human
ugaaaugugaauuuuuauugu

SEQ ID NO: 3700498 - RNA, 19 nt, Human
ugaaaugugguuuuccuga

SEQ ID NO: 3700499 - RNA, 14 nt, Human
ugaaauguguguga

SEQ ID NO: 3700500 - RNA, 17 nt, Human
ugaaaugugugugaugu

SEQ ID NO: 3700501 - RNA, 19 nt, Human
ugaaaugugugugauguga

SEQ ID NO: 3700502 - RNA, 20 nt, Human
ugaaauguuacaaaaauaaa

SEQ ID NO: 3700503 - RNA, 18 nt, Human
ugaaauuaaccauagaug

SEQ ID NO: 3700504 - RNA, 22 nt, Human
ugaaauuaaccauagauguaga

SEQ ID NO: 3700505 - RNA, 17 nt, Human
ugaaauuaaccucucac

SEQ ID NO: 3700506 - RNA, 21 nt, Human
ugaaauuaagaaggcaaaaau

SEQ ID NO: 3700507 - RNA, 23 nt, Human
ugaaauuaagaaggcaaaaaugu

SEQ ID NO: 3700508 - RNA, 13 nt, Human
ugaaauuauaguu

SEQ ID NO: 3700509 - RNA, 12 nt, Human
ugaaauuauuca

SEQ ID NO: 3700510 - RNA, 18 nt, Human
ugaaauucacaaaguuaa

SEQ ID NO: 3700511 - RNA, 16 nt, Human
ugaaauuccaaagucu

SEQ ID NO: 3700512 - RNA, 15 nt, Human
ugaaauuccauuugu

SEQ ID NO: 3700513 - RNA, 23 nt, Human
ugaaauucuaaagagcacuuacu

SEQ ID NO: 3700514 - RNA, 13 nt, Human
ugaaauucuauuu

SEQ ID NO: 3700515 - RNA, 11 nt, Human
ugaaauucuga

SEQ ID NO: 3700516 - RNA, 13 nt, Human
ugaaauucugaau

SEQ ID NO: 3700517 - RNA, 16 nt, Human
ugaaauugaaaaguua

SEQ ID NO: 3700518 - RNA, 18 nt, Human
ugaaauugaaaaguuauu

SEQ ID NO: 3700519 - RNA, 16 nt, Human
ugaaauugcauacuuu

SEQ ID NO: 3700520 - RNA, 17 nt, Human
ugaaauuguacauauuu

SEQ ID NO: 3700521 - RNA, 16 nt, Human
ugaaauuuaaacauua

SEQ ID NO: 3700522 - RNA, 16 nt, Human
ugagaugcuggagaag

SEQ ID NO: 3700523 - RNA, 12 nt, Human
ugagaugcuggc

SEQ ID NO: 3700524 - RNA, 15 nt, Human
ugagaugcuggcuug

SEQ ID NO: 3700525 - RNA, 17 nt, Human
ugagauggagucuugcu

SEQ ID NO: 3700526 - RNA, 18 nt, Human
ugagauggcccucuggua

SEQ ID NO: 3700527 - RNA, 17 nt, Human
ugagauggggauaaaau

SEQ ID NO: 3700528 - RNA, 23 nt, Human
ugagauguaagucucaacucugu

SEQ ID NO: 3700529 - RNA, 23 nt, Human
ugagauguagccccucuccugga

SEQ ID NO: 3700530 - RNA, 12 nt, Human
ugagauguauga

SEQ ID NO: 3700531 - RNA, 19 nt, Human
ugagauugccccaggucug

SEQ ID NO: 3700532 - RNA, 16 nt, Human
ugagauuuauuaaaga

SEQ ID NO: 3700533 - RNA, 15 nt, Human
ugagauuuccuccug

SEQ ID NO: 3700534 - RNA, 22 nt, Human
ugagauuuuuaaaaaauauuuu

SEQ ID NO: 3700535 - RNA, 16 nt, Human
ugagcaaaccugcccc

SEQ ID NO: 3700536 - RNA, 20 nt, Human
ugagcaaaccugccccaucc

SEQ ID NO: 3700537 - RNA, 15 nt, Human
ugagcaaauguggcu

SEQ ID NO: 3700538 - RNA, 21 nt, Human
ugagcaacgcuauuccagcug

SEQ ID NO: 3700539 - RNA, 23 nt, Human
ugagcaaggagcacaagccacaa

SEQ ID NO: 3700540 - RNA, 22 nt, Human
ugagcacaacuuuaagaggaca

SEQ ID NO: 3700541 - RNA, 13 nt, Human
ugagcacacuuua

SEQ ID NO: 3700542 - RNA, 13 nt, Human
ugagcacagagug

SEQ ID NO: 3700543 - RNA, 16 nt, Human
ugagcaccaggggaug

SEQ ID NO: 3700544 - RNA, 14 nt, Human
ugagcaccucccag

SEQ ID NO: 3700545 - RNA, 15 nt, Human
ugagcaccucccagc

SEQ ID NO: 3700546 - RNA, 16 nt, Human
ugagcaccucccagcc

SEQ ID NO: 3700547 - RNA, 20 nt, Human
ugagcacggccaacaaagcu

SEQ ID NO: 3700548 - RNA, 20 nt, Human
ugagcacuaaggugugcucu

SEQ ID NO: 3700549 - RNA, 21 nt, Human
ugagcacuaaggugugcucug

SEQ ID NO: 3700550 - RNA, 23 nt, Human
ugagcacuaaggugugcucugau

SEQ ID NO: 3700551 - RNA, 15 nt, Human
ugagcacucccaagu

SEQ ID NO: 3700552 - RNA, 23 nt, Human
ugagcacucccaagucuacagag

SEQ ID NO: 3700553 - RNA, 15 nt, Human
ugagcacugccagga

SEQ ID NO: 3700554 - RNA, 16 nt, Human
ugagcacugccaggag

SEQ ID NO: 3700555 - RNA, 19 nt, Human
ugagcacugccaggaggga

SEQ ID NO: 3700556 - RNA, 22 nt, Human
ugagcacugccaggagggacaa

SEQ ID NO: 3700557 - RNA, 13 nt, Human
ugagcacuguagg

SEQ ID NO: 3700558 - RNA, 13 nt, Human
ugagcacuguuuu

SEQ ID NO: 3700559 - RNA, 14 nt, Human
ugagcacuguuuuc

SEQ ID NO: 3700560 - RNA, 14 nt, Human
ugagcacuuuucaa

SEQ ID NO: 3700561 - RNA, 18 nt, Human
ugagcagccuggagcccu

SEQ ID NO: 3700562 - RNA, 16 nt, Human
ugagcaggaaggccug

SEQ ID NO: 3700563 - RNA, 17 nt, Human
ugagcaggaaggccugg

SEQ ID NO: 3700564 - RNA, 18 nt, Human
ugagcaggaaggccuggg

SEQ ID NO: 3700565 - RNA, 22 nt, Human
ugagcaggccacacuucaaacu

SEQ ID NO: 3700566 - RNA, 17 nt, Human
ugagcagggcucagcgg

SEQ ID NO: 3700567 - RNA, 17 nt, Human
ugagcagucaggaaaga

SEQ ID NO: 3700568 - RNA, 20 nt, Human
ugagcagucaggaaagagaa

SEQ ID NO: 3700569 - RNA, 17 nt, Human
ugagcaguccuuggccu

SEQ ID NO: 3700570 - RNA, 20 nt, Human
ugagcaguccuuggccugcu

SEQ ID NO: 3700571 - RNA, 23 nt, Human
ugagcagugauauucuuuguuaa

SEQ ID NO: 3700572 - RNA, 12 nt, Human
ugagcaguggcu

SEQ ID NO: 3700573 - RNA, 15 nt, Human
ugagcaguggcuggu

SEQ ID NO: 3700574 - RNA, 15 nt, Human
ugagcagugugucuc

SEQ ID NO: 3700575 - RNA, 18 nt, Human
ugagcagugugucuccug

SEQ ID NO: 3700576 - RNA, 16 nt, Human
ugagcaguguuagcuu

SEQ ID NO: 3700577 - RNA, 13 nt, Human
ugagcauagguga

SEQ ID NO: 3700578 - RNA, 21 nt, Human
ugagcauaggugauccaugua

SEQ ID NO: 3700579 - RNA, 13 nt, Human
ugagcaucacaga

SEQ ID NO: 3700580 - RNA, 14 nt, Human
ugagcaucacagaa

SEQ ID NO: 3700581 - RNA, 15 nt, Human
ugagcaucacagaau

SEQ ID NO: 3700582 - RNA, 16 nt, Human
ugagcaucacaguuuu

SEQ ID NO: 3700583 - RNA, 13 nt, Human
ugagcaucaggcc

SEQ ID NO: 3700584 - RNA, 19 nt, Human
ugagcaucaggccaggccc

SEQ ID NO: 3700585 - RNA, 22 nt, Human
ugagcaucaggccaggcccucu

SEQ ID NO: 3700586 - RNA, 24 nt, Human
ugagcaucaggccaggcccucugc

SEQ ID NO: 3700587 - RNA, 16 nt, Human
ugagcauccugagccc

SEQ ID NO: 3700588 - RNA, 23 nt, Human
ugagcaucgcuuaggagaagucu

SEQ ID NO: 3700589 - RNA, 16 nt, Human
ugagcaucuguccccc

SEQ ID NO: 3700590 - RNA, 16 nt, Human
ugagcauggagcuggc

SEQ ID NO: 3700591 - RNA, 15 nt, Human
ugagccaccacgccc

SEQ ID NO: 3700592 - RNA, 19 nt, Human
ugagccaccgugccuggcc

SEQ ID NO: 3700593 - RNA, 20 nt, Human
ugagccaccgugccuggcca

SEQ ID NO: 3700594 - RNA, 13 nt, Human
ugagccacugcac

SEQ ID NO: 3700595 - RNA, 14 nt, Human
ugagccagauuuca

SEQ ID NO: 3700596 - RNA, 19 nt, Human
ugagccagauuucacucuc

SEQ ID NO: 3700597 - RNA, 23 nt, Human
ugagccagcagacauugucagca

SEQ ID NO: 3700598 - RNA, 21 nt, Human
ugagccaggcuagcuggagcc

SEQ ID NO: 3700599 - RNA, 22 nt, Human
ugagccagggucuccagaaagc

SEQ ID NO: 3700600 - RNA, 14 nt, Human
ugagccagucccag

SEQ ID NO: 3700601 - RNA, 19 nt, Human
ugagcccacugugcguggg

SEQ ID NO: 3700602 - RNA, 15 nt, Human
ugagcccagagaaca

SEQ ID NO: 3700603 - RNA, 21 nt, Human
ugagcccagcugggucaggca

SEQ ID NO: 3700604 - RNA, 13 nt, Human
ugagcccaggagu

SEQ ID NO: 3700605 - RNA, 14 nt, Human
ugagcccagggagg

SEQ ID NO: 3700606 - RNA, 15 nt, Human
ugagcccagggaggc

SEQ ID NO: 3700607 - RNA, 18 nt, Human
ugagcccauguucugccc

SEQ ID NO: 3700608 - RNA, 23 nt, Human
ugagcccauguucugcccccagc

SEQ ID NO: 3700609 - RNA, 14 nt, Human
ugagccccagggag

SEQ ID NO: 3700610 - RNA, 21 nt, Human
ugagccccagggugcccagaa

SEQ ID NO: 3700611 - RNA, 23 nt, Human
ugagccccagggugcccagaacu

SEQ ID NO: 3700612 - RNA, 20 nt, Human
ugagcccccccaacacugug

SEQ ID NO: 3700613 - RNA, 23 nt, Human
ugagcccccccaacacugugccc

SEQ ID NO: 3700614 - RNA, 22 nt, Human
ugagccccgcccucuuccugac

SEQ ID NO: 3700615 - RNA, 12 nt, Human
ugagccccuucc

SEQ ID NO: 3700616 - RNA, 14 nt, Human
ugagcccgggcugc

SEQ ID NO: 3700617 - RNA, 17 nt, Human
ugagcccgggcugccug

SEQ ID NO: 3700618 - RNA, 21 nt, Human
ugagcccgggcugccugggcu

SEQ ID NO: 3700619 - RNA, 22 nt, Human
ugagcccgggcugccugggcug

SEQ ID NO: 3700620 - RNA, 20 nt, Human
ugagcccuacucccugcaga

SEQ ID NO: 3700621 - RNA, 12 nt, Human
ugagcccucaga

SEQ ID NO: 3700622 - RNA, 14 nt, Human
ugagcccuccccag

SEQ ID NO: 3700623 - RNA, 24 nt, Human
ugagcccuucggaggaccagggcu

SEQ ID NO: 3700624 - RNA, 21 nt, Human
ugagccgagaucacgccacug

SEQ ID NO: 3700625 - RNA, 20 nt, Human
ugagccgcaucuucuccauc

SEQ ID NO: 3700626 - RNA, 15 nt, Human
ugagccgcccaaggc

SEQ ID NO: 3700627 - RNA, 19 nt, Human
ugagccgcccaaggccuuc

SEQ ID NO: 3700628 - RNA, 17 nt, Human
ugagccgggccccuggg

SEQ ID NO: 3700629 - RNA, 19 nt, Human
ugagccgggccccugggcu

SEQ ID NO: 3700630 - RNA, 20 nt, Human
ugagccgggccccugggcuu

SEQ ID NO: 3700631 - RNA, 14 nt, Human
ugagccgugaacug

SEQ ID NO: 3700632 - RNA, 14 nt, Human
ugagccuaaaaaua

SEQ ID NO: 3700633 - RNA, 16 nt, Human
ugagccuacagaugaa

SEQ ID NO: 3700634 - RNA, 15 nt, Human
ugagccucacagcag

SEQ ID NO: 3700635 - RNA, 13 nt, Human
ugagccucagcau

SEQ ID NO: 3700636 - RNA, 22 nt, Human
ugagccucagcauccuggcacc

SEQ ID NO: 3700637 - RNA, 14 nt, Human
ugagccucagucuc

SEQ ID NO: 3700638 - RNA, 19 nt, Human
ugagccucucaccuguacu

SEQ ID NO: 3700639 - RNA, 14 nt, Human
ugagccucugcucc

SEQ ID NO: 3700640 - RNA, 17 nt, Human
ugagccugcagggaagc

SEQ ID NO: 3700641 - RNA, 10 nt, Human
ugagccuggc

SEQ ID NO: 3700642 - RNA, 11 nt, Human
ugagccuggcc

SEQ ID NO: 3700643 - RNA, 13 nt, Human
ugagccuggcucu

SEQ ID NO: 3700644 - RNA, 16 nt, Human
ugagccugggaaauaa

SEQ ID NO: 3700645 - RNA, 11 nt, Human
ugagccugguc

SEQ ID NO: 3700646 - RNA, 13 nt, Human
ugagccuucaguc

SEQ ID NO: 3700647 - RNA, 14 nt, Human
ugagccuucugagc

SEQ ID NO: 3700648 - RNA, 17 nt, Human
ugagcgacaaagaugau

SEQ ID NO: 3700649 - RNA, 20 nt, Human
ugagcgacagugagacucug

SEQ ID NO: 3700650 - RNA, 22 nt, Human
ugagcgaggagaugcuccuugg

SEQ ID NO: 3700651 - RNA, 23 nt, Human
ugagcgauuauuaucuaaagugu

SEQ ID NO: 3700652 - RNA, 23 nt, Human
ugagcgccuccauccaaggccag

SEQ ID NO: 3700653 - RNA, 18 nt, Human
ugagcgccuggauuucug

SEQ ID NO: 3700654 - RNA, 14 nt, Human
ugagcgcuccugcc

SEQ ID NO: 3700655 - RNA, 18 nt, Human
ugagcgcuccugccgcag

SEQ ID NO: 3700656 - RNA, 12 nt, Human
ugagcgggaggc

SEQ ID NO: 3700657 - RNA, 21 nt, Human
ugagcggugcuguccucaggu

SEQ ID NO: 3700658 - RNA, 17 nt, Human
ugagcguccagaaaugg

SEQ ID NO: 3700659 - RNA, 15 nt, Human
ugagcgugacacuca

SEQ ID NO: 3700660 - RNA, 14 nt, Human
ugagcuacaaaugc

SEQ ID NO: 3700661 - RNA, 18 nt, Human
ugagcuacuggauucuua

SEQ ID NO: 3700662 - RNA, 19 nt, Human
ugagcuagaagcuggagga

SEQ ID NO: 3700663 - RNA, 19 nt, Human
ugagcuaugacuuaacaua

SEQ ID NO: 3700664 - RNA, 18 nt, Human
ugagcuauuaaaacucag

SEQ ID NO: 3700665 - RNA, 16 nt, Human
ugagcuauugcuguuc

SEQ ID NO: 3700666 - RNA, 22 nt, Human
ugagcucagacccccacucuca

SEQ ID NO: 3700667 - RNA, 20 nt, Human
ugagcucagcccuggugggc

SEQ ID NO: 3700668 - RNA, 14 nt, Human
ugagcucagcgugg

SEQ ID NO: 3700669 - RNA, 19 nt, Human
ugagcucaggaguuugaga

SEQ ID NO: 3700670 - RNA, 17 nt, Human
ugagcuccagaccccca

SEQ ID NO: 3700671 - RNA, 19 nt, Human
ugagcucccacaagccuga

SEQ ID NO: 3700672 - RNA, 17 nt, Human
ggguuugccauuugaua

SEQ ID NO: 3700673 - RNA, 20 nt, Human
ggguuuggcgggccaaggac

SEQ ID NO: 3700674 - RNA, 22 nt, Human
ggguuuggcgggccaaggacug

SEQ ID NO: 3700675 - RNA, 14 nt, Human
ggguuuuauauuuu

SEQ ID NO: 3700676 - RNA, 20 nt, Human
ggguuuuauuguuuaaaauc

SEQ ID NO: 3700677 - RNA, 18 nt, Human
ggguuuuccaaugugacu

SEQ ID NO: 3700678 - RNA, 16 nt, Human
ggguuuuccacccugg

SEQ ID NO: 3700679 - RNA, 14 nt, Human
gguaaaacaaaaca

SEQ ID NO: 3700680 - RNA, 23 nt, Human
gguaaaagugugagcagugaguu

SEQ ID NO: 3700681 - RNA, 13 nt, Human
gguaaaauacuuc

SEQ ID NO: 3700682 - RNA, 23 nt, Human
gguaaaauacuuuuacucugccu

SEQ ID NO: 3700683 - RNA, 13 nt, Human
gguaaaauguauu

SEQ ID NO: 3700684 - RNA, 16 nt, Human
gguaaaauuagaugca

SEQ ID NO: 3700685 - RNA, 22 nt, Human
gguaaaauuagaugcauguuga

SEQ ID NO: 3700686 - RNA, 16 nt, Human
gguaaacacgccugca

SEQ ID NO: 3700687 - RNA, 15 nt, Human
gguaaagacuggcuu

SEQ ID NO: 3700688 - RNA, 20 nt, Human
gguaaaguuaaguugagaua

SEQ ID NO: 3700689 - RNA, 15 nt, Human
gguaaaucaguaaga

SEQ ID NO: 3700690 - RNA, 16 nt, Human
gguaaauguuucuuuu

SEQ ID NO: 3700691 - RNA, 21 nt, Human
gguaaauguuucuuuuaaaga

SEQ ID NO: 3700692 - RNA, 18 nt, Human
gguaaauuuccccaacag

SEQ ID NO: 3700693 - RNA, 21 nt, Human
gguaacagaacagcuucaggu

SEQ ID NO: 3700694 - RNA, 22 nt, Human
gguaacauccuuucuauugaaa

SEQ ID NO: 3700695 - RNA, 17 nt, Human
gguaacuguccuguccu

SEQ ID NO: 3700696 - RNA, 24 nt, Human
gguaacuuuugugaauuaggcugu

SEQ ID NO: 3700697 - RNA, 23 nt, Human
gguaagaagccgggaacagacaa

SEQ ID NO: 3700698 - RNA, 15 nt, Human
gguaagauuguuauu

SEQ ID NO: 3700699 - RNA, 13 nt, Human
gguaagcuuccag

SEQ ID NO: 3700700 - RNA, 20 nt, Human
gguaaucaaugaauauugaa

SEQ ID NO: 3700701 - RNA, 22 nt, Human
gguaauuguugcuaaucuucuu

SEQ ID NO: 3700702 - RNA, 19 nt, Human
gguacaaaaauaaauuuau

SEQ ID NO: 3700703 - RNA, 16 nt, Human
gguacaauuucuuuug

SEQ ID NO: 3700704 - RNA, 16 nt, Human
gguacauggugcuggg

SEQ ID NO: 3700705 - RNA, 19 nt, Human
gguacauuuauaauugcau

SEQ ID NO: 3700706 - RNA, 23 nt, Human
gguacauuuuucaacuuugaaua

SEQ ID NO: 3700707 - RNA, 17 nt, Human
gguaccagauaacuuuu

SEQ ID NO: 3700708 - RNA, 14 nt, Human
gguaccagaugcag

SEQ ID NO: 3700709 - RNA, 20 nt, Human
gguaccaggucuccuccacc

SEQ ID NO: 3700710 - RNA, 16 nt, Human
gguacccacugcucug

SEQ ID NO: 3700711 - RNA, 12 nt, Human
gguacccagcca

SEQ ID NO: 3700712 - RNA, 21 nt, Human
gguacccagccaucugcccag

SEQ ID NO: 3700713 - RNA, 14 nt, Human
gguacccuccuggc

SEQ ID NO: 3700714 - RNA, 11 nt, Human
gguacccuggg

SEQ ID NO: 3700715 - RNA, 23 nt, Human
gguaccuugcacacaucaucugu

SEQ ID NO: 3700716 - RNA, 14 nt, Human
gguacuaaauuuaa

SEQ ID NO: 3700717 - RNA, 16 nt, Human
gguacucuccuagaga

SEQ ID NO: 3700718 - RNA, 15 nt, Human
gguacucuuguugag

SEQ ID NO: 3700719 - RNA, 20 nt, Human
gguacuguacagcuggcucu

SEQ ID NO: 3700720 - RNA, 16 nt, Human
gguacuucuugaaggu

SEQ ID NO: 3700721 - RNA, 16 nt, Human
gguacuugucauuucg

SEQ ID NO: 3700722 - RNA, 21 nt, Human
gguacuuuuaugauguauauu

SEQ ID NO: 3700723 - RNA, 20 nt, Human
gguacuuuugagugugugug

SEQ ID NO: 3700724 - RNA, 17 nt, Human
gguacuuuuugugaaga

SEQ ID NO: 3700725 - RNA, 15 nt, Human
gguagaauguaaagc

SEQ ID NO: 3700726 - RNA, 15 nt, Human
gguagacacacauga

SEQ ID NO: 3700727 - RNA, 19 nt, Human
gguagaccaggauuucuaa

SEQ ID NO: 3700728 - RNA, 14 nt, Human
gguagaccugucuc

SEQ ID NO: 3700729 - RNA, 15 nt, Human
gguagagcugaucca

SEQ ID NO: 3700730 - RNA, 23 nt, Human
gguagagcugauccagagcacag

SEQ ID NO: 3700731 - RNA, 23 nt, Human
gguagaguuugaaggaggugagg

SEQ ID NO: 3700732 - RNA, 14 nt, Human
gguagcauuuuaaa

SEQ ID NO: 3700733 - RNA, 14 nt, Human
gguagccaggggga

SEQ ID NO: 3700734 - RNA, 13 nt, Human
gguagccugcugg

SEQ ID NO: 3700735 - RNA, 22 nt, Human
gguagcgggggaggguaggcag

SEQ ID NO: 3700736 - RNA, 18 nt, Human
gguagcugccccuggcuc

SEQ ID NO: 3700737 - RNA, 19 nt, Human
gguagcugccccuggcucu

SEQ ID NO: 3700738 - RNA, 18 nt, Human
gguagcuuaccugacaca

SEQ ID NO: 3700739 - RNA, 18 nt, Human
gguaggaacugcugggcu

SEQ ID NO: 3700740 - RNA, 20 nt, Human
gguaggccuuuuaacauuuu

SEQ ID NO: 3700741 - RNA, 15 nt, Human
gguagggaggcagcc

SEQ ID NO: 3700742 - RNA, 17 nt, Human
gguagggaggcagccuc

SEQ ID NO: 3700743 - RNA, 13 nt, Human
gguaggggcuggg

SEQ ID NO: 3700744 - RNA, 23 nt, Human
gguagggggcuggaggagcccag

SEQ ID NO: 3700745 - RNA, 23 nt, Human
gguaggggggaaacagguuggga

SEQ ID NO: 3700746 - RNA, 16 nt, Human
gguaggguaaaucagu

SEQ ID NO: 3700747 - RNA, 17 nt, Human
gguagguugggacacca

SEQ ID NO: 3700748 - RNA, 21 nt, Human
gguaguaccuuuuauauccca

SEQ ID NO: 3700749 - RNA, 20 nt, Human
gguagucucacugcuugaac

SEQ ID NO: 3700750 - RNA, 21 nt, Human
gguaguuaggaugcucaguug

SEQ ID NO: 3700751 - RNA, 19 nt, Human
gguaguuaguagcauguug

SEQ ID NO: 3700752 - RNA, 18 nt, Human
gguaguugcaauugaauu

SEQ ID NO: 3700753 - RNA, 21 nt, Human
gguauaaaacuuuccucgccu

SEQ ID NO: 3700754 - RNA, 13 nt, Human
gguauaaaagaug

SEQ ID NO: 3700755 - RNA, 16 nt, Human
gguauaaaagaugggg

SEQ ID NO: 3700756 - RNA, 23 nt, Human
gguauaaaggcauugauauuuua

SEQ ID NO: 3700757 - RNA, 18 nt, Human
gguauaaguggugugugu

SEQ ID NO: 3700758 - RNA, 20 nt, Human
gguauaaugguugacugggu

SEQ ID NO: 3700759 - RNA, 23 nt, Human
gguauaguucaugucugcuauca

SEQ ID NO: 3700760 - RNA, 18 nt, Human
gguauauauccgccuggc

SEQ ID NO: 3700761 - RNA, 22 nt, Human
gguauaucauuauaacugaagg

SEQ ID NO: 3700762 - RNA, 17 nt, Human
gguauaucauucuaaag

SEQ ID NO: 3700763 - RNA, 15 nt, Human
gguauaucugggcug

SEQ ID NO: 3700764 - RNA, 14 nt, Human
gguaucaaaauuac

SEQ ID NO: 3700765 - RNA, 21 nt, Human
gguaucaaacagcucaggcug

SEQ ID NO: 3700766 - RNA, 14 nt, Human
gguaucaggugcug

SEQ ID NO: 3700767 - RNA, 19 nt, Human
gguaucaggugcugccauc

SEQ ID NO: 3700768 - RNA, 18 nt, Human
gguauccccccaucuugc

SEQ ID NO: 3700769 - RNA, 20 nt, Human
gguaucuaauucuuuaauga

SEQ ID NO: 3700770 - RNA, 16 nt, Human
gguaucuguucuuuaa

SEQ ID NO: 3700771 - RNA, 21 nt, Human
gguaugaacuugaggacacau

SEQ ID NO: 3700772 - RNA, 22 nt, Human
gguaugaacuugaggacacaug

SEQ ID NO: 3700773 - RNA, 14 nt, Human
gguaugagcugagg

SEQ ID NO: 3700774 - RNA, 16 nt, Human
gguaugagcugagggg

SEQ ID NO: 3700775 - RNA, 22 nt, Human
gguauggcguaaguacagagaa

SEQ ID NO: 3700776 - RNA, 14 nt, Human
gguaugucugccau

SEQ ID NO: 3700777 - RNA, 14 nt, Human
gguaugugugugua

SEQ ID NO: 3700778 - RNA, 18 nt, Human
gguauuaugcuucuugga

SEQ ID NO: 3700779 - RNA, 18 nt, Human
gguauuccuuuuguguac

SEQ ID NO: 3700780 - RNA, 12 nt, Human
gguauuguauuu

SEQ ID NO: 3700781 - RNA, 20 nt, Human
gguauuguauuuauucaaua

SEQ ID NO: 3700782 - RNA, 14 nt, Human
gguauuuaaaguau

SEQ ID NO: 3700783 - RNA, 20 nt, Human
gguauuuaucuauuguaaga

SEQ ID NO: 3700784 - RNA, 20 nt, Human
gguauuuucccccuuuucug

SEQ ID NO: 3700785 - RNA, 18 nt, Human
gguauuuuugcccugagu

SEQ ID NO: 3700786 - RNA, 18 nt, Human
ggucaaaauagugccacu

SEQ ID NO: 3700787 - RNA, 18 nt, Human
ggucaacagaaugaaaaa

SEQ ID NO: 3700788 - RNA, 22 nt, Human
ggucaacuugagcauguuacug

SEQ ID NO: 3700789 - RNA, 14 nt, Human
ggucaagaaacagc

SEQ ID NO: 3700790 - RNA, 15 nt, Human
ggucaagcccaggag

SEQ ID NO: 3700791 - RNA, 19 nt, Human
ggucaagcccaggaggacu

SEQ ID NO: 3700792 - RNA, 18 nt, Human
ggucaaguuauuaauuuc

SEQ ID NO: 3700793 - RNA, 22 nt, Human
ggucaaguugucagguuauuua

SEQ ID NO: 3700794 - RNA, 20 nt, Human
ggucaauacaguacaggcag

SEQ ID NO: 3700795 - RNA, 13 nt, Human
ggucaaucccaaa

SEQ ID NO: 3700796 - RNA, 14 nt, Human
ggucaaugcuauuu

SEQ ID NO: 3700797 - RNA, 23 nt, Human
ggucaaugcuauuuuuguuuuua

SEQ ID NO: 3700798 - RNA, 17 nt, Human
ggucacagccaggcgcu

SEQ ID NO: 3700799 - RNA, 13 nt, Human
ggucacagccucc

SEQ ID NO: 3700800 - RNA, 17 nt, Human
ggucacauucaggaaga

SEQ ID NO: 3700801 - RNA, 21 nt, Human
ggucacauucaggaagaugaa

SEQ ID NO: 3700802 - RNA, 15 nt, Human
ggucaccaugaaacu

SEQ ID NO: 3700803 - RNA, 19 nt, Human
ggucaccucacucagcacc

SEQ ID NO: 3700804 - RNA, 21 nt, Human
ggucaccucacucagcaccac

SEQ ID NO: 3700805 - RNA, 12 nt, Human
ggucacucuggc

SEQ ID NO: 3700806 - RNA, 19 nt, Human
ggucacugaaacuucaagc

SEQ ID NO: 3700807 - RNA, 20 nt, Human
ggucacugaggccugagacc

SEQ ID NO: 3700808 - RNA, 15 nt, Human
ggucacugccaugga

SEQ ID NO: 3700809 - RNA, 13 nt, Human
ggucacuggaaag

SEQ ID NO: 3700810 - RNA, 16 nt, Human
ggucacuggcucucca

SEQ ID NO: 3700811 - RNA, 18 nt, Human
ggucacuguuuccugggc

SEQ ID NO: 3700812 - RNA, 21 nt, Human
ggucacuuaaaaugugcagua

SEQ ID NO: 3700813 - RNA, 17 nt, Human
ggucagaaacaggaccg

SEQ ID NO: 3700814 - RNA, 17 nt, Human
ggucagaagagagggug

SEQ ID NO: 3700815 - RNA, 16 nt, Human
ggucagagccugcagu

SEQ ID NO: 3700816 - RNA, 18 nt, Human
ggucagaggaccuguauu

SEQ ID NO: 3700817 - RNA, 19 nt, Human
ggucagaggaccuguauuu

SEQ ID NO: 3700818 - RNA, 21 nt, Human
ggucagcaugucuauucagcu

SEQ ID NO: 3700819 - RNA, 18 nt, Human
ggucagccagggccaggg

SEQ ID NO: 3700820 - RNA, 16 nt, Human
ugagcuccccaaaaac

SEQ ID NO: 3700821 - RNA, 20 nt, Human
ugagcuccccaccaccccag

SEQ ID NO: 3700822 - RNA, 16 nt, Human
ugagcuccucugggca

SEQ ID NO: 3700823 - RNA, 19 nt, Human
ugagcuccucugggcagga

SEQ ID NO: 3700824 - RNA, 20 nt, Human
ugagcuccuguccccugcua

SEQ ID NO: 3700825 - RNA, 22 nt, Human
ugagcuccuguccccugcuaca

SEQ ID NO: 3700826 - RNA, 20 nt, Human
ugagcucgguggacccaggg

SEQ ID NO: 3700827 - RNA, 22 nt, Human
ugagcucuacccagggccugca

SEQ ID NO: 3700828 - RNA, 20 nt, Human
ugagcucucggaacugcaug

SEQ ID NO: 3700829 - RNA, 21 nt, Human
ugagcucucggaacugcaugc

SEQ ID NO: 3700830 - RNA, 13 nt, Human
ugagcucucugcc

SEQ ID NO: 3700831 - RNA, 22 nt, Human
ugagcucugcauuugucuauuc

SEQ ID NO: 3700832 - RNA, 15 nt, Human
ugagcucuucauguu

SEQ ID NO: 3700833 - RNA, 22 nt, Human
ugagcucuugugaggaaaguca

SEQ ID NO: 3700834 - RNA, 17 nt, Human
ugagcugaaagaggcca

SEQ ID NO: 3700835 - RNA, 20 nt, Human
ugagcugaaaugcugcauuu

SEQ ID NO: 3700836 - RNA, 17 nt, Human
ugagcugagaucgugcc

SEQ ID NO: 3700837 - RNA, 15 nt, Human
ugagcugagccaggc

SEQ ID NO: 3700838 - RNA, 14 nt, Human
ugagcugaggcagc

SEQ ID NO: 3700839 - RNA, 16 nt, Human
ugagcugauauaaauu

SEQ ID NO: 3700840 - RNA, 16 nt, Human
ugagcugaucugcgga

SEQ ID NO: 3700841 - RNA, 11 nt, Human
ugagcugccuu

SEQ ID NO: 3700842 - RNA, 19 nt, Human
ugagcugcugacugccaau

SEQ ID NO: 3700843 - RNA, 13 nt, Human
ugagcugggauga

SEQ ID NO: 3700844 - RNA, 14 nt, Human
ugagcugggcaugg

SEQ ID NO: 3700845 - RNA, 20 nt, Human
ugagcuggggaugucucuca

SEQ ID NO: 3700846 - RNA, 15 nt, Human
ugagcuguugccuca

SEQ ID NO: 3700847 - RNA, 23 nt, Human
ugagcuuaagaauuuugagcagg

SEQ ID NO: 3700848 - RNA, 16 nt, Human
ugagcuuagugaaauu

SEQ ID NO: 3700849 - RNA, 15 nt, Human
ugagcuucucuguga

SEQ ID NO: 3700850 - RNA, 16 nt, Human
ugagcuucucugugaa

SEQ ID NO: 3700851 - RNA, 15 nt, Human
ugagcuuggccagaa

SEQ ID NO: 3700852 - RNA, 22 nt, Human
ugagcuuuauguaauaauguga

SEQ ID NO: 3700853 - RNA, 18 nt, Human
ugagcuuucugaacagcu

SEQ ID NO: 3700854 - RNA, 22 nt, Human
ugagcuuugcauguuccacuaa

SEQ ID NO: 3700855 - RNA, 17 nt, Human
ugagcuuugcugcuaca

SEQ ID NO: 3700856 - RNA, 17 nt, Human
ugagcuuuggacacaca

SEQ ID NO: 3700857 - RNA, 22 nt, Human
ugagcuuuggacacacacagcu

SEQ ID NO: 3700858 - RNA, 19 nt, Human
ugagcuuuggacgcacaca

SEQ ID NO: 3700859 - RNA, 12 nt, Human
ugagcuuuucua

SEQ ID NO: 3700860 - RNA, 13 nt, Human
ugagcuuuucuag

SEQ ID NO: 3700861 - RNA, 23 nt, Human
ugaggaaaaaaaucguccaggga

SEQ ID NO: 3700862 - RNA, 18 nt, Human
ugaggaaaaauaugugaa

SEQ ID NO: 3700863 - RNA, 19 nt, Human
ugaggaaaaauaugugaag

SEQ ID NO: 3700864 - RNA, 15 nt, Human
ugaggaaaauucuua

SEQ ID NO: 3700865 - RNA, 17 nt, Human
ugaggaaagcacacagu

SEQ ID NO: 3700866 - RNA, 19 nt, Human
ugaggaaagcauguauuca

SEQ ID NO: 3700867 - RNA, 15 nt, Human
ugaggaaaggccagc

SEQ ID NO: 3700868 - RNA, 17 nt, Human
ugaggaaagucauuggc

SEQ ID NO: 3700869 - RNA, 18 nt, Human
ugaggaaagucauuggcu

SEQ ID NO: 3700870 - RNA, 16 nt, Human
ugaggaaaucaaagug

SEQ ID NO: 3700871 - RNA, 18 nt, Human
ugaggaaaucaaagugcu

SEQ ID NO: 3700872 - RNA, 22 nt, Human
ugaggaaaucaaagugcuauua

SEQ ID NO: 3700873 - RNA, 14 nt, Human
ugaggaaauuugca

SEQ ID NO: 3700874 - RNA, 15 nt, Human
ugaggaacuguacag

SEQ ID NO: 3700875 - RNA, 19 nt, Human
ugaggaacuguagaugaug

SEQ ID NO: 3700876 - RNA, 22 nt, Human
ugaggaagcaaaagcaucuaug

SEQ ID NO: 3700877 - RNA, 23 nt, Human
ugaggaagccagguccacggucu

SEQ ID NO: 3700878 - RNA, 17 nt, Human
ugaggaagccgcugggg

SEQ ID NO: 3700879 - RNA, 16 nt, Human
ugaggaagcuccaguc

SEQ ID NO: 3700880 - RNA, 19 nt, Human
ugaggaagcuccaguccug

SEQ ID NO: 3700881 - RNA, 23 nt, Human
ugaggaagcuccaguccugcucu

SEQ ID NO: 3700882 - RNA, 19 nt, Human
ugaggaaggcaggaagaga

SEQ ID NO: 3700883 - RNA, 20 nt, Human
ugaggaaggcaggaagagag

SEQ ID NO: 3700884 - RNA, 19 nt, Human
ugaggaauaguugagcccc

SEQ ID NO: 3700885 - RNA, 20 nt, Human
ugaggaauaguugagcccca

SEQ ID NO: 3700886 - RNA, 19 nt, Human
ugaggaauguauauguuuu

SEQ ID NO: 3700887 - RNA, 15 nt, Human
ugaggaauuucaccu

SEQ ID NO: 3700888 - RNA, 13 nt, Human
ugaggacaagaga

SEQ ID NO: 3700889 - RNA, 16 nt, Human
ugaggacacaugucca

SEQ ID NO: 3700890 - RNA, 18 nt, Human
ugaggacagaugccuccu

SEQ ID NO: 3700891 - RNA, 16 nt, Human
ugaggacagcuguccu

SEQ ID NO: 3700892 - RNA, 17 nt, Human
ugaggacagcuguccuc

SEQ ID NO: 3700893 - RNA, 21 nt, Human
ugaggagagaaaauauaugua

SEQ ID NO: 3700894 - RNA, 11 nt, Human
ugaggagcccc

SEQ ID NO: 3700895 - RNA, 16 nt, Human
ugaggagcuugaaacc

SEQ ID NO: 3700896 - RNA, 17 nt, Human
ugaggaggccuccaucu

SEQ ID NO: 3700897 - RNA, 13 nt, Human
ugaggaggguggg

SEQ ID NO: 3700898 - RNA, 16 nt, Human
ugaggaguaaaauuca

SEQ ID NO: 3700899 - RNA, 16 nt, Human
ugaggagucuugugug

SEQ ID NO: 3700900 - RNA, 16 nt, Human
ugaggagugugagaau

SEQ ID NO: 3700901 - RNA, 14 nt, Human
ugaggaguuuccua

SEQ ID NO: 3700902 - RNA, 21 nt, Human
ugaggaguuuccuaaaaguuc

SEQ ID NO: 3700903 - RNA, 15 nt, Human
ugaggaucagaaagu

SEQ ID NO: 3700904 - RNA, 17 nt, Human
ugaggaucagaguaauc

SEQ ID NO: 3700905 - RNA, 19 nt, Human
ugaggaucagaguaaucca

SEQ ID NO: 3700906 - RNA, 22 nt, Human
ugaggaugaaaaaauaacacug

SEQ ID NO: 3700907 - RNA, 16 nt, Human
ugaggaugagcuggaa

SEQ ID NO: 3700908 - RNA, 14 nt, Human
ugaggaugauguac

SEQ ID NO: 3700909 - RNA, 12 nt, Human
ugaggaugggaa

SEQ ID NO: 3700910 - RNA, 16 nt, Human
ugaggaugggaaggag

SEQ ID NO: 3700911 - RNA, 20 nt, Human
ugaggauuaguuuagaacag

SEQ ID NO: 3700912 - RNA, 16 nt, Human
ugaggauuuagaagug

SEQ ID NO: 3700913 - RNA, 16 nt, Human
ugaggauuuugaguau

SEQ ID NO: 3700914 - RNA, 14 nt, Human
ugaggcaaaagaag

SEQ ID NO: 3700915 - RNA, 20 nt, Human
ugaggcaaccugauuguaaa

SEQ ID NO: 3700916 - RNA, 15 nt, Human
ugaggcaaguguggg

SEQ ID NO: 3700917 - RNA, 16 nt, Human
ugaggcaaugucagga

SEQ ID NO: 3700918 - RNA, 20 nt, Human
ugaggcaaugucaggaacag

SEQ ID NO: 3700919 - RNA, 14 nt, Human
ugaggcagacagca

SEQ ID NO: 3700920 - RNA, 15 nt, Human
ugaggcagacagcag

SEQ ID NO: 3700921 - RNA, 21 nt, Human
ugaggcagcagugugaggcca

SEQ ID NO: 3700922 - RNA, 22 nt, Human
ugaggcagggaaguccccaggc

SEQ ID NO: 3700923 - RNA, 15 nt, Human
ugaggcaggggcgga

SEQ ID NO: 3700924 - RNA, 17 nt, Human
ugaggcagguccccaga

SEQ ID NO: 3700925 - RNA, 19 nt, Human
ugaggcagugggucccacu

SEQ ID NO: 3700926 - RNA, 21 nt, Human
ugaggcagugggucccacuuc

SEQ ID NO: 3700927 - RNA, 22 nt, Human
ugaggcagugggucccacuucc

SEQ ID NO: 3700928 - RNA, 18 nt, Human
ugaggcauugcacaggga

SEQ ID NO: 3700929 - RNA, 21 nt, Human
ugaggcauuuguuugaacuga

SEQ ID NO: 3700930 - RNA, 22 nt, Human
ugaggccaaacguuuugaacua

SEQ ID NO: 3700931 - RNA, 21 nt, Human
ugaggccaagaauauugcaaa

SEQ ID NO: 3700932 - RNA, 15 nt, Human
ugaggccacugaaga

SEQ ID NO: 3700933 - RNA, 12 nt, Human
ugaggccagaga

SEQ ID NO: 3700934 - RNA, 17 nt, Human
ugaggccagccuggccu

SEQ ID NO: 3700935 - RNA, 18 nt, Human
ugaggccagccuggccuc

SEQ ID NO: 3700936 - RNA, 20 nt, Human
ugaggccauggacucugucc

SEQ ID NO: 3700937 - RNA, 17 nt, Human
ugaggcccagagggccu

SEQ ID NO: 3700938 - RNA, 18 nt, Human
ugaggcccagagggccug

SEQ ID NO: 3700939 - RNA, 20 nt, Human
ugaggcccagagggccugca

SEQ ID NO: 3700940 - RNA, 13 nt, Human
ugaggcccaggga

SEQ ID NO: 3700941 - RNA, 21 nt, Human
ugaggccccuucuagguggca

SEQ ID NO: 3700942 - RNA, 12 nt, Human
ugaggcccucca

SEQ ID NO: 3700943 - RNA, 13 nt, Human
ugaggcccuccac

SEQ ID NO: 3700944 - RNA, 19 nt, Human
ugaggcccuccacaccugc

SEQ ID NO: 3700945 - RNA, 20 nt, Human
ugaggccgcuagaggccuga

SEQ ID NO: 3700946 - RNA, 19 nt, Human
ugaggccuaaaaguaaaca

SEQ ID NO: 3700947 - RNA, 18 nt, Human
ugaggccugagacccagg

SEQ ID NO: 3700948 - RNA, 19 nt, Human
ugaggccugcccucaggga

SEQ ID NO: 3700949 - RNA, 11 nt, Human
ugaggccugga

SEQ ID NO: 3700950 - RNA, 14 nt, Human
ugaggccuggacuu

SEQ ID NO: 3700951 - RNA, 23 nt, Human
ugaggccuggacuuuccugcaac

SEQ ID NO: 3700952 - RNA, 14 nt, Human
ugaggccuggccag

SEQ ID NO: 3700953 - RNA, 15 nt, Human
ugaggccuggccagg

SEQ ID NO: 3700954 - RNA, 16 nt, Human
ugaggccuggccaggc

SEQ ID NO: 3700955 - RNA, 13 nt, Human
ugaggccugggcc

SEQ ID NO: 3700956 - RNA, 14 nt, Human
ugaggccugucugu

SEQ ID NO: 3700957 - RNA, 22 nt, Human
ugaggccuuaucauucauucuu

SEQ ID NO: 3700958 - RNA, 20 nt, Human
ugaggcgagaagggcugcuu

SEQ ID NO: 3700959 - RNA, 17 nt, Human
ugaggcuaguguggugu

SEQ ID NO: 3700960 - RNA, 23 nt, Human
ugaggcuagugugguguuuccug

SEQ ID NO: 3700961 - RNA, 18 nt, Human
ugaggcucugcccuuggu

SEQ ID NO: 3700962 - RNA, 17 nt, Human
ugaggcucuuucugggc

SEQ ID NO: 3700963 - RNA, 19 nt, Human
ugaggcucuuucugggcca

SEQ ID NO: 3700964 - RNA, 13 nt, Human
ugaggcugagacu

SEQ ID NO: 3700965 - RNA, 21 nt, Human
ugaggcuggacuccagaucug

SEQ ID NO: 3700966 - RNA, 11 nt, Human
ugaggcugggc

SEQ ID NO: 3700967 - RNA, 13 nt, Human
ugaggcuguccug

SEQ ID NO: 3700968 - RNA, 21 nt, Human
ugaggcuguggucacagcgga

SEQ ID NO: 3700969 - RNA, 14 nt, Human
ggucagcccuagga

SEQ ID NO: 3700970 - RNA, 16 nt, Human
ggucagcguugcaugu

SEQ ID NO: 3700971 - RNA, 22 nt, Human
ggucaggaguuagaggccagcc

SEQ ID NO: 3700972 - RNA, 13 nt, Human
ggucaggcagggu

SEQ ID NO: 3700973 - RNA, 20 nt, Human
ggucaggccuuugagcucag

SEQ ID NO: 3700974 - RNA, 18 nt, Human
ggucaggcuggucucaaa

SEQ ID NO: 3700975 - RNA, 23 nt, Human
ggucagggagugcuggcucacag

SEQ ID NO: 3700976 - RNA, 18 nt, Human
ggucaggggugacacaga

SEQ ID NO: 3700977 - RNA, 15 nt, Human
ggucagguuuaacau

SEQ ID NO: 3700978 - RNA, 17 nt, Human
ggucaguacccaccuga

SEQ ID NO: 3700979 - RNA, 14 nt, Human
ggucaguggcucuu

SEQ ID NO: 3700980 - RNA, 24 nt, Human
ggucaguguccaaagcagggucug

SEQ ID NO: 3700981 - RNA, 21 nt, Human
ggucauacuaucuacucuccu

SEQ ID NO: 3700982 - RNA, 21 nt, Human
ggucauauuaauauauuucca

SEQ ID NO: 3700983 - RNA, 22 nt, Human
ggucauccagacucagagcucu

SEQ ID NO: 3700984 - RNA, 14 nt, Human
ggucauccugcccc

SEQ ID NO: 3700985 - RNA, 20 nt, Human
ggucaugaugcucuuuccca

SEQ ID NO: 3700986 - RNA, 19 nt, Human
ggucauguuugcaggggug

SEQ ID NO: 3700987 - RNA, 20 nt, Human
ggucauuaaggccacaucca

SEQ ID NO: 3700988 - RNA, 15 nt, Human
ggucauuuaugaaaa

SEQ ID NO: 3700989 - RNA, 15 nt, Human
gguccaaauaaaaac

SEQ ID NO: 3700990 - RNA, 15 nt, Human
gguccaacugcaacu

SEQ ID NO: 3700991 - RNA, 17 nt, Human
gguccaaugagcuuucu

SEQ ID NO: 3700992 - RNA, 14 nt, Human
gguccaccccaugu

SEQ ID NO: 3700993 - RNA, 14 nt, Human
gguccagaagagaa

SEQ ID NO: 3700994 - RNA, 20 nt, Human
gguccagaaggagacaggca

SEQ ID NO: 3700995 - RNA, 22 nt, Human
gguccagccucguuggaagagg

SEQ ID NO: 3700996 - RNA, 12 nt, Human
gguccagcucug

SEQ ID NO: 3700997 - RNA, 13 nt, Human
gguccagcucugg

SEQ ID NO: 3700998 - RNA, 22 nt, Human
gguccagcucuggaggggaggg

SEQ ID NO: 3700999 - RNA, 15 nt, Human
gguccagcuggccug

SEQ ID NO: 3701000 - RNA, 18 nt, Human
gguccagcuggccuggac

SEQ ID NO: 3701001 - RNA, 22 nt, Human
gguccaggccuacuccugucuu

SEQ ID NO: 3701002 - RNA, 13 nt, Human
gguccaggcugug

SEQ ID NO: 3701003 - RNA, 15 nt, Human
gguccaggggccccu

SEQ ID NO: 3701004 - RNA, 23 nt, Human
gguccaggggccccuccagcuug

SEQ ID NO: 3701005 - RNA, 16 nt, Human
gguccaucagccccuc

SEQ ID NO: 3701006 - RNA, 17 nt, Human
gguccaugggcagagcc

SEQ ID NO: 3701007 - RNA, 20 nt, Human
ggucccaagcugggccccag

SEQ ID NO: 3701008 - RNA, 23 nt, Human
ggucccaagcugggccccagccc

SEQ ID NO: 3701009 - RNA, 19 nt, Human
ggucccacaucccugggcc

SEQ ID NO: 3701010 - RNA, 22 nt, Human
ggucccacaucccugggccugc

SEQ ID NO: 3701011 - RNA, 14 nt, Human
ggucccaccccaca

SEQ ID NO: 3701012 - RNA, 16 nt, Human
ggucccaccccacaca

SEQ ID NO: 3701013 - RNA, 22 nt, Human
ggucccaccccacacacgccag

SEQ ID NO: 3701014 - RNA, 16 nt, Human
ggucccaccuccagcc

SEQ ID NO: 3701015 - RNA, 17 nt, Human
ggucccaccuccagccc

SEQ ID NO: 3701016 - RNA, 22 nt, Human
ggucccaccuccagcccgggag

SEQ ID NO: 3701017 - RNA, 22 nt, Human
ggucccacucaguccauagcag

SEQ ID NO: 3701018 - RNA, 15 nt, Human
ggucccagcagcugc

SEQ ID NO: 3701019 - RNA, 14 nt, Human
ggucccagccaccc

SEQ ID NO: 3701020 - RNA, 12 nt, Human
ggucccagcucc

SEQ ID NO: 3701021 - RNA, 15 nt, Human
ggucccagugggagg

SEQ ID NO: 3701022 - RNA, 18 nt, Human
ggucccagugggaggggc

SEQ ID NO: 3701023 - RNA, 13 nt, Human
ggugcugggcccc

SEQ ID NO: 3701024 - RNA, 16 nt, Human
ggugcuggggccuggu

SEQ ID NO: 3701025 - RNA, 18 nt, Human
ggugcuguuuugccagcc

SEQ ID NO: 3701026 - RNA, 17 nt, Human
ggugcuuacacaucuca

SEQ ID NO: 3701027 - RNA, 14 nt, Human
ggugcuucuccucu

SEQ ID NO: 3701028 - RNA, 18 nt, Human
ggugcuuuuuauaaaaag

SEQ ID NO: 3701029 - RNA, 21 nt, Human
ggugcuuuuuauaaaaagaua

SEQ ID NO: 3701030 - RNA, 11 nt, Human
gguggaagagc

SEQ ID NO: 3701031 - RNA, 16 nt, Human
gguggaagaggggaca

SEQ ID NO: 3701032 - RNA, 19 nt, Human
gguggaagcccuccuucca

SEQ ID NO: 3701033 - RNA, 20 nt, Human
gguggaagcccuccuuccac

SEQ ID NO: 3701034 - RNA, 15 nt, Human
gguggaaggcagaca

SEQ ID NO: 3701035 - RNA, 17 nt, Human
gguggacaguccuggga

SEQ ID NO: 3701036 - RNA, 14 nt, Human
gguggacccaggga

SEQ ID NO: 3701037 - RNA, 23 nt, Human
gguggacuuagaaagcaggggcu

SEQ ID NO: 3701038 - RNA, 14 nt, Human
gguggagaaaggag

SEQ ID NO: 3701039 - RNA, 12 nt, Human
gguggagaagcc

SEQ ID NO: 3701040 - RNA, 21 nt, Human
gguggagccaguaaacagagg

SEQ ID NO: 3701041 - RNA, 17 nt, Human
gguggaucacagaggcu

SEQ ID NO: 3701042 - RNA, 14 nt, Human
gguggaugccuggu

SEQ ID NO: 3701043 - RNA, 23 nt, Human
gguggcacaggaguguccucuuc

SEQ ID NO: 3701044 - RNA, 14 nt, Human
gguggcaccagcag

SEQ ID NO: 3701045 - RNA, 15 nt, Human
gguggcacugagccc

SEQ ID NO: 3701046 - RNA, 13 nt, Human
gguggcacugcca

SEQ ID NO: 3701047 - RNA, 13 nt, Human
gguggcagcaaca

SEQ ID NO: 3701048 - RNA, 15 nt, Human
gguggcagcccugua

SEQ ID NO: 3701049 - RNA, 13 nt, Human
gguggcagcucac

SEQ ID NO: 3701050 - RNA, 13 nt, Human
gguggcagcugcg

SEQ ID NO: 3701051 - RNA, 15 nt, Human
gguggcagcugcggu

SEQ ID NO: 3701052 - RNA, 18 nt, Human
gguggcaguggagguggg

SEQ ID NO: 3701053 - RNA, 21 nt, Human
gguggcaugcaccugcaaucc

SEQ ID NO: 3701054 - RNA, 13 nt, Human
gguggccacagcg

SEQ ID NO: 3701055 - RNA, 17 nt, Human
gguggccacagcgccag

SEQ ID NO: 3701056 - RNA, 21 nt, Human
gguggccacuccagaccccug

SEQ ID NO: 3701057 - RNA, 23 nt, Human
gguggccacuccagaccccuggc

SEQ ID NO: 3701058 - RNA, 17 nt, Human
gguggccagagguguca

SEQ ID NO: 3701059 - RNA, 12 nt, Human
gguggccaggcc

SEQ ID NO: 3701060 - RNA, 13 nt, Human
gguggccaggccg

SEQ ID NO: 3701061 - RNA, 18 nt, Human
gguggccauuuagccacc

SEQ ID NO: 3701062 - RNA, 19 nt, Human
gguggcccacgccuguaau

SEQ ID NO: 3701063 - RNA, 14 nt, Human
gguggccccugccu

SEQ ID NO: 3701064 - RNA, 17 nt, Human
gguggcccgacagccug

SEQ ID NO: 3701065 - RNA, 18 nt, Human
gguggcccgacagccugg

SEQ ID NO: 3701066 - RNA, 20 nt, Human
gguggcccgacagccuggca

SEQ ID NO: 3701067 - RNA, 22 nt, Human
gguggcccucuccccugccccc

SEQ ID NO: 3701068 - RNA, 13 nt, Human
gguggcccugucc

SEQ ID NO: 3701069 - RNA, 20 nt, Human
gguggccgcugaguggcagg

SEQ ID NO: 3701070 - RNA, 12 nt, Human
gguggccucagc

SEQ ID NO: 3701071 - RNA, 17 nt, Human
gguggccucccaacuca

SEQ ID NO: 3701072 - RNA, 23 nt, Human
gguggccucccaacucaccccag

SEQ ID NO: 3701073 - RNA, 14 nt, Human
gguggcuaaagguc

SEQ ID NO: 3701074 - RNA, 20 nt, Human
gguggcuagucaagcuccuc

SEQ ID NO: 3701075 - RNA, 15 nt, Human
gguggcuagucagag

SEQ ID NO: 3701076 - RNA, 19 nt, Human
gguggcucacgccuguaau

SEQ ID NO: 3701077 - RNA, 13 nt, Human
gguggcucugaga

SEQ ID NO: 3701078 - RNA, 18 nt, Human
gguggcugacccaguccc

SEQ ID NO: 3701079 - RNA, 19 nt, Human
gguggcugacccagucccu

SEQ ID NO: 3701080 - RNA, 22 nt, Human
gguggcugacccagucccuggg

SEQ ID NO: 3701081 - RNA, 13 nt, Human
gguggcugggcag

SEQ ID NO: 3701082 - RNA, 18 nt, Human
gguggcuggguuggaggg

SEQ ID NO: 3701083 - RNA, 14 nt, Human
gguggcuucagcuc

SEQ ID NO: 3701084 - RNA, 22 nt, Human
ggugggaaaugguaugagcuga

SEQ ID NO: 3701085 - RNA, 21 nt, Human
ggugggaaccaugaagacagg

SEQ ID NO: 3701086 - RNA, 16 nt, Human
ggugggacacccugug

SEQ ID NO: 3701087 - RNA, 20 nt, Human
ggugggacccccguggggca

SEQ ID NO: 3701088 - RNA, 13 nt, Human
ggugggagcagga

SEQ ID NO: 3701089 - RNA, 14 nt, Human
ggugggauccucca

SEQ ID NO: 3701090 - RNA, 16 nt, Human
ggugggcaccuauaau

SEQ ID NO: 3701091 - RNA, 16 nt, Human
ggugggcagguggugg

SEQ ID NO: 3701092 - RNA, 12 nt, Human
ggugggcccagg

SEQ ID NO: 3701093 - RNA, 18 nt, Human
ggugggcccaggaccagc

SEQ ID NO: 3701094 - RNA, 14 nt, Human
ggugggccucuggu

SEQ ID NO: 3701095 - RNA, 12 nt, Human
ggugggccuggu

SEQ ID NO: 3701096 - RNA, 20 nt, Human
ggugggcgggcagcacagca

SEQ ID NO: 3701097 - RNA, 21 nt, Human
ggugggcguggucacugcugu

SEQ ID NO: 3701098 - RNA, 16 nt, Human
ggugggcucugugcag

SEQ ID NO: 3701099 - RNA, 14 nt, Human
ggugggcuggacuu

SEQ ID NO: 3701100 - RNA, 17 nt, Human
ggugggcuucagggcag

SEQ ID NO: 3701101 - RNA, 13 nt, Human
gguggggaauguu

SEQ ID NO: 3701102 - RNA, 19 nt, Human
gguggggaccucaggccug

SEQ ID NO: 3701103 - RNA, 12 nt, Human
gguggggcagcu

SEQ ID NO: 3701104 - RNA, 15 nt, Human
gguggggcagcuccu

SEQ ID NO: 3701105 - RNA, 18 nt, Human
gguggggcagugcuuggc

SEQ ID NO: 3701106 - RNA, 15 nt, Human
gguggggcgaggcag

SEQ ID NO: 3701107 - RNA, 18 nt, Human
gguggggggcuucauaca

SEQ ID NO: 3701108 - RNA, 15 nt, Human
ggugggggggcagag

SEQ ID NO: 3701109 - RNA, 23 nt, Human
gguggggucacucuggcagcuca

SEQ ID NO: 3701110 - RNA, 23 nt, Human
gguggggucaugcccuccucucc

SEQ ID NO: 3701111 - RNA, 17 nt, Human
gguggguccaugggcag

SEQ ID NO: 3701112 - RNA, 19 nt, Human
ggugggugccuaggccugg

SEQ ID NO: 3701113 - RNA, 13 nt, Human
ggugggugcucag

SEQ ID NO: 3701114 - RNA, 14 nt, Human
ggugggugcucaga

SEQ ID NO: 3701115 - RNA, 16 nt, Human
ggugggugguggggag

SEQ ID NO: 3701116 - RNA, 19 nt, Human
gguggguucuuuggaagga

SEQ ID NO: 3701117 - RNA, 15 nt, Human
ggugguaccaggucu

SEQ ID NO: 3701118 - RNA, 16 nt, Human
ggugguaccaggucuc

SEQ ID NO: 3701119 - RNA, 13 nt, Human
ggugguauuuuca

SEQ ID NO: 3701120 - RNA, 19 nt, Human
ggugguccugacucaacau

SEQ ID NO: 3701121 - RNA, 17 nt, Human
ggugguccugagaccug

SEQ ID NO: 3701122 - RNA, 14 nt, Human
gguggucugcucgg

SEQ ID NO: 3701123 - RNA, 20 nt, Human
gguggucugcucgggcccag

SEQ ID NO: 3701124 - RNA, 21 nt, Human
gguggucuguuggcaggcugg

SEQ ID NO: 3701125 - RNA, 14 nt, Human
gguggugaccucug

SEQ ID NO: 3701126 - RNA, 21 nt, Human
gguggugcagguagaccuguc

SEQ ID NO: 3701127 - RNA, 17 nt, Human
ggugguggcacugagcc

SEQ ID NO: 3701128 - RNA, 20 nt, Human
gguggugggaaccaugaaga

SEQ ID NO: 3701129 - RNA, 22 nt, Human
ggugguucacucuuggagccug

SEQ ID NO: 3701130 - RNA, 23 nt, Human
ggugguugcuguuuuccucccuu

SEQ ID NO: 3701131 - RNA, 13 nt, Human
gguguaaacacau

SEQ ID NO: 3701132 - RNA, 18 nt, Human
gguguaaucaugaaggag

SEQ ID NO: 3701133 - RNA, 17 nt, Human
gguguagcuacagagaa

SEQ ID NO: 3701134 - RNA, 18 nt, Human
gguguagcuacagagaaa

SEQ ID NO: 3701135 - RNA, 13 nt, Human
gguguauuuaaac

SEQ ID NO: 3701136 - RNA, 22 nt, Human
gguguauuuauuuuccucccca

SEQ ID NO: 3701137 - RNA, 17 nt, Human
ggugucaagagggucug

SEQ ID NO: 3701138 - RNA, 24 nt, Human
ggugucacccaaaccggcaggugc

SEQ ID NO: 3701139 - RNA, 11 nt, Human
ggugucacccc

SEQ ID NO: 3701140 - RNA, 17 nt, Human
ggugucaccccagagcc

SEQ ID NO: 3701141 - RNA, 20 nt, Human
ggugucacugucccuccugg

SEQ ID NO: 3701142 - RNA, 15 nt, Human
ggugucacuuacugu

SEQ ID NO: 3701143 - RNA, 20 nt, Human
ggugucaggcugcuggcgcc

SEQ ID NO: 3701144 - RNA, 17 nt, Human
ggugucaguauccaggc

SEQ ID NO: 3701145 - RNA, 14 nt, Human
ggugucauuucauu

SEQ ID NO: 3701146 - RNA, 18 nt, Human
ggugucauuucauuccau

SEQ ID NO: 3701147 - RNA, 21 nt, Human
gguguccagcauugcuggacu

SEQ ID NO: 3701148 - RNA, 15 nt, Human
gguguccccaacagc

SEQ ID NO: 3701149 - RNA, 19 nt, Human
gguguccccaacagcgccc

SEQ ID NO: 3701150 - RNA, 20 nt, Human
gguguccccaacagcgccca

SEQ ID NO: 3701151 - RNA, 13 nt, Human
gguguccccacca

SEQ ID NO: 3701152 - RNA, 18 nt, Human
gguguccuacagaaaaac

SEQ ID NO: 3701153 - RNA, 20 nt, Human
gguguccugaccacccuccc

SEQ ID NO: 3701154 - RNA, 21 nt, Human
gguguccugcaccggggccug

SEQ ID NO: 3701155 - RNA, 17 nt, Human
gguguccuuucccucca

SEQ ID NO: 3701156 - RNA, 21 nt, Human
ggugucgcucugcuggccugg

SEQ ID NO: 3701157 - RNA, 17 nt, Human
ggugucucaggcugccu

SEQ ID NO: 3701158 - RNA, 18 nt, Human
ggugucucaggcugccug

SEQ ID NO: 3701159 - RNA, 15 nt, Human
ggugucuccuuaagc

SEQ ID NO: 3701160 - RNA, 17 nt, Human
ggugugaacccgggagc

SEQ ID NO: 3701161 - RNA, 16 nt, Human
ggugugacugaauuuc

SEQ ID NO: 3701162 - RNA, 10 nt, Human
ugaaggggcg

SEQ ID NO: 3701163 - RNA, 18 nt, Human
ugaagggggcggccuaug

SEQ ID NO: 3701164 - RNA, 19 nt, Human
ugaagguagaauguuuuca

SEQ ID NO: 3701165 - RNA, 21 nt, Human
ugaaggugaaacauuuucucc

SEQ ID NO: 3701166 - RNA, 18 nt, Human
ugaaggugauaagggaaa

SEQ ID NO: 3701167 - RNA, 19 nt, Human
ugaaggugauaagggaaaa

SEQ ID NO: 3701168 - RNA, 22 nt, Human
ugaaggugauuuaagggcccag

SEQ ID NO: 3701169 - RNA, 20 nt, Human
ugaaggugcugacggccagg

SEQ ID NO: 3701170 - RNA, 14 nt, Human
ugaagguugaagag

SEQ ID NO: 3701171 - RNA, 13 nt, Human
ugaagguuucuga

SEQ ID NO: 3701172 - RNA, 16 nt, Human
ugaagguuucugaaaa

SEQ ID NO: 3701173 - RNA, 18 nt, Human
ugaagguuucugaaaauu

SEQ ID NO: 3701174 - RNA, 18 nt, Human
ugaagguuuuaagugguu

SEQ ID NO: 3701175 - RNA, 15 nt, Human
ugaagguuuuuguaa

SEQ ID NO: 3701176 - RNA, 13 nt, Human
ugaaguaaaacaa

SEQ ID NO: 3701177 - RNA, 15 nt, Human
ugaaguaaaagcaag

SEQ ID NO: 3701178 - RNA, 16 nt, Human
ugaaguaaacuuuuug

SEQ ID NO: 3701179 - RNA, 19 nt, Human
ugaaguaaagccauuaaau

SEQ ID NO: 3701180 - RNA, 14 nt, Human
ugaaguaagcaaag

SEQ ID NO: 3701181 - RNA, 16 nt, Human
ugaaguaauaugcaca

SEQ ID NO: 3701182 - RNA, 14 nt, Human
ugaaguaaugaauu

SEQ ID NO: 3701183 - RNA, 20 nt, Human
ugaaguacauauuaggaaaa

SEQ ID NO: 3701184 - RNA, 22 nt, Human
ugaaguauauaaugguuucaaa

SEQ ID NO: 3701185 - RNA, 20 nt, Human
ugaagucaauuacucuauaa

SEQ ID NO: 3701186 - RNA, 14 nt, Human
ugaagucaccuugu

SEQ ID NO: 3701187 - RNA, 20 nt, Human
ugaagucagaucugccuaag

SEQ ID NO: 3701188 - RNA, 22 nt, Human
ugaaguccaagcauuuagaugu

SEQ ID NO: 3701189 - RNA, 17 nt, Human
ugaagucuguauuguaa

SEQ ID NO: 3701190 - RNA, 10 nt, Human
ugaagucuug

SEQ ID NO: 3701191 - RNA, 13 nt, Human
ugaagucuuguau

SEQ ID NO: 3701192 - RNA, 22 nt, Human
ugaagucuuuguacagacaaca

SEQ ID NO: 3701193 - RNA, 14 nt, Human
ugaagugaaacugc

SEQ ID NO: 3701194 - RNA, 13 nt, Human
ugaagugccuuaa

SEQ ID NO: 3701195 - RNA, 13 nt, Human
ugaagugcgugaa

SEQ ID NO: 3701196 - RNA, 22 nt, Human
ugaagugcuguuuauuaaucuu

SEQ ID NO: 3701197 - RNA, 13 nt, Human
ugaagugcuugga

SEQ ID NO: 3701198 - RNA, 18 nt, Human
ugaaguguaggcagacac

SEQ ID NO: 3701199 - RNA, 18 nt, Human
ugaaguguguuuccuuca

SEQ ID NO: 3701200 - RNA, 16 nt, Human
ugaaguuacuuuaugu

SEQ ID NO: 3701201 - RNA, 19 nt, Human
ugaaguuacuuucuuaaug

SEQ ID NO: 3701202 - RNA, 19 nt, Human
ugaaguuagaauuccuuca

SEQ ID NO: 3701203 - RNA, 21 nt, Human
ugaaguuagguucuuaaaagu

SEQ ID NO: 3701204 - RNA, 22 nt, Human
ugaaguuagguucuuaaaagug

SEQ ID NO: 3701205 - RNA, 17 nt, Human
ugaaguuaucuggcuuc

SEQ ID NO: 3701206 - RNA, 16 nt, Human
ugaaguucaccauuaa

SEQ ID NO: 3701207 - RNA, 15 nt, Human
ugaaguugcugcuuc

SEQ ID NO: 3701208 - RNA, 22 nt, Human
ugaaguugcugcuucucccagg

SEQ ID NO: 3701209 - RNA, 19 nt, Human
ugaaguuuaaaacaguauu

SEQ ID NO: 3701210 - RNA, 16 nt, Human
ugaaguuuacauugua

SEQ ID NO: 3701211 - RNA, 15 nt, Human
ugaaguuuacauuuu

SEQ ID NO: 3701212 - RNA, 13 nt, Human
ugaaguuucacau

SEQ ID NO: 3701213 - RNA, 17 nt, Human
ugaaguuucacuccgga

SEQ ID NO: 3701214 - RNA, 15 nt, Human
ugaaguuucauuuau

SEQ ID NO: 3701215 - RNA, 21 nt, Human
ugaaguuucauuuaugauaca

SEQ ID NO: 3701216 - RNA, 16 nt, Human
ugaaguuuccuuggcu

SEQ ID NO: 3701217 - RNA, 21 nt, Human
ugaaguuuccuuggcuggugc

SEQ ID NO: 3701218 - RNA, 18 nt, Human
ugaaguuugaacuucaua

SEQ ID NO: 3701219 - RNA, 20 nt, Human
ugaaguuugaauguuaaaua

SEQ ID NO: 3701220 - RNA, 21 nt, Human
ugaaguuugaauguuaaauaa

SEQ ID NO: 3701221 - RNA, 14 nt, Human
ugaaguuugauaaa

SEQ ID NO: 3701222 - RNA, 20 nt, Human
ugaaguuugauaaauagugu

SEQ ID NO: 3701223 - RNA, 20 nt, Human
ugaaguuuguaguuguuuua

SEQ ID NO: 3701224 - RNA, 14 nt, Human
ugaaguuuuacauu

SEQ ID NO: 3701225 - RNA, 17 nt, Human
ugaaguuuuacauuguu

SEQ ID NO: 3701226 - RNA, 16 nt, Human
ugaaguuuuacugucu

SEQ ID NO: 3701227 - RNA, 22 nt, Human
ugaaguuuuuuugcugcugccu

SEQ ID NO: 3701228 - RNA, 20 nt, Human
ugaauaaaaacuuugcuaaa

SEQ ID NO: 3701229 - RNA, 15 nt, Human
ugaauaaaauuauuu

SEQ ID NO: 3701230 - RNA, 14 nt, Human
ugaauaaacuucag

SEQ ID NO: 3701231 - RNA, 18 nt, Human
ugaauaaacuucagcacc

SEQ ID NO: 3701232 - RNA, 16 nt, Human
ugaauaaagaauacuu

SEQ ID NO: 3701233 - RNA, 17 nt, Human
ugaauaaagaauacuug

SEQ ID NO: 3701234 - RNA, 19 nt, Human
ugaauaaagaauacuugaa

SEQ ID NO: 3701235 - RNA, 14 nt, Human
ugaauaaagacacc

SEQ ID NO: 3701236 - RNA, 18 nt, Human
ugaauaaagccugcuuuu

SEQ ID NO: 3701237 - RNA, 17 nt, Human
ugaauaaaguugaagcu

SEQ ID NO: 3701238 - RNA, 14 nt, Human
ugaauaaauaccuc

SEQ ID NO: 3701239 - RNA, 15 nt, Human
ugaauaaauaccucu

SEQ ID NO: 3701240 - RNA, 17 nt, Human
ugaauaaauaccucuua

SEQ ID NO: 3701241 - RNA, 19 nt, Human
ugaauaaauaccucuuagc

SEQ ID NO: 3701242 - RNA, 16 nt, Human
ugaauaaaugucacuu

SEQ ID NO: 3701243 - RNA, 23 nt, Human
ugaauaacugauuaguaagucuu

SEQ ID NO: 3701244 - RNA, 17 nt, Human
ugaauaagccauucuga

SEQ ID NO: 3701245 - RNA, 13 nt, Human
ugaauaauacagu

SEQ ID NO: 3701246 - RNA, 21 nt, Human
ugaauaaugccuuuguaacca

SEQ ID NO: 3701247 - RNA, 19 nt, Human
ugaauaauggaaaaugcca

SEQ ID NO: 3701248 - RNA, 18 nt, Human
ugaauaaugguaccagau

SEQ ID NO: 3701249 - RNA, 23 nt, Human
ugaauaauguaagacaaauaugu

SEQ ID NO: 3701250 - RNA, 17 nt, Human
ugaauaauuacagugcc

SEQ ID NO: 3701251 - RNA, 18 nt, Human
ugaauaauuacagugccu

SEQ ID NO: 3701252 - RNA, 13 nt, Human
ugaauaauuucuu

SEQ ID NO: 3701253 - RNA, 20 nt, Human
ugaauacaaacaauggaaac

SEQ ID NO: 3701254 - RNA, 14 nt, Human
ugaauacagcagca

SEQ ID NO: 3701255 - RNA, 21 nt, Human
ugaauacagcagcaagaaaaa

SEQ ID NO: 3701256 - RNA, 15 nt, Human
ugaauacauuuccaa

SEQ ID NO: 3701257 - RNA, 21 nt, Human
ugaauaccauuaaaacugcuu

SEQ ID NO: 3701258 - RNA, 16 nt, Human
ugaauacccuuuucug

SEQ ID NO: 3701259 - RNA, 16 nt, Human
ugaauaccuuagugca

SEQ ID NO: 3701260 - RNA, 22 nt, Human
ugaauaccuuagugcaguuauu

SEQ ID NO: 3701261 - RNA, 22 nt, Human
ugaauacucugcccucuagagc

SEQ ID NO: 3701262 - RNA, 14 nt, Human
ugaauacugcuaca

SEQ ID NO: 3701263 - RNA, 15 nt, Human
ugaauacugcuugaa

SEQ ID NO: 3701264 - RNA, 18 nt, Human
ugaauacugcuugaauaa

SEQ ID NO: 3701265 - RNA, 21 nt, Human
ugaauacugcuugaauaaaca

SEQ ID NO: 3701266 - RNA, 16 nt, Human
ugaauacuugaaccau

SEQ ID NO: 3701267 - RNA, 19 nt, Human
ugaauacuugaaccauaaa

SEQ ID NO: 3701268 - RNA, 14 nt, Human
ugaauacuuugaau

SEQ ID NO: 3701269 - RNA, 18 nt, Human
ugaauacuuugaaugugu

SEQ ID NO: 3701270 - RNA, 15 nt, Human
ugaauagaaauggga

SEQ ID NO: 3701271 - RNA, 21 nt, Human
ugaauagcaauagcauggaua

SEQ ID NO: 3701272 - RNA, 20 nt, Human
ugaauagccauauuuguaaa

SEQ ID NO: 3701273 - RNA, 20 nt, Human
ugaauagcucccagauuuca

SEQ ID NO: 3701274 - RNA, 19 nt, Human
ugaauaggcgaucacaacg

SEQ ID NO: 3701275 - RNA, 12 nt, Human
ugaauauaaaaa

SEQ ID NO: 3701276 - RNA, 16 nt, Human
ugaauauaaacacuau

SEQ ID NO: 3701277 - RNA, 17 nt, Human
ugaauauaaaugugugu

SEQ ID NO: 3701278 - RNA, 21 nt, Human
ugaauauaaauguguguaugu

SEQ ID NO: 3701279 - RNA, 22 nt, Human
ugaauauaaauguguguaugug

SEQ ID NO: 3701280 - RNA, 22 nt, Human
ugaauauaauauauuuguguau

SEQ ID NO: 3701281 - RNA, 14 nt, Human
ugaauauaaucccu

SEQ ID NO: 3701282 - RNA, 21 nt, Human
ugaauauacagcaggugcuca

SEQ ID NO: 3701283 - RNA, 15 nt, Human
ugaauauacucauua

SEQ ID NO: 3701284 - RNA, 19 nt, Human
ugaauauacucauuagaau

SEQ ID NO: 3701285 - RNA, 16 nt, Human
ugaauauauggcauuu

SEQ ID NO: 3701286 - RNA, 21 nt, Human
ugaauauauggcauuugcaga

SEQ ID NO: 3701287 - RNA, 23 nt, Human
ugaauauauuuaagcaacaucuu

SEQ ID NO: 3701288 - RNA, 17 nt, Human
ugaauaucuauuaauau

SEQ ID NO: 3701289 - RNA, 22 nt, Human
ugaauaugaggcauuuggcauu

SEQ ID NO: 3701290 - RNA, 22 nt, Human
ugaauaugauuaaaaauaucaa

SEQ ID NO: 3701291 - RNA, 19 nt, Human
ugaauaugauuaguaaaga

SEQ ID NO: 3701292 - RNA, 12 nt, Human
ugaauauggaca

SEQ ID NO: 3701293 - RNA, 21 nt, Human
ugaauauggacucaguuuucu

SEQ ID NO: 3701294 - RNA, 22 nt, Human
ugaauauuacuccuauuuuugu

SEQ ID NO: 3701295 - RNA, 20 nt, Human
ugaauauuuuaucuuuccuu

SEQ ID NO: 3701296 - RNA, 12 nt, Human
ugaauauuuuca

SEQ ID NO: 3701297 - RNA, 22 nt, Human
ugaaucaauaauauauuuucug

SEQ ID NO: 3701298 - RNA, 14 nt, Human
ugaaucacuguuuu

SEQ ID NO: 3701299 - RNA, 19 nt, Human
ugaaucacuguuuuuagac

SEQ ID NO: 3701300 - RNA, 22 nt, Human
ugaaucagacccuaccccacca

SEQ ID NO: 3701301 - RNA, 16 nt, Human
ugaaucaguauaaaca

SEQ ID NO: 3701302 - RNA, 20 nt, Human
ugaaucaguuuccaauuauu

SEQ ID NO: 3701303 - RNA, 15 nt, Human
ugaaucaugagccug

SEQ ID NO: 3701304 - RNA, 19 nt, Human
ugaaucaugguuuuucuua

SEQ ID NO: 3701305 - RNA, 12 nt, Human
ugaaucauguag

SEQ ID NO: 3701306 - RNA, 21 nt, Human
ugaaucauguaguaucaaaua

SEQ ID NO: 3701307 - RNA, 22 nt, Human
ugaaucauuuuaccuuugacaa

SEQ ID NO: 3701308 - RNA, 23 nt, Human
ugaaucauuuuaccuuugacaaa

SEQ ID NO: 3701309 - RNA, 16 nt, Human
ugaauccaaacuaauc

SEQ ID NO: 3701310 - RNA, 18 nt, Human
ugaauccaacugcuuaaa

SEQ ID NO: 3701311 - RNA, 18 nt, Human
ugauguuuguggccucag

SEQ ID NO: 3701312 - RNA, 18 nt, Human
ugauguuuuaaggaugcu

SEQ ID NO: 3701313 - RNA, 18 nt, Human
ugauguuuuccuauaaua

SEQ ID NO: 3701314 - RNA, 15 nt, Human
ugauguuuuuaaaau

SEQ ID NO: 3701315 - RNA, 18 nt, Human
ugauguuuuuaaaaucuu

SEQ ID NO: 3701316 - RNA, 20 nt, Human
ugauuaaaaauaucaaauua

SEQ ID NO: 3701317 - RNA, 17 nt, Human
ugauuaaauaagauucu

SEQ ID NO: 3701318 - RNA, 13 nt, Human
ugauuaaaugaca

SEQ ID NO: 3701319 - RNA, 17 nt, Human
ugauuaacucaguccug

SEQ ID NO: 3701320 - RNA, 21 nt, Human
ugauuaacuuggaugaguuuu

SEQ ID NO: 3701321 - RNA, 12 nt, Human
ugauuaaggcag

SEQ ID NO: 3701322 - RNA, 22 nt, Human
ugauuaaggucucucuuuggac

SEQ ID NO: 3701323 - RNA, 16 nt, Human
ugauuaaguaaugaua

SEQ ID NO: 3701324 - RNA, 15 nt, Human
ugauuaauuaaaaca

SEQ ID NO: 3701325 - RNA, 19 nt, Human
ugauuaauuaaauagcuuu

SEQ ID NO: 3701326 - RNA, 15 nt, Human
ugauuacacaaaaca

SEQ ID NO: 3701327 - RNA, 13 nt, Human
ugauuacacaguu

SEQ ID NO: 3701328 - RNA, 14 nt, Human
ugauuacacaguug

SEQ ID NO: 3701329 - RNA, 14 nt, Human
ugauuacagugcag

SEQ ID NO: 3701330 - RNA, 14 nt, Human
ugauuaccagggac

SEQ ID NO: 3701331 - RNA, 20 nt, Human
ugauuacuggccuuuuucau

SEQ ID NO: 3701332 - RNA, 21 nt, Human
ugauuacuggccuuuuucauu

SEQ ID NO: 3701333 - RNA, 23 nt, Human
ugauuacuggccuuuuucauuua

SEQ ID NO: 3701334 - RNA, 24 nt, Human
ugauuacugucaaggcugcuuaga

SEQ ID NO: 3701335 - RNA, 14 nt, Human
ugauuacugucaau

SEQ ID NO: 3701336 - RNA, 18 nt, Human
ugauuacugucaauaaac

SEQ ID NO: 3701337 - RNA, 19 nt, Human
ugauuacugucaauaaaca

SEQ ID NO: 3701338 - RNA, 23 nt, Human
ugauuagaaauuaccuguggaua

SEQ ID NO: 3701339 - RNA, 14 nt, Human
ugauuaguaagucu

SEQ ID NO: 3701340 - RNA, 19 nt, Human
ugauuaugaauuacauuug

SEQ ID NO: 3701341 - RNA, 21 nt, Human
ugauuaugaauuacauuugua

SEQ ID NO: 3701342 - RNA, 22 nt, Human
ugauuaugucuuuuauauuugu

SEQ ID NO: 3701343 - RNA, 20 nt, Human
ugauuauuaacgauguccaa

SEQ ID NO: 3701344 - RNA, 18 nt, Human
ugauuauucugauuccac

SEQ ID NO: 3701345 - RNA, 15 nt, Human
ugauuauuguauuua

SEQ ID NO: 3701346 - RNA, 16 nt, Human
ugauuauuuaucacau

SEQ ID NO: 3701347 - RNA, 17 nt, Human
ugauuauuuaucacaua

SEQ ID NO: 3701348 - RNA, 13 nt, Human
ugauuauuugcau

SEQ ID NO: 3701349 - RNA, 20 nt, Human
ugauuauuuucauuacaaug

SEQ ID NO: 3701350 - RNA, 13 nt, Human
ugauucaaaauau

SEQ ID NO: 3701351 - RNA, 17 nt, Human
ugauucaaaauauuuaa

SEQ ID NO: 3701352 - RNA, 23 nt, Human
ugauucaaaauauuuaaaaaugu

SEQ ID NO: 3701353 - RNA, 20 nt, Human
ugauucaacagguuuuccug

SEQ ID NO: 3701354 - RNA, 21 nt, Human
ugauucaagccauuccaaagu

SEQ ID NO: 3701355 - RNA, 17 nt, Human
ugauucaaucuguaaac

SEQ ID NO: 3701356 - RNA, 21 nt, Human
ugauucaauucaacacucccu

SEQ ID NO: 3701357 - RNA, 16 nt, Human
ugauucaauuugaugu

SEQ ID NO: 3701358 - RNA, 19 nt, Human
ugauucacauguuuucaaa

SEQ ID NO: 3701359 - RNA, 21 nt, Human
ugauucaccuccuaaaacaac

SEQ ID NO: 3701360 - RNA, 16 nt, Human
ugauucaccucuucuu

SEQ ID NO: 3701361 - RNA, 20 nt, Human
ugauucacuucacgcuuuca

SEQ ID NO: 3701362 - RNA, 18 nt, Human
ugauucagaaaauguucu

SEQ ID NO: 3701363 - RNA, 15 nt, Human
ugauucagacagcug

SEQ ID NO: 3701364 - RNA, 16 nt, Human
ugauucagacagcugc

SEQ ID NO: 3701365 - RNA, 23 nt, Human
ugauucagacagcugccugggau

SEQ ID NO: 3701366 - RNA, 14 nt, Human
ugauucaggugcag

SEQ ID NO: 3701367 - RNA, 12 nt, Human
ugauucaguguu

SEQ ID NO: 3701368 - RNA, 24 nt, Human
ugauucaguguuaaaugugaugaa

SEQ ID NO: 3701369 - RNA, 13 nt, Human
ugauucauaaaga

SEQ ID NO: 3701370 - RNA, 19 nt, Human
ugauucaugccaauuagca

SEQ ID NO: 3701371 - RNA, 20 nt, Human
ugauucauuuuaacaucuga

SEQ ID NO: 3701372 - RNA, 18 nt, Human
ugauuccauccaccuuuc

SEQ ID NO: 3701373 - RNA, 16 nt, Human
ugauucccaagcucug

SEQ ID NO: 3701374 - RNA, 21 nt, Human
ugauucccaagcucugcuccu

SEQ ID NO: 3701375 - RNA, 23 nt, Human
ugauucccaagcucugcuccucu

SEQ ID NO: 3701376 - RNA, 19 nt, Human
ugauucccuuguuauucaa

SEQ ID NO: 3701377 - RNA, 12 nt, Human
ugauuccuuccu

SEQ ID NO: 3701378 - RNA, 14 nt, Human
ugauuccuuuaaca

SEQ ID NO: 3701379 - RNA, 15 nt, Human
ugauucgagcuauau

SEQ ID NO: 3701380 - RNA, 21 nt, Human
ugauucgcccaaagccagaca

SEQ ID NO: 3701381 - RNA, 15 nt, Human
ugauucuaaugucuu

SEQ ID NO: 3701382 - RNA, 22 nt, Human
ugauucuauuuauauguacaug

SEQ ID NO: 3701383 - RNA, 11 nt, Human
ugauucucagg

SEQ ID NO: 3701384 - RNA, 15 nt, Human
ugauucucagggucu

SEQ ID NO: 3701385 - RNA, 21 nt, Human
ugauucucagggucucugcug

SEQ ID NO: 3701386 - RNA, 16 nt, Human
ugauucucaugccuca

SEQ ID NO: 3701387 - RNA, 13 nt, Human
ugauucuccugcc

SEQ ID NO: 3701388 - RNA, 20 nt, Human
ugauucuccugccucagccu

SEQ ID NO: 3701389 - RNA, 12 nt, Human
ugauucuccuuc

SEQ ID NO: 3701390 - RNA, 16 nt, Human
ugauucuccuucagcc

SEQ ID NO: 3701391 - RNA, 19 nt, Human
ugauucuccuucagcccuc

SEQ ID NO: 3701392 - RNA, 23 nt, Human
ugauucuccuucagcccucaccc

SEQ ID NO: 3701393 - RNA, 11 nt, Human
ugauucucucc

SEQ ID NO: 3701394 - RNA, 19 nt, Human
ugauucugauguacucuaa

SEQ ID NO: 3701395 - RNA, 21 nt, Human
ugauucuggcuuuaagccuuc

SEQ ID NO: 3701396 - RNA, 19 nt, Human
ugauucuuuguuacaggca

SEQ ID NO: 3701397 - RNA, 22 nt, Human
ugauugaaucugauuggacauu

SEQ ID NO: 3701398 - RNA, 12 nt, Human
ugauugauuuga

SEQ ID NO: 3701399 - RNA, 15 nt, Human
ugauugcuaaaugua

SEQ ID NO: 3701400 - RNA, 22 nt, Human
ugauugcuguguccaacuccag

SEQ ID NO: 3701401 - RNA, 14 nt, Human
ugauugcuuuuaaa

SEQ ID NO: 3701402 - RNA, 21 nt, Human
ugauuggaggggggagguggg

SEQ ID NO: 3701403 - RNA, 15 nt, Human
ugauuggauuauuca

SEQ ID NO: 3701404 - RNA, 19 nt, Human
ugauuggauuauucauuua

SEQ ID NO: 3701405 - RNA, 21 nt, Human
ugauuggccuguagaguugcu

SEQ ID NO: 3701406 - RNA, 16 nt, Human
ugauugggaaaacauu

SEQ ID NO: 3701407 - RNA, 20 nt, Human
ugauugggaaaacauuugcu

SEQ ID NO: 3701408 - RNA, 22 nt, Human
ugauuguaacguugcuguggga

SEQ ID NO: 3701409 - RNA, 14 nt, Human
ugauugucagcuac

SEQ ID NO: 3701410 - RNA, 18 nt, Human
ugauugucuuaauauugu

SEQ ID NO: 3701411 - RNA, 14 nt, Human
ugauuguggaaugg

SEQ ID NO: 3701412 - RNA, 19 nt, Human
ugauuguuaauuuacagcu

SEQ ID NO: 3701413 - RNA, 18 nt, Human
ugauuguucgggugugca

SEQ ID NO: 3701414 - RNA, 16 nt, Human
ugauuguuugcucuga

SEQ ID NO: 3701415 - RNA, 16 nt, Human
ugauuuaaaacaugua

SEQ ID NO: 3701416 - RNA, 15 nt, Human
ugauuuaaacacaca

SEQ ID NO: 3701417 - RNA, 16 nt, Human
ugauuuaaacacacag

SEQ ID NO: 3701418 - RNA, 16 nt, Human
ugauuuaaacacauua

SEQ ID NO: 3701419 - RNA, 19 nt, Human
ugauuuacagcaaguagau

SEQ ID NO: 3701420 - RNA, 13 nt, Human
ugauuuacaguuu

SEQ ID NO: 3701421 - RNA, 22 nt, Human
ugauuuacauauauuauuuauu

SEQ ID NO: 3701422 - RNA, 21 nt, Human
ugauuuagaacuguaugucag

SEQ ID NO: 3701423 - RNA, 16 nt, Human
ugauuuaggagaagcc

SEQ ID NO: 3701424 - RNA, 20 nt, Human
ugauuuaggagaagccagga

SEQ ID NO: 3701425 - RNA, 15 nt, Human
ugauuuauaaacaga

SEQ ID NO: 3701426 - RNA, 18 nt, Human
ugauuuaucacacaaagc

SEQ ID NO: 3701427 - RNA, 16 nt, Human
ugauuuauuaacuuaa

SEQ ID NO: 3701428 - RNA, 22 nt, Human
ugauuuauuaacuuaauaauca

SEQ ID NO: 3701429 - RNA, 23 nt, Human
ugauuuauuaauauauauuaucu

SEQ ID NO: 3701430 - RNA, 20 nt, Human
ugauuucaaaguuuuguugu

SEQ ID NO: 3701431 - RNA, 23 nt, Human
ugauuucacaaauauuaaaaagu

SEQ ID NO: 3701432 - RNA, 16 nt, Human
ugauuucacaacagau

SEQ ID NO: 3701433 - RNA, 16 nt, Human
ugauuucacagugugu

SEQ ID NO: 3701434 - RNA, 13 nt, Human
ugauuucagaaac

SEQ ID NO: 3701435 - RNA, 22 nt, Human
ugauuucaguagcacaaguuau

SEQ ID NO: 3701436 - RNA, 21 nt, Human
ugauuucaguucuaggaaaau

SEQ ID NO: 3701437 - RNA, 21 nt, Human
ugauuuccccuccaagguaug

SEQ ID NO: 3701438 - RNA, 22 nt, Human
ugauuuccguuaaaauaccagc

SEQ ID NO: 3701439 - RNA, 15 nt, Human
ugauuuccucccucu

SEQ ID NO: 3701440 - RNA, 19 nt, Human
ugauuuccugugucaaucc

SEQ ID NO: 3701441 - RNA, 15 nt, Human
ugauuuccuugaaug

SEQ ID NO: 3701442 - RNA, 16 nt, Human
ugauuuccuugaaugu

SEQ ID NO: 3701443 - RNA, 17 nt, Human
ugauuucuagaaagccu

SEQ ID NO: 3701444 - RNA, 12 nt, Human
ugauuucuaugc

SEQ ID NO: 3701445 - RNA, 16 nt, Human
ugauuucuaugcugag

SEQ ID NO: 3701446 - RNA, 13 nt, Human
ugauuucuauuca

SEQ ID NO: 3701447 - RNA, 18 nt, Human
ugauuucuuuaaaagaau

SEQ ID NO: 3701448 - RNA, 17 nt, Human
ugauuugaagaacaugu

SEQ ID NO: 3701449 - RNA, 19 nt, Human
ugauuugaagaacauguga

SEQ ID NO: 3701450 - RNA, 18 nt, Human
ugauuugacuguuuuuac

SEQ ID NO: 3701451 - RNA, 20 nt, Human
ugauuugacuguuuuuaccc

SEQ ID NO: 3701452 - RNA, 22 nt, Human
ugauuugaguugauugagaaga

SEQ ID NO: 3701453 - RNA, 17 nt, Human
ugauuugcaauaaaaau

SEQ ID NO: 3701454 - RNA, 15 nt, Human
ugauuugcauauuca

SEQ ID NO: 3701455 - RNA, 15 nt, Human
ugauuugcauugaac

SEQ ID NO: 3701456 - RNA, 14 nt, Human
ugauuugccacuga

SEQ ID NO: 3701457 - RNA, 21 nt, Human
ugauuugggcugaauguaugu

SEQ ID NO: 3701458 - RNA, 22 nt, Human
ugauuuggggauucagauuucu

SEQ ID NO: 3701459 - RNA, 20 nt, Human
ugauuuggugaccaacuguc

SEQ ID NO: 3701460 - RNA, 14 nt, Human
ugaauccucucucu

SEQ ID NO: 3701461 - RNA, 20 nt, Human
ugaaucuaagcagcauuucu

SEQ ID NO: 3701462 - RNA, 14 nt, Human
ugaaucuaugccaa

SEQ ID NO: 3701463 - RNA, 21 nt, Human
ugaaucuauuauacuguauua

SEQ ID NO: 3701464 - RNA, 22 nt, Human
ugaaucuauuauacuguauuaa

SEQ ID NO: 3701465 - RNA, 14 nt, Human
ugaaucucaauuug

SEQ ID NO: 3701466 - RNA, 15 nt, Human
ugaaucucaauuuga

SEQ ID NO: 3701467 - RNA, 23 nt, Human
ugaaucugauuggacauuuucuu

SEQ ID NO: 3701468 - RNA, 15 nt, Human
ugaaucugauuuuua

SEQ ID NO: 3701469 - RNA, 16 nt, Human
ugaaucuuggugucua

SEQ ID NO: 3701470 - RNA, 16 nt, Human
ugaaucuugucucaau

SEQ ID NO: 3701471 - RNA, 20 nt, Human
ugaaucuugucucaaugcuc

SEQ ID NO: 3701472 - RNA, 13 nt, Human
ugaaucuuugugc

SEQ ID NO: 3701473 - RNA, 17 nt, Human
ugaaugaaaaauuuaag

SEQ ID NO: 3701474 - RNA, 21 nt, Human
ugaaugaaaaauuuaagcauu

SEQ ID NO: 3701475 - RNA, 17 nt, Human
ugaaugaaaauguccau

SEQ ID NO: 3701476 - RNA, 22 nt, Human
ugaaugaaagauuaaacagaug

SEQ ID NO: 3701477 - RNA, 14 nt, Human
ugaaugaaauauca

SEQ ID NO: 3701478 - RNA, 22 nt, Human
ugaaugaagcaaaugucaugcu

SEQ ID NO: 3701479 - RNA, 16 nt, Human
ugaaugaagcaguauu

SEQ ID NO: 3701480 - RNA, 12 nt, Human
ugaaugacaaag

SEQ ID NO: 3701481 - RNA, 17 nt, Human
ugaaugacaacagaagc

SEQ ID NO: 3701482 - RNA, 17 nt, Human
ugaaugacuaagaggaa

SEQ ID NO: 3701483 - RNA, 21 nt, Human
ugaaugacuuccccaauaucu

SEQ ID NO: 3701484 - RNA, 19 nt, Human
ugaaugaggucccaggcag

SEQ ID NO: 3701485 - RNA, 21 nt, Human
ugaaugagucuguuguguguc

SEQ ID NO: 3701486 - RNA, 15 nt, Human
ugaaugaucucucug

SEQ ID NO: 3701487 - RNA, 17 nt, Human
ugaaugauucauguuau

SEQ ID NO: 3701488 - RNA, 14 nt, Human
ugaaugauuugcau

SEQ ID NO: 3701489 - RNA, 19 nt, Human
ugaaugauuuuucuuuaca

SEQ ID NO: 3701490 - RNA, 19 nt, Human
ugaaugcaccauggucaaa

SEQ ID NO: 3701491 - RNA, 18 nt, Human
ugaaugcagguuuuauca

SEQ ID NO: 3701492 - RNA, 22 nt, Human
ugaaugcagucuguccaggcuc

SEQ ID NO: 3701493 - RNA, 12 nt, Human
ugaaugcauuuu

SEQ ID NO: 3701494 - RNA, 14 nt, Human
ugaaugcauuuugu

SEQ ID NO: 3701495 - RNA, 21 nt, Human
ugaaugcauuuuguuugguau

SEQ ID NO: 3701496 - RNA, 22 nt, Human
ugaaugcauuuuguuugguauu

SEQ ID NO: 3701497 - RNA, 20 nt, Human
ugaaugccacgcgguacaaa

SEQ ID NO: 3701498 - RNA, 21 nt, Human
ugaaugccacugccuucgcuu

SEQ ID NO: 3701499 - RNA, 21 nt, Human
ugaaugccgcgaugggucagg

SEQ ID NO: 3701500 - RNA, 16 nt, Human
ugaaugccuccugugg

SEQ ID NO: 3701501 - RNA, 17 nt, Human
ugaaugccuccuguggg

SEQ ID NO: 3701502 - RNA, 18 nt, Human
ugaaugccuccugugggg

SEQ ID NO: 3701503 - RNA, 14 nt, Human
ugaaugcugccagu

SEQ ID NO: 3701504 - RNA, 11 nt, Human
ugaaugcuggg

SEQ ID NO: 3701505 - RNA, 12 nt, Human
ugaaugcuggga

SEQ ID NO: 3701506 - RNA, 14 nt, Human
ugaaugcugggacu

SEQ ID NO: 3701507 - RNA, 22 nt, Human
ugaaugcuuaaagaauucaaau

SEQ ID NO: 3701508 - RNA, 19 nt, Human
ugaaugcuuauagguggcc

SEQ ID NO: 3701509 - RNA, 21 nt, Human
ugaaugcuuauagguggccuc

SEQ ID NO: 3701510 - RNA, 23 nt, Human
ugaaugcuucuaaguaaauacaa

SEQ ID NO: 3701511 - RNA, 14 nt, Human
ugaaugcuuugcau

SEQ ID NO: 3701512 - RNA, 19 nt, Human
ugaaugcuuuuugaauguu

SEQ ID NO: 3701513 - RNA, 23 nt, Human
ugaaugcuuuuugaauguuauuu

SEQ ID NO: 3701514 - RNA, 15 nt, Human
ugaauggauuggauu

SEQ ID NO: 3701515 - RNA, 23 nt, Human
ugaauggauuggauuauuuaaua

SEQ ID NO: 3701516 - RNA, 15 nt, Human
ugaauggccugccuu

SEQ ID NO: 3701517 - RNA, 17 nt, Human
ugaauggccugccuuga

SEQ ID NO: 3701518 - RNA, 20 nt, Human
ugaauggcuauguuuuuaau

SEQ ID NO: 3701519 - RNA, 17 nt, Human
ugaauggcuuuguauag

SEQ ID NO: 3701520 - RNA, 18 nt, Human
ugaauggcuuuguauaga

SEQ ID NO: 3701521 - RNA, 18 nt, Human
ugaaugggacagaguuga

SEQ ID NO: 3701522 - RNA, 13 nt, Human
ugaaugggaucau

SEQ ID NO: 3701523 - RNA, 19 nt, Human
ugaaugggcaaaacugaau

SEQ ID NO: 3701524 - RNA, 13 nt, Human
ugaaugguaugga

SEQ ID NO: 3701525 - RNA, 21 nt, Human
ugaauggucagcguugcaugu

SEQ ID NO: 3701526 - RNA, 15 nt, Human
ugaaugguguuguau

SEQ ID NO: 3701527 - RNA, 20 nt, Human
ugaaugguuuucaaaauaaa

SEQ ID NO: 3701528 - RNA, 21 nt, Human
ugaauguaaauuuguacuauu

SEQ ID NO: 3701529 - RNA, 18 nt, Human
ugaauguaauuuguguaa

SEQ ID NO: 3701530 - RNA, 23 nt, Human
ugaauguaggcuggcuuucagag

SEQ ID NO: 3701531 - RNA, 16 nt, Human
ugaauguaucaggaaa

SEQ ID NO: 3701532 - RNA, 19 nt, Human
ugaauguaugcuucauaca

SEQ ID NO: 3701533 - RNA, 20 nt, Human
ugaauguaugcuucauacag

SEQ ID NO: 3701534 - RNA, 14 nt, Human
ugaauguauguaaa

SEQ ID NO: 3701535 - RNA, 20 nt, Human
ugaauguauguaaugugugg

SEQ ID NO: 3701536 - RNA, 15 nt, Human
ugaauguaugugcac

SEQ ID NO: 3701537 - RNA, 16 nt, Human
ugaauguauugaacuu

SEQ ID NO: 3701538 - RNA, 11 nt, Human
ugaauguauuu

SEQ ID NO: 3701539 - RNA, 15 nt, Human
ugaauguauuuauuu

SEQ ID NO: 3701540 - RNA, 15 nt, Human
ugaaugucaguguga

SEQ ID NO: 3701541 - RNA, 15 nt, Human
ugaaugucaguuguu

SEQ ID NO: 3701542 - RNA, 16 nt, Human
ugaaugucauucacaa

SEQ ID NO: 3701543 - RNA, 18 nt, Human
ugaaugucuaaaauuguu

SEQ ID NO: 3701544 - RNA, 15 nt, Human
ugaaugucuuuugaa

SEQ ID NO: 3701545 - RNA, 22 nt, Human
ugaaugucuuuuuucaaacuuu

SEQ ID NO: 3701546 - RNA, 15 nt, Human
ugaaugugaagccuu

SEQ ID NO: 3701547 - RNA, 17 nt, Human
ugaaugugaagccuucc

SEQ ID NO: 3701548 - RNA, 18 nt, Human
ugaauguggcuugagaaa

SEQ ID NO: 3701549 - RNA, 16 nt, Human
ugaaugugggcacugg

SEQ ID NO: 3701550 - RNA, 15 nt, Human
ugaauguggucucag

SEQ ID NO: 3701551 - RNA, 20 nt, Human
ugaauguguuucacaguuug

SEQ ID NO: 3701552 - RNA, 23 nt, Human
ugaauguguuucacaguuugaaa

SEQ ID NO: 3701553 - RNA, 11 nt, Human
ugaauguuaaa

SEQ ID NO: 3701554 - RNA, 16 nt, Human
ugaauguuaaauaaau

SEQ ID NO: 3701555 - RNA, 21 nt, Human
ugaauguuaaauaaauuguau

SEQ ID NO: 3701556 - RNA, 17 nt, Human
ugaauguuaagaauuga

SEQ ID NO: 3701557 - RNA, 16 nt, Human
ugaauguuaauuuuuu

SEQ ID NO: 3701558 - RNA, 22 nt, Human
ugaauguuuacacucuuuguaa

SEQ ID NO: 3701559 - RNA, 19 nt, Human
ugaauguuuauuccuugau

SEQ ID NO: 3701560 - RNA, 11 nt, Human
ugaauguuucc

SEQ ID NO: 3701561 - RNA, 14 nt, Human
ugaauuaaguuuuu

SEQ ID NO: 3701562 - RNA, 16 nt, Human
ugaauuaauaucccua

SEQ ID NO: 3701563 - RNA, 20 nt, Human
ugaauuaaugacagagccag

SEQ ID NO: 3701564 - RNA, 19 nt, Human
ugaauuaauuaauuuggag

SEQ ID NO: 3701565 - RNA, 16 nt, Human
ugaauuacuaacuucu

SEQ ID NO: 3701566 - RNA, 20 nt, Human
ugaauuacuaacuucuaaaa

SEQ ID NO: 3701567 - RNA, 19 nt, Human
ugaauuagaaacauaaaua

SEQ ID NO: 3701568 - RNA, 15 nt, Human
ugaauuagugaguau

SEQ ID NO: 3701569 - RNA, 15 nt, Human
ugaauuaugaaacuu

SEQ ID NO: 3701570 - RNA, 18 nt, Human
ugaauuauuacaguguuu

SEQ ID NO: 3701571 - RNA, 18 nt, Human
ugaauuauugacacugaa

SEQ ID NO: 3701572 - RNA, 21 nt, Human
ugaauuauugacacugaacuu

SEQ ID NO: 3701573 - RNA, 13 nt, Human
ugaauucauagaa

SEQ ID NO: 3701574 - RNA, 15 nt, Human
ugaauucauuucacu

SEQ ID NO: 3701575 - RNA, 13 nt, Human
ugaauucccucac

SEQ ID NO: 3701576 - RNA, 14 nt, Human
ugaauucccucacu

SEQ ID NO: 3701577 - RNA, 22 nt, Human
ugaauucccucacucgucuccc

SEQ ID NO: 3701578 - RNA, 17 nt, Human
ugaauuccuaaaauuau

SEQ ID NO: 3701579 - RNA, 23 nt, Human
ugaauuccuaaaauuauggaaac

SEQ ID NO: 3701580 - RNA, 23 nt, Human
ugaauucggaacuguccuuuccu

SEQ ID NO: 3701581 - RNA, 16 nt, Human
ugaauugaaguuucaa

SEQ ID NO: 3701582 - RNA, 13 nt, Human
ugaauugacuacc

SEQ ID NO: 3701583 - RNA, 17 nt, Human
ugaauugagccuaaaaa

SEQ ID NO: 3701584 - RNA, 15 nt, Human
ugaauugauaauaaa

SEQ ID NO: 3701585 - RNA, 16 nt, Human
ugaauugauaauaaac

SEQ ID NO: 3701586 - RNA, 14 nt, Human
ugaauuggaaugca

SEQ ID NO: 3701587 - RNA, 19 nt, Human
ugaauuguaacuguucuug

SEQ ID NO: 3701588 - RNA, 13 nt, Human
ugaauuguaagga

SEQ ID NO: 3701589 - RNA, 12 nt, Human
ugaauuguacag

SEQ ID NO: 3701590 - RNA, 13 nt, Human
ugaauuguacaga

SEQ ID NO: 3701591 - RNA, 19 nt, Human
ugaauuuaaauauaauucu

SEQ ID NO: 3701592 - RNA, 19 nt, Human
ugaauuuagugagauuuac

SEQ ID NO: 3701593 - RNA, 15 nt, Human
ugaauuuagugagca

SEQ ID NO: 3701594 - RNA, 17 nt, Human
ugaauuuauaaaguacc

SEQ ID NO: 3701595 - RNA, 15 nt, Human
ugaauuuaucuuuga

SEQ ID NO: 3701596 - RNA, 16 nt, Human
ugaauuuaucuuugau

SEQ ID NO: 3701597 - RNA, 20 nt, Human
ugaauuuauugcacauuguu

SEQ ID NO: 3701598 - RNA, 15 nt, Human
ugaauuuauuggcuu

SEQ ID NO: 3701599 - RNA, 17 nt, Human
ugaauuuauuggcuuuu

SEQ ID NO: 3701600 - RNA, 11 nt, Human
ugaauuucauc

SEQ ID NO: 3701601 - RNA, 14 nt, Human
ugaauuucucuaca

SEQ ID NO: 3701602 - RNA, 20 nt, Human
ugaauuucuucacuguugaa

SEQ ID NO: 3701603 - RNA, 23 nt, Human
ugaauuucuucacuguugaaaau

SEQ ID NO: 3701604 - RNA, 16 nt, Human
ugaauuugaaugaaaa

SEQ ID NO: 3701605 - RNA, 15 nt, Human
ugaauuugcaaagua

SEQ ID NO: 3701606 - RNA, 17 nt, Human
ugaauuugcaaaguacu

SEQ ID NO: 3701607 - RNA, 18 nt, Human
ugaauuugcaaaguacug

SEQ ID NO: 3701608 - RNA, 11 nt, Human
ugaauuuggag

SEQ ID NO: 3701609 - RNA, 20 nt, Human
ugaauuuggagacucugugg

SEQ ID NO: 3701610 - RNA, 19 nt, Human
ggugugaggacauaaaucu

SEQ ID NO: 3701611 - RNA, 16 nt, Human
ggugugaggcaggaga

SEQ ID NO: 3701612 - RNA, 15 nt, Human
ggugugcacaucucu

SEQ ID NO: 3701613 - RNA, 16 nt, Human
ggugugcacaucucug

SEQ ID NO: 3701614 - RNA, 14 nt, Human
ggugugcuauagcu

SEQ ID NO: 3701615 - RNA, 12 nt, Human
ggugugcuggga

SEQ ID NO: 3701616 - RNA, 19 nt, Human
ggugugcugggagcuccac

SEQ ID NO: 3701617 - RNA, 12 nt, Human
gguguggaagag

SEQ ID NO: 3701618 - RNA, 15 nt, Human
gguguggcccugcca

SEQ ID NO: 3701619 - RNA, 15 nt, Human
ggugugggggccccg

SEQ ID NO: 3701620 - RNA, 12 nt, Human
ggugugucugcu

SEQ ID NO: 3701621 - RNA, 14 nt, Human
gguguguguagcca

SEQ ID NO: 3701622 - RNA, 21 nt, Human
gguguguuggacagagaaggg

SEQ ID NO: 3701623 - RNA, 15 nt, Human
gguguuaacagaagg

SEQ ID NO: 3701624 - RNA, 14 nt, Human
gguguuaauuuuug

SEQ ID NO: 3701625 - RNA, 17 nt, Human
gguguuacugcaguuga

SEQ ID NO: 3701626 - RNA, 23 nt, Human
gguguuccgaaaccaaagaagaa

SEQ ID NO: 3701627 - RNA, 13 nt, Human
gguguucuaagau

SEQ ID NO: 3701628 - RNA, 17 nt, Human
gguguugccaguugucc

SEQ ID NO: 3701629 - RNA, 20 nt, Human
gguguuguacucaauuuuaa

SEQ ID NO: 3701630 - RNA, 15 nt, Human
gguguuguaugccuu

SEQ ID NO: 3701631 - RNA, 17 nt, Human
gguguuuccuggcacug

SEQ ID NO: 3701632 - RNA, 21 nt, Human
gguguuucuagcacuggccug

SEQ ID NO: 3701633 - RNA, 14 nt, Human
gguguuuucaugua

SEQ ID NO: 3701634 - RNA, 13 nt, Human
gguguuuucugug

SEQ ID NO: 3701635 - RNA, 17 nt, Human
gguguuuucuguguaac

SEQ ID NO: 3701636 - RNA, 19 nt, Human
gguguuuuuuaugaagugc

SEQ ID NO: 3701637 - RNA, 11 nt, Human
gguuaaaacug

SEQ ID NO: 3701638 - RNA, 12 nt, Human
gguuaaaaugga

SEQ ID NO: 3701639 - RNA, 14 nt, Human
gguuaaauguuuug

SEQ ID NO: 3701640 - RNA, 17 nt, Human
gguuaacuauguacaau

SEQ ID NO: 3701641 - RNA, 15 nt, Human
gguuaaggcugagga

SEQ ID NO: 3701642 - RNA, 13 nt, Human
gguuaagucuguu

SEQ ID NO: 3701643 - RNA, 13 nt, Human
gguuaauaaguuu

SEQ ID NO: 3701644 - RNA, 14 nt, Human
gguuacaaacugca

SEQ ID NO: 3701645 - RNA, 15 nt, Human
gguuacuucuucucu

SEQ ID NO: 3701646 - RNA, 15 nt, Human
gguuagaccuacagg

SEQ ID NO: 3701647 - RNA, 22 nt, Human
gguuagaccuacagggggucug

SEQ ID NO: 3701648 - RNA, 14 nt, Human
gguuagauauagag

SEQ ID NO: 3701649 - RNA, 22 nt, Human
gguuagcucagccccagcccag

SEQ ID NO: 3701650 - RNA, 20 nt, Human
gguuaggaguucgagaccag

SEQ ID NO: 3701651 - RNA, 17 nt, Human
gguuaggcauuguggga

SEQ ID NO: 3701652 - RNA, 16 nt, Human
gguuagggaaaacauu

SEQ ID NO: 3701653 - RNA, 22 nt, Human
gguuaguggauggaaggggcug

SEQ ID NO: 3701654 - RNA, 15 nt, Human
gguuauagugcaaua

SEQ ID NO: 3701655 - RNA, 17 nt, Human
gguuauagugcaauaua

SEQ ID NO: 3701656 - RNA, 21 nt, Human
gguuauauuuuacuacugugg

SEQ ID NO: 3701657 - RNA, 21 nt, Human
gguuaugaaagaauauauuua

SEQ ID NO: 3701658 - RNA, 13 nt, Human
gguuaugaauauu

SEQ ID NO: 3701659 - RNA, 11 nt, Human
gguuauguuuu

SEQ ID NO: 3701660 - RNA, 14 nt, Human
gguuauuuauuuaa

SEQ ID NO: 3701661 - RNA, 18 nt, Human
gguuauuuauuuaaaugu

SEQ ID NO: 3701662 - RNA, 24 nt, Human
gguuauuucucaacaaagcacagu

SEQ ID NO: 3701663 - RNA, 13 nt, Human
gguuauuucucug

SEQ ID NO: 3701664 - RNA, 17 nt, Human
gguucaaaccugugaag

SEQ ID NO: 3701665 - RNA, 19 nt, Human
gguucaagugauucucuug

SEQ ID NO: 3701666 - RNA, 13 nt, Human
gguucaccagccu

SEQ ID NO: 3701667 - RNA, 16 nt, Human
gguucaccauugagac

SEQ ID NO: 3701668 - RNA, 19 nt, Human
gguucacucuuggagccug

SEQ ID NO: 3701669 - RNA, 21 nt, Human
gguucacucuuggagccugca

SEQ ID NO: 3701670 - RNA, 16 nt, Human
gguucagaaaugcugc

SEQ ID NO: 3701671 - RNA, 16 nt, Human
gguucagagacucagg

SEQ ID NO: 3701672 - RNA, 13 nt, Human
gguucaggcccgg

SEQ ID NO: 3701673 - RNA, 21 nt, Human
gguucaggguuggccccugcc

SEQ ID NO: 3701674 - RNA, 15 nt, Human
gguucaguguuucug

SEQ ID NO: 3701675 - RNA, 14 nt, Human
gguucaguuucuuc

SEQ ID NO: 3701676 - RNA, 15 nt, Human
gguucaugaugcagu

SEQ ID NO: 3701677 - RNA, 18 nt, Human
gguuccaauccuggcucu

SEQ ID NO: 3701678 - RNA, 12 nt, Human
gguuccacagac

SEQ ID NO: 3701679 - RNA, 13 nt, Human
gguuccacagagu

SEQ ID NO: 3701680 - RNA, 19 nt, Human
gguuccacagaguaagaca

SEQ ID NO: 3701681 - RNA, 22 nt, Human
gguuccacagaguaagacauug

SEQ ID NO: 3701682 - RNA, 23 nt, Human
gguuccagcaauucuccugccuc

SEQ ID NO: 3701683 - RNA, 16 nt, Human
gguuccagccugccac

SEQ ID NO: 3701684 - RNA, 13 nt, Human
gguucccaagcuc

SEQ ID NO: 3701685 - RNA, 16 nt, Human
gguucccaagcucaga

SEQ ID NO: 3701686 - RNA, 17 nt, Human
gguucccauuugcuccu

SEQ ID NO: 3701687 - RNA, 18 nt, Human
gguucccuguucuuccuc

SEQ ID NO: 3701688 - RNA, 12 nt, Human
gguucccuuccu

SEQ ID NO: 3701689 - RNA, 17 nt, Human
gguucccuuuccuucca

SEQ ID NO: 3701690 - RNA, 23 nt, Human
gguucccuuugacgccaucccag

SEQ ID NO: 3701691 - RNA, 22 nt, Human
gguuccgcuuggagcagagggg

SEQ ID NO: 3701692 - RNA, 21 nt, Human
gguuccggaauccuguccuca

SEQ ID NO: 3701693 - RNA, 16 nt, Human
gguuccuccucuccua

SEQ ID NO: 3701694 - RNA, 18 nt, Human
gguuccucugccugcccc

SEQ ID NO: 3701695 - RNA, 16 nt, Human
gguuccuucugggcau

SEQ ID NO: 3701696 - RNA, 19 nt, Human
gguucguucuguacuguua

SEQ ID NO: 3701697 - RNA, 14 nt, Human
gguucuaaaguucu

SEQ ID NO: 3701698 - RNA, 23 nt, Human
gguucuaaggccuaggauucuaa

SEQ ID NO: 3701699 - RNA, 18 nt, Human
gguucuaggcaucucugu

SEQ ID NO: 3701700 - RNA, 18 nt, Human
gguucucccccuuucucu

SEQ ID NO: 3701701 - RNA, 17 nt, Human
gguucugagauggcucc

SEQ ID NO: 3701702 - RNA, 12 nt, Human
gguucugccucu

SEQ ID NO: 3701703 - RNA, 13 nt, Human
gguucugccugcu

SEQ ID NO: 3701704 - RNA, 22 nt, Human
gguucugguuagcucagcccca

SEQ ID NO: 3701705 - RNA, 16 nt, Human
gguucuuagugucacu

SEQ ID NO: 3701706 - RNA, 22 nt, Human
gguucuuguauuaagaaugaaa

SEQ ID NO: 3701707 - RNA, 18 nt, Human
gguucuuucauuugcuuu

SEQ ID NO: 3701708 - RNA, 23 nt, Human
gguucuuugagggacugccucug

SEQ ID NO: 3701709 - RNA, 15 nt, Human
gguucuuuggaagga

SEQ ID NO: 3701710 - RNA, 13 nt, Human
gguucuuugugua

SEQ ID NO: 3701711 - RNA, 14 nt, Human
gguugaagcaccaa

SEQ ID NO: 3701712 - RNA, 18 nt, Human
gguugaggggcuccugga

SEQ ID NO: 3701713 - RNA, 19 nt, Human
gguugagguggaagcccuc

SEQ ID NO: 3701714 - RNA, 14 nt, Human
gguugaucacacuc

SEQ ID NO: 3701715 - RNA, 14 nt, Human
gguugccacaggcc

SEQ ID NO: 3701716 - RNA, 18 nt, Human
gguugccacaggccuccc

SEQ ID NO: 3701717 - RNA, 17 nt, Human
gguugcgggacagagua

SEQ ID NO: 3701718 - RNA, 16 nt, Human
gguugcucacagcugu

SEQ ID NO: 3701719 - RNA, 18 nt, Human
gguugcuccgccuggccu

SEQ ID NO: 3701720 - RNA, 16 nt, Human
gguugcugguugcugu

SEQ ID NO: 3701721 - RNA, 17 nt, Human
gguugcugguugcugug

SEQ ID NO: 3701722 - RNA, 18 nt, Human
gguugcugguugcugugu

SEQ ID NO: 3701723 - RNA, 18 nt, Human
gguugcuguuuuccuccc

SEQ ID NO: 3701724 - RNA, 22 nt, Human
gguuggaagugagggucagaga

SEQ ID NO: 3701725 - RNA, 15 nt, Human
gguugggaugggaua

SEQ ID NO: 3701726 - RNA, 14 nt, Human
gguuggggugacag

SEQ ID NO: 3701727 - RNA, 19 nt, Human
gguuguaauuaaauucuga

SEQ ID NO: 3701728 - RNA, 19 nt, Human
gguuguauucuuugauguu

SEQ ID NO: 3701729 - RNA, 10 nt, Human
gguugucaau

SEQ ID NO: 3701730 - RNA, 14 nt, Human
gguugucagcucuc

SEQ ID NO: 3701731 - RNA, 21 nt, Human
gguugucuguuuuuguaacuu

SEQ ID NO: 3701732 - RNA, 14 nt, Human
gguugugaggccug

SEQ ID NO: 3701733 - RNA, 16 nt, Human
gguugugaggccuggc

SEQ ID NO: 3701734 - RNA, 21 nt, Human
gguugugaggccuggccaggc

SEQ ID NO: 3701735 - RNA, 20 nt, Human
gguuuaaacuuguuugcugu

SEQ ID NO: 3701736 - RNA, 23 nt, Human
gguuuaacucagaucacuacugc

SEQ ID NO: 3701737 - RNA, 16 nt, Human
gguuuaaguagauuuc

SEQ ID NO: 3701738 - RNA, 14 nt, Human
gguuuacaggcccu

SEQ ID NO: 3701739 - RNA, 22 nt, Human
gguuuacaugugauguuuuagu

SEQ ID NO: 3701740 - RNA, 19 nt, Human
gguuuacauucaucucauu

SEQ ID NO: 3701741 - RNA, 18 nt, Human
gguuuacucacugcugca

SEQ ID NO: 3701742 - RNA, 12 nt, Human
gguuuacuuuca

SEQ ID NO: 3701743 - RNA, 16 nt, Human
gguuuagaaagcuugc

SEQ ID NO: 3701744 - RNA, 22 nt, Human
gguuuaggcugguggcccagga

SEQ ID NO: 3701745 - RNA, 18 nt, Human
gguuuaguguaaaaauga

SEQ ID NO: 3701746 - RNA, 23 nt, Human
gguuuaucgcccuggcaggcagg

SEQ ID NO: 3701747 - RNA, 11 nt, Human
gguuuauuugg

SEQ ID NO: 3701748 - RNA, 17 nt, Human
gguuuauuuuucuguua

SEQ ID NO: 3701749 - RNA, 16 nt, Human
gguuucaaagaugcug

SEQ ID NO: 3701750 - RNA, 19 nt, Human
gguuucaccauguugccca

SEQ ID NO: 3701751 - RNA, 14 nt, Human
gguuucagaaaugu

SEQ ID NO: 3701752 - RNA, 13 nt, Human
gguuucagcacua

SEQ ID NO: 3701753 - RNA, 17 nt, Human
gguuucauauuucuuau

SEQ ID NO: 3701754 - RNA, 16 nt, Human
gguuucauguuaguua

SEQ ID NO: 3701755 - RNA, 12 nt, Human
gguuuccaaagg

SEQ ID NO: 3701756 - RNA, 20 nt, Human
gguuucccaaugguguuuuu

SEQ ID NO: 3701757 - RNA, 13 nt, Human
gguuuccugcccu

SEQ ID NO: 3701758 - RNA, 16 nt, Human
gguuuccugcccuggg

SEQ ID NO: 3701759 - RNA, 17 nt, Human
gguuucgaagucauuaa

SEQ ID NO: 3701760 - RNA, 15 nt, Human
gguuucgagaagcug

SEQ ID NO: 3701761 - RNA, 20 nt, Human
gguuucucuauuaaaaugca

SEQ ID NO: 3701762 - RNA, 17 nt, Human
ugauuuguaacccacug

SEQ ID NO: 3701763 - RNA, 20 nt, Human
ugauuuguaacccacugaga

SEQ ID NO: 3701764 - RNA, 22 nt, Human
ugauuuuaaaccauaaaaagcu

SEQ ID NO: 3701765 - RNA, 15 nt, Human
ugauuuuaaaugugu

SEQ ID NO: 3701766 - RNA, 12 nt, Human
ugauuuuaacaa

SEQ ID NO: 3701767 - RNA, 22 nt, Human
ugauuuuaacaauaacuacugu

SEQ ID NO: 3701768 - RNA, 15 nt, Human
ugauuuuaacucugu

SEQ ID NO: 3701769 - RNA, 17 nt, Human
ugauuuuaacucugucu

SEQ ID NO: 3701770 - RNA, 19 nt, Human
ugauuuuaaguuucucugc

SEQ ID NO: 3701771 - RNA, 22 nt, Human
ugauuuuaaguuucucugcaga

SEQ ID NO: 3701772 - RNA, 21 nt, Human
ugauuuuaauggauuguuaau

SEQ ID NO: 3701773 - RNA, 19 nt, Human
ugauuuuacaauugaaaug

SEQ ID NO: 3701774 - RNA, 18 nt, Human
ugauuuuagcugcagaac

SEQ ID NO: 3701775 - RNA, 18 nt, Human
ugauuuuaugaucagugu

SEQ ID NO: 3701776 - RNA, 12 nt, Human
ugauuuuauucu

SEQ ID NO: 3701777 - RNA, 14 nt, Human
ugauuuuauucuug

SEQ ID NO: 3701778 - RNA, 17 nt, Human
ugauuuucaagcagcau

SEQ ID NO: 3701779 - RNA, 15 nt, Human
ugauuuucauugcug

SEQ ID NO: 3701780 - RNA, 17 nt, Human
ugauuuuccaucuaaaa

SEQ ID NO: 3701781 - RNA, 14 nt, Human
ugauuuucccucua

SEQ ID NO: 3701782 - RNA, 12 nt, Human
ugauuuucuguu

SEQ ID NO: 3701783 - RNA, 13 nt, Human
ugauuuucuguug

SEQ ID NO: 3701784 - RNA, 23 nt, Human
ugauuuugaaccugaugaaaaua

SEQ ID NO: 3701785 - RNA, 13 nt, Human
ugauuuugcaaau

SEQ ID NO: 3701786 - RNA, 14 nt, Human
ugauuuugcuguag

SEQ ID NO: 3701787 - RNA, 16 nt, Human
ugauuuugcuguagaa

SEQ ID NO: 3701788 - RNA, 19 nt, Human
ugauuuugcuguagaagau

SEQ ID NO: 3701789 - RNA, 21 nt, Human
ugauuuuuaccguuucuuccc

SEQ ID NO: 3701790 - RNA, 23 nt, Human
ugauuuuuauaaauacugcaaau

SEQ ID NO: 3701791 - RNA, 20 nt, Human
ugauuuuuaugaugaugaaa

SEQ ID NO: 3701792 - RNA, 15 nt, Human
ugauuuuucuuuaca

SEQ ID NO: 3701793 - RNA, 23 nt, Human
ugauuuuugagcccuuguuucag

SEQ ID NO: 3701794 - RNA, 22 nt, Human
ugauuuuugccucuuccagucu

SEQ ID NO: 3701795 - RNA, 18 nt, Human
ugauuuuuguaagacaau

SEQ ID NO: 3701796 - RNA, 13 nt, Human
ugauuuuugucuc

SEQ ID NO: 3701797 - RNA, 14 nt, Human
ugauuuuuguugau

SEQ ID NO: 3701798 - RNA, 19 nt, Human
ugauuuuuguugauuaaaa

SEQ ID NO: 3701799 - RNA, 13 nt, Human
ugauuuuuuaaaa

SEQ ID NO: 3701800 - RNA, 16 nt, Human
ugauuuuuuaaaagaa

SEQ ID NO: 3701801 - RNA, 23 nt, Human
ugauuuuuuuucccauuuagaau

SEQ ID NO: 3701802 - RNA, 23 nt, Human
ugauuuuuuuuuagaacagaaaa

SEQ ID NO: 3701803 - RNA, 12 nt, Human
ugcaaaaaauag

SEQ ID NO: 3701804 - RNA, 22 nt, Human
ugcaaaaagaaaugacuaauua

SEQ ID NO: 3701805 - RNA, 21 nt, Human
ugcaaaaagcuagucaacagu

SEQ ID NO: 3701806 - RNA, 18 nt, Human
ugcaaaaagcuucugugg

SEQ ID NO: 3701807 - RNA, 23 nt, Human
ugcaaaaauauuuauaaaacuuc

SEQ ID NO: 3701808 - RNA, 17 nt, Human
ugcaaaaauccaaauau

SEQ ID NO: 3701809 - RNA, 22 nt, Human
ugcaaaaauccaaauauuguua

SEQ ID NO: 3701810 - RNA, 20 nt, Human
ugcaaaaauuuuuggauuga

SEQ ID NO: 3701811 - RNA, 14 nt, Human
ugcaaaaccuuuga

SEQ ID NO: 3701812 - RNA, 20 nt, Human
ugcaaaagacuaauuuaaaa

SEQ ID NO: 3701813 - RNA, 19 nt, Human
ugcaaaaggacucucagga

SEQ ID NO: 3701814 - RNA, 22 nt, Human
ugcaaaaggacucucaggacca

SEQ ID NO: 3701815 - RNA, 23 nt, Human
ugcaaaagguucacuaaagcagu

SEQ ID NO: 3701816 - RNA, 20 nt, Human
ugcaaaaguucugacuugac

SEQ ID NO: 3701817 - RNA, 15 nt, Human
ugcaaaauacaugaa

SEQ ID NO: 3701818 - RNA, 23 nt, Human
ugcaaaauacaugaugauuucag

SEQ ID NO: 3701819 - RNA, 14 nt, Human
ugcaaaaucaguuu

SEQ ID NO: 3701820 - RNA, 15 nt, Human
ugcaaaaucaguuuu

SEQ ID NO: 3701821 - RNA, 20 nt, Human
ugcaaaaucaguuuuccucu

SEQ ID NO: 3701822 - RNA, 14 nt, Human
ugcaaaauuuccag

SEQ ID NO: 3701823 - RNA, 21 nt, Human
ugcaaaauuugaugccaggac

SEQ ID NO: 3701824 - RNA, 14 nt, Human
ugcaaacagaacag

SEQ ID NO: 3701825 - RNA, 13 nt, Human
ugcaaacauugga

SEQ ID NO: 3701826 - RNA, 16 nt, Human
ugcaaacauuggaaga

SEQ ID NO: 3701827 - RNA, 12 nt, Human
ugcaaaccauca

SEQ ID NO: 3701828 - RNA, 20 nt, Human
ugcaaaccaucauugaaauc

SEQ ID NO: 3701829 - RNA, 16 nt, Human
ugcaaacgcugccugc

SEQ ID NO: 3701830 - RNA, 21 nt, Human
ugcaaacgcugccugcccgua

SEQ ID NO: 3701831 - RNA, 11 nt, Human
ugcaaacuggg

SEQ ID NO: 3701832 - RNA, 13 nt, Human
ugcaaacugggaa

SEQ ID NO: 3701833 - RNA, 22 nt, Human
ugcaaacugggcuggaagauau

SEQ ID NO: 3701834 - RNA, 23 nt, Human
ugcaaacugggcuggaagauauu

SEQ ID NO: 3701835 - RNA, 16 nt, Human
ugcaaagaaagaaaaa

SEQ ID NO: 3701836 - RNA, 22 nt, Human
ugcaaagaaagaaaaaaaacca

SEQ ID NO: 3701837 - RNA, 12 nt, Human
ugcaaagaugaa

SEQ ID NO: 3701838 - RNA, 20 nt, Human
ugcaaagcacugacuucuaa

SEQ ID NO: 3701839 - RNA, 13 nt, Human
ugcaaaggacaga

SEQ ID NO: 3701840 - RNA, 15 nt, Human
ugcaaaggacagauc

SEQ ID NO: 3701841 - RNA, 22 nt, Human
ugcaaaggucuuuuuaaaccag

SEQ ID NO: 3701842 - RNA, 15 nt, Human
ugcaaaguacaaugu

SEQ ID NO: 3701843 - RNA, 18 nt, Human
ugcaaaguacaauguguu

SEQ ID NO: 3701844 - RNA, 21 nt, Human
ugcaaaguacagguacuuugu

SEQ ID NO: 3701845 - RNA, 21 nt, Human
ugcaaaguacuguaagaauaa

SEQ ID NO: 3701846 - RNA, 19 nt, Human
ugcaaaguauaaauuugug

SEQ ID NO: 3701847 - RNA, 20 nt, Human
ugcaaaguaucccuacugua

SEQ ID NO: 3701848 - RNA, 12 nt, Human
ugcaaaguauug

SEQ ID NO: 3701849 - RNA, 15 nt, Human
ugcaaaguauuguaa

SEQ ID NO: 3701850 - RNA, 18 nt, Human
ugcaaaguauuguaaauu

SEQ ID NO: 3701851 - RNA, 23 nt, Human
ugcaaagucaugcaaaggcuggg

SEQ ID NO: 3701852 - RNA, 23 nt, Human
ugcaaaguucccuacuuccugug

SEQ ID NO: 3701853 - RNA, 14 nt, Human
ugcaaaguucugug

SEQ ID NO: 3701854 - RNA, 13 nt, Human
ugcaaauaacaaa

SEQ ID NO: 3701855 - RNA, 17 nt, Human
ugcaaauaacaaaugcc

SEQ ID NO: 3701856 - RNA, 15 nt, Human
ugcaaauaaguguau

SEQ ID NO: 3701857 - RNA, 23 nt, Human
ugcaaauacuguauauucaggac

SEQ ID NO: 3701858 - RNA, 13 nt, Human
ugcaaauauaaac

SEQ ID NO: 3701859 - RNA, 15 nt, Human
ugcaaauauaaacau

SEQ ID NO: 3701860 - RNA, 16 nt, Human
ugcaaauauaaacauc

SEQ ID NO: 3701861 - RNA, 15 nt, Human
ugcaaauccuaugug

SEQ ID NO: 3701862 - RNA, 18 nt, Human
ugcaaauccuaugugauu

SEQ ID NO: 3701863 - RNA, 19 nt, Human
ugcaaauccuaugugauuu

SEQ ID NO: 3701864 - RNA, 14 nt, Human
ugcaaaucugaugg

SEQ ID NO: 3701865 - RNA, 20 nt, Human
ugcaaaugagcucugaaauc

SEQ ID NO: 3701866 - RNA, 22 nt, Human
ugcaaauggugguuguuucuuc

SEQ ID NO: 3701867 - RNA, 20 nt, Human
ugcaaauucccagauuugaa

SEQ ID NO: 3701868 - RNA, 12 nt, Human
ugcaaauuucau

SEQ ID NO: 3701869 - RNA, 16 nt, Human
ugcaacaaaauacauu

SEQ ID NO: 3701870 - RNA, 17 nt, Human
ugcaacaaaauguagaa

SEQ ID NO: 3701871 - RNA, 13 nt, Human
ugcaacaaaauuc

SEQ ID NO: 3701872 - RNA, 15 nt, Human
ugcaacaagcaugca

SEQ ID NO: 3701873 - RNA, 12 nt, Human
ugcaacacacag

SEQ ID NO: 3701874 - RNA, 14 nt, Human
ugcaacacacagac

SEQ ID NO: 3701875 - RNA, 12 nt, Human
ugcaacacuggu

SEQ ID NO: 3701876 - RNA, 16 nt, Human
ugcaacagacuugaau

SEQ ID NO: 3701877 - RNA, 24 nt, Human
ugcaacagcacuggcucucuccag

SEQ ID NO: 3701878 - RNA, 15 nt, Human
ugcaacaggcugggc

SEQ ID NO: 3701879 - RNA, 16 nt, Human
ugcaacaggcugggcu

SEQ ID NO: 3701880 - RNA, 19 nt, Human
ugcaacaggcugggcuuca

SEQ ID NO: 3701881 - RNA, 20 nt, Human
ugcaacaggcugggcuucag

SEQ ID NO: 3701882 - RNA, 24 nt, Human
ugcaacaggguauggacuaucugu

SEQ ID NO: 3701883 - RNA, 23 nt, Human
ugcaacauuuacaguccuucaaa

SEQ ID NO: 3701884 - RNA, 16 nt, Human
ugcaaccaagucacac

SEQ ID NO: 3701885 - RNA, 17 nt, Human
ugcaaccaagucacacg

SEQ ID NO: 3701886 - RNA, 14 nt, Human
ugcaaccacacacc

SEQ ID NO: 3701887 - RNA, 15 nt, Human
ugcaaccacugcaac

SEQ ID NO: 3701888 - RNA, 17 nt, Human
ugcaaccagggagcugc

SEQ ID NO: 3701889 - RNA, 16 nt, Human
ugcaacccaaggacug

SEQ ID NO: 3701890 - RNA, 15 nt, Human
ugcaaccuccaccuc

SEQ ID NO: 3701891 - RNA, 21 nt, Human
ugcaaccuccaccuccugggu

SEQ ID NO: 3701892 - RNA, 13 nt, Human
ugcaaccuccgcc

SEQ ID NO: 3701893 - RNA, 21 nt, Human
ugcaaccuccgccucuugggu

SEQ ID NO: 3701894 - RNA, 22 nt, Human
ugcaaccucgcuggacucucag

SEQ ID NO: 3701895 - RNA, 21 nt, Human
ugcaaccucugcuucccaggu

SEQ ID NO: 3701896 - RNA, 14 nt, Human
ugcaaccuguugau

SEQ ID NO: 3701897 - RNA, 14 nt, Human
ugcaaccuucaccu

SEQ ID NO: 3701898 - RNA, 16 nt, Human
ugcaacggcuuagacu

SEQ ID NO: 3701899 - RNA, 20 nt, Human
ugcaacggucuccugacugg

SEQ ID NO: 3701900 - RNA, 21 nt, Human
ugcaacggucuccugacuggu

SEQ ID NO: 3701901 - RNA, 19 nt, Human
ugcaacucaucaucgguga

SEQ ID NO: 3701902 - RNA, 17 nt, Human
ugcaacuucuuuuuauu

SEQ ID NO: 3701903 - RNA, 20 nt, Human
ugcaacuuuaagcagcucuu

SEQ ID NO: 3701904 - RNA, 23 nt, Human
ugcaacuuuaagcagcucuugcu

SEQ ID NO: 3701905 - RNA, 20 nt, Human
ugcaagaaaaugauguguac

SEQ ID NO: 3701906 - RNA, 18 nt, Human
ugcaagaacucaucacug

SEQ ID NO: 3701907 - RNA, 18 nt, Human
ugcaagagacucuggccu

SEQ ID NO: 3701908 - RNA, 23 nt, Human
ugcaagagccuugguguccaccu

SEQ ID NO: 3701909 - RNA, 17 nt, Human
ugcaagagugauugcag

SEQ ID NO: 3701910 - RNA, 20 nt, Human
ugcaagagugauugcagcuu

SEQ ID NO: 3701911 - RNA, 13 nt, Human
ugaauuuguaaug

SEQ ID NO: 3701912 - RNA, 13 nt, Human
ugaauuugugaag

SEQ ID NO: 3701913 - RNA, 21 nt, Human
ugaauuugugaagguggaaau

SEQ ID NO: 3701914 - RNA, 13 nt, Human
ugaauuuuaaagu

SEQ ID NO: 3701915 - RNA, 17 nt, Human
ugaauuuuaaggguuuc

SEQ ID NO: 3701916 - RNA, 14 nt, Human
ugaauuuuagcuuu

SEQ ID NO: 3701917 - RNA, 15 nt, Human
ugaauuuucacauga

SEQ ID NO: 3701918 - RNA, 16 nt, Human
ugaauuuucacaugaa

SEQ ID NO: 3701919 - RNA, 21 nt, Human
ugaauuuucauuuuacaguua

SEQ ID NO: 3701920 - RNA, 15 nt, Human
ugaauuuucuguguu

SEQ ID NO: 3701921 - RNA, 13 nt, Human
ugaauuuugggga

SEQ ID NO: 3701922 - RNA, 20 nt, Human
ugaauuuuguucucugggag

SEQ ID NO: 3701923 - RNA, 14 nt, Human
ugaauuuuguugcu

SEQ ID NO: 3701924 - RNA, 18 nt, Human
ugaauuuuguuuggacuu

SEQ ID NO: 3701925 - RNA, 17 nt, Human
ugaauuuuuaaacaagu

SEQ ID NO: 3701926 - RNA, 16 nt, Human
ugaauuuuuauuguug

SEQ ID NO: 3701927 - RNA, 15 nt, Human
ugaauuuuuccuaug

SEQ ID NO: 3701928 - RNA, 13 nt, Human
ugaauuuuugcaa

SEQ ID NO: 3701929 - RNA, 16 nt, Human
ugaauuuuugcaauaa

SEQ ID NO: 3701930 - RNA, 23 nt, Human
ugaauuuuuuucaucuucucugg

SEQ ID NO: 3701931 - RNA, 16 nt, Human
ugaauuuuuuuguaau

SEQ ID NO: 3701932 - RNA, 15 nt, Human
ugaauuuuuuuuaac

SEQ ID NO: 3701933 - RNA, 22 nt, Human
ugaauuuuuuuuaacauuccuc

SEQ ID NO: 3701934 - RNA, 19 nt, Human
ugacaaaaaauuaaagcau

SEQ ID NO: 3701935 - RNA, 16 nt, Human
ugacaaaaccuaacuu

SEQ ID NO: 3701936 - RNA, 17 nt, Human
ugacaaaaccuaacuug

SEQ ID NO: 3701937 - RNA, 13 nt, Human
ugacaaaauguua

SEQ ID NO: 3701938 - RNA, 14 nt, Human
ugacaaaauguuau

SEQ ID NO: 3701939 - RNA, 12 nt, Human
ugacaaacugug

SEQ ID NO: 3701940 - RNA, 17 nt, Human
ugacaaagaaacccaag

SEQ ID NO: 3701941 - RNA, 21 nt, Human
ugacaaagaguagacauuucu

SEQ ID NO: 3701942 - RNA, 16 nt, Human
ugacaaagauggcuca

SEQ ID NO: 3701943 - RNA, 23 nt, Human
ugacaaagauggcucagaggggg

SEQ ID NO: 3701944 - RNA, 16 nt, Human
ugacaaagcuuggaag

SEQ ID NO: 3701945 - RNA, 17 nt, Human
ugacaaaggcaagcacu

SEQ ID NO: 3701946 - RNA, 19 nt, Human
ugacaaaucaaguuuccaa

SEQ ID NO: 3701947 - RNA, 23 nt, Human
ugacaaaucuguguauauuauuu

SEQ ID NO: 3701948 - RNA, 17 nt, Human
ugacaaauguuucuaag

SEQ ID NO: 3701949 - RNA, 19 nt, Human
ugacaaauguuucuaaggu

SEQ ID NO: 3701950 - RNA, 23 nt, Human
ugacaacacucauugaccugagg

SEQ ID NO: 3701951 - RNA, 16 nt, Human
ugacaacauuucuaua

SEQ ID NO: 3701952 - RNA, 23 nt, Human
ugacaacauuucuauagccaaaa

SEQ ID NO: 3701953 - RNA, 16 nt, Human
ugacaaccaccgcucc

SEQ ID NO: 3701954 - RNA, 21 nt, Human
ugacaaccaccgcuccccagc

SEQ ID NO: 3701955 - RNA, 19 nt, Human
ugacaaccauuaaagucag

SEQ ID NO: 3701956 - RNA, 21 nt, Human
ugacaaccauuaaagucagaa

SEQ ID NO: 3701957 - RNA, 17 nt, Human
ugacaaccgagaagguu

SEQ ID NO: 3701958 - RNA, 21 nt, Human
ugacaacguuucagcgacucc

SEQ ID NO: 3701959 - RNA, 16 nt, Human
ugacaacuacagaaaa

SEQ ID NO: 3701960 - RNA, 22 nt, Human
ugacaacuacagaaaaaccaga

SEQ ID NO: 3701961 - RNA, 17 nt, Human
ugacaacuggcaggcag

SEQ ID NO: 3701962 - RNA, 14 nt, Human
ugacaacugugacu

SEQ ID NO: 3701963 - RNA, 16 nt, Human
ugacaacugugacugu

SEQ ID NO: 3701964 - RNA, 15 nt, Human
ugacaacuucuaauu

SEQ ID NO: 3701965 - RNA, 22 nt, Human
ugacaagagccugaucucuucc

SEQ ID NO: 3701966 - RNA, 22 nt, Human
ugacaagauuauaauauuuuaa

SEQ ID NO: 3701967 - RNA, 15 nt, Human
ugacaagccccaggc

SEQ ID NO: 3701968 - RNA, 21 nt, Human
ugacaagcuccauuuaaacag

SEQ ID NO: 3701969 - RNA, 14 nt, Human
ugacaagcuggcuu

SEQ ID NO: 3701970 - RNA, 18 nt, Human
ugacaaggauugcuacug

SEQ ID NO: 3701971 - RNA, 16 nt, Human
ugacaagggcugaccu

SEQ ID NO: 3701972 - RNA, 20 nt, Human
ugacaagucauuuuaacuuu

SEQ ID NO: 3701973 - RNA, 16 nt, Human
ugacaauaaaacauua

SEQ ID NO: 3701974 - RNA, 17 nt, Human
ugacaauaaaacauuaa

SEQ ID NO: 3701975 - RNA, 15 nt, Human
ugacaauaaagcuug

SEQ ID NO: 3701976 - RNA, 19 nt, Human
ugacaauaaagcuuguuga

SEQ ID NO: 3701977 - RNA, 14 nt, Human
ugacaauaaaugug

SEQ ID NO: 3701978 - RNA, 22 nt, Human
ugacaauaauauuguuguauaa

SEQ ID NO: 3701979 - RNA, 14 nt, Human
ugacaauaauuuca

SEQ ID NO: 3701980 - RNA, 24 nt, Human
ugacaauauuccagaucuuucaga

SEQ ID NO: 3701981 - RNA, 18 nt, Human
ugacaaucaacucuaaua

SEQ ID NO: 3701982 - RNA, 13 nt, Human
ugacaaucaugug

SEQ ID NO: 3701983 - RNA, 15 nt, Human
ugacaaucaugugug

SEQ ID NO: 3701984 - RNA, 13 nt, Human
ugacaaugaugau

SEQ ID NO: 3701985 - RNA, 14 nt, Human
ugacaauguuuaca

SEQ ID NO: 3701986 - RNA, 13 nt, Human
ugacaauugucac

SEQ ID NO: 3701987 - RNA, 12 nt, Human
ugacacaaacac

SEQ ID NO: 3701988 - RNA, 17 nt, Human
ugacacaaaccugccug

SEQ ID NO: 3701989 - RNA, 13 nt, Human
ugacacaaaggaa

SEQ ID NO: 3701990 - RNA, 15 nt, Human
ugacacaaaggaagu

SEQ ID NO: 3701991 - RNA, 16 nt, Human
ugacacaacuguguga

SEQ ID NO: 3701992 - RNA, 16 nt, Human
ugacacaaguggaccu

SEQ ID NO: 3701993 - RNA, 17 nt, Human
ugacacaauuggaauug

SEQ ID NO: 3701994 - RNA, 14 nt, Human
ugacacacagcucu

SEQ ID NO: 3701995 - RNA, 16 nt, Human
ugacacaccaggcgcu

SEQ ID NO: 3701996 - RNA, 16 nt, Human
ugacacacuacaccac

SEQ ID NO: 3701997 - RNA, 18 nt, Human
ugacacacuacaccacac

SEQ ID NO: 3701998 - RNA, 22 nt, Human
ugacacagcagcuucaccagag

SEQ ID NO: 3701999 - RNA, 16 nt, Human
ugacacaggaaaccaa

SEQ ID NO: 3702000 - RNA, 23 nt, Human
ugacacagucuuggcucacugca

SEQ ID NO: 3702001 - RNA, 19 nt, Human
ugacacauccgccuuuugu

SEQ ID NO: 3702002 - RNA, 22 nt, Human
ugacacauccgccuuuuguaua

SEQ ID NO: 3702003 - RNA, 12 nt, Human
ugacacaugcaa

SEQ ID NO: 3702004 - RNA, 20 nt, Human
ugacaccaaagccaccucug

SEQ ID NO: 3702005 - RNA, 12 nt, Human
ugacaccagccu

SEQ ID NO: 3702006 - RNA, 15 nt, Human
ugacaccagccuuuc

SEQ ID NO: 3702007 - RNA, 16 nt, Human
ugacaccagccuuucu

SEQ ID NO: 3702008 - RNA, 23 nt, Human
ugacaccagccuuucucccaggc

SEQ ID NO: 3702009 - RNA, 19 nt, Human
ugacacccuucucccacuc

SEQ ID NO: 3702010 - RNA, 21 nt, Human
ugacacccuucucccacucuc

SEQ ID NO: 3702011 - RNA, 19 nt, Human
ugacacgaauauugcugau

SEQ ID NO: 3702012 - RNA, 21 nt, Human
ugacacgacuucuguuucaca

SEQ ID NO: 3702013 - RNA, 15 nt, Human
ugacacuagaaaacu

SEQ ID NO: 3702014 - RNA, 18 nt, Human
ugacacuagcccaaugaa

SEQ ID NO: 3702015 - RNA, 19 nt, Human
ugacacuagcccaaugaaa

SEQ ID NO: 3702016 - RNA, 17 nt, Human
ugacacuauaucuguau

SEQ ID NO: 3702017 - RNA, 18 nt, Human
ugacacuauaucuguaua

SEQ ID NO: 3702018 - RNA, 22 nt, Human
ugacacucauauaauuauaugu

SEQ ID NO: 3702019 - RNA, 16 nt, Human
ugacacucccacccag

SEQ ID NO: 3702020 - RNA, 20 nt, Human
ugacacucccacccagucuc

SEQ ID NO: 3702021 - RNA, 15 nt, Human
ugacacucuccuugc

SEQ ID NO: 3702022 - RNA, 12 nt, Human
ugacacugaaag

SEQ ID NO: 3702023 - RNA, 19 nt, Human
ugacacugaaaguuuugua

SEQ ID NO: 3702024 - RNA, 13 nt, Human
ugacacugaaaug

SEQ ID NO: 3702025 - RNA, 16 nt, Human
ugacacugaaaugccu

SEQ ID NO: 3702026 - RNA, 22 nt, Human
ugacacugaacuuaauaacugu

SEQ ID NO: 3702027 - RNA, 11 nt, Human
ugacacugacc

SEQ ID NO: 3702028 - RNA, 13 nt, Human
ugacacugcucua

SEQ ID NO: 3702029 - RNA, 15 nt, Human
ugacacugcucuaac

SEQ ID NO: 3702030 - RNA, 19 nt, Human
ugacacugcucuaacagcc

SEQ ID NO: 3702031 - RNA, 20 nt, Human
ugacacugcuggagaggccc

SEQ ID NO: 3702032 - RNA, 20 nt, Human
ugacacuucagagagcuggu

SEQ ID NO: 3702033 - RNA, 20 nt, Human
ugacacuuuucauaucauuu

SEQ ID NO: 3702034 - RNA, 23 nt, Human
ugacagaaaauauguauuaacac

SEQ ID NO: 3702035 - RNA, 14 nt, Human
ugacagaacacugu

SEQ ID NO: 3702036 - RNA, 17 nt, Human
ugacagaaggugccacu

SEQ ID NO: 3702037 - RNA, 20 nt, Human
ugacagaaggugccacuuua

SEQ ID NO: 3702038 - RNA, 14 nt, Human
ugacagacacaggc

SEQ ID NO: 3702039 - RNA, 17 nt, Human
ugacagacacaggcccg

SEQ ID NO: 3702040 - RNA, 23 nt, Human
ugacagacacaggcccggcucca

SEQ ID NO: 3702041 - RNA, 15 nt, Human
ugacagacuccugag

SEQ ID NO: 3702042 - RNA, 14 nt, Human
ugacagacucucgu

SEQ ID NO: 3702043 - RNA, 23 nt, Human
ugacagagagagauacucuggga

SEQ ID NO: 3702044 - RNA, 22 nt, Human
ugacagagcaagugagacccug

SEQ ID NO: 3702045 - RNA, 16 nt, Human
ugacagagccugcccc

SEQ ID NO: 3702046 - RNA, 17 nt, Human
ugacagagccugcccca

SEQ ID NO: 3702047 - RNA, 22 nt, Human
ugacagagccugccccagcgcu

SEQ ID NO: 3702048 - RNA, 23 nt, Human
ugacagagccugccccagcgcug

SEQ ID NO: 3702049 - RNA, 15 nt, Human
ugacagaggcagccc

SEQ ID NO: 3702050 - RNA, 16 nt, Human
ugacagaggcagcccc

SEQ ID NO: 3702051 - RNA, 18 nt, Human
ugacagaggcagccccau

SEQ ID NO: 3702052 - RNA, 15 nt, Human
ugacagaucaagcug

SEQ ID NO: 3702053 - RNA, 16 nt, Human
ugacagaucaagcugu

SEQ ID NO: 3702054 - RNA, 18 nt, Human
ugacagaucaagcuguga

SEQ ID NO: 3702055 - RNA, 19 nt, Human
ugacagaugucagccgagc

SEQ ID NO: 3702056 - RNA, 12 nt, Human
ugacagcagcau

SEQ ID NO: 3702057 - RNA, 16 nt, Human
ugacagcagcaucucu

SEQ ID NO: 3702058 - RNA, 20 nt, Human
ugacagcaugugcccuccug

SEQ ID NO: 3702059 - RNA, 14 nt, Human
ugacagccagaacu

SEQ ID NO: 3702060 - RNA, 15 nt, Human
ugacagccucaguga

SEQ ID NO: 3702061 - RNA, 15 nt, Human
ugcaagcagaggacc

SEQ ID NO: 3702062 - RNA, 17 nt, Human
ugcaagcagaggaccag

SEQ ID NO: 3702063 - RNA, 21 nt, Human
ugcaagcagaggaccagggcc

SEQ ID NO: 3702064 - RNA, 23 nt, Human
ugcaagccccugcuccagaagau

SEQ ID NO: 3702065 - RNA, 18 nt, Human
ugcaagccugucugagac

SEQ ID NO: 3702066 - RNA, 17 nt, Human
ugcaagcuuuuccuaau

SEQ ID NO: 3702067 - RNA, 19 nt, Human
ugcaaggaaggaaagaaag

SEQ ID NO: 3702068 - RNA, 13 nt, Human
ugcaaggaccagg

SEQ ID NO: 3702069 - RNA, 17 nt, Human
ugcaaggaccaggacuc

SEQ ID NO: 3702070 - RNA, 14 nt, Human
ugcaaggcaaaugu

SEQ ID NO: 3702071 - RNA, 18 nt, Human
ugcaaggcagccgugggc

SEQ ID NO: 3702072 - RNA, 13 nt, Human
ugcaaggcccaca

SEQ ID NO: 3702073 - RNA, 14 nt, Human
ugcaaggcccacag

SEQ ID NO: 3702074 - RNA, 16 nt, Human
ugcaaggcccacagga

SEQ ID NO: 3702075 - RNA, 21 nt, Human
ugcaaggccugguguuucuug

SEQ ID NO: 3702076 - RNA, 22 nt, Human
ugcaagggcagaacacuaaccu

SEQ ID NO: 3702077 - RNA, 20 nt, Human
ugcaagggcggccuuuccca

SEQ ID NO: 3702078 - RNA, 16 nt, Human
ugcaagggcuccccac

SEQ ID NO: 3702079 - RNA, 16 nt, Human
ugcaagguacucuggu

SEQ ID NO: 3702080 - RNA, 16 nt, Human
ugcaaggucuuugguu

SEQ ID NO: 3702081 - RNA, 12 nt, Human
ugcaagguucca

SEQ ID NO: 3702082 - RNA, 14 nt, Human
ugcaagguuccaca

SEQ ID NO: 3702083 - RNA, 19 nt, Human
ugcaagguuccacagagua

SEQ ID NO: 3702084 - RNA, 19 nt, Human
ugcaaguacugcuguaaau

SEQ ID NO: 3702085 - RNA, 20 nt, Human
ugcaaguauacuagggagcc

SEQ ID NO: 3702086 - RNA, 14 nt, Human
ugcaaguauucuca

SEQ ID NO: 3702087 - RNA, 18 nt, Human
ugcaagucacaaaggaau

SEQ ID NO: 3702088 - RNA, 13 nt, Human
ugcaagucagagg

SEQ ID NO: 3702089 - RNA, 14 nt, Human
ugcaagucagagga

SEQ ID NO: 3702090 - RNA, 16 nt, Human
ugcaagucagaggaug

SEQ ID NO: 3702091 - RNA, 19 nt, Human
ugcaaguccuuuuguaaag

SEQ ID NO: 3702092 - RNA, 13 nt, Human
ugcaagugaaggu

SEQ ID NO: 3702093 - RNA, 18 nt, Human
ugcaagugaagguuuaca

SEQ ID NO: 3702094 - RNA, 20 nt, Human
ugcaagugagcaaaccugcc

SEQ ID NO: 3702095 - RNA, 14 nt, Human
ugcaagugugugca

SEQ ID NO: 3702096 - RNA, 13 nt, Human
ugcaaguugagga

SEQ ID NO: 3702097 - RNA, 24 nt, Human
ugcaauaaaaaugauacugauggu

SEQ ID NO: 3702098 - RNA, 17 nt, Human
ugcaauaaaauuuaaaa

SEQ ID NO: 3702099 - RNA, 14 nt, Human
ugcaauaaaguaua

SEQ ID NO: 3702100 - RNA, 14 nt, Human
ugcaauaacuucug

SEQ ID NO: 3702101 - RNA, 18 nt, Human
ugcaauaacuucugaccu

SEQ ID NO: 3702102 - RNA, 21 nt, Human
ugcaauaagaauuuagggaga

SEQ ID NO: 3702103 - RNA, 14 nt, Human
ugcaauaauacuuc

SEQ ID NO: 3702104 - RNA, 14 nt, Human
ugcaauaaugcagu

SEQ ID NO: 3702105 - RNA, 18 nt, Human
ugcaauacaaguuucauc

SEQ ID NO: 3702106 - RNA, 21 nt, Human
ugcaauagaagugcuccccuc

SEQ ID NO: 3702107 - RNA, 20 nt, Human
ugcaauagagacuguagauu

SEQ ID NO: 3702108 - RNA, 15 nt, Human
ugcaauauacuggaa

SEQ ID NO: 3702109 - RNA, 18 nt, Human
ugcaauauauuuuguaug

SEQ ID NO: 3702110 - RNA, 21 nt, Human
ugcaauauauuuuguaugcaa

SEQ ID NO: 3702111 - RNA, 22 nt, Human
ugcaauauuuccucaugugauc

SEQ ID NO: 3702112 - RNA, 14 nt, Human
ugcaauauuugaau

SEQ ID NO: 3702113 - RNA, 13 nt, Human
ugcaaucauaugu

SEQ ID NO: 3702114 - RNA, 15 nt, Human
ugcaaucauauguga

SEQ ID NO: 3702115 - RNA, 14 nt, Human
ugcaauccuuacaa

SEQ ID NO: 3702116 - RNA, 20 nt, Human
ugcaauccuuacaaaugauu

SEQ ID NO: 3702117 - RNA, 11 nt, Human
ugcaaugaaca

SEQ ID NO: 3702118 - RNA, 18 nt, Human
ugcaaugaagucucugaa

SEQ ID NO: 3702119 - RNA, 17 nt, Human
ugcaaugacaucuucaa

SEQ ID NO: 3702120 - RNA, 22 nt, Human
ugcaaugaccuuucaauaggaa

SEQ ID NO: 3702121 - RNA, 23 nt, Human
ugcaaugaccuuucaauaggaaa

SEQ ID NO: 3702122 - RNA, 20 nt, Human
ugcaauggcgugaucucggc

SEQ ID NO: 3702123 - RNA, 17 nt, Human
ugcaaugguuaacaucu

SEQ ID NO: 3702124 - RNA, 22 nt, Human
ugcaauguagaggggaaaagag

SEQ ID NO: 3702125 - RNA, 22 nt, Human
ugcaaugucugagugaaccugu

SEQ ID NO: 3702126 - RNA, 15 nt, Human
ugcaaugugaaaaau

SEQ ID NO: 3702127 - RNA, 18 nt, Human
ugcaaugugaucuauguu

SEQ ID NO: 3702128 - RNA, 18 nt, Human
ugcaauguguauaaacaa

SEQ ID NO: 3702129 - RNA, 19 nt, Human
ugcaauguguguauaugga

SEQ ID NO: 3702130 - RNA, 20 nt, Human
ugcaauguguguauauggac

SEQ ID NO: 3702131 - RNA, 19 nt, Human
ugcaauuaaacuuccaaag

SEQ ID NO: 3702132 - RNA, 22 nt, Human
ugcaauuggcaccgaagcccag

SEQ ID NO: 3702133 - RNA, 13 nt, Human
ugcaauuucaagg

SEQ ID NO: 3702134 - RNA, 19 nt, Human
ugcaauuuguuugugcuuc

SEQ ID NO: 3702135 - RNA, 19 nt, Human
ugcacaaaacccagaccug

SEQ ID NO: 3702136 - RNA, 23 nt, Human
ugcacaaaaugaaugaggucugg

SEQ ID NO: 3702137 - RNA, 19 nt, Human
ugcacaaacagaggccgcc

SEQ ID NO: 3702138 - RNA, 17 nt, Human
ugcacaaagcccuucca

SEQ ID NO: 3702139 - RNA, 14 nt, Human
ugcacaacauuaca

SEQ ID NO: 3702140 - RNA, 12 nt, Human
ugcacaaggauu

SEQ ID NO: 3702141 - RNA, 19 nt, Human
ugcacaaggauugaaaauu

SEQ ID NO: 3702142 - RNA, 18 nt, Human
ugcacaauaacuccuccc

SEQ ID NO: 3702143 - RNA, 13 nt, Human
ugcacaauguaga

SEQ ID NO: 3702144 - RNA, 21 nt, Human
ugcacacacacacacaugcac

SEQ ID NO: 3702145 - RNA, 18 nt, Human
ugcacacaccagagccca

SEQ ID NO: 3702146 - RNA, 21 nt, Human
ugcacacaccagagcccaccu

SEQ ID NO: 3702147 - RNA, 20 nt, Human
ugcacacagaaauauauaua

SEQ ID NO: 3702148 - RNA, 12 nt, Human
ugcacacagcac

SEQ ID NO: 3702149 - RNA, 24 nt, Human
ugcacacagcacgggggccaagga

SEQ ID NO: 3702150 - RNA, 12 nt, Human
ugcacacauuuu

SEQ ID NO: 3702151 - RNA, 14 nt, Human
ugcacacccacuca

SEQ ID NO: 3702152 - RNA, 17 nt, Human
ugcacacccacucagcu

SEQ ID NO: 3702153 - RNA, 18 nt, Human
ugcacaccccacucccac

SEQ ID NO: 3702154 - RNA, 22 nt, Human
ugcacaccuacuagucaccaga

SEQ ID NO: 3702155 - RNA, 15 nt, Human
ugcacacucaugugc

SEQ ID NO: 3702156 - RNA, 18 nt, Human
ugcacacuccccugcacu

SEQ ID NO: 3702157 - RNA, 14 nt, Human
ugcacacuguccua

SEQ ID NO: 3702158 - RNA, 23 nt, Human
ugcacacuugugugugggcugug

SEQ ID NO: 3702159 - RNA, 16 nt, Human
ugcacacuuuggccca

SEQ ID NO: 3702160 - RNA, 19 nt, Human
ugcacacuuuggcccaggg

SEQ ID NO: 3702161 - RNA, 20 nt, Human
ugcacacuuuggcccagggu

SEQ ID NO: 3702162 - RNA, 21 nt, Human
ugcacacuuuggcccagggug

SEQ ID NO: 3702163 - RNA, 14 nt, Human
ugcacagaagcaca

SEQ ID NO: 3702164 - RNA, 15 nt, Human
ugcacagaaguccug

SEQ ID NO: 3702165 - RNA, 19 nt, Human
ugcacagacgucccuccac

SEQ ID NO: 3702166 - RNA, 13 nt, Human
ugcacagagaagc

SEQ ID NO: 3702167 - RNA, 12 nt, Human
ugcacagagcuc

SEQ ID NO: 3702168 - RNA, 19 nt, Human
ugcacagagcucuccagcu

SEQ ID NO: 3702169 - RNA, 21 nt, Human
ugcacagagcucuccagcucc

SEQ ID NO: 3702170 - RNA, 18 nt, Human
ugcacagaguuguuacau

SEQ ID NO: 3702171 - RNA, 22 nt, Human
ugcacagaguuguuacauuuuu

SEQ ID NO: 3702172 - RNA, 18 nt, Human
ugcacagauauacuuugu

SEQ ID NO: 3702173 - RNA, 19 nt, Human
ugcacagauauacuuugug

SEQ ID NO: 3702174 - RNA, 23 nt, Human
ugcacagauggauuugccugugc

SEQ ID NO: 3702175 - RNA, 23 nt, Human
ugcacagcaggcugccagugccu

SEQ ID NO: 3702176 - RNA, 17 nt, Human
ugcacagcuaacaugga

SEQ ID NO: 3702177 - RNA, 13 nt, Human
ugcacagcugucc

SEQ ID NO: 3702178 - RNA, 13 nt, Human
ugcacaggagggg

SEQ ID NO: 3702179 - RNA, 15 nt, Human
ugcacaggagggggu

SEQ ID NO: 3702180 - RNA, 23 nt, Human
ugcacaggagggggucguggaga

SEQ ID NO: 3702181 - RNA, 18 nt, Human
ugcagccucacaguccuu

SEQ ID NO: 3702182 - RNA, 14 nt, Human
ugcagccucagaga

SEQ ID NO: 3702183 - RNA, 14 nt, Human
ugcagccuccuccu

SEQ ID NO: 3702184 - RNA, 15 nt, Human
ugcagccuccuccug

SEQ ID NO: 3702185 - RNA, 22 nt, Human
ugcagccucgaacuccugggcu

SEQ ID NO: 3702186 - RNA, 14 nt, Human
ugcagccugcgcca

SEQ ID NO: 3702187 - RNA, 22 nt, Human
ugcagccugcucuagugggaca

SEQ ID NO: 3702188 - RNA, 15 nt, Human
ugcagccuggaggcc

SEQ ID NO: 3702189 - RNA, 20 nt, Human
ugcagccuguccugggcugg

SEQ ID NO: 3702190 - RNA, 21 nt, Human
ugcagccuugaacucugggcu

SEQ ID NO: 3702191 - RNA, 23 nt, Human
ugcagccuuugccuccccggcuc

SEQ ID NO: 3702192 - RNA, 18 nt, Human
ugcagcgauuaauaacag

SEQ ID NO: 3702193 - RNA, 19 nt, Human
ugcagcuaguccuagugaa

SEQ ID NO: 3702194 - RNA, 14 nt, Human
ugcagcuaucuggu

SEQ ID NO: 3702195 - RNA, 22 nt, Human
ugcagcucaaggaaaggccuga

SEQ ID NO: 3702196 - RNA, 18 nt, Human
ugcagcucagaaccacag

SEQ ID NO: 3702197 - RNA, 20 nt, Human
ugcagcucagaaccacagca

SEQ ID NO: 3702198 - RNA, 21 nt, Human
ugcagcucucaugcugccccu

SEQ ID NO: 3702199 - RNA, 20 nt, Human
ugcagcucuccccuucucug

SEQ ID NO: 3702200 - RNA, 22 nt, Human
ugcagcucuccccuucucugua

SEQ ID NO: 3702201 - RNA, 22 nt, Human
ugcagcugaaauugaaaaguua

SEQ ID NO: 3702202 - RNA, 12 nt, Human
ugcagcuggaca

SEQ ID NO: 3702203 - RNA, 13 nt, Human
ugcagcuggacag

SEQ ID NO: 3702204 - RNA, 20 nt, Human
ugcagcuguggcagaguuac

SEQ ID NO: 3702205 - RNA, 21 nt, Human
ugcagcuguuuuguugacauu

SEQ ID NO: 3702206 - RNA, 13 nt, Human
ugcagcuuccugu

SEQ ID NO: 3702207 - RNA, 16 nt, Human
ugcagcuugggagagc

SEQ ID NO: 3702208 - RNA, 23 nt, Human
ugcagcuugggagagccccuggg

SEQ ID NO: 3702209 - RNA, 14 nt, Human
ugcagcuuguagcc

SEQ ID NO: 3702210 - RNA, 20 nt, Human
ugcagcuuguagccagccgg

SEQ ID NO: 3702211 - RNA, 15 nt, Human
ugcagcuuuacaugc

SEQ ID NO: 3702212 - RNA, 15 nt, Human
ugcagcuuuauguuc

SEQ ID NO: 3702213 - RNA, 22 nt, Human
ugcagcuuuauguucauuuguu

SEQ ID NO: 3702214 - RNA, 15 nt, Human
ugcagcuuugcaaac

SEQ ID NO: 3702215 - RNA, 17 nt, Human
ugcaggaaauggcugug

SEQ ID NO: 3702216 - RNA, 12 nt, Human
ugcaggaaggag

SEQ ID NO: 3702217 - RNA, 14 nt, Human
ugcaggaaggagcu

SEQ ID NO: 3702218 - RNA, 23 nt, Human
ugcaggaaggagcugccuggacc

SEQ ID NO: 3702219 - RNA, 17 nt, Human
ugcaggaauaaggccuu

SEQ ID NO: 3702220 - RNA, 14 nt, Human
ugcaggaaucaaaa

SEQ ID NO: 3702221 - RNA, 15 nt, Human
ugcaggaaucaaaaa

SEQ ID NO: 3702222 - RNA, 15 nt, Human
ugcaggaccucaggu

SEQ ID NO: 3702223 - RNA, 22 nt, Human
ugcaggagcaguaucaugaagc

SEQ ID NO: 3702224 - RNA, 17 nt, Human
ugcaggaucucaccagg

SEQ ID NO: 3702225 - RNA, 21 nt, Human
ugcaggaucucaccaggcagc

SEQ ID NO: 3702226 - RNA, 17 nt, Human
ugcaggcagccaggcca

SEQ ID NO: 3702227 - RNA, 19 nt, Human
ugcaggcagccaggccaca

SEQ ID NO: 3702228 - RNA, 20 nt, Human
ugcaggcaggaacaaacagg

SEQ ID NO: 3702229 - RNA, 16 nt, Human
ugcaggcaucacagcu

SEQ ID NO: 3702230 - RNA, 20 nt, Human
ugcaggccaagagcagaggc

SEQ ID NO: 3702231 - RNA, 21 nt, Human
ugcaggccaagagcagaggca

SEQ ID NO: 3702232 - RNA, 15 nt, Human
ugcaggcccuggccu

SEQ ID NO: 3702233 - RNA, 11 nt, Human
ugcaggcccuu

SEQ ID NO: 3702234 - RNA, 15 nt, Human
ugcaggcuccccuga

SEQ ID NO: 3702235 - RNA, 17 nt, Human
ugcaggcuccccugagg

SEQ ID NO: 3702236 - RNA, 18 nt, Human
ugcaggcuggcaccgccu

SEQ ID NO: 3702237 - RNA, 21 nt, Human
ugcaggcuggcaccgccuucu

SEQ ID NO: 3702238 - RNA, 22 nt, Human
ugcaggcuggcaccgccuucuc

SEQ ID NO: 3702239 - RNA, 22 nt, Human
ugcaggcuggccagccgcucuc

SEQ ID NO: 3702240 - RNA, 19 nt, Human
ugcaggcuuugccauugug

SEQ ID NO: 3702241 - RNA, 22 nt, Human
ugcagggaaaauuauuugcaua

SEQ ID NO: 3702242 - RNA, 15 nt, Human
ugcagggacaaagag

SEQ ID NO: 3702243 - RNA, 16 nt, Human
ugcagggacagagcau

SEQ ID NO: 3702244 - RNA, 18 nt, Human
ugcagggauguggguucc

SEQ ID NO: 3702245 - RNA, 19 nt, Human
ugcagggauugcugccacu

SEQ ID NO: 3702246 - RNA, 22 nt, Human
ugcagggcaaaauauucacugg

SEQ ID NO: 3702247 - RNA, 15 nt, Human
ugcagggccaggacu

SEQ ID NO: 3702248 - RNA, 19 nt, Human
ugcagggcuuuaaaauucu

SEQ ID NO: 3702249 - RNA, 20 nt, Human
ugcaggggauugaagcccuc

SEQ ID NO: 3702250 - RNA, 16 nt, Human
ugacuuuuauaaagca

SEQ ID NO: 3702251 - RNA, 18 nt, Human
ugacuuuuauaaagcaug

SEQ ID NO: 3702252 - RNA, 22 nt, Human
ugacuuuuccauguaucuaccu

SEQ ID NO: 3702253 - RNA, 22 nt, Human
ugacuuuucuguaauucagguu

SEQ ID NO: 3702254 - RNA, 17 nt, Human
ugacuuuugcuuuaauu

SEQ ID NO: 3702255 - RNA, 21 nt, Human
ugacuuuugcuuuaauuccau

SEQ ID NO: 3702256 - RNA, 17 nt, Human
ugacuuuuugcauuuaa

SEQ ID NO: 3702257 - RNA, 14 nt, Human
ugacuuuuuuugua

SEQ ID NO: 3702258 - RNA, 12 nt, Human
ugagaaaacaug

SEQ ID NO: 3702259 - RNA, 16 nt, Human
ugagaaaacuucuuuu

SEQ ID NO: 3702260 - RNA, 15 nt, Human
ugagaaaauaaagcu

SEQ ID NO: 3702261 - RNA, 21 nt, Human
ugagaaaauugaaauaaagcu

SEQ ID NO: 3702262 - RNA, 20 nt, Human
ugagaaacaucucaauaaag

SEQ ID NO: 3702263 - RNA, 16 nt, Human
ugagaaaccuguaucu

SEQ ID NO: 3702264 - RNA, 20 nt, Human
ugagaaaccuguaucuuucu

SEQ ID NO: 3702265 - RNA, 21 nt, Human
ugagaaaccuguaucuuucua

SEQ ID NO: 3702266 - RNA, 23 nt, Human
ugagaaaccuuauuguaccucuc

SEQ ID NO: 3702267 - RNA, 13 nt, Human
ugagaaagagcac

SEQ ID NO: 3702268 - RNA, 20 nt, Human
ugagaaagucagauucuugc

SEQ ID NO: 3702269 - RNA, 15 nt, Human
ugagaaauauggaca

SEQ ID NO: 3702270 - RNA, 17 nt, Human
ugagaaauauggacacu

SEQ ID NO: 3702271 - RNA, 14 nt, Human
ugagaaauccugga

SEQ ID NO: 3702272 - RNA, 13 nt, Human
ugagaaaucuaaa

SEQ ID NO: 3702273 - RNA, 14 nt, Human
ugagaaaugaaaua

SEQ ID NO: 3702274 - RNA, 18 nt, Human
ugagaaaugaaauauugu

SEQ ID NO: 3702275 - RNA, 15 nt, Human
ugagaaaugaauaau

SEQ ID NO: 3702276 - RNA, 14 nt, Human
ugagaaauuaagua

SEQ ID NO: 3702277 - RNA, 18 nt, Human
ugagaaauuuaaacuaua

SEQ ID NO: 3702278 - RNA, 12 nt, Human
ugagaacaaagc

SEQ ID NO: 3702279 - RNA, 15 nt, Human
ugagaacaaagcugu

SEQ ID NO: 3702280 - RNA, 16 nt, Human
ugagaacaaagcuguu

SEQ ID NO: 3702281 - RNA, 19 nt, Human
ugagaacaaagcuguuaaa

SEQ ID NO: 3702282 - RNA, 23 nt, Human
ugagaacagauaaagauugugug

SEQ ID NO: 3702283 - RNA, 22 nt, Human
ugagaacagaucuccaaagcuu

SEQ ID NO: 3702284 - RNA, 16 nt, Human
ugagaacauguuggua

SEQ ID NO: 3702285 - RNA, 12 nt, Human
ugagaaccuggc

SEQ ID NO: 3702286 - RNA, 14 nt, Human
ugagaaccuggccu

SEQ ID NO: 3702287 - RNA, 15 nt, Human
ugagaaccuggccuu

SEQ ID NO: 3702288 - RNA, 17 nt, Human
ugagaacugcauauguu

SEQ ID NO: 3702289 - RNA, 23 nt, Human
ugagaagaaaacaucuauucucu

SEQ ID NO: 3702290 - RNA, 12 nt, Human
ugagaagaauag

SEQ ID NO: 3702291 - RNA, 13 nt, Human
ugagaagaauauu

SEQ ID NO: 3702292 - RNA, 21 nt, Human
ugagaagaauauuguuccuaa

SEQ ID NO: 3702293 - RNA, 22 nt, Human
ugagaagaauauuguuccuaag

SEQ ID NO: 3702294 - RNA, 15 nt, Human
ugagaagagggccug

SEQ ID NO: 3702295 - RNA, 16 nt, Human
ugagaagagggccugu

SEQ ID NO: 3702296 - RNA, 16 nt, Human
ugagaagauugugaau

SEQ ID NO: 3702297 - RNA, 14 nt, Human
ugagaagccuucag

SEQ ID NO: 3702298 - RNA, 20 nt, Human
ugagaagccuucagcuccag

SEQ ID NO: 3702299 - RNA, 12 nt, Human
ugagaagcucug

SEQ ID NO: 3702300 - RNA, 17 nt, Human
ugagaagcugcucaacu

SEQ ID NO: 3702301 - RNA, 15 nt, Human
ugagaagcugcucca

SEQ ID NO: 3702302 - RNA, 19 nt, Human
ugagaagcuuuugaauaaa

SEQ ID NO: 3702303 - RNA, 13 nt, Human
ugagaaggcagcc

SEQ ID NO: 3702304 - RNA, 14 nt, Human
ugagaaggcagcca

SEQ ID NO: 3702305 - RNA, 15 nt, Human
ugagaagguuuauug

SEQ ID NO: 3702306 - RNA, 12 nt, Human
ugagaaguauac

SEQ ID NO: 3702307 - RNA, 18 nt, Human
ugagaaguuuuguacaga

SEQ ID NO: 3702308 - RNA, 24 nt, Human
ugagaaguuuuguacagagaauua

SEQ ID NO: 3702309 - RNA, 17 nt, Human
ugagaauagaaggaaac

SEQ ID NO: 3702310 - RNA, 13 nt, Human
ugagaaucccaaa

SEQ ID NO: 3702311 - RNA, 22 nt, Human
ugagaaucccaaauuugauuga

SEQ ID NO: 3702312 - RNA, 18 nt, Human
ugagaaucuauauuuaac

SEQ ID NO: 3702313 - RNA, 20 nt, Human
ugagaaucuuuauugagaaa

SEQ ID NO: 3702314 - RNA, 14 nt, Human
ugagaaugaacaaa

SEQ ID NO: 3702315 - RNA, 15 nt, Human
ugagaauguaagaac

SEQ ID NO: 3702316 - RNA, 12 nt, Human
ugagaauuaccc

SEQ ID NO: 3702317 - RNA, 16 nt, Human
ugagaauucagcugcc

SEQ ID NO: 3702318 - RNA, 22 nt, Human
ugagaauucagcugcccccgcu

SEQ ID NO: 3702319 - RNA, 12 nt, Human
ugagacaaaaau

SEQ ID NO: 3702320 - RNA, 23 nt, Human
ugagacaaauuuuaacuucuugu

SEQ ID NO: 3702321 - RNA, 23 nt, Human
ugagacacacaacggcagugaag

SEQ ID NO: 3702322 - RNA, 20 nt, Human
ugagacagaaucucgcucug

SEQ ID NO: 3702323 - RNA, 17 nt, Human
ugagacagcccgggcuc

SEQ ID NO: 3702324 - RNA, 22 nt, Human
ugagacagcccgggcucugccu

SEQ ID NO: 3702325 - RNA, 22 nt, Human
ugagacaggagaaacacuugaa

SEQ ID NO: 3702326 - RNA, 15 nt, Human
ugagacaggagaauc

SEQ ID NO: 3702327 - RNA, 16 nt, Human
ugagacaguccagccu

SEQ ID NO: 3702328 - RNA, 13 nt, Human
ugagacaguggga

SEQ ID NO: 3702329 - RNA, 18 nt, Human
ugagacagugggaaauau

SEQ ID NO: 3702330 - RNA, 18 nt, Human
ugagacaguuucuuagcu

SEQ ID NO: 3702331 - RNA, 10 nt, Human
ugagacaucc

SEQ ID NO: 3702332 - RNA, 12 nt, Human
ugagacauccag

SEQ ID NO: 3702333 - RNA, 12 nt, Human
ugagaccaccuc

SEQ ID NO: 3702334 - RNA, 19 nt, Human
ugagaccaccucucaauau

SEQ ID NO: 3702335 - RNA, 13 nt, Human
ugagaccagccug

SEQ ID NO: 3702336 - RNA, 18 nt, Human
ugagacccagcccucauc

SEQ ID NO: 3702337 - RNA, 20 nt, Human
ugagacccagcccucauccc

SEQ ID NO: 3702338 - RNA, 13 nt, Human
ugagacccaggac

SEQ ID NO: 3702339 - RNA, 16 nt, Human
ugagacccccacaccu

SEQ ID NO: 3702340 - RNA, 15 nt, Human
ugagaccccuggccu

SEQ ID NO: 3702341 - RNA, 18 nt, Human
ugagaccccuggccuccg

SEQ ID NO: 3702342 - RNA, 12 nt, Human
ugagaccucagc

SEQ ID NO: 3702343 - RNA, 19 nt, Human
ugagaccucagccaugagg

SEQ ID NO: 3702344 - RNA, 22 nt, Human
ugagaccugccccuccucucug

SEQ ID NO: 3702345 - RNA, 23 nt, Human
ugagacggagucucgcucuguca

SEQ ID NO: 3702346 - RNA, 23 nt, Human
ugagacguuuuuggaagaguagu

SEQ ID NO: 3702347 - RNA, 18 nt, Human
ugagacuaugcguuuuua

SEQ ID NO: 3702348 - RNA, 14 nt, Human
ugagacuauuuaaa

SEQ ID NO: 3702349 - RNA, 17 nt, Human
ugagacucacaggaagg

SEQ ID NO: 3702350 - RNA, 17 nt, Human
ugagacuccagaccuga

SEQ ID NO: 3702351 - RNA, 18 nt, Human
ugagacugggucucgcuu

SEQ ID NO: 3702352 - RNA, 13 nt, Human
ugagacuugccuu

SEQ ID NO: 3702353 - RNA, 20 nt, Human
ugagacuugcucucuggccu

SEQ ID NO: 3702354 - RNA, 13 nt, Human
ugagacuuuaaaa

SEQ ID NO: 3702355 - RNA, 14 nt, Human
ugagacuuuuuggu

SEQ ID NO: 3702356 - RNA, 22 nt, Human
ugagagaaauauggaacuuaca

SEQ ID NO: 3702357 - RNA, 18 nt, Human
ugagagaauaagucaugu

SEQ ID NO: 3702358 - RNA, 14 nt, Human
ugagagaauggaaa

SEQ ID NO: 3702359 - RNA, 18 nt, Human
ugagagacggugucuugu

SEQ ID NO: 3702360 - RNA, 18 nt, Human
ugagagagagucuuacuc

SEQ ID NO: 3702361 - RNA, 17 nt, Human
ugagagagaugggagcu

SEQ ID NO: 3702362 - RNA, 21 nt, Human
ugagagagaugggagcuccuc

SEQ ID NO: 3702363 - RNA, 22 nt, Human
ugagagagaugggagcuccucu

SEQ ID NO: 3702364 - RNA, 16 nt, Human
ugagagagauguguaa

SEQ ID NO: 3702365 - RNA, 18 nt, Human
ugagagaggcuaaaaugu

SEQ ID NO: 3702366 - RNA, 19 nt, Human
ugagagaggcuaaaauguu

SEQ ID NO: 3702367 - RNA, 21 nt, Human
ugagagaggcuaaaauguuuu

SEQ ID NO: 3702368 - RNA, 22 nt, Human
ugagagaguggcuggggcaugg

SEQ ID NO: 3702369 - RNA, 17 nt, Human
ugagagaucugcuguca

SEQ ID NO: 3702370 - RNA, 14 nt, Human
ugagagaugcugua

SEQ ID NO: 3702371 - RNA, 14 nt, Human
ugagagauucugug

SEQ ID NO: 3702372 - RNA, 13 nt, Human
ugagagcauaauu

SEQ ID NO: 3702373 - RNA, 19 nt, Human
ugagagcccagagguaaca

SEQ ID NO: 3702374 - RNA, 19 nt, Human
ugagagccccagcugacau

SEQ ID NO: 3702375 - RNA, 22 nt, Human
ugagagccccagcugacaugga

SEQ ID NO: 3702376 - RNA, 16 nt, Human
ugagagcgcagcccgc

SEQ ID NO: 3702377 - RNA, 23 nt, Human
ugagagcgugcuccagccuggcu

SEQ ID NO: 3702378 - RNA, 16 nt, Human
ugagagcugcucugga

SEQ ID NO: 3702379 - RNA, 17 nt, Human
ugagagcugugcaucag

SEQ ID NO: 3702380 - RNA, 13 nt, Human
ugagaggaaauca

SEQ ID NO: 3702381 - RNA, 17 nt, Human
ugagaggaaaucaccga

SEQ ID NO: 3702382 - RNA, 16 nt, Human
ugagaggacacucccg

SEQ ID NO: 3702383 - RNA, 23 nt, Human
ugagaggacuuuucuuuguggcu

SEQ ID NO: 3702384 - RNA, 15 nt, Human
ugagaggaugaaugu

SEQ ID NO: 3702385 - RNA, 22 nt, Human
ugagaggaugaauguaugugca

SEQ ID NO: 3702386 - RNA, 14 nt, Human
ugagaggcaggcau

SEQ ID NO: 3702387 - RNA, 16 nt, Human
ugagaggcauuucccc

SEQ ID NO: 3702388 - RNA, 23 nt, Human
ugagaggcccuggaucagcgugg

SEQ ID NO: 3702389 - RNA, 19 nt, Human
ugagaggcugggaauggag

SEQ ID NO: 3702390 - RNA, 19 nt, Human
ugagaggcugucuguugua

SEQ ID NO: 3702391 - RNA, 21 nt, Human
ugagagggcaguguuuccuuu

SEQ ID NO: 3702392 - RNA, 14 nt, Human
ugagagggccgggc

SEQ ID NO: 3702393 - RNA, 16 nt, Human
ugagaggggaagcggc

SEQ ID NO: 3702394 - RNA, 13 nt, Human
ugagaggggagag

SEQ ID NO: 3702395 - RNA, 18 nt, Human
ugagagguggcuuuugcg

SEQ ID NO: 3702396 - RNA, 18 nt, Human
ugagaguaacuuaaguua

SEQ ID NO: 3702397 - RNA, 17 nt, Human
ugagaguagagucacug

SEQ ID NO: 3702398 - RNA, 22 nt, Human
ugagagucagcucucugcccug

SEQ ID NO: 3702399 - RNA, 16 nt, Human
ugagagucuagauucu

SEQ ID NO: 3702400 - RNA, 17 nt, Human
ugagagucuagauucuc

SEQ ID NO: 3702401 - RNA, 21 nt, Human
ugagagucuagcacucauuuu

SEQ ID NO: 3702402 - RNA, 21 nt, Human
ugagagugucucugauaaaag

SEQ ID NO: 3702403 - RNA, 22 nt, Human
ugagagugucuucacggcagga

SEQ ID NO: 3702404 - RNA, 13 nt, Human
ugagagugugacc

SEQ ID NO: 3702405 - RNA, 15 nt, Human
ugagauacauacaga

SEQ ID NO: 3702406 - RNA, 22 nt, Human
ugagauacuuugcauugucugu

SEQ ID NO: 3702407 - RNA, 21 nt, Human
ugagauacuuuuucuuuugua

SEQ ID NO: 3702408 - RNA, 19 nt, Human
ugagauagcauugugaacu

SEQ ID NO: 3702409 - RNA, 15 nt, Human
ugagauaguuuucau

SEQ ID NO: 3702410 - RNA, 16 nt, Human
ugagauaguuuucauc

SEQ ID NO: 3702411 - RNA, 15 nt, Human
ugagauauuuauugu

SEQ ID NO: 3702412 - RNA, 15 nt, Human
ugagaucagccuggg

SEQ ID NO: 3702413 - RNA, 16 nt, Human
ugagauccccugagcc

SEQ ID NO: 3702414 - RNA, 21 nt, Human
ugagaucgugcuacugcacuc

SEQ ID NO: 3702415 - RNA, 22 nt, Human
ugagaucuaaaaauaacuguaa

SEQ ID NO: 3702416 - RNA, 22 nt, Human
ugagaucuaagccuuuccauaa

SEQ ID NO: 3702417 - RNA, 23 nt, Human
ugagaugagggaugggccuggca

SEQ ID NO: 3702418 - RNA, 18 nt, Human
ugagaugauucagaaggg

SEQ ID NO: 3702419 - RNA, 14 nt, Human
ugagaugcagcugg

SEQ ID NO: 3702420 - RNA, 18 nt, Human
ugagaugcagcuggaaaa

SEQ ID NO: 3702421 - RNA, 17 nt, Human
ugagaugcugguuuucu

SEQ ID NO: 3702422 - RNA, 21 nt, Human
ugagauggaaaaguguccuuc

SEQ ID NO: 3702423 - RNA, 21 nt, Human
ugagauggaacccuuuuggcc

SEQ ID NO: 3702424 - RNA, 13 nt, Human
ugagauggacaca

SEQ ID NO: 3702425 - RNA, 18 nt, Human
ugagauggagucucacuc

SEQ ID NO: 3702426 - RNA, 18 nt, Human
ugagauggagucuugcuc

SEQ ID NO: 3702427 - RNA, 12 nt, Human
ugagauggcccu

SEQ ID NO: 3702428 - RNA, 15 nt, Human
ugagauggcccucug

SEQ ID NO: 3702429 - RNA, 16 nt, Human
ugagauggcccucugg

SEQ ID NO: 3702430 - RNA, 22 nt, Human
ugagaugggcuucccaagggcu

SEQ ID NO: 3702431 - RNA, 21 nt, Human
ugagauggggauaaaaugacu

SEQ ID NO: 3702432 - RNA, 18 nt, Human
ugagaugugaacacauca

SEQ ID NO: 3702433 - RNA, 19 nt, Human
ugagaugugaacacaucag

SEQ ID NO: 3702434 - RNA, 15 nt, Human
ugagauuacagagga

SEQ ID NO: 3702435 - RNA, 15 nt, Human
ugagauuauuuuaau

SEQ ID NO: 3702436 - RNA, 23 nt, Human
ugagauucaauauugaauuuuuc

SEQ ID NO: 3702437 - RNA, 22 nt, Human
ugagauucucaaaggagcgagc

SEQ ID NO: 3702438 - RNA, 22 nt, Human
ugagauuguccucauuucucca

SEQ ID NO: 3702439 - RNA, 21 nt, Human
ugagauuuauuaaagaaaaaa

SEQ ID NO: 3702440 - RNA, 19 nt, Human
ugagauuucaucugcucuc

SEQ ID NO: 3702441 - RNA, 22 nt, Human
ugagauuucaucugcucuccuu

SEQ ID NO: 3702442 - RNA, 16 nt, Human
ugagauuuuuuauugc

SEQ ID NO: 3702443 - RNA, 18 nt, Human
ugagcaaaccugccccau

SEQ ID NO: 3702444 - RNA, 19 nt, Human
ugagcaaaccugccccauc

SEQ ID NO: 3702445 - RNA, 18 nt, Human
ugagcaaacuaacuugac

SEQ ID NO: 3702446 - RNA, 15 nt, Human
ugagcaacaagaauc

SEQ ID NO: 3702447 - RNA, 17 nt, Human
ugagcaacuuucuuaca

SEQ ID NO: 3702448 - RNA, 15 nt, Human
ugagcaagcccagga

SEQ ID NO: 3702449 - RNA, 15 nt, Human
ugagcaauccugcaa

SEQ ID NO: 3702450 - RNA, 16 nt, Human
ugagcaaugucugugc

SEQ ID NO: 3702451 - RNA, 17 nt, Human
ugagcaaugucugugcu

SEQ ID NO: 3702452 - RNA, 18 nt, Human
ugagcaaugucugugcua

SEQ ID NO: 3702453 - RNA, 21 nt, Human
ugagcacaacuuuaagaggac

SEQ ID NO: 3702454 - RNA, 20 nt, Human
ugagcacacuuuaguggccg

SEQ ID NO: 3702455 - RNA, 13 nt, Human
ugagcaccagggg

SEQ ID NO: 3702456 - RNA, 15 nt, Human
ugagcacccucugga

SEQ ID NO: 3702457 - RNA, 16 nt, Human
ugagcacccucuggau

SEQ ID NO: 3702458 - RNA, 20 nt, Human
ugagcaccucccagccccug

SEQ ID NO: 3702459 - RNA, 22 nt, Human
ugagcacuaaggugugcucuga

SEQ ID NO: 3702460 - RNA, 14 nt, Human
ugagcacugccagg

SEQ ID NO: 3702461 - RNA, 18 nt, Human
ugagcagaaggaaacaaa

SEQ ID NO: 3702462 - RNA, 16 nt, Human
ugagcagacuggugag

SEQ ID NO: 3702463 - RNA, 17 nt, Human
ugagcagacuggugagc

SEQ ID NO: 3702464 - RNA, 21 nt, Human
ugagcagagucuugcuaccuc

SEQ ID NO: 3702465 - RNA, 22 nt, Human
ugagcagggagauccugguugg

SEQ ID NO: 3702466 - RNA, 12 nt, Human
ugagcagggccg

SEQ ID NO: 3702467 - RNA, 14 nt, Human
ugagcagggccggg

SEQ ID NO: 3702468 - RNA, 20 nt, Human
ugagcagggccggggaacug

SEQ ID NO: 3702469 - RNA, 13 nt, Human
ugagcagggcuca

SEQ ID NO: 3702470 - RNA, 14 nt, Human
ugagcagggcucag

SEQ ID NO: 3702471 - RNA, 15 nt, Human
ugagcagggcucagc

SEQ ID NO: 3702472 - RNA, 22 nt, Human
ugagcagggcucagcggggaca

SEQ ID NO: 3702473 - RNA, 16 nt, Human
ugagcaguccuuggcc

SEQ ID NO: 3702474 - RNA, 15 nt, Human
ugagcagugagcaga

SEQ ID NO: 3702475 - RNA, 23 nt, Human
ugagcagugaguuacagcgagag

SEQ ID NO: 3702476 - RNA, 22 nt, Human
ugagcauacaucuuaaaucuuu

SEQ ID NO: 3702477 - RNA, 17 nt, Human
ugagcaucacaguuuug

SEQ ID NO: 3702478 - RNA, 15 nt, Human
ugagcaucaggccag

SEQ ID NO: 3702479 - RNA, 20 nt, Human
ugagcaucaggccaggcccu

SEQ ID NO: 3702480 - RNA, 21 nt, Human
ugagcaucaggccaggcccuc

SEQ ID NO: 3702481 - RNA, 14 nt, Human
ugagcauccugagc

SEQ ID NO: 3702482 - RNA, 15 nt, Human
ugagcauccugagcc

SEQ ID NO: 3702483 - RNA, 18 nt, Human
ugagcaucugucccccuu

SEQ ID NO: 3702484 - RNA, 19 nt, Human
ugagcaugacagccugcag

SEQ ID NO: 3702485 - RNA, 19 nt, Human
ugagcauggaacacuucga

SEQ ID NO: 3702486 - RNA, 15 nt, Human
ugagcauggagcugg

SEQ ID NO: 3702487 - RNA, 15 nt, Human
ugagcauguuacuga

SEQ ID NO: 3702488 - RNA, 15 nt, Human
ugagcauguuuagac

SEQ ID NO: 3702489 - RNA, 23 nt, Human
ugagcauguuuagacuuuaacau

SEQ ID NO: 3702490 - RNA, 18 nt, Human
ugagcauguuugccuaga

SEQ ID NO: 3702491 - RNA, 16 nt, Human
ugagcauuagauuucu

SEQ ID NO: 3702492 - RNA, 19 nt, Human
ugagcauuggauacagcag

SEQ ID NO: 3702493 - RNA, 14 nt, Human
ugagccaaagagaa

SEQ ID NO: 3702494 - RNA, 16 nt, Human
ugagccacagcagcau

SEQ ID NO: 3702495 - RNA, 18 nt, Human
ugagccacagcagcauuu

SEQ ID NO: 3702496 - RNA, 16 nt, Human
ugagccaccacaccug

SEQ ID NO: 3702497 - RNA, 14 nt, Human
ugagccaccgugcc

SEQ ID NO: 3702498 - RNA, 18 nt, Human
ugagccaccgugccuggc

SEQ ID NO: 3702499 - RNA, 21 nt, Human
ugagccaccgugccuggccac

SEQ ID NO: 3702500 - RNA, 18 nt, Human
ugagccaccugcccuuuu

SEQ ID NO: 3702501 - RNA, 19 nt, Human
ugagccaccugcccuuuuu

SEQ ID NO: 3702502 - RNA, 16 nt, Human
ugagccacucucuucc

SEQ ID NO: 3702503 - RNA, 11 nt, Human
ugagccacugc

SEQ ID NO: 3702504 - RNA, 12 nt, Human
ugagccacugca

SEQ ID NO: 3702505 - RNA, 23 nt, Human
ugagccacugcaccgggccacag

SEQ ID NO: 3702506 - RNA, 13 nt, Human
ugagccagauuuc

SEQ ID NO: 3702507 - RNA, 17 nt, Human
ugagccagauuucacuc

SEQ ID NO: 3702508 - RNA, 18 nt, Human
ugagccagauuucacucu

SEQ ID NO: 3702509 - RNA, 20 nt, Human
ugagccagauuucacucucc

SEQ ID NO: 3702510 - RNA, 17 nt, Human
ugagccagcagacauug

SEQ ID NO: 3702511 - RNA, 18 nt, Human
ugagccagcagacauugu

SEQ ID NO: 3702512 - RNA, 14 nt, Human
ugagccaggccugg

SEQ ID NO: 3702513 - RNA, 18 nt, Human
ugagccaggccugggucu

SEQ ID NO: 3702514 - RNA, 22 nt, Human
ugagccaggcuagcuggagccu

SEQ ID NO: 3702515 - RNA, 23 nt, Human
ugagccaggcuagcuggagccug

SEQ ID NO: 3702516 - RNA, 13 nt, Human
ugagccagggucu

SEQ ID NO: 3702517 - RNA, 17 nt, Human
ugagccagucccagggg

SEQ ID NO: 3702518 - RNA, 18 nt, Human
ugagccagucccaggggc

SEQ ID NO: 3702519 - RNA, 21 nt, Human
ugagccagugcuuuaauggca

SEQ ID NO: 3702520 - RNA, 17 nt, Human
ugagcccacaaagccuu

SEQ ID NO: 3702521 - RNA, 23 nt, Human
ugagcccacugcccacccccuca

SEQ ID NO: 3702522 - RNA, 12 nt, Human
ugagcccacugu

SEQ ID NO: 3702523 - RNA, 13 nt, Human
ugagcccagagaa

SEQ ID NO: 3702524 - RNA, 16 nt, Human
ugagcccagagaacag

SEQ ID NO: 3702525 - RNA, 17 nt, Human
ugagcccagagaacagc

SEQ ID NO: 3702526 - RNA, 17 nt, Human
ugagcccagcuggguca

SEQ ID NO: 3702527 - RNA, 12 nt, Human
ugagcccaggag

SEQ ID NO: 3702528 - RNA, 17 nt, Human
ugagcccagggaggccg

SEQ ID NO: 3702529 - RNA, 17 nt, Human
ugagcccauggcccucc

SEQ ID NO: 3702530 - RNA, 21 nt, Human
ugagcccauguggagucagcc

SEQ ID NO: 3702531 - RNA, 22 nt, Human
ugagcccauguucugcccccag

SEQ ID NO: 3702532 - RNA, 18 nt, Human
ugagccccagggugccca

SEQ ID NO: 3702533 - RNA, 20 nt, Human
ugagccccagggugcccaga

SEQ ID NO: 3702534 - RNA, 12 nt, Human
ugagccccaucu

SEQ ID NO: 3702535 - RNA, 14 nt, Human
ugagccccaucuuc

SEQ ID NO: 3702536 - RNA, 15 nt, Human
ugagcccccagcuuc

SEQ ID NO: 3702537 - RNA, 22 nt, Human
ugagcccccccaacacugugcc

SEQ ID NO: 3702538 - RNA, 16 nt, Human
ugagccccgcagaccu

SEQ ID NO: 3702539 - RNA, 17 nt, Human
ugagccccgcagaccuc

SEQ ID NO: 3702540 - RNA, 19 nt, Human
ugagccccuaccccacacc

SEQ ID NO: 3702541 - RNA, 21 nt, Human
ugagccccuaccccacaccag

SEQ ID NO: 3702542 - RNA, 15 nt, Human
ugagccccugguccu

SEQ ID NO: 3702543 - RNA, 17 nt, Human
ugagccccugucuagag

SEQ ID NO: 3702544 - RNA, 21 nt, Human
ugagccccugucuagagaggg

SEQ ID NO: 3702545 - RNA, 19 nt, Human
ugagcccgggcugccuggg

SEQ ID NO: 3702546 - RNA, 19 nt, Human
ugagcccuacucccugcag

SEQ ID NO: 3702547 - RNA, 23 nt, Human
ugagcccuacucccugcagaugc

SEQ ID NO: 3702548 - RNA, 16 nt, Human
ugagcccucaaaguga

SEQ ID NO: 3702549 - RNA, 21 nt, Human
ugcaggggauugaagcccucc

SEQ ID NO: 3702550 - RNA, 18 nt, Human
ugcaggggcucuggagag

SEQ ID NO: 3702551 - RNA, 21 nt, Human
ugcaggggcucuggagagaaa

SEQ ID NO: 3702552 - RNA, 16 nt, Human
ugcagggggcuccugg

SEQ ID NO: 3702553 - RNA, 19 nt, Human
ugcagggggugugucugcu

SEQ ID NO: 3702554 - RNA, 14 nt, Human
ugcaggggugacgg

SEQ ID NO: 3702555 - RNA, 15 nt, Human
ugcaggguccucuuc

SEQ ID NO: 3702556 - RNA, 22 nt, Human
ugcaggguccucuucugggccu

SEQ ID NO: 3702557 - RNA, 20 nt, Human
ugcaggguggugcugggacu

SEQ ID NO: 3702558 - RNA, 23 nt, Human
ugcaggguucucccucccaccuu

SEQ ID NO: 3702559 - RNA, 22 nt, Human
ugcagguagaccugucuccugg

SEQ ID NO: 3702560 - RNA, 16 nt, Human
ugcaggucccuaauaa

SEQ ID NO: 3702561 - RNA, 23 nt, Human
ugcaggugagcccauggcccucc

SEQ ID NO: 3702562 - RNA, 13 nt, Human
ugcagguggggag

SEQ ID NO: 3702563 - RNA, 21 nt, Human
ugcagguggugucgggcccuu

SEQ ID NO: 3702564 - RNA, 16 nt, Human
ugcagguuggacccca

SEQ ID NO: 3702565 - RNA, 15 nt, Human
ugcaguaaaucuuuu

SEQ ID NO: 3702566 - RNA, 16 nt, Human
ugcaguaacuguuuuu

SEQ ID NO: 3702567 - RNA, 21 nt, Human
ugcaguaacuguuuuuuaagu

SEQ ID NO: 3702568 - RNA, 16 nt, Human
ugcaguacaggacaua

SEQ ID NO: 3702569 - RNA, 22 nt, Human
ugcaguagagucaucuccauca

SEQ ID NO: 3702570 - RNA, 15 nt, Human
ugcaguagucucugu

SEQ ID NO: 3702571 - RNA, 16 nt, Human
ugcaguaucugugaac

SEQ ID NO: 3702572 - RNA, 15 nt, Human
ugcaguaugaaaaua

SEQ ID NO: 3702573 - RNA, 17 nt, Human
ugcaguauugagcacug

SEQ ID NO: 3702574 - RNA, 19 nt, Human
ugcagucacguggaggagc

SEQ ID NO: 3702575 - RNA, 14 nt, Human
ugcagucacuggag

SEQ ID NO: 3702576 - RNA, 13 nt, Human
ugcagucaucuug

SEQ ID NO: 3702577 - RNA, 21 nt, Human
ugcagucccaagcggugucuc

SEQ ID NO: 3702578 - RNA, 23 nt, Human
ugcagucccaagcggugucucuc

SEQ ID NO: 3702579 - RNA, 22 nt, Human
ugcaguccugaucagagccgug

SEQ ID NO: 3702580 - RNA, 15 nt, Human
ugcagucuccucuuu

SEQ ID NO: 3702581 - RNA, 17 nt, Human
ugcagucuccucuuuaa

SEQ ID NO: 3702582 - RNA, 19 nt, Human
ugcagucucuauaccaaua

SEQ ID NO: 3702583 - RNA, 14 nt, Human
ugcagucugcuucu

SEQ ID NO: 3702584 - RNA, 14 nt, Human
ugcagucuggcuga

SEQ ID NO: 3702585 - RNA, 20 nt, Human
ugcagucuggcugagcccug

SEQ ID NO: 3702586 - RNA, 13 nt, Human
ugcagucugggug

SEQ ID NO: 3702587 - RNA, 19 nt, Human
ugcagugaacuuccagaca

SEQ ID NO: 3702588 - RNA, 13 nt, Human
ugcagugaauugu

SEQ ID NO: 3702589 - RNA, 18 nt, Human
ugcagugacgugcaccug

SEQ ID NO: 3702590 - RNA, 19 nt, Human
ugcagugacgugcaccugu

SEQ ID NO: 3702591 - RNA, 22 nt, Human
ugcagugacgugcaccuguacu

SEQ ID NO: 3702592 - RNA, 17 nt, Human
ugcagugauauggcaga

SEQ ID NO: 3702593 - RNA, 23 nt, Human
ugcagugauauggcagaagacac

SEQ ID NO: 3702594 - RNA, 23 nt, Human
ugcagugccuuggggaauuuccu

SEQ ID NO: 3702595 - RNA, 21 nt, Human
ugcagugcucgcuguugcuga

SEQ ID NO: 3702596 - RNA, 23 nt, Human
ugcagugcucgcuguugcugaau

SEQ ID NO: 3702597 - RNA, 13 nt, Human
ugcagugcugcuu

SEQ ID NO: 3702598 - RNA, 19 nt, Human
ugcagugguauuaauuuug

SEQ ID NO: 3702599 - RNA, 15 nt, Human
ugcaguguagauuuu

SEQ ID NO: 3702600 - RNA, 16 nt, Human
ugcaguguucgcuugg

SEQ ID NO: 3702601 - RNA, 17 nt, Human
ugcaguguucgcuuggc

SEQ ID NO: 3702602 - RNA, 23 nt, Human
ugcaguuacaaauuauaauguau

SEQ ID NO: 3702603 - RNA, 14 nt, Human
ugcaguuauuugcu

SEQ ID NO: 3702604 - RNA, 13 nt, Human
ugcaguucccauc

SEQ ID NO: 3702605 - RNA, 20 nt, Human
ugcaguucccccaaccucag

SEQ ID NO: 3702606 - RNA, 21 nt, Human
ugcaguucccccaaccucaga

SEQ ID NO: 3702607 - RNA, 18 nt, Human
ugcaguucuaguuugcau

SEQ ID NO: 3702608 - RNA, 22 nt, Human
ugcaguucugaagaagauggua

SEQ ID NO: 3702609 - RNA, 16 nt, Human
ugcaguucuugaguug

SEQ ID NO: 3702610 - RNA, 15 nt, Human
ugcaguugccaguca

SEQ ID NO: 3702611 - RNA, 12 nt, Human
ugcaguuuauca

SEQ ID NO: 3702612 - RNA, 17 nt, Human
ugcaguuuaucauucaa

SEQ ID NO: 3702613 - RNA, 19 nt, Human
ugcaguuuaucauucaagu

SEQ ID NO: 3702614 - RNA, 11 nt, Human
ugcaguuugaa

SEQ ID NO: 3702615 - RNA, 15 nt, Human
ugcaguuugaaauuc

SEQ ID NO: 3702616 - RNA, 19 nt, Human
ugcaguuugagacaggaga

SEQ ID NO: 3702617 - RNA, 12 nt, Human
ugcaguuuuccu

SEQ ID NO: 3702618 - RNA, 16 nt, Human
ugcaguuuuucagagu

SEQ ID NO: 3702619 - RNA, 17 nt, Human
ugcauaaaauuggauua

SEQ ID NO: 3702620 - RNA, 15 nt, Human
ugcauaaauaugcag

SEQ ID NO: 3702621 - RNA, 18 nt, Human
ugcauaagguuuuuaugc

SEQ ID NO: 3702622 - RNA, 14 nt, Human
ugcauaagugaaaa

SEQ ID NO: 3702623 - RNA, 22 nt, Human
ugcauaagugaaaaucuuacaa

SEQ ID NO: 3702624 - RNA, 17 nt, Human
ugcauaaguuaacuucc

SEQ ID NO: 3702625 - RNA, 17 nt, Human
ugcauaauguuucugga

SEQ ID NO: 3702626 - RNA, 21 nt, Human
ugcauaccacuuuuguucuug

SEQ ID NO: 3702627 - RNA, 22 nt, Human
ugcauacuuaccuagugaaacu

SEQ ID NO: 3702628 - RNA, 18 nt, Human
ugcauacuucaaaaguau

SEQ ID NO: 3702629 - RNA, 13 nt, Human
ugcauacuuugua

SEQ ID NO: 3702630 - RNA, 20 nt, Human
ugcauacuuuguauuuugau

SEQ ID NO: 3702631 - RNA, 17 nt, Human
ugcauagaacuggguaa

SEQ ID NO: 3702632 - RNA, 22 nt, Human
ugcauagaacuggguaaaugca

SEQ ID NO: 3702633 - RNA, 17 nt, Human
ugcauagaaggaggaga

SEQ ID NO: 3702634 - RNA, 19 nt, Human
ugcauagagccacguaugu

SEQ ID NO: 3702635 - RNA, 15 nt, Human
ugcauagcaguauau

SEQ ID NO: 3702636 - RNA, 16 nt, Human
ugcauagcaguauaug

SEQ ID NO: 3702637 - RNA, 20 nt, Human
ugcauagguuagauauagag

SEQ ID NO: 3702638 - RNA, 21 nt, Human
ugcauaguaccaaucauuuua

SEQ ID NO: 3702639 - RNA, 21 nt, Human
ugcauaguauuccauugugug

SEQ ID NO: 3702640 - RNA, 18 nt, Human
ugcauaguuguagacaaa

SEQ ID NO: 3702641 - RNA, 21 nt, Human
ugcauaguuguagacaaagua

SEQ ID NO: 3702642 - RNA, 13 nt, Human
ugcauaguuucuu

SEQ ID NO: 3702643 - RNA, 18 nt, Human
ugcauauaacuuauauug

SEQ ID NO: 3702644 - RNA, 21 nt, Human
ugcauauaacuuauauuguaa

SEQ ID NO: 3702645 - RNA, 17 nt, Human
ugcauauauacauauau

SEQ ID NO: 3702646 - RNA, 17 nt, Human
ugcauauauauaugugu

SEQ ID NO: 3702647 - RNA, 15 nt, Human
ugcauauguaugacu

SEQ ID NO: 3702648 - RNA, 19 nt, Human
ugcauaugucacuagaaug

SEQ ID NO: 3702649 - RNA, 19 nt, Human
ugcauauguugaauacuuu

SEQ ID NO: 3702650 - RNA, 16 nt, Human
ugcauauuauaaagga

SEQ ID NO: 3702651 - RNA, 18 nt, Human
ugcauauuauuuuauguu

SEQ ID NO: 3702652 - RNA, 13 nt, Human
ugcauauuccuuu

SEQ ID NO: 3702653 - RNA, 22 nt, Human
ugcauauuccuuucuaucauuu

SEQ ID NO: 3702654 - RNA, 13 nt, Human
ugcauauuguaca

SEQ ID NO: 3702655 - RNA, 15 nt, Human
ugcauauuguauuac

SEQ ID NO: 3702656 - RNA, 16 nt, Human
ugcauauuguauuacu

SEQ ID NO: 3702657 - RNA, 15 nt, Human
ugcauauuuguuuau

SEQ ID NO: 3702658 - RNA, 19 nt, Human
ugcaucaagaugugacaug

SEQ ID NO: 3702659 - RNA, 20 nt, Human
ugcaucaauccugugugguu

SEQ ID NO: 3702660 - RNA, 16 nt, Human
ugcaucaccucuguaa

SEQ ID NO: 3702661 - RNA, 13 nt, Human
ugcaucagaaagc

SEQ ID NO: 3702662 - RNA, 17 nt, Human
ugcaucagaaagggagg

SEQ ID NO: 3702663 - RNA, 21 nt, Human
ugcaucagaaagggagggcuc

SEQ ID NO: 3702664 - RNA, 14 nt, Human
ugcaucagaaaugu

SEQ ID NO: 3702665 - RNA, 19 nt, Human
ugcaucagcugcugaaaca

SEQ ID NO: 3702666 - RNA, 13 nt, Human
ugcauccaacucc

SEQ ID NO: 3702667 - RNA, 14 nt, Human
ugcauccagaggca

SEQ ID NO: 3702668 - RNA, 22 nt, Human
ugcaucccaaaccacgccucuu

SEQ ID NO: 3702669 - RNA, 19 nt, Human
ugcaucccagcaccugccu

SEQ ID NO: 3702670 - RNA, 14 nt, Human
ugcaucccugagac

SEQ ID NO: 3702671 - RNA, 16 nt, Human
ugcauccgugagcagu

SEQ ID NO: 3702672 - RNA, 23 nt, Human
ugcauccgugagcagugugucuc

SEQ ID NO: 3702673 - RNA, 13 nt, Human
ugcauccuuccua

SEQ ID NO: 3702674 - RNA, 18 nt, Human
ugcauccuuccuauaacu

SEQ ID NO: 3702675 - RNA, 14 nt, Human
ugcaucguggagac

SEQ ID NO: 3702676 - RNA, 15 nt, Human
ugcaucuaagcccau

SEQ ID NO: 3702677 - RNA, 16 nt, Human
ugcaucuaagcccaug

SEQ ID NO: 3702678 - RNA, 14 nt, Human
ugcaucuacuccca

SEQ ID NO: 3702679 - RNA, 18 nt, Human
ugcaucuagccucaagcu

SEQ ID NO: 3702680 - RNA, 21 nt, Human
ugcaucucacuggaugcaaag

SEQ ID NO: 3702681 - RNA, 13 nt, Human
ugcaucucagccc

SEQ ID NO: 3702682 - RNA, 15 nt, Human
ugcaucucagcccac

SEQ ID NO: 3702683 - RNA, 13 nt, Human
ugcaucucccaga

SEQ ID NO: 3702684 - RNA, 17 nt, Human
ugcaucugaccagcagc

SEQ ID NO: 3702685 - RNA, 23 nt, Human
ugcaucugggauucccaccaagg

SEQ ID NO: 3702686 - RNA, 20 nt, Human
ugcaucuggguagcuguaag

SEQ ID NO: 3702687 - RNA, 18 nt, Human
ugcaucuuacugaaggua

SEQ ID NO: 3702688 - RNA, 18 nt, Human
ugcaucuuuuuuucauuu

SEQ ID NO: 3702689 - RNA, 18 nt, Human
ugcaugaagagaagcaau

SEQ ID NO: 3702690 - RNA, 21 nt, Human
ugcaugaagagaagcaauuuu

SEQ ID NO: 3702691 - RNA, 18 nt, Human
ugcaugaagguuucugaa

SEQ ID NO: 3702692 - RNA, 22 nt, Human
ugcaugaaguaauaugcacaca

SEQ ID NO: 3702693 - RNA, 15 nt, Human
ugcaugacagccucu

SEQ ID NO: 3702694 - RNA, 15 nt, Human
ugcaugacuuguagc

SEQ ID NO: 3702695 - RNA, 21 nt, Human
ugcaugagcuacgccugccuc

SEQ ID NO: 3702696 - RNA, 14 nt, Human
ugcaugauguauuu

SEQ ID NO: 3702697 - RNA, 22 nt, Human
ugcaugcacuguucccccugug

SEQ ID NO: 3702698 - RNA, 13 nt, Human
guacagugucuuu

SEQ ID NO: 3702699 - RNA, 14 nt, Human
guacagugucuuuu

SEQ ID NO: 3702700 - RNA, 21 nt, Human
guacaguuauuuaugccucug

SEQ ID NO: 3702701 - RNA, 16 nt, Human
guacaguucaguuccu

SEQ ID NO: 3702702 - RNA, 19 nt, Human
guacaguucaguuccucuu

SEQ ID NO: 3702703 - RNA, 22 nt, Human
guacaguucuucgggaagagag

SEQ ID NO: 3702704 - RNA, 13 nt, Human
guacaguuuuuau

SEQ ID NO: 3702705 - RNA, 23 nt, Human
guacauaaaggugguaugugugu

SEQ ID NO: 3702706 - RNA, 16 nt, Human
guacauaacucuguaa

SEQ ID NO: 3702707 - RNA, 19 nt, Human
guacauaauacugaaccac

SEQ ID NO: 3702708 - RNA, 22 nt, Human
guacauaaugcuuaauuucuaa

SEQ ID NO: 3702709 - RNA, 22 nt, Human
guacauacccuggccgcccccu

SEQ ID NO: 3702710 - RNA, 19 nt, Human
guacauacuuuuuggguuu

SEQ ID NO: 3702711 - RNA, 12 nt, Human
guacauagccua

SEQ ID NO: 3702712 - RNA, 15 nt, Human
guacauagccuauau

SEQ ID NO: 3702713 - RNA, 16 nt, Human
guacauaugugcugga

SEQ ID NO: 3702714 - RNA, 17 nt, Human
guacauauuuauuuucu

SEQ ID NO: 3702715 - RNA, 13 nt, Human
guacaucuggcuu

SEQ ID NO: 3702716 - RNA, 20 nt, Human
guacaucuggcuuauuuuaa

SEQ ID NO: 3702717 - RNA, 21 nt, Human
guacaucuggcuuauuuuaau

SEQ ID NO: 3702718 - RNA, 14 nt, Human
guacaugaaaacac

SEQ ID NO: 3702719 - RNA, 16 nt, Human
guacaugaaaacacau

SEQ ID NO: 3702720 - RNA, 17 nt, Human
guacaugaaaacacauu

SEQ ID NO: 3702721 - RNA, 19 nt, Human
guacaugaaaacacauuuu

SEQ ID NO: 3702722 - RNA, 14 nt, Human
guacaugaaaguag

SEQ ID NO: 3702723 - RNA, 19 nt, Human
guacauggaauaacaugua

SEQ ID NO: 3702724 - RNA, 17 nt, Human
guacauucaauguuuau

SEQ ID NO: 3702725 - RNA, 17 nt, Human
guacauugaaggccugg

SEQ ID NO: 3702726 - RNA, 14 nt, Human
guacauuuaaaauu

SEQ ID NO: 3702727 - RNA, 16 nt, Human
guacauuuaauugaga

SEQ ID NO: 3702728 - RNA, 17 nt, Human
guacauuuaauugagaa

SEQ ID NO: 3702729 - RNA, 23 nt, Human
guacauuuaauugagaagcguau

SEQ ID NO: 3702730 - RNA, 12 nt, Human
guacauuuauaa

SEQ ID NO: 3702731 - RNA, 14 nt, Human
guacauuuauaauu

SEQ ID NO: 3702732 - RNA, 16 nt, Human
guacauuuaugauuua

SEQ ID NO: 3702733 - RNA, 22 nt, Human
guacauuuaugauuuaauaaaa

SEQ ID NO: 3702734 - RNA, 16 nt, Human
guacauuucccugugc

SEQ ID NO: 3702735 - RNA, 18 nt, Human
guacauuucccugugcug

SEQ ID NO: 3702736 - RNA, 14 nt, Human
guacauuucuauaa

SEQ ID NO: 3702737 - RNA, 21 nt, Human
guacauuucuauaaauagaug

SEQ ID NO: 3702738 - RNA, 13 nt, Human
guacauuucugaa

SEQ ID NO: 3702739 - RNA, 17 nt, Human
guacauuuuguuguaaa

SEQ ID NO: 3702740 - RNA, 23 nt, Human
guacauuuuucaacuuugaauaa

SEQ ID NO: 3702741 - RNA, 14 nt, Human
guacauuuuuugaa

SEQ ID NO: 3702742 - RNA, 19 nt, Human
guaccaaaauuuuaaaaaa

SEQ ID NO: 3702743 - RNA, 18 nt, Human
guaccaaaugcuuuaaaa

SEQ ID NO: 3702744 - RNA, 21 nt, Human
guaccaagaaucuugguuugc

SEQ ID NO: 3702745 - RNA, 13 nt, Human
guaccaagugaaa

SEQ ID NO: 3702746 - RNA, 22 nt, Human
guaccaaugcagaacucccaag

SEQ ID NO: 3702747 - RNA, 18 nt, Human
guaccacugaaucuguac

SEQ ID NO: 3702748 - RNA, 15 nt, Human
guaccagauaacuuu

SEQ ID NO: 3702749 - RNA, 17 nt, Human
guaccagauaacuuuuu

SEQ ID NO: 3702750 - RNA, 21 nt, Human
guaccagcgcucuaaaagcac

SEQ ID NO: 3702751 - RNA, 21 nt, Human
guaccagugaauuuuugcaau

SEQ ID NO: 3702752 - RNA, 20 nt, Human
guaccaguuaauuuuuccaa

SEQ ID NO: 3702753 - RNA, 21 nt, Human
guaccaguucuuuaagaagau

SEQ ID NO: 3702754 - RNA, 20 nt, Human
guaccauagcgcugcucuua

SEQ ID NO: 3702755 - RNA, 20 nt, Human
guaccaugaaacaaagcugc

SEQ ID NO: 3702756 - RNA, 15 nt, Human
guaccauuaaaauau

SEQ ID NO: 3702757 - RNA, 15 nt, Human
guacccaccugagcu

SEQ ID NO: 3702758 - RNA, 17 nt, Human
guacccaccugagcuuu

SEQ ID NO: 3702759 - RNA, 12 nt, Human
guacccacugcu

SEQ ID NO: 3702760 - RNA, 12 nt, Human
guacccagccau

SEQ ID NO: 3702761 - RNA, 18 nt, Human
guacccagccaucugccc

SEQ ID NO: 3702762 - RNA, 12 nt, Human
guaccccacccu

SEQ ID NO: 3702763 - RNA, 23 nt, Human
guaccccacccucagcaccccuu

SEQ ID NO: 3702764 - RNA, 21 nt, Human
guaccccccaaccccugagga

SEQ ID NO: 3702765 - RNA, 17 nt, Human
guacccccgcccaggcu

SEQ ID NO: 3702766 - RNA, 18 nt, Human
guacccccgcccaggcug

SEQ ID NO: 3702767 - RNA, 14 nt, Human
guacccccuucugg

SEQ ID NO: 3702768 - RNA, 15 nt, Human
guacccccuucuggg

SEQ ID NO: 3702769 - RNA, 18 nt, Human
guacccucucagcuccag

SEQ ID NO: 3702770 - RNA, 18 nt, Human
guaccgcgucuacccugg

SEQ ID NO: 3702771 - RNA, 20 nt, Human
guaccgcgucuacccuggga

SEQ ID NO: 3702772 - RNA, 17 nt, Human
guaccuccccugccuug

SEQ ID NO: 3702773 - RNA, 15 nt, Human
guaccugggcaagcu

SEQ ID NO: 3702774 - RNA, 16 nt, Human
guaccugggcaagcug

SEQ ID NO: 3702775 - RNA, 15 nt, Human
guaccuggggccaaa

SEQ ID NO: 3702776 - RNA, 19 nt, Human
guaccuucagauccuaccc

SEQ ID NO: 3702777 - RNA, 20 nt, Human
guaccuugaccuuuguacag

SEQ ID NO: 3702778 - RNA, 23 nt, Human
guaccuugcacacaucaucugua

SEQ ID NO: 3702779 - RNA, 11 nt, Human
guaccuugcuu

SEQ ID NO: 3702780 - RNA, 13 nt, Human
guaccuugcuucu

SEQ ID NO: 3702781 - RNA, 21 nt, Human
guaccuuuugaggagccccag

SEQ ID NO: 3702782 - RNA, 23 nt, Human
guaccuuuugaggagccccagcu

SEQ ID NO: 3702783 - RNA, 22 nt, Human
guaccuuuuuuguuuuuucaaa

SEQ ID NO: 3702784 - RNA, 13 nt, Human
guacgcacagaca

SEQ ID NO: 3702785 - RNA, 15 nt, Human
guacgcacagacagg

SEQ ID NO: 3702786 - RNA, 17 nt, Human
guacgucugacaggcaa

SEQ ID NO: 3702787 - RNA, 13 nt, Human
guacgugacccuc

SEQ ID NO: 3702788 - RNA, 14 nt, Human
guacguugugcauu

SEQ ID NO: 3702789 - RNA, 15 nt, Human
guacguugugcauuu

SEQ ID NO: 3702790 - RNA, 13 nt, Human
guacuaaauuuaa

SEQ ID NO: 3702791 - RNA, 17 nt, Human
guacuaaauuuaaauuu

SEQ ID NO: 3702792 - RNA, 20 nt, Human
guacuacuagaugucuuuag

SEQ ID NO: 3702793 - RNA, 21 nt, Human
guacuacuagaugucuuuagg

SEQ ID NO: 3702794 - RNA, 14 nt, Human
guacuagagauauu

SEQ ID NO: 3702795 - RNA, 22 nt, Human
guacuagagaucugguuuugcu

SEQ ID NO: 3702796 - RNA, 22 nt, Human
guacuagggggaagugacaagg

SEQ ID NO: 3702797 - RNA, 16 nt, Human
guacuaguacugugua

SEQ ID NO: 3702798 - RNA, 20 nt, Human
guacuaguggcauggagaau

SEQ ID NO: 3702799 - RNA, 14 nt, Human
guacuaguguucug

SEQ ID NO: 3702800 - RNA, 15 nt, Human
guacuaguguucugu

SEQ ID NO: 3702801 - RNA, 13 nt, Human
guacuauaucugu

SEQ ID NO: 3702802 - RNA, 16 nt, Human
guacuauaucuguuuu

SEQ ID NO: 3702803 - RNA, 13 nt, Human
guacuauguauca

SEQ ID NO: 3702804 - RNA, 15 nt, Human
guacuauguaucaau

SEQ ID NO: 3702805 - RNA, 18 nt, Human
guacuauuuaacugacua

SEQ ID NO: 3702806 - RNA, 15 nt, Human
guacucaaauguagc

SEQ ID NO: 3702807 - RNA, 20 nt, Human
guacucacugaagccugcgu

SEQ ID NO: 3702808 - RNA, 19 nt, Human
guacuccacacugcacaau

SEQ ID NO: 3702809 - RNA, 15 nt, Human
guacucccucucagg

SEQ ID NO: 3702810 - RNA, 21 nt, Human
guacuccugcaaaauuuuaua

SEQ ID NO: 3702811 - RNA, 17 nt, Human
guacucgcuugugcaga

SEQ ID NO: 3702812 - RNA, 21 nt, Human
guacucugccacuuuauuucu

SEQ ID NO: 3702813 - RNA, 14 nt, Human
guacucuuccgaaa

SEQ ID NO: 3702814 - RNA, 14 nt, Human
guacugaaagccuu

SEQ ID NO: 3702815 - RNA, 23 nt, Human
guacugaaagccuuagggaagcu

SEQ ID NO: 3702816 - RNA, 16 nt, Human
guacugauuuuuguaa

SEQ ID NO: 3702817 - RNA, 11 nt, Human
guacugccugc

SEQ ID NO: 3702818 - RNA, 13 nt, Human
guacugccugcuu

SEQ ID NO: 3702819 - RNA, 12 nt, Human
guacuggggguu

SEQ ID NO: 3702820 - RNA, 19 nt, Human
guacugguaagauuguuau

SEQ ID NO: 3702821 - RNA, 12 nt, Human
guacuguaauaa

SEQ ID NO: 3702822 - RNA, 17 nt, Human
guacugucugauuggcu

SEQ ID NO: 3702823 - RNA, 18 nt, Human
guacugucugauuggcuu

SEQ ID NO: 3702824 - RNA, 11 nt, Human
guacugugaau

SEQ ID NO: 3702825 - RNA, 17 nt, Human
guacuguucugugucuu

SEQ ID NO: 3702826 - RNA, 13 nt, Human
guacuguuuacca

SEQ ID NO: 3702827 - RNA, 20 nt, Human
guacuguuuaccauuuuuca

SEQ ID NO: 3702828 - RNA, 17 nt, Human
guacuuaaaugaaagca

SEQ ID NO: 3702829 - RNA, 23 nt, Human
guacuuaaaugguaauaagcacu

SEQ ID NO: 3702830 - RNA, 16 nt, Human
guacuuauuacugcua

SEQ ID NO: 3702831 - RNA, 18 nt, Human
guacuuauuacugcuaag

SEQ ID NO: 3702832 - RNA, 15 nt, Human
guacuucacugucag

SEQ ID NO: 3702833 - RNA, 14 nt, Human
guacuucagcaaga

SEQ ID NO: 3702834 - RNA, 18 nt, Human
guacuucaggggcacuuc

SEQ ID NO: 3702835 - RNA, 21 nt, Human
guacuucccgggccagggcug

SEQ ID NO: 3702836 - RNA, 14 nt, Human
guacuucuccaccc

SEQ ID NO: 3702837 - RNA, 18 nt, Human
guacuucuccacccugcu

SEQ ID NO: 3702838 - RNA, 19 nt, Human
guacuucuccacccugcuc

SEQ ID NO: 3702839 - RNA, 20 nt, Human
guacuucuccacccugcucu

SEQ ID NO: 3702840 - RNA, 20 nt, Human
guacuucuugaauauaaaaa

SEQ ID NO: 3702841 - RNA, 23 nt, Human
guacuugaagucuaaaagcagaa

SEQ ID NO: 3702842 - RNA, 18 nt, Human
guacuugaguguaauguu

SEQ ID NO: 3702843 - RNA, 23 nt, Human
guacuugccagaaguuguggauu

SEQ ID NO: 3702844 - RNA, 22 nt, Human
guacuugccuuauuagaguguc

SEQ ID NO: 3702845 - RNA, 18 nt, Human
guacuugcugcuauuuua

SEQ ID NO: 3702846 - RNA, 15 nt, Human
guacuugguccaacu

SEQ ID NO: 3702847 - RNA, 17 nt, Human
guacuugucaaagaagg

SEQ ID NO: 3702848 - RNA, 22 nt, Human
ugcaugcagccacugugcugaa

SEQ ID NO: 3702849 - RNA, 18 nt, Human
ugcaugcccagagaccca

SEQ ID NO: 3702850 - RNA, 16 nt, Human
ugcaugcucucugcag

SEQ ID NO: 3702851 - RNA, 15 nt, Human
ugcaugcuuuccaua

SEQ ID NO: 3702852 - RNA, 18 nt, Human
ugcaugcuuuccauauuu

SEQ ID NO: 3702853 - RNA, 12 nt, Human
ugcauggaaauc

SEQ ID NO: 3702854 - RNA, 17 nt, Human
ugcauggaaaucagcca

SEQ ID NO: 3702855 - RNA, 22 nt, Human
ugcauggaaaucagccaaguuu

SEQ ID NO: 3702856 - RNA, 23 nt, Human
ugcauggacaccccuuauccagg

SEQ ID NO: 3702857 - RNA, 13 nt, Human
ugcauggagcagg

SEQ ID NO: 3702858 - RNA, 16 nt, Human
ugcauggaggcccucc

SEQ ID NO: 3702859 - RNA, 14 nt, Human
ugcauggauuucuu

SEQ ID NO: 3702860 - RNA, 20 nt, Human
ugcauggauuucuuugaaaa

SEQ ID NO: 3702861 - RNA, 15 nt, Human
ugcauggcagcaggc

SEQ ID NO: 3702862 - RNA, 20 nt, Human
ugcauggcagggggcugcug

SEQ ID NO: 3702863 - RNA, 21 nt, Human
ugcauggcagggggcugcugc

SEQ ID NO: 3702864 - RNA, 23 nt, Human
ugcauggcagggggcugcugcug

SEQ ID NO: 3702865 - RNA, 20 nt, Human
ugcauggcauccuccagccc

SEQ ID NO: 3702866 - RNA, 22 nt, Human
ugcauggcuccagaaaugucua

SEQ ID NO: 3702867 - RNA, 21 nt, Human
ugcaugggccagccccuccau

SEQ ID NO: 3702868 - RNA, 16 nt, Human
ugcaugggugaaggga

SEQ ID NO: 3702869 - RNA, 18 nt, Human
ugcauggguuuuguaggu

SEQ ID NO: 3702870 - RNA, 19 nt, Human
ugcauggguuuuguaggua

SEQ ID NO: 3702871 - RNA, 16 nt, Human
ugcaugguaauuuaua

SEQ ID NO: 3702872 - RNA, 19 nt, Human
ugcaugguaauuuauaguu

SEQ ID NO: 3702873 - RNA, 19 nt, Human
ugcauggugccccaggacc

SEQ ID NO: 3702874 - RNA, 20 nt, Human
ugcauggugccccaggacca

SEQ ID NO: 3702875 - RNA, 15 nt, Human
ugcaugguuucagca

SEQ ID NO: 3702876 - RNA, 16 nt, Human
ugcaugguuucagcac

SEQ ID NO: 3702877 - RNA, 15 nt, Human
ugcauguacuaucuu

SEQ ID NO: 3702878 - RNA, 14 nt, Human
ugcauguaguaaca

SEQ ID NO: 3702879 - RNA, 15 nt, Human
ugcauguauaaauga

SEQ ID NO: 3702880 - RNA, 17 nt, Human
ugcauguauaaaugaag

SEQ ID NO: 3702881 - RNA, 14 nt, Human
ugcauguaugucuu

SEQ ID NO: 3702882 - RNA, 16 nt, Human
ugcauguccuguaaag

SEQ ID NO: 3702883 - RNA, 13 nt, Human
ugcaugugacucu

SEQ ID NO: 3702884 - RNA, 14 nt, Human
ugcaugugacucug

SEQ ID NO: 3702885 - RNA, 15 nt, Human
ugcaugugacucuga

SEQ ID NO: 3702886 - RNA, 16 nt, Human
ugcaugugucuuuaua

SEQ ID NO: 3702887 - RNA, 11 nt, Human
ugcaugugugu

SEQ ID NO: 3702888 - RNA, 14 nt, Human
ugcaugugugugug

SEQ ID NO: 3702889 - RNA, 16 nt, Human
ugcauguuccacuaac

SEQ ID NO: 3702890 - RNA, 15 nt, Human
ugcauguuugugauu

SEQ ID NO: 3702891 - RNA, 16 nt, Human
ugcauuaaauucacaa

SEQ ID NO: 3702892 - RNA, 19 nt, Human
ugcauuaaauucacaaacu

SEQ ID NO: 3702893 - RNA, 22 nt, Human
ugcauuaccgcguuguaaaaua

SEQ ID NO: 3702894 - RNA, 14 nt, Human
ugcauuagaaauua

SEQ ID NO: 3702895 - RNA, 18 nt, Human
ugcauuagcacagauuuu

SEQ ID NO: 3702896 - RNA, 19 nt, Human
ugcauuagggaugccuccu

SEQ ID NO: 3702897 - RNA, 14 nt, Human
ugcauuauauuuau

SEQ ID NO: 3702898 - RNA, 15 nt, Human
ugcauuauauuuauu

SEQ ID NO: 3702899 - RNA, 13 nt, Human
ugcauuaugcaau

SEQ ID NO: 3702900 - RNA, 17 nt, Human
ugcauuauuaaauugua

SEQ ID NO: 3702901 - RNA, 15 nt, Human
ugcauuauuugagaa

SEQ ID NO: 3702902 - RNA, 16 nt, Human
ugcauuauuugagaag

SEQ ID NO: 3702903 - RNA, 12 nt, Human
ugcauucaaauu

SEQ ID NO: 3702904 - RNA, 14 nt, Human
ugcauucacccaga

SEQ ID NO: 3702905 - RNA, 16 nt, Human
ugcauucacccagaca

SEQ ID NO: 3702906 - RNA, 11 nt, Human
ugcauucauuu

SEQ ID NO: 3702907 - RNA, 23 nt, Human
ugcauuccugauaugauuuaaaa

SEQ ID NO: 3702908 - RNA, 20 nt, Human
ugcauuccuuugucuucaaa

SEQ ID NO: 3702909 - RNA, 12 nt, Human
ugcauucuagua

SEQ ID NO: 3702910 - RNA, 13 nt, Human
ugcauucuauugc

SEQ ID NO: 3702911 - RNA, 19 nt, Human
ugcauucuauugccuucuu

SEQ ID NO: 3702912 - RNA, 21 nt, Human
ugcauucucccuccuucccuu

SEQ ID NO: 3702913 - RNA, 21 nt, Human
ugcauucugccgugugcccuc

SEQ ID NO: 3702914 - RNA, 16 nt, Human
ugcauucuggauuuua

SEQ ID NO: 3702915 - RNA, 15 nt, Human
ugcauucuuauucau

SEQ ID NO: 3702916 - RNA, 20 nt, Human
ugcauucuucugagcacugu

SEQ ID NO: 3702917 - RNA, 15 nt, Human
ugcauucuucugauc

SEQ ID NO: 3702918 - RNA, 20 nt, Human
ugcauucuugguuggcuggc

SEQ ID NO: 3702919 - RNA, 16 nt, Human
ugcauucuuuuaaaag

SEQ ID NO: 3702920 - RNA, 17 nt, Human
ugcauugaacacaaacu

SEQ ID NO: 3702921 - RNA, 19 nt, Human
ugcauugaacacaaacugu

SEQ ID NO: 3702922 - RNA, 13 nt, Human
ugcauugaauaua

SEQ ID NO: 3702923 - RNA, 15 nt, Human
ugcauugaauauauu

SEQ ID NO: 3702924 - RNA, 17 nt, Human
ugcauugagaacugcau

SEQ ID NO: 3702925 - RNA, 15 nt, Human
ugcauugcuagauaa

SEQ ID NO: 3702926 - RNA, 18 nt, Human
ugcauugcuagauaaaag

SEQ ID NO: 3702927 - RNA, 19 nt, Human
ugcauugcuuuuuuuuccu

SEQ ID NO: 3702928 - RNA, 18 nt, Human
ugcauuggaagaccccac

SEQ ID NO: 3702929 - RNA, 18 nt, Human
ugcauugggauuuuagaa

SEQ ID NO: 3702930 - RNA, 17 nt, Human
ugcauugugauuggccu

SEQ ID NO: 3702931 - RNA, 19 nt, Human
ugcauuguuagcacuaggc

SEQ ID NO: 3702932 - RNA, 17 nt, Human
ugcauuuaaaacagaca

SEQ ID NO: 3702933 - RNA, 22 nt, Human
ugcauuuaaaacagacacuggc

SEQ ID NO: 3702934 - RNA, 20 nt, Human
ugcauuuaaaagauacaguu

SEQ ID NO: 3702935 - RNA, 16 nt, Human
ugcauuuaaauacagu

SEQ ID NO: 3702936 - RNA, 21 nt, Human
ugcauuuagggaguauucuaa

SEQ ID NO: 3702937 - RNA, 19 nt, Human
ugcauuucugaauagaaau

SEQ ID NO: 3702938 - RNA, 19 nt, Human
ugcauuugaaaauuuugau

SEQ ID NO: 3702939 - RNA, 13 nt, Human
ugcauuugagguc

SEQ ID NO: 3702940 - RNA, 18 nt, Human
ugcauuugaggucuguuc

SEQ ID NO: 3702941 - RNA, 19 nt, Human
ugcauuugaggucuguucu

SEQ ID NO: 3702942 - RNA, 20 nt, Human
ugcauuugaggucuguucuu

SEQ ID NO: 3702943 - RNA, 14 nt, Human
ugcauuugggucca

SEQ ID NO: 3702944 - RNA, 18 nt, Human
ugcauuuggguccaggag

SEQ ID NO: 3702945 - RNA, 21 nt, Human
ugcauuuggugguuucagaaa

SEQ ID NO: 3702946 - RNA, 23 nt, Human
ugcauuuggugguuucagaaaug

SEQ ID NO: 3702947 - RNA, 18 nt, Human
ugcauuugugcuagaaau

SEQ ID NO: 3702948 - RNA, 19 nt, Human
ugcauuuguuuauguaauu

SEQ ID NO: 3702949 - RNA, 14 nt, Human
ugcauuuuaccauc

SEQ ID NO: 3702950 - RNA, 16 nt, Human
ugcauuuucugaaacu

SEQ ID NO: 3702951 - RNA, 19 nt, Human
ugcauuuucugaaacuaau

SEQ ID NO: 3702952 - RNA, 23 nt, Human
ugcauuuucugaaacuaaugaaa

SEQ ID NO: 3702953 - RNA, 15 nt, Human
ugcauuuugcuauug

SEQ ID NO: 3702954 - RNA, 13 nt, Human
ugcauuuuucugc

SEQ ID NO: 3702955 - RNA, 17 nt, Human
ugcauuuuucugcagaa

SEQ ID NO: 3702956 - RNA, 14 nt, Human
ugcauuuuuguaaa
